United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 57

SEQ ID NO: 2034834 - RNA, 18 nt, Staphylococcus aureus subsp. aureus Mu50
cuaaaaauauugaauaau

SEQ ID NO: 2034835 - RNA, 19 nt, Staphylococcus aureus subsp. aureus Mu50
cuaaaaaugucguauaugu

SEQ ID NO: 2034836 - RNA, 18 nt, Staphylococcus aureus subsp. aureus Mu50
cuaaaacauguugauaaa

SEQ ID NO: 2034837 - RNA, 22 nt, Staphylococcus aureus subsp. aureus Mu50
cuaaaaauucuggauuaaaccc

SEQ ID NO: 2034838 - RNA, 11 nt, Staphylococcus aureus subsp. aureus Mu50
cuaaaacaaau

SEQ ID NO: 2034839 - RNA, 12 nt, Staphylococcus aureus subsp. aureus Mu50
cguuuauaucuu

SEQ ID NO: 2034840 - RNA, 11 nt, Staphylococcus aureus subsp. aureus Mu50
cguuuaauuua

SEQ ID NO: 2034841 - RNA, 16 nt, Staphylococcus aureus subsp. aureus Mu50
cguuuaauaccuauga

SEQ ID NO: 2034842 - RNA, 16 nt, Staphylococcus aureus subsp. aureus Mu50
cguuucagaaguuguu

SEQ ID NO: 2034843 - RNA, 13 nt, Staphylococcus aureus subsp. aureus Mu50
cgucuucucuauc

SEQ ID NO: 2034844 - RNA, 21 nt, Staphylococcus aureus subsp. aureus Mu50
cgucuauacuccaguuuauaa

SEQ ID NO: 2034845 - RNA, 14 nt, Staphylococcus aureus subsp. aureus Mu50
cguauaguacuaaa

SEQ ID NO: 2034846 - RNA, 23 nt, Staphylococcus aureus subsp. aureus Mu50
cguauaagggguauauuaaaaau

SEQ ID NO: 2034847 - RNA, 18 nt, Staphylococcus aureus subsp. aureus Mu50
cggugucaauauuguagg

SEQ ID NO: 2034848 - RNA, 16 nt, Staphylococcus aureus subsp. aureus Mu50
cgguuugaaaaugacg

SEQ ID NO: 2034849 - RNA, 21 nt, Staphylococcus aureus subsp. aureus Mu50
cguaauguguuaauacuucau

SEQ ID NO: 2034850 - RNA, 23 nt, Staphylococcus aureus subsp. aureus Mu50
cguaauuaauagguuauuugaua

SEQ ID NO: 2034851 - RNA, 15 nt, Staphylococcus aureus subsp. aureus Mu50
cguaauuauuauaau

SEQ ID NO: 2034852 - RNA, 14 nt, Staphylococcus aureus subsp. aureus Mu50
cuguauuuaauaaa

SEQ ID NO: 2034853 - RNA, 20 nt, Staphylococcus aureus subsp. aureus Mu50
cuguguuggggcccacaccc

SEQ ID NO: 2034854 - RNA, 19 nt, Staphylococcus aureus subsp. aureus Mu50
cuguguaauaccaauuguu

SEQ ID NO: 2034855 - RNA, 16 nt, Staphylococcus aureus subsp. aureus Mu50
cuguguacguuucaau

SEQ ID NO: 2034856 - RNA, 21 nt, Staphylococcus aureus subsp. aureus Mu50
cuucaauucuuacaccugcaa

SEQ ID NO: 2034857 - RNA, 19 nt, Staphylococcus aureus subsp. aureus Mu50
cuucaauauucuuaucauu

SEQ ID NO: 2034858 - RNA, 17 nt, Staphylococcus aureus subsp. aureus Mu50
cuucaauauuuaaauuu

SEQ ID NO: 2034859 - RNA, 13 nt, Staphylococcus aureus subsp. aureus Mu50
cuucaacuaaugu

SEQ ID NO: 2034860 - RNA, 14 nt, Staphylococcus aureus subsp. aureus Mu50
cuucaacgucaucu

SEQ ID NO: 2034861 - RNA, 15 nt, Staphylococcus aureus subsp. aureus Mu50
cuucaacauaacuca

SEQ ID NO: 2034862 - RNA, 23 nt, Staphylococcus aureus subsp. aureus Mu50
cuucaacauaacucaaauaucua

SEQ ID NO: 2034863 - RNA, 15 nt, Staphylococcus aureus subsp. aureus Mu50
cuuauuugaaaugau

SEQ ID NO: 2034864 - RNA, 22 nt, Staphylococcus aureus subsp. aureus Mu50
cuuauuugaaugcaaaucaaau

SEQ ID NO: 2034865 - RNA, 16 nt, Staphylococcus aureus subsp. aureus Mu50
cuucaaaguagacauu

SEQ ID NO: 2034866 - RNA, 21 nt, Staphylococcus aureus subsp. aureus Mu50
cuuaucuuuaugauaauuaau

SEQ ID NO: 2034867 - RNA, 12 nt, Staphylococcus aureus subsp. aureus Mu50
cuuauugaaaag

SEQ ID NO: 2034868 - RNA, 13 nt, Staphylococcus aureus subsp. aureus Mu50
cuuauuaauuguu

SEQ ID NO: 2034869 - RNA, 20 nt, Staphylococcus aureus subsp. aureus Mu50
cuuauuauagggcuguuuuu

SEQ ID NO: 2034870 - RNA, 13 nt, Staphylococcus aureus subsp. aureus Mu50
cuuauuauuaauu

SEQ ID NO: 2034871 - RNA, 13 nt, Staphylococcus aureus subsp. aureus Mu50
cuuauucaaauua

SEQ ID NO: 2034872 - RNA, 16 nt, Staphylococcus aureus subsp. aureus Mu50
cuuauucgaacgauau

SEQ ID NO: 2034873 - RNA, 20 nt, Staphylococcus aureus subsp. aureus Mu50
cuuacuuuucuaaacaacuu

SEQ ID NO: 2034874 - RNA, 21 nt, Staphylococcus aureus subsp. aureus Mu50
cuuagacgcuguuuuaaauug

SEQ ID NO: 2034875 - RNA, 14 nt, Staphylococcus aureus subsp. aureus Mu50
cuuacuacuuaauu

SEQ ID NO: 2034876 - RNA, 18 nt, Staphylococcus aureus subsp. aureus Mu50
cuuacugaaacuaaauua

SEQ ID NO: 2034877 - RNA, 20 nt, Staphylococcus aureus subsp. aureus Mu50
cuguuuaugagcuuaauaaa

SEQ ID NO: 2034878 - RNA, 17 nt, Staphylococcus aureus subsp. aureus Mu50
cuguuucacguaaugaa

SEQ ID NO: 2034879 - RNA, 19 nt, Staphylococcus aureus subsp. aureus Mu50
cuguuuaauuaaaauacaa

SEQ ID NO: 2034880 - RNA, 18 nt, Staphylococcus aureus subsp. aureus Mu50
cuuaacgagugcuuucac

SEQ ID NO: 2034881 - RNA, 16 nt, Staphylococcus aureus subsp. aureus Mu50
cuguuggcaaaacaau

SEQ ID NO: 2034882 - RNA, 13 nt, Staphylococcus aureus subsp. aureus Mu50
cuuacauugauaa

SEQ ID NO: 2034883 - RNA, 13 nt, Staphylococcus aureus subsp. aureus Mu50
cuuacccaaaaaa

SEQ ID NO: 2034884 - RNA, 21 nt, Staphylococcus aureus subsp. aureus Mu50
cuuaauaaccauguaaaauua

SEQ ID NO: 2034885 - RNA, 15 nt, Staphylococcus aureus subsp. aureus Mu50
cuuaauaagcugaaa

SEQ ID NO: 2034886 - RNA, 18 nt, Staphylococcus aureus subsp. aureus Mu50
cuuaauagagguauaauu

SEQ ID NO: 2034887 - RNA, 18 nt, Staphylococcus aureus subsp. aureus Mu50
cuuaauauauucggcaaa

SEQ ID NO: 2034888 - RNA, 17 nt, Staphylococcus aureus subsp. aureus Mu50
cuuaaguacauaaaugc

SEQ ID NO: 2034889 - RNA, 14 nt, Staphylococcus aureus subsp. aureus Mu50
cuuaacuuguguua

SEQ ID NO: 2034890 - RNA, 15 nt, Staphylococcus aureus subsp. aureus Mu50
cuuaacucaaagaaa

SEQ ID NO: 2034891 - RNA, 14 nt, Staphylococcus aureus subsp. aureus Mu50
cuuaagucaucaau

SEQ ID NO: 2034892 - RNA, 14 nt, Staphylococcus aureus subsp. aureus Mu50
cuuaauuuaaauug

SEQ ID NO: 2034893 - RNA, 23 nt, Staphylococcus aureus subsp. aureus Mu50
cuuaauuuugcaacauuaaauua

SEQ ID NO: 2034894 - RNA, 18 nt, Staphylococcus aureus subsp. aureus Mu50
cuuaauauugauuaaucu

SEQ ID NO: 2034895 - RNA, 13 nt, Staphylococcus aureus subsp. aureus Mu50
cuuaauuaauaau

SEQ ID NO: 2034896 - RNA, 14 nt, Staphylococcus aureus subsp. aureus Mu50
cuucgaagucauau

SEQ ID NO: 2034897 - RNA, 18 nt, Staphylococcus aureus subsp. aureus Mu50
cuuccuuuuuauuuuuug

SEQ ID NO: 2034898 - RNA, 14 nt, Staphylococcus aureus subsp. aureus Mu50
cuucauugaugaug

SEQ ID NO: 2034899 - RNA, 17 nt, Staphylococcus aureus subsp. aureus Mu50
cuuccaauaauaaauca

SEQ ID NO: 2034900 - RNA, 19 nt, Staphylococcus aureus subsp. aureus Mu50
cuucauguucuaaugauau

SEQ ID NO: 2034901 - RNA, 21 nt, Staphylococcus aureus subsp. aureus Mu50
cuucauguucuaaugauauuu

SEQ ID NO: 2034902 - RNA, 14 nt, Staphylococcus aureus subsp. aureus Mu50
cuucacauuuaucc

SEQ ID NO: 2034903 - RNA, 16 nt, Staphylococcus aureus subsp. aureus Mu50
cuucaauugucucaau

SEQ ID NO: 2034904 - RNA, 23 nt, Staphylococcus aureus subsp. aureus Mu50
cuucuuaucaacaacaaguucuu

SEQ ID NO: 2034905 - RNA, 21 nt, Staphylococcus aureus subsp. aureus Mu50
cuucuuaaaauaugauuuaaa

SEQ ID NO: 2034906 - RNA, 22 nt, Staphylococcus aureus subsp. aureus Mu50
cuucuuaaaucaacaucaucuu

SEQ ID NO: 2034907 - RNA, 19 nt, Staphylococcus aureus subsp. aureus Mu50
cuucuguacguuuuaaaua

SEQ ID NO: 2034908 - RNA, 19 nt, Staphylococcus aureus subsp. aureus Mu50
cuucuuuguuuuuaauuuu

SEQ ID NO: 2034909 - RNA, 14 nt, Staphylococcus aureus subsp. aureus Mu50
cuucuuuuaaguua

SEQ ID NO: 2034910 - RNA, 18 nt, Staphylococcus aureus subsp. aureus Mu50
cuucuuuuucuugcauac

SEQ ID NO: 2034911 - RNA, 23 nt, Staphylococcus aureus subsp. aureus Mu50
cuucuuuuugcguuuuuaaauaa

SEQ ID NO: 2034912 - RNA, 15 nt, Staphylococcus aureus subsp. aureus Mu50
cuugaaauuauuauu

SEQ ID NO: 2034913 - RNA, 23 nt, Staphylococcus aureus subsp. aureus Mu50
cuucuauagcaccauuauuaaau

SEQ ID NO: 2034914 - RNA, 12 nt, Staphylococcus aureus subsp. aureus Mu50
cuucucaucauu

SEQ ID NO: 2034915 - RNA, 18 nt, Staphylococcus aureus subsp. aureus Mu50
cuucuauuaaacauuuuu

SEQ ID NO: 2034916 - RNA, 20 nt, Staphylococcus aureus subsp. aureus Mu50
cuucuauuuuauaauaaauu

SEQ ID NO: 2034917 - RNA, 12 nt, Staphylococcus aureus subsp. aureus Mu50
cuucucauugaa

SEQ ID NO: 2034918 - RNA, 23 nt, Staphylococcus aureus subsp. aureus Mu50
cuucucacaacugcauauaaagu

SEQ ID NO: 2034919 - RNA, 16 nt, Staphylococcus aureus subsp. aureus Mu50
cuucuccuucaauguu

SEQ ID NO: 2034920 - RNA, 15 nt, Staphylococcus aureus subsp. aureus Mu50
cuucucccuuaaaua

SEQ ID NO: 2034921 - RNA, 22 nt, Staphylococcus aureus subsp. aureus Mu50
gaaaaacuucuuaacuugaaau

SEQ ID NO: 2034922 - RNA, 20 nt, Staphylococcus aureus subsp. aureus Mu50
gaaaaacuuuucauggaguc

SEQ ID NO: 2034923 - RNA, 17 nt, Staphylococcus aureus subsp. aureus Mu50
cuuuguuuaucaauuuc

SEQ ID NO: 2034924 - RNA, 18 nt, Staphylococcus aureus subsp. aureus Mu50
cuuuuaaaaaacauaccu

SEQ ID NO: 2034925 - RNA, 15 nt, Staphylococcus aureus subsp. aureus Mu50
cuuugucuuuaauga

SEQ ID NO: 2034926 - RNA, 21 nt, Staphylococcus aureus subsp. aureus Mu50
gaaaauaaaacaaauuauuaa

SEQ ID NO: 2034927 - RNA, 15 nt, Staphylococcus aureus subsp. aureus Mu50
gaaaauaagauuauu

SEQ ID NO: 2034928 - RNA, 19 nt, Staphylococcus aureus subsp. aureus Mu50
gaaaauaccucuacauuau

SEQ ID NO: 2034929 - RNA, 20 nt, Staphylococcus aureus subsp. aureus Mu50
gaaaauaaucgaacagaaaa

SEQ ID NO: 2034930 - RNA, 17 nt, Staphylococcus aureus subsp. aureus Mu50
gaaaaucauucauuugc

SEQ ID NO: 2034931 - RNA, 13 nt, Staphylococcus aureus subsp. aureus Mu50
cuuucacauacca

SEQ ID NO: 2034932 - RNA, 19 nt, Staphylococcus aureus subsp. aureus Mu50
cuuucaccauuuacuucau

SEQ ID NO: 2034933 - RNA, 18 nt, Staphylococcus aureus subsp. aureus Mu50
cuuguaauccuuguucua

SEQ ID NO: 2034934 - RNA, 20 nt, Staphylococcus aureus subsp. aureus Mu50
cuuguaucaacauuaauaaa

SEQ ID NO: 2034935 - RNA, 21 nt, Staphylococcus aureus subsp. aureus Mu50
cuuucauuguuaaacauugaa

SEQ ID NO: 2034936 - RNA, 18 nt, Staphylococcus aureus subsp. aureus Mu50
cuuucgagguaauuucac

SEQ ID NO: 2034937 - RNA, 21 nt, Staphylococcus aureus subsp. aureus Mu50
cuuuccauuguugauaaaugg

SEQ ID NO: 2034938 - RNA, 21 nt, Staphylococcus aureus subsp. aureus Mu50
cuuugcagauugauauaaauu

SEQ ID NO: 2034939 - RNA, 15 nt, Staphylococcus aureus subsp. aureus Mu50
cuuugauguuuucua

SEQ ID NO: 2034940 - RNA, 21 nt, Staphylococcus aureus subsp. aureus Mu50
cuuugaauugguugaucaauu

SEQ ID NO: 2034941 - RNA, 20 nt, Staphylococcus aureus subsp. aureus Mu50
cuuucuuagugaaucuucua

SEQ ID NO: 2034942 - RNA, 20 nt, Staphylococcus aureus subsp. aureus Mu50
cuuugaagggagcauuucac

SEQ ID NO: 2034943 - RNA, 20 nt, Staphylococcus aureus subsp. aureus Mu50
cuuugaagggagcauuucau

SEQ ID NO: 2034944 - RNA, 14 nt, Staphylococcus aureus subsp. aureus Mu50
cuuucucuauuaau

SEQ ID NO: 2034945 - RNA, 17 nt, Staphylococcus aureus subsp. aureus Mu50
cuuucucuauuaauuua

SEQ ID NO: 2034946 - RNA, 21 nt, Staphylococcus aureus subsp. aureus Mu50
cuuucugaucgacuaauuuuu

SEQ ID NO: 2034947 - RNA, 18 nt, Staphylococcus aureus subsp. aureus Mu50
cuugcaaauauaucaucu

SEQ ID NO: 2034948 - RNA, 16 nt, Staphylococcus aureus subsp. aureus Mu50
cuugcaagccaucaau

SEQ ID NO: 2034949 - RNA, 17 nt, Staphylococcus aureus subsp. aureus Mu50
cuugauuuuauaaauca

SEQ ID NO: 2034950 - RNA, 14 nt, Staphylococcus aureus subsp. aureus Mu50
cuugaucuaaauga

SEQ ID NO: 2034951 - RNA, 12 nt, Staphylococcus aureus subsp. aureus Mu50
cuugauauucau

SEQ ID NO: 2034952 - RNA, 17 nt, Staphylococcus aureus subsp. aureus Mu50
cuugauggauauucaau

SEQ ID NO: 2034953 - RNA, 13 nt, Staphylococcus aureus subsp. aureus Mu50
cuugauuaucauu

SEQ ID NO: 2034954 - RNA, 21 nt, Staphylococcus aureus subsp. aureus Mu50
cuugauucauuucgauuaauu

SEQ ID NO: 2034955 - RNA, 15 nt, Staphylococcus aureus subsp. aureus Mu50
cuugauuuaacaacc

SEQ ID NO: 2034956 - RNA, 14 nt, Staphylococcus aureus subsp. aureus Mu50
cuugauuuaauuuu

SEQ ID NO: 2034957 - RNA, 22 nt, Staphylococcus aureus subsp. aureus Mu50
cuugauaaaauaaauaagcaau

SEQ ID NO: 2034958 - RNA, 17 nt, Staphylococcus aureus subsp. aureus Mu50
cuugagcaucacucaac

SEQ ID NO: 2034959 - RNA, 13 nt, Staphylococcus aureus subsp. aureus Mu50
cuugaacuaaaac

SEQ ID NO: 2034960 - RNA, 16 nt, Staphylococcus aureus subsp. aureus Mu50
cuugaccuucaguuuc

SEQ ID NO: 2034961 - RNA, 21 nt, Staphylococcus aureus subsp. aureus Mu50
cuugcuuugcauacauaucuu

SEQ ID NO: 2034962 - RNA, 20 nt, Staphylococcus aureus subsp. aureus Mu50
cuuggaaaauacuauacuga

SEQ ID NO: 2034963 - RNA, 21 nt, Staphylococcus aureus subsp. aureus Mu50
cuuguaaaucacgauuuucaa

SEQ ID NO: 2034964 - RNA, 17 nt, Staphylococcus aureus subsp. aureus Mu50
cuuguaacaagcauuuu

SEQ ID NO: 2034965 - RNA, 17 nt, Staphylococcus aureus subsp. aureus Mu50
cuuguaacaagcuuuuu

SEQ ID NO: 2034966 - RNA, 16 nt, Staphylococcus aureus subsp. aureus Mu50
cuuggcguauuuuuug

SEQ ID NO: 2034967 - RNA, 14 nt, Staphylococcus aureus subsp. aureus Mu50
cugcuaauuuuuuc

SEQ ID NO: 2034968 - RNA, 15 nt, Staphylococcus aureus subsp. aureus Mu50
cugcuaaaauaaaau

SEQ ID NO: 2034969 - RNA, 22 nt, Staphylococcus aureus subsp. aureus Mu50
cugcaccuaaggcuaaugauaa

SEQ ID NO: 2034970 - RNA, 17 nt, Staphylococcus aureus subsp. aureus Mu50
cugcaccuccaaccgcu

SEQ ID NO: 2034971 - RNA, 23 nt, Staphylococcus aureus subsp. aureus Mu50
cugcugcuuucauagaaccauuu

SEQ ID NO: 2034972 - RNA, 13 nt, Staphylococcus aureus subsp. aureus Mu50
cuggaauaaaucg

SEQ ID NO: 2034973 - RNA, 21 nt, Staphylococcus aureus subsp. aureus Mu50
cuggaaucgaaaauaucaauu

SEQ ID NO: 2034974 - RNA, 21 nt, Staphylococcus aureus subsp. aureus Mu50
cuggauuuuucuuauaaaaau

SEQ ID NO: 2034975 - RNA, 23 nt, Staphylococcus aureus subsp. aureus Mu50
cuggcaaauugccuuucauuuua

SEQ ID NO: 2034976 - RNA, 20 nt, Staphylococcus aureus subsp. aureus Mu50
gaauugauggaaaaguuuuu

SEQ ID NO: 2034977 - RNA, 14 nt, Staphylococcus aureus subsp. aureus Mu50
gaauucuaaaagaa

SEQ ID NO: 2034978 - RNA, 12 nt, Staphylococcus aureus subsp. aureus Mu50
gaauugaaaaau

SEQ ID NO: 2034979 - RNA, 17 nt, Staphylococcus aureus subsp. aureus Mu50
gaauugaaaaauuaaaa

SEQ ID NO: 2034980 - RNA, 18 nt, Staphylococcus aureus subsp. aureus Mu50
gaaugugaacaucuaguu

SEQ ID NO: 2034981 - RNA, 14 nt, Staphylococcus aureus subsp. aureus Mu50
gaauagauugauug

SEQ ID NO: 2034982 - RNA, 15 nt, Staphylococcus aureus subsp. aureus Mu50
gaauauaauaacaau

SEQ ID NO: 2034983 - RNA, 20 nt, Staphylococcus aureus subsp. aureus Mu50
gaauauaauaacaaucaaag

SEQ ID NO: 2034984 - RNA, 15 nt, Staphylococcus aureus subsp. aureus Mu50
gaauauucagauuuu

SEQ ID NO: 2034985 - RNA, 16 nt, Staphylococcus aureus subsp. aureus Mu50
gaauaugauauugauu

SEQ ID NO: 2034986 - RNA, 16 nt, Staphylococcus aureus subsp. aureus Mu50
gaauauuguauugauc

SEQ ID NO: 2034987 - RNA, 18 nt, Staphylococcus aureus subsp. aureus Mu50
gaaugauacgccuaaaua

SEQ ID NO: 2034988 - RNA, 21 nt, Staphylococcus aureus subsp. aureus Mu50
gaaguacuuaccuuucaaaua

SEQ ID NO: 2034989 - RNA, 14 nt, Staphylococcus aureus subsp. aureus Mu50
gacaucuacaacgc

SEQ ID NO: 2034990 - RNA, 18 nt, Staphylococcus aureus subsp. aureus Mu50
gacauagcguauugauuc

SEQ ID NO: 2034991 - RNA, 19 nt, Staphylococcus aureus subsp. aureus Mu50
gaauugucuuaauaugcaa

SEQ ID NO: 2034992 - RNA, 19 nt, Staphylococcus aureus subsp. aureus Mu50
gaagcaucuccaauuuaau

SEQ ID NO: 2034993 - RNA, 22 nt, Staphylococcus aureus subsp. aureus Mu50
gaaaccguuuagaaagaauaca

SEQ ID NO: 2034994 - RNA, 15 nt, Staphylococcus aureus subsp. aureus Mu50
gaagaauaaaaaagu

SEQ ID NO: 2034995 - RNA, 14 nt, Staphylococcus aureus subsp. aureus Mu50
gaacuaacauaauu

SEQ ID NO: 2034996 - RNA, 16 nt, Staphylococcus aureus subsp. aureus Mu50
gaacuaagaugugcau

SEQ ID NO: 2034997 - RNA, 14 nt, Staphylococcus aureus subsp. aureus Mu50
gacccaaauuauau

SEQ ID NO: 2034998 - RNA, 15 nt, Staphylococcus aureus subsp. aureus Mu50
gcacgagcaacaucu

SEQ ID NO: 2034999 - RNA, 14 nt, Staphylococcus aureus subsp. aureus Mu50
gcacgagaaauguc

SEQ ID NO: 2035000 - RNA, 17 nt, Staphylococcus aureus subsp. aureus Mu50
gcaauaggaugaaacuu

SEQ ID NO: 2035001 - RNA, 21 nt, Staphylococcus aureus subsp. aureus Mu50
gcaauauacuuuuuaaaugau

SEQ ID NO: 2035002 - RNA, 15 nt, Staphylococcus aureus subsp. aureus Mu50
gcaauacgcaauguu

SEQ ID NO: 2035003 - RNA, 20 nt, Staphylococcus aureus subsp. aureus Mu50
gcagugaucuuuuuuauauu

SEQ ID NO: 2035004 - RNA, 22 nt, Staphylococcus aureus subsp. aureus Mu50
gcauaugauaguguauguuuuu

SEQ ID NO: 2035005 - RNA, 16 nt, Staphylococcus aureus subsp. aureus Mu50
gcauauucuauuguug

SEQ ID NO: 2035006 - RNA, 14 nt, Staphylococcus aureus subsp. aureus Mu50
gaugugaauguuuu

SEQ ID NO: 2035007 - RNA, 23 nt, Staphylococcus aureus subsp. aureus Mu50
gauguuuucguuugcaaucaucu

SEQ ID NO: 2035008 - RNA, 18 nt, Staphylococcus aureus subsp. aureus Mu50
gauuaaaauaugacacau

SEQ ID NO: 2035009 - RNA, 22 nt, Staphylococcus aureus subsp. aureus Mu50
gauuaauuucauguucauaaua

SEQ ID NO: 2035010 - RNA, 12 nt, Staphylococcus aureus subsp. aureus Mu50
gauuaaaugaug

SEQ ID NO: 2035011 - RNA, 18 nt, Staphylococcus aureus subsp. aureus Mu50
gauucacucuguaauaaa

SEQ ID NO: 2035012 - RNA, 15 nt, Staphylococcus aureus subsp. aureus Mu50
gauucauauuuauau

SEQ ID NO: 2035013 - RNA, 15 nt, Staphylococcus aureus subsp. aureus Mu50
gauucauauuuaucg

SEQ ID NO: 2035014 - RNA, 21 nt, Staphylococcus aureus subsp. aureus Mu50
gauucaugaauaauuagauuu

SEQ ID NO: 2035015 - RNA, 19 nt, Staphylococcus aureus subsp. aureus Mu50
gauucauuucgauuaauuu

SEQ ID NO: 2035016 - RNA, 14 nt, Staphylococcus aureus subsp. aureus Mu50
gauuuugaauuuua

SEQ ID NO: 2035017 - RNA, 20 nt, Staphylococcus aureus subsp. aureus Mu50
gauuuuguuucaaacgugau

SEQ ID NO: 2035018 - RNA, 16 nt, Staphylococcus aureus subsp. aureus Mu50
gauuuuaaaagauaaa

SEQ ID NO: 2035019 - RNA, 20 nt, Staphylococcus aureus subsp. aureus Mu50
gauuuuaaaagauaaauaaa

SEQ ID NO: 2035020 - RNA, 18 nt, Staphylococcus aureus subsp. aureus Mu50
gauuuguagcuugaauaa

SEQ ID NO: 2035021 - RNA, 19 nt, Staphylococcus aureus subsp. aureus Mu50
gauuggcagugaucuuuuu

SEQ ID NO: 2035022 - RNA, 13 nt, Staphylococcus aureus subsp. aureus Mu50
gcaaaacuaauca

SEQ ID NO: 2035023 - RNA, 15 nt, Staphylococcus aureus subsp. aureus Mu50
gauuuuuugguuucu

SEQ ID NO: 2035024 - RNA, 17 nt, Staphylococcus aureus subsp. aureus Mu50
gauuuuuguaauugaug

SEQ ID NO: 2035025 - RNA, 18 nt, Staphylococcus aureus subsp. aureus Mu50
gcaaaaauaauaugaauu

SEQ ID NO: 2035026 - RNA, 22 nt, Staphylococcus aureus subsp. aureus Mu50
gauggcguaagcaguuaauaag

SEQ ID NO: 2035027 - RNA, 22 nt, Staphylococcus aureus subsp. aureus Mu50
gaugaaagacugacuaauaaaa

SEQ ID NO: 2035028 - RNA, 21 nt, Staphylococcus aureus subsp. aureus Mu50
gaugaaaacuuaaaaaugaaa

SEQ ID NO: 2035029 - RNA, 17 nt, Staphylococcus aureus subsp. aureus Mu50
gaugauaaaaauaaaac

SEQ ID NO: 2035030 - RNA, 13 nt, Staphylococcus aureus subsp. aureus Mu50
gaugagaaauguu

SEQ ID NO: 2035031 - RNA, 22 nt, Staphylococcus aureus subsp. aureus Mu50
gaugacuuugucuuuaaugaaa

SEQ ID NO: 2035032 - RNA, 21 nt, Staphylococcus aureus subsp. aureus Mu50
gaugagaaauguuaacgauag

SEQ ID NO: 2035033 - RNA, 21 nt, Staphylococcus aureus subsp. aureus Mu50
gagcguauuauuauugaaauc

SEQ ID NO: 2035034 - RNA, 17 nt, Staphylococcus aureus subsp. aureus Mu50
gaucaaaaauguuaucu

SEQ ID NO: 2035035 - RNA, 12 nt, Staphylococcus aureus subsp. aureus Mu50
gaucaaaaucau

SEQ ID NO: 2035036 - RNA, 22 nt, Staphylococcus aureus subsp. aureus Mu50
gauauuuuaaaaaguaauuaau

SEQ ID NO: 2035037 - RNA, 22 nt, Staphylococcus aureus subsp. aureus Mu50
gauauuuucuucucaacaaauc

SEQ ID NO: 2035038 - RNA, 14 nt, Staphylococcus aureus subsp. aureus Mu50
gaucaagugcagau

SEQ ID NO: 2035039 - RNA, 11 nt, Staphylococcus aureus subsp. aureus Mu50
gauauuuagaa

SEQ ID NO: 2035040 - RNA, 12 nt, Staphylococcus aureus subsp. aureus Mu50
gauaauuauuag

SEQ ID NO: 2035041 - RNA, 18 nt, Staphylococcus aureus subsp. aureus Mu50
gauacaaacccauauaaa

SEQ ID NO: 2035042 - RNA, 17 nt, Staphylococcus aureus subsp. aureus Mu50
gauacaaaccuaacacu

SEQ ID NO: 2035043 - RNA, 20 nt, Staphylococcus aureus subsp. aureus Mu50
gauaguacauuuauuuucaa

SEQ ID NO: 2035044 - RNA, 16 nt, Staphylococcus aureus subsp. aureus Mu50
gauagucauaacgauu

SEQ ID NO: 2035045 - RNA, 19 nt, Staphylococcus aureus subsp. aureus Mu50
gauaauuaaaauaagauau

SEQ ID NO: 2035046 - RNA, 22 nt, Staphylococcus aureus subsp. aureus Mu50
gauaaccauuaugauuaauccu

SEQ ID NO: 2035047 - RNA, 22 nt, Staphylococcus aureus subsp. aureus Mu50
gaggauuguguaaugagauuau

SEQ ID NO: 2035048 - RNA, 17 nt, Staphylococcus aureus subsp. aureus Mu50
cggaccuuguaaauuua

SEQ ID NO: 2035049 - RNA, 18 nt, Staphylococcus aureus subsp. aureus Mu50
cggcauuuuuauauugau

SEQ ID NO: 2035050 - RNA, 23 nt, Staphylococcus aureus subsp. aureus Mu50
ccguuaaaauauaugaauaaguc

SEQ ID NO: 2035051 - RNA, 15 nt, Staphylococcus aureus subsp. aureus Mu50
ccucauaauuaucau

SEQ ID NO: 2035052 - RNA, 16 nt, Staphylococcus aureus subsp. aureus Mu50
ccuacaguguuauaau

SEQ ID NO: 2035053 - RNA, 17 nt, Staphylococcus aureus subsp. aureus Mu50
ccuagacgaucuuuaau

SEQ ID NO: 2035054 - RNA, 10 nt, Staphylococcus aureus subsp. aureus Mu50
ccuacuacau

SEQ ID NO: 2035055 - RNA, 16 nt, Staphylococcus aureus subsp. aureus Mu50
ccuacuuuuuuggcaa

SEQ ID NO: 2035056 - RNA, 13 nt, Staphylococcus aureus subsp. aureus Mu50
ccugauuuaaugu

SEQ ID NO: 2035057 - RNA, 23 nt, Staphylococcus aureus subsp. aureus Mu50
ccugaugaauagauaaucgccau

SEQ ID NO: 2035058 - RNA, 19 nt, Staphylococcus aureus subsp. aureus Mu50
ccucuuagcacuuggauuu

SEQ ID NO: 2035059 - RNA, 17 nt, Staphylococcus aureus subsp. aureus Mu50
ccugaaaagaauaaguu

SEQ ID NO: 2035060 - RNA, 20 nt, Staphylococcus aureus subsp. aureus Mu50
ccucuugauaaaauaaauaa

SEQ ID NO: 2035061 - RNA, 15 nt, Staphylococcus aureus subsp. aureus Mu50
ccgauaucauauaau

SEQ ID NO: 2035062 - RNA, 13 nt, Staphylococcus aureus subsp. aureus Mu50
ccgaucaugccuu

SEQ ID NO: 2035063 - RNA, 16 nt, Staphylococcus aureus subsp. aureus Mu50
ccgaugaauggauuuu

SEQ ID NO: 2035064 - RNA, 17 nt, Staphylococcus aureus subsp. aureus Mu50
ccgacuugauaaaaaau

SEQ ID NO: 2035065 - RNA, 17 nt, Staphylococcus aureus subsp. aureus Mu50
ccgccuaauaauaaaau

SEQ ID NO: 2035066 - RNA, 13 nt, Staphylococcus aureus subsp. aureus Mu50
cgaagaauccuau

SEQ ID NO: 2035067 - RNA, 13 nt, Staphylococcus aureus subsp. aureus Mu50
cgaagaaugauac

SEQ ID NO: 2035068 - RNA, 15 nt, Staphylococcus aureus subsp. aureus Mu50
cgaacuaucaauaua

SEQ ID NO: 2035069 - RNA, 23 nt, Staphylococcus aureus subsp. aureus Mu50
cgaacaaucggaagcauauuucu

SEQ ID NO: 2035070 - RNA, 19 nt, Staphylococcus aureus subsp. aureus Mu50
cgaaauucucuuuguuggg

SEQ ID NO: 2035071 - RNA, 20 nt, Staphylococcus aureus subsp. aureus Mu50
cgaaauuacuguuaggauaa

SEQ ID NO: 2035072 - RNA, 14 nt, Staphylococcus aureus subsp. aureus Mu50
cgacaagaauuaau

SEQ ID NO: 2035073 - RNA, 13 nt, Staphylococcus aureus subsp. aureus Mu50
cgacaauuauaau

SEQ ID NO: 2035074 - RNA, 15 nt, Staphylococcus aureus subsp. aureus Mu50
ccuucaguuucuacu

SEQ ID NO: 2035075 - RNA, 20 nt, Staphylococcus aureus subsp. aureus Mu50
ccuucaguuucuacuguaua

SEQ ID NO: 2035076 - RNA, 17 nt, Staphylococcus aureus subsp. aureus Mu50
ccuuucaaauauaucua

SEQ ID NO: 2035077 - RNA, 20 nt, Staphylococcus aureus subsp. aureus Mu50
ccuuucuaagauguguugaa

SEQ ID NO: 2035078 - RNA, 16 nt, Staphylococcus aureus subsp. aureus Mu50
ccuuucgauaaacuac

SEQ ID NO: 2035079 - RNA, 17 nt, Staphylococcus aureus subsp. aureus Mu50
ccuuuauauuuaguuag

SEQ ID NO: 2035080 - RNA, 15 nt, Staphylococcus aureus subsp. aureus Mu50
ccuuuaauaucuaau

SEQ ID NO: 2035081 - RNA, 15 nt, Staphylococcus aureus subsp. aureus Mu50
ccuuuaccaguauca

SEQ ID NO: 2035082 - RNA, 19 nt, Staphylococcus aureus subsp. aureus Mu50
ccuuguuggcuuuuuuaau

SEQ ID NO: 2035083 - RNA, 24 nt, Staphylococcus aureus subsp. aureus Mu50
cgaaaauuucaggcguuaauacau

SEQ ID NO: 2035084 - RNA, 19 nt, Staphylococcus aureus subsp. aureus Mu50
cgaaaauagcuauuaaaau

SEQ ID NO: 2035085 - RNA, 23 nt, Staphylococcus aureus subsp. aureus Mu50
cgaaagguauaucuucauuuaaa

SEQ ID NO: 2035086 - RNA, 14 nt, Staphylococcus aureus subsp. aureus Mu50
cgacuaauuuuucu

SEQ ID NO: 2035087 - RNA, 15 nt, Staphylococcus aureus subsp. aureus Mu50
cgacuucgauaucaa

SEQ ID NO: 2035088 - RNA, 14 nt, Staphylococcus aureus subsp. aureus Mu50
cgagacaucaucua

SEQ ID NO: 2035089 - RNA, 19 nt, Staphylococcus aureus subsp. aureus Mu50
cgaccuuuauaugaagcgu

SEQ ID NO: 2035090 - RNA, 13 nt, Staphylococcus aureus subsp. aureus Mu50
cgauugaugcguu

SEQ ID NO: 2035091 - RNA, 14 nt, Staphylococcus aureus subsp. aureus Mu50
cgauuauucuuaau

SEQ ID NO: 2035092 - RNA, 17 nt, Staphylococcus aureus subsp. aureus Mu50
cgauucaauuuaacguu

SEQ ID NO: 2035093 - RNA, 13 nt, Staphylococcus aureus subsp. aureus Mu50
cgaguuauaucuu

SEQ ID NO: 2035094 - RNA, 21 nt, Staphylococcus aureus subsp. aureus Mu50
cgauagacauugagauaucuu

SEQ ID NO: 2035095 - RNA, 15 nt, Staphylococcus aureus subsp. aureus Mu50
cgauacugcuuugga

SEQ ID NO: 2035096 - RNA, 19 nt, Staphylococcus aureus subsp. aureus Mu50
cgauaucuaagucgauaag

SEQ ID NO: 2035097 - RNA, 12 nt, Staphylococcus aureus subsp. aureus Mu50
cgauauucuaca

SEQ ID NO: 2035098 - RNA, 14 nt, Staphylococcus aureus subsp. aureus Mu50
cgauauuuguuugu

SEQ ID NO: 2035099 - RNA, 20 nt, Staphylococcus aureus subsp. aureus Mu50
cgauauuuuaaaaaguaauu

SEQ ID NO: 2035100 - RNA, 17 nt, Staphylococcus aureus subsp. aureus Mu50
cgauauuucuaguugca

SEQ ID NO: 2035101 - RNA, 14 nt, Staphylococcus aureus subsp. aureus Mu50
cgauacauaaaaca

SEQ ID NO: 2035102 - RNA, 17 nt, Staphylococcus aureus subsp. aureus Mu50
cgcacuucuauauuaau

SEQ ID NO: 2035103 - RNA, 18 nt, Staphylococcus aureus subsp. aureus Mu50
cagcauuugcuguuaaua

SEQ ID NO: 2035104 - RNA, 19 nt, Staphylococcus aureus subsp. aureus Mu50
cagauguucaguuguuuuu

SEQ ID NO: 2035105 - RNA, 17 nt, Staphylococcus aureus subsp. aureus Mu50
cacgacgcuaaacaaag

SEQ ID NO: 2035106 - RNA, 14 nt, Staphylococcus aureus subsp. aureus Mu50
cacgauaauugaua

SEQ ID NO: 2035107 - RNA, 14 nt, Staphylococcus aureus subsp. aureus Mu50
cacgcauuacuuua

SEQ ID NO: 2035108 - RNA, 19 nt, Staphylococcus aureus subsp. aureus Mu50
cacgcauaccacuugaaua

SEQ ID NO: 2035109 - RNA, 13 nt, Staphylococcus aureus subsp. aureus Mu50
caccugcaauaua

SEQ ID NO: 2035110 - RNA, 13 nt, Staphylococcus aureus subsp. aureus Mu50
caccuuugaauau

SEQ ID NO: 2035111 - RNA, 17 nt, Staphylococcus aureus subsp. aureus Mu50
caccuuguuuaaguuuu

SEQ ID NO: 2035112 - RNA, 14 nt, Staphylococcus aureus subsp. aureus Mu50
caccuucaauaucu

SEQ ID NO: 2035113 - RNA, 22 nt, Staphylococcus aureus subsp. aureus Mu50
cacgaaauggugaacuaaauug

SEQ ID NO: 2035114 - RNA, 14 nt, Staphylococcus aureus subsp. aureus Mu50
cacgaacaacauua

SEQ ID NO: 2035115 - RNA, 15 nt, Staphylococcus aureus subsp. aureus Mu50
cacuccucuauuuua

SEQ ID NO: 2035116 - RNA, 17 nt, Staphylococcus aureus subsp. aureus Mu50
cacucuguaauaaagaa

SEQ ID NO: 2035117 - RNA, 17 nt, Staphylococcus aureus subsp. aureus Mu50
cacugacaugauaaauu

SEQ ID NO: 2035118 - RNA, 18 nt, Staphylococcus aureus subsp. aureus Mu50
cacugcacaucauaauaa

SEQ ID NO: 2035119 - RNA, 17 nt, Staphylococcus aureus subsp. aureus Mu50
cacugcauauaaaguca

SEQ ID NO: 2035120 - RNA, 14 nt, Staphylococcus aureus subsp. aureus Mu50
cagaaauuuaauau

SEQ ID NO: 2035121 - RNA, 19 nt, Staphylococcus aureus subsp. aureus Mu50
cagaaauuuaauauuguua

SEQ ID NO: 2035122 - RNA, 14 nt, Staphylococcus aureus subsp. aureus Mu50
cacuuucaguaauu

SEQ ID NO: 2035123 - RNA, 21 nt, Staphylococcus aureus subsp. aureus Mu50
cacuuucaguaauuguuacua

SEQ ID NO: 2035124 - RNA, 14 nt, Staphylococcus aureus subsp. aureus Mu50
cacuuuugauuguu

SEQ ID NO: 2035125 - RNA, 19 nt, Staphylococcus aureus subsp. aureus Mu50
cacuuuuagaaucaaccgu

SEQ ID NO: 2035126 - RNA, 12 nt, Staphylococcus aureus subsp. aureus Mu50
cagaaaugacau

SEQ ID NO: 2035127 - RNA, 13 nt, Staphylococcus aureus subsp. aureus Mu50
cacuuggauucaa

SEQ ID NO: 2035128 - RNA, 18 nt, Staphylococcus aureus subsp. aureus Mu50
cacuuggcuuaggaugaa

SEQ ID NO: 2035129 - RNA, 15 nt, Staphylococcus aureus subsp. aureus Mu50
cacuuauuauuuugu

SEQ ID NO: 2035130 - RNA, 11 nt, Staphylococcus aureus subsp. aureus Mu50
cacuuaauaag

SEQ ID NO: 2035131 - RNA, 15 nt, Staphylococcus aureus subsp. aureus Mu50
cacuuaauauaagga

SEQ ID NO: 2035132 - RNA, 23 nt, Staphylococcus aureus subsp. aureus Mu50
cacuguaacgaguccauuuucuu

SEQ ID NO: 2035133 - RNA, 16 nt, Staphylococcus aureus subsp. aureus Mu50
cacuguuaaagucugu

SEQ ID NO: 2035134 - RNA, 18 nt, Staphylococcus aureus subsp. aureus Mu50
cacggucuugauauugac

SEQ ID NO: 2035135 - RNA, 21 nt, Staphylococcus aureus subsp. aureus Mu50
caguguaaucauuguggcuuu

SEQ ID NO: 2035136 - RNA, 23 nt, Staphylococcus aureus subsp. aureus Mu50
caguuauuuggguaacauuagca

SEQ ID NO: 2035137 - RNA, 20 nt, Staphylococcus aureus subsp. aureus Mu50
cauagucacuuuuaacgaca

SEQ ID NO: 2035138 - RNA, 21 nt, Staphylococcus aureus subsp. aureus Mu50
cauaguaauaaaaugaugaua

SEQ ID NO: 2035139 - RNA, 21 nt, Staphylococcus aureus subsp. aureus Mu50
cauacuucuauuuuauaauaa

SEQ ID NO: 2035140 - RNA, 22 nt, Staphylococcus aureus subsp. aureus Mu50
cauacuucuauuuuauaauaaa

SEQ ID NO: 2035141 - RNA, 13 nt, Staphylococcus aureus subsp. aureus Mu50
cauacuuuuucag

SEQ ID NO: 2035142 - RNA, 18 nt, Staphylococcus aureus subsp. aureus Mu50
cauauaaaaaauuauuaa

SEQ ID NO: 2035143 - RNA, 20 nt, Staphylococcus aureus subsp. aureus Mu50
cauauaaagucguaucauau

SEQ ID NO: 2035144 - RNA, 11 nt, Staphylococcus aureus subsp. aureus Mu50
cauauaaauag

SEQ ID NO: 2035145 - RNA, 21 nt, Staphylococcus aureus subsp. aureus Mu50
cauauaaauauuuuuaauuau

SEQ ID NO: 2035146 - RNA, 11 nt, Staphylococcus aureus subsp. aureus Mu50
cauauaaaugu

SEQ ID NO: 2035147 - RNA, 18 nt, Staphylococcus aureus subsp. aureus Mu50
cauauaaugccaaauaua

SEQ ID NO: 2035148 - RNA, 23 nt, Staphylococcus aureus subsp. aureus Mu50
cauauaaugcugauaauuuuucu

SEQ ID NO: 2035149 - RNA, 18 nt, Staphylococcus aureus subsp. aureus Mu50
cauauaaugguugaauaa

SEQ ID NO: 2035150 - RNA, 21 nt, Staphylococcus aureus subsp. aureus Mu50
cauacugauuaaacuguuugu

SEQ ID NO: 2035151 - RNA, 15 nt, Staphylococcus aureus subsp. aureus Mu50
caguuuuauuaucuu

SEQ ID NO: 2035152 - RNA, 21 nt, Staphylococcus aureus subsp. aureus Mu50
cauaaaugcuaaaaguauaaa

SEQ ID NO: 2035153 - RNA, 13 nt, Staphylococcus aureus subsp. aureus Mu50
cauaaauuaauau

SEQ ID NO: 2035154 - RNA, 19 nt, Staphylococcus aureus subsp. aureus Mu50
cauaccaaauaaauaagug

SEQ ID NO: 2035155 - RNA, 17 nt, Staphylococcus aureus subsp. aureus Mu50
cauacagucaauacaaa

SEQ ID NO: 2035156 - RNA, 19 nt, Staphylococcus aureus subsp. aureus Mu50
cauaaccuguaauugauga

SEQ ID NO: 2035157 - RNA, 21 nt, Staphylococcus aureus subsp. aureus Mu50
cauaaccuugcuuugcauaca

SEQ ID NO: 2035158 - RNA, 19 nt, Staphylococcus aureus subsp. aureus Mu50
cauaaccuugcuuugcaua

SEQ ID NO: 2035159 - RNA, 17 nt, Staphylococcus aureus subsp. aureus Mu50
cauaacuuuauauauaa

SEQ ID NO: 2035160 - RNA, 21 nt, Staphylococcus aureus subsp. aureus Mu50
cauaagaaaauacuaacaauu

SEQ ID NO: 2035161 - RNA, 16 nt, Staphylococcus aureus subsp. aureus Mu50
cauaagaaauacuaau

SEQ ID NO: 2035162 - RNA, 14 nt, Staphylococcus aureus subsp. aureus Mu50
cauaacugaauaaa

SEQ ID NO: 2035163 - RNA, 22 nt, Staphylococcus aureus subsp. aureus Mu50
caucauuuauaugauguucaau

SEQ ID NO: 2035164 - RNA, 22 nt, Staphylococcus aureus subsp. aureus Mu50
caucauuuaaauauuucacgau

SEQ ID NO: 2035165 - RNA, 12 nt, Staphylococcus aureus subsp. aureus Mu50
caucauuucuga

SEQ ID NO: 2035166 - RNA, 15 nt, Staphylococcus aureus subsp. aureus Mu50
caucauuuucaauac

SEQ ID NO: 2035167 - RNA, 14 nt, Staphylococcus aureus subsp. aureus Mu50
caucaggucgcccu

SEQ ID NO: 2035168 - RNA, 13 nt, Staphylococcus aureus subsp. aureus Mu50
caucaucuuuaau

SEQ ID NO: 2035169 - RNA, 24 nt, Staphylococcus aureus subsp. aureus Mu50
caucaugaacuuuuauugccauaa

SEQ ID NO: 2035170 - RNA, 14 nt, Staphylococcus aureus subsp. aureus Mu50
caucaguuaauaau

SEQ ID NO: 2035171 - RNA, 20 nt, Staphylococcus aureus subsp. aureus Mu50
caucauacuucaauaacaau

SEQ ID NO: 2035172 - RNA, 17 nt, Staphylococcus aureus subsp. aureus Mu50
caucaguuguguaauaa

SEQ ID NO: 2035173 - RNA, 18 nt, Staphylococcus aureus subsp. aureus Mu50
caucaguuguguaauaaa

SEQ ID NO: 2035174 - RNA, 19 nt, Staphylococcus aureus subsp. aureus Mu50
caucaacgccauauuuauu

SEQ ID NO: 2035175 - RNA, 13 nt, Staphylococcus aureus subsp. aureus Mu50
caucaauuucugu

SEQ ID NO: 2035176 - RNA, 22 nt, Staphylococcus aureus subsp. aureus Mu50
caucaauuucuguaauaauauc

SEQ ID NO: 2035177 - RNA, 16 nt, Staphylococcus aureus subsp. aureus Mu50
caucacaguguugaau

SEQ ID NO: 2035178 - RNA, 17 nt, Staphylococcus aureus subsp. aureus Mu50
caucacuaaaguaaaua

SEQ ID NO: 2035179 - RNA, 13 nt, Staphylococcus aureus subsp. aureus Mu50
cauauuaaauuuu

SEQ ID NO: 2035180 - RNA, 16 nt, Staphylococcus aureus subsp. aureus Mu50
cauauguuuuauaaua

SEQ ID NO: 2035181 - RNA, 18 nt, Staphylococcus aureus subsp. aureus Mu50
cauauguuuuauaauaaa

SEQ ID NO: 2035182 - RNA, 17 nt, Staphylococcus aureus subsp. aureus Mu50
cauaugcuauauuuagu

SEQ ID NO: 2035183 - RNA, 13 nt, Staphylococcus aureus subsp. aureus Mu50
cauauguaauaca

SEQ ID NO: 2035184 - RNA, 21 nt, Staphylococcus aureus subsp. aureus Mu50
cauaugugguggcuauauaau

SEQ ID NO: 2035185 - RNA, 17 nt, Staphylococcus aureus subsp. aureus Mu50
cauauguguuucuagcu

SEQ ID NO: 2035186 - RNA, 15 nt, Staphylococcus aureus subsp. aureus Mu50
cauaucuuuaucauu

SEQ ID NO: 2035187 - RNA, 12 nt, Staphylococcus aureus subsp. aureus Mu50
cauauuacccca

SEQ ID NO: 2035188 - RNA, 16 nt, Staphylococcus aureus subsp. aureus Mu50
cauauuuuuuaaauuu

SEQ ID NO: 2035189 - RNA, 19 nt, Staphylococcus aureus subsp. aureus Mu50
caucaaaacguuugaagaa

SEQ ID NO: 2035190 - RNA, 19 nt, Staphylococcus aureus subsp. aureus Mu50
cauauauauucguuacaaa

SEQ ID NO: 2035191 - RNA, 21 nt, Staphylococcus aureus subsp. aureus Mu50
cauauaucaacauguuccgcu

SEQ ID NO: 2035192 - RNA, 19 nt, Staphylococcus aureus subsp. aureus Mu50
cauauaugauaaauauugu

SEQ ID NO: 2035193 - RNA, 14 nt, Staphylococcus aureus subsp. aureus Mu50
cauauacuauaugu

SEQ ID NO: 2035194 - RNA, 15 nt, Staphylococcus aureus subsp. aureus Mu50
cauaucgauaaaugu

SEQ ID NO: 2035195 - RNA, 17 nt, Staphylococcus aureus subsp. aureus Mu50
cauauauuuuguuaaua

SEQ ID NO: 2035196 - RNA, 14 nt, Staphylococcus aureus subsp. aureus Mu50
cauaucgauuaaua

SEQ ID NO: 2035197 - RNA, 19 nt, Staphylococcus aureus subsp. aureus Mu50
cauaugacuuuauuucuau

SEQ ID NO: 2035198 - RNA, 16 nt, Staphylococcus aureus subsp. aureus Mu50
cagguaaauuuaaaau

SEQ ID NO: 2035199 - RNA, 16 nt, Staphylococcus aureus subsp. aureus Mu50
caguacgaacaacuaa

SEQ ID NO: 2035200 - RNA, 17 nt, Staphylococcus aureus subsp. aureus Mu50
cagcuucaaaaucaaau

SEQ ID NO: 2035201 - RNA, 16 nt, Staphylococcus aureus subsp. aureus Mu50
cagcuguccgauuuuu

SEQ ID NO: 2035202 - RNA, 19 nt, Staphylococcus aureus subsp. aureus Mu50
ccaaauaacguuaauauaa

SEQ ID NO: 2035203 - RNA, 20 nt, Staphylococcus aureus subsp. aureus Mu50
ccaaauaacguuaauauaau

SEQ ID NO: 2035204 - RNA, 19 nt, Staphylococcus aureus subsp. aureus Mu50
ccaaauagagaaauacuau

SEQ ID NO: 2035205 - RNA, 18 nt, Staphylococcus aureus subsp. aureus Mu50
ccaaauaucaguaauaau

SEQ ID NO: 2035206 - RNA, 15 nt, Staphylococcus aureus subsp. aureus Mu50
ccaaauccaucuaau

SEQ ID NO: 2035207 - RNA, 15 nt, Staphylococcus aureus subsp. aureus Mu50
ccaaauguugauaau

SEQ ID NO: 2035208 - RNA, 13 nt, Staphylococcus aureus subsp. aureus Mu50
ccaaaucuuuaau

SEQ ID NO: 2035209 - RNA, 12 nt, Staphylococcus aureus subsp. aureus Mu50
cauuugcuuuuu

SEQ ID NO: 2035210 - RNA, 16 nt, Staphylococcus aureus subsp. aureus Mu50
cauuuguguaaaugaa

SEQ ID NO: 2035211 - RNA, 19 nt, Staphylococcus aureus subsp. aureus Mu50
cauuuguguauaaauguca

SEQ ID NO: 2035212 - RNA, 13 nt, Staphylococcus aureus subsp. aureus Mu50
cauuuguguuuuu

SEQ ID NO: 2035213 - RNA, 19 nt, Staphylococcus aureus subsp. aureus Mu50
cauuugcaacaauauaaua

SEQ ID NO: 2035214 - RNA, 13 nt, Staphylococcus aureus subsp. aureus Mu50
cauuguugauaaa

SEQ ID NO: 2035215 - RNA, 19 nt, Staphylococcus aureus subsp. aureus Mu50
cauuguugauaaauggaaa

SEQ ID NO: 2035216 - RNA, 20 nt, Staphylococcus aureus subsp. aureus Mu50
cauuguuauuaucguaaaaa

SEQ ID NO: 2035217 - RNA, 22 nt, Staphylococcus aureus subsp. aureus Mu50
cauuguguauuguuuuacuuuc

SEQ ID NO: 2035218 - RNA, 19 nt, Staphylococcus aureus subsp. aureus Mu50
cauuguccaacugcuuuuu

SEQ ID NO: 2035219 - RNA, 18 nt, Staphylococcus aureus subsp. aureus Mu50
cauuguaauaauaaucuu

SEQ ID NO: 2035220 - RNA, 20 nt, Staphylococcus aureus subsp. aureus Mu50
cauuguaaauuuguuaucuu

SEQ ID NO: 2035221 - RNA, 13 nt, Staphylococcus aureus subsp. aureus Mu50
cauuguaacucaa

SEQ ID NO: 2035222 - RNA, 16 nt, Staphylococcus aureus subsp. aureus Mu50
cauuuuaugcacuuuu

SEQ ID NO: 2035223 - RNA, 13 nt, Staphylococcus aureus subsp. aureus Mu50
ccaaacaauacau

SEQ ID NO: 2035224 - RNA, 21 nt, Staphylococcus aureus subsp. aureus Mu50
ccaaagaaagcuaauaucaau

SEQ ID NO: 2035225 - RNA, 15 nt, Staphylococcus aureus subsp. aureus Mu50
ccaaacauaauuacc

SEQ ID NO: 2035226 - RNA, 21 nt, Staphylococcus aureus subsp. aureus Mu50
cauugaaaggaacauuucaau

SEQ ID NO: 2035227 - RNA, 20 nt, Staphylococcus aureus subsp. aureus Mu50
cauucuuuauagaaaccaaa

SEQ ID NO: 2035228 - RNA, 14 nt, Staphylococcus aureus subsp. aureus Mu50
cauucuugguuuuu

SEQ ID NO: 2035229 - RNA, 16 nt, Staphylococcus aureus subsp. aureus Mu50
cauucuguguaaauau

SEQ ID NO: 2035230 - RNA, 12 nt, Staphylococcus aureus subsp. aureus Mu50
cauucuuauuug

SEQ ID NO: 2035231 - RNA, 23 nt, Staphylococcus aureus subsp. aureus Mu50
cauugguaccuuuuuauuaucuu

SEQ ID NO: 2035232 - RNA, 20 nt, Staphylococcus aureus subsp. aureus Mu50
cauugccuguagaauuucuu

SEQ ID NO: 2035233 - RNA, 19 nt, Staphylococcus aureus subsp. aureus Mu50
cauugcuucuuggcauuuu

SEQ ID NO: 2035234 - RNA, 19 nt, Staphylococcus aureus subsp. aureus Mu50
cauucauaauuuguugaua

SEQ ID NO: 2035235 - RNA, 19 nt, Staphylococcus aureus subsp. aureus Mu50
cauguauuuaguaucauga

SEQ ID NO: 2035236 - RNA, 14 nt, Staphylococcus aureus subsp. aureus Mu50
caugucccauaaca

SEQ ID NO: 2035237 - RNA, 13 nt, Staphylococcus aureus subsp. aureus Mu50
cauucauuacuug

SEQ ID NO: 2035238 - RNA, 14 nt, Staphylococcus aureus subsp. aureus Mu50
cauucauuugcaaa

SEQ ID NO: 2035239 - RNA, 20 nt, Staphylococcus aureus subsp. aureus Mu50
cauucuaccaguugauuuaa

SEQ ID NO: 2035240 - RNA, 16 nt, Staphylococcus aureus subsp. aureus Mu50
ccaauacguuuccaau

SEQ ID NO: 2035241 - RNA, 22 nt, Staphylococcus aureus subsp. aureus Mu50
ccaacucgcauugccuguagaa

SEQ ID NO: 2035242 - RNA, 21 nt, Staphylococcus aureus subsp. aureus Mu50
ccaacguuauucguuaacaau

SEQ ID NO: 2035243 - RNA, 14 nt, Staphylococcus aureus subsp. aureus Mu50
ccaacuaauguuaa

SEQ ID NO: 2035244 - RNA, 17 nt, Staphylococcus aureus subsp. aureus Mu50
ccaacuaauguuaaaau

SEQ ID NO: 2035245 - RNA, 20 nt, Staphylococcus aureus subsp. aureus Mu50
ccaaguacgcaauuuaauau

SEQ ID NO: 2035246 - RNA, 15 nt, Staphylococcus aureus subsp. aureus Mu50
ccaaguucacuaaau

SEQ ID NO: 2035247 - RNA, 23 nt, Staphylococcus aureus subsp. aureus Mu50
ccaaguucacuaaauucaauaau

SEQ ID NO: 2035248 - RNA, 20 nt, Staphylococcus aureus subsp. aureus Mu50
ccaagucuaacaguuaauau

SEQ ID NO: 2035249 - RNA, 23 nt, Staphylococcus aureus subsp. aureus Mu50
ccaagagaauuaauaauuuuuuu

SEQ ID NO: 2035250 - RNA, 16 nt, Staphylococcus aureus subsp. aureus Mu50
ccaagcaucauugaau

SEQ ID NO: 2035251 - RNA, 14 nt, Staphylococcus aureus subsp. aureus Mu50
caugcuuuuaauau

SEQ ID NO: 2035252 - RNA, 13 nt, Staphylococcus aureus subsp. aureus Mu50
caugcuuaauuua

SEQ ID NO: 2035253 - RNA, 15 nt, Staphylococcus aureus subsp. aureus Mu50
cauggaacgugcuuu

SEQ ID NO: 2035254 - RNA, 16 nt, Staphylococcus aureus subsp. aureus Mu50
caugcgauucaaucua

SEQ ID NO: 2035255 - RNA, 21 nt, Staphylococcus aureus subsp. aureus Mu50
caugcccucuauuagauacau

SEQ ID NO: 2035256 - RNA, 20 nt, Staphylococcus aureus subsp. aureus Mu50
caugccagaugcaaugauac

SEQ ID NO: 2035257 - RNA, 17 nt, Staphylococcus aureus subsp. aureus Mu50
caugacuauuuuccauc

SEQ ID NO: 2035258 - RNA, 14 nt, Staphylococcus aureus subsp. aureus Mu50
caugacgauaauga

SEQ ID NO: 2035259 - RNA, 14 nt, Staphylococcus aureus subsp. aureus Mu50
caugaugauaaauu

SEQ ID NO: 2035260 - RNA, 17 nt, Staphylococcus aureus subsp. aureus Mu50
caugaacaaauaauuua

SEQ ID NO: 2035261 - RNA, 13 nt, Staphylococcus aureus subsp. aureus Mu50
caucuuuuguugu

SEQ ID NO: 2035262 - RNA, 17 nt, Staphylococcus aureus subsp. aureus Mu50
caugaaucgcauuuaaa

SEQ ID NO: 2035263 - RNA, 19 nt, Staphylococcus aureus subsp. aureus Mu50
caucuuaugacugcuuuuu

SEQ ID NO: 2035264 - RNA, 20 nt, Staphylococcus aureus subsp. aureus Mu50
caucuucaagacgcauuguu

SEQ ID NO: 2035265 - RNA, 19 nt, Staphylococcus aureus subsp. aureus Mu50
caucuucaauauuuaaauu

SEQ ID NO: 2035266 - RNA, 21 nt, Staphylococcus aureus subsp. aureus Mu50
caucuguuuuagguuuguugc

SEQ ID NO: 2035267 - RNA, 14 nt, Staphylococcus aureus subsp. aureus Mu50
caucuuaacaacuu

SEQ ID NO: 2035268 - RNA, 17 nt, Staphylococcus aureus subsp. aureus Mu50
caucuuuuagguaauaa

SEQ ID NO: 2035269 - RNA, 19 nt, Staphylococcus aureus subsp. aureus Mu50
caucuuuaagcuuaaauag

SEQ ID NO: 2035270 - RNA, 13 nt, Staphylococcus aureus subsp. aureus Mu50
caucuuuaauuuu

SEQ ID NO: 2035271 - RNA, 21 nt, Staphylococcus aureus subsp. aureus Mu50
caucucuuauaaguucaacca

SEQ ID NO: 2035272 - RNA, 14 nt, Staphylococcus aureus subsp. aureus Mu50
caucugcauuuaau

SEQ ID NO: 2035273 - RNA, 20 nt, Staphylococcus aureus subsp. aureus Mu50
caucuauauuuguuuguugu

SEQ ID NO: 2035274 - RNA, 19 nt, Staphylococcus aureus subsp. aureus Mu50
caucuauccgauuuaaguu

SEQ ID NO: 2035275 - RNA, 22 nt, Staphylococcus aureus subsp. aureus Mu50
caucuauccgauuuaaguugau

SEQ ID NO: 2035276 - RNA, 20 nt, Staphylococcus aureus subsp. aureus Mu50
caucuauuauuauguuauaa

SEQ ID NO: 2035277 - RNA, 19 nt, Staphylococcus aureus subsp. aureus Mu50
caucuauuuaauaauguau

SEQ ID NO: 2035278 - RNA, 17 nt, Staphylococcus aureus subsp. aureus Mu50
cauccgccaauuaaaau

SEQ ID NO: 2035279 - RNA, 19 nt, Staphylococcus aureus subsp. aureus Mu50
caucguauagaugugucuu

SEQ ID NO: 2035280 - RNA, 15 nt, Staphylococcus aureus subsp. aureus Mu50
ccagccauuaaaccu

SEQ ID NO: 2035281 - RNA, 15 nt, Staphylococcus aureus subsp. aureus Mu50
ccagauaucauaaua

SEQ ID NO: 2035282 - RNA, 20 nt, Staphylococcus aureus subsp. aureus Mu50
ccaggccagucaauuuuuuc

SEQ ID NO: 2035283 - RNA, 23 nt, Staphylococcus aureus subsp. aureus Mu50
ccaguauacgaguuauaucuuuu

SEQ ID NO: 2035284 - RNA, 17 nt, Staphylococcus aureus subsp. aureus Mu50
ccauaaauauuuaaaau

SEQ ID NO: 2035285 - RNA, 17 nt, Staphylococcus aureus subsp. aureus Mu50
ccauaaucuuuauuaau

SEQ ID NO: 2035286 - RNA, 20 nt, Staphylococcus aureus subsp. aureus Mu50
ccauaaucuuuauuaauaaa

SEQ ID NO: 2035287 - RNA, 21 nt, Staphylococcus aureus subsp. aureus Mu50
ccauaaucuuuauuaauaaau

SEQ ID NO: 2035288 - RNA, 21 nt, Staphylococcus aureus subsp. aureus Mu50
ccauuuuuuuaucuguagaaa

SEQ ID NO: 2035289 - RNA, 22 nt, Staphylococcus aureus subsp. aureus Mu50
ccauuugcuggcgcaaugauau

SEQ ID NO: 2035290 - RNA, 23 nt, Staphylococcus aureus subsp. aureus Mu50
ccauugcuucuuggcauuuuuuc

SEQ ID NO: 2035291 - RNA, 22 nt, Staphylococcus aureus subsp. aureus Mu50
cccaaucgauuuuauaucuuuc

SEQ ID NO: 2035292 - RNA, 22 nt, Staphylococcus aureus subsp. aureus Mu50
cccaauuaaccuugauuuaauu

SEQ ID NO: 2035293 - RNA, 14 nt, Staphylococcus aureus subsp. aureus Mu50
cccaacuuaauaac

SEQ ID NO: 2035294 - RNA, 22 nt, Staphylococcus aureus subsp. aureus Mu50
cccaaauugaugacuuacuaau

SEQ ID NO: 2035295 - RNA, 13 nt, Staphylococcus aureus subsp. aureus Mu50
cccaacaaagaag

SEQ ID NO: 2035296 - RNA, 18 nt, Staphylococcus aureus subsp. aureus Mu50
ccaucuccaccauuaaua

SEQ ID NO: 2035297 - RNA, 20 nt, Staphylococcus aureus subsp. aureus Mu50
cccgagacauaaauuaauau

SEQ ID NO: 2035298 - RNA, 14 nt, Staphylococcus aureus subsp. aureus Mu50
cccauggauucuga

SEQ ID NO: 2035299 - RNA, 18 nt, Staphylococcus aureus subsp. aureus Mu50
cccguaauaauuuacagg

SEQ ID NO: 2035300 - RNA, 18 nt, Staphylococcus aureus subsp. aureus Mu50
augccuuuuauuuaucuu

SEQ ID NO: 2035301 - RNA, 22 nt, Staphylococcus aureus subsp. aureus Mu50
augcgaggguuuucuuaauuau

SEQ ID NO: 2035302 - RNA, 14 nt, Staphylococcus aureus subsp. aureus Mu50
augcuaauuuaacu

SEQ ID NO: 2035303 - RNA, 13 nt, Staphylococcus aureus subsp. aureus Mu50
augcuaaacuugc

SEQ ID NO: 2035304 - RNA, 14 nt, Staphylococcus aureus subsp. aureus Mu50
augcuauuuaaauc

SEQ ID NO: 2035305 - RNA, 22 nt, Staphylococcus aureus subsp. aureus Mu50
augcuauauuucgguauuuuaa

SEQ ID NO: 2035306 - RNA, 19 nt, Staphylococcus aureus subsp. aureus Mu50
augcguggugugaauguuu

SEQ ID NO: 2035307 - RNA, 15 nt, Staphylococcus aureus subsp. aureus Mu50
augaugcgcuucuaa

SEQ ID NO: 2035308 - RNA, 20 nt, Staphylococcus aureus subsp. aureus Mu50
augaugcgcuucuaacucac

SEQ ID NO: 2035309 - RNA, 18 nt, Staphylococcus aureus subsp. aureus Mu50
augauucguauucaaagu

SEQ ID NO: 2035310 - RNA, 14 nt, Staphylococcus aureus subsp. aureus Mu50
augauuuacuaaug

SEQ ID NO: 2035311 - RNA, 16 nt, Staphylococcus aureus subsp. aureus Mu50
augauugguauacagu

SEQ ID NO: 2035312 - RNA, 23 nt, Staphylococcus aureus subsp. aureus Mu50
augauugguuugugauuuuuuga

SEQ ID NO: 2035313 - RNA, 21 nt, Staphylococcus aureus subsp. aureus Mu50
augauuguuuaagaauguaca

SEQ ID NO: 2035314 - RNA, 13 nt, Staphylococcus aureus subsp. aureus Mu50
augaugcauaaga

SEQ ID NO: 2035315 - RNA, 14 nt, Staphylococcus aureus subsp. aureus Mu50
augaugauaaauug

SEQ ID NO: 2035316 - RNA, 17 nt, Staphylococcus aureus subsp. aureus Mu50
augaugagauaaaauca

SEQ ID NO: 2035317 - RNA, 22 nt, Staphylococcus aureus subsp. aureus Mu50
augaucuuuguagccuucaacu

SEQ ID NO: 2035318 - RNA, 15 nt, Staphylococcus aureus subsp. aureus Mu50
augacuucuuuauau

SEQ ID NO: 2035319 - RNA, 18 nt, Staphylococcus aureus subsp. aureus Mu50
augaggaucaacugaaau

SEQ ID NO: 2035320 - RNA, 15 nt, Staphylococcus aureus subsp. aureus Mu50
aucugacauuguugc

SEQ ID NO: 2035321 - RNA, 19 nt, Staphylococcus aureus subsp. aureus Mu50
aucugacauuucaucaaua

SEQ ID NO: 2035322 - RNA, 13 nt, Staphylococcus aureus subsp. aureus Mu50
aucugacugauuu

SEQ ID NO: 2035323 - RNA, 23 nt, Staphylococcus aureus subsp. aureus Mu50
aucugacugauuuuuuuuaugca

SEQ ID NO: 2035324 - RNA, 21 nt, Staphylococcus aureus subsp. aureus Mu50
augacguauacaaauugauuu

SEQ ID NO: 2035325 - RNA, 17 nt, Staphylococcus aureus subsp. aureus Mu50
augacgugcuuuuaaau

SEQ ID NO: 2035326 - RNA, 18 nt, Staphylococcus aureus subsp. aureus Mu50
augcaaaacuaaucaaau

SEQ ID NO: 2035327 - RNA, 14 nt, Staphylococcus aureus subsp. aureus Mu50
augcaaaauaauac

SEQ ID NO: 2035328 - RNA, 14 nt, Staphylococcus aureus subsp. aureus Mu50
augauuuuucauca

SEQ ID NO: 2035329 - RNA, 21 nt, Staphylococcus aureus subsp. aureus Mu50
augcaaaucaaauacaucaau

SEQ ID NO: 2035330 - RNA, 22 nt, Staphylococcus aureus subsp. aureus Mu50
augcaaaucaaauacaucaauu

SEQ ID NO: 2035331 - RNA, 22 nt, Staphylococcus aureus subsp. aureus Mu50
augcaauugguagucaucacga

SEQ ID NO: 2035332 - RNA, 22 nt, Staphylococcus aureus subsp. aureus Mu50
augcaauuuuucacuuauaaca

SEQ ID NO: 2035333 - RNA, 12 nt, Staphylococcus aureus subsp. aureus Mu50
augcacaauauu

SEQ ID NO: 2035334 - RNA, 19 nt, Staphylococcus aureus subsp. aureus Mu50
augcacaauauucguagca

SEQ ID NO: 2035335 - RNA, 18 nt, Staphylococcus aureus subsp. aureus Mu50
augccacgcucauuuucu

SEQ ID NO: 2035336 - RNA, 18 nt, Staphylococcus aureus subsp. aureus Mu50
augcaccuuuacaacaua

SEQ ID NO: 2035337 - RNA, 17 nt, Staphylococcus aureus subsp. aureus Mu50
auuaauugcuuucacau

SEQ ID NO: 2035338 - RNA, 22 nt, Staphylococcus aureus subsp. aureus Mu50
auuaauugcuuucacauuguuu

SEQ ID NO: 2035339 - RNA, 21 nt, Staphylococcus aureus subsp. aureus Mu50
auuaauuuacucaaaccaucu

SEQ ID NO: 2035340 - RNA, 19 nt, Staphylococcus aureus subsp. aureus Mu50
auuaauuacuuucauugua

SEQ ID NO: 2035341 - RNA, 12 nt, Staphylococcus aureus subsp. aureus Mu50
auuaauuaucau

SEQ ID NO: 2035342 - RNA, 23 nt, Staphylococcus aureus subsp. aureus Mu50
auuaauuccuggugcaauaauaa

SEQ ID NO: 2035343 - RNA, 14 nt, Staphylococcus aureus subsp. aureus Mu50
auuaauuuuaucuu

SEQ ID NO: 2035344 - RNA, 21 nt, Staphylococcus aureus subsp. aureus Mu50
auuaauguuucuucaauuguc

SEQ ID NO: 2035345 - RNA, 15 nt, Staphylococcus aureus subsp. aureus Mu50
auuaaugguauugau

SEQ ID NO: 2035346 - RNA, 17 nt, Staphylococcus aureus subsp. aureus Mu50
auuaaugccauuguuau

SEQ ID NO: 2035347 - RNA, 19 nt, Staphylococcus aureus subsp. aureus Mu50
auuaauaggauuauuauca

SEQ ID NO: 2035348 - RNA, 19 nt, Staphylococcus aureus subsp. aureus Mu50
auuaauauaaauaucaauu

SEQ ID NO: 2035349 - RNA, 22 nt, Staphylococcus aureus subsp. aureus Mu50
auuaaucuauggaaaauguuau

SEQ ID NO: 2035350 - RNA, 21 nt, Staphylococcus aureus subsp. aureus Mu50
auuaauaaauaauaacccgaa

SEQ ID NO: 2035351 - RNA, 21 nt, Staphylococcus aureus subsp. aureus Mu50
auuaauagagacauuuuaucu

SEQ ID NO: 2035352 - RNA, 14 nt, Staphylococcus aureus subsp. aureus Mu50
auuaauaaaauucu

SEQ ID NO: 2035353 - RNA, 15 nt, Staphylococcus aureus subsp. aureus Mu50
auuaaguacuuuuac

SEQ ID NO: 2035354 - RNA, 23 nt, Staphylococcus aureus subsp. aureus Mu50
auuacagauuccugcaaaauguu

SEQ ID NO: 2035355 - RNA, 16 nt, Staphylococcus aureus subsp. aureus Mu50
auuaccaaugaauaaa

SEQ ID NO: 2035356 - RNA, 18 nt, Staphylococcus aureus subsp. aureus Mu50
auuacaguucuauagguu

SEQ ID NO: 2035357 - RNA, 17 nt, Staphylococcus aureus subsp. aureus Mu50
auuacaccauuguuaua

SEQ ID NO: 2035358 - RNA, 19 nt, Staphylococcus aureus subsp. aureus Mu50
auuacaaaaucaccuuuuu

SEQ ID NO: 2035359 - RNA, 16 nt, Staphylococcus aureus subsp. aureus Mu50
auuacaacuuauucuu

SEQ ID NO: 2035360 - RNA, 15 nt, Staphylococcus aureus subsp. aureus Mu50
auuaauuuuucaaaa

SEQ ID NO: 2035361 - RNA, 20 nt, Staphylococcus aureus subsp. aureus Mu50
auuaauugaaaaaccaaguu

SEQ ID NO: 2035362 - RNA, 12 nt, Staphylococcus aureus subsp. aureus Mu50
auuaauuucauu

SEQ ID NO: 2035363 - RNA, 18 nt, Staphylococcus aureus subsp. aureus Mu50
auuacauauaagauagau

SEQ ID NO: 2035364 - RNA, 18 nt, Staphylococcus aureus subsp. aureus Mu50
auuaccauaacuuuauau

SEQ ID NO: 2035365 - RNA, 13 nt, Staphylococcus aureus subsp. aureus Mu50
auuaccauauaaa

SEQ ID NO: 2035366 - RNA, 21 nt, Staphylococcus aureus subsp. aureus Mu50
auguuugccagguaaaaaucg

SEQ ID NO: 2035367 - RNA, 18 nt, Staphylococcus aureus subsp. aureus Mu50
auguuucuccuacuauaa

SEQ ID NO: 2035368 - RNA, 14 nt, Staphylococcus aureus subsp. aureus Mu50
auguuucuuuauua

SEQ ID NO: 2035369 - RNA, 21 nt, Staphylococcus aureus subsp. aureus Mu50
auguuuuauaauaaaugucac

SEQ ID NO: 2035370 - RNA, 13 nt, Staphylococcus aureus subsp. aureus Mu50
auguuuucuaaau

SEQ ID NO: 2035371 - RNA, 16 nt, Staphylococcus aureus subsp. aureus Mu50
auguuuucuaaaucua

SEQ ID NO: 2035372 - RNA, 16 nt, Staphylococcus aureus subsp. aureus Mu50
auguuuucuauaauau

SEQ ID NO: 2035373 - RNA, 22 nt, Staphylococcus aureus subsp. aureus Mu50
auguuuauauugcaaaaauaau

SEQ ID NO: 2035374 - RNA, 13 nt, Staphylococcus aureus subsp. aureus Mu50
auguuucaaaaua

SEQ ID NO: 2035375 - RNA, 16 nt, Staphylococcus aureus subsp. aureus Mu50
auguuucaaaauaauu

SEQ ID NO: 2035376 - RNA, 16 nt, Staphylococcus aureus subsp. aureus Mu50
auguuguuauauaaau

SEQ ID NO: 2035377 - RNA, 23 nt, Staphylococcus aureus subsp. aureus Mu50
augucgcacuauaaaauucacca

SEQ ID NO: 2035378 - RNA, 21 nt, Staphylococcus aureus subsp. aureus Mu50
auguugugauacuuucuaaga

SEQ ID NO: 2035379 - RNA, 14 nt, Staphylococcus aureus subsp. aureus Mu50
auuaaccuugauuu

SEQ ID NO: 2035380 - RNA, 18 nt, Staphylococcus aureus subsp. aureus Mu50
auuaaaacuauaauaaag

SEQ ID NO: 2035381 - RNA, 15 nt, Staphylococcus aureus subsp. aureus Mu50
auuaaaagcaucuuu

SEQ ID NO: 2035382 - RNA, 17 nt, Staphylococcus aureus subsp. aureus Mu50
auuaaccaguauaauuu

SEQ ID NO: 2035383 - RNA, 15 nt, Staphylococcus aureus subsp. aureus Mu50
auuaaccaucaugac

SEQ ID NO: 2035384 - RNA, 15 nt, Staphylococcus aureus subsp. aureus Mu50
auuaagcauuugucu

SEQ ID NO: 2035385 - RNA, 13 nt, Staphylococcus aureus subsp. aureus Mu50
auuaaggauaguu

SEQ ID NO: 2035386 - RNA, 17 nt, Staphylococcus aureus subsp. aureus Mu50
auuaaggauaguucuuu

SEQ ID NO: 2035387 - RNA, 21 nt, Staphylococcus aureus subsp. aureus Mu50
auuaagcaauguaacuuggcu

SEQ ID NO: 2035388 - RNA, 17 nt, Staphylococcus aureus subsp. aureus Mu50
auuaagaaugcaccaac

SEQ ID NO: 2035389 - RNA, 21 nt, Staphylococcus aureus subsp. aureus Mu50
auuaacuagugccucuuuuau

SEQ ID NO: 2035390 - RNA, 21 nt, Staphylococcus aureus subsp. aureus Mu50
auuaacugaccuaacaauuug

SEQ ID NO: 2035391 - RNA, 21 nt, Staphylococcus aureus subsp. aureus Mu50
auuaacuguaccaucacuaaa

SEQ ID NO: 2035392 - RNA, 22 nt, Staphylococcus aureus subsp. aureus Mu50
auuaacuguaugccgccuaaua

SEQ ID NO: 2035393 - RNA, 20 nt, Staphylococcus aureus subsp. aureus Mu50
auuaacuuacuuuuguaaaa

SEQ ID NO: 2035394 - RNA, 16 nt, Staphylococcus aureus subsp. aureus Mu50
auuaguccuuaacauu

SEQ ID NO: 2035395 - RNA, 20 nt, Staphylococcus aureus subsp. aureus Mu50
auuaggucuacgaucaaaau

SEQ ID NO: 2035396 - RNA, 19 nt, Staphylococcus aureus subsp. aureus Mu50
auuagguuacuuauugacg

SEQ ID NO: 2035397 - RNA, 17 nt, Staphylococcus aureus subsp. aureus Mu50
auuaguuuuuaaaauua

SEQ ID NO: 2035398 - RNA, 22 nt, Staphylococcus aureus subsp. aureus Mu50
auuaguuuuuaaaauuaucaau

SEQ ID NO: 2035399 - RNA, 13 nt, Staphylococcus aureus subsp. aureus Mu50
auuaguauaauuu

SEQ ID NO: 2035400 - RNA, 14 nt, Staphylococcus aureus subsp. aureus Mu50
auuaguauaauuua

SEQ ID NO: 2035401 - RNA, 17 nt, Staphylococcus aureus subsp. aureus Mu50
auuaucaauagaugaaa

SEQ ID NO: 2035402 - RNA, 20 nt, Staphylococcus aureus subsp. aureus Mu50
auuaucagaaucaaguaauu

SEQ ID NO: 2035403 - RNA, 23 nt, Staphylococcus aureus subsp. aureus Mu50
auuaucagguuaacauuugucau

SEQ ID NO: 2035404 - RNA, 15 nt, Staphylococcus aureus subsp. aureus Mu50
auuaucauaaagaua

SEQ ID NO: 2035405 - RNA, 15 nt, Staphylococcus aureus subsp. aureus Mu50
auuaucaacauaaua

SEQ ID NO: 2035406 - RNA, 14 nt, Staphylococcus aureus subsp. aureus Mu50
auuauauuaucauu

SEQ ID NO: 2035407 - RNA, 16 nt, Staphylococcus aureus subsp. aureus Mu50
auuauauuuuucuuca

SEQ ID NO: 2035408 - RNA, 16 nt, Staphylococcus aureus subsp. aureus Mu50
auuauacgugcuuuaa

SEQ ID NO: 2035409 - RNA, 19 nt, Staphylococcus aureus subsp. aureus Mu50
auuauauauauuccacgcu

SEQ ID NO: 2035410 - RNA, 17 nt, Staphylococcus aureus subsp. aureus Mu50
auuauaaugauugucuu

SEQ ID NO: 2035411 - RNA, 14 nt, Staphylococcus aureus subsp. aureus Mu50
auuauaauaaauag

SEQ ID NO: 2035412 - RNA, 21 nt, Staphylococcus aureus subsp. aureus Mu50
auuauagggcuguuuuuuuau

SEQ ID NO: 2035413 - RNA, 14 nt, Staphylococcus aureus subsp. aureus Mu50
auuauaguuuagau

SEQ ID NO: 2035414 - RNA, 22 nt, Staphylococcus aureus subsp. aureus Mu50
auuauaguuuagauucacugua

SEQ ID NO: 2035415 - RNA, 18 nt, Staphylococcus aureus subsp. aureus Mu50
auuauaaaccuaaugcuu

SEQ ID NO: 2035416 - RNA, 19 nt, Staphylococcus aureus subsp. aureus Mu50
auuauaaaccuaaugcuuu

SEQ ID NO: 2035417 - RNA, 21 nt, Staphylococcus aureus subsp. aureus Mu50
auuauaaaccuaaugcuuuaa

SEQ ID NO: 2035418 - RNA, 23 nt, Staphylococcus aureus subsp. aureus Mu50
auuauaaauuugguacauaauag

SEQ ID NO: 2035419 - RNA, 16 nt, Staphylococcus aureus subsp. aureus Mu50
auuauaaccgcuacaa

SEQ ID NO: 2035420 - RNA, 23 nt, Staphylococcus aureus subsp. aureus Mu50
auuacgguuugcuuuuuuguuau

SEQ ID NO: 2035421 - RNA, 22 nt, Staphylococcus aureus subsp. aureus Mu50
auuacuccaauuaccaaugaau

SEQ ID NO: 2035422 - RNA, 19 nt, Staphylococcus aureus subsp. aureus Mu50
auuacugcagcaucauaau

SEQ ID NO: 2035423 - RNA, 19 nt, Staphylococcus aureus subsp. aureus Mu50
auuacucuggucugugaua

SEQ ID NO: 2035424 - RNA, 14 nt, Staphylococcus aureus subsp. aureus Mu50
auuacucuuuuucu

SEQ ID NO: 2035425 - RNA, 14 nt, Staphylococcus aureus subsp. aureus Mu50
auuacuuuaucguu

SEQ ID NO: 2035426 - RNA, 20 nt, Staphylococcus aureus subsp. aureus Mu50
auuacugcagcaucauaauc

SEQ ID NO: 2035427 - RNA, 22 nt, Staphylococcus aureus subsp. aureus Mu50
auuagagaacgcuuuauuacuu

SEQ ID NO: 2035428 - RNA, 16 nt, Staphylococcus aureus subsp. aureus Mu50
auuagaauauucagau

SEQ ID NO: 2035429 - RNA, 22 nt, Staphylococcus aureus subsp. aureus Mu50
auuagaaugaaaccguauuauu

SEQ ID NO: 2035430 - RNA, 21 nt, Staphylococcus aureus subsp. aureus Mu50
auuagagccuacucauauuca

SEQ ID NO: 2035431 - RNA, 14 nt, Staphylococcus aureus subsp. aureus Mu50
auuagauuuaaaau

SEQ ID NO: 2035432 - RNA, 21 nt, Staphylococcus aureus subsp. aureus Mu50
auuagcaaauauuauuaaauc

SEQ ID NO: 2035433 - RNA, 22 nt, Staphylococcus aureus subsp. aureus Mu50
auucauucguacuuccaauacu

SEQ ID NO: 2035434 - RNA, 18 nt, Staphylococcus aureus subsp. aureus Mu50
auucauuucgauuaauuu

SEQ ID NO: 2035435 - RNA, 12 nt, Staphylococcus aureus subsp. aureus Mu50
auuccaaucuau

SEQ ID NO: 2035436 - RNA, 22 nt, Staphylococcus aureus subsp. aureus Mu50
auuccaaucuauuuuaaacuca

SEQ ID NO: 2035437 - RNA, 19 nt, Staphylococcus aureus subsp. aureus Mu50
auuccaaagaaagcuaaua

SEQ ID NO: 2035438 - RNA, 16 nt, Staphylococcus aureus subsp. aureus Mu50
auucaauauuuuuucu

SEQ ID NO: 2035439 - RNA, 22 nt, Staphylococcus aureus subsp. aureus Mu50
auucaaucuaaucuuaauuguc

SEQ ID NO: 2035440 - RNA, 15 nt, Staphylococcus aureus subsp. aureus Mu50
auuccaugucaauuu

SEQ ID NO: 2035441 - RNA, 19 nt, Staphylococcus aureus subsp. aureus Mu50
auuccauuucgauaccuaa

SEQ ID NO: 2035442 - RNA, 18 nt, Staphylococcus aureus subsp. aureus Mu50
auuccacuacaaucauac

SEQ ID NO: 2035443 - RNA, 17 nt, Staphylococcus aureus subsp. aureus Mu50
auuauccauucuuuguu

SEQ ID NO: 2035444 - RNA, 20 nt, Staphylococcus aureus subsp. aureus Mu50
auuaucguaauuguuaaacc

SEQ ID NO: 2035445 - RNA, 15 nt, Staphylococcus aureus subsp. aureus Mu50
auuaucuauccauuu

SEQ ID NO: 2035446 - RNA, 15 nt, Staphylococcus aureus subsp. aureus Mu50
auuaucuucaucauu

SEQ ID NO: 2035447 - RNA, 14 nt, Staphylococcus aureus subsp. aureus Mu50
auuauuuagaaacu

SEQ ID NO: 2035448 - RNA, 19 nt, Staphylococcus aureus subsp. aureus Mu50
auuauuuagauaaaaauua

SEQ ID NO: 2035449 - RNA, 12 nt, Staphylococcus aureus subsp. aureus Mu50
auuauuuauauu

SEQ ID NO: 2035450 - RNA, 22 nt, Staphylococcus aureus subsp. aureus Mu50
auuauuugauaaauaaaauuuu

SEQ ID NO: 2035451 - RNA, 22 nt, Staphylococcus aureus subsp. aureus Mu50
auucaaacaguccuuauuauag

SEQ ID NO: 2035452 - RNA, 18 nt, Staphylococcus aureus subsp. aureus Mu50
auucaaauaaaucaaacu

SEQ ID NO: 2035453 - RNA, 23 nt, Staphylococcus aureus subsp. aureus Mu50
auucaaaaagguauucaaauaaa

SEQ ID NO: 2035454 - RNA, 12 nt, Staphylococcus aureus subsp. aureus Mu50
auuauuuucaau

SEQ ID NO: 2035455 - RNA, 23 nt, Staphylococcus aureus subsp. aureus Mu50
auuauuuugcaauugcaaugaau

SEQ ID NO: 2035456 - RNA, 22 nt, Staphylococcus aureus subsp. aureus Mu50
auuauuuuguauuuuucaaaua

SEQ ID NO: 2035457 - RNA, 13 nt, Staphylococcus aureus subsp. aureus Mu50
auucaauaauuau

SEQ ID NO: 2035458 - RNA, 20 nt, Staphylococcus aureus subsp. aureus Mu50
auucaauaauucaucaaguu

SEQ ID NO: 2035459 - RNA, 17 nt, Staphylococcus aureus subsp. aureus Mu50
auucaacuaauuuaaag

SEQ ID NO: 2035460 - RNA, 17 nt, Staphylococcus aureus subsp. aureus Mu50
auucaacuuguuuccua

SEQ ID NO: 2035461 - RNA, 19 nt, Staphylococcus aureus subsp. aureus Mu50
auucaacuuguuuccuaca

SEQ ID NO: 2035462 - RNA, 15 nt, Staphylococcus aureus subsp. aureus Mu50
auucaacuuuaauca

SEQ ID NO: 2035463 - RNA, 19 nt, Staphylococcus aureus subsp. aureus Mu50
auucaacuuuaaucaaaaa

SEQ ID NO: 2035464 - RNA, 21 nt, Staphylococcus aureus subsp. aureus Mu50
auggcuagucuuuaacuuuaa

SEQ ID NO: 2035465 - RNA, 16 nt, Staphylococcus aureus subsp. aureus Mu50
augcucucuucaaagu

SEQ ID NO: 2035466 - RNA, 19 nt, Staphylococcus aureus subsp. aureus Mu50
augcucucuucaaaguaga

SEQ ID NO: 2035467 - RNA, 22 nt, Staphylococcus aureus subsp. aureus Mu50
augucgaaaauagcuauuaaaa

SEQ ID NO: 2035468 - RNA, 17 nt, Staphylococcus aureus subsp. aureus Mu50
augucgcacuauaaaau

SEQ ID NO: 2035469 - RNA, 18 nt, Staphylococcus aureus subsp. aureus Mu50
auguacguuuuuuuaaau

SEQ ID NO: 2035470 - RNA, 22 nt, Staphylococcus aureus subsp. aureus Mu50
auguaccgaauccuucaucaau

SEQ ID NO: 2035471 - RNA, 14 nt, Staphylococcus aureus subsp. aureus Mu50
auguacacuuuuga

SEQ ID NO: 2035472 - RNA, 22 nt, Staphylococcus aureus subsp. aureus Mu50
auguacacuuuugauuguuuaa

SEQ ID NO: 2035473 - RNA, 14 nt, Staphylococcus aureus subsp. aureus Mu50
auguacaguuacuu

SEQ ID NO: 2035474 - RNA, 17 nt, Staphylococcus aureus subsp. aureus Mu50
auguacauguauaaaag

SEQ ID NO: 2035475 - RNA, 22 nt, Staphylococcus aureus subsp. aureus Mu50
auguaccacucauaaucaaguc

SEQ ID NO: 2035476 - RNA, 13 nt, Staphylococcus aureus subsp. aureus Mu50
auguacaauaauu

SEQ ID NO: 2035477 - RNA, 14 nt, Staphylococcus aureus subsp. aureus Mu50
auguacuucaauuu

SEQ ID NO: 2035478 - RNA, 18 nt, Staphylococcus aureus subsp. aureus Mu50
auguagauggacaguuuu

SEQ ID NO: 2035479 - RNA, 16 nt, Staphylococcus aureus subsp. aureus Mu50
auguacuacuuuauuu

SEQ ID NO: 2035480 - RNA, 15 nt, Staphylococcus aureus subsp. aureus Mu50
auguacuaggaccua

SEQ ID NO: 2035481 - RNA, 21 nt, Staphylococcus aureus subsp. aureus Mu50
auguacuaggaccuacaauuu

SEQ ID NO: 2035482 - RNA, 22 nt, Staphylococcus aureus subsp. aureus Mu50
auguacuauuaucuauccauuu

SEQ ID NO: 2035483 - RNA, 20 nt, Staphylococcus aureus subsp. aureus Mu50
auguaggcgccauaaucauu

SEQ ID NO: 2035484 - RNA, 19 nt, Staphylococcus aureus subsp. aureus Mu50
auguagcaggcaacuuuua

SEQ ID NO: 2035485 - RNA, 13 nt, Staphylococcus aureus subsp. aureus Mu50
auguagcuuugug

SEQ ID NO: 2035486 - RNA, 14 nt, Staphylococcus aureus subsp. aureus Mu50
auguauaugaauuu

SEQ ID NO: 2035487 - RNA, 16 nt, Staphylococcus aureus subsp. aureus Mu50
auggcucguuuuuuua

SEQ ID NO: 2035488 - RNA, 16 nt, Staphylococcus aureus subsp. aureus Mu50
auggcugcaucaauau

SEQ ID NO: 2035489 - RNA, 20 nt, Staphylococcus aureus subsp. aureus Mu50
auggucuuuuaauuaaaagu

SEQ ID NO: 2035490 - RNA, 15 nt, Staphylococcus aureus subsp. aureus Mu50
auggugaacuaaauu

SEQ ID NO: 2035491 - RNA, 15 nt, Staphylococcus aureus subsp. aureus Mu50
auggugaacuguuaa

SEQ ID NO: 2035492 - RNA, 14 nt, Staphylococcus aureus subsp. aureus Mu50
aucgcauuuuguuu

SEQ ID NO: 2035493 - RNA, 16 nt, Staphylococcus aureus subsp. aureus Mu50
aucgauauaguagcuu

SEQ ID NO: 2035494 - RNA, 14 nt, Staphylococcus aureus subsp. aureus Mu50
aucgauuuaucauu

SEQ ID NO: 2035495 - RNA, 19 nt, Staphylococcus aureus subsp. aureus Mu50
aucguaaacacuauaaaag

SEQ ID NO: 2035496 - RNA, 20 nt, Staphylococcus aureus subsp. aureus Mu50
aucguaaagaucauuuucaa

SEQ ID NO: 2035497 - RNA, 18 nt, Staphylococcus aureus subsp. aureus Mu50
aucgguaauuacuuguaa

SEQ ID NO: 2035498 - RNA, 14 nt, Staphylococcus aureus subsp. aureus Mu50
aucggcuuucuaag

SEQ ID NO: 2035499 - RNA, 17 nt, Staphylococcus aureus subsp. aureus Mu50
aucucugcuuuaauaua

SEQ ID NO: 2035500 - RNA, 15 nt, Staphylococcus aureus subsp. aureus Mu50
aucucuauuuuuuau

SEQ ID NO: 2035501 - RNA, 21 nt, Staphylococcus aureus subsp. aureus Mu50
aucucuauuuuuuauguuuua

SEQ ID NO: 2035502 - RNA, 16 nt, Staphylococcus aureus subsp. aureus Mu50
aucucguuuuuacaug

SEQ ID NO: 2035503 - RNA, 21 nt, Staphylococcus aureus subsp. aureus Mu50
aucucauucuuuaauauaaau

SEQ ID NO: 2035504 - RNA, 18 nt, Staphylococcus aureus subsp. aureus Mu50
aucguucaauguuauuaa

SEQ ID NO: 2035505 - RNA, 19 nt, Staphylococcus aureus subsp. aureus Mu50
aucuauuuuucgauuuuga

SEQ ID NO: 2035506 - RNA, 17 nt, Staphylococcus aureus subsp. aureus Mu50
aucuauuuuuaacuaau

SEQ ID NO: 2035507 - RNA, 15 nt, Staphylococcus aureus subsp. aureus Mu50
aucuauuuuucgauu

SEQ ID NO: 2035508 - RNA, 22 nt, Staphylococcus aureus subsp. aureus Mu50
aucguguauuauugaaacuaau

SEQ ID NO: 2035509 - RNA, 19 nt, Staphylococcus aureus subsp. aureus Mu50
aucguauagaugugucuuu

SEQ ID NO: 2035510 - RNA, 15 nt, Staphylococcus aureus subsp. aureus Mu50
aucaucuauuuuuaa

SEQ ID NO: 2035511 - RNA, 21 nt, Staphylococcus aureus subsp. aureus Mu50
aucaucuuaacaacuuuaauu

SEQ ID NO: 2035512 - RNA, 17 nt, Staphylococcus aureus subsp. aureus Mu50
aucaucugcaagugcuu

SEQ ID NO: 2035513 - RNA, 14 nt, Staphylococcus aureus subsp. aureus Mu50
aucaugaugauaaa

SEQ ID NO: 2035514 - RNA, 14 nt, Staphylococcus aureus subsp. aureus Mu50
aucaucuuuuugaa

SEQ ID NO: 2035515 - RNA, 15 nt, Staphylococcus aureus subsp. aureus Mu50
aucauuagauaauaa

SEQ ID NO: 2035516 - RNA, 15 nt, Staphylococcus aureus subsp. aureus Mu50
aucauucauggccaa

SEQ ID NO: 2035517 - RNA, 14 nt, Staphylococcus aureus subsp. aureus Mu50
aucauuaaaucuga

SEQ ID NO: 2035518 - RNA, 15 nt, Staphylococcus aureus subsp. aureus Mu50
aucauuaaauugcuu

SEQ ID NO: 2035519 - RNA, 20 nt, Staphylococcus aureus subsp. aureus Mu50
aucauuaauuggauuuuuac

SEQ ID NO: 2035520 - RNA, 22 nt, Staphylococcus aureus subsp. aureus Mu50
aucauugauauagucaaugaau

SEQ ID NO: 2035521 - RNA, 23 nt, Staphylococcus aureus subsp. aureus Mu50
aucauucuguguaaauauaaaua

SEQ ID NO: 2035522 - RNA, 20 nt, Staphylococcus aureus subsp. aureus Mu50
aucauuuggcguucaacauu

SEQ ID NO: 2035523 - RNA, 15 nt, Staphylococcus aureus subsp. aureus Mu50
aucauuuucaauacu

SEQ ID NO: 2035524 - RNA, 16 nt, Staphylococcus aureus subsp. aureus Mu50
aucauugguuucauca

SEQ ID NO: 2035525 - RNA, 19 nt, Staphylococcus aureus subsp. aureus Mu50
aucauuguggcuuuuuuua

SEQ ID NO: 2035526 - RNA, 15 nt, Staphylococcus aureus subsp. aureus Mu50
aucauuuaaaauauu

SEQ ID NO: 2035527 - RNA, 18 nt, Staphylococcus aureus subsp. aureus Mu50
aucauuaguguagaaaau

SEQ ID NO: 2035528 - RNA, 18 nt, Staphylococcus aureus subsp. aureus Mu50
aucauuaguuuuuaaaau

SEQ ID NO: 2035529 - RNA, 13 nt, Staphylococcus aureus subsp. aureus Mu50
aucauuauaaaau

SEQ ID NO: 2035530 - RNA, 14 nt, Staphylococcus aureus subsp. aureus Mu50
aucauuauaaaaug

SEQ ID NO: 2035531 - RNA, 23 nt, Staphylococcus aureus subsp. aureus Mu50
aucauucaaacuccuuucuaaga

SEQ ID NO: 2035532 - RNA, 22 nt, Staphylococcus aureus subsp. aureus Mu50
aucauggucaacuuuuuuaacu

SEQ ID NO: 2035533 - RNA, 21 nt, Staphylococcus aureus subsp. aureus Mu50
aucaugggcaguaauuuucau

SEQ ID NO: 2035534 - RNA, 22 nt, Staphylococcus aureus subsp. aureus Mu50
aucauguauauggcaucaucac

SEQ ID NO: 2035535 - RNA, 20 nt, Staphylococcus aureus subsp. aureus Mu50
aucauuucuguuccaauccc

SEQ ID NO: 2035536 - RNA, 22 nt, Staphylococcus aureus subsp. aureus Mu50
aucauuuucauuuaauccuucu

SEQ ID NO: 2035537 - RNA, 20 nt, Staphylococcus aureus subsp. aureus Mu50
auccaaggauguuauaaaau

SEQ ID NO: 2035538 - RNA, 22 nt, Staphylococcus aureus subsp. aureus Mu50
auccaauuuaauagcuuguaca

SEQ ID NO: 2035539 - RNA, 13 nt, Staphylococcus aureus subsp. aureus Mu50
aucauauauugac

SEQ ID NO: 2035540 - RNA, 18 nt, Staphylococcus aureus subsp. aureus Mu50
aucauaccaaaaaguauu

SEQ ID NO: 2035541 - RNA, 12 nt, Staphylococcus aureus subsp. aureus Mu50
aucauacguacg

SEQ ID NO: 2035542 - RNA, 18 nt, Staphylococcus aureus subsp. aureus Mu50
aucauagcauuaagauga

SEQ ID NO: 2035543 - RNA, 15 nt, Staphylococcus aureus subsp. aureus Mu50
aucauagacaauguu

SEQ ID NO: 2035544 - RNA, 15 nt, Staphylococcus aureus subsp. aureus Mu50
aucaguuaauaauuu

SEQ ID NO: 2035545 - RNA, 16 nt, Staphylococcus aureus subsp. aureus Mu50
aucaguuuuuaaauca

SEQ ID NO: 2035546 - RNA, 21 nt, Staphylococcus aureus subsp. aureus Mu50
aucauaaauguuauuaaccau

SEQ ID NO: 2035547 - RNA, 21 nt, Staphylococcus aureus subsp. aureus Mu50
aucaguuuccgcacaagcauc

SEQ ID NO: 2035548 - RNA, 23 nt, Staphylococcus aureus subsp. aureus Mu50
aucaguuuccgcacaagcaucua

SEQ ID NO: 2035549 - RNA, 19 nt, Staphylococcus aureus subsp. aureus Mu50
aucaguuugcacuucaaaa

SEQ ID NO: 2035550 - RNA, 13 nt, Staphylococcus aureus subsp. aureus Mu50
aucaguaguuuua

SEQ ID NO: 2035551 - RNA, 15 nt, Staphylococcus aureus subsp. aureus Mu50
auauugauagcaccg

SEQ ID NO: 2035552 - RNA, 22 nt, Staphylococcus aureus subsp. aureus Mu50
auauuuaaaaaauacuaagauu

SEQ ID NO: 2035553 - RNA, 16 nt, Staphylococcus aureus subsp. aureus Mu50
auauuggacuuugcug

SEQ ID NO: 2035554 - RNA, 16 nt, Staphylococcus aureus subsp. aureus Mu50
auauuguuaaaauuug

SEQ ID NO: 2035555 - RNA, 18 nt, Staphylococcus aureus subsp. aureus Mu50
auauuguuaaaauuugaa

SEQ ID NO: 2035556 - RNA, 14 nt, Staphylococcus aureus subsp. aureus Mu50
auauuguuaaguag

SEQ ID NO: 2035557 - RNA, 15 nt, Staphylococcus aureus subsp. aureus Mu50
aucagcuuuuucauu

SEQ ID NO: 2035558 - RNA, 20 nt, Staphylococcus aureus subsp. aureus Mu50
aucccucuaucaaauuacca

SEQ ID NO: 2035559 - RNA, 12 nt, Staphylococcus aureus subsp. aureus Mu50
auccaucuacac

SEQ ID NO: 2035560 - RNA, 14 nt, Staphylococcus aureus subsp. aureus Mu50
auccauucaauguu

SEQ ID NO: 2035561 - RNA, 15 nt, Staphylococcus aureus subsp. aureus Mu50
auccauucaauguuu

SEQ ID NO: 2035562 - RNA, 14 nt, Staphylococcus aureus subsp. aureus Mu50
auccauaaggauuu

SEQ ID NO: 2035563 - RNA, 23 nt, Staphylococcus aureus subsp. aureus Mu50
auccccauuuauguguuggcuuu

SEQ ID NO: 2035564 - RNA, 22 nt, Staphylococcus aureus subsp. aureus Mu50
aucccauaccuacaaauaugua

SEQ ID NO: 2035565 - RNA, 18 nt, Staphylococcus aureus subsp. aureus Mu50
auuuaccgucauuauauu

SEQ ID NO: 2035566 - RNA, 19 nt, Staphylococcus aureus subsp. aureus Mu50
auuuacuccuuacaauaaa

SEQ ID NO: 2035567 - RNA, 15 nt, Staphylococcus aureus subsp. aureus Mu50
auuuagauaaaaauu

SEQ ID NO: 2035568 - RNA, 23 nt, Staphylococcus aureus subsp. aureus Mu50
auuuagauacugaauuuuaacua

SEQ ID NO: 2035569 - RNA, 13 nt, Staphylococcus aureus subsp. aureus Mu50
auuuaauuuuuaa

SEQ ID NO: 2035570 - RNA, 20 nt, Staphylococcus aureus subsp. aureus Mu50
auuuacacacaugauaauuu

SEQ ID NO: 2035571 - RNA, 19 nt, Staphylococcus aureus subsp. aureus Mu50
auuuaauacuuuucucgau

SEQ ID NO: 2035572 - RNA, 23 nt, Staphylococcus aureus subsp. aureus Mu50
auuuaauaggcuauguaaaucgu

SEQ ID NO: 2035573 - RNA, 12 nt, Staphylococcus aureus subsp. aureus Mu50
auuuaacuaauc

SEQ ID NO: 2035574 - RNA, 14 nt, Staphylococcus aureus subsp. aureus Mu50
auuuaccuucuucu

SEQ ID NO: 2035575 - RNA, 15 nt, Staphylococcus aureus subsp. aureus Mu50
auuuaccuucuucua

SEQ ID NO: 2035576 - RNA, 19 nt, Staphylococcus aureus subsp. aureus Mu50
auuuaccuuugucuuuuuu

SEQ ID NO: 2035577 - RNA, 16 nt, Staphylococcus aureus subsp. aureus Mu50
auuuacccauuacauu

SEQ ID NO: 2035578 - RNA, 14 nt, Staphylococcus aureus subsp. aureus Mu50
auuuauaacuuuaa

SEQ ID NO: 2035579 - RNA, 14 nt, Staphylococcus aureus subsp. aureus Mu50
auuuauacuaaauu

SEQ ID NO: 2035580 - RNA, 15 nt, Staphylococcus aureus subsp. aureus Mu50
auuuauacuauaaau

SEQ ID NO: 2035581 - RNA, 19 nt, Staphylococcus aureus subsp. aureus Mu50
auuuaggaguauccugauu

SEQ ID NO: 2035582 - RNA, 14 nt, Staphylococcus aureus subsp. aureus Mu50
auuuagcaaauauu

SEQ ID NO: 2035583 - RNA, 17 nt, Staphylococcus aureus subsp. aureus Mu50
auuuagcaucaaaaaua

SEQ ID NO: 2035584 - RNA, 15 nt, Staphylococcus aureus subsp. aureus Mu50
auuuaguccuucuuu

SEQ ID NO: 2035585 - RNA, 17 nt, Staphylococcus aureus subsp. aureus Mu50
auuuaggcaugucaaau

SEQ ID NO: 2035586 - RNA, 21 nt, Staphylococcus aureus subsp. aureus Mu50
auuuaguuuuuuuaaaguuua

SEQ ID NO: 2035587 - RNA, 13 nt, Staphylococcus aureus subsp. aureus Mu50
auucccacucaau

SEQ ID NO: 2035588 - RNA, 13 nt, Staphylococcus aureus subsp. aureus Mu50
auuuaaauuuuaa

SEQ ID NO: 2035589 - RNA, 15 nt, Staphylococcus aureus subsp. aureus Mu50
auuuaacaucaauua

SEQ ID NO: 2035590 - RNA, 20 nt, Staphylococcus aureus subsp. aureus Mu50
auuuaacggaaauacaauga

SEQ ID NO: 2035591 - RNA, 19 nt, Staphylococcus aureus subsp. aureus Mu50
auuuaauaucacgaucuuu

SEQ ID NO: 2035592 - RNA, 23 nt, Staphylococcus aureus subsp. aureus Mu50
auuuaauggucuaauaucaauuu

SEQ ID NO: 2035593 - RNA, 16 nt, Staphylococcus aureus subsp. aureus Mu50
auuuaauuauuucucu

SEQ ID NO: 2035594 - RNA, 16 nt, Staphylococcus aureus subsp. aureus Mu50
auuucaguucaucaua

SEQ ID NO: 2035595 - RNA, 21 nt, Staphylococcus aureus subsp. aureus Mu50
auuucauaaaguuuauuuaug

SEQ ID NO: 2035596 - RNA, 21 nt, Staphylococcus aureus subsp. aureus Mu50
auuucaucaaauccaaaaucu

SEQ ID NO: 2035597 - RNA, 21 nt, Staphylococcus aureus subsp. aureus Mu50
auuucacgcugaaauuuuuua

SEQ ID NO: 2035598 - RNA, 16 nt, Staphylococcus aureus subsp. aureus Mu50
auuucaguaccauguu

SEQ ID NO: 2035599 - RNA, 22 nt, Staphylococcus aureus subsp. aureus Mu50
auuucaguaucauguucuuaua

SEQ ID NO: 2035600 - RNA, 13 nt, Staphylococcus aureus subsp. aureus Mu50
auuucaucaauaa

SEQ ID NO: 2035601 - RNA, 15 nt, Staphylococcus aureus subsp. aureus Mu50
auuucaccgcuuuca

SEQ ID NO: 2035602 - RNA, 22 nt, Staphylococcus aureus subsp. aureus Mu50
auuucaccgcuuucaaucgcuu

SEQ ID NO: 2035603 - RNA, 15 nt, Staphylococcus aureus subsp. aureus Mu50
auuuauuuuuauaug

SEQ ID NO: 2035604 - RNA, 14 nt, Staphylococcus aureus subsp. aureus Mu50
auuucaaaaauagc

SEQ ID NO: 2035605 - RNA, 15 nt, Staphylococcus aureus subsp. aureus Mu50
auuuauuuuauaaua

SEQ ID NO: 2035606 - RNA, 17 nt, Staphylococcus aureus subsp. aureus Mu50
auuuauuuuauaauaac

SEQ ID NO: 2035607 - RNA, 15 nt, Staphylococcus aureus subsp. aureus Mu50
auuucaacuuuuuaa

SEQ ID NO: 2035608 - RNA, 17 nt, Staphylococcus aureus subsp. aureus Mu50
auuucaaauaagaaugu

SEQ ID NO: 2035609 - RNA, 14 nt, Staphylococcus aureus subsp. aureus Mu50
auuuauucauaacg

SEQ ID NO: 2035610 - RNA, 16 nt, Staphylococcus aureus subsp. aureus Mu50
auuucaagguauacac

SEQ ID NO: 2035611 - RNA, 14 nt, Staphylococcus aureus subsp. aureus Mu50
auuuauuaauccau

SEQ ID NO: 2035612 - RNA, 14 nt, Staphylococcus aureus subsp. aureus Mu50
auuuauuauaaaau

SEQ ID NO: 2035613 - RNA, 22 nt, Staphylococcus aureus subsp. aureus Mu50
auuuaugguguagcugaggauu

SEQ ID NO: 2035614 - RNA, 15 nt, Staphylococcus aureus subsp. aureus Mu50
auuuauuuaaucgua

SEQ ID NO: 2035615 - RNA, 17 nt, Staphylococcus aureus subsp. aureus Mu50
auuuauuauuaacugua

SEQ ID NO: 2035616 - RNA, 15 nt, Staphylococcus aureus subsp. aureus Mu50
auuuauuauuaccau

SEQ ID NO: 2035617 - RNA, 20 nt, Staphylococcus aureus subsp. aureus Mu50
auuuaucagcgaaauuugua

SEQ ID NO: 2035618 - RNA, 12 nt, Staphylococcus aureus subsp. aureus Mu50
auuuaucauuau

SEQ ID NO: 2035619 - RNA, 13 nt, Staphylococcus aureus subsp. aureus Mu50
auuuaucuuuuaa

SEQ ID NO: 2035620 - RNA, 16 nt, Staphylococcus aureus subsp. aureus Mu50
auuuaucuuuuaaaau

SEQ ID NO: 2035621 - RNA, 17 nt, Staphylococcus aureus subsp. aureus Mu50
auuuaucuuuuaaaauc

SEQ ID NO: 2035622 - RNA, 15 nt, Staphylococcus aureus subsp. aureus Mu50
auuucuacucgaaac

SEQ ID NO: 2035623 - RNA, 15 nt, Staphylococcus aureus subsp. aureus Mu50
auuucgguauuuuaa

SEQ ID NO: 2035624 - RNA, 16 nt, Staphylococcus aureus subsp. aureus Mu50
auuucgacaucuagau

SEQ ID NO: 2035625 - RNA, 18 nt, Staphylococcus aureus subsp. aureus Mu50
auuucgauaccuaaaaua

SEQ ID NO: 2035626 - RNA, 15 nt, Staphylococcus aureus subsp. aureus Mu50
auuuccuuaauaugc

SEQ ID NO: 2035627 - RNA, 21 nt, Staphylococcus aureus subsp. aureus Mu50
auuucgauugcguuuucuaau

SEQ ID NO: 2035628 - RNA, 19 nt, Staphylococcus aureus subsp. aureus Mu50
auuucgcccaccgcguguu

SEQ ID NO: 2035629 - RNA, 17 nt, Staphylococcus aureus subsp. aureus Mu50
auuucuucauuaucaau

SEQ ID NO: 2035630 - RNA, 19 nt, Staphylococcus aureus subsp. aureus Mu50
auuucuucuccuucaaugu

SEQ ID NO: 2035631 - RNA, 13 nt, Staphylococcus aureus subsp. aureus Mu50
auuucugucccac

SEQ ID NO: 2035632 - RNA, 23 nt, Staphylococcus aureus subsp. aureus Mu50
auuucuuagauuuuauauaaaaa

SEQ ID NO: 2035633 - RNA, 21 nt, Staphylococcus aureus subsp. aureus Mu50
auuugaauaagugguuguucc

SEQ ID NO: 2035634 - RNA, 20 nt, Staphylococcus aureus subsp. aureus Mu50
auuugacacauuauugaaau

SEQ ID NO: 2035635 - RNA, 13 nt, Staphylococcus aureus subsp. aureus Mu50
auuucuuuuuaaa

SEQ ID NO: 2035636 - RNA, 15 nt, Staphylococcus aureus subsp. aureus Mu50
auuucuuuuuaaaau

SEQ ID NO: 2035637 - RNA, 17 nt, Staphylococcus aureus subsp. aureus Mu50
auuucuuuuuaaaaucg

SEQ ID NO: 2035638 - RNA, 19 nt, Staphylococcus aureus subsp. aureus Mu50
auuucuuuuuaaaaucguu

SEQ ID NO: 2035639 - RNA, 21 nt, Staphylococcus aureus subsp. aureus Mu50
auuucuuuuuaaaaucguuaa

SEQ ID NO: 2035640 - RNA, 15 nt, Staphylococcus aureus subsp. aureus Mu50
auuucugcuucuuuu

SEQ ID NO: 2035641 - RNA, 23 nt, Staphylococcus aureus subsp. aureus Mu50
auuucugaaaugauacauuauua

SEQ ID NO: 2035642 - RNA, 19 nt, Staphylococcus aureus subsp. aureus Mu50
auuucugaacauaaaaaau

SEQ ID NO: 2035643 - RNA, 14 nt, Staphylococcus aureus subsp. aureus Mu50
auuucugaauuuuu

SEQ ID NO: 2035644 - RNA, 17 nt, Staphylococcus aureus subsp. aureus Mu50
auuucugaauuuuucaa

SEQ ID NO: 2035645 - RNA, 23 nt, Staphylococcus aureus subsp. aureus Mu50
auuucucauacuauaagcaauuu

SEQ ID NO: 2035646 - RNA, 14 nt, Staphylococcus aureus subsp. aureus Mu50
auuucuaucaaaua

SEQ ID NO: 2035647 - RNA, 13 nt, Staphylococcus aureus subsp. aureus Mu50
auuuguuuuaaau

SEQ ID NO: 2035648 - RNA, 18 nt, Staphylococcus aureus subsp. aureus Mu50
auuuuaaacguaucauuu

SEQ ID NO: 2035649 - RNA, 23 nt, Staphylococcus aureus subsp. aureus Mu50
auuuuaaacguaucauuuaaaau

SEQ ID NO: 2035650 - RNA, 21 nt, Staphylococcus aureus subsp. aureus Mu50
auuuuaaaaaaugaugcacua

SEQ ID NO: 2035651 - RNA, 18 nt, Staphylococcus aureus subsp. aureus Mu50
auuuuaauaaaaucaucu

SEQ ID NO: 2035652 - RNA, 22 nt, Staphylococcus aureus subsp. aureus Mu50
auuuuaaauauugauauaaaaa

SEQ ID NO: 2035653 - RNA, 14 nt, Staphylococcus aureus subsp. aureus Mu50
auuuuaaauuacaa

SEQ ID NO: 2035654 - RNA, 15 nt, Staphylococcus aureus subsp. aureus Mu50
auuuuaaauuuauaa

SEQ ID NO: 2035655 - RNA, 17 nt, Staphylococcus aureus subsp. aureus Mu50
auuuuaaauuuauaaua

SEQ ID NO: 2035656 - RNA, 23 nt, Staphylococcus aureus subsp. aureus Mu50
auuuuaccuugagcagcaucaau

SEQ ID NO: 2035657 - RNA, 13 nt, Staphylococcus aureus subsp. aureus Mu50
auuuuaauaacga

SEQ ID NO: 2035658 - RNA, 14 nt, Staphylococcus aureus subsp. aureus Mu50
auuuguuacuucua

SEQ ID NO: 2035659 - RNA, 15 nt, Staphylococcus aureus subsp. aureus Mu50
auuuguuacuucuaa

SEQ ID NO: 2035660 - RNA, 21 nt, Staphylococcus aureus subsp. aureus Mu50
auuuguguucaaaucacaagu

SEQ ID NO: 2035661 - RNA, 16 nt, Staphylococcus aureus subsp. aureus Mu50
auuugugcguuucaau

SEQ ID NO: 2035662 - RNA, 20 nt, Staphylococcus aureus subsp. aureus Mu50
auuugucaucguauuucuag

SEQ ID NO: 2035663 - RNA, 16 nt, Staphylococcus aureus subsp. aureus Mu50
auuuguaaacaguaug

SEQ ID NO: 2035664 - RNA, 21 nt, Staphylococcus aureus subsp. aureus Mu50
auuugguucuucuaucuuuuc

SEQ ID NO: 2035665 - RNA, 15 nt, Staphylococcus aureus subsp. aureus Mu50
auuugguugaacugu

SEQ ID NO: 2035666 - RNA, 19 nt, Staphylococcus aureus subsp. aureus Mu50
auuuguaaucccauuuuaa

SEQ ID NO: 2035667 - RNA, 14 nt, Staphylococcus aureus subsp. aureus Mu50
auuuguaccaaaua

SEQ ID NO: 2035668 - RNA, 15 nt, Staphylococcus aureus subsp. aureus Mu50
auuugccuuuuuuau

SEQ ID NO: 2035669 - RNA, 17 nt, Staphylococcus aureus subsp. aureus Mu50
auuugcuagucauaauu

SEQ ID NO: 2035670 - RNA, 18 nt, Staphylococcus aureus subsp. aureus Mu50
auuugcuagucauaauuu

SEQ ID NO: 2035671 - RNA, 22 nt, Staphylococcus aureus subsp. aureus Mu50
auuugcuagucauaauuuaaaa

SEQ ID NO: 2035672 - RNA, 19 nt, Staphylococcus aureus subsp. aureus Mu50
auuuggauauuuauuuuaa

SEQ ID NO: 2035673 - RNA, 20 nt, Staphylococcus aureus subsp. aureus Mu50
auuuggcucuauaucaaauu

SEQ ID NO: 2035674 - RNA, 20 nt, Staphylococcus aureus subsp. aureus Mu50
auuugggucguuagaugaau

SEQ ID NO: 2035675 - RNA, 15 nt, Staphylococcus aureus subsp. aureus Mu50
auuugguacauaaua

SEQ ID NO: 2035676 - RNA, 21 nt, Staphylococcus aureus subsp. aureus Mu50
auuugguggagaaccaaaauu

SEQ ID NO: 2035677 - RNA, 22 nt, Staphylococcus aureus subsp. aureus Mu50
auuugguggagaaccaaaauua

SEQ ID NO: 2035678 - RNA, 17 nt, Staphylococcus aureus subsp. aureus Mu50
auuugauaaauaaaauu

SEQ ID NO: 2035679 - RNA, 21 nt, Staphylococcus aureus subsp. aureus Mu50
auuugaucaaccuguucuuua

SEQ ID NO: 2035680 - RNA, 21 nt, Staphylococcus aureus subsp. aureus Mu50
auuucuguuuacgccauaaga

SEQ ID NO: 2035681 - RNA, 15 nt, Staphylococcus aureus subsp. aureus Mu50
auuugagaaaugaaa

SEQ ID NO: 2035682 - RNA, 20 nt, Staphylococcus aureus subsp. aureus Mu50
auuugagaaccacuauaauu

SEQ ID NO: 2035683 - RNA, 19 nt, Staphylococcus aureus subsp. aureus Mu50
auuugcacaaagauauguu

SEQ ID NO: 2035684 - RNA, 17 nt, Staphylococcus aureus subsp. aureus Mu50
auuuucauguccaucuu

SEQ ID NO: 2035685 - RNA, 17 nt, Staphylococcus aureus subsp. aureus Mu50
auuuucaaguuuaaaau

SEQ ID NO: 2035686 - RNA, 21 nt, Staphylococcus aureus subsp. aureus Mu50
auuuucaacacacuauuauag

SEQ ID NO: 2035687 - RNA, 19 nt, Staphylococcus aureus subsp. aureus Mu50
auuuucaagaccaaauauu

SEQ ID NO: 2035688 - RNA, 13 nt, Staphylococcus aureus subsp. aureus Mu50
auuuuauucuuca

SEQ ID NO: 2035689 - RNA, 18 nt, Staphylococcus aureus subsp. aureus Mu50
auuuuauuuaauuccauu

SEQ ID NO: 2035690 - RNA, 23 nt, Staphylococcus aureus subsp. aureus Mu50
auuuuaauuaauuauuauauaau

SEQ ID NO: 2035691 - RNA, 18 nt, Staphylococcus aureus subsp. aureus Mu50
auuuuauuauuaaucguu

SEQ ID NO: 2035692 - RNA, 19 nt, Staphylococcus aureus subsp. aureus Mu50
auuuuauuuuaacuuaauu

SEQ ID NO: 2035693 - RNA, 15 nt, Staphylococcus aureus subsp. aureus Mu50
auuuuaugcacuuuu

SEQ ID NO: 2035694 - RNA, 18 nt, Staphylococcus aureus subsp. aureus Mu50
auuuuaucugaaucugcu

SEQ ID NO: 2035695 - RNA, 13 nt, Staphylococcus aureus subsp. aureus Mu50
auuuuaucugaau

SEQ ID NO: 2035696 - RNA, 18 nt, Staphylococcus aureus subsp. aureus Mu50
auuuuaucaaauucauca

SEQ ID NO: 2035697 - RNA, 16 nt, Staphylococcus aureus subsp. aureus Mu50
auuuuaggcaauguaa

SEQ ID NO: 2035698 - RNA, 18 nt, Staphylococcus aureus subsp. aureus Mu50
auuuuauaaguauauaau

SEQ ID NO: 2035699 - RNA, 13 nt, Staphylococcus aureus subsp. aureus Mu50
auuuuacucugua

SEQ ID NO: 2035700 - RNA, 19 nt, Staphylococcus aureus subsp. aureus Mu50
auuuuacucuguauggaug

SEQ ID NO: 2035701 - RNA, 17 nt, Staphylococcus aureus subsp. aureus Mu50
auuuuacuuacuuuucu

SEQ ID NO: 2035702 - RNA, 18 nt, Staphylococcus aureus subsp. aureus Mu50
auuuuacuuacuuuucua

SEQ ID NO: 2035703 - RNA, 16 nt, Staphylococcus aureus subsp. aureus Mu50
auuuugcucuaaacuu

SEQ ID NO: 2035704 - RNA, 20 nt, Staphylococcus aureus subsp. aureus Mu50
auuuuggcacauaaaucaau

SEQ ID NO: 2035705 - RNA, 17 nt, Staphylococcus aureus subsp. aureus Mu50
auuuuggcuuaauagag

SEQ ID NO: 2035706 - RNA, 14 nt, Staphylococcus aureus subsp. aureus Mu50
auuuugcaacauua

SEQ ID NO: 2035707 - RNA, 16 nt, Staphylococcus aureus subsp. aureus Mu50
auuuucucuauaauuu

SEQ ID NO: 2035708 - RNA, 15 nt, Staphylococcus aureus subsp. aureus Mu50
auuuucuuuuucuaa

SEQ ID NO: 2035709 - RNA, 13 nt, Staphylococcus aureus subsp. aureus Mu50
auuuucuuuuuua

SEQ ID NO: 2035710 - RNA, 17 nt, Staphylococcus aureus subsp. aureus Mu50
auuuugaaucacauuaa

SEQ ID NO: 2035711 - RNA, 21 nt, Staphylococcus aureus subsp. aureus Mu50
auuuucuguugcaguuucaau

SEQ ID NO: 2035712 - RNA, 23 nt, Staphylococcus aureus subsp. aureus Mu50
auuuucuguugcaguuucaaucg

SEQ ID NO: 2035713 - RNA, 20 nt, Staphylococcus aureus subsp. aureus Mu50
auuuucuguuuaauuaaaau

SEQ ID NO: 2035714 - RNA, 12 nt, Staphylococcus aureus subsp. aureus Mu50
auuuuuaauaau

SEQ ID NO: 2035715 - RNA, 22 nt, Staphylococcus aureus subsp. aureus Mu50
auuuuuaacagcgugaauauaa

SEQ ID NO: 2035716 - RNA, 15 nt, Staphylococcus aureus subsp. aureus Mu50
auuuuuaagcugcuc

SEQ ID NO: 2035717 - RNA, 13 nt, Staphylococcus aureus subsp. aureus Mu50
auuuuguuucaaa

SEQ ID NO: 2035718 - RNA, 15 nt, Staphylococcus aureus subsp. aureus Mu50
auuuuguuucaacau

SEQ ID NO: 2035719 - RNA, 14 nt, Staphylococcus aureus subsp. aureus Mu50
auuuuguuuuaaaa

SEQ ID NO: 2035720 - RNA, 12 nt, Staphylococcus aureus subsp. aureus Mu50
auuuuuauaaau

SEQ ID NO: 2035721 - RNA, 14 nt, Staphylococcus aureus subsp. aureus Mu50
auuuuuauaaauuu

SEQ ID NO: 2035722 - RNA, 14 nt, Staphylococcus aureus subsp. aureus Mu50
auuuuuaauaauuu

SEQ ID NO: 2035723 - RNA, 22 nt, Staphylococcus aureus subsp. aureus Mu50
auuuuuaauguauucuucuaau

SEQ ID NO: 2035724 - RNA, 15 nt, Staphylococcus aureus subsp. aureus Mu50
caaaaaaagcugauu

SEQ ID NO: 2035725 - RNA, 19 nt, Staphylococcus aureus subsp. aureus Mu50
caaaaacgguaauuucuau

SEQ ID NO: 2035726 - RNA, 19 nt, Staphylococcus aureus subsp. aureus Mu50
caaaaagacuuccaauaac

SEQ ID NO: 2035727 - RNA, 20 nt, Staphylococcus aureus subsp. aureus Mu50
caaaaagguauucaaauaaa

SEQ ID NO: 2035728 - RNA, 14 nt, Staphylococcus aureus subsp. aureus Mu50
caaaaauaaaccau

SEQ ID NO: 2035729 - RNA, 21 nt, Staphylococcus aureus subsp. aureus Mu50
caaaaauaaucaguauuuacu

SEQ ID NO: 2035730 - RNA, 21 nt, Staphylococcus aureus subsp. aureus Mu50
auuuuuugguuucuauaaaga

SEQ ID NO: 2035731 - RNA, 22 nt, Staphylococcus aureus subsp. aureus Mu50
auuuuuguaauacaucuaauaa

SEQ ID NO: 2035732 - RNA, 13 nt, Staphylococcus aureus subsp. aureus Mu50
auuuuuucaaugu

SEQ ID NO: 2035733 - RNA, 17 nt, Staphylococcus aureus subsp. aureus Mu50
auuuuucauauuuuuua

SEQ ID NO: 2035734 - RNA, 15 nt, Staphylococcus aureus subsp. aureus Mu50
auuuuucaucaauau

SEQ ID NO: 2035735 - RNA, 20 nt, Staphylococcus aureus subsp. aureus Mu50
auuuuucaucaauaucaaau

SEQ ID NO: 2035736 - RNA, 14 nt, Staphylococcus aureus subsp. aureus Mu50
auuuuucaaauguu

SEQ ID NO: 2035737 - RNA, 16 nt, Staphylococcus aureus subsp. aureus Mu50
auuuuucuaaaugauu

SEQ ID NO: 2035738 - RNA, 18 nt, Staphylococcus aureus subsp. aureus Mu50
auuuuucucaacaguuuc

SEQ ID NO: 2035739 - RNA, 17 nt, Staphylococcus aureus subsp. aureus Mu50
auuuuucuucuuuuuua

SEQ ID NO: 2035740 - RNA, 14 nt, Staphylococcus aureus subsp. aureus Mu50
auuuuugggaagaa

SEQ ID NO: 2035741 - RNA, 19 nt, Staphylococcus aureus subsp. aureus Mu50
auuuuugcguuaauaauuu

SEQ ID NO: 2035742 - RNA, 13 nt, Staphylococcus aureus subsp. aureus Mu50
caaacauaaauaa

SEQ ID NO: 2035743 - RNA, 16 nt, Staphylococcus aureus subsp. aureus Mu50
caaagcgaauuaucuu

SEQ ID NO: 2035744 - RNA, 13 nt, Staphylococcus aureus subsp. aureus Mu50
caaaacauauuca

SEQ ID NO: 2035745 - RNA, 18 nt, Staphylococcus aureus subsp. aureus Mu50
caaaacauauucaguaua

SEQ ID NO: 2035746 - RNA, 21 nt, Staphylococcus aureus subsp. aureus Mu50
caaaacaccucgauauuaugu

SEQ ID NO: 2035747 - RNA, 14 nt, Staphylococcus aureus subsp. aureus Mu50
caaaaccaauuaau

SEQ ID NO: 2035748 - RNA, 18 nt, Staphylococcus aureus subsp. aureus Mu50
caaaagaaaguuaauuau

SEQ ID NO: 2035749 - RNA, 19 nt, Staphylococcus aureus subsp. aureus Mu50
caaaaucaacccaucaugu

SEQ ID NO: 2035750 - RNA, 18 nt, Staphylococcus aureus subsp. aureus Mu50
caaaauauggaauuucau

SEQ ID NO: 2035751 - RNA, 16 nt, Staphylococcus aureus subsp. aureus Mu50
caagauuaugacaaca

SEQ ID NO: 2035752 - RNA, 18 nt, Staphylococcus aureus subsp. aureus Mu50
caagccaagauaaaucau

SEQ ID NO: 2035753 - RNA, 12 nt, Staphylococcus aureus subsp. aureus Mu50
caagcaucauug

SEQ ID NO: 2035754 - RNA, 14 nt, Staphylococcus aureus subsp. aureus Mu50
caagcauaccuaca

SEQ ID NO: 2035755 - RNA, 20 nt, Staphylococcus aureus subsp. aureus Mu50
caagcuaucguuuauugaua

SEQ ID NO: 2035756 - RNA, 18 nt, Staphylococcus aureus subsp. aureus Mu50
caacugaucauuuucauu

SEQ ID NO: 2035757 - RNA, 18 nt, Staphylococcus aureus subsp. aureus Mu50
caacugcauauaaaguca

SEQ ID NO: 2035758 - RNA, 21 nt, Staphylococcus aureus subsp. aureus Mu50
caagaagacauuggauuacuu

SEQ ID NO: 2035759 - RNA, 18 nt, Staphylococcus aureus subsp. aureus Mu50
caagaaauacucaguuua

SEQ ID NO: 2035760 - RNA, 17 nt, Staphylococcus aureus subsp. aureus Mu50
caacuuuacgauaaaua

SEQ ID NO: 2035761 - RNA, 21 nt, Staphylococcus aureus subsp. aureus Mu50
caacuuuuuguuaauuuuuua

SEQ ID NO: 2035762 - RNA, 18 nt, Staphylococcus aureus subsp. aureus Mu50
caagaaugugaugauuaa

SEQ ID NO: 2035763 - RNA, 20 nt, Staphylococcus aureus subsp. aureus Mu50
caagaaugugaugauuaauc

SEQ ID NO: 2035764 - RNA, 13 nt, Staphylococcus aureus subsp. aureus Mu50
caacuuauuauuu

SEQ ID NO: 2035765 - RNA, 15 nt, Staphylococcus aureus subsp. aureus Mu50
caacuugaacuaaaa

SEQ ID NO: 2035766 - RNA, 19 nt, Staphylococcus aureus subsp. aureus Mu50
caacuucuucuccguauuu

SEQ ID NO: 2035767 - RNA, 14 nt, Staphylococcus aureus subsp. aureus Mu50
caaccauauuuuua

SEQ ID NO: 2035768 - RNA, 14 nt, Staphylococcus aureus subsp. aureus Mu50
caacaucuuuuguu

SEQ ID NO: 2035769 - RNA, 23 nt, Staphylococcus aureus subsp. aureus Mu50
caacaguauuugccuuuugaaua

SEQ ID NO: 2035770 - RNA, 21 nt, Staphylococcus aureus subsp. aureus Mu50
caaaguucguaauugucuuua

SEQ ID NO: 2035771 - RNA, 20 nt, Staphylococcus aureus subsp. aureus Mu50
caaaguacucaaguaaucaa

SEQ ID NO: 2035772 - RNA, 18 nt, Staphylococcus aureus subsp. aureus Mu50
caaaguagacauugaaua

SEQ ID NO: 2035773 - RNA, 16 nt, Staphylococcus aureus subsp. aureus Mu50
caaaguagauauugaa

SEQ ID NO: 2035774 - RNA, 16 nt, Staphylococcus aureus subsp. aureus Mu50
caaaguuuaauugcug

SEQ ID NO: 2035775 - RNA, 18 nt, Staphylococcus aureus subsp. aureus Mu50
caaauaaaaaaguuaucu

SEQ ID NO: 2035776 - RNA, 19 nt, Staphylococcus aureus subsp. aureus Mu50
caaauaaauaagugauaaa

SEQ ID NO: 2035777 - RNA, 19 nt, Staphylococcus aureus subsp. aureus Mu50
caaauaacguuaauauaau

SEQ ID NO: 2035778 - RNA, 20 nt, Staphylococcus aureus subsp. aureus Mu50
caaauaacguuaauauaauu

SEQ ID NO: 2035779 - RNA, 18 nt, Staphylococcus aureus subsp. aureus Mu50
caaauaaaacgcuucaua

SEQ ID NO: 2035780 - RNA, 13 nt, Staphylococcus aureus subsp. aureus Mu50
caaauaacaaaca

SEQ ID NO: 2035781 - RNA, 16 nt, Staphylococcus aureus subsp. aureus Mu50
caacacguuguuguug

SEQ ID NO: 2035782 - RNA, 22 nt, Staphylococcus aureus subsp. aureus Mu50
caacacguuguuguugaccacc

SEQ ID NO: 2035783 - RNA, 18 nt, Staphylococcus aureus subsp. aureus Mu50
caccccaacuugcauugu

SEQ ID NO: 2035784 - RNA, 14 nt, Staphylococcus aureus subsp. aureus Mu50
cacccaaauuuagg

SEQ ID NO: 2035785 - RNA, 21 nt, Staphylococcus aureus subsp. aureus Mu50
caccaguauaaccauguauau

SEQ ID NO: 2035786 - RNA, 21 nt, Staphylococcus aureus subsp. aureus Mu50
caccaucaacgccauauuuau

SEQ ID NO: 2035787 - RNA, 22 nt, Staphylococcus aureus subsp. aureus Mu50
caccaucuguaacuaauaugau

SEQ ID NO: 2035788 - RNA, 14 nt, Staphylococcus aureus subsp. aureus Mu50
caaugcuaucaugc

SEQ ID NO: 2035789 - RNA, 13 nt, Staphylococcus aureus subsp. aureus Mu50
caauuagaaaauu

SEQ ID NO: 2035790 - RNA, 24 nt, Staphylococcus aureus subsp. aureus Mu50
caauuacucuuuuucuuucauaau

SEQ ID NO: 2035791 - RNA, 12 nt, Staphylococcus aureus subsp. aureus Mu50
caauuaauugua

SEQ ID NO: 2035792 - RNA, 20 nt, Staphylococcus aureus subsp. aureus Mu50
caauuaauuuagucauuaca

SEQ ID NO: 2035793 - RNA, 18 nt, Staphylococcus aureus subsp. aureus Mu50
caauuaccaaugaauaaa

SEQ ID NO: 2035794 - RNA, 13 nt, Staphylococcus aureus subsp. aureus Mu50
caauuaaaucgau

SEQ ID NO: 2035795 - RNA, 21 nt, Staphylococcus aureus subsp. aureus Mu50
caauuaaucggaucauuauuu

SEQ ID NO: 2035796 - RNA, 14 nt, Staphylococcus aureus subsp. aureus Mu50
caauuaauaaacac

SEQ ID NO: 2035797 - RNA, 13 nt, Staphylococcus aureus subsp. aureus Mu50
caauguugcuugu

SEQ ID NO: 2035798 - RNA, 17 nt, Staphylococcus aureus subsp. aureus Mu50
caauuaaaacuauaaua

SEQ ID NO: 2035799 - RNA, 23 nt, Staphylococcus aureus subsp. aureus Mu50
caauuaaaauuuguuaauuuaau

SEQ ID NO: 2035800 - RNA, 18 nt, Staphylococcus aureus subsp. aureus Mu50
caauuauugaaaacaaaa

SEQ ID NO: 2035801 - RNA, 16 nt, Staphylococcus aureus subsp. aureus Mu50
caauuauuuuucaaau

SEQ ID NO: 2035802 - RNA, 17 nt, Staphylococcus aureus subsp. aureus Mu50
caauuaucaacauaaua

SEQ ID NO: 2035803 - RNA, 20 nt, Staphylococcus aureus subsp. aureus Mu50
caauugaaucuuuguuauau

SEQ ID NO: 2035804 - RNA, 21 nt, Staphylococcus aureus subsp. aureus Mu50
caaugauuuuauaauauuauu

SEQ ID NO: 2035805 - RNA, 14 nt, Staphylococcus aureus subsp. aureus Mu50
caaugauuuuuaaa

SEQ ID NO: 2035806 - RNA, 15 nt, Staphylococcus aureus subsp. aureus Mu50
caaugauguuacaau

SEQ ID NO: 2035807 - RNA, 21 nt, Staphylococcus aureus subsp. aureus Mu50
caaugauuacuuuaagauuau

SEQ ID NO: 2035808 - RNA, 23 nt, Staphylococcus aureus subsp. aureus Mu50
caaugauuaguaaugauuaacuu

SEQ ID NO: 2035809 - RNA, 18 nt, Staphylococcus aureus subsp. aureus Mu50
caaugacauccauacaaa

SEQ ID NO: 2035810 - RNA, 13 nt, Staphylococcus aureus subsp. aureus Mu50
caaugaauaaauu

SEQ ID NO: 2035811 - RNA, 15 nt, Staphylococcus aureus subsp. aureus Mu50
caaugauagugaaua

SEQ ID NO: 2035812 - RNA, 21 nt, Staphylococcus aureus subsp. aureus Mu50
cacagcggaauacagaugaug

SEQ ID NO: 2035813 - RNA, 22 nt, Staphylococcus aureus subsp. aureus Mu50
cacacagguaaauuuaaaauaa

SEQ ID NO: 2035814 - RNA, 23 nt, Staphylococcus aureus subsp. aureus Mu50
cacaaauuugaauauacuuaauu

SEQ ID NO: 2035815 - RNA, 16 nt, Staphylococcus aureus subsp. aureus Mu50
caauugaaugaaguaa

SEQ ID NO: 2035816 - RNA, 21 nt, Staphylococcus aureus subsp. aureus Mu50
cacaaaaaugaagaauacaaa

SEQ ID NO: 2035817 - RNA, 18 nt, Staphylococcus aureus subsp. aureus Mu50
cacaaaaagacuuccaau

SEQ ID NO: 2035818 - RNA, 15 nt, Staphylococcus aureus subsp. aureus Mu50
cacauuauugaaauu

SEQ ID NO: 2035819 - RNA, 22 nt, Staphylococcus aureus subsp. aureus Mu50
cacauucaaauaaaugacauuu

SEQ ID NO: 2035820 - RNA, 22 nt, Staphylococcus aureus subsp. aureus Mu50
caccaaauccaucuaauucaau

SEQ ID NO: 2035821 - RNA, 17 nt, Staphylococcus aureus subsp. aureus Mu50
cacauuguuuacaaagu

SEQ ID NO: 2035822 - RNA, 15 nt, Staphylococcus aureus subsp. aureus Mu50
caccaacauauuuua

SEQ ID NO: 2035823 - RNA, 16 nt, Staphylococcus aureus subsp. aureus Mu50
cacaucuuuuugauaa

SEQ ID NO: 2035824 - RNA, 17 nt, Staphylococcus aureus subsp. aureus Mu50
cacaucuuuuugauaau

SEQ ID NO: 2035825 - RNA, 20 nt, Staphylococcus aureus subsp. aureus Mu50
cacauaugucuuucuaaguu

SEQ ID NO: 2035826 - RNA, 13 nt, Staphylococcus aureus subsp. aureus Mu50
cacauaaaucaau

SEQ ID NO: 2035827 - RNA, 16 nt, Staphylococcus aureus subsp. aureus Mu50
cacauacaccuucaga

SEQ ID NO: 2035828 - RNA, 21 nt, Staphylococcus aureus subsp. aureus Mu50
aggcuuaugggggauuuuuuu

SEQ ID NO: 2035829 - RNA, 14 nt, Staphylococcus aureus subsp. aureus Mu50
aggcgcgaauuaaa

SEQ ID NO: 2035830 - RNA, 22 nt, Staphylococcus aureus subsp. aureus Mu50
agguaaacggaauaacuuuuua

SEQ ID NO: 2035831 - RNA, 13 nt, Staphylococcus aureus subsp. aureus Mu50
agguaaaucuguu

SEQ ID NO: 2035832 - RNA, 17 nt, Staphylococcus aureus subsp. aureus Mu50
agguaaccuuaaauaua

SEQ ID NO: 2035833 - RNA, 13 nt, Staphylococcus aureus subsp. aureus Mu50
agguaacuuuuua

SEQ ID NO: 2035834 - RNA, 16 nt, Staphylococcus aureus subsp. aureus Mu50
agguaaauuuaaaaua

SEQ ID NO: 2035835 - RNA, 14 nt, Staphylococcus aureus subsp. aureus Mu50
agguauaucuucau

SEQ ID NO: 2035836 - RNA, 22 nt, Staphylococcus aureus subsp. aureus Mu50
agguaucacuaggauguucauc

SEQ ID NO: 2035837 - RNA, 19 nt, Staphylococcus aureus subsp. aureus Mu50
agguaugaaauaacaauag

SEQ ID NO: 2035838 - RNA, 23 nt, Staphylococcus aureus subsp. aureus Mu50
agggcucggcaccauaucaaguu

SEQ ID NO: 2035839 - RNA, 17 nt, Staphylococcus aureus subsp. aureus Mu50
aggauaagaacgagaau

SEQ ID NO: 2035840 - RNA, 14 nt, Staphylococcus aureus subsp. aureus Mu50
aggaucuuuuccau

SEQ ID NO: 2035841 - RNA, 15 nt, Staphylococcus aureus subsp. aureus Mu50
aggaucaacugaaau

SEQ ID NO: 2035842 - RNA, 13 nt, Staphylococcus aureus subsp. aureus Mu50
aggauauuuuuua

SEQ ID NO: 2035843 - RNA, 20 nt, Staphylococcus aureus subsp. aureus Mu50
aggaucacguuuuucuuuaa

SEQ ID NO: 2035844 - RNA, 14 nt, Staphylococcus aureus subsp. aureus Mu50
aggcaggaaugaua

SEQ ID NO: 2035845 - RNA, 20 nt, Staphylococcus aureus subsp. aureus Mu50
aggcaacuuuuauuacuuau

SEQ ID NO: 2035846 - RNA, 18 nt, Staphylococcus aureus subsp. aureus Mu50
agcuguauaaccauaaug

SEQ ID NO: 2035847 - RNA, 22 nt, Staphylococcus aureus subsp. aureus Mu50
aggaaugauauaccuugauuca

SEQ ID NO: 2035848 - RNA, 19 nt, Staphylococcus aureus subsp. aureus Mu50
aggaauaauuuuaaaaaua

SEQ ID NO: 2035849 - RNA, 13 nt, Staphylococcus aureus subsp. aureus Mu50
agcuuuaauaaua

SEQ ID NO: 2035850 - RNA, 16 nt, Staphylococcus aureus subsp. aureus Mu50
agcuuuaauaauauga

SEQ ID NO: 2035851 - RNA, 16 nt, Staphylococcus aureus subsp. aureus Mu50
agcuuguaaaucacga

SEQ ID NO: 2035852 - RNA, 23 nt, Staphylococcus aureus subsp. aureus Mu50
agcuuguacacauccucauaauu

SEQ ID NO: 2035853 - RNA, 16 nt, Staphylococcus aureus subsp. aureus Mu50
agcuugcuguucaaca

SEQ ID NO: 2035854 - RNA, 16 nt, Staphylococcus aureus subsp. aureus Mu50
agcuugcuuacaauaa

SEQ ID NO: 2035855 - RNA, 21 nt, Staphylococcus aureus subsp. aureus Mu50
agcuuucguuucuuuuauauc

SEQ ID NO: 2035856 - RNA, 13 nt, Staphylococcus aureus subsp. aureus Mu50
agcuuugacauau

SEQ ID NO: 2035857 - RNA, 16 nt, Staphylococcus aureus subsp. aureus Mu50
agcuucucauugaaau

SEQ ID NO: 2035858 - RNA, 13 nt, Staphylococcus aureus subsp. aureus Mu50
agcuucuuaaauc

SEQ ID NO: 2035859 - RNA, 16 nt, Staphylococcus aureus subsp. aureus Mu50
agcuucuuaaaucaac

SEQ ID NO: 2035860 - RNA, 16 nt, Staphylococcus aureus subsp. aureus Mu50
agcuugaauaauauau

SEQ ID NO: 2035861 - RNA, 17 nt, Staphylococcus aureus subsp. aureus Mu50
agcuugaauaauauauu

SEQ ID NO: 2035862 - RNA, 20 nt, Staphylococcus aureus subsp. aureus Mu50
agcuucuuaaaucaacauca

SEQ ID NO: 2035863 - RNA, 17 nt, Staphylococcus aureus subsp. aureus Mu50
auaucaaaauauaaaau

SEQ ID NO: 2035864 - RNA, 20 nt, Staphylococcus aureus subsp. aureus Mu50
auauauucguuacaaaugaa

SEQ ID NO: 2035865 - RNA, 22 nt, Staphylococcus aureus subsp. aureus Mu50
auauauugucgacuuuuagauu

SEQ ID NO: 2035866 - RNA, 18 nt, Staphylococcus aureus subsp. aureus Mu50
auauauuuugcaauaauu

SEQ ID NO: 2035867 - RNA, 14 nt, Staphylococcus aureus subsp. aureus Mu50
auauauuuuguuaa

SEQ ID NO: 2035868 - RNA, 21 nt, Staphylococcus aureus subsp. aureus Mu50
auauaugaauugaguauuaaa

SEQ ID NO: 2035869 - RNA, 20 nt, Staphylococcus aureus subsp. aureus Mu50
auauaugcguagcaacauua

SEQ ID NO: 2035870 - RNA, 20 nt, Staphylococcus aureus subsp. aureus Mu50
auauaucaacguuaauauaa

SEQ ID NO: 2035871 - RNA, 23 nt, Staphylococcus aureus subsp. aureus Mu50
auauauccugccaauauauucac

SEQ ID NO: 2035872 - RNA, 21 nt, Staphylococcus aureus subsp. aureus Mu50
auauaguggugguacuuuuuu

SEQ ID NO: 2035873 - RNA, 22 nt, Staphylococcus aureus subsp. aureus Mu50
auauaguuaauguaaucauuau

SEQ ID NO: 2035874 - RNA, 18 nt, Staphylococcus aureus subsp. aureus Mu50
auauaguuauaugugcuu

SEQ ID NO: 2035875 - RNA, 23 nt, Staphylococcus aureus subsp. aureus Mu50
auaucggaaguuaggcaacuaaa

SEQ ID NO: 2035876 - RNA, 18 nt, Staphylococcus aureus subsp. aureus Mu50
auaucgcgcaucaaaaau

SEQ ID NO: 2035877 - RNA, 22 nt, Staphylococcus aureus subsp. aureus Mu50
auaucgacaaauuaaaaaacaa

SEQ ID NO: 2035878 - RNA, 23 nt, Staphylococcus aureus subsp. aureus Mu50
auaucgagaggguacacuucaac

SEQ ID NO: 2035879 - RNA, 14 nt, Staphylococcus aureus subsp. aureus Mu50
auauaauuuaaaga

SEQ ID NO: 2035880 - RNA, 22 nt, Staphylococcus aureus subsp. aureus Mu50
auauaauuuauuuagcaucuuu

SEQ ID NO: 2035881 - RNA, 18 nt, Staphylococcus aureus subsp. aureus Mu50
auauaauuugguuaauac

SEQ ID NO: 2035882 - RNA, 17 nt, Staphylococcus aureus subsp. aureus Mu50
auauaaugcugauaauu

SEQ ID NO: 2035883 - RNA, 16 nt, Staphylococcus aureus subsp. aureus Mu50
auauaauguauaaaac

SEQ ID NO: 2035884 - RNA, 22 nt, Staphylococcus aureus subsp. aureus Mu50
auauaaggcauauccgaaaauu

SEQ ID NO: 2035885 - RNA, 14 nt, Staphylococcus aureus subsp. aureus Mu50
auauaaaucauuuc

SEQ ID NO: 2035886 - RNA, 18 nt, Staphylococcus aureus subsp. aureus Mu50
auauaaauguuuauaucu

SEQ ID NO: 2035887 - RNA, 16 nt, Staphylococcus aureus subsp. aureus Mu50
auauaacacgauaauu

SEQ ID NO: 2035888 - RNA, 14 nt, Staphylococcus aureus subsp. aureus Mu50
auauaaagcuuuga

SEQ ID NO: 2035889 - RNA, 17 nt, Staphylococcus aureus subsp. aureus Mu50
auauaaaauccuaagca

SEQ ID NO: 2035890 - RNA, 14 nt, Staphylococcus aureus subsp. aureus Mu50
auauaaauaucaau

SEQ ID NO: 2035891 - RNA, 14 nt, Staphylococcus aureus subsp. aureus Mu50
auauaaauaugguu

SEQ ID NO: 2035892 - RNA, 22 nt, Staphylococcus aureus subsp. aureus Mu50
auauagacaguaguuaauugaa

SEQ ID NO: 2035893 - RNA, 18 nt, Staphylococcus aureus subsp. aureus Mu50
auauacuaaaguucaaca

SEQ ID NO: 2035894 - RNA, 14 nt, Staphylococcus aureus subsp. aureus Mu50
auauacucuaaaaa

SEQ ID NO: 2035895 - RNA, 21 nt, Staphylococcus aureus subsp. aureus Mu50
auauacuugaagcaucgauuu

SEQ ID NO: 2035896 - RNA, 14 nt, Staphylococcus aureus subsp. aureus Mu50
auauacuuuuuaaa

SEQ ID NO: 2035897 - RNA, 14 nt, Staphylococcus aureus subsp. aureus Mu50
auauagucaaugaa

SEQ ID NO: 2035898 - RNA, 22 nt, Staphylococcus aureus subsp. aureus Mu50
auauagaguaguucggaugaga

SEQ ID NO: 2035899 - RNA, 17 nt, Staphylococcus aureus subsp. aureus Mu50
auauagauggcuuuuuu

SEQ ID NO: 2035900 - RNA, 21 nt, Staphylococcus aureus subsp. aureus Mu50
auauagauugccauucauaca

SEQ ID NO: 2035901 - RNA, 22 nt, Staphylococcus aureus subsp. aureus Mu50
auauagcauaaaauuucugcuu

SEQ ID NO: 2035902 - RNA, 14 nt, Staphylococcus aureus subsp. aureus Mu50
auauucacaucuuu

SEQ ID NO: 2035903 - RNA, 19 nt, Staphylococcus aureus subsp. aureus Mu50
auauucaguauauguauag

SEQ ID NO: 2035904 - RNA, 23 nt, Staphylococcus aureus subsp. aureus Mu50
auauucaaaaggauaagaacgag

SEQ ID NO: 2035905 - RNA, 22 nt, Staphylococcus aureus subsp. aureus Mu50
auauucaacuuauuauuuaucg

SEQ ID NO: 2035906 - RNA, 15 nt, Staphylococcus aureus subsp. aureus Mu50
auauucgcgaacguu

SEQ ID NO: 2035907 - RNA, 19 nt, Staphylococcus aureus subsp. aureus Mu50
auauucgcgaacguuauuu

SEQ ID NO: 2035908 - RNA, 15 nt, Staphylococcus aureus subsp. aureus Mu50
auaucuuuuuuuuua

SEQ ID NO: 2035909 - RNA, 19 nt, Staphylococcus aureus subsp. aureus Mu50
auauuccacgcucacauua

SEQ ID NO: 2035910 - RNA, 13 nt, Staphylococcus aureus subsp. aureus Mu50
auauucucugcuu

SEQ ID NO: 2035911 - RNA, 13 nt, Staphylococcus aureus subsp. aureus Mu50
auauucguuacaa

SEQ ID NO: 2035912 - RNA, 19 nt, Staphylococcus aureus subsp. aureus Mu50
auauugaggaucaaaaguu

SEQ ID NO: 2035913 - RNA, 15 nt, Staphylococcus aureus subsp. aureus Mu50
auauugagaauauua

SEQ ID NO: 2035914 - RNA, 16 nt, Staphylococcus aureus subsp. aureus Mu50
auauugagaauauuaa

SEQ ID NO: 2035915 - RNA, 17 nt, Staphylococcus aureus subsp. aureus Mu50
auauucuggaugguuau

SEQ ID NO: 2035916 - RNA, 17 nt, Staphylococcus aureus subsp. aureus Mu50
auauucuuaucauucau

SEQ ID NO: 2035917 - RNA, 13 nt, Staphylococcus aureus subsp. aureus Mu50
auauucuuuuuaa

SEQ ID NO: 2035918 - RNA, 15 nt, Staphylococcus aureus subsp. aureus Mu50
auauugaagaugcuu

SEQ ID NO: 2035919 - RNA, 22 nt, Staphylococcus aureus subsp. aureus Mu50
auauugaauaaucauccauaua

SEQ ID NO: 2035920 - RNA, 17 nt, Staphylococcus aureus subsp. aureus Mu50
auauucucugcuucuaa

SEQ ID NO: 2035921 - RNA, 23 nt, Staphylococcus aureus subsp. aureus Mu50
auauuauguuagugacaagguau

SEQ ID NO: 2035922 - RNA, 14 nt, Staphylococcus aureus subsp. aureus Mu50
auauuauuaaauca

SEQ ID NO: 2035923 - RNA, 13 nt, Staphylococcus aureus subsp. aureus Mu50
auauuauuacuua

SEQ ID NO: 2035924 - RNA, 12 nt, Staphylococcus aureus subsp. aureus Mu50
auaucuuucaau

SEQ ID NO: 2035925 - RNA, 18 nt, Staphylococcus aureus subsp. aureus Mu50
auaucuuucaauuaauuu

SEQ ID NO: 2035926 - RNA, 20 nt, Staphylococcus aureus subsp. aureus Mu50
auaucuugcuuggauaauug

SEQ ID NO: 2035927 - RNA, 14 nt, Staphylococcus aureus subsp. aureus Mu50
auaucuuaaguaca

SEQ ID NO: 2035928 - RNA, 14 nt, Staphylococcus aureus subsp. aureus Mu50
auaucuuaaucuaa

SEQ ID NO: 2035929 - RNA, 18 nt, Staphylococcus aureus subsp. aureus Mu50
auaucuuacugcuguuuu

SEQ ID NO: 2035930 - RNA, 16 nt, Staphylococcus aureus subsp. aureus Mu50
auaucuuaugauacuu

SEQ ID NO: 2035931 - RNA, 21 nt, Staphylococcus aureus subsp. aureus Mu50
auaucuucuucuaaccacuuc

SEQ ID NO: 2035932 - RNA, 17 nt, Staphylococcus aureus subsp. aureus Mu50
auaucuucuuuuaauau

SEQ ID NO: 2035933 - RNA, 17 nt, Staphylococcus aureus subsp. aureus Mu50
auaucuugcuuggauaa

SEQ ID NO: 2035934 - RNA, 19 nt, Staphylococcus aureus subsp. aureus Mu50
auaucuaagucgauaaguu

SEQ ID NO: 2035935 - RNA, 23 nt, Staphylococcus aureus subsp. aureus Mu50
auaucuaauacuuucacuuuuua

SEQ ID NO: 2035936 - RNA, 19 nt, Staphylococcus aureus subsp. aureus Mu50
auaucgucguaacucuuua

SEQ ID NO: 2035937 - RNA, 22 nt, Staphylococcus aureus subsp. aureus Mu50
auaucgucguaacucuuuaauu

SEQ ID NO: 2035938 - RNA, 15 nt, Staphylococcus aureus subsp. aureus Mu50
auaucugucaaaggu

SEQ ID NO: 2035939 - RNA, 22 nt, Staphylococcus aureus subsp. aureus Mu50
auaucugaaaaaccaauacgaa

SEQ ID NO: 2035940 - RNA, 20 nt, Staphylococcus aureus subsp. aureus Mu50
auaucucaagauauccauua

SEQ ID NO: 2035941 - RNA, 17 nt, Staphylococcus aureus subsp. aureus Mu50
auaggcgcgaaaugacc

SEQ ID NO: 2035942 - RNA, 19 nt, Staphylococcus aureus subsp. aureus Mu50
auaggauuuacaccuauac

SEQ ID NO: 2035943 - RNA, 19 nt, Staphylococcus aureus subsp. aureus Mu50
auaggauuugcaccuauac

SEQ ID NO: 2035944 - RNA, 17 nt, Staphylococcus aureus subsp. aureus Mu50
auaggugcaguuaaauu

SEQ ID NO: 2035945 - RNA, 14 nt, Staphylococcus aureus subsp. aureus Mu50
auagguauaaucau

SEQ ID NO: 2035946 - RNA, 13 nt, Staphylococcus aureus subsp. aureus Mu50
auaguaaucgauu

SEQ ID NO: 2035947 - RNA, 23 nt, Staphylococcus aureus subsp. aureus Mu50
auaguauagcgcagcaaaugcuu

SEQ ID NO: 2035948 - RNA, 23 nt, Staphylococcus aureus subsp. aureus Mu50
auaguaaucucucgcuaaauuua

SEQ ID NO: 2035949 - RNA, 14 nt, Staphylococcus aureus subsp. aureus Mu50
auaguaauuguuau

SEQ ID NO: 2035950 - RNA, 16 nt, Staphylococcus aureus subsp. aureus Mu50
auaguaauuguuauaa

SEQ ID NO: 2035951 - RNA, 14 nt, Staphylococcus aureus subsp. aureus Mu50
auagucacuuuuaa

SEQ ID NO: 2035952 - RNA, 20 nt, Staphylococcus aureus subsp. aureus Mu50
auagucauaacgauuguugc

SEQ ID NO: 2035953 - RNA, 16 nt, Staphylococcus aureus subsp. aureus Mu50
auagucauuacauuuu

SEQ ID NO: 2035954 - RNA, 18 nt, Staphylococcus aureus subsp. aureus Mu50
auagucauuacauuuuau

SEQ ID NO: 2035955 - RNA, 18 nt, Staphylococcus aureus subsp. aureus Mu50
auagucauucauaauuug

SEQ ID NO: 2035956 - RNA, 19 nt, Staphylococcus aureus subsp. aureus Mu50
auaguccgcguguacuuua

SEQ ID NO: 2035957 - RNA, 19 nt, Staphylococcus aureus subsp. aureus Mu50
auaguggaugcucguauag

SEQ ID NO: 2035958 - RNA, 17 nt, Staphylococcus aureus subsp. aureus Mu50
auaguucaaaauacuca

SEQ ID NO: 2035959 - RNA, 18 nt, Staphylococcus aureus subsp. aureus Mu50
auagugguaaaaaguuua

SEQ ID NO: 2035960 - RNA, 17 nt, Staphylococcus aureus subsp. aureus Mu50
auagugcuuuuucaaaa

SEQ ID NO: 2035961 - RNA, 15 nt, Staphylococcus aureus subsp. aureus Mu50
auaguuaccaaaauu

SEQ ID NO: 2035962 - RNA, 19 nt, Staphylococcus aureus subsp. aureus Mu50
auaguugaucaaaaagaca

SEQ ID NO: 2035963 - RNA, 20 nt, Staphylococcus aureus subsp. aureus Mu50
auaguugaaucggugucuuu

SEQ ID NO: 2035964 - RNA, 19 nt, Staphylococcus aureus subsp. aureus Mu50
auauaaaacggacaaguuu

SEQ ID NO: 2035965 - RNA, 16 nt, Staphylococcus aureus subsp. aureus Mu50
auaguuucaaugccuu

SEQ ID NO: 2035966 - RNA, 14 nt, Staphylococcus aureus subsp. aureus Mu50
auagcuggcuuuuu

SEQ ID NO: 2035967 - RNA, 12 nt, Staphylococcus aureus subsp. aureus Mu50
auagcugcuuua

SEQ ID NO: 2035968 - RNA, 17 nt, Staphylococcus aureus subsp. aureus Mu50
auagcucauuacaaagu

SEQ ID NO: 2035969 - RNA, 23 nt, Staphylococcus aureus subsp. aureus Mu50
auagcgcucuggauuuuucuuau

SEQ ID NO: 2035970 - RNA, 12 nt, Staphylococcus aureus subsp. aureus Mu50
auacguaaacac

SEQ ID NO: 2035971 - RNA, 21 nt, Staphylococcus aureus subsp. aureus Mu50
auacuugcucuaauucaauga

SEQ ID NO: 2035972 - RNA, 21 nt, Staphylococcus aureus subsp. aureus Mu50
auacuuucacuuuuuauauca

SEQ ID NO: 2035973 - RNA, 19 nt, Staphylococcus aureus subsp. aureus Mu50
auagaaaaauuucaaaaau

SEQ ID NO: 2035974 - RNA, 21 nt, Staphylococcus aureus subsp. aureus Mu50
auacuuuuucagaaugaacuu

SEQ ID NO: 2035975 - RNA, 18 nt, Staphylococcus aureus subsp. aureus Mu50
auacuuucuaagauacgu

SEQ ID NO: 2035976 - RNA, 15 nt, Staphylococcus aureus subsp. aureus Mu50
auagaaagaaauugu

SEQ ID NO: 2035977 - RNA, 23 nt, Staphylococcus aureus subsp. aureus Mu50
auagaaagugcgguuauuuauac

SEQ ID NO: 2035978 - RNA, 16 nt, Staphylococcus aureus subsp. aureus Mu50
auagaacgaaauaguu

SEQ ID NO: 2035979 - RNA, 18 nt, Staphylococcus aureus subsp. aureus Mu50
auagaaaugacgauaccu

SEQ ID NO: 2035980 - RNA, 22 nt, Staphylococcus aureus subsp. aureus Mu50
auaaccuagguuaaagauggcu

SEQ ID NO: 2035981 - RNA, 20 nt, Staphylococcus aureus subsp. aureus Mu50
auaaccuuuaaaacaucauu

SEQ ID NO: 2035982 - RNA, 20 nt, Staphylococcus aureus subsp. aureus Mu50
auaacgacacuuuuuaguga

SEQ ID NO: 2035983 - RNA, 23 nt, Staphylococcus aureus subsp. aureus Mu50
auaacgagcaguauauaucaaau

SEQ ID NO: 2035984 - RNA, 24 nt, Staphylococcus aureus subsp. aureus Mu50
auaacgagcaguauauaucaaaua

SEQ ID NO: 2035985 - RNA, 22 nt, Staphylococcus aureus subsp. aureus Mu50
aguuugaucauaauucaguguu

SEQ ID NO: 2035986 - RNA, 17 nt, Staphylococcus aureus subsp. aureus Mu50
aguuugaucauaauuca

SEQ ID NO: 2035987 - RNA, 13 nt, Staphylococcus aureus subsp. aureus Mu50
aguuugaaauaau

SEQ ID NO: 2035988 - RNA, 20 nt, Staphylococcus aureus subsp. aureus Mu50
aguuucguuguacaguaaua

SEQ ID NO: 2035989 - RNA, 16 nt, Staphylococcus aureus subsp. aureus Mu50
aguuugaaucauuuga

SEQ ID NO: 2035990 - RNA, 16 nt, Staphylococcus aureus subsp. aureus Mu50
auaacagcuacaaaua

SEQ ID NO: 2035991 - RNA, 19 nt, Staphylococcus aureus subsp. aureus Mu50
auaaccgaaauauuguaau

SEQ ID NO: 2035992 - RNA, 15 nt, Staphylococcus aureus subsp. aureus Mu50
auaacaucaaauaga

SEQ ID NO: 2035993 - RNA, 14 nt, Staphylococcus aureus subsp. aureus Mu50
auaaccauaaugaa

SEQ ID NO: 2035994 - RNA, 22 nt, Staphylococcus aureus subsp. aureus Mu50
auaaccaccaucccauuaaacc

SEQ ID NO: 2035995 - RNA, 14 nt, Staphylococcus aureus subsp. aureus Mu50
auaauaaagauuau

SEQ ID NO: 2035996 - RNA, 11 nt, Staphylococcus aureus subsp. aureus Mu50
auaauaaauag

SEQ ID NO: 2035997 - RNA, 13 nt, Staphylococcus aureus subsp. aureus Mu50
auaauaaauagac

SEQ ID NO: 2035998 - RNA, 15 nt, Staphylococcus aureus subsp. aureus Mu50
auaauaaaucgaauu

SEQ ID NO: 2035999 - RNA, 17 nt, Staphylococcus aureus subsp. aureus Mu50
auaaguuacuagcauua

SEQ ID NO: 2036000 - RNA, 21 nt, Staphylococcus aureus subsp. aureus Mu50
auaagugguuguucccauuuu

SEQ ID NO: 2036001 - RNA, 12 nt, Staphylococcus aureus subsp. aureus Mu50
auaaguuaaaaa

SEQ ID NO: 2036002 - RNA, 19 nt, Staphylococcus aureus subsp. aureus Mu50
auaaguagugauuuuuuac

SEQ ID NO: 2036003 - RNA, 14 nt, Staphylococcus aureus subsp. aureus Mu50
auaagucacauuua

SEQ ID NO: 2036004 - RNA, 17 nt, Staphylococcus aureus subsp. aureus Mu50
auaauacacgaucaguu

SEQ ID NO: 2036005 - RNA, 17 nt, Staphylococcus aureus subsp. aureus Mu50
auaauaccaauugcuuc

SEQ ID NO: 2036006 - RNA, 21 nt, Staphylococcus aureus subsp. aureus Mu50
auaauaacuagaacaagaauu

SEQ ID NO: 2036007 - RNA, 22 nt, Staphylococcus aureus subsp. aureus Mu50
auaauacgucguaaugaagauu

SEQ ID NO: 2036008 - RNA, 14 nt, Staphylococcus aureus subsp. aureus Mu50
auaauagcaaaauu

SEQ ID NO: 2036009 - RNA, 18 nt, Staphylococcus aureus subsp. aureus Mu50
auaauagccauucgaugc

SEQ ID NO: 2036010 - RNA, 14 nt, Staphylococcus aureus subsp. aureus Mu50
auaauacuguauuu

SEQ ID NO: 2036011 - RNA, 18 nt, Staphylococcus aureus subsp. aureus Mu50
auaauacuguauuuuaac

SEQ ID NO: 2036012 - RNA, 16 nt, Staphylococcus aureus subsp. aureus Mu50
auaacucaaauaucua

SEQ ID NO: 2036013 - RNA, 21 nt, Staphylococcus aureus subsp. aureus Mu50
auaacucaaauaucuaaacaa

SEQ ID NO: 2036014 - RNA, 16 nt, Staphylococcus aureus subsp. aureus Mu50
auaacugcuaauuuuu

SEQ ID NO: 2036015 - RNA, 15 nt, Staphylococcus aureus subsp. aureus Mu50
auaacuauaaucauu

SEQ ID NO: 2036016 - RNA, 19 nt, Staphylococcus aureus subsp. aureus Mu50
auaacuuuauauauaaaga

SEQ ID NO: 2036017 - RNA, 13 nt, Staphylococcus aureus subsp. aureus Mu50
auaacuuuauggg

SEQ ID NO: 2036018 - RNA, 15 nt, Staphylococcus aureus subsp. aureus Mu50
auaacuuuuuaaagg

SEQ ID NO: 2036019 - RNA, 15 nt, Staphylococcus aureus subsp. aureus Mu50
auaagaaaauacuaa

SEQ ID NO: 2036020 - RNA, 19 nt, Staphylococcus aureus subsp. aureus Mu50
auaagagaacuuuucaaac

SEQ ID NO: 2036021 - RNA, 13 nt, Staphylococcus aureus subsp. aureus Mu50
auaagcaaaaauu

SEQ ID NO: 2036022 - RNA, 15 nt, Staphylococcus aureus subsp. aureus Mu50
auaaguacaaauaau

SEQ ID NO: 2036023 - RNA, 19 nt, Staphylococcus aureus subsp. aureus Mu50
auaagggguauauuaaaaa

SEQ ID NO: 2036024 - RNA, 11 nt, Staphylococcus aureus subsp. aureus Mu50
auacaaugaau

SEQ ID NO: 2036025 - RNA, 23 nt, Staphylococcus aureus subsp. aureus Mu50
auacaaacccuuuaaacauauuu

SEQ ID NO: 2036026 - RNA, 22 nt, Staphylococcus aureus subsp. aureus Mu50
auacaaaacaccucgauauuau

SEQ ID NO: 2036027 - RNA, 20 nt, Staphylococcus aureus subsp. aureus Mu50
auacaaauuauaaauuuggu

SEQ ID NO: 2036028 - RNA, 23 nt, Staphylococcus aureus subsp. aureus Mu50
auacaaaucguaaacauaaugac

SEQ ID NO: 2036029 - RNA, 22 nt, Staphylococcus aureus subsp. aureus Mu50
auacaacgacacgaacaacauu

SEQ ID NO: 2036030 - RNA, 18 nt, Staphylococcus aureus subsp. aureus Mu50
auaauaugugcaugagac

SEQ ID NO: 2036031 - RNA, 20 nt, Staphylococcus aureus subsp. aureus Mu50
auaauauuaaauugcguacu

SEQ ID NO: 2036032 - RNA, 19 nt, Staphylococcus aureus subsp. aureus Mu50
auaauauuauucuuuauau

SEQ ID NO: 2036033 - RNA, 17 nt, Staphylococcus aureus subsp. aureus Mu50
auaauagaaagcgcauu

SEQ ID NO: 2036034 - RNA, 22 nt, Staphylococcus aureus subsp. aureus Mu50
auaauaggauaccacaucgcau

SEQ ID NO: 2036035 - RNA, 18 nt, Staphylococcus aureus subsp. aureus Mu50
auaauauuucuuaccauu

SEQ ID NO: 2036036 - RNA, 20 nt, Staphylococcus aureus subsp. aureus Mu50
auaauauuuugaauuguaau

SEQ ID NO: 2036037 - RNA, 15 nt, Staphylococcus aureus subsp. aureus Mu50
auaaucaagaauaua

SEQ ID NO: 2036038 - RNA, 18 nt, Staphylococcus aureus subsp. aureus Mu50
auaaucaagaauauaagu

SEQ ID NO: 2036039 - RNA, 22 nt, Staphylococcus aureus subsp. aureus Mu50
auaaucaagaauauaagugauu

SEQ ID NO: 2036040 - RNA, 14 nt, Staphylococcus aureus subsp. aureus Mu50
auaauuuccuaaaa

SEQ ID NO: 2036041 - RNA, 23 nt, Staphylococcus aureus subsp. aureus Mu50
auaauuuuugaguaauuuaauca

SEQ ID NO: 2036042 - RNA, 23 nt, Staphylococcus aureus subsp. aureus Mu50
auaauuuucuguccaaaaagguu

SEQ ID NO: 2036043 - RNA, 17 nt, Staphylococcus aureus subsp. aureus Mu50
auaauuuuguuucacua

SEQ ID NO: 2036044 - RNA, 15 nt, Staphylococcus aureus subsp. aureus Mu50
auaauuuuaaaaaua

SEQ ID NO: 2036045 - RNA, 15 nt, Staphylococcus aureus subsp. aureus Mu50
auaauuuuaauauua

SEQ ID NO: 2036046 - RNA, 17 nt, Staphylococcus aureus subsp. aureus Mu50
auaccaguggaaauuau

SEQ ID NO: 2036047 - RNA, 13 nt, Staphylococcus aureus subsp. aureus Mu50
auaccauaauuaa

SEQ ID NO: 2036048 - RNA, 17 nt, Staphylococcus aureus subsp. aureus Mu50
auaccggcaaauaacaa

SEQ ID NO: 2036049 - RNA, 20 nt, Staphylococcus aureus subsp. aureus Mu50
auaccacuugaauacuuuuu

SEQ ID NO: 2036050 - RNA, 17 nt, Staphylococcus aureus subsp. aureus Mu50
auacauuaauauaaaua

SEQ ID NO: 2036051 - RNA, 18 nt, Staphylococcus aureus subsp. aureus Mu50
auacauuaauauaaauau

SEQ ID NO: 2036052 - RNA, 18 nt, Staphylococcus aureus subsp. aureus Mu50
auaccaaacugccuaaua

SEQ ID NO: 2036053 - RNA, 14 nt, Staphylococcus aureus subsp. aureus Mu50
auaccaaauaaaua

SEQ ID NO: 2036054 - RNA, 14 nt, Staphylococcus aureus subsp. aureus Mu50
auaccaauaauuac

SEQ ID NO: 2036055 - RNA, 19 nt, Staphylococcus aureus subsp. aureus Mu50
auaccacaucgcauaauau

SEQ ID NO: 2036056 - RNA, 20 nt, Staphylococcus aureus subsp. aureus Mu50
auaccuaagcugauuaaaau

SEQ ID NO: 2036057 - RNA, 22 nt, Staphylococcus aureus subsp. aureus Mu50
auaccuaaugcgacaucgccaa

SEQ ID NO: 2036058 - RNA, 19 nt, Staphylococcus aureus subsp. aureus Mu50
auaccuaauugcuuaauau

SEQ ID NO: 2036059 - RNA, 13 nt, Staphylococcus aureus subsp. aureus Mu50
auaccuacaaaua

SEQ ID NO: 2036060 - RNA, 18 nt, Staphylococcus aureus subsp. aureus Mu50
auaccucuacauuauauu

SEQ ID NO: 2036061 - RNA, 12 nt, Staphylococcus aureus subsp. aureus Mu50
auaccuuuaauu

SEQ ID NO: 2036062 - RNA, 14 nt, Staphylococcus aureus subsp. aureus Mu50
auaccuuuauuauu

SEQ ID NO: 2036063 - RNA, 12 nt, Staphylococcus aureus subsp. aureus Mu50
auaccuuuuucu

SEQ ID NO: 2036064 - RNA, 22 nt, Staphylococcus aureus subsp. aureus Mu50
auaccuuuuucuaccaauaauu

SEQ ID NO: 2036065 - RNA, 16 nt, Staphylococcus aureus subsp. aureus Mu50
auacgauuuguucaau

SEQ ID NO: 2036066 - RNA, 24 nt, Staphylococcus aureus subsp. aureus Mu50
auacgagcuuugcucauagaugac

SEQ ID NO: 2036067 - RNA, 12 nt, Staphylococcus aureus subsp. aureus Mu50
auacgccaaaua

SEQ ID NO: 2036068 - RNA, 22 nt, Staphylococcus aureus subsp. aureus Mu50
auacgcaaucauuguaaaugau

SEQ ID NO: 2036069 - RNA, 15 nt, Staphylococcus aureus subsp. aureus Mu50
auacgcuuuuuaaaa

SEQ ID NO: 2036070 - RNA, 17 nt, Staphylococcus aureus subsp. aureus Mu50
auacggcaaauucaacu

SEQ ID NO: 2036071 - RNA, 21 nt, Staphylococcus aureus subsp. aureus Mu50
aguagauuuauuaaauauaug

SEQ ID NO: 2036072 - RNA, 15 nt, Staphylococcus aureus subsp. aureus Mu50
aguacucuuuuaccu

SEQ ID NO: 2036073 - RNA, 21 nt, Staphylococcus aureus subsp. aureus Mu50
aguagacgguaucaucugcau

SEQ ID NO: 2036074 - RNA, 12 nt, Staphylococcus aureus subsp. aureus Mu50
aguacgauuauu

SEQ ID NO: 2036075 - RNA, 17 nt, Staphylococcus aureus subsp. aureus Mu50
agguccuuucacauacc

SEQ ID NO: 2036076 - RNA, 13 nt, Staphylococcus aureus subsp. aureus Mu50
aguauaauccauc

SEQ ID NO: 2036077 - RNA, 18 nt, Staphylococcus aureus subsp. aureus Mu50
aguauuaacuauaaauag

SEQ ID NO: 2036078 - RNA, 15 nt, Staphylococcus aureus subsp. aureus Mu50
aguauaauuuaucuu

SEQ ID NO: 2036079 - RNA, 15 nt, Staphylococcus aureus subsp. aureus Mu50
aguauugccguuauu

SEQ ID NO: 2036080 - RNA, 21 nt, Staphylococcus aureus subsp. aureus Mu50
aguauuuuugcguuaauaauu

SEQ ID NO: 2036081 - RNA, 22 nt, Staphylococcus aureus subsp. aureus Mu50
aguaguuccguugaauuaacaa

SEQ ID NO: 2036082 - RNA, 19 nt, Staphylococcus aureus subsp. aureus Mu50
aguaguugacugaacgaaa

SEQ ID NO: 2036083 - RNA, 19 nt, Staphylococcus aureus subsp. aureus Mu50
aguauaaaccaaaucggaa

SEQ ID NO: 2036084 - RNA, 20 nt, Staphylococcus aureus subsp. aureus Mu50
aguauaaaccgccaacuaau

SEQ ID NO: 2036085 - RNA, 18 nt, Staphylococcus aureus subsp. aureus Mu50
aguaguuaauugaaugaa

SEQ ID NO: 2036086 - RNA, 20 nt, Staphylococcus aureus subsp. aureus Mu50
aguaguuaauugaaugaaaa

SEQ ID NO: 2036087 - RNA, 21 nt, Staphylococcus aureus subsp. aureus Mu50
agucaaucaaguuaaucagaa

SEQ ID NO: 2036088 - RNA, 15 nt, Staphylococcus aureus subsp. aureus Mu50
agucaaaaaaucgaa

SEQ ID NO: 2036089 - RNA, 19 nt, Staphylococcus aureus subsp. aureus Mu50
agucccaaccccuuuauuu

SEQ ID NO: 2036090 - RNA, 12 nt, Staphylococcus aureus subsp. aureus Mu50
aguccauuauug

SEQ ID NO: 2036091 - RNA, 14 nt, Staphylococcus aureus subsp. aureus Mu50
agucuaacaguuaa

SEQ ID NO: 2036092 - RNA, 19 nt, Staphylococcus aureus subsp. aureus Mu50
agucucuaaaacuuuuuca

SEQ ID NO: 2036093 - RNA, 17 nt, Staphylococcus aureus subsp. aureus Mu50
agucuuaaacauaacau

SEQ ID NO: 2036094 - RNA, 22 nt, Staphylococcus aureus subsp. aureus Mu50
agucuuaacaaauuaaaaaggu

SEQ ID NO: 2036095 - RNA, 23 nt, Staphylococcus aureus subsp. aureus Mu50
agucuuagacauuguaaaaugcu

SEQ ID NO: 2036096 - RNA, 23 nt, Staphylococcus aureus subsp. aureus Mu50
agugaaguuaacuauaacaauag

SEQ ID NO: 2036097 - RNA, 13 nt, Staphylococcus aureus subsp. aureus Mu50
agugaaauaccuc

SEQ ID NO: 2036098 - RNA, 16 nt, Staphylococcus aureus subsp. aureus Mu50
agugaaaguauuagau

SEQ ID NO: 2036099 - RNA, 14 nt, Staphylococcus aureus subsp. aureus Mu50
agugcauuuuuuau

SEQ ID NO: 2036100 - RNA, 20 nt, Staphylococcus aureus subsp. aureus Mu50
agugauuucuucauuaucaa

SEQ ID NO: 2036101 - RNA, 19 nt, Staphylococcus aureus subsp. aureus Mu50
agugaaucuaaacuauaau

SEQ ID NO: 2036102 - RNA, 22 nt, Staphylococcus aureus subsp. aureus Mu50
agugaaucuaaacuauaauaau

SEQ ID NO: 2036103 - RNA, 19 nt, Staphylococcus aureus subsp. aureus Mu50
agugaaauaucaagauguu

SEQ ID NO: 2036104 - RNA, 16 nt, Staphylococcus aureus subsp. aureus Mu50
agugacacaccaccac

SEQ ID NO: 2036105 - RNA, 22 nt, Staphylococcus aureus subsp. aureus Mu50
agugagcguauuauuauugaaa

SEQ ID NO: 2036106 - RNA, 23 nt, Staphylococcus aureus subsp. aureus Mu50
agugacuuaauaucauauucaaa

SEQ ID NO: 2036107 - RNA, 24 nt, Staphylococcus aureus subsp. aureus Mu50
aguggauuuucucccauacugauu

SEQ ID NO: 2036108 - RNA, 21 nt, Staphylococcus aureus subsp. aureus Mu50
aguggaaaggaggagauuguu

SEQ ID NO: 2036109 - RNA, 13 nt, Staphylococcus aureus subsp. aureus Mu50
aguggaaaugaua

SEQ ID NO: 2036110 - RNA, 12 nt, Staphylococcus aureus subsp. aureus Mu50
agugcuuuuuca

SEQ ID NO: 2036111 - RNA, 16 nt, Staphylococcus aureus subsp. aureus Mu50
agugcuuuuucaaaau

SEQ ID NO: 2036112 - RNA, 21 nt, Staphylococcus aureus subsp. aureus Mu50
agugcgggggauuauuuauau

SEQ ID NO: 2036113 - RNA, 17 nt, Staphylococcus aureus subsp. aureus Mu50
aguuuccauauuuuuua

SEQ ID NO: 2036114 - RNA, 21 nt, Staphylococcus aureus subsp. aureus Mu50
aguuuccauaaauaaaaugcu

SEQ ID NO: 2036115 - RNA, 17 nt, Staphylococcus aureus subsp. aureus Mu50
aguuucgcagcuuuaua

SEQ ID NO: 2036116 - RNA, 15 nt, Staphylococcus aureus subsp. aureus Mu50
aguuucguuguacag

SEQ ID NO: 2036117 - RNA, 20 nt, Staphylococcus aureus subsp. aureus Mu50
aguuggcugauagaugaaaa

SEQ ID NO: 2036118 - RNA, 14 nt, Staphylococcus aureus subsp. aureus Mu50
aguugguaucgauu

SEQ ID NO: 2036119 - RNA, 17 nt, Staphylococcus aureus subsp. aureus Mu50
aguugcugaauaaaaua

SEQ ID NO: 2036120 - RNA, 15 nt, Staphylococcus aureus subsp. aureus Mu50
aguuagguccuuuca

SEQ ID NO: 2036121 - RNA, 22 nt, Staphylococcus aureus subsp. aureus Mu50
aguuauacuaagcgcucauaaa

SEQ ID NO: 2036122 - RNA, 18 nt, Staphylococcus aureus subsp. aureus Mu50
aguuaucggcuaaaguua

SEQ ID NO: 2036123 - RNA, 23 nt, Staphylococcus aureus subsp. aureus Mu50
aguuaauucuccuaauaauuugg

SEQ ID NO: 2036124 - RNA, 11 nt, Staphylococcus aureus subsp. aureus Mu50
aguuaauguaa

SEQ ID NO: 2036125 - RNA, 23 nt, Staphylococcus aureus subsp. aureus Mu50
aguuaauaauuuuggauuuuuuu

SEQ ID NO: 2036126 - RNA, 19 nt, Staphylococcus aureus subsp. aureus Mu50
aguuaaaucacugcuuuca

SEQ ID NO: 2036127 - RNA, 21 nt, Staphylococcus aureus subsp. aureus Mu50
aguuaaagacuagccauaccu

SEQ ID NO: 2036128 - RNA, 13 nt, Staphylococcus aureus subsp. aureus Mu50
aguguuucauaau

SEQ ID NO: 2036129 - RNA, 17 nt, Staphylococcus aureus subsp. aureus Mu50
aguguugaauuucaaaa

SEQ ID NO: 2036130 - RNA, 19 nt, Staphylococcus aureus subsp. aureus Mu50
aguguugaauuucaaaaua

SEQ ID NO: 2036131 - RNA, 17 nt, Staphylococcus aureus subsp. aureus Mu50
acugcuguucuuuuuau

SEQ ID NO: 2036132 - RNA, 15 nt, Staphylococcus aureus subsp. aureus Mu50
agaaauaaucacauu

SEQ ID NO: 2036133 - RNA, 21 nt, Staphylococcus aureus subsp. aureus Mu50
agaaaugacaucaucuauaau

SEQ ID NO: 2036134 - RNA, 19 nt, Staphylococcus aureus subsp. aureus Mu50
agaaauucgaaaagaaauu

SEQ ID NO: 2036135 - RNA, 18 nt, Staphylococcus aureus subsp. aureus Mu50
agaaauucgaaaagaaau

SEQ ID NO: 2036136 - RNA, 13 nt, Staphylococcus aureus subsp. aureus Mu50
agaacaaucaaua

SEQ ID NO: 2036137 - RNA, 19 nt, Staphylococcus aureus subsp. aureus Mu50
agaaauuuuuucuauggca

SEQ ID NO: 2036138 - RNA, 15 nt, Staphylococcus aureus subsp. aureus Mu50
agaaccaaaaauuag

SEQ ID NO: 2036139 - RNA, 14 nt, Staphylococcus aureus subsp. aureus Mu50
agaaccaacaauaa

SEQ ID NO: 2036140 - RNA, 16 nt, Staphylococcus aureus subsp. aureus Mu50
agaacguaauguuaca

SEQ ID NO: 2036141 - RNA, 16 nt, Staphylococcus aureus subsp. aureus Mu50
agaacuaacauaauuu

SEQ ID NO: 2036142 - RNA, 13 nt, Staphylococcus aureus subsp. aureus Mu50
agaacuaauguaa

SEQ ID NO: 2036143 - RNA, 18 nt, Staphylococcus aureus subsp. aureus Mu50
agaaccuauuuuuuauau

SEQ ID NO: 2036144 - RNA, 19 nt, Staphylococcus aureus subsp. aureus Mu50
agaacuuuucaaacaauac

SEQ ID NO: 2036145 - RNA, 20 nt, Staphylococcus aureus subsp. aureus Mu50
agaacuuaguacguaucauu

SEQ ID NO: 2036146 - RNA, 20 nt, Staphylococcus aureus subsp. aureus Mu50
agaaggggacuuaaccauuu

SEQ ID NO: 2036147 - RNA, 19 nt, Staphylococcus aureus subsp. aureus Mu50
agaauaaauguuaaagauu

SEQ ID NO: 2036148 - RNA, 23 nt, Staphylococcus aureus subsp. aureus Mu50
agaauaaauguuaaagauuauua

SEQ ID NO: 2036149 - RNA, 13 nt, Staphylococcus aureus subsp. aureus Mu50
agaauacuaaaag

SEQ ID NO: 2036150 - RNA, 17 nt, Staphylococcus aureus subsp. aureus Mu50
agaagugccguauucuu

SEQ ID NO: 2036151 - RNA, 15 nt, Staphylococcus aureus subsp. aureus Mu50
agaauaaaaggcuuu

SEQ ID NO: 2036152 - RNA, 18 nt, Staphylococcus aureus subsp. aureus Mu50
agaaguuuccaacguuau

SEQ ID NO: 2036153 - RNA, 22 nt, Staphylococcus aureus subsp. aureus Mu50
agaaugcgaagauuuuuaacau

SEQ ID NO: 2036154 - RNA, 18 nt, Staphylococcus aureus subsp. aureus Mu50
agacauuaaaaaaucgaa

SEQ ID NO: 2036155 - RNA, 10 nt, Staphylococcus aureus subsp. aureus Mu50
agacagaaau

SEQ ID NO: 2036156 - RNA, 13 nt, Staphylococcus aureus subsp. aureus Mu50
agaauuaauaauu

SEQ ID NO: 2036157 - RNA, 21 nt, Staphylococcus aureus subsp. aureus Mu50
agaauuucgaaaagaaauucu

SEQ ID NO: 2036158 - RNA, 17 nt, Staphylococcus aureus subsp. aureus Mu50
agaauuuaagcuuacga

SEQ ID NO: 2036159 - RNA, 15 nt, Staphylococcus aureus subsp. aureus Mu50
agaauugcaacgcau

SEQ ID NO: 2036160 - RNA, 22 nt, Staphylococcus aureus subsp. aureus Mu50
agauaggauuuacaccuauacc

SEQ ID NO: 2036161 - RNA, 14 nt, Staphylococcus aureus subsp. aureus Mu50
agauaaaaauuacu

SEQ ID NO: 2036162 - RNA, 16 nt, Staphylococcus aureus subsp. aureus Mu50
agacgauuucaaugag

SEQ ID NO: 2036163 - RNA, 14 nt, Staphylococcus aureus subsp. aureus Mu50
agcauaccuuuauu

SEQ ID NO: 2036164 - RNA, 17 nt, Staphylococcus aureus subsp. aureus Mu50
agcauugggacauaaaa

SEQ ID NO: 2036165 - RNA, 22 nt, Staphylococcus aureus subsp. aureus Mu50
agcauuauuugcugcuaauuga

SEQ ID NO: 2036166 - RNA, 15 nt, Staphylococcus aureus subsp. aureus Mu50
agcacuuaauaaguc

SEQ ID NO: 2036167 - RNA, 21 nt, Staphylococcus aureus subsp. aureus Mu50
agauucuucaccaacuuuuuu

SEQ ID NO: 2036168 - RNA, 22 nt, Staphylococcus aureus subsp. aureus Mu50
agauucuucaccaacuuuuuua

SEQ ID NO: 2036169 - RNA, 22 nt, Staphylococcus aureus subsp. aureus Mu50
agauuuuuuauguuuaauuuga

SEQ ID NO: 2036170 - RNA, 21 nt, Staphylococcus aureus subsp. aureus Mu50
agauuuuaaacgcucaucacu

SEQ ID NO: 2036171 - RNA, 12 nt, Staphylococcus aureus subsp. aureus Mu50
agauuuuaaauc

SEQ ID NO: 2036172 - RNA, 17 nt, Staphylococcus aureus subsp. aureus Mu50
agauuuuaaacgcucau

SEQ ID NO: 2036173 - RNA, 19 nt, Staphylococcus aureus subsp. aureus Mu50
agcaaaaauucuaacugca

SEQ ID NO: 2036174 - RNA, 15 nt, Staphylococcus aureus subsp. aureus Mu50
agauuuaaaauguca

SEQ ID NO: 2036175 - RNA, 19 nt, Staphylococcus aureus subsp. aureus Mu50
agauugccauucauacacu

SEQ ID NO: 2036176 - RNA, 23 nt, Staphylococcus aureus subsp. aureus Mu50
agauugccauucauacacuauca

SEQ ID NO: 2036177 - RNA, 20 nt, Staphylococcus aureus subsp. aureus Mu50
agauuggucaaacuuaucgc

SEQ ID NO: 2036178 - RNA, 13 nt, Staphylococcus aureus subsp. aureus Mu50
agcaauaauaauu

SEQ ID NO: 2036179 - RNA, 22 nt, Staphylococcus aureus subsp. aureus Mu50
agcacaccuaauucauauauac

SEQ ID NO: 2036180 - RNA, 17 nt, Staphylococcus aureus subsp. aureus Mu50
agcacauuuuuaguuag

SEQ ID NO: 2036181 - RNA, 15 nt, Staphylococcus aureus subsp. aureus Mu50
agcacagaaaauuau

SEQ ID NO: 2036182 - RNA, 19 nt, Staphylococcus aureus subsp. aureus Mu50
agcacagcgauuaaaugau

SEQ ID NO: 2036183 - RNA, 16 nt, Staphylococcus aureus subsp. aureus Mu50
agcaaagcaaauuagu

SEQ ID NO: 2036184 - RNA, 12 nt, Staphylococcus aureus subsp. aureus Mu50
agcguaaaguuu

SEQ ID NO: 2036185 - RNA, 14 nt, Staphylococcus aureus subsp. aureus Mu50
agcguaauggauua

SEQ ID NO: 2036186 - RNA, 18 nt, Staphylococcus aureus subsp. aureus Mu50
agcguauuuuaaugauuu

SEQ ID NO: 2036187 - RNA, 22 nt, Staphylococcus aureus subsp. aureus Mu50
agcgcaagagauaagaaaauac

SEQ ID NO: 2036188 - RNA, 21 nt, Staphylococcus aureus subsp. aureus Mu50
agcgauuuuaaagaaaaguuu

SEQ ID NO: 2036189 - RNA, 17 nt, Staphylococcus aureus subsp. aureus Mu50
uaaaauguuaggugaaa

SEQ ID NO: 2036190 - RNA, 20 nt, Staphylococcus aureus subsp. aureus Mu50
uaaaauguuaggugaaacca

SEQ ID NO: 2036191 - RNA, 22 nt, Staphylococcus aureus subsp. aureus Mu50
uaaaauuugaauugacuuacau

SEQ ID NO: 2036192 - RNA, 22 nt, Staphylococcus aureus subsp. aureus Mu50
uaaaauuguauagaauguguau

SEQ ID NO: 2036193 - RNA, 15 nt, Staphylococcus aureus subsp. aureus Mu50
uaaaauuuguuaauu

SEQ ID NO: 2036194 - RNA, 17 nt, Staphylococcus aureus subsp. aureus Mu50
uaaacaaauaaaugucc

SEQ ID NO: 2036195 - RNA, 22 nt, Staphylococcus aureus subsp. aureus Mu50
uaaaagauauaaacauuuauau

SEQ ID NO: 2036196 - RNA, 21 nt, Staphylococcus aureus subsp. aureus Mu50
uaaaagauuagaugauauuua

SEQ ID NO: 2036197 - RNA, 23 nt, Staphylococcus aureus subsp. aureus Mu50
uaaaaguguugacuuuaucaauu

SEQ ID NO: 2036198 - RNA, 19 nt, Staphylococcus aureus subsp. aureus Mu50
uaaaaguuaccuacuacau

SEQ ID NO: 2036199 - RNA, 12 nt, Staphylococcus aureus subsp. aureus Mu50
uaaaacuuacau

SEQ ID NO: 2036200 - RNA, 17 nt, Staphylococcus aureus subsp. aureus Mu50
uaaaacguuaguacuuu

SEQ ID NO: 2036201 - RNA, 19 nt, Staphylococcus aureus subsp. aureus Mu50
uaaaacuaaugauaguaca

SEQ ID NO: 2036202 - RNA, 13 nt, Staphylococcus aureus subsp. aureus Mu50
uaaaacuacugau

SEQ ID NO: 2036203 - RNA, 15 nt, Staphylococcus aureus subsp. aureus Mu50
uaaaacgcuucauau

SEQ ID NO: 2036204 - RNA, 20 nt, Staphylococcus aureus subsp. aureus Mu50
uaaaacgcuucauauaaagu

SEQ ID NO: 2036205 - RNA, 19 nt, Staphylococcus aureus subsp. aureus Mu50
uaaaacggaaauaaccacc

SEQ ID NO: 2036206 - RNA, 16 nt, Staphylococcus aureus subsp. aureus Mu50
uaaaacgacucauuau

SEQ ID NO: 2036207 - RNA, 23 nt, Staphylococcus aureus subsp. aureus Mu50
guuucaucuucaacuuuaucuaa

SEQ ID NO: 2036208 - RNA, 14 nt, Staphylococcus aureus subsp. aureus Mu50
uaaaggugauauuu

SEQ ID NO: 2036209 - RNA, 16 nt, Staphylococcus aureus subsp. aureus Mu50
uaaaguacuuacaaau

SEQ ID NO: 2036210 - RNA, 15 nt, Staphylococcus aureus subsp. aureus Mu50
uaaagguaccacugu

SEQ ID NO: 2036211 - RNA, 13 nt, Staphylococcus aureus subsp. aureus Mu50
uaaaguuccaagu

SEQ ID NO: 2036212 - RNA, 19 nt, Staphylococcus aureus subsp. aureus Mu50
uaaaguuuaaauauucacg

SEQ ID NO: 2036213 - RNA, 20 nt, Staphylococcus aureus subsp. aureus Mu50
uaaagcauaucucaagauau

SEQ ID NO: 2036214 - RNA, 18 nt, Staphylococcus aureus subsp. aureus Mu50
uaaagcuguuuauugguu

SEQ ID NO: 2036215 - RNA, 15 nt, Staphylococcus aureus subsp. aureus Mu50
uaaaggcaacaaaua

SEQ ID NO: 2036216 - RNA, 21 nt, Staphylococcus aureus subsp. aureus Mu50
uaaacaagccaagauaaauca

SEQ ID NO: 2036217 - RNA, 21 nt, Staphylococcus aureus subsp. aureus Mu50
uaaagacaccuucaauaucug

SEQ ID NO: 2036218 - RNA, 20 nt, Staphylococcus aureus subsp. aureus Mu50
uaaagauuauaucuuuauau

SEQ ID NO: 2036219 - RNA, 22 nt, Staphylococcus aureus subsp. aureus Mu50
uaaagauagaaugaauaauucc

SEQ ID NO: 2036220 - RNA, 13 nt, Staphylococcus aureus subsp. aureus Mu50
uaaagaucauuuu

SEQ ID NO: 2036221 - RNA, 16 nt, Staphylococcus aureus subsp. aureus Mu50
uaaagauuaaaauaug

SEQ ID NO: 2036222 - RNA, 18 nt, Staphylococcus aureus subsp. aureus Mu50
uaaagauuaaaauaugac

SEQ ID NO: 2036223 - RNA, 21 nt, Staphylococcus aureus subsp. aureus Mu50
uaaagaaggggagaguuaauc

SEQ ID NO: 2036224 - RNA, 16 nt, Staphylococcus aureus subsp. aureus Mu50
uaaagaauuaaguagu

SEQ ID NO: 2036225 - RNA, 15 nt, Staphylococcus aureus subsp. aureus Mu50
uaaagacaccuucaa

SEQ ID NO: 2036226 - RNA, 14 nt, Staphylococcus aureus subsp. aureus Mu50
uaaaucacgauuuu

SEQ ID NO: 2036227 - RNA, 19 nt, Staphylococcus aureus subsp. aureus Mu50
uaaaucacgauuuucaagu

SEQ ID NO: 2036228 - RNA, 20 nt, Staphylococcus aureus subsp. aureus Mu50
uaaaucacuagcuaaugcac

SEQ ID NO: 2036229 - RNA, 17 nt, Staphylococcus aureus subsp. aureus Mu50
uaaaucauagaggcaca

SEQ ID NO: 2036230 - RNA, 13 nt, Staphylococcus aureus subsp. aureus Mu50
uaaaucaucauaa

SEQ ID NO: 2036231 - RNA, 14 nt, Staphylococcus aureus subsp. aureus Mu50
uaaaucaugacaua

SEQ ID NO: 2036232 - RNA, 18 nt, Staphylococcus aureus subsp. aureus Mu50
uaaauauuggaauacucu

SEQ ID NO: 2036233 - RNA, 22 nt, Staphylococcus aureus subsp. aureus Mu50
uaaauauuggaauacucuucaa

SEQ ID NO: 2036234 - RNA, 22 nt, Staphylococcus aureus subsp. aureus Mu50
uaaaucaaagcuauauaugaau

SEQ ID NO: 2036235 - RNA, 13 nt, Staphylococcus aureus subsp. aureus Mu50
uaaauauauuagu

SEQ ID NO: 2036236 - RNA, 15 nt, Staphylococcus aureus subsp. aureus Mu50
uaaauaucaauaauu

SEQ ID NO: 2036237 - RNA, 19 nt, Staphylococcus aureus subsp. aureus Mu50
uaaauaucuuuuucuaagu

SEQ ID NO: 2036238 - RNA, 17 nt, Staphylococcus aureus subsp. aureus Mu50
uaaauaugguuucuuau

SEQ ID NO: 2036239 - RNA, 18 nt, Staphylococcus aureus subsp. aureus Mu50
uaaauagugcuuuuucaa

SEQ ID NO: 2036240 - RNA, 17 nt, Staphylococcus aureus subsp. aureus Mu50
uaaauaguuuuucauau

SEQ ID NO: 2036241 - RNA, 17 nt, Staphylococcus aureus subsp. aureus Mu50
uaaauauaaauaugaau

SEQ ID NO: 2036242 - RNA, 23 nt, Staphylococcus aureus subsp. aureus Mu50
uaaauaaacucaccaaguucacu

SEQ ID NO: 2036243 - RNA, 15 nt, Staphylococcus aureus subsp. aureus Mu50
uaaauaacaaguagu

SEQ ID NO: 2036244 - RNA, 14 nt, Staphylococcus aureus subsp. aureus Mu50
uaaauaaacaacug

SEQ ID NO: 2036245 - RNA, 20 nt, Staphylococcus aureus subsp. aureus Mu50
uaaauaaccgcacuuucuau

SEQ ID NO: 2036246 - RNA, 20 nt, Staphylococcus aureus subsp. aureus Mu50
uaaauacgccaaauaucagu

SEQ ID NO: 2036247 - RNA, 13 nt, Staphylococcus aureus subsp. aureus Mu50
uaaauaaguaguu

SEQ ID NO: 2036248 - RNA, 14 nt, Staphylococcus aureus subsp. aureus Mu50
uaaauaauaaaugc

SEQ ID NO: 2036249 - RNA, 14 nt, Staphylococcus aureus subsp. aureus Mu50
uaaauaauaauuca

SEQ ID NO: 2036250 - RNA, 12 nt, Staphylococcus aureus subsp. aureus Mu50
uaaauguaucac

SEQ ID NO: 2036251 - RNA, 13 nt, Staphylococcus aureus subsp. aureus Mu50
uaaaugaaggcuu

SEQ ID NO: 2036252 - RNA, 18 nt, Staphylococcus aureus subsp. aureus Mu50
uaaaugcagcuguauaac

SEQ ID NO: 2036253 - RNA, 15 nt, Staphylococcus aureus subsp. aureus Mu50
uaaaucugauucauu

SEQ ID NO: 2036254 - RNA, 20 nt, Staphylococcus aureus subsp. aureus Mu50
uaaaucuuuccacggcauuu

SEQ ID NO: 2036255 - RNA, 14 nt, Staphylococcus aureus subsp. aureus Mu50
uaaaugaaauaucg

SEQ ID NO: 2036256 - RNA, 13 nt, Staphylococcus aureus subsp. aureus Mu50
uaaaugacugaau

SEQ ID NO: 2036257 - RNA, 14 nt, Staphylococcus aureus subsp. aureus Mu50
uaaaugagcuauua

SEQ ID NO: 2036258 - RNA, 14 nt, Staphylococcus aureus subsp. aureus Mu50
uaaaugauuaaagu

SEQ ID NO: 2036259 - RNA, 18 nt, Staphylococcus aureus subsp. aureus Mu50
uaaaugauuaauaacaua

SEQ ID NO: 2036260 - RNA, 21 nt, Staphylococcus aureus subsp. aureus Mu50
uaaaucaugacauaggcgcuu

SEQ ID NO: 2036261 - RNA, 16 nt, Staphylococcus aureus subsp. aureus Mu50
uaaaucgauaaaaugu

SEQ ID NO: 2036262 - RNA, 16 nt, Staphylococcus aureus subsp. aureus Mu50
uaaaucuacuacuaau

SEQ ID NO: 2036263 - RNA, 21 nt, Staphylococcus aureus subsp. aureus Mu50
uaaaucgugcuguuaucaugg

SEQ ID NO: 2036264 - RNA, 16 nt, Staphylococcus aureus subsp. aureus Mu50
uaaaucuauauaaagu

SEQ ID NO: 2036265 - RNA, 22 nt, Staphylococcus aureus subsp. aureus Mu50
uaaaucuauauaaaguugacaa

SEQ ID NO: 2036266 - RNA, 17 nt, Staphylococcus aureus subsp. aureus Mu50
uaacaaacauuaaucua

SEQ ID NO: 2036267 - RNA, 13 nt, Staphylococcus aureus subsp. aureus Mu50
uaaauuucaaggu

SEQ ID NO: 2036268 - RNA, 14 nt, Staphylococcus aureus subsp. aureus Mu50
uaaauuuucaucau

SEQ ID NO: 2036269 - RNA, 13 nt, Staphylococcus aureus subsp. aureus Mu50
uaaauuugaaagu

SEQ ID NO: 2036270 - RNA, 17 nt, Staphylococcus aureus subsp. aureus Mu50
uaaauuugaaaguaaau

SEQ ID NO: 2036271 - RNA, 14 nt, Staphylococcus aureus subsp. aureus Mu50
uaaauuuccaaagu

SEQ ID NO: 2036272 - RNA, 20 nt, Staphylococcus aureus subsp. aureus Mu50
uaaauuguuuacuauacuuu

SEQ ID NO: 2036273 - RNA, 18 nt, Staphylococcus aureus subsp. aureus Mu50
uaaauugcacgucuugua

SEQ ID NO: 2036274 - RNA, 17 nt, Staphylococcus aureus subsp. aureus Mu50
uaaauuguauuucuuaa

SEQ ID NO: 2036275 - RNA, 20 nt, Staphylococcus aureus subsp. aureus Mu50
uaaauuguauuucuuaacau

SEQ ID NO: 2036276 - RNA, 21 nt, Staphylococcus aureus subsp. aureus Mu50
uaaauuguuaucguucaaugu

SEQ ID NO: 2036277 - RNA, 18 nt, Staphylococcus aureus subsp. aureus Mu50
uaaauuauuguuuuaaug

SEQ ID NO: 2036278 - RNA, 20 nt, Staphylococcus aureus subsp. aureus Mu50
uaaauugacuuuaauugcuc

SEQ ID NO: 2036279 - RNA, 16 nt, Staphylococcus aureus subsp. aureus Mu50
uaaauguauuaaacau

SEQ ID NO: 2036280 - RNA, 16 nt, Staphylococcus aureus subsp. aureus Mu50
uaaaugucuuucaaau

SEQ ID NO: 2036281 - RNA, 17 nt, Staphylococcus aureus subsp. aureus Mu50
uaaauguuauuaaccau

SEQ ID NO: 2036282 - RNA, 19 nt, Staphylococcus aureus subsp. aureus Mu50
uaaauguuauuaaccauca

SEQ ID NO: 2036283 - RNA, 15 nt, Staphylococcus aureus subsp. aureus Mu50
uaaauguuuuaugua

SEQ ID NO: 2036284 - RNA, 14 nt, Staphylococcus aureus subsp. aureus Mu50
uaaauuaauauagu

SEQ ID NO: 2036285 - RNA, 20 nt, Staphylococcus aureus subsp. aureus Mu50
uaaauuagaugaaauggaaa

SEQ ID NO: 2036286 - RNA, 23 nt, Staphylococcus aureus subsp. aureus Mu50
uaaauuauaguacguuugcauau

SEQ ID NO: 2036287 - RNA, 22 nt, Staphylococcus aureus subsp. aureus Mu50
uaaauuauauacccaccacauu

SEQ ID NO: 2036288 - RNA, 23 nt, Staphylococcus aureus subsp. aureus Mu50
uaacacucuagagguaaaucuau

SEQ ID NO: 2036289 - RNA, 15 nt, Staphylococcus aureus subsp. aureus Mu50
uaacaccuacugauu

SEQ ID NO: 2036290 - RNA, 16 nt, Staphylococcus aureus subsp. aureus Mu50
uaacaauguugcuugu

SEQ ID NO: 2036291 - RNA, 20 nt, Staphylococcus aureus subsp. aureus Mu50
uaacaauuacgacaagaauu

SEQ ID NO: 2036292 - RNA, 12 nt, Staphylococcus aureus subsp. aureus Mu50
uaacaauugauu

SEQ ID NO: 2036293 - RNA, 21 nt, Staphylococcus aureus subsp. aureus Mu50
uaacaauuuuguugcaugacu

SEQ ID NO: 2036294 - RNA, 13 nt, Staphylococcus aureus subsp. aureus Mu50
uaacaagcuuuuu

SEQ ID NO: 2036295 - RNA, 18 nt, Staphylococcus aureus subsp. aureus Mu50
uaacaaguaguaugucau

SEQ ID NO: 2036296 - RNA, 21 nt, Staphylococcus aureus subsp. aureus Mu50
uaacaauacgcaauuagaguu

SEQ ID NO: 2036297 - RNA, 20 nt, Staphylococcus aureus subsp. aureus Mu50
uaaugaccggcauauaaucc

SEQ ID NO: 2036298 - RNA, 19 nt, Staphylococcus aureus subsp. aureus Mu50
uaaucuuaauauugauuaa

SEQ ID NO: 2036299 - RNA, 13 nt, Staphylococcus aureus subsp. aureus Mu50
uaaugacaaauua

SEQ ID NO: 2036300 - RNA, 17 nt, Staphylococcus aureus subsp. aureus Mu50
uaaugacuauaacacca

SEQ ID NO: 2036301 - RNA, 17 nt, Staphylococcus aureus subsp. aureus Mu50
uaaucuggguuguaauc

SEQ ID NO: 2036302 - RNA, 18 nt, Staphylococcus aureus subsp. aureus Mu50
uaaucuuuuuuuaauuaa

SEQ ID NO: 2036303 - RNA, 13 nt, Staphylococcus aureus subsp. aureus Mu50
uaaucuugauuau

SEQ ID NO: 2036304 - RNA, 14 nt, Staphylococcus aureus subsp. aureus Mu50
uaaucuuguuuuca

SEQ ID NO: 2036305 - RNA, 13 nt, Staphylococcus aureus subsp. aureus Mu50
uaaucuuuaacau

SEQ ID NO: 2036306 - RNA, 19 nt, Staphylococcus aureus subsp. aureus Mu50
uaaugaagauuuuguugaa

SEQ ID NO: 2036307 - RNA, 14 nt, Staphylococcus aureus subsp. aureus Mu50
uaaucggaucauua

SEQ ID NO: 2036308 - RNA, 17 nt, Staphylococcus aureus subsp. aureus Mu50
uaaucggaucauuauuu

SEQ ID NO: 2036309 - RNA, 12 nt, Staphylococcus aureus subsp. aureus Mu50
uaaucguaacau

SEQ ID NO: 2036310 - RNA, 18 nt, Staphylococcus aureus subsp. aureus Mu50
uaaucuauauaaaaacug

SEQ ID NO: 2036311 - RNA, 16 nt, Staphylococcus aureus subsp. aureus Mu50
uaaucucauucuuuaa

SEQ ID NO: 2036312 - RNA, 17 nt, Staphylococcus aureus subsp. aureus Mu50
uaaucugcaaaugccuc

SEQ ID NO: 2036313 - RNA, 14 nt, Staphylococcus aureus subsp. aureus Mu50
uaaucugcaacgau

SEQ ID NO: 2036314 - RNA, 20 nt, Staphylococcus aureus subsp. aureus Mu50
uaaucucucgcuaaauuuau

SEQ ID NO: 2036315 - RNA, 18 nt, Staphylococcus aureus subsp. aureus Mu50
uaaucgaacauaaauaaa

SEQ ID NO: 2036316 - RNA, 18 nt, Staphylococcus aureus subsp. aureus Mu50
uaauccgauuuugauaua

SEQ ID NO: 2036317 - RNA, 17 nt, Staphylococcus aureus subsp. aureus Mu50
uaaucgcauuguuaaag

SEQ ID NO: 2036318 - RNA, 20 nt, Staphylococcus aureus subsp. aureus Mu50
uaauccauacguaucaaaau

SEQ ID NO: 2036319 - RNA, 15 nt, Staphylococcus aureus subsp. aureus Mu50
uaauccauccauuaa

SEQ ID NO: 2036320 - RNA, 19 nt, Staphylococcus aureus subsp. aureus Mu50
uaauccaauuuaauagcuu

SEQ ID NO: 2036321 - RNA, 15 nt, Staphylococcus aureus subsp. aureus Mu50
uaauacuucucaauu

SEQ ID NO: 2036322 - RNA, 18 nt, Staphylococcus aureus subsp. aureus Mu50
uaauacuucucaauuuag

SEQ ID NO: 2036323 - RNA, 12 nt, Staphylococcus aureus subsp. aureus Mu50
uaauacuuucaa

SEQ ID NO: 2036324 - RNA, 19 nt, Staphylococcus aureus subsp. aureus Mu50
uaauacuuucaaacaaauc

SEQ ID NO: 2036325 - RNA, 22 nt, Staphylococcus aureus subsp. aureus Mu50
uaauacguuuugcuaauucaag

SEQ ID NO: 2036326 - RNA, 22 nt, Staphylococcus aureus subsp. aureus Mu50
uaaugauugacgauuuaauuaa

SEQ ID NO: 2036327 - RNA, 14 nt, Staphylococcus aureus subsp. aureus Mu50
uaaugaugacauca

SEQ ID NO: 2036328 - RNA, 13 nt, Staphylococcus aureus subsp. aureus Mu50
uaaugauauuaag

SEQ ID NO: 2036329 - RNA, 16 nt, Staphylococcus aureus subsp. aureus Mu50
uaaugauaaauuaaag

SEQ ID NO: 2036330 - RNA, 21 nt, Staphylococcus aureus subsp. aureus Mu50
uaaugagauuauucugagauu

SEQ ID NO: 2036331 - RNA, 15 nt, Staphylococcus aureus subsp. aureus Mu50
uaauggcacuuaaua

SEQ ID NO: 2036332 - RNA, 14 nt, Staphylococcus aureus subsp. aureus Mu50
uaauggauuauuau

SEQ ID NO: 2036333 - RNA, 16 nt, Staphylococcus aureus subsp. aureus Mu50
uaauggcaacuaagau

SEQ ID NO: 2036334 - RNA, 13 nt, Staphylococcus aureus subsp. aureus Mu50
uaaugcuucaaau

SEQ ID NO: 2036335 - RNA, 23 nt, Staphylococcus aureus subsp. aureus Mu50
uaaugcuucaaauguaacauuaa

SEQ ID NO: 2036336 - RNA, 15 nt, Staphylococcus aureus subsp. aureus Mu50
uaaugaucaaguagu

SEQ ID NO: 2036337 - RNA, 23 nt, Staphylococcus aureus subsp. aureus Mu50
uaaugccauuguuauccaaaaca

SEQ ID NO: 2036338 - RNA, 16 nt, Staphylococcus aureus subsp. aureus Mu50
uaaugcugcuucuuca

SEQ ID NO: 2036339 - RNA, 11 nt, Staphylococcus aureus subsp. aureus Mu50
uaauuaguugg

SEQ ID NO: 2036340 - RNA, 14 nt, Staphylococcus aureus subsp. aureus Mu50
uaauuauauuaaug

SEQ ID NO: 2036341 - RNA, 12 nt, Staphylococcus aureus subsp. aureus Mu50
uaauuaucauaa

SEQ ID NO: 2036342 - RNA, 14 nt, Staphylococcus aureus subsp. aureus Mu50
uaauuaucauaaag

SEQ ID NO: 2036343 - RNA, 12 nt, Staphylococcus aureus subsp. aureus Mu50
uaauuaucauua

SEQ ID NO: 2036344 - RNA, 15 nt, Staphylococcus aureus subsp. aureus Mu50
uaauuaauguuucuu

SEQ ID NO: 2036345 - RNA, 16 nt, Staphylococcus aureus subsp. aureus Mu50
uaauuaauguuucuuc

SEQ ID NO: 2036346 - RNA, 14 nt, Staphylococcus aureus subsp. aureus Mu50
uaauuaauacauca

SEQ ID NO: 2036347 - RNA, 23 nt, Staphylococcus aureus subsp. aureus Mu50
uaaugggaauuguauuagcaauu

SEQ ID NO: 2036348 - RNA, 17 nt, Staphylococcus aureus subsp. aureus Mu50
uaaugguaaugucauau

SEQ ID NO: 2036349 - RNA, 20 nt, Staphylococcus aureus subsp. aureus Mu50
uaauuauuuucucgauacaa

SEQ ID NO: 2036350 - RNA, 17 nt, Staphylococcus aureus subsp. aureus Mu50
uaauuaugguaauuagu

SEQ ID NO: 2036351 - RNA, 19 nt, Staphylococcus aureus subsp. aureus Mu50
uaauuauuaggggagauua

SEQ ID NO: 2036352 - RNA, 21 nt, Staphylococcus aureus subsp. aureus Mu50
uaauuugaaugccuacagauu

SEQ ID NO: 2036353 - RNA, 14 nt, Staphylococcus aureus subsp. aureus Mu50
uaauucgccaucuu

SEQ ID NO: 2036354 - RNA, 18 nt, Staphylococcus aureus subsp. aureus Mu50
uaauuccaguauuaacug

SEQ ID NO: 2036355 - RNA, 15 nt, Staphylococcus aureus subsp. aureus Mu50
uaauucccuguuaug

SEQ ID NO: 2036356 - RNA, 22 nt, Staphylococcus aureus subsp. aureus Mu50
uaauucaucaaguugauaaugu

SEQ ID NO: 2036357 - RNA, 23 nt, Staphylococcus aureus subsp. aureus Mu50
uaauucaucuugcgccuuguuca

SEQ ID NO: 2036358 - RNA, 13 nt, Staphylococcus aureus subsp. aureus Mu50
uaagcuuguaaca

SEQ ID NO: 2036359 - RNA, 14 nt, Staphylococcus aureus subsp. aureus Mu50
uaagcuuucauuaa

SEQ ID NO: 2036360 - RNA, 14 nt, Staphylococcus aureus subsp. aureus Mu50
uaagcugaaaauca

SEQ ID NO: 2036361 - RNA, 14 nt, Staphylococcus aureus subsp. aureus Mu50
uaauaaaaaccaau

SEQ ID NO: 2036362 - RNA, 14 nt, Staphylococcus aureus subsp. aureus Mu50
uaaguuuguuuucu

SEQ ID NO: 2036363 - RNA, 20 nt, Staphylococcus aureus subsp. aureus Mu50
uaaguuugucuuugaacaua

SEQ ID NO: 2036364 - RNA, 15 nt, Staphylococcus aureus subsp. aureus Mu50
uaaguuugucuuuga

SEQ ID NO: 2036365 - RNA, 19 nt, Staphylococcus aureus subsp. aureus Mu50
uaauaauuaaauauaaaga

SEQ ID NO: 2036366 - RNA, 19 nt, Staphylococcus aureus subsp. aureus Mu50
uaauaauuggaaucaucuu

SEQ ID NO: 2036367 - RNA, 13 nt, Staphylococcus aureus subsp. aureus Mu50
uaauacaucuaau

SEQ ID NO: 2036368 - RNA, 15 nt, Staphylococcus aureus subsp. aureus Mu50
uaauacauacugauu

SEQ ID NO: 2036369 - RNA, 14 nt, Staphylococcus aureus subsp. aureus Mu50
uaauacaucaucaa

SEQ ID NO: 2036370 - RNA, 21 nt, Staphylococcus aureus subsp. aureus Mu50
uaauacaucaucaaguucacc

SEQ ID NO: 2036371 - RNA, 20 nt, Staphylococcus aureus subsp. aureus Mu50
uaauaagucugaugucgaaa

SEQ ID NO: 2036372 - RNA, 21 nt, Staphylococcus aureus subsp. aureus Mu50
uaauaaucggacugauggaaa

SEQ ID NO: 2036373 - RNA, 14 nt, Staphylococcus aureus subsp. aureus Mu50
uaauaauaucuuuu

SEQ ID NO: 2036374 - RNA, 14 nt, Staphylococcus aureus subsp. aureus Mu50
uaauaauguaucau

SEQ ID NO: 2036375 - RNA, 12 nt, Staphylococcus aureus subsp. aureus Mu50
uaauaacgcaua

SEQ ID NO: 2036376 - RNA, 22 nt, Staphylococcus aureus subsp. aureus Mu50
uaauaagagaacuuuucaaaca

SEQ ID NO: 2036377 - RNA, 18 nt, Staphylococcus aureus subsp. aureus Mu50
uaauaaauaucuuaguau

SEQ ID NO: 2036378 - RNA, 14 nt, Staphylococcus aureus subsp. aureus Mu50
uaauaacaaauagu

SEQ ID NO: 2036379 - RNA, 16 nt, Staphylococcus aureus subsp. aureus Mu50
uaaccuuuaaaacguu

SEQ ID NO: 2036380 - RNA, 22 nt, Staphylococcus aureus subsp. aureus Mu50
uaaccuuucgcagcuucuuuaa

SEQ ID NO: 2036381 - RNA, 22 nt, Staphylococcus aureus subsp. aureus Mu50
uaacgauaguuuuuuuucauag

SEQ ID NO: 2036382 - RNA, 18 nt, Staphylococcus aureus subsp. aureus Mu50
uaacuuucccuacugcuu

SEQ ID NO: 2036383 - RNA, 14 nt, Staphylococcus aureus subsp. aureus Mu50
uaacuuuuuaaagg

SEQ ID NO: 2036384 - RNA, 17 nt, Staphylococcus aureus subsp. aureus Mu50
uaacuuuuuacauuuuc

SEQ ID NO: 2036385 - RNA, 21 nt, Staphylococcus aureus subsp. aureus Mu50
uaacuuuuuaauaauuguauc

SEQ ID NO: 2036386 - RNA, 15 nt, Staphylococcus aureus subsp. aureus Mu50
uaagaauuuaaaaga

SEQ ID NO: 2036387 - RNA, 21 nt, Staphylococcus aureus subsp. aureus Mu50
uaagaaaaaguuauaucauca

SEQ ID NO: 2036388 - RNA, 21 nt, Staphylococcus aureus subsp. aureus Mu50
uaagagucuucuuacugcaau

SEQ ID NO: 2036389 - RNA, 21 nt, Staphylococcus aureus subsp. aureus Mu50
uaagauaauuuucaauuagaa

SEQ ID NO: 2036390 - RNA, 20 nt, Staphylococcus aureus subsp. aureus Mu50
uaagauacuuuuaaauuaug

SEQ ID NO: 2036391 - RNA, 16 nt, Staphylococcus aureus subsp. aureus Mu50
uaagauagauaaauca

SEQ ID NO: 2036392 - RNA, 15 nt, Staphylococcus aureus subsp. aureus Mu50
uaagaucaauaucac

SEQ ID NO: 2036393 - RNA, 12 nt, Staphylococcus aureus subsp. aureus Mu50
uaagauuauuug

SEQ ID NO: 2036394 - RNA, 12 nt, Staphylococcus aureus subsp. aureus Mu50
uaagcaauuucu

SEQ ID NO: 2036395 - RNA, 18 nt, Staphylococcus aureus subsp. aureus Mu50
guuuaucuccuaaaggua

SEQ ID NO: 2036396 - RNA, 14 nt, Staphylococcus aureus subsp. aureus Mu50
guuucaacauauua

SEQ ID NO: 2036397 - RNA, 16 nt, Staphylococcus aureus subsp. aureus Mu50
guuucaacauauuaua

SEQ ID NO: 2036398 - RNA, 22 nt, Staphylococcus aureus subsp. aureus Mu50
guuucaagcguuucuugaucua

SEQ ID NO: 2036399 - RNA, 22 nt, Staphylococcus aureus subsp. aureus Mu50
guuuauugccgguuaaauuauu

SEQ ID NO: 2036400 - RNA, 16 nt, Staphylococcus aureus subsp. aureus Mu50
guuuauuuaauaacga

SEQ ID NO: 2036401 - RNA, 18 nt, Staphylococcus aureus subsp. aureus Mu50
guuuauuuaauaacgaag

SEQ ID NO: 2036402 - RNA, 18 nt, Staphylococcus aureus subsp. aureus Mu50
guuuauacuuaauauagu

SEQ ID NO: 2036403 - RNA, 14 nt, Staphylococcus aureus subsp. aureus Mu50
guuuauaucuuugu

SEQ ID NO: 2036404 - RNA, 14 nt, Staphylococcus aureus subsp. aureus Mu50
guuuauauugcaaa

SEQ ID NO: 2036405 - RNA, 18 nt, Staphylococcus aureus subsp. aureus Mu50
guuuauauugcaaaaaua

SEQ ID NO: 2036406 - RNA, 22 nt, Staphylococcus aureus subsp. aureus Mu50
guuuagauucacuguauaaaua

SEQ ID NO: 2036407 - RNA, 22 nt, Staphylococcus aureus subsp. aureus Mu50
guuuaauggcagcgaucuuuuu

SEQ ID NO: 2036408 - RNA, 15 nt, Staphylococcus aureus subsp. aureus Mu50
guuguguaauaaagc

SEQ ID NO: 2036409 - RNA, 19 nt, Staphylococcus aureus subsp. aureus Mu50
guuuaauugcuguaaauau

SEQ ID NO: 2036410 - RNA, 20 nt, Staphylococcus aureus subsp. aureus Mu50
guuuaauugcuguaaauauu

SEQ ID NO: 2036411 - RNA, 17 nt, Staphylococcus aureus subsp. aureus Mu50
guuuaauuuucuaaaua

SEQ ID NO: 2036412 - RNA, 16 nt, Staphylococcus aureus subsp. aureus Mu50
guuuaagauuuuaucu

SEQ ID NO: 2036413 - RNA, 15 nt, Staphylococcus aureus subsp. aureus Mu50
guuuaagaaaucaac

SEQ ID NO: 2036414 - RNA, 14 nt, Staphylococcus aureus subsp. aureus Mu50
guuuaagaauguac

SEQ ID NO: 2036415 - RNA, 13 nt, Staphylococcus aureus subsp. aureus Mu50
guuguuuuuuugu

SEQ ID NO: 2036416 - RNA, 13 nt, Staphylococcus aureus subsp. aureus Mu50
guugcuucuuauc

SEQ ID NO: 2036417 - RNA, 21 nt, Staphylococcus aureus subsp. aureus Mu50
guucaaauugaacuucuuuuu

SEQ ID NO: 2036418 - RNA, 18 nt, Staphylococcus aureus subsp. aureus Mu50
guucuauauaauuuauuu

SEQ ID NO: 2036419 - RNA, 14 nt, Staphylococcus aureus subsp. aureus Mu50
guucuauugcagaa

SEQ ID NO: 2036420 - RNA, 13 nt, Staphylococcus aureus subsp. aureus Mu50
guucuauuugaua

SEQ ID NO: 2036421 - RNA, 19 nt, Staphylococcus aureus subsp. aureus Mu50
guucucauuauaaugauuu

SEQ ID NO: 2036422 - RNA, 14 nt, Staphylococcus aureus subsp. aureus Mu50
guucgggaauuuuu

SEQ ID NO: 2036423 - RNA, 18 nt, Staphylococcus aureus subsp. aureus Mu50
guugaauacuucguuaua

SEQ ID NO: 2036424 - RNA, 12 nt, Staphylococcus aureus subsp. aureus Mu50
guuaaaauaaaa

SEQ ID NO: 2036425 - RNA, 23 nt, Staphylococcus aureus subsp. aureus Mu50
guuaaaaucgcagcaaugacacu

SEQ ID NO: 2036426 - RNA, 17 nt, Staphylococcus aureus subsp. aureus Mu50
guuaaacgcugauuuua

SEQ ID NO: 2036427 - RNA, 13 nt, Staphylococcus aureus subsp. aureus Mu50
guuaaauucaucu

SEQ ID NO: 2036428 - RNA, 21 nt, Staphylococcus aureus subsp. aureus Mu50
guuaaaaccuuuucaaauuau

SEQ ID NO: 2036429 - RNA, 22 nt, Staphylococcus aureus subsp. aureus Mu50
guuaaagucauaggcuugccaa

SEQ ID NO: 2036430 - RNA, 15 nt, Staphylococcus aureus subsp. aureus Mu50
guuaagacauaugca

SEQ ID NO: 2036431 - RNA, 23 nt, Staphylococcus aureus subsp. aureus Mu50
guuaagagguuuugcacuaaugg

SEQ ID NO: 2036432 - RNA, 14 nt, Staphylococcus aureus subsp. aureus Mu50
guuaauauucuuuc

SEQ ID NO: 2036433 - RNA, 14 nt, Staphylococcus aureus subsp. aureus Mu50
guuaaucaacguau

SEQ ID NO: 2036434 - RNA, 15 nt, Staphylococcus aureus subsp. aureus Mu50
guuaauaagcgcauc

SEQ ID NO: 2036435 - RNA, 16 nt, Staphylococcus aureus subsp. aureus Mu50
guuaagugucuauguu

SEQ ID NO: 2036436 - RNA, 16 nt, Staphylococcus aureus subsp. aureus Mu50
guuaauccucauuaug

SEQ ID NO: 2036437 - RNA, 19 nt, Staphylococcus aureus subsp. aureus Mu50
guuaaucagugaaauauca

SEQ ID NO: 2036438 - RNA, 18 nt, Staphylococcus aureus subsp. aureus Mu50
guuaaugugcauuuaucu

SEQ ID NO: 2036439 - RNA, 13 nt, Staphylococcus aureus subsp. aureus Mu50
guuaauucaacgg

SEQ ID NO: 2036440 - RNA, 19 nt, Staphylococcus aureus subsp. aureus Mu50
guuaauuggguuuaauaac

SEQ ID NO: 2036441 - RNA, 21 nt, Staphylococcus aureus subsp. aureus Mu50
guuaauuggguuuaauaacau

SEQ ID NO: 2036442 - RNA, 16 nt, Staphylococcus aureus subsp. aureus Mu50
guuaauuucaacauua

SEQ ID NO: 2036443 - RNA, 17 nt, Staphylococcus aureus subsp. aureus Mu50
guuacacuuuucuuauc

SEQ ID NO: 2036444 - RNA, 20 nt, Staphylococcus aureus subsp. aureus Mu50
guucaaauaacgcaaugucu

SEQ ID NO: 2036445 - RNA, 16 nt, Staphylococcus aureus subsp. aureus Mu50
guuauuaaccaucaug

SEQ ID NO: 2036446 - RNA, 17 nt, Staphylococcus aureus subsp. aureus Mu50
guuauguuagucuuuuu

SEQ ID NO: 2036447 - RNA, 22 nt, Staphylococcus aureus subsp. aureus Mu50
aaguucaucuggugcaauauua

SEQ ID NO: 2036448 - RNA, 14 nt, Staphylococcus aureus subsp. aureus Mu50
aaguucauuacaaa

SEQ ID NO: 2036449 - RNA, 16 nt, Staphylococcus aureus subsp. aureus Mu50
aaguuauuuauucagc

SEQ ID NO: 2036450 - RNA, 17 nt, Staphylococcus aureus subsp. aureus Mu50
aaguuaauaaacgcuuc

SEQ ID NO: 2036451 - RNA, 18 nt, Staphylococcus aureus subsp. aureus Mu50
aaguguuuuaaguucauc

SEQ ID NO: 2036452 - RNA, 22 nt, Staphylococcus aureus subsp. aureus Mu50
aaguuaaaaccuuuucaaauua

SEQ ID NO: 2036453 - RNA, 18 nt, Staphylococcus aureus subsp. aureus Mu50
aaguuauuuaguacauag

SEQ ID NO: 2036454 - RNA, 17 nt, Staphylococcus aureus subsp. aureus Mu50
aaguuauaucaucaaca

SEQ ID NO: 2036455 - RNA, 15 nt, Staphylococcus aureus subsp. aureus Mu50
guuacauauugcauu

SEQ ID NO: 2036456 - RNA, 18 nt, Staphylococcus aureus subsp. aureus Mu50
guuaccaaguaaugauac

SEQ ID NO: 2036457 - RNA, 22 nt, Staphylococcus aureus subsp. aureus Mu50
aagugucugguucuuuacuaaa

SEQ ID NO: 2036458 - RNA, 12 nt, Staphylococcus aureus subsp. aureus Mu50
aaguguuucaac

SEQ ID NO: 2036459 - RNA, 16 nt, Staphylococcus aureus subsp. aureus Mu50
aaguguuucaacauau

SEQ ID NO: 2036460 - RNA, 18 nt, Staphylococcus aureus subsp. aureus Mu50
guguaauaaagcaauguu

SEQ ID NO: 2036461 - RNA, 16 nt, Staphylococcus aureus subsp. aureus Mu50
guguaacuuuaucacu

SEQ ID NO: 2036462 - RNA, 20 nt, Staphylococcus aureus subsp. aureus Mu50
guguaacuuuaucacuguau

SEQ ID NO: 2036463 - RNA, 22 nt, Staphylococcus aureus subsp. aureus Mu50
gugugcaggauaacguucacuu

SEQ ID NO: 2036464 - RNA, 20 nt, Staphylococcus aureus subsp. aureus Mu50
gugucaaauaggcauaauga

SEQ ID NO: 2036465 - RNA, 14 nt, Staphylococcus aureus subsp. aureus Mu50
aagugauaaauaau

SEQ ID NO: 2036466 - RNA, 15 nt, Staphylococcus aureus subsp. aureus Mu50
aagugacaacauuau

SEQ ID NO: 2036467 - RNA, 13 nt, Staphylococcus aureus subsp. aureus Mu50
aagucuuuacucu

SEQ ID NO: 2036468 - RNA, 14 nt, Staphylococcus aureus subsp. aureus Mu50
aagucuuuuaaaug

SEQ ID NO: 2036469 - RNA, 13 nt, Staphylococcus aureus subsp. aureus Mu50
aagucuugugaua

SEQ ID NO: 2036470 - RNA, 18 nt, Staphylococcus aureus subsp. aureus Mu50
aagugcauauuuaauaca

SEQ ID NO: 2036471 - RNA, 21 nt, Staphylococcus aureus subsp. aureus Mu50
aagugccauuuuuaaauuacu

SEQ ID NO: 2036472 - RNA, 18 nt, Staphylococcus aureus subsp. aureus Mu50
aagugccguccauuucca

SEQ ID NO: 2036473 - RNA, 13 nt, Staphylococcus aureus subsp. aureus Mu50
aagugcgauuauc

SEQ ID NO: 2036474 - RNA, 22 nt, Staphylococcus aureus subsp. aureus Mu50
aagugcgggggauuauuuauau

SEQ ID NO: 2036475 - RNA, 13 nt, Staphylococcus aureus subsp. aureus Mu50
gugcauauuuaau

SEQ ID NO: 2036476 - RNA, 21 nt, Staphylococcus aureus subsp. aureus Mu50
gugauuuuuaauaauuugaau

SEQ ID NO: 2036477 - RNA, 17 nt, Staphylococcus aureus subsp. aureus Mu50
gugcacuuguaauauua

SEQ ID NO: 2036478 - RNA, 18 nt, Staphylococcus aureus subsp. aureus Mu50
ucacucauaacaguccca

SEQ ID NO: 2036479 - RNA, 14 nt, Staphylococcus aureus subsp. aureus Mu50
ucacucacuucaac

SEQ ID NO: 2036480 - RNA, 22 nt, Staphylococcus aureus subsp. aureus Mu50
ucacgauagauuuaucaccuuu

SEQ ID NO: 2036481 - RNA, 15 nt, Staphylococcus aureus subsp. aureus Mu50
ucacuguuuuaucua

SEQ ID NO: 2036482 - RNA, 14 nt, Staphylococcus aureus subsp. aureus Mu50
ucacuguuuuauua

SEQ ID NO: 2036483 - RNA, 15 nt, Staphylococcus aureus subsp. aureus Mu50
ucacugcuguucuuu

SEQ ID NO: 2036484 - RNA, 19 nt, Staphylococcus aureus subsp. aureus Mu50
aauacagcuagcaagaaua

SEQ ID NO: 2036485 - RNA, 19 nt, Staphylococcus aureus subsp. aureus Mu50
aauaauuucaguucuuaga

SEQ ID NO: 2036486 - RNA, 18 nt, Staphylococcus aureus subsp. aureus Mu50
aauacauuauguucuuca

SEQ ID NO: 2036487 - RNA, 15 nt, Staphylococcus aureus subsp. aureus Mu50
aauacauaauuaacu

SEQ ID NO: 2036488 - RNA, 16 nt, Staphylococcus aureus subsp. aureus Mu50
aauacauaauuaacuu

SEQ ID NO: 2036489 - RNA, 13 nt, Staphylococcus aureus subsp. aureus Mu50
aauacauacugau

SEQ ID NO: 2036490 - RNA, 19 nt, Staphylococcus aureus subsp. aureus Mu50
aauacauaucggcccauaa

SEQ ID NO: 2036491 - RNA, 21 nt, Staphylococcus aureus subsp. aureus Mu50
aauacauaucggcccauaaua

SEQ ID NO: 2036492 - RNA, 16 nt, Staphylococcus aureus subsp. aureus Mu50
aauacaucaauaucuu

SEQ ID NO: 2036493 - RNA, 14 nt, Staphylococcus aureus subsp. aureus Mu50
aauacaagucuuua

SEQ ID NO: 2036494 - RNA, 16 nt, Staphylococcus aureus subsp. aureus Mu50
aauacagaugaugcuu

SEQ ID NO: 2036495 - RNA, 21 nt, Staphylococcus aureus subsp. aureus Mu50
aauacaagucuuuacucuaca

SEQ ID NO: 2036496 - RNA, 12 nt, Staphylococcus aureus subsp. aureus Mu50
aauacacuugau

SEQ ID NO: 2036497 - RNA, 19 nt, Staphylococcus aureus subsp. aureus Mu50
aauacaaauuacaauaagc

SEQ ID NO: 2036498 - RNA, 15 nt, Staphylococcus aureus subsp. aureus Mu50
aauacaaauauuaag

SEQ ID NO: 2036499 - RNA, 16 nt, Staphylococcus aureus subsp. aureus Mu50
aauaauuuuaucuaaa

SEQ ID NO: 2036500 - RNA, 20 nt, Staphylococcus aureus subsp. aureus Mu50
ucaccauauuuaacauuuug

SEQ ID NO: 2036501 - RNA, 23 nt, Staphylococcus aureus subsp. aureus Mu50
ucaccaguuugugguaaugauuu

SEQ ID NO: 2036502 - RNA, 16 nt, Staphylococcus aureus subsp. aureus Mu50
ucaacgauugaauugu

SEQ ID NO: 2036503 - RNA, 19 nt, Staphylococcus aureus subsp. aureus Mu50
ucaacgucgaauguuucuu

SEQ ID NO: 2036504 - RNA, 14 nt, Staphylococcus aureus subsp. aureus Mu50
ucacauauuaugau

SEQ ID NO: 2036505 - RNA, 22 nt, Staphylococcus aureus subsp. aureus Mu50
ucacauacauuuugaaacaucu

SEQ ID NO: 2036506 - RNA, 18 nt, Staphylococcus aureus subsp. aureus Mu50
ucacaugugaaauaaucc

SEQ ID NO: 2036507 - RNA, 20 nt, Staphylococcus aureus subsp. aureus Mu50
ucacaugaggaucaacugaa

SEQ ID NO: 2036508 - RNA, 18 nt, Staphylococcus aureus subsp. aureus Mu50
ucacaucuuuagcuaugu

SEQ ID NO: 2036509 - RNA, 18 nt, Staphylococcus aureus subsp. aureus Mu50
ucacaguguugaauuuca

SEQ ID NO: 2036510 - RNA, 15 nt, Staphylococcus aureus subsp. aureus Mu50
ucaugagacaaacgc

SEQ ID NO: 2036511 - RNA, 20 nt, Staphylococcus aureus subsp. aureus Mu50
ucaugacauaaaacuuacau

SEQ ID NO: 2036512 - RNA, 18 nt, Staphylococcus aureus subsp. aureus Mu50
ucaugcuuaauuuaugug

SEQ ID NO: 2036513 - RNA, 17 nt, Staphylococcus aureus subsp. aureus Mu50
uccaacacccauauaau

SEQ ID NO: 2036514 - RNA, 17 nt, Staphylococcus aureus subsp. aureus Mu50
uccaacauauaaaaaau

SEQ ID NO: 2036515 - RNA, 18 nt, Staphylococcus aureus subsp. aureus Mu50
ucaugaaauuagauuuua

SEQ ID NO: 2036516 - RNA, 18 nt, Staphylococcus aureus subsp. aureus Mu50
ucaugaaaauaagcauca

SEQ ID NO: 2036517 - RNA, 15 nt, Staphylococcus aureus subsp. aureus Mu50
ucaucuuuugucuua

SEQ ID NO: 2036518 - RNA, 20 nt, Staphylococcus aureus subsp. aureus Mu50
ucaucuuuugucuuacuaau

SEQ ID NO: 2036519 - RNA, 15 nt, Staphylococcus aureus subsp. aureus Mu50
ucauccauaaaaaua

SEQ ID NO: 2036520 - RNA, 13 nt, Staphylococcus aureus subsp. aureus Mu50
ucauaucuuucaa

SEQ ID NO: 2036521 - RNA, 16 nt, Staphylococcus aureus subsp. aureus Mu50
ucauauccuucauuag

SEQ ID NO: 2036522 - RNA, 15 nt, Staphylococcus aureus subsp. aureus Mu50
ucauaucgauuaaua

SEQ ID NO: 2036523 - RNA, 16 nt, Staphylococcus aureus subsp. aureus Mu50
ucauaucgauuaauag

SEQ ID NO: 2036524 - RNA, 17 nt, Staphylococcus aureus subsp. aureus Mu50
ucauaucgauuaauagu

SEQ ID NO: 2036525 - RNA, 22 nt, Staphylococcus aureus subsp. aureus Mu50
ucauauuuaucgcgauuauuac

SEQ ID NO: 2036526 - RNA, 17 nt, Staphylococcus aureus subsp. aureus Mu50
ucaguuauaccauauuu

SEQ ID NO: 2036527 - RNA, 19 nt, Staphylococcus aureus subsp. aureus Mu50
ucaguccgcuuuuucauag

SEQ ID NO: 2036528 - RNA, 23 nt, Staphylococcus aureus subsp. aureus Mu50
ucaguaggacauauaaauguuga

SEQ ID NO: 2036529 - RNA, 17 nt, Staphylococcus aureus subsp. aureus Mu50
ucaguaguuuuaaaagu

SEQ ID NO: 2036530 - RNA, 21 nt, Staphylococcus aureus subsp. aureus Mu50
ucaguacgguuauuuaauaau

SEQ ID NO: 2036531 - RNA, 16 nt, Staphylococcus aureus subsp. aureus Mu50
ucaguaaaaacgaaau

SEQ ID NO: 2036532 - RNA, 19 nt, Staphylococcus aureus subsp. aureus Mu50
uaccgaauccuucaucaau

SEQ ID NO: 2036533 - RNA, 19 nt, Staphylococcus aureus subsp. aureus Mu50
uacccaaaaaauuguauaa

SEQ ID NO: 2036534 - RNA, 13 nt, Staphylococcus aureus subsp. aureus Mu50
uaccauuccaaaa

SEQ ID NO: 2036535 - RNA, 17 nt, Staphylococcus aureus subsp. aureus Mu50
uaccauugugaauaauu

SEQ ID NO: 2036536 - RNA, 18 nt, Staphylococcus aureus subsp. aureus Mu50
uaccauugugaauaauuu

SEQ ID NO: 2036537 - RNA, 22 nt, Staphylococcus aureus subsp. aureus Mu50
uaccccaagaugguauugcuuu

SEQ ID NO: 2036538 - RNA, 17 nt, Staphylococcus aureus subsp. aureus Mu50
uacaaaacauauucagu

SEQ ID NO: 2036539 - RNA, 14 nt, Staphylococcus aureus subsp. aureus Mu50
uaauuuuucauuaa

SEQ ID NO: 2036540 - RNA, 15 nt, Staphylococcus aureus subsp. aureus Mu50
uaauuuuuaauguau

SEQ ID NO: 2036541 - RNA, 17 nt, Staphylococcus aureus subsp. aureus Mu50
uaauucguaauuuauga

SEQ ID NO: 2036542 - RNA, 15 nt, Staphylococcus aureus subsp. aureus Mu50
uaauuuuauuauuaa

SEQ ID NO: 2036543 - RNA, 17 nt, Staphylococcus aureus subsp. aureus Mu50
uaauuuucaauuagaaa

SEQ ID NO: 2036544 - RNA, 17 nt, Staphylococcus aureus subsp. aureus Mu50
uaauuuuaccuguuucu

SEQ ID NO: 2036545 - RNA, 13 nt, Staphylococcus aureus subsp. aureus Mu50
uaauuuuacucug

SEQ ID NO: 2036546 - RNA, 17 nt, Staphylococcus aureus subsp. aureus Mu50
uaccauaauuaaauaac

SEQ ID NO: 2036547 - RNA, 20 nt, Staphylococcus aureus subsp. aureus Mu50
uaccauaauuaaauaacuuu

SEQ ID NO: 2036548 - RNA, 19 nt, Staphylococcus aureus subsp. aureus Mu50
uacaaagugauuuaaaaaa

SEQ ID NO: 2036549 - RNA, 18 nt, Staphylococcus aureus subsp. aureus Mu50
uacaaagccuuaauauca

SEQ ID NO: 2036550 - RNA, 22 nt, Staphylococcus aureus subsp. aureus Mu50
uaccgguuuuucguauaauuuu

SEQ ID NO: 2036551 - RNA, 15 nt, Staphylococcus aureus subsp. aureus Mu50
uaccuaauaggauca

SEQ ID NO: 2036552 - RNA, 19 nt, Staphylococcus aureus subsp. aureus Mu50
uaccucugauaaaugaauu

SEQ ID NO: 2036553 - RNA, 20 nt, Staphylococcus aureus subsp. aureus Mu50
uagccaaaggcaaaauguau

SEQ ID NO: 2036554 - RNA, 19 nt, Staphylococcus aureus subsp. aureus Mu50
uagaugcuaauguaaucug

SEQ ID NO: 2036555 - RNA, 15 nt, Staphylococcus aureus subsp. aureus Mu50
uagauuaucuuucaa

SEQ ID NO: 2036556 - RNA, 18 nt, Staphylococcus aureus subsp. aureus Mu50
uagauuuaucgccaauua

SEQ ID NO: 2036557 - RNA, 21 nt, Staphylococcus aureus subsp. aureus Mu50
uagcauagcguucaauagcau

SEQ ID NO: 2036558 - RNA, 18 nt, Staphylococcus aureus subsp. aureus Mu50
uagcauauucgcuuaaaa

SEQ ID NO: 2036559 - RNA, 19 nt, Staphylococcus aureus subsp. aureus Mu50
uagcguacgauauagugcu

SEQ ID NO: 2036560 - RNA, 15 nt, Staphylococcus aureus subsp. aureus Mu50
uagagauaacuagaa

SEQ ID NO: 2036561 - RNA, 18 nt, Staphylococcus aureus subsp. aureus Mu50
uagagauuguaagaauua

SEQ ID NO: 2036562 - RNA, 15 nt, Staphylococcus aureus subsp. aureus Mu50
uagauauauuugaaa

SEQ ID NO: 2036563 - RNA, 13 nt, Staphylococcus aureus subsp. aureus Mu50
uagauaucauuuu

SEQ ID NO: 2036564 - RNA, 21 nt, Staphylococcus aureus subsp. aureus Mu50
uagauacugaauuuuaacuaa

SEQ ID NO: 2036565 - RNA, 21 nt, Staphylococcus aureus subsp. aureus Mu50
uagauagacuuucuugaugaa

SEQ ID NO: 2036566 - RNA, 19 nt, Staphylococcus aureus subsp. aureus Mu50
uagauaaaucgauaaaaug

SEQ ID NO: 2036567 - RNA, 16 nt, Staphylococcus aureus subsp. aureus Mu50
uagauaaauuaauaug

SEQ ID NO: 2036568 - RNA, 15 nt, Staphylococcus aureus subsp. aureus Mu50
uagauaaaucaagaa

SEQ ID NO: 2036569 - RNA, 18 nt, Staphylococcus aureus subsp. aureus Mu50
uagaacuaagaugugcau

SEQ ID NO: 2036570 - RNA, 16 nt, Staphylococcus aureus subsp. aureus Mu50
uagaacaagaauuaug

SEQ ID NO: 2036571 - RNA, 20 nt, Staphylococcus aureus subsp. aureus Mu50
uagaagaacaauaauugaug

SEQ ID NO: 2036572 - RNA, 21 nt, Staphylococcus aureus subsp. aureus Mu50
uagaagauauaacauguauau

SEQ ID NO: 2036573 - RNA, 22 nt, Staphylococcus aureus subsp. aureus Mu50
uagacguuuuuauguauuuauu

SEQ ID NO: 2036574 - RNA, 18 nt, Staphylococcus aureus subsp. aureus Mu50
uagaaugucgauauuucu

SEQ ID NO: 2036575 - RNA, 11 nt, Staphylococcus aureus subsp. aureus Mu50
uagaaugaaua

SEQ ID NO: 2036576 - RNA, 14 nt, Staphylococcus aureus subsp. aureus Mu50
uagaaugaauaauu

SEQ ID NO: 2036577 - RNA, 15 nt, Staphylococcus aureus subsp. aureus Mu50
uagaaugaauaauuc

SEQ ID NO: 2036578 - RNA, 19 nt, Staphylococcus aureus subsp. aureus Mu50
uagaaucuacgauuuucaa

SEQ ID NO: 2036579 - RNA, 23 nt, Staphylococcus aureus subsp. aureus Mu50
uagaaucuacgauuuucaagacc

SEQ ID NO: 2036580 - RNA, 16 nt, Staphylococcus aureus subsp. aureus Mu50
uacuauggcauuauug

SEQ ID NO: 2036581 - RNA, 13 nt, Staphylococcus aureus subsp. aureus Mu50
uacucaaguaauc

SEQ ID NO: 2036582 - RNA, 13 nt, Staphylococcus aureus subsp. aureus Mu50
uacucauuuagcu

SEQ ID NO: 2036583 - RNA, 21 nt, Staphylococcus aureus subsp. aureus Mu50
uacugucuuuccauaauaaug

SEQ ID NO: 2036584 - RNA, 15 nt, Staphylococcus aureus subsp. aureus Mu50
uacuguguuuaggua

SEQ ID NO: 2036585 - RNA, 22 nt, Staphylococcus aureus subsp. aureus Mu50
uacuguauuuuaacgucauuuu

SEQ ID NO: 2036586 - RNA, 14 nt, Staphylococcus aureus subsp. aureus Mu50
uacuuaauauaguu

SEQ ID NO: 2036587 - RNA, 20 nt, Staphylococcus aureus subsp. aureus Mu50
uacuuaaugacuucuuuaua

SEQ ID NO: 2036588 - RNA, 19 nt, Staphylococcus aureus subsp. aureus Mu50
uacuuagcguacgauauag

SEQ ID NO: 2036589 - RNA, 16 nt, Staphylococcus aureus subsp. aureus Mu50
uacuuaauuaauaauu

SEQ ID NO: 2036590 - RNA, 12 nt, Staphylococcus aureus subsp. aureus Mu50
uacuuaauuuaa

SEQ ID NO: 2036591 - RNA, 16 nt, Staphylococcus aureus subsp. aureus Mu50
uacucuaacuuaccau

SEQ ID NO: 2036592 - RNA, 16 nt, Staphylococcus aureus subsp. aureus Mu50
uauaaagaaauaauuu

SEQ ID NO: 2036593 - RNA, 21 nt, Staphylococcus aureus subsp. aureus Mu50
uauaaagauagaaugaauaau

SEQ ID NO: 2036594 - RNA, 14 nt, Staphylococcus aureus subsp. aureus Mu50
uauaaauacaaaua

SEQ ID NO: 2036595 - RNA, 19 nt, Staphylococcus aureus subsp. aureus Mu50
uauaaaguuuguaauauug

SEQ ID NO: 2036596 - RNA, 20 nt, Staphylococcus aureus subsp. aureus Mu50
uauaaauaaccgcacuuucu

SEQ ID NO: 2036597 - RNA, 15 nt, Staphylococcus aureus subsp. aureus Mu50
uauaaauaauaaaug

SEQ ID NO: 2036598 - RNA, 17 nt, Staphylococcus aureus subsp. aureus Mu50
uaguuuguaauaauuaa

SEQ ID NO: 2036599 - RNA, 12 nt, Staphylococcus aureus subsp. aureus Mu50
uaguuuucuuaa

SEQ ID NO: 2036600 - RNA, 13 nt, Staphylococcus aureus subsp. aureus Mu50
uauaaaaacaaaa

SEQ ID NO: 2036601 - RNA, 20 nt, Staphylococcus aureus subsp. aureus Mu50
uauaaaaauuuauucaaaau

SEQ ID NO: 2036602 - RNA, 19 nt, Staphylococcus aureus subsp. aureus Mu50
uauaaaagauauaaacauu

SEQ ID NO: 2036603 - RNA, 13 nt, Staphylococcus aureus subsp. aureus Mu50
uauaaaauaaaau

SEQ ID NO: 2036604 - RNA, 14 nt, Staphylococcus aureus subsp. aureus Mu50
uauaaaauaaaaug

SEQ ID NO: 2036605 - RNA, 13 nt, Staphylococcus aureus subsp. aureus Mu50
uauaaaauaaaua

SEQ ID NO: 2036606 - RNA, 15 nt, Staphylococcus aureus subsp. aureus Mu50
uauaaaaugaauaau

SEQ ID NO: 2036607 - RNA, 18 nt, Staphylococcus aureus subsp. aureus Mu50
uauaacugauaauacugu

SEQ ID NO: 2036608 - RNA, 23 nt, Staphylococcus aureus subsp. aureus Mu50
uauaagaaucagcuaaauauuuu

SEQ ID NO: 2036609 - RNA, 21 nt, Staphylococcus aureus subsp. aureus Mu50
uauaagaauuguugaucauga

SEQ ID NO: 2036610 - RNA, 17 nt, Staphylococcus aureus subsp. aureus Mu50
uauaaguaaucauaaua

SEQ ID NO: 2036611 - RNA, 15 nt, Staphylococcus aureus subsp. aureus Mu50
uauaagccuuuucaa

SEQ ID NO: 2036612 - RNA, 18 nt, Staphylococcus aureus subsp. aureus Mu50
uauaagccuuuucaaaca

SEQ ID NO: 2036613 - RNA, 22 nt, Staphylococcus aureus subsp. aureus Mu50
uauaaauauuuuuaauuauuuu

SEQ ID NO: 2036614 - RNA, 13 nt, Staphylococcus aureus subsp. aureus Mu50
uauaaaucaaaua

SEQ ID NO: 2036615 - RNA, 18 nt, Staphylococcus aureus subsp. aureus Mu50
uauaaaucaaauauacuu

SEQ ID NO: 2036616 - RNA, 23 nt, Staphylococcus aureus subsp. aureus Mu50
uauaaaugcacaaacaaaagcac

SEQ ID NO: 2036617 - RNA, 17 nt, Staphylococcus aureus subsp. aureus Mu50
uauaaauuaaaugcaau

SEQ ID NO: 2036618 - RNA, 15 nt, Staphylococcus aureus subsp. aureus Mu50
uauaaauuaucagaa

SEQ ID NO: 2036619 - RNA, 14 nt, Staphylococcus aureus subsp. aureus Mu50
uauaacaucaaaua

SEQ ID NO: 2036620 - RNA, 23 nt, Staphylococcus aureus subsp. aureus Mu50
uauaacauucuucaaaaaauaau

SEQ ID NO: 2036621 - RNA, 19 nt, Staphylococcus aureus subsp. aureus Mu50
uauaaauuugguacauaau

SEQ ID NO: 2036622 - RNA, 22 nt, Staphylococcus aureus subsp. aureus Mu50
uauaaauuuguaccaaauaaau

SEQ ID NO: 2036623 - RNA, 15 nt, Staphylococcus aureus subsp. aureus Mu50
uauaacaacuacuua

SEQ ID NO: 2036624 - RNA, 18 nt, Staphylococcus aureus subsp. aureus Mu50
uauaacaaguacaauaau

SEQ ID NO: 2036625 - RNA, 19 nt, Staphylococcus aureus subsp. aureus Mu50
uauagcguuuaagaaauca

SEQ ID NO: 2036626 - RNA, 13 nt, Staphylococcus aureus subsp. aureus Mu50
uauaguaauuguu

SEQ ID NO: 2036627 - RNA, 23 nt, Staphylococcus aureus subsp. aureus Mu50
uauaguccggggccccaacaaag

SEQ ID NO: 2036628 - RNA, 20 nt, Staphylococcus aureus subsp. aureus Mu50
uauagucuuaaacauaacau

SEQ ID NO: 2036629 - RNA, 14 nt, Staphylococcus aureus subsp. aureus Mu50
uauauaaaaucauu

SEQ ID NO: 2036630 - RNA, 16 nt, Staphylococcus aureus subsp. aureus Mu50
uauauaaagaaauaau

SEQ ID NO: 2036631 - RNA, 14 nt, Staphylococcus aureus subsp. aureus Mu50
uauaguucuauugc

SEQ ID NO: 2036632 - RNA, 18 nt, Staphylococcus aureus subsp. aureus Mu50
uauagugucgagauuuua

SEQ ID NO: 2036633 - RNA, 22 nt, Staphylococcus aureus subsp. aureus Mu50
uauaguguucaagcuuuauuuu

SEQ ID NO: 2036634 - RNA, 16 nt, Staphylococcus aureus subsp. aureus Mu50
uauagcaccauuauua

SEQ ID NO: 2036635 - RNA, 19 nt, Staphylococcus aureus subsp. aureus Mu50
uauagcaucauaaaguaaa

SEQ ID NO: 2036636 - RNA, 16 nt, Staphylococcus aureus subsp. aureus Mu50
uauagauagacuuucu

SEQ ID NO: 2036637 - RNA, 21 nt, Staphylococcus aureus subsp. aureus Mu50
uauagauuaaaccgcacuucu

SEQ ID NO: 2036638 - RNA, 20 nt, Staphylococcus aureus subsp. aureus Mu50
uauaaguagcucaaaacaau

SEQ ID NO: 2036639 - RNA, 13 nt, Staphylococcus aureus subsp. aureus Mu50
uauaaguauaaug

SEQ ID NO: 2036640 - RNA, 18 nt, Staphylococcus aureus subsp. aureus Mu50
uauaaguauauaauugau

SEQ ID NO: 2036641 - RNA, 15 nt, Staphylococcus aureus subsp. aureus Mu50
uauaauagaaauaau

SEQ ID NO: 2036642 - RNA, 12 nt, Staphylococcus aureus subsp. aureus Mu50
uauaaucauuaa

SEQ ID NO: 2036643 - RNA, 14 nt, Staphylococcus aureus subsp. aureus Mu50
uauaaugauguauu

SEQ ID NO: 2036644 - RNA, 16 nt, Staphylococcus aureus subsp. aureus Mu50
uauaaugauguauuuu

SEQ ID NO: 2036645 - RNA, 18 nt, Staphylococcus aureus subsp. aureus Mu50
uauaaugcugauaauuuu

SEQ ID NO: 2036646 - RNA, 17 nt, Staphylococcus aureus subsp. aureus Mu50
uaucacauagaguaauu

SEQ ID NO: 2036647 - RNA, 15 nt, Staphylococcus aureus subsp. aureus Mu50
uaucaauugaaugaa

SEQ ID NO: 2036648 - RNA, 22 nt, Staphylococcus aureus subsp. aureus Mu50
uaucaauuuauuauuaacugua

SEQ ID NO: 2036649 - RNA, 17 nt, Staphylococcus aureus subsp. aureus Mu50
uaucaauagaugaaaau

SEQ ID NO: 2036650 - RNA, 20 nt, Staphylococcus aureus subsp. aureus Mu50
uaucaauugaaugaaguaau

SEQ ID NO: 2036651 - RNA, 14 nt, Staphylococcus aureus subsp. aureus Mu50
uaucaacauaaaau

SEQ ID NO: 2036652 - RNA, 14 nt, Staphylococcus aureus subsp. aureus Mu50
uaucaaauaaugaa

SEQ ID NO: 2036653 - RNA, 12 nt, Staphylococcus aureus subsp. aureus Mu50
uaucaacaaauu

SEQ ID NO: 2036654 - RNA, 23 nt, Staphylococcus aureus subsp. aureus Mu50
uaucaaagaaauguaugauauaa

SEQ ID NO: 2036655 - RNA, 20 nt, Staphylococcus aureus subsp. aureus Mu50
uauauaguaggguauugaaa

SEQ ID NO: 2036656 - RNA, 17 nt, Staphylococcus aureus subsp. aureus Mu50
uauauuuuuaucaucuu

SEQ ID NO: 2036657 - RNA, 17 nt, Staphylococcus aureus subsp. aureus Mu50
uauccugauuuaauguu

SEQ ID NO: 2036658 - RNA, 21 nt, Staphylococcus aureus subsp. aureus Mu50
uauccaaggauguuauaaaau

SEQ ID NO: 2036659 - RNA, 15 nt, Staphylococcus aureus subsp. aureus Mu50
uaucauucauuacuu

SEQ ID NO: 2036660 - RNA, 12 nt, Staphylococcus aureus subsp. aureus Mu50
uaucauuauuug

SEQ ID NO: 2036661 - RNA, 17 nt, Staphylococcus aureus subsp. aureus Mu50
uaucauuauuugauaaa

SEQ ID NO: 2036662 - RNA, 19 nt, Staphylococcus aureus subsp. aureus Mu50
uaucaugauuaauuaaaga

SEQ ID NO: 2036663 - RNA, 20 nt, Staphylococcus aureus subsp. aureus Mu50
uaucaugcccucuauuagau

SEQ ID NO: 2036664 - RNA, 14 nt, Staphylococcus aureus subsp. aureus Mu50
uaguaucucauuuu

SEQ ID NO: 2036665 - RNA, 13 nt, Staphylococcus aureus subsp. aureus Mu50
uaguauaaauaaa

SEQ ID NO: 2036666 - RNA, 20 nt, Staphylococcus aureus subsp. aureus Mu50
uaguauaaauaucauaaaug

SEQ ID NO: 2036667 - RNA, 13 nt, Staphylococcus aureus subsp. aureus Mu50
uaguauauucaac

SEQ ID NO: 2036668 - RNA, 18 nt, Staphylococcus aureus subsp. aureus Mu50
uaguaguguauucauuuu

SEQ ID NO: 2036669 - RNA, 15 nt, Staphylococcus aureus subsp. aureus Mu50
uaguacuugaaacau

SEQ ID NO: 2036670 - RNA, 22 nt, Staphylococcus aureus subsp. aureus Mu50
uaguagacgguaucaucugcau

SEQ ID NO: 2036671 - RNA, 19 nt, Staphylococcus aureus subsp. aureus Mu50
uagguuuguugcuuauuaa

SEQ ID NO: 2036672 - RNA, 21 nt, Staphylococcus aureus subsp. aureus Mu50
uaguaauaacaucuaaauuug

SEQ ID NO: 2036673 - RNA, 15 nt, Staphylococcus aureus subsp. aureus Mu50
uaguaauaagacaau

SEQ ID NO: 2036674 - RNA, 23 nt, Staphylococcus aureus subsp. aureus Mu50
uaguaauucuucaucuucuucaa

SEQ ID NO: 2036675 - RNA, 23 nt, Staphylococcus aureus subsp. aureus Mu50
uagguuauuauaaaauaaauaua

SEQ ID NO: 2036676 - RNA, 15 nt, Staphylococcus aureus subsp. aureus Mu50
uagcuuuuaugucua

SEQ ID NO: 2036677 - RNA, 18 nt, Staphylococcus aureus subsp. aureus Mu50
aaguugaauauaaaaaag

SEQ ID NO: 2036678 - RNA, 18 nt, Staphylococcus aureus subsp. aureus Mu50
aaguugacaauacaaauc

SEQ ID NO: 2036679 - RNA, 16 nt, Staphylococcus aureus subsp. aureus Mu50
uagcuguuugauauug

SEQ ID NO: 2036680 - RNA, 13 nt, Staphylococcus aureus subsp. aureus Mu50
uagcuuaauaauu

SEQ ID NO: 2036681 - RNA, 17 nt, Staphylococcus aureus subsp. aureus Mu50
uagcugcuucugcugua

SEQ ID NO: 2036682 - RNA, 17 nt, Staphylococcus aureus subsp. aureus Mu50
uagugccucuuuuauua

SEQ ID NO: 2036683 - RNA, 18 nt, Staphylococcus aureus subsp. aureus Mu50
uagugcgcgauaaauaau

SEQ ID NO: 2036684 - RNA, 22 nt, Staphylococcus aureus subsp. aureus Mu50
uaguggaucacgauaauguaua

SEQ ID NO: 2036685 - RNA, 14 nt, Staphylococcus aureus subsp. aureus Mu50
uaguguuuguaaug

SEQ ID NO: 2036686 - RNA, 14 nt, Staphylococcus aureus subsp. aureus Mu50
uaguuagaaaguau

SEQ ID NO: 2036687 - RNA, 15 nt, Staphylococcus aureus subsp. aureus Mu50
uaguuguaucauuaa

SEQ ID NO: 2036688 - RNA, 19 nt, Staphylococcus aureus subsp. aureus Mu50
uaguuuaagucuaacuuua

SEQ ID NO: 2036689 - RNA, 16 nt, Staphylococcus aureus subsp. aureus Mu50
uaguucgauucaugaa

SEQ ID NO: 2036690 - RNA, 18 nt, Staphylococcus aureus subsp. aureus Mu50
uaguucgauucaugaaua

SEQ ID NO: 2036691 - RNA, 15 nt, Staphylococcus aureus subsp. aureus Mu50
uaguucagcuucuaa

SEQ ID NO: 2036692 - RNA, 20 nt, Staphylococcus aureus subsp. aureus Mu50
uaguucagcuucuaaguaau

SEQ ID NO: 2036693 - RNA, 19 nt, Staphylococcus aureus subsp. aureus Mu50
uaguugagcguuuaauuag

SEQ ID NO: 2036694 - RNA, 16 nt, Staphylococcus aureus subsp. aureus Mu50
uaguucuuuaaauuau

SEQ ID NO: 2036695 - RNA, 16 nt, Staphylococcus aureus subsp. aureus Mu50
uagucucguaauaaug

SEQ ID NO: 2036696 - RNA, 17 nt, Staphylococcus aureus subsp. aureus Mu50
uagucggggccccaaca

SEQ ID NO: 2036697 - RNA, 15 nt, Staphylococcus aureus subsp. aureus Mu50
uaguacauuuauuuu

SEQ ID NO: 2036698 - RNA, 13 nt, Staphylococcus aureus subsp. aureus Mu50
ucaaaaauguuau

SEQ ID NO: 2036699 - RNA, 14 nt, Staphylococcus aureus subsp. aureus Mu50
ucaaaaaauauuua

SEQ ID NO: 2036700 - RNA, 14 nt, Staphylococcus aureus subsp. aureus Mu50
ucaaaaauaaaaau

SEQ ID NO: 2036701 - RNA, 14 nt, Staphylococcus aureus subsp. aureus Mu50
ucaaaagaaauugu

SEQ ID NO: 2036702 - RNA, 21 nt, Staphylococcus aureus subsp. aureus Mu50
ucaaaaaaagcugauuucuau

SEQ ID NO: 2036703 - RNA, 19 nt, Staphylococcus aureus subsp. aureus Mu50
uauuuuuuaguaauaacau

SEQ ID NO: 2036704 - RNA, 16 nt, Staphylococcus aureus subsp. aureus Mu50
uauuuuuuaucauuuu

SEQ ID NO: 2036705 - RNA, 16 nt, Staphylococcus aureus subsp. aureus Mu50
uauuuuuuauguuuua

SEQ ID NO: 2036706 - RNA, 20 nt, Staphylococcus aureus subsp. aureus Mu50
uauuuuucgaauuuaaccag

SEQ ID NO: 2036707 - RNA, 12 nt, Staphylococcus aureus subsp. aureus Mu50
uauuuuucuuaa

SEQ ID NO: 2036708 - RNA, 17 nt, Staphylococcus aureus subsp. aureus Mu50
uauuuuucuucaguuaa

SEQ ID NO: 2036709 - RNA, 19 nt, Staphylococcus aureus subsp. aureus Mu50
uauuuuugcguuaauaauu

SEQ ID NO: 2036710 - RNA, 22 nt, Staphylococcus aureus subsp. aureus Mu50
uauuuuuguauuuauguuuucu

SEQ ID NO: 2036711 - RNA, 18 nt, Staphylococcus aureus subsp. aureus Mu50
ucaacaaagugcaauuau

SEQ ID NO: 2036712 - RNA, 20 nt, Staphylococcus aureus subsp. aureus Mu50
ucaaauuacaaauuaucuag

SEQ ID NO: 2036713 - RNA, 16 nt, Staphylococcus aureus subsp. aureus Mu50
ucaaauuagucaucca

SEQ ID NO: 2036714 - RNA, 20 nt, Staphylococcus aureus subsp. aureus Mu50
ucaaauuauaaccgcuacaa

SEQ ID NO: 2036715 - RNA, 20 nt, Staphylococcus aureus subsp. aureus Mu50
ucaaauucaucaguaccaaa

SEQ ID NO: 2036716 - RNA, 23 nt, Staphylococcus aureus subsp. aureus Mu50
ucaaauugguuuucaugugucau

SEQ ID NO: 2036717 - RNA, 20 nt, Staphylococcus aureus subsp. aureus Mu50
ucaacauaacucaaauaucu

SEQ ID NO: 2036718 - RNA, 18 nt, Staphylococcus aureus subsp. aureus Mu50
ucaacauaauauuucuua

SEQ ID NO: 2036719 - RNA, 19 nt, Staphylococcus aureus subsp. aureus Mu50
ucaacagggguuuuuauau

SEQ ID NO: 2036720 - RNA, 19 nt, Staphylococcus aureus subsp. aureus Mu50
ucaacauuacaugcaccuu

SEQ ID NO: 2036721 - RNA, 22 nt, Staphylococcus aureus subsp. aureus Mu50
ucaacauauuauauauauucca

SEQ ID NO: 2036722 - RNA, 11 nt, Staphylococcus aureus subsp. aureus Mu50
ucaacauuuug

SEQ ID NO: 2036723 - RNA, 19 nt, Staphylococcus aureus subsp. aureus Mu50
ucaacaaaucuauaaauau

SEQ ID NO: 2036724 - RNA, 17 nt, Staphylococcus aureus subsp. aureus Mu50
uauuucacucuacaauc

SEQ ID NO: 2036725 - RNA, 15 nt, Staphylococcus aureus subsp. aureus Mu50
uauuuagauaaaaau

SEQ ID NO: 2036726 - RNA, 17 nt, Staphylococcus aureus subsp. aureus Mu50
uauuuagauucuuuucu

SEQ ID NO: 2036727 - RNA, 16 nt, Staphylococcus aureus subsp. aureus Mu50
uauuuagaauaaacuu

SEQ ID NO: 2036728 - RNA, 19 nt, Staphylococcus aureus subsp. aureus Mu50
uauuuagaauucuaaaaga

SEQ ID NO: 2036729 - RNA, 22 nt, Staphylococcus aureus subsp. aureus Mu50
uauuuauuuugauuaacacaau

SEQ ID NO: 2036730 - RNA, 21 nt, Staphylococcus aureus subsp. aureus Mu50
uauuucaacuuuuuaauaaua

SEQ ID NO: 2036731 - RNA, 23 nt, Staphylococcus aureus subsp. aureus Mu50
uauuuauucauaacguguuugcu

SEQ ID NO: 2036732 - RNA, 14 nt, Staphylococcus aureus subsp. aureus Mu50
uauuuauucauuau

SEQ ID NO: 2036733 - RNA, 15 nt, Staphylococcus aureus subsp. aureus Mu50
uauuuauucauuaua

SEQ ID NO: 2036734 - RNA, 17 nt, Staphylococcus aureus subsp. aureus Mu50
uauuuauucuaaucuaa

SEQ ID NO: 2036735 - RNA, 14 nt, Staphylococcus aureus subsp. aureus Mu50
uauuuauuguuuuu

SEQ ID NO: 2036736 - RNA, 15 nt, Staphylococcus aureus subsp. aureus Mu50
uauuuacuaagucgu

SEQ ID NO: 2036737 - RNA, 14 nt, Staphylococcus aureus subsp. aureus Mu50
uauuuaauuuuucu

SEQ ID NO: 2036738 - RNA, 19 nt, Staphylococcus aureus subsp. aureus Mu50
uauuuacacagaaugauau

SEQ ID NO: 2036739 - RNA, 15 nt, Staphylococcus aureus subsp. aureus Mu50
uauuuacauugccac

SEQ ID NO: 2036740 - RNA, 18 nt, Staphylococcus aureus subsp. aureus Mu50
uauuuaaacucucuaaaa

SEQ ID NO: 2036741 - RNA, 12 nt, Staphylococcus aureus subsp. aureus Mu50
uauuuaauaaug

SEQ ID NO: 2036742 - RNA, 13 nt, Staphylococcus aureus subsp. aureus Mu50
uauuguuuuuuau

SEQ ID NO: 2036743 - RNA, 16 nt, Staphylococcus aureus subsp. aureus Mu50
uauuuaaaauauuauu

SEQ ID NO: 2036744 - RNA, 19 nt, Staphylococcus aureus subsp. aureus Mu50
uauuuaaaaugcuuguuca

SEQ ID NO: 2036745 - RNA, 20 nt, Staphylococcus aureus subsp. aureus Mu50
uauuguuuguuuuuauaguu

SEQ ID NO: 2036746 - RNA, 14 nt, Staphylococcus aureus subsp. aureus Mu50
uauuguuuuuaaaa

SEQ ID NO: 2036747 - RNA, 14 nt, Staphylococcus aureus subsp. aureus Mu50
uauugagaauauuu

SEQ ID NO: 2036748 - RNA, 17 nt, Staphylococcus aureus subsp. aureus Mu50
uauugaggauaauuauu

SEQ ID NO: 2036749 - RNA, 14 nt, Staphylococcus aureus subsp. aureus Mu50
uauucuuuuaauag

SEQ ID NO: 2036750 - RNA, 17 nt, Staphylococcus aureus subsp. aureus Mu50
uauugaaacuaauaauu

SEQ ID NO: 2036751 - RNA, 21 nt, Staphylococcus aureus subsp. aureus Mu50
uauugaagaugcuuuaauuaa

SEQ ID NO: 2036752 - RNA, 13 nt, Staphylococcus aureus subsp. aureus Mu50
uauugaaugaauu

SEQ ID NO: 2036753 - RNA, 19 nt, Staphylococcus aureus subsp. aureus Mu50
uauugaaugaauucauuau

SEQ ID NO: 2036754 - RNA, 20 nt, Staphylococcus aureus subsp. aureus Mu50
uauuuuuaggugcuuuaaug

SEQ ID NO: 2036755 - RNA, 16 nt, Staphylococcus aureus subsp. aureus Mu50
uauuuuuaugauucua

SEQ ID NO: 2036756 - RNA, 16 nt, Staphylococcus aureus subsp. aureus Mu50
uauuuuguucaguuaa

SEQ ID NO: 2036757 - RNA, 20 nt, Staphylococcus aureus subsp. aureus Mu50
uauuuuggacugguacuacu

SEQ ID NO: 2036758 - RNA, 14 nt, Staphylococcus aureus subsp. aureus Mu50
uauuuucuugugua

SEQ ID NO: 2036759 - RNA, 13 nt, Staphylococcus aureus subsp. aureus Mu50
uauuuuacaauca

SEQ ID NO: 2036760 - RNA, 15 nt, Staphylococcus aureus subsp. aureus Mu50
uauuuucaaugauua

SEQ ID NO: 2036761 - RNA, 16 nt, Staphylococcus aureus subsp. aureus Mu50
uauuuucauaaacucu

SEQ ID NO: 2036762 - RNA, 21 nt, Staphylococcus aureus subsp. aureus Mu50
uauuucccuaugaaauaacua

SEQ ID NO: 2036763 - RNA, 22 nt, Staphylococcus aureus subsp. aureus Mu50
uauuuguacaugaacaaauaau

SEQ ID NO: 2036764 - RNA, 21 nt, Staphylococcus aureus subsp. aureus Mu50
uauuucuuuucauuaucauua

SEQ ID NO: 2036765 - RNA, 14 nt, Staphylococcus aureus subsp. aureus Mu50
uauuugaaaugaua

SEQ ID NO: 2036766 - RNA, 22 nt, Staphylococcus aureus subsp. aureus Mu50
uauuugauaacaaaacgauuga

SEQ ID NO: 2036767 - RNA, 15 nt, Staphylococcus aureus subsp. aureus Mu50
uauuugauaaugaua

SEQ ID NO: 2036768 - RNA, 16 nt, Staphylococcus aureus subsp. aureus Mu50
uauuuuauaauaaccu

SEQ ID NO: 2036769 - RNA, 17 nt, Staphylococcus aureus subsp. aureus Mu50
uauuuuaacuuaauuaa

SEQ ID NO: 2036770 - RNA, 18 nt, Staphylococcus aureus subsp. aureus Mu50
uauuuggauauuuauuuu

SEQ ID NO: 2036771 - RNA, 20 nt, Staphylococcus aureus subsp. aureus Mu50
uauuuuaaacguaucauuua

SEQ ID NO: 2036772 - RNA, 24 nt, Staphylococcus aureus subsp. aureus Mu50
uauucagcauugggacauaaaauu

SEQ ID NO: 2036773 - RNA, 19 nt, Staphylococcus aureus subsp. aureus Mu50
uauucagucaguaaaaaua

SEQ ID NO: 2036774 - RNA, 18 nt, Staphylococcus aureus subsp. aureus Mu50
uauucacgaacauuacuu

SEQ ID NO: 2036775 - RNA, 20 nt, Staphylococcus aureus subsp. aureus Mu50
uauucacgauauaacauuaa

SEQ ID NO: 2036776 - RNA, 23 nt, Staphylococcus aureus subsp. aureus Mu50
uauucacgauauaacauuaaaau

SEQ ID NO: 2036777 - RNA, 15 nt, Staphylococcus aureus subsp. aureus Mu50
uaugugcuaaucuau

SEQ ID NO: 2036778 - RNA, 22 nt, Staphylococcus aureus subsp. aureus Mu50
uaugugcuaaucuauuuagcuu

SEQ ID NO: 2036779 - RNA, 17 nt, Staphylococcus aureus subsp. aureus Mu50
uauguguauauuauuuu

SEQ ID NO: 2036780 - RNA, 17 nt, Staphylococcus aureus subsp. aureus Mu50
uauguguuguguaucag

SEQ ID NO: 2036781 - RNA, 22 nt, Staphylococcus aureus subsp. aureus Mu50
uauggcgaaauguuuuggaaaa

SEQ ID NO: 2036782 - RNA, 19 nt, Staphylococcus aureus subsp. aureus Mu50
uauggucuggaauaaaucg

SEQ ID NO: 2036783 - RNA, 14 nt, Staphylococcus aureus subsp. aureus Mu50
uaugguauuuauag

SEQ ID NO: 2036784 - RNA, 20 nt, Staphylococcus aureus subsp. aureus Mu50
uauguagcaggcaacuuuua

SEQ ID NO: 2036785 - RNA, 16 nt, Staphylococcus aureus subsp. aureus Mu50
uauguaaauucaaaau

SEQ ID NO: 2036786 - RNA, 14 nt, Staphylococcus aureus subsp. aureus Mu50
uauucaauuguaaa

SEQ ID NO: 2036787 - RNA, 19 nt, Staphylococcus aureus subsp. aureus Mu50
uauucaucucuuauaaguu

SEQ ID NO: 2036788 - RNA, 18 nt, Staphylococcus aureus subsp. aureus Mu50
uauucauguucuuguaau

SEQ ID NO: 2036789 - RNA, 18 nt, Staphylococcus aureus subsp. aureus Mu50
uauucauuccuaagaaug

SEQ ID NO: 2036790 - RNA, 15 nt, Staphylococcus aureus subsp. aureus Mu50
uauucauuuguguuc

SEQ ID NO: 2036791 - RNA, 15 nt, Staphylococcus aureus subsp. aureus Mu50
uauuccuaauaaaua

SEQ ID NO: 2036792 - RNA, 24 nt, Staphylococcus aureus subsp. aureus Mu50
uauucgauaauauaacugcaugua

SEQ ID NO: 2036793 - RNA, 18 nt, Staphylococcus aureus subsp. aureus Mu50
uauucgcuuaaaaacgcu

SEQ ID NO: 2036794 - RNA, 10 nt, Staphylococcus aureus subsp. aureus Mu50
uauucuguaa

SEQ ID NO: 2036795 - RNA, 19 nt, Staphylococcus aureus subsp. aureus Mu50
uauucuuaucauucauuac

SEQ ID NO: 2036796 - RNA, 19 nt, Staphylococcus aureus subsp. aureus Mu50
uauucuucauuuauaacau

SEQ ID NO: 2036797 - RNA, 16 nt, Staphylococcus aureus subsp. aureus Mu50
uauucucagucucuuu

SEQ ID NO: 2036798 - RNA, 18 nt, Staphylococcus aureus subsp. aureus Mu50
uaucgauuuuaucgaaau

SEQ ID NO: 2036799 - RNA, 23 nt, Staphylococcus aureus subsp. aureus Mu50
uaucgauuuuggcacauaaauca

SEQ ID NO: 2036800 - RNA, 17 nt, Staphylococcus aureus subsp. aureus Mu50
uaugccgccuaauaaua

SEQ ID NO: 2036801 - RNA, 22 nt, Staphylococcus aureus subsp. aureus Mu50
uaugcugucaaacaacaaucaa

SEQ ID NO: 2036802 - RNA, 15 nt, Staphylococcus aureus subsp. aureus Mu50
uaugcuguuggcaaa

SEQ ID NO: 2036803 - RNA, 17 nt, Staphylococcus aureus subsp. aureus Mu50
uaugcuaaacuugcauc

SEQ ID NO: 2036804 - RNA, 14 nt, Staphylococcus aureus subsp. aureus Mu50
uaugcuuuaaaucg

SEQ ID NO: 2036805 - RNA, 22 nt, Staphylococcus aureus subsp. aureus Mu50
uaugcuuuuuuuacaauaugau

SEQ ID NO: 2036806 - RNA, 18 nt, Staphylococcus aureus subsp. aureus Mu50
uauggaucauaaucauaa

SEQ ID NO: 2036807 - RNA, 19 nt, Staphylococcus aureus subsp. aureus Mu50
ugauaacucguaaucauag

SEQ ID NO: 2036808 - RNA, 15 nt, Staphylococcus aureus subsp. aureus Mu50
ugauaaauaaugcau

SEQ ID NO: 2036809 - RNA, 19 nt, Staphylococcus aureus subsp. aureus Mu50
ugauaauguaauuguuuuu

SEQ ID NO: 2036810 - RNA, 15 nt, Staphylococcus aureus subsp. aureus Mu50
ugauaauuaaaauaa

SEQ ID NO: 2036811 - RNA, 13 nt, Staphylococcus aureus subsp. aureus Mu50
ugauaauuaaugc

SEQ ID NO: 2036812 - RNA, 19 nt, Staphylococcus aureus subsp. aureus Mu50
ugauacaucaucgccagca

SEQ ID NO: 2036813 - RNA, 14 nt, Staphylococcus aureus subsp. aureus Mu50
ugauacaaugauua

SEQ ID NO: 2036814 - RNA, 14 nt, Staphylococcus aureus subsp. aureus Mu50
ugauacauuauuaa

SEQ ID NO: 2036815 - RNA, 19 nt, Staphylococcus aureus subsp. aureus Mu50
ugauacagaaccaacaaua

SEQ ID NO: 2036816 - RNA, 13 nt, Staphylococcus aureus subsp. aureus Mu50
ugauacgcuuuuu

SEQ ID NO: 2036817 - RNA, 14 nt, Staphylococcus aureus subsp. aureus Mu50
ugaguguuucauaa

SEQ ID NO: 2036818 - RNA, 14 nt, Staphylococcus aureus subsp. aureus Mu50
ugaguugaaaauaa

SEQ ID NO: 2036819 - RNA, 16 nt, Staphylococcus aureus subsp. aureus Mu50
ugauaaaauaaauaag

SEQ ID NO: 2036820 - RNA, 21 nt, Staphylococcus aureus subsp. aureus Mu50
ugauaaaaggggaaaucauuu

SEQ ID NO: 2036821 - RNA, 17 nt, Staphylococcus aureus subsp. aureus Mu50
ugaguuuuuuaaaauaa

SEQ ID NO: 2036822 - RNA, 21 nt, Staphylococcus aureus subsp. aureus Mu50
ugauaaaaaauaaagucauau

SEQ ID NO: 2036823 - RNA, 15 nt, Staphylococcus aureus subsp. aureus Mu50
ugauaaaaaucuuau

SEQ ID NO: 2036824 - RNA, 21 nt, Staphylococcus aureus subsp. aureus Mu50
ugaggccauaagccauaugcu

SEQ ID NO: 2036825 - RNA, 14 nt, Staphylococcus aureus subsp. aureus Mu50
ugauauuuaacaaa

SEQ ID NO: 2036826 - RNA, 15 nt, Staphylococcus aureus subsp. aureus Mu50
ugauauuuaacaaaa

SEQ ID NO: 2036827 - RNA, 19 nt, Staphylococcus aureus subsp. aureus Mu50
ugauauuaggcuuaaauau

SEQ ID NO: 2036828 - RNA, 14 nt, Staphylococcus aureus subsp. aureus Mu50
ugauaucuuuucca

SEQ ID NO: 2036829 - RNA, 20 nt, Staphylococcus aureus subsp. aureus Mu50
ugauaugcucucuucaaagu

SEQ ID NO: 2036830 - RNA, 16 nt, Staphylococcus aureus subsp. aureus Mu50
ugaugaauuaaacuga

SEQ ID NO: 2036831 - RNA, 13 nt, Staphylococcus aureus subsp. aureus Mu50
ugaugaacuucua

SEQ ID NO: 2036832 - RNA, 14 nt, Staphylococcus aureus subsp. aureus Mu50
ugaugaacuuaaug

SEQ ID NO: 2036833 - RNA, 21 nt, Staphylococcus aureus subsp. aureus Mu50
ugaugaaaacuuaaaaaugaa

SEQ ID NO: 2036834 - RNA, 20 nt, Staphylococcus aureus subsp. aureus Mu50
ugaucuuuuuuauauucaac

SEQ ID NO: 2036835 - RNA, 21 nt, Staphylococcus aureus subsp. aureus Mu50
ugaccgccuaugauauaugua

SEQ ID NO: 2036836 - RNA, 14 nt, Staphylococcus aureus subsp. aureus Mu50
ugaccuaauauauu

SEQ ID NO: 2036837 - RNA, 14 nt, Staphylococcus aureus subsp. aureus Mu50
ugcagcuguauuua

SEQ ID NO: 2036838 - RNA, 22 nt, Staphylococcus aureus subsp. aureus Mu50
ugcagcuguauuuaauaaacca

SEQ ID NO: 2036839 - RNA, 20 nt, Staphylococcus aureus subsp. aureus Mu50
ugcagauugauauaaauuau

SEQ ID NO: 2036840 - RNA, 20 nt, Staphylococcus aureus subsp. aureus Mu50
ugcacuuuuuucauuucuuu

SEQ ID NO: 2036841 - RNA, 19 nt, Staphylococcus aureus subsp. aureus Mu50
ugcacuuaugauacugaua

SEQ ID NO: 2036842 - RNA, 17 nt, Staphylococcus aureus subsp. aureus Mu50
ugcacugcuaauauuag

SEQ ID NO: 2036843 - RNA, 23 nt, Staphylococcus aureus subsp. aureus Mu50
ugcacucuuuucucguuucguca

SEQ ID NO: 2036844 - RNA, 19 nt, Staphylococcus aureus subsp. aureus Mu50
ugcaccuuuacaacauaca

SEQ ID NO: 2036845 - RNA, 15 nt, Staphylococcus aureus subsp. aureus Mu50
ugaugucauaugcac

SEQ ID NO: 2036846 - RNA, 16 nt, Staphylococcus aureus subsp. aureus Mu50
ugauggaaaauuauuu

SEQ ID NO: 2036847 - RNA, 23 nt, Staphylococcus aureus subsp. aureus Mu50
ugaugggaaaucaguaauaucaa

SEQ ID NO: 2036848 - RNA, 19 nt, Staphylococcus aureus subsp. aureus Mu50
ugcauacgaauuaaaauaa

SEQ ID NO: 2036849 - RNA, 16 nt, Staphylococcus aureus subsp. aureus Mu50
ugcauagcuaaauaaa

SEQ ID NO: 2036850 - RNA, 18 nt, Staphylococcus aureus subsp. aureus Mu50
ugcauagcucuucuuuuu

SEQ ID NO: 2036851 - RNA, 12 nt, Staphylococcus aureus subsp. aureus Mu50
ugcauauucacg

SEQ ID NO: 2036852 - RNA, 17 nt, Staphylococcus aureus subsp. aureus Mu50
ugcauauuuaauacauu

SEQ ID NO: 2036853 - RNA, 22 nt, Staphylococcus aureus subsp. aureus Mu50
ugcauaagauuuugaauuuuau

SEQ ID NO: 2036854 - RNA, 18 nt, Staphylococcus aureus subsp. aureus Mu50
ucuucaccaguuuguggu

SEQ ID NO: 2036855 - RNA, 13 nt, Staphylococcus aureus subsp. aureus Mu50
ucuucauaaucgu

SEQ ID NO: 2036856 - RNA, 13 nt, Staphylococcus aureus subsp. aureus Mu50
ucuuccaaucaac

SEQ ID NO: 2036857 - RNA, 18 nt, Staphylococcus aureus subsp. aureus Mu50
ucuucggcuuuguaaaau

SEQ ID NO: 2036858 - RNA, 15 nt, Staphylococcus aureus subsp. aureus Mu50
ucuucucgcauacug

SEQ ID NO: 2036859 - RNA, 13 nt, Staphylococcus aureus subsp. aureus Mu50
ucuucuaaaaaau

SEQ ID NO: 2036860 - RNA, 13 nt, Staphylococcus aureus subsp. aureus Mu50
ucuuggacuaaua

SEQ ID NO: 2036861 - RNA, 16 nt, Staphylococcus aureus subsp. aureus Mu50
ucuuggacuaauaauu

SEQ ID NO: 2036862 - RNA, 16 nt, Staphylococcus aureus subsp. aureus Mu50
ucugcugcuuucauag

SEQ ID NO: 2036863 - RNA, 16 nt, Staphylococcus aureus subsp. aureus Mu50
ucugcgauuucuaaag

SEQ ID NO: 2036864 - RNA, 22 nt, Staphylococcus aureus subsp. aureus Mu50
ucuucaacuucgauaugauuaa

SEQ ID NO: 2036865 - RNA, 23 nt, Staphylococcus aureus subsp. aureus Mu50
ucuucaaaaaauaauagcaaaau

SEQ ID NO: 2036866 - RNA, 14 nt, Staphylococcus aureus subsp. aureus Mu50
ucuucaaaacguuu

SEQ ID NO: 2036867 - RNA, 15 nt, Staphylococcus aureus subsp. aureus Mu50
ucuucaauuuauuuu

SEQ ID NO: 2036868 - RNA, 16 nt, Staphylococcus aureus subsp. aureus Mu50
ucuuacuuuuaaauua

SEQ ID NO: 2036869 - RNA, 23 nt, Staphylococcus aureus subsp. aureus Mu50
ucuuagucaaucaaguuaaucag

SEQ ID NO: 2036870 - RNA, 20 nt, Staphylococcus aureus subsp. aureus Mu50
ucuuauaaguucaaccauau

SEQ ID NO: 2036871 - RNA, 18 nt, Staphylococcus aureus subsp. aureus Mu50
ucuuauauucuuaaaaga

SEQ ID NO: 2036872 - RNA, 15 nt, Staphylococcus aureus subsp. aureus Mu50
ucuuauguauaucuu

SEQ ID NO: 2036873 - RNA, 19 nt, Staphylococcus aureus subsp. aureus Mu50
ucuuauguauaucuuuauu

SEQ ID NO: 2036874 - RNA, 16 nt, Staphylococcus aureus subsp. aureus Mu50
ucuuaaaauaugauuu

SEQ ID NO: 2036875 - RNA, 17 nt, Staphylococcus aureus subsp. aureus Mu50
ucuuacauugauaaaau

SEQ ID NO: 2036876 - RNA, 12 nt, Staphylococcus aureus subsp. aureus Mu50
ucuuaauguacu

SEQ ID NO: 2036877 - RNA, 17 nt, Staphylococcus aureus subsp. aureus Mu50
ucuuaauuaucauuaca

SEQ ID NO: 2036878 - RNA, 16 nt, Staphylococcus aureus subsp. aureus Mu50
ucuuaauuuuucucca

SEQ ID NO: 2036879 - RNA, 23 nt, Staphylococcus aureus subsp. aureus Mu50
ucuuagacgcuguuuuaaauuga

SEQ ID NO: 2036880 - RNA, 14 nt, Staphylococcus aureus subsp. aureus Mu50
ucuuucuuguucua

SEQ ID NO: 2036881 - RNA, 16 nt, Staphylococcus aureus subsp. aureus Mu50
ucuuucucuauuaauu

SEQ ID NO: 2036882 - RNA, 14 nt, Staphylococcus aureus subsp. aureus Mu50
ucuuucagcuaauu

SEQ ID NO: 2036883 - RNA, 15 nt, Staphylococcus aureus subsp. aureus Mu50
ucuugguauuuuuua

SEQ ID NO: 2036884 - RNA, 18 nt, Staphylococcus aureus subsp. aureus Mu50
ucuuggcguauuuuuugu

SEQ ID NO: 2036885 - RNA, 15 nt, Staphylococcus aureus subsp. aureus Mu50
ugaaaccguauuauu

SEQ ID NO: 2036886 - RNA, 21 nt, Staphylococcus aureus subsp. aureus Mu50
ugaaacgccucaacacuuucu

SEQ ID NO: 2036887 - RNA, 15 nt, Staphylococcus aureus subsp. aureus Mu50
ugaaauaguuaaagu

SEQ ID NO: 2036888 - RNA, 16 nt, Staphylococcus aureus subsp. aureus Mu50
ugaacgauauucuaca

SEQ ID NO: 2036889 - RNA, 15 nt, Staphylococcus aureus subsp. aureus Mu50
ugaacauaaaaaaua

SEQ ID NO: 2036890 - RNA, 13 nt, Staphylococcus aureus subsp. aureus Mu50
ugaacaucuaguu

SEQ ID NO: 2036891 - RNA, 13 nt, Staphylococcus aureus subsp. aureus Mu50
ugaaaugauacau

SEQ ID NO: 2036892 - RNA, 14 nt, Staphylococcus aureus subsp. aureus Mu50
ugaaaugauacauu

SEQ ID NO: 2036893 - RNA, 17 nt, Staphylococcus aureus subsp. aureus Mu50
ugaaauuaaauucaaau

SEQ ID NO: 2036894 - RNA, 20 nt, Staphylococcus aureus subsp. aureus Mu50
ugaaauguucccuucaaagu

SEQ ID NO: 2036895 - RNA, 16 nt, Staphylococcus aureus subsp. aureus Mu50
ugaaauuagaaaaaua

SEQ ID NO: 2036896 - RNA, 13 nt, Staphylococcus aureus subsp. aureus Mu50
ugaaauuauuauu

SEQ ID NO: 2036897 - RNA, 22 nt, Staphylococcus aureus subsp. aureus Mu50
ugaacaacaucuuuuguuguuu

SEQ ID NO: 2036898 - RNA, 13 nt, Staphylococcus aureus subsp. aureus Mu50
ugaaauuucauaa

SEQ ID NO: 2036899 - RNA, 17 nt, Staphylococcus aureus subsp. aureus Mu50
ugaaauuucgacaucua

SEQ ID NO: 2036900 - RNA, 16 nt, Staphylococcus aureus subsp. aureus Mu50
ucuauuuuuaacuaau

SEQ ID NO: 2036901 - RNA, 19 nt, Staphylococcus aureus subsp. aureus Mu50
ucucaucuucuaaaucaau

SEQ ID NO: 2036902 - RNA, 19 nt, Staphylococcus aureus subsp. aureus Mu50
ucucguuuguacucuucgu

SEQ ID NO: 2036903 - RNA, 14 nt, Staphylococcus aureus subsp. aureus Mu50
ucugaauuuuucaa

SEQ ID NO: 2036904 - RNA, 19 nt, Staphylococcus aureus subsp. aureus Mu50
ucugaaaaaauuaauaauu

SEQ ID NO: 2036905 - RNA, 16 nt, Staphylococcus aureus subsp. aureus Mu50
ucugaacauaaaaaau

SEQ ID NO: 2036906 - RNA, 17 nt, Staphylococcus aureus subsp. aureus Mu50
ucguauauguaaucaga

SEQ ID NO: 2036907 - RNA, 17 nt, Staphylococcus aureus subsp. aureus Mu50
ucccuggaaaaugauuc

SEQ ID NO: 2036908 - RNA, 21 nt, Staphylococcus aureus subsp. aureus Mu50
uccuuggaaacgauauagacc

SEQ ID NO: 2036909 - RNA, 19 nt, Staphylococcus aureus subsp. aureus Mu50
ucgaaaaacuguaaaucau

SEQ ID NO: 2036910 - RNA, 18 nt, Staphylococcus aureus subsp. aureus Mu50
uccuuuuuguuauaucua

SEQ ID NO: 2036911 - RNA, 16 nt, Staphylococcus aureus subsp. aureus Mu50
uccuuugauguuuucu

SEQ ID NO: 2036912 - RNA, 14 nt, Staphylococcus aureus subsp. aureus Mu50
uccuuuauauucua

SEQ ID NO: 2036913 - RNA, 13 nt, Staphylococcus aureus subsp. aureus Mu50
uccuuuguuugua

SEQ ID NO: 2036914 - RNA, 14 nt, Staphylococcus aureus subsp. aureus Mu50
ucgacauugauguc

SEQ ID NO: 2036915 - RNA, 15 nt, Staphylococcus aureus subsp. aureus Mu50
ucgaacauaaauaaa

SEQ ID NO: 2036916 - RNA, 23 nt, Staphylococcus aureus subsp. aureus Mu50
ucgaaccaaauuuuauacuauua

SEQ ID NO: 2036917 - RNA, 19 nt, Staphylococcus aureus subsp. aureus Mu50
ucgaacaugaaugauauug

SEQ ID NO: 2036918 - RNA, 15 nt, Staphylococcus aureus subsp. aureus Mu50
uccugccaauauauu

SEQ ID NO: 2036919 - RNA, 15 nt, Staphylococcus aureus subsp. aureus Mu50
uccucuauuguaucu

SEQ ID NO: 2036920 - RNA, 16 nt, Staphylococcus aureus subsp. aureus Mu50
uccucgguuuuauuuu

SEQ ID NO: 2036921 - RNA, 14 nt, Staphylococcus aureus subsp. aureus Mu50
ucgacucaaacaau

SEQ ID NO: 2036922 - RNA, 19 nt, Staphylococcus aureus subsp. aureus Mu50
ucgcgaccguguuguugaa

SEQ ID NO: 2036923 - RNA, 17 nt, Staphylococcus aureus subsp. aureus Mu50
ucgcuugauuaauuuua

SEQ ID NO: 2036924 - RNA, 21 nt, Staphylococcus aureus subsp. aureus Mu50
ucgcuucgguuaacuguucua

SEQ ID NO: 2036925 - RNA, 18 nt, Staphylococcus aureus subsp. aureus Mu50
ucgcuuguaacaagcuuu

SEQ ID NO: 2036926 - RNA, 22 nt, Staphylococcus aureus subsp. aureus Mu50
aauacgccaaauaucaguaaua

SEQ ID NO: 2036927 - RNA, 20 nt, Staphylococcus aureus subsp. aureus Mu50
aauaccguuauagcucauua

SEQ ID NO: 2036928 - RNA, 16 nt, Staphylococcus aureus subsp. aureus Mu50
aauacgaaguguuaua

SEQ ID NO: 2036929 - RNA, 16 nt, Staphylococcus aureus subsp. aureus Mu50
aauaccuaccacaaua

SEQ ID NO: 2036930 - RNA, 19 nt, Staphylococcus aureus subsp. aureus Mu50
aauaccuaucccuguaaaa

SEQ ID NO: 2036931 - RNA, 18 nt, Staphylococcus aureus subsp. aureus Mu50
aauaccagaugaaccaaa

SEQ ID NO: 2036932 - RNA, 21 nt, Staphylococcus aureus subsp. aureus Mu50
aauaccagaugaaccaaaaaa

SEQ ID NO: 2036933 - RNA, 18 nt, Staphylococcus aureus subsp. aureus Mu50
ucggcaccauaucaaguu

SEQ ID NO: 2036934 - RNA, 16 nt, Staphylococcus aureus subsp. aureus Mu50
acccauaauuuaaaug

SEQ ID NO: 2036935 - RNA, 15 nt, Staphylococcus aureus subsp. aureus Mu50
acccauauaauuugg

SEQ ID NO: 2036936 - RNA, 13 nt, Staphylococcus aureus subsp. aureus Mu50
acccauauuaaau

SEQ ID NO: 2036937 - RNA, 23 nt, Staphylococcus aureus subsp. aureus Mu50
accgcacuucuauauuaauagaa

SEQ ID NO: 2036938 - RNA, 14 nt, Staphylococcus aureus subsp. aureus Mu50
accaccugcaauuu

SEQ ID NO: 2036939 - RNA, 17 nt, Staphylococcus aureus subsp. aureus Mu50
accacauuauaauggac

SEQ ID NO: 2036940 - RNA, 16 nt, Staphylococcus aureus subsp. aureus Mu50
accacuguauuuacua

SEQ ID NO: 2036941 - RNA, 14 nt, Staphylococcus aureus subsp. aureus Mu50
accacuuauaacau

SEQ ID NO: 2036942 - RNA, 17 nt, Staphylococcus aureus subsp. aureus Mu50
acagcguauuuuaauga

SEQ ID NO: 2036943 - RNA, 16 nt, Staphylococcus aureus subsp. aureus Mu50
acaguucuauagguuu

SEQ ID NO: 2036944 - RNA, 20 nt, Staphylococcus aureus subsp. aureus Mu50
acaguguugaauuucaaaau

SEQ ID NO: 2036945 - RNA, 15 nt, Staphylococcus aureus subsp. aureus Mu50
acagugacugauuca

SEQ ID NO: 2036946 - RNA, 13 nt, Staphylococcus aureus subsp. aureus Mu50
acaguuuuaaaga

SEQ ID NO: 2036947 - RNA, 22 nt, Staphylococcus aureus subsp. aureus Mu50
acaguuuuacuauaaugaugua

SEQ ID NO: 2036948 - RNA, 17 nt, Staphylococcus aureus subsp. aureus Mu50
acauaaaaaaacgucgu

SEQ ID NO: 2036949 - RNA, 18 nt, Staphylococcus aureus subsp. aureus Mu50
acauaaauuaagcaugac

SEQ ID NO: 2036950 - RNA, 22 nt, Staphylococcus aureus subsp. aureus Mu50
acauaaccuaauucgccaucuu

SEQ ID NO: 2036951 - RNA, 21 nt, Staphylococcus aureus subsp. aureus Mu50
acauaauauuucuuaccauuu

SEQ ID NO: 2036952 - RNA, 20 nt, Staphylococcus aureus subsp. aureus Mu50
acaucuagaugaaauugugu

SEQ ID NO: 2036953 - RNA, 21 nt, Staphylococcus aureus subsp. aureus Mu50
acaucguauucuuuuaauaga

SEQ ID NO: 2036954 - RNA, 15 nt, Staphylococcus aureus subsp. aureus Mu50
acauccucauaauua

SEQ ID NO: 2036955 - RNA, 22 nt, Staphylococcus aureus subsp. aureus Mu50
acauagaauaacgucauauguu

SEQ ID NO: 2036956 - RNA, 19 nt, Staphylococcus aureus subsp. aureus Mu50
acauaccacacuuuaaaca

SEQ ID NO: 2036957 - RNA, 20 nt, Staphylococcus aureus subsp. aureus Mu50
acauaauuaccuuuccauuc

SEQ ID NO: 2036958 - RNA, 18 nt, Staphylococcus aureus subsp. aureus Mu50
acauaucagcuuuuucau

SEQ ID NO: 2036959 - RNA, 14 nt, Staphylococcus aureus subsp. aureus Mu50
acauaugcagugac

SEQ ID NO: 2036960 - RNA, 17 nt, Staphylococcus aureus subsp. aureus Mu50
acauauucauaauaucg

SEQ ID NO: 2036961 - RNA, 15 nt, Staphylococcus aureus subsp. aureus Mu50
acauccauacaaauc

SEQ ID NO: 2036962 - RNA, 13 nt, Staphylococcus aureus subsp. aureus Mu50
acauauugcauuu

SEQ ID NO: 2036963 - RNA, 22 nt, Staphylococcus aureus subsp. aureus Mu50
acaucugaaaaaauuaauaauu

SEQ ID NO: 2036964 - RNA, 17 nt, Staphylococcus aureus subsp. aureus Mu50
acaucuucauguaugaa

SEQ ID NO: 2036965 - RNA, 14 nt, Staphylococcus aureus subsp. aureus Mu50
acaugacauucauu

SEQ ID NO: 2036966 - RNA, 18 nt, Staphylococcus aureus subsp. aureus Mu50
acaugaaugauauugauu

SEQ ID NO: 2036967 - RNA, 19 nt, Staphylococcus aureus subsp. aureus Mu50
acaucuuuuugauaauguu

SEQ ID NO: 2036968 - RNA, 19 nt, Staphylococcus aureus subsp. aureus Mu50
acaugauucaugauauguu

SEQ ID NO: 2036969 - RNA, 15 nt, Staphylococcus aureus subsp. aureus Mu50
acaugauaauuuuua

SEQ ID NO: 2036970 - RNA, 20 nt, Staphylococcus aureus subsp. aureus Mu50
acauuugguggagaaccuuu

SEQ ID NO: 2036971 - RNA, 12 nt, Staphylococcus aureus subsp. aureus Mu50
acauuugucaua

SEQ ID NO: 2036972 - RNA, 21 nt, Staphylococcus aureus subsp. aureus Mu50
acauuuuugaauuuaauacua

SEQ ID NO: 2036973 - RNA, 22 nt, Staphylococcus aureus subsp. aureus Mu50
acauuuugcucuaaacuucuau

SEQ ID NO: 2036974 - RNA, 14 nt, Staphylococcus aureus subsp. aureus Mu50
acauuugucauaau

SEQ ID NO: 2036975 - RNA, 18 nt, Staphylococcus aureus subsp. aureus Mu50
acauuuucaaguuuaaaa

SEQ ID NO: 2036976 - RNA, 19 nt, Staphylococcus aureus subsp. aureus Mu50
acauuuucaaguuuaaaau

SEQ ID NO: 2036977 - RNA, 15 nt, Staphylococcus aureus subsp. aureus Mu50
acauuuaauacuuuu

SEQ ID NO: 2036978 - RNA, 18 nt, Staphylococcus aureus subsp. aureus Mu50
acauuuacuuaagaacua

SEQ ID NO: 2036979 - RNA, 15 nt, Staphylococcus aureus subsp. aureus Mu50
acauuucugaugcua

SEQ ID NO: 2036980 - RNA, 13 nt, Staphylococcus aureus subsp. aureus Mu50
acauucuucaaaa

SEQ ID NO: 2036981 - RNA, 21 nt, Staphylococcus aureus subsp. aureus Mu50
acauucuugaauaaauuuuau

SEQ ID NO: 2036982 - RNA, 16 nt, Staphylococcus aureus subsp. aureus Mu50
acauugaauaaaugaa

SEQ ID NO: 2036983 - RNA, 16 nt, Staphylococcus aureus subsp. aureus Mu50
accaacauauuuuaac

SEQ ID NO: 2036984 - RNA, 24 nt, Staphylococcus aureus subsp. aureus Mu50
accaaguaugagacgcauugcaag

SEQ ID NO: 2036985 - RNA, 20 nt, Staphylococcus aureus subsp. aureus Mu50
acaaucuguucauaauguaa

SEQ ID NO: 2036986 - RNA, 16 nt, Staphylococcus aureus subsp. aureus Mu50
acaaucuuaucauaau

SEQ ID NO: 2036987 - RNA, 20 nt, Staphylococcus aureus subsp. aureus Mu50
acaaucgaauguauugcuau

SEQ ID NO: 2036988 - RNA, 13 nt, Staphylococcus aureus subsp. aureus Mu50
acaaucacagcaa

SEQ ID NO: 2036989 - RNA, 16 nt, Staphylococcus aureus subsp. aureus Mu50
acaaucaguaauaaug

SEQ ID NO: 2036990 - RNA, 15 nt, Staphylococcus aureus subsp. aureus Mu50
acaaucacagcaaua

SEQ ID NO: 2036991 - RNA, 23 nt, Staphylococcus aureus subsp. aureus Mu50
acaauaccgcgauaaauaacuuu

SEQ ID NO: 2036992 - RNA, 12 nt, Staphylococcus aureus subsp. aureus Mu50
acaauacgauga

SEQ ID NO: 2036993 - RNA, 13 nt, Staphylococcus aureus subsp. aureus Mu50
acaauaguacuaa

SEQ ID NO: 2036994 - RNA, 22 nt, Staphylococcus aureus subsp. aureus Mu50
acaauauagaaaaugaguacaa

SEQ ID NO: 2036995 - RNA, 21 nt, Staphylococcus aureus subsp. aureus Mu50
acaauauucguaaauccuuua

SEQ ID NO: 2036996 - RNA, 23 nt, Staphylococcus aureus subsp. aureus Mu50
acaaguuuuaccccuguugaaua

SEQ ID NO: 2036997 - RNA, 21 nt, Staphylococcus aureus subsp. aureus Mu50
acaaguugaucaaaaauguua

SEQ ID NO: 2036998 - RNA, 16 nt, Staphylococcus aureus subsp. aureus Mu50
acaaguuuacagguug

SEQ ID NO: 2036999 - RNA, 17 nt, Staphylococcus aureus subsp. aureus Mu50
acaauaauaccuucaau

SEQ ID NO: 2037000 - RNA, 17 nt, Staphylococcus aureus subsp. aureus Mu50
acaaugcgcaaugaaaa

SEQ ID NO: 2037001 - RNA, 15 nt, Staphylococcus aureus subsp. aureus Mu50
acaauggaugccgcu

SEQ ID NO: 2037002 - RNA, 15 nt, Staphylococcus aureus subsp. aureus Mu50
acaaugauuaaaauu

SEQ ID NO: 2037003 - RNA, 21 nt, Staphylococcus aureus subsp. aureus Mu50
acaaugauugaauauuguugu

SEQ ID NO: 2037004 - RNA, 18 nt, Staphylococcus aureus subsp. aureus Mu50
acaauuauaaaugauuaa

SEQ ID NO: 2037005 - RNA, 15 nt, Staphylococcus aureus subsp. aureus Mu50
acaauuaaagugaau

SEQ ID NO: 2037006 - RNA, 18 nt, Staphylococcus aureus subsp. aureus Mu50
acaauuuuugggaagaau

SEQ ID NO: 2037007 - RNA, 15 nt, Staphylococcus aureus subsp. aureus Mu50
acaauuuagaugagu

SEQ ID NO: 2037008 - RNA, 13 nt, Staphylococcus aureus subsp. aureus Mu50
acaauuucgcuua

SEQ ID NO: 2037009 - RNA, 22 nt, Staphylococcus aureus subsp. aureus Mu50
acaauuuuccuuccaauaauaa

SEQ ID NO: 2037010 - RNA, 14 nt, Staphylococcus aureus subsp. aureus Mu50
acaauuugaggaua

SEQ ID NO: 2037011 - RNA, 14 nt, Staphylococcus aureus subsp. aureus Mu50
acaacuauucccac

SEQ ID NO: 2037012 - RNA, 21 nt, Staphylococcus aureus subsp. aureus Mu50
acaacugagaaaucuuaaaga

SEQ ID NO: 2037013 - RNA, 17 nt, Staphylococcus aureus subsp. aureus Mu50
acaacugauuuaauauc

SEQ ID NO: 2037014 - RNA, 15 nt, Staphylococcus aureus subsp. aureus Mu50
acaacuacuuaaauu

SEQ ID NO: 2037015 - RNA, 19 nt, Staphylococcus aureus subsp. aureus Mu50
acaacuuuacgauaaauag

SEQ ID NO: 2037016 - RNA, 15 nt, Staphylococcus aureus subsp. aureus Mu50
acaagcuuuucauuu

SEQ ID NO: 2037017 - RNA, 17 nt, Staphylococcus aureus subsp. aureus Mu50
acaagcuuuuuucaauu

SEQ ID NO: 2037018 - RNA, 12 nt, Staphylococcus aureus subsp. aureus Mu50
acaaaaagacuu

SEQ ID NO: 2037019 - RNA, 17 nt, Staphylococcus aureus subsp. aureus Mu50
aauuuuuuucauaauua

SEQ ID NO: 2037020 - RNA, 15 nt, Staphylococcus aureus subsp. aureus Mu50
aauuuuuuagugaaa

SEQ ID NO: 2037021 - RNA, 15 nt, Staphylococcus aureus subsp. aureus Mu50
acaaaaguaugauuu

SEQ ID NO: 2037022 - RNA, 21 nt, Staphylococcus aureus subsp. aureus Mu50
acaaacccuuuaaacauauuu

SEQ ID NO: 2037023 - RNA, 16 nt, Staphylococcus aureus subsp. aureus Mu50
acaaacauuaaucuau

SEQ ID NO: 2037024 - RNA, 17 nt, Staphylococcus aureus subsp. aureus Mu50
aauguucccuucaaagu

SEQ ID NO: 2037025 - RNA, 17 nt, Staphylococcus aureus subsp. aureus Mu50
aauguugauagccaccu

SEQ ID NO: 2037026 - RNA, 13 nt, Staphylococcus aureus subsp. aureus Mu50
aauguuuccauuu

SEQ ID NO: 2037027 - RNA, 14 nt, Staphylococcus aureus subsp. aureus Mu50
aauguuugaugauu

SEQ ID NO: 2037028 - RNA, 13 nt, Staphylococcus aureus subsp. aureus Mu50
aauguuuaacaau

SEQ ID NO: 2037029 - RNA, 21 nt, Staphylococcus aureus subsp. aureus Mu50
aauuuuuccgauugagcuuuc

SEQ ID NO: 2037030 - RNA, 23 nt, Staphylococcus aureus subsp. aureus Mu50
aauuuuuauuuacacacaugaua

SEQ ID NO: 2037031 - RNA, 23 nt, Staphylococcus aureus subsp. aureus Mu50
aauguucuggaauaccuaauuca

SEQ ID NO: 2037032 - RNA, 12 nt, Staphylococcus aureus subsp. aureus Mu50
aauuuuucaaaa

SEQ ID NO: 2037033 - RNA, 18 nt, Staphylococcus aureus subsp. aureus Mu50
aauguuuuauguauuuau

SEQ ID NO: 2037034 - RNA, 17 nt, Staphylococcus aureus subsp. aureus Mu50
aauguuuuuacaaaugu

SEQ ID NO: 2037035 - RNA, 14 nt, Staphylococcus aureus subsp. aureus Mu50
aauuaaaaaaugau

SEQ ID NO: 2037036 - RNA, 19 nt, Staphylococcus aureus subsp. aureus Mu50
aaugugcaauuagaauaua

SEQ ID NO: 2037037 - RNA, 18 nt, Staphylococcus aureus subsp. aureus Mu50
aauguguuggcuuuuuga

SEQ ID NO: 2037038 - RNA, 17 nt, Staphylococcus aureus subsp. aureus Mu50
aauguuaacugcaaacu

SEQ ID NO: 2037039 - RNA, 14 nt, Staphylococcus aureus subsp. aureus Mu50
aauguuaggugaaa

SEQ ID NO: 2037040 - RNA, 20 nt, Staphylococcus aureus subsp. aureus Mu50
aauguuccuuguuuuaaacu

SEQ ID NO: 2037041 - RNA, 14 nt, Staphylococcus aureus subsp. aureus Mu50
acaacauuguugau

SEQ ID NO: 2037042 - RNA, 11 nt, Staphylococcus aureus subsp. aureus Mu50
acaacauguuu

SEQ ID NO: 2037043 - RNA, 17 nt, Staphylococcus aureus subsp. aureus Mu50
acaaauguucuauagaa

SEQ ID NO: 2037044 - RNA, 15 nt, Staphylococcus aureus subsp. aureus Mu50
acaacaaauugugau

SEQ ID NO: 2037045 - RNA, 21 nt, Staphylococcus aureus subsp. aureus Mu50
acaaauguauaaauaauaaau

SEQ ID NO: 2037046 - RNA, 16 nt, Staphylococcus aureus subsp. aureus Mu50
acaaaucuuuuaaauu

SEQ ID NO: 2037047 - RNA, 21 nt, Staphylococcus aureus subsp. aureus Mu50
acaaagggguauguuuguuau

SEQ ID NO: 2037048 - RNA, 20 nt, Staphylococcus aureus subsp. aureus Mu50
acaaagucugucugaauuag

SEQ ID NO: 2037049 - RNA, 15 nt, Staphylococcus aureus subsp. aureus Mu50
acaaauaauuuacau

SEQ ID NO: 2037050 - RNA, 12 nt, Staphylococcus aureus subsp. aureus Mu50
acaaauaaaggc

SEQ ID NO: 2037051 - RNA, 15 nt, Staphylococcus aureus subsp. aureus Mu50
acaaauaacaaacau

SEQ ID NO: 2037052 - RNA, 14 nt, Staphylococcus aureus subsp. aureus Mu50
acaaauaguucaaa

SEQ ID NO: 2037053 - RNA, 22 nt, Staphylococcus aureus subsp. aureus Mu50
acaaagaaccacgcaucaugua

SEQ ID NO: 2037054 - RNA, 23 nt, Staphylococcus aureus subsp. aureus Mu50
acaaagaauuucgaaaagaaauu

SEQ ID NO: 2037055 - RNA, 16 nt, Staphylococcus aureus subsp. aureus Mu50
acaaagcucaauaaau

SEQ ID NO: 2037056 - RNA, 21 nt, Staphylococcus aureus subsp. aureus Mu50
acacgcgguaaaacgaaguca

SEQ ID NO: 2037057 - RNA, 15 nt, Staphylococcus aureus subsp. aureus Mu50
acaccuaauauuuua

SEQ ID NO: 2037058 - RNA, 15 nt, Staphylococcus aureus subsp. aureus Mu50
acacagaaugauaua

SEQ ID NO: 2037059 - RNA, 20 nt, Staphylococcus aureus subsp. aureus Mu50
acacacuuauaaucuauaaa

SEQ ID NO: 2037060 - RNA, 20 nt, Staphylococcus aureus subsp. aureus Mu50
acacacuguugaaaaugacu

SEQ ID NO: 2037061 - RNA, 23 nt, Staphylococcus aureus subsp. aureus Mu50
acacucaaaauguuuaacaauaa

SEQ ID NO: 2037062 - RNA, 12 nt, Staphylococcus aureus subsp. aureus Mu50
acacucaaacaa

SEQ ID NO: 2037063 - RNA, 21 nt, Staphylococcus aureus subsp. aureus Mu50
acacuuauaaucuauaaaugg

SEQ ID NO: 2037064 - RNA, 21 nt, Staphylococcus aureus subsp. aureus Mu50
acacuuccaucaauccaacua

SEQ ID NO: 2037065 - RNA, 18 nt, Staphylococcus aureus subsp. aureus Mu50
acacuugaggccauaagc

SEQ ID NO: 2037066 - RNA, 14 nt, Staphylococcus aureus subsp. aureus Mu50
acacugccguuuga

SEQ ID NO: 2037067 - RNA, 20 nt, Staphylococcus aureus subsp. aureus Mu50
acagcagacuucuuucaauu

SEQ ID NO: 2037068 - RNA, 15 nt, Staphylococcus aureus subsp. aureus Mu50
acgcaguugaaaaag

SEQ ID NO: 2037069 - RNA, 20 nt, Staphylococcus aureus subsp. aureus Mu50
acgccaaucacaauauaaca

SEQ ID NO: 2037070 - RNA, 23 nt, Staphylococcus aureus subsp. aureus Mu50
acgcaauuuaauauuauaaguug

SEQ ID NO: 2037071 - RNA, 12 nt, Staphylococcus aureus subsp. aureus Mu50
acgaaucuuaau

SEQ ID NO: 2037072 - RNA, 17 nt, Staphylococcus aureus subsp. aureus Mu50
acgaaguuauauuggca

SEQ ID NO: 2037073 - RNA, 22 nt, Staphylococcus aureus subsp. aureus Mu50
accuuuccauucguauaagaau

SEQ ID NO: 2037074 - RNA, 15 nt, Staphylococcus aureus subsp. aureus Mu50
accuuucgauaaacu

SEQ ID NO: 2037075 - RNA, 16 nt, Staphylococcus aureus subsp. aureus Mu50
accuuucaaauauauc

SEQ ID NO: 2037076 - RNA, 17 nt, Staphylococcus aureus subsp. aureus Mu50
acgacaccaacauauuu

SEQ ID NO: 2037077 - RNA, 23 nt, Staphylococcus aureus subsp. aureus Mu50
acgaauguuccuuguuuuaaacu

SEQ ID NO: 2037078 - RNA, 20 nt, Staphylococcus aureus subsp. aureus Mu50
accuguucuuuauuuaaagg

SEQ ID NO: 2037079 - RNA, 22 nt, Staphylococcus aureus subsp. aureus Mu50
accuguuaauguuccaauaaac

SEQ ID NO: 2037080 - RNA, 18 nt, Staphylococcus aureus subsp. aureus Mu50
accuuacccaaaaaauug

SEQ ID NO: 2037081 - RNA, 19 nt, Staphylococcus aureus subsp. aureus Mu50
accuuacuacgcauuauua

SEQ ID NO: 2037082 - RNA, 22 nt, Staphylococcus aureus subsp. aureus Mu50
accuucaauugacauuaaugau

SEQ ID NO: 2037083 - RNA, 12 nt, Staphylococcus aureus subsp. aureus Mu50
accuauuuuuua

SEQ ID NO: 2037084 - RNA, 23 nt, Staphylococcus aureus subsp. aureus Mu50
accuaucaucaaucguuaauuuc

SEQ ID NO: 2037085 - RNA, 14 nt, Staphylococcus aureus subsp. aureus Mu50
accuagguuaaaga

SEQ ID NO: 2037086 - RNA, 15 nt, Staphylococcus aureus subsp. aureus Mu50
accuagguuaaagau

SEQ ID NO: 2037087 - RNA, 20 nt, Staphylococcus aureus subsp. aureus Mu50
accuauucccaaaaugauug

SEQ ID NO: 2037088 - RNA, 20 nt, Staphylococcus aureus subsp. aureus Mu50
accuaucgucgcuaauaaac

SEQ ID NO: 2037089 - RNA, 17 nt, Staphylococcus aureus subsp. aureus Mu50
accuacuuuuucaauau

SEQ ID NO: 2037090 - RNA, 16 nt, Staphylococcus aureus subsp. aureus Mu50
accuaccacaauaauc

SEQ ID NO: 2037091 - RNA, 18 nt, Staphylococcus aureus subsp. aureus Mu50
accuacaauauagaaaau

SEQ ID NO: 2037092 - RNA, 17 nt, Staphylococcus aureus subsp. aureus Mu50
accuaauucaauaccua

SEQ ID NO: 2037093 - RNA, 22 nt, Staphylococcus aureus subsp. aureus Mu50
accuaauugaaggccauuuuua

SEQ ID NO: 2037094 - RNA, 16 nt, Staphylococcus aureus subsp. aureus Mu50
accuaauuuaauacca

SEQ ID NO: 2037095 - RNA, 19 nt, Staphylococcus aureus subsp. aureus Mu50
accugaugaauagauaauc

SEQ ID NO: 2037096 - RNA, 15 nt, Staphylococcus aureus subsp. aureus Mu50
accucuugauaaaau

SEQ ID NO: 2037097 - RNA, 15 nt, Staphylococcus aureus subsp. aureus Mu50
accucuaaauaaaau

SEQ ID NO: 2037098 - RNA, 19 nt, Staphylococcus aureus subsp. aureus Mu50
accucuaaauaaaauuaaa

SEQ ID NO: 2037099 - RNA, 18 nt, Staphylococcus aureus subsp. aureus Mu50
acucauccauugaucuuu

SEQ ID NO: 2037100 - RNA, 23 nt, Staphylococcus aureus subsp. aureus Mu50
acucauuauaaaugaaucgcuuu

SEQ ID NO: 2037101 - RNA, 13 nt, Staphylococcus aureus subsp. aureus Mu50
acuauaugaaaag

SEQ ID NO: 2037102 - RNA, 13 nt, Staphylococcus aureus subsp. aureus Mu50
acuauaaaauuca

SEQ ID NO: 2037103 - RNA, 17 nt, Staphylococcus aureus subsp. aureus Mu50
acuauaaauacaaauau

SEQ ID NO: 2037104 - RNA, 21 nt, Staphylococcus aureus subsp. aureus Mu50
acuauaaauccuaagucuuuu

SEQ ID NO: 2037105 - RNA, 15 nt, Staphylococcus aureus subsp. aureus Mu50
acuauaacaauaguu

SEQ ID NO: 2037106 - RNA, 23 nt, Staphylococcus aureus subsp. aureus Mu50
acuauagccaaaggcaaaaugua

SEQ ID NO: 2037107 - RNA, 13 nt, Staphylococcus aureus subsp. aureus Mu50
acuaguaauagaa

SEQ ID NO: 2037108 - RNA, 20 nt, Staphylococcus aureus subsp. aureus Mu50
acucccgcaaauauuaaauu

SEQ ID NO: 2037109 - RNA, 22 nt, Staphylococcus aureus subsp. aureus Mu50
acucccgcauuauuauuaaauu

SEQ ID NO: 2037110 - RNA, 14 nt, Staphylococcus aureus subsp. aureus Mu50
acucccuucaacau

SEQ ID NO: 2037111 - RNA, 15 nt, Staphylococcus aureus subsp. aureus Mu50
acucccuaauaacug

SEQ ID NO: 2037112 - RNA, 13 nt, Staphylococcus aureus subsp. aureus Mu50
acuccuccaaagc

SEQ ID NO: 2037113 - RNA, 20 nt, Staphylococcus aureus subsp. aureus Mu50
acugccauucuuuuucucaa

SEQ ID NO: 2037114 - RNA, 15 nt, Staphylococcus aureus subsp. aureus Mu50
acugauggaaaauua

SEQ ID NO: 2037115 - RNA, 23 nt, Staphylococcus aureus subsp. aureus Mu50
acugauggaaaauuauuugauau

SEQ ID NO: 2037116 - RNA, 20 nt, Staphylococcus aureus subsp. aureus Mu50
acugauuaaacuguuuguuu

SEQ ID NO: 2037117 - RNA, 16 nt, Staphylococcus aureus subsp. aureus Mu50
acugauuucgcccacc

SEQ ID NO: 2037118 - RNA, 13 nt, Staphylococcus aureus subsp. aureus Mu50
acugauuuuguuu

SEQ ID NO: 2037119 - RNA, 19 nt, Staphylococcus aureus subsp. aureus Mu50
acugcaaacacaguacaaa

SEQ ID NO: 2037120 - RNA, 18 nt, Staphylococcus aureus subsp. aureus Mu50
acugaaugcuaauacuaa

SEQ ID NO: 2037121 - RNA, 19 nt, Staphylococcus aureus subsp. aureus Mu50
acugaugaacauaccugca

SEQ ID NO: 2037122 - RNA, 14 nt, Staphylococcus aureus subsp. aureus Mu50
acguuuuucuuuaa

SEQ ID NO: 2037123 - RNA, 22 nt, Staphylococcus aureus subsp. aureus Mu50
acuaaaaugucuuugaaaaacu

SEQ ID NO: 2037124 - RNA, 13 nt, Staphylococcus aureus subsp. aureus Mu50
acuaaaaucacuu

SEQ ID NO: 2037125 - RNA, 18 nt, Staphylococcus aureus subsp. aureus Mu50
acuaaaacgauaauaaua

SEQ ID NO: 2037126 - RNA, 20 nt, Staphylococcus aureus subsp. aureus Mu50
acuaaaacaugauacguggu

SEQ ID NO: 2037127 - RNA, 15 nt, Staphylococcus aureus subsp. aureus Mu50
acuacuuguuuguuu

SEQ ID NO: 2037128 - RNA, 15 nt, Staphylococcus aureus subsp. aureus Mu50
acuacuuuauaaaua

SEQ ID NO: 2037129 - RNA, 18 nt, Staphylococcus aureus subsp. aureus Mu50
acuagaaaacauaaauac

SEQ ID NO: 2037130 - RNA, 12 nt, Staphylococcus aureus subsp. aureus Mu50
acuagaaugauu

SEQ ID NO: 2037131 - RNA, 13 nt, Staphylococcus aureus subsp. aureus Mu50
acuagauaguuua

SEQ ID NO: 2037132 - RNA, 19 nt, Staphylococcus aureus subsp. aureus Mu50
acuacgucauacuaucuac

SEQ ID NO: 2037133 - RNA, 22 nt, Staphylococcus aureus subsp. aureus Mu50
acuacugauuuauugauaaaua

SEQ ID NO: 2037134 - RNA, 18 nt, Staphylococcus aureus subsp. aureus Mu50
acuacuuaauuaauaauu

SEQ ID NO: 2037135 - RNA, 20 nt, Staphylococcus aureus subsp. aureus Mu50
acuacuuaauuaauaauuua

SEQ ID NO: 2037136 - RNA, 22 nt, Staphylococcus aureus subsp. aureus Mu50
acuaacauugguaccuuuuuau

SEQ ID NO: 2037137 - RNA, 15 nt, Staphylococcus aureus subsp. aureus Mu50
acuaaauaaguaguu

SEQ ID NO: 2037138 - RNA, 12 nt, Staphylococcus aureus subsp. aureus Mu50
acuaaaugaauu

SEQ ID NO: 2037139 - RNA, 19 nt, Staphylococcus aureus subsp. aureus Mu50
acguucuugguauuuuuua

SEQ ID NO: 2037140 - RNA, 22 nt, Staphylococcus aureus subsp. aureus Mu50
acguuuaauaccuaugauauau

SEQ ID NO: 2037141 - RNA, 17 nt, Staphylococcus aureus subsp. aureus Mu50
acguuugcaugaggaua

SEQ ID NO: 2037142 - RNA, 22 nt, Staphylococcus aureus subsp. aureus Mu50
acguuucguugcugauacccaa

SEQ ID NO: 2037143 - RNA, 15 nt, Staphylococcus aureus subsp. aureus Mu50
acguuuccaaucuau

SEQ ID NO: 2037144 - RNA, 19 nt, Staphylococcus aureus subsp. aureus Mu50
acguuauuuucaauauuug

SEQ ID NO: 2037145 - RNA, 21 nt, Staphylococcus aureus subsp. aureus Mu50
acgugcuuuccaaauugcaaa

SEQ ID NO: 2037146 - RNA, 23 nt, Staphylococcus aureus subsp. aureus Mu50
acgguagucucccauaacaccua

SEQ ID NO: 2037147 - RNA, 20 nt, Staphylococcus aureus subsp. aureus Mu50
acgguauaaaaaaauuaacu

SEQ ID NO: 2037148 - RNA, 20 nt, Staphylococcus aureus subsp. aureus Mu50
acguauagaugcuaauguaa

SEQ ID NO: 2037149 - RNA, 23 nt, Staphylococcus aureus subsp. aureus Mu50
acgucauauguuuuauaauaaau

SEQ ID NO: 2037150 - RNA, 22 nt, Staphylococcus aureus subsp. aureus Mu50
acgucauacuaucuacaauaac

SEQ ID NO: 2037151 - RNA, 21 nt, Staphylococcus aureus subsp. aureus Mu50
acgguaaauaaccacuuugaa

SEQ ID NO: 2037152 - RNA, 13 nt, Staphylococcus aureus subsp. aureus Mu50
acgggaacaucau

SEQ ID NO: 2037153 - RNA, 15 nt, Staphylococcus aureus subsp. aureus Mu50
acggcacgauacauc

SEQ ID NO: 2037154 - RNA, 17 nt, Staphylococcus aureus subsp. aureus Mu50
acgcuuuauuacuuuaa

SEQ ID NO: 2037155 - RNA, 16 nt, Staphylococcus aureus subsp. aureus Mu50
acgcuuauucgaacga

SEQ ID NO: 2037156 - RNA, 21 nt, Staphylococcus aureus subsp. aureus Mu50
aauccauacguaucaaaauuu

SEQ ID NO: 2037157 - RNA, 18 nt, Staphylococcus aureus subsp. aureus Mu50
aauccaaaaucuuuacuu

SEQ ID NO: 2037158 - RNA, 20 nt, Staphylococcus aureus subsp. aureus Mu50
aauccaaagcugaauuuuag

SEQ ID NO: 2037159 - RNA, 12 nt, Staphylococcus aureus subsp. aureus Mu50
aauccaauuaaa

SEQ ID NO: 2037160 - RNA, 16 nt, Staphylococcus aureus subsp. aureus Mu50
aaucccauuuuaaagu

SEQ ID NO: 2037161 - RNA, 19 nt, Staphylococcus aureus subsp. aureus Mu50
uuggcacauaaaucaaugu

SEQ ID NO: 2037162 - RNA, 20 nt, Staphylococcus aureus subsp. aureus Mu50
uuggggugagggccccaaca

SEQ ID NO: 2037163 - RNA, 19 nt, Staphylococcus aureus subsp. aureus Mu50
uuggggccccgacuauuuu

SEQ ID NO: 2037164 - RNA, 16 nt, Staphylococcus aureus subsp. aureus Mu50
uuggguaauguuuuua

SEQ ID NO: 2037165 - RNA, 17 nt, Staphylococcus aureus subsp. aureus Mu50
uuggguggucguaauuu

SEQ ID NO: 2037166 - RNA, 21 nt, Staphylococcus aureus subsp. aureus Mu50
uuggucaccuacagauaaagc

SEQ ID NO: 2037167 - RNA, 14 nt, Staphylococcus aureus subsp. aureus Mu50
aaucccuucaaaau

SEQ ID NO: 2037168 - RNA, 17 nt, Staphylococcus aureus subsp. aureus Mu50
aaucgcauuuuguuuca

SEQ ID NO: 2037169 - RNA, 17 nt, Staphylococcus aureus subsp. aureus Mu50
aaucgcauuguuaaaga

SEQ ID NO: 2037170 - RNA, 14 nt, Staphylococcus aureus subsp. aureus Mu50
aaucgcauuuaaau

SEQ ID NO: 2037171 - RNA, 15 nt, Staphylococcus aureus subsp. aureus Mu50
aaucgcauuuaaaua

SEQ ID NO: 2037172 - RNA, 16 nt, Staphylococcus aureus subsp. aureus Mu50
aaucgcauuuaaauau

SEQ ID NO: 2037173 - RNA, 14 nt, Staphylococcus aureus subsp. aureus Mu50
aaucgcauuuuguu

SEQ ID NO: 2037174 - RNA, 14 nt, Staphylococcus aureus subsp. aureus Mu50
aaucgauaaaaugu

SEQ ID NO: 2037175 - RNA, 18 nt, Staphylococcus aureus subsp. aureus Mu50
uugguuucuauaaagaau

SEQ ID NO: 2037176 - RNA, 14 nt, Staphylococcus aureus subsp. aureus Mu50
uuguaaacuucuuu

SEQ ID NO: 2037177 - RNA, 20 nt, Staphylococcus aureus subsp. aureus Mu50
uugguggagaaccuuuuugu

SEQ ID NO: 2037178 - RNA, 17 nt, Staphylococcus aureus subsp. aureus Mu50
uuguaauuguaaucuau

SEQ ID NO: 2037179 - RNA, 11 nt, Staphylococcus aureus subsp. aureus Mu50
uuguaauuuaa

SEQ ID NO: 2037180 - RNA, 15 nt, Staphylococcus aureus subsp. aureus Mu50
uuguaugaauaauau

SEQ ID NO: 2037181 - RNA, 20 nt, Staphylococcus aureus subsp. aureus Mu50
uuguaaagcaugaauagcuu

SEQ ID NO: 2037182 - RNA, 15 nt, Staphylococcus aureus subsp. aureus Mu50
uuguaaauuuauuuu

SEQ ID NO: 2037183 - RNA, 16 nt, Staphylococcus aureus subsp. aureus Mu50
uuguaaacuucuuuuc

SEQ ID NO: 2037184 - RNA, 21 nt, Staphylococcus aureus subsp. aureus Mu50
uuguaugcaucaguuaauaau

SEQ ID NO: 2037185 - RNA, 11 nt, Staphylococcus aureus subsp. aureus Mu50
uugucacaauc

SEQ ID NO: 2037186 - RNA, 14 nt, Staphylococcus aureus subsp. aureus Mu50
uuguauuuaauaag

SEQ ID NO: 2037187 - RNA, 18 nt, Staphylococcus aureus subsp. aureus Mu50
uugucauaauagauaaug

SEQ ID NO: 2037188 - RNA, 22 nt, Staphylococcus aureus subsp. aureus Mu50
uuguccguuuuauauuuauuuu

SEQ ID NO: 2037189 - RNA, 22 nt, Staphylococcus aureus subsp. aureus Mu50
uugucguucucguguaaaaugc

SEQ ID NO: 2037190 - RNA, 18 nt, Staphylococcus aureus subsp. aureus Mu50
uugugauuuuuaauaauu

SEQ ID NO: 2037191 - RNA, 17 nt, Staphylococcus aureus subsp. aureus Mu50
uugugaugauaauuaau

SEQ ID NO: 2037192 - RNA, 18 nt, Staphylococcus aureus subsp. aureus Mu50
uugugaugauaauuaaug

SEQ ID NO: 2037193 - RNA, 16 nt, Staphylococcus aureus subsp. aureus Mu50
uugugauaauucuuca

SEQ ID NO: 2037194 - RNA, 21 nt, Staphylococcus aureus subsp. aureus Mu50
uuguggcaccucuuuuguuua

SEQ ID NO: 2037195 - RNA, 23 nt, Staphylococcus aureus subsp. aureus Mu50
uuguggcuacuaaucuuuuuuua

SEQ ID NO: 2037196 - RNA, 15 nt, Staphylococcus aureus subsp. aureus Mu50
uuguggcuuuuuuua

SEQ ID NO: 2037197 - RNA, 13 nt, Staphylococcus aureus subsp. aureus Mu50
uuguguauaaaug

SEQ ID NO: 2037198 - RNA, 22 nt, Staphylococcus aureus subsp. aureus Mu50
uugugguaaugauuuugcuuua

SEQ ID NO: 2037199 - RNA, 14 nt, Staphylococcus aureus subsp. aureus Mu50
uuguuaaaauaaug

SEQ ID NO: 2037200 - RNA, 12 nt, Staphylococcus aureus subsp. aureus Mu50
uuuaaaaauaaa

SEQ ID NO: 2037201 - RNA, 13 nt, Staphylococcus aureus subsp. aureus Mu50
uuuaaaaaucaaa

SEQ ID NO: 2037202 - RNA, 12 nt, Staphylococcus aureus subsp. aureus Mu50
aaucaucauuau

SEQ ID NO: 2037203 - RNA, 20 nt, Staphylococcus aureus subsp. aureus Mu50
aaucauaaugaauaauuaaa

SEQ ID NO: 2037204 - RNA, 20 nt, Staphylococcus aureus subsp. aureus Mu50
aaucauaccggcaaauaaca

SEQ ID NO: 2037205 - RNA, 17 nt, Staphylococcus aureus subsp. aureus Mu50
aaucauacgagaaauua

SEQ ID NO: 2037206 - RNA, 21 nt, Staphylococcus aureus subsp. aureus Mu50
aaucauucauggccaaauguu

SEQ ID NO: 2037207 - RNA, 19 nt, Staphylococcus aureus subsp. aureus Mu50
aaucauugguuucaucaua

SEQ ID NO: 2037208 - RNA, 14 nt, Staphylococcus aureus subsp. aureus Mu50
aaucauuguaaaug

SEQ ID NO: 2037209 - RNA, 20 nt, Staphylococcus aureus subsp. aureus Mu50
aaucauuguguauuguuuua

SEQ ID NO: 2037210 - RNA, 11 nt, Staphylococcus aureus subsp. aureus Mu50
aaucauuuaaa

SEQ ID NO: 2037211 - RNA, 19 nt, Staphylococcus aureus subsp. aureus Mu50
aaucagguuuaaacaguuu

SEQ ID NO: 2037212 - RNA, 13 nt, Staphylococcus aureus subsp. aureus Mu50
uugcacuuuuuuc

SEQ ID NO: 2037213 - RNA, 18 nt, Staphylococcus aureus subsp. aureus Mu50
uugcacgucuuguaucaa

SEQ ID NO: 2037214 - RNA, 20 nt, Staphylococcus aureus subsp. aureus Mu50
uugcaaugaauaacaagaaa

SEQ ID NO: 2037215 - RNA, 13 nt, Staphylococcus aureus subsp. aureus Mu50
uugcaaucaucug

SEQ ID NO: 2037216 - RNA, 17 nt, Staphylococcus aureus subsp. aureus Mu50
uugcaagccaucaauau

SEQ ID NO: 2037217 - RNA, 16 nt, Staphylococcus aureus subsp. aureus Mu50
uugauuaacacauucu

SEQ ID NO: 2037218 - RNA, 17 nt, Staphylococcus aureus subsp. aureus Mu50
uugcaaagacucaauuu

SEQ ID NO: 2037219 - RNA, 15 nt, Staphylococcus aureus subsp. aureus Mu50
uugauucuaaauaau

SEQ ID NO: 2037220 - RNA, 21 nt, Staphylococcus aureus subsp. aureus Mu50
uugauuuugaauaaaaaaagc

SEQ ID NO: 2037221 - RNA, 18 nt, Staphylococcus aureus subsp. aureus Mu50
uugauuuuuugaaauguu

SEQ ID NO: 2037222 - RNA, 16 nt, Staphylococcus aureus subsp. aureus Mu50
uugcaaaaauaauaug

SEQ ID NO: 2037223 - RNA, 16 nt, Staphylococcus aureus subsp. aureus Mu50
uucugucuguaaauua

SEQ ID NO: 2037224 - RNA, 20 nt, Staphylococcus aureus subsp. aureus Mu50
uucuuagauuuuauauaaaa

SEQ ID NO: 2037225 - RNA, 13 nt, Staphylococcus aureus subsp. aureus Mu50
uucuuauaaaaau

SEQ ID NO: 2037226 - RNA, 16 nt, Staphylococcus aureus subsp. aureus Mu50
uucuucaaaaaauaau

SEQ ID NO: 2037227 - RNA, 23 nt, Staphylococcus aureus subsp. aureus Mu50
uucuucaccaguuugugguaaug

SEQ ID NO: 2037228 - RNA, 16 nt, Staphylococcus aureus subsp. aureus Mu50
uucuguaauaauauca

SEQ ID NO: 2037229 - RNA, 17 nt, Staphylococcus aureus subsp. aureus Mu50
uugaugaauaaauagau

SEQ ID NO: 2037230 - RNA, 19 nt, Staphylococcus aureus subsp. aureus Mu50
uugaugaugaugugcuuua

SEQ ID NO: 2037231 - RNA, 13 nt, Staphylococcus aureus subsp. aureus Mu50
uugauuaaauaaa

SEQ ID NO: 2037232 - RNA, 18 nt, Staphylococcus aureus subsp. aureus Mu50
uugauuaacacaauccuu

SEQ ID NO: 2037233 - RNA, 11 nt, Staphylococcus aureus subsp. aureus Mu50
uugauguuuau

SEQ ID NO: 2037234 - RNA, 20 nt, Staphylococcus aureus subsp. aureus Mu50
uugauuaaacgguucauuuc

SEQ ID NO: 2037235 - RNA, 15 nt, Staphylococcus aureus subsp. aureus Mu50
uugauggauauucaa

SEQ ID NO: 2037236 - RNA, 20 nt, Staphylococcus aureus subsp. aureus Mu50
aaugaaaguaccuaaaauag

SEQ ID NO: 2037237 - RNA, 20 nt, Staphylococcus aureus subsp. aureus Mu50
aaugaauuauuuaaaaugcu

SEQ ID NO: 2037238 - RNA, 19 nt, Staphylococcus aureus subsp. aureus Mu50
aaugaauucauucaauacg

SEQ ID NO: 2037239 - RNA, 23 nt, Staphylococcus aureus subsp. aureus Mu50
aaugaauaaugacaaauuaucac

SEQ ID NO: 2037240 - RNA, 17 nt, Staphylococcus aureus subsp. aureus Mu50
aaugacaucaucuauaa

SEQ ID NO: 2037241 - RNA, 20 nt, Staphylococcus aureus subsp. aureus Mu50
aaucuuuuaaauuuaguauc

SEQ ID NO: 2037242 - RNA, 12 nt, Staphylococcus aureus subsp. aureus Mu50
aaucuuuuaacu

SEQ ID NO: 2037243 - RNA, 17 nt, Staphylococcus aureus subsp. aureus Mu50
aaucuauggaaaauguu

SEQ ID NO: 2037244 - RNA, 20 nt, Staphylococcus aureus subsp. aureus Mu50
aaucuuuuuuacuaaaauca

SEQ ID NO: 2037245 - RNA, 20 nt, Staphylococcus aureus subsp. aureus Mu50
uuuuugcguuuuuaaauaau

SEQ ID NO: 2037246 - RNA, 19 nt, Staphylococcus aureus subsp. aureus Mu50
uuuuugacucagaaucuua

SEQ ID NO: 2037247 - RNA, 23 nt, Staphylococcus aureus subsp. aureus Mu50
aaucuaauacuuucaaacaaauc

SEQ ID NO: 2037248 - RNA, 16 nt, Staphylococcus aureus subsp. aureus Mu50
aaucuaaacuauaaua

SEQ ID NO: 2037249 - RNA, 13 nt, Staphylococcus aureus subsp. aureus Mu50
aaucuauaaauau

SEQ ID NO: 2037250 - RNA, 14 nt, Staphylococcus aureus subsp. aureus Mu50
aaucuauaaauauc

SEQ ID NO: 2037251 - RNA, 19 nt, Staphylococcus aureus subsp. aureus Mu50
aaucuagaccuucaauauc

SEQ ID NO: 2037252 - RNA, 22 nt, Staphylococcus aureus subsp. aureus Mu50
aaucuacaauauuaaaauuaaa

SEQ ID NO: 2037253 - RNA, 18 nt, Staphylococcus aureus subsp. aureus Mu50
aaucgggaugauaaccaa

SEQ ID NO: 2037254 - RNA, 18 nt, Staphylococcus aureus subsp. aureus Mu50
aaucguaacuaacauguu

SEQ ID NO: 2037255 - RNA, 19 nt, Staphylococcus aureus subsp. aureus Mu50
uuuguggcaccucuuuugu

SEQ ID NO: 2037256 - RNA, 16 nt, Staphylococcus aureus subsp. aureus Mu50
uuuuacugcuucgaca

SEQ ID NO: 2037257 - RNA, 20 nt, Staphylococcus aureus subsp. aureus Mu50
uuuuagauuuaguuuuuuua

SEQ ID NO: 2037258 - RNA, 22 nt, Staphylococcus aureus subsp. aureus Mu50
uuuuaguaguuuauaucaaaaa

SEQ ID NO: 2037259 - RNA, 14 nt, Staphylococcus aureus subsp. aureus Mu50
uuuuauaaaucauu

SEQ ID NO: 2037260 - RNA, 16 nt, Staphylococcus aureus subsp. aureus Mu50
uuuuguuuuuauauua

SEQ ID NO: 2037261 - RNA, 21 nt, Staphylococcus aureus subsp. aureus Mu50
uuuuuaaaaggugugggcuuu

SEQ ID NO: 2037262 - RNA, 17 nt, Staphylococcus aureus subsp. aureus Mu50
uuuuuaaauuacuauau

SEQ ID NO: 2037263 - RNA, 13 nt, Staphylococcus aureus subsp. aureus Mu50
uuuuuaaugugua

SEQ ID NO: 2037264 - RNA, 21 nt, Staphylococcus aureus subsp. aureus Mu50
uuuuuaauuauuuuaaaaaau

SEQ ID NO: 2037265 - RNA, 22 nt, Staphylococcus aureus subsp. aureus Mu50
uuuuuauuccgaacauguuucu

SEQ ID NO: 2037266 - RNA, 10 nt, Staphylococcus aureus subsp. aureus Mu50
uuuuuauuua

SEQ ID NO: 2037267 - RNA, 10 nt, Staphylococcus aureus subsp. aureus Mu50
uuuuuauuuu

SEQ ID NO: 2037268 - RNA, 14 nt, Staphylococcus aureus subsp. aureus Mu50
uuuuuauaaaucau

SEQ ID NO: 2037269 - RNA, 18 nt, Staphylococcus aureus subsp. aureus Mu50
uuuuuauaaguuaaaaau

SEQ ID NO: 2037270 - RNA, 13 nt, Staphylococcus aureus subsp. aureus Mu50
uuuuuaucaugau

SEQ ID NO: 2037271 - RNA, 12 nt, Staphylococcus aureus subsp. aureus Mu50
uuuuuaucaugu

SEQ ID NO: 2037272 - RNA, 18 nt, Staphylococcus aureus subsp. aureus Mu50
uuuuuauguuaaaucgau

SEQ ID NO: 2037273 - RNA, 19 nt, Staphylococcus aureus subsp. aureus Mu50
uuuuuauuaauuaaaaaau

SEQ ID NO: 2037274 - RNA, 13 nt, Staphylococcus aureus subsp. aureus Mu50
uuuuucaaauaau

SEQ ID NO: 2037275 - RNA, 22 nt, Staphylococcus aureus subsp. aureus Mu50
aaugacuaccuguuggcuuuaa

SEQ ID NO: 2037276 - RNA, 19 nt, Staphylococcus aureus subsp. aureus Mu50
aaugacugagaaaaauauu

SEQ ID NO: 2037277 - RNA, 15 nt, Staphylococcus aureus subsp. aureus Mu50
aaugaguacaacaua

SEQ ID NO: 2037278 - RNA, 21 nt, Staphylococcus aureus subsp. aureus Mu50
aaugauaauccaccaaauaca

SEQ ID NO: 2037279 - RNA, 17 nt, Staphylococcus aureus subsp. aureus Mu50
aaugagcuuuucuaaug

SEQ ID NO: 2037280 - RNA, 14 nt, Staphylococcus aureus subsp. aureus Mu50
aaugccuaauuugu

SEQ ID NO: 2037281 - RNA, 15 nt, Staphylococcus aureus subsp. aureus Mu50
aaugccuaauuuugu

SEQ ID NO: 2037282 - RNA, 22 nt, Staphylococcus aureus subsp. aureus Mu50
aaugccuacagauuuuaaaaau

SEQ ID NO: 2037283 - RNA, 17 nt, Staphylococcus aureus subsp. aureus Mu50
aaugauggguauuuugu

SEQ ID NO: 2037284 - RNA, 14 nt, Staphylococcus aureus subsp. aureus Mu50
aaugauuaaaauua

SEQ ID NO: 2037285 - RNA, 20 nt, Staphylococcus aureus subsp. aureus Mu50
aaugauagcgugauuuuuca

SEQ ID NO: 2037286 - RNA, 16 nt, Staphylococcus aureus subsp. aureus Mu50
aaugauauugauuuga

SEQ ID NO: 2037287 - RNA, 22 nt, Staphylococcus aureus subsp. aureus Mu50
aaugauauuugaucguugaaua

SEQ ID NO: 2037288 - RNA, 20 nt, Staphylococcus aureus subsp. aureus Mu50
aaugaugcauaagauuuuga

SEQ ID NO: 2037289 - RNA, 20 nt, Staphylococcus aureus subsp. aureus Mu50
aaugaugacaucaauaucuu

SEQ ID NO: 2037290 - RNA, 13 nt, Staphylococcus aureus subsp. aureus Mu50
aauggccauuuga

SEQ ID NO: 2037291 - RNA, 16 nt, Staphylococcus aureus subsp. aureus Mu50
aauggcaaucuauaua

SEQ ID NO: 2037292 - RNA, 16 nt, Staphylococcus aureus subsp. aureus Mu50
aauggcuccauuuaau

SEQ ID NO: 2037293 - RNA, 21 nt, Staphylococcus aureus subsp. aureus Mu50
aauggcuccauuuaauuuguu

SEQ ID NO: 2037294 - RNA, 12 nt, Staphylococcus aureus subsp. aureus Mu50
aaugugaugauu

SEQ ID NO: 2037295 - RNA, 15 nt, Staphylococcus aureus subsp. aureus Mu50
aaugugaccuuaugu

SEQ ID NO: 2037296 - RNA, 16 nt, Staphylococcus aureus subsp. aureus Mu50
aaugucuaaaaauguc

SEQ ID NO: 2037297 - RNA, 14 nt, Staphylococcus aureus subsp. aureus Mu50
aaugucuuucaaau

SEQ ID NO: 2037298 - RNA, 14 nt, Staphylococcus aureus subsp. aureus Mu50
aauguauaucgaca

SEQ ID NO: 2037299 - RNA, 20 nt, Staphylococcus aureus subsp. aureus Mu50
aauguaggcgccauaaucau

SEQ ID NO: 2037300 - RNA, 19 nt, Staphylococcus aureus subsp. aureus Mu50
aauguaagcgcaauggcca

SEQ ID NO: 2037301 - RNA, 19 nt, Staphylococcus aureus subsp. aureus Mu50
aauguagauuacuuugcua

SEQ ID NO: 2037302 - RNA, 14 nt, Staphylococcus aureus subsp. aureus Mu50
aauguaacauuaaa

SEQ ID NO: 2037303 - RNA, 16 nt, Staphylococcus aureus subsp. aureus Mu50
aaugguuucauaaacu

SEQ ID NO: 2037304 - RNA, 23 nt, Staphylococcus aureus subsp. aureus Mu50
aaugguuaauaacccauuuucaa

SEQ ID NO: 2037305 - RNA, 17 nt, Staphylococcus aureus subsp. aureus Mu50
aaugguucauagugaaa

SEQ ID NO: 2037306 - RNA, 20 nt, Staphylococcus aureus subsp. aureus Mu50
uuucguaauguguuaauacu

SEQ ID NO: 2037307 - RNA, 21 nt, Staphylococcus aureus subsp. aureus Mu50
uuucggauugaaccggaaauu

SEQ ID NO: 2037308 - RNA, 12 nt, Staphylococcus aureus subsp. aureus Mu50
uuucuuaauuac

SEQ ID NO: 2037309 - RNA, 12 nt, Staphylococcus aureus subsp. aureus Mu50
uuucuuaauuau

SEQ ID NO: 2037310 - RNA, 22 nt, Staphylococcus aureus subsp. aureus Mu50
uuucuugcauacgaauuaaaau

SEQ ID NO: 2037311 - RNA, 13 nt, Staphylococcus aureus subsp. aureus Mu50
uuucuuuggugaa

SEQ ID NO: 2037312 - RNA, 13 nt, Staphylococcus aureus subsp. aureus Mu50
uuucuuuuauuuu

SEQ ID NO: 2037313 - RNA, 12 nt, Staphylococcus aureus subsp. aureus Mu50
uuucuuuuuuau

SEQ ID NO: 2037314 - RNA, 19 nt, Staphylococcus aureus subsp. aureus Mu50
uuugaaagaaggaauaauu

SEQ ID NO: 2037315 - RNA, 14 nt, Staphylococcus aureus subsp. aureus Mu50
uuugaaagacauuu

SEQ ID NO: 2037316 - RNA, 15 nt, Staphylococcus aureus subsp. aureus Mu50
uuucugaaaugauac

SEQ ID NO: 2037317 - RNA, 13 nt, Staphylococcus aureus subsp. aureus Mu50
uuucuuauuaaau

SEQ ID NO: 2037318 - RNA, 14 nt, Staphylococcus aureus subsp. aureus Mu50
uuuccauucguaua

SEQ ID NO: 2037319 - RNA, 14 nt, Staphylococcus aureus subsp. aureus Mu50
uuuccauaaauaaa

SEQ ID NO: 2037320 - RNA, 16 nt, Staphylococcus aureus subsp. aureus Mu50
uuuccauaaauaaaau

SEQ ID NO: 2037321 - RNA, 23 nt, Staphylococcus aureus subsp. aureus Mu50
uuuacauauuuauacugaucaaa

SEQ ID NO: 2037322 - RNA, 20 nt, Staphylococcus aureus subsp. aureus Mu50
uuuaccauugugaauaauuu

SEQ ID NO: 2037323 - RNA, 18 nt, Staphylococcus aureus subsp. aureus Mu50
uuuaauuaagaaaaucau

SEQ ID NO: 2037324 - RNA, 19 nt, Staphylococcus aureus subsp. aureus Mu50
uuuaauugguugauuaguu

SEQ ID NO: 2037325 - RNA, 17 nt, Staphylococcus aureus subsp. aureus Mu50
uuuaauuguuuaauaac

SEQ ID NO: 2037326 - RNA, 13 nt, Staphylococcus aureus subsp. aureus Mu50
uuuaauuaaagca

SEQ ID NO: 2037327 - RNA, 20 nt, Staphylococcus aureus subsp. aureus Mu50
uuuaacccaaauugaugacu

SEQ ID NO: 2037328 - RNA, 15 nt, Staphylococcus aureus subsp. aureus Mu50
uuuaacauaaaaaug

SEQ ID NO: 2037329 - RNA, 13 nt, Staphylococcus aureus subsp. aureus Mu50
uuuacaaucaacu

SEQ ID NO: 2037330 - RNA, 14 nt, Staphylococcus aureus subsp. aureus Mu50
uuuacaaucaacuu

SEQ ID NO: 2037331 - RNA, 23 nt, Staphylococcus aureus subsp. aureus Mu50
uuuacaggagcgagccauuauua

SEQ ID NO: 2037332 - RNA, 21 nt, Staphylococcus aureus subsp. aureus Mu50
uuuaauuucuaugaaaaaaau

SEQ ID NO: 2037333 - RNA, 16 nt, Staphylococcus aureus subsp. aureus Mu50
uuuaauuucugguaaa

SEQ ID NO: 2037334 - RNA, 16 nt, Staphylococcus aureus subsp. aureus Mu50
uuuaauuuuuaaugua

SEQ ID NO: 2037335 - RNA, 23 nt, Staphylococcus aureus subsp. aureus Mu50
uuuaauugcuguaaauauucguu

SEQ ID NO: 2037336 - RNA, 20 nt, Staphylococcus aureus subsp. aureus Mu50
uuuaaaaucucauaauaauu

SEQ ID NO: 2037337 - RNA, 23 nt, Staphylococcus aureus subsp. aureus Mu50
uuuaaaccguguucuuuaaugua

SEQ ID NO: 2037338 - RNA, 18 nt, Staphylococcus aureus subsp. aureus Mu50
uuuaaagaaaauuucagu

SEQ ID NO: 2037339 - RNA, 19 nt, Staphylococcus aureus subsp. aureus Mu50
uuuaaagacugaaccguau

SEQ ID NO: 2037340 - RNA, 17 nt, Staphylococcus aureus subsp. aureus Mu50
uuuaaaccuguuaaugu

SEQ ID NO: 2037341 - RNA, 13 nt, Staphylococcus aureus subsp. aureus Mu50
uuuaaauaaaaug

SEQ ID NO: 2037342 - RNA, 15 nt, Staphylococcus aureus subsp. aureus Mu50
uuugaaauuuauuau

SEQ ID NO: 2037343 - RNA, 20 nt, Staphylococcus aureus subsp. aureus Mu50
uuugaagggagcauuucacu

SEQ ID NO: 2037344 - RNA, 19 nt, Staphylococcus aureus subsp. aureus Mu50
uuugaagggagcauuucau

SEQ ID NO: 2037345 - RNA, 21 nt, Staphylococcus aureus subsp. aureus Mu50
uuugaaguuacuauauuuauu

SEQ ID NO: 2037346 - RNA, 17 nt, Staphylococcus aureus subsp. aureus Mu50
uuugaaugcaaaucaaa

SEQ ID NO: 2037347 - RNA, 23 nt, Staphylococcus aureus subsp. aureus Mu50
uuugaaucaguauaaucagcaau

SEQ ID NO: 2037348 - RNA, 17 nt, Staphylococcus aureus subsp. aureus Mu50
uuugaauacuuuauuug

SEQ ID NO: 2037349 - RNA, 12 nt, Staphylococcus aureus subsp. aureus Mu50
uuugacauaaaa

SEQ ID NO: 2037350 - RNA, 18 nt, Staphylococcus aureus subsp. aureus Mu50
uuugacauaaaaaauaac

SEQ ID NO: 2037351 - RNA, 15 nt, Staphylococcus aureus subsp. aureus Mu50
uuugauccaaaguac

SEQ ID NO: 2037352 - RNA, 14 nt, Staphylococcus aureus subsp. aureus Mu50
uuugauaaugauag

SEQ ID NO: 2037353 - RNA, 19 nt, Staphylococcus aureus subsp. aureus Mu50
uuugagcggaaauaugauu

SEQ ID NO: 2037354 - RNA, 20 nt, Staphylococcus aureus subsp. aureus Mu50
uuugaguguguccaucauuu

SEQ ID NO: 2037355 - RNA, 21 nt, Staphylococcus aureus subsp. aureus Mu50
uuugaggauacauaaaucuaa

SEQ ID NO: 2037356 - RNA, 14 nt, Staphylococcus aureus subsp. aureus Mu50
uuugauaacaaaac

SEQ ID NO: 2037357 - RNA, 21 nt, Staphylococcus aureus subsp. aureus Mu50
uuugauaacaauuuuaaaucu

SEQ ID NO: 2037358 - RNA, 14 nt, Staphylococcus aureus subsp. aureus Mu50
uuugcauacauauc

SEQ ID NO: 2037359 - RNA, 17 nt, Staphylococcus aureus subsp. aureus Mu50
uuugauuaaaaucugcu

SEQ ID NO: 2037360 - RNA, 11 nt, Staphylococcus aureus subsp. aureus Mu50
uuugaugauuu

SEQ ID NO: 2037361 - RNA, 16 nt, Staphylococcus aureus subsp. aureus Mu50
uuugauuauauuuauu

SEQ ID NO: 2037362 - RNA, 13 nt, Staphylococcus aureus subsp. aureus Mu50
uuugauuuggaaa

SEQ ID NO: 2037363 - RNA, 14 nt, Staphylococcus aureus subsp. aureus Mu50
uuugcaaaaucaac

SEQ ID NO: 2037364 - RNA, 20 nt, Staphylococcus aureus subsp. aureus Mu50
uuugccccucauucacaaug

SEQ ID NO: 2037365 - RNA, 12 nt, Staphylococcus aureus subsp. aureus Mu50
uuugccauaauu

SEQ ID NO: 2037366 - RNA, 20 nt, Staphylococcus aureus subsp. aureus Mu50
uuuguaaccuaaaaacaaag

SEQ ID NO: 2037367 - RNA, 19 nt, Staphylococcus aureus subsp. aureus Mu50
uuuguaagacaacaaaucg

SEQ ID NO: 2037368 - RNA, 21 nt, Staphylococcus aureus subsp. aureus Mu50
uuuguaccaaauaaauuaaau

SEQ ID NO: 2037369 - RNA, 12 nt, Staphylococcus aureus subsp. aureus Mu50
uuugucauaaua

SEQ ID NO: 2037370 - RNA, 19 nt, Staphylococcus aureus subsp. aureus Mu50
uuugucauuuugauuaagu

SEQ ID NO: 2037371 - RNA, 16 nt, Staphylococcus aureus subsp. aureus Mu50
uuuuaauuucacuuua

SEQ ID NO: 2037372 - RNA, 19 nt, Staphylococcus aureus subsp. aureus Mu50
uuuuaccauugugaauaau

SEQ ID NO: 2037373 - RNA, 20 nt, Staphylococcus aureus subsp. aureus Mu50
uuuuaccauugugaauaauu

SEQ ID NO: 2037374 - RNA, 21 nt, Staphylococcus aureus subsp. aureus Mu50
uuuuaccucugauaaaugaau

SEQ ID NO: 2037375 - RNA, 15 nt, Staphylococcus aureus subsp. aureus Mu50
uuuuaccuuuaauua

SEQ ID NO: 2037376 - RNA, 14 nt, Staphylococcus aureus subsp. aureus Mu50
uuuuacguuuucua

SEQ ID NO: 2037377 - RNA, 15 nt, Staphylococcus aureus subsp. aureus Mu50
uuuuacuaaaugaau

SEQ ID NO: 2037378 - RNA, 23 nt, Staphylococcus aureus subsp. aureus Mu50
uuuuacuacugucucaucuucua

SEQ ID NO: 2037379 - RNA, 16 nt, Staphylococcus aureus subsp. aureus Mu50
uuuuacuauaauaauu

SEQ ID NO: 2037380 - RNA, 19 nt, Staphylococcus aureus subsp. aureus Mu50
uuuuacuauggcauuauug

SEQ ID NO: 2037381 - RNA, 18 nt, Staphylococcus aureus subsp. aureus Mu50
uuuuaauauauuuauuuu

SEQ ID NO: 2037382 - RNA, 15 nt, Staphylococcus aureus subsp. aureus Mu50
uuuuaauaaucaaac

SEQ ID NO: 2037383 - RNA, 22 nt, Staphylococcus aureus subsp. aureus Mu50
uuuuaauaaugcagauucuuca

SEQ ID NO: 2037384 - RNA, 18 nt, Staphylococcus aureus subsp. aureus Mu50
uuuuaauguauucuucua

SEQ ID NO: 2037385 - RNA, 12 nt, Staphylococcus aureus subsp. aureus Mu50
uuuuaauuaagu

SEQ ID NO: 2037386 - RNA, 16 nt, Staphylococcus aureus subsp. aureus Mu50
uuuuaauuaauuauca

SEQ ID NO: 2037387 - RNA, 16 nt, Staphylococcus aureus subsp. aureus Mu50
uuuggcgacauaaaua

SEQ ID NO: 2037388 - RNA, 18 nt, Staphylococcus aureus subsp. aureus Mu50
uuuggcguaaugauauua

SEQ ID NO: 2037389 - RNA, 14 nt, Staphylococcus aureus subsp. aureus Mu50
uuuggaugaacaaa

SEQ ID NO: 2037390 - RNA, 14 nt, Staphylococcus aureus subsp. aureus Mu50
uuugguacauaaua

SEQ ID NO: 2037391 - RNA, 22 nt, Staphylococcus aureus subsp. aureus Mu50
uuugguggagaaccauuuuauu

SEQ ID NO: 2037392 - RNA, 21 nt, Staphylococcus aureus subsp. aureus Mu50
uuugguguuuaacuaaaccau

SEQ ID NO: 2037393 - RNA, 19 nt, Staphylococcus aureus subsp. aureus Mu50
uuugcuaaccaucauaaau

SEQ ID NO: 2037394 - RNA, 20 nt, Staphylococcus aureus subsp. aureus Mu50
uuugcuaaccaucauaaaug

SEQ ID NO: 2037395 - RNA, 15 nt, Staphylococcus aureus subsp. aureus Mu50
uuugcuuuuugugua

SEQ ID NO: 2037396 - RNA, 18 nt, Staphylococcus aureus subsp. aureus Mu50
uuugcuggcgcaaugaua

SEQ ID NO: 2037397 - RNA, 15 nt, Staphylococcus aureus subsp. aureus Mu50
uuuggaaauuuauua

SEQ ID NO: 2037398 - RNA, 21 nt, Staphylococcus aureus subsp. aureus Mu50
uuuggaaauuuauuauaaaau

SEQ ID NO: 2037399 - RNA, 21 nt, Staphylococcus aureus subsp. aureus Mu50
uuugcuuuaaaauucucuagu

SEQ ID NO: 2037400 - RNA, 12 nt, Staphylococcus aureus subsp. aureus Mu50
uuugcuuuauca

SEQ ID NO: 2037401 - RNA, 16 nt, Staphylococcus aureus subsp. aureus Mu50
uucaucaaguugauaa

SEQ ID NO: 2037402 - RNA, 20 nt, Staphylococcus aureus subsp. aureus Mu50
uucaucaauaaauauugauu

SEQ ID NO: 2037403 - RNA, 17 nt, Staphylococcus aureus subsp. aureus Mu50
uucaucauaucgauuaa

SEQ ID NO: 2037404 - RNA, 12 nt, Staphylococcus aureus subsp. aureus Mu50
uucaucaauaau

SEQ ID NO: 2037405 - RNA, 21 nt, Staphylococcus aureus subsp. aureus Mu50
uucaucauuuacgauacauca

SEQ ID NO: 2037406 - RNA, 14 nt, Staphylococcus aureus subsp. aureus Mu50
uucagggucaacau

SEQ ID NO: 2037407 - RNA, 16 nt, Staphylococcus aureus subsp. aureus Mu50
uucagggucaacauca

SEQ ID NO: 2037408 - RNA, 15 nt, Staphylococcus aureus subsp. aureus Mu50
uucaugaacagcauc

SEQ ID NO: 2037409 - RNA, 18 nt, Staphylococcus aureus subsp. aureus Mu50
uucaugcacuuuaacaua

SEQ ID NO: 2037410 - RNA, 16 nt, Staphylococcus aureus subsp. aureus Mu50
uucauggccaaauguu

SEQ ID NO: 2037411 - RNA, 17 nt, Staphylococcus aureus subsp. aureus Mu50
uucaccuaaaugauuaa

SEQ ID NO: 2037412 - RNA, 17 nt, Staphylococcus aureus subsp. aureus Mu50
uucacgauauaacauua

SEQ ID NO: 2037413 - RNA, 23 nt, Staphylococcus aureus subsp. aureus Mu50
uucacgauauaacauuaaaauga

SEQ ID NO: 2037414 - RNA, 14 nt, Staphylococcus aureus subsp. aureus Mu50
uucacguuaucaua

SEQ ID NO: 2037415 - RNA, 14 nt, Staphylococcus aureus subsp. aureus Mu50
uucagcuaauuguc

SEQ ID NO: 2037416 - RNA, 19 nt, Staphylococcus aureus subsp. aureus Mu50
uucacuuuaacuucuuuug

SEQ ID NO: 2037417 - RNA, 22 nt, Staphylococcus aureus subsp. aureus Mu50
uucacuuuuuuuaauuugauua

SEQ ID NO: 2037418 - RNA, 14 nt, Staphylococcus aureus subsp. aureus Mu50
uucacuuuaacuuc

SEQ ID NO: 2037419 - RNA, 14 nt, Staphylococcus aureus subsp. aureus Mu50
uucacuucauaaag

SEQ ID NO: 2037420 - RNA, 14 nt, Staphylococcus aureus subsp. aureus Mu50
uucauuuuugauaa

SEQ ID NO: 2037421 - RNA, 18 nt, Staphylococcus aureus subsp. aureus Mu50
uucauuucccuuaaauca

SEQ ID NO: 2037422 - RNA, 12 nt, Staphylococcus aureus subsp. aureus Mu50
uuccaauaucuu

SEQ ID NO: 2037423 - RNA, 11 nt, Staphylococcus aureus subsp. aureus Mu50
uuccaauaaua

SEQ ID NO: 2037424 - RNA, 20 nt, Staphylococcus aureus subsp. aureus Mu50
uucauuggauagguaacuaa

SEQ ID NO: 2037425 - RNA, 14 nt, Staphylococcus aureus subsp. aureus Mu50
uucauuguaacuca

SEQ ID NO: 2037426 - RNA, 18 nt, Staphylococcus aureus subsp. aureus Mu50
uucaugugcaagcuuuuu

SEQ ID NO: 2037427 - RNA, 19 nt, Staphylococcus aureus subsp. aureus Mu50
uucaugugcaagcuuuuua

SEQ ID NO: 2037428 - RNA, 14 nt, Staphylococcus aureus subsp. aureus Mu50
uucauuauaugguu

SEQ ID NO: 2037429 - RNA, 18 nt, Staphylococcus aureus subsp. aureus Mu50
uuccaucauuuguguaaa

SEQ ID NO: 2037430 - RNA, 16 nt, Staphylococcus aureus subsp. aureus Mu50
uuccgaacauguuucu

SEQ ID NO: 2037431 - RNA, 16 nt, Staphylococcus aureus subsp. aureus Mu50
uucgaauuuaacaucu

SEQ ID NO: 2037432 - RNA, 19 nt, Staphylococcus aureus subsp. aureus Mu50
uucgaauuuaacaucuuug

SEQ ID NO: 2037433 - RNA, 23 nt, Staphylococcus aureus subsp. aureus Mu50
uucgacacgcccgacaucauaaa

SEQ ID NO: 2037434 - RNA, 15 nt, Staphylococcus aureus subsp. aureus Mu50
uuccuuucuuuuucg

SEQ ID NO: 2037435 - RNA, 13 nt, Staphylococcus aureus subsp. aureus Mu50
uucgcuugauuaa

SEQ ID NO: 2037436 - RNA, 20 nt, Staphylococcus aureus subsp. aureus Mu50
uucgcuuaaaaacgcuuuua

SEQ ID NO: 2037437 - RNA, 21 nt, Staphylococcus aureus subsp. aureus Mu50
uucggauugagggauuuuuau

SEQ ID NO: 2037438 - RNA, 14 nt, Staphylococcus aureus subsp. aureus Mu50
aaucacgcuaacau

SEQ ID NO: 2037439 - RNA, 14 nt, Staphylococcus aureus subsp. aureus Mu50
aaucacugcuuuca

SEQ ID NO: 2037440 - RNA, 17 nt, Staphylococcus aureus subsp. aureus Mu50
uucuaccaguugauuua

SEQ ID NO: 2037441 - RNA, 18 nt, Staphylococcus aureus subsp. aureus Mu50
uucuagauucauauuuau

SEQ ID NO: 2037442 - RNA, 17 nt, Staphylococcus aureus subsp. aureus Mu50
aaucacgcuaacauuca

SEQ ID NO: 2037443 - RNA, 22 nt, Staphylococcus aureus subsp. aureus Mu50
uucuccaguuuucaauuuauua

SEQ ID NO: 2037444 - RNA, 15 nt, Staphylococcus aureus subsp. aureus Mu50
uucuaaaugauuuau

SEQ ID NO: 2037445 - RNA, 20 nt, Staphylococcus aureus subsp. aureus Mu50
uucguugcacuuuaauauca

SEQ ID NO: 2037446 - RNA, 23 nt, Staphylococcus aureus subsp. aureus Mu50
uucguuuugcuaaccaucauaaa

SEQ ID NO: 2037447 - RNA, 19 nt, Staphylococcus aureus subsp. aureus Mu50
uucuaaaacggaaauaacc

SEQ ID NO: 2037448 - RNA, 16 nt, Staphylococcus aureus subsp. aureus Mu50
uuaaaauguuaauaau

SEQ ID NO: 2037449 - RNA, 17 nt, Staphylococcus aureus subsp. aureus Mu50
uuaaaauuuuaauuaau

SEQ ID NO: 2037450 - RNA, 17 nt, Staphylococcus aureus subsp. aureus Mu50
uuaaacgcugauuuuau

SEQ ID NO: 2037451 - RNA, 14 nt, Staphylococcus aureus subsp. aureus Mu50
uuaaacguaucauu

SEQ ID NO: 2037452 - RNA, 14 nt, Staphylococcus aureus subsp. aureus Mu50
uuaaacaagcauca

SEQ ID NO: 2037453 - RNA, 17 nt, Staphylococcus aureus subsp. aureus Mu50
uuaaaguuguugaaauu

SEQ ID NO: 2037454 - RNA, 15 nt, Staphylococcus aureus subsp. aureus Mu50
uuaaaguuuaaauau

SEQ ID NO: 2037455 - RNA, 22 nt, Staphylococcus aureus subsp. aureus Mu50
uuaaaggauggauacuuaaaga

SEQ ID NO: 2037456 - RNA, 20 nt, Staphylococcus aureus subsp. aureus Mu50
uuaaagauggcugcaucaau

SEQ ID NO: 2037457 - RNA, 22 nt, Staphylococcus aureus subsp. aureus Mu50
uuaaagauuuacccauuacauu

SEQ ID NO: 2037458 - RNA, 17 nt, Staphylococcus aureus subsp. aureus Mu50
uuaaaccguuauauauu

SEQ ID NO: 2037459 - RNA, 19 nt, Staphylococcus aureus subsp. aureus Mu50
uuaaaugcuggguaauaaa

SEQ ID NO: 2037460 - RNA, 21 nt, Staphylococcus aureus subsp. aureus Mu50
uuaaauguacauuguaaauau

SEQ ID NO: 2037461 - RNA, 18 nt, Staphylococcus aureus subsp. aureus Mu50
uuaaaugugcaauuagaa

SEQ ID NO: 2037462 - RNA, 12 nt, Staphylococcus aureus subsp. aureus Mu50
uuaaauaauaau

SEQ ID NO: 2037463 - RNA, 23 nt, Staphylococcus aureus subsp. aureus Mu50
uuaaauaaugauaaauuaaagcu

SEQ ID NO: 2037464 - RNA, 19 nt, Staphylococcus aureus subsp. aureus Mu50
uuaaauacuugcucuaauu

SEQ ID NO: 2037465 - RNA, 13 nt, Staphylococcus aureus subsp. aureus Mu50
uuaaauaucauac

SEQ ID NO: 2037466 - RNA, 21 nt, Staphylococcus aureus subsp. aureus Mu50
uuaaauauucacgacuugaua

SEQ ID NO: 2037467 - RNA, 20 nt, Staphylococcus aureus subsp. aureus Mu50
uuaaaucaacaucaucuuua

SEQ ID NO: 2037468 - RNA, 20 nt, Staphylococcus aureus subsp. aureus Mu50
uuaaaucacuagcuaaugca

SEQ ID NO: 2037469 - RNA, 19 nt, Staphylococcus aureus subsp. aureus Mu50
uguugauuugauaagugau

SEQ ID NO: 2037470 - RNA, 14 nt, Staphylococcus aureus subsp. aureus Mu50
uguugcaauaaaau

SEQ ID NO: 2037471 - RNA, 18 nt, Staphylococcus aureus subsp. aureus Mu50
uguugacuacucaauccu

SEQ ID NO: 2037472 - RNA, 16 nt, Staphylococcus aureus subsp. aureus Mu50
uguugaauuucaaaau

SEQ ID NO: 2037473 - RNA, 16 nt, Staphylococcus aureus subsp. aureus Mu50
uguugaagucaauaau

SEQ ID NO: 2037474 - RNA, 15 nt, Staphylococcus aureus subsp. aureus Mu50
uguugaaaaugacua

SEQ ID NO: 2037475 - RNA, 15 nt, Staphylococcus aureus subsp. aureus Mu50
uguucuuuuuauuua

SEQ ID NO: 2037476 - RNA, 20 nt, Staphylococcus aureus subsp. aureus Mu50
uguugaaacgguaucaacau

SEQ ID NO: 2037477 - RNA, 19 nt, Staphylococcus aureus subsp. aureus Mu50
uguugaacuuuaguauauu

SEQ ID NO: 2037478 - RNA, 18 nt, Staphylococcus aureus subsp. aureus Mu50
uguucuaaccauucguaa

SEQ ID NO: 2037479 - RNA, 15 nt, Staphylococcus aureus subsp. aureus Mu50
uuaacauuauccauu

SEQ ID NO: 2037480 - RNA, 15 nt, Staphylococcus aureus subsp. aureus Mu50
uuaacagcuuuuucu

SEQ ID NO: 2037481 - RNA, 18 nt, Staphylococcus aureus subsp. aureus Mu50
uuaacaguuguaaucauu

SEQ ID NO: 2037482 - RNA, 13 nt, Staphylococcus aureus subsp. aureus Mu50
uuaacauaaaaau

SEQ ID NO: 2037483 - RNA, 18 nt, Staphylococcus aureus subsp. aureus Mu50
uuaacaaucaguaauaau

SEQ ID NO: 2037484 - RNA, 15 nt, Staphylococcus aureus subsp. aureus Mu50
uuaacaauugauugc

SEQ ID NO: 2037485 - RNA, 18 nt, Staphylococcus aureus subsp. aureus Mu50
uuaaauuggaaucccaau

SEQ ID NO: 2037486 - RNA, 19 nt, Staphylococcus aureus subsp. aureus Mu50
uuaauaauuuuuuuccuuu

SEQ ID NO: 2037487 - RNA, 17 nt, Staphylococcus aureus subsp. aureus Mu50
uuaauagcuuggauugu

SEQ ID NO: 2037488 - RNA, 13 nt, Staphylococcus aureus subsp. aureus Mu50
uuaauauaaauau

SEQ ID NO: 2037489 - RNA, 17 nt, Staphylococcus aureus subsp. aureus Mu50
uuaauauaaauaucaau

SEQ ID NO: 2037490 - RNA, 17 nt, Staphylococcus aureus subsp. aureus Mu50
uuaauacguuuaauaau

SEQ ID NO: 2037491 - RNA, 19 nt, Staphylococcus aureus subsp. aureus Mu50
uuaauacuauaguaagaaa

SEQ ID NO: 2037492 - RNA, 17 nt, Staphylococcus aureus subsp. aureus Mu50
uuaauaucagguacaaa

SEQ ID NO: 2037493 - RNA, 15 nt, Staphylococcus aureus subsp. aureus Mu50
uuacaugcaccuuua

SEQ ID NO: 2037494 - RNA, 17 nt, Staphylococcus aureus subsp. aureus Mu50
uuacagucaacugcugc

SEQ ID NO: 2037495 - RNA, 17 nt, Staphylococcus aureus subsp. aureus Mu50
uuacauauacgacauuu

SEQ ID NO: 2037496 - RNA, 14 nt, Staphylococcus aureus subsp. aureus Mu50
uuacauuacauaua

SEQ ID NO: 2037497 - RNA, 22 nt, Staphylococcus aureus subsp. aureus Mu50
uuaaucucuuuuugauuauauu

SEQ ID NO: 2037498 - RNA, 19 nt, Staphylococcus aureus subsp. aureus Mu50
uuaaucuucgucauaagga

SEQ ID NO: 2037499 - RNA, 23 nt, Staphylococcus aureus subsp. aureus Mu50
uuaaugaaauaccuaccacaaua

SEQ ID NO: 2037500 - RNA, 20 nt, Staphylococcus aureus subsp. aureus Mu50
uuacaccuuuggcaccagua

SEQ ID NO: 2037501 - RNA, 22 nt, Staphylococcus aureus subsp. aureus Mu50
uuaaugccggucauaacaccau

SEQ ID NO: 2037502 - RNA, 19 nt, Staphylococcus aureus subsp. aureus Mu50
uuacacuuuucuuaucagu

SEQ ID NO: 2037503 - RNA, 20 nt, Staphylococcus aureus subsp. aureus Mu50
uuacacuuuucuuaucaguu

SEQ ID NO: 2037504 - RNA, 20 nt, Staphylococcus aureus subsp. aureus Mu50
uuaucauauaugugagcaaa

SEQ ID NO: 2037505 - RNA, 16 nt, Staphylococcus aureus subsp. aureus Mu50
uuaucaucuucuggau

SEQ ID NO: 2037506 - RNA, 16 nt, Staphylococcus aureus subsp. aureus Mu50
uuaucauuauucgcau

SEQ ID NO: 2037507 - RNA, 20 nt, Staphylococcus aureus subsp. aureus Mu50
uuaucaaauaaccuauuaau

SEQ ID NO: 2037508 - RNA, 22 nt, Staphylococcus aureus subsp. aureus Mu50
uuauaaaauaaauauaaaacgg

SEQ ID NO: 2037509 - RNA, 16 nt, Staphylococcus aureus subsp. aureus Mu50
uuauaacuuuaaaaau

SEQ ID NO: 2037510 - RNA, 22 nt, Staphylococcus aureus subsp. aureus Mu50
uuauaaaacaguaaguaauaaa

SEQ ID NO: 2037511 - RNA, 17 nt, Staphylococcus aureus subsp. aureus Mu50
uuauaaauuauauuuau

SEQ ID NO: 2037512 - RNA, 11 nt, Staphylococcus aureus subsp. aureus Mu50
uuauaaauuug

SEQ ID NO: 2037513 - RNA, 15 nt, Staphylococcus aureus subsp. aureus Mu50
uuauaaauuuuggac

SEQ ID NO: 2037514 - RNA, 15 nt, Staphylococcus aureus subsp. aureus Mu50
uuaguuugacaucua

SEQ ID NO: 2037515 - RNA, 12 nt, Staphylococcus aureus subsp. aureus Mu50
uuaguuuauguc

SEQ ID NO: 2037516 - RNA, 19 nt, Staphylococcus aureus subsp. aureus Mu50
uuaguugcauaaucaauuu

SEQ ID NO: 2037517 - RNA, 13 nt, Staphylococcus aureus subsp. aureus Mu50
uuaggauuaacau

SEQ ID NO: 2037518 - RNA, 12 nt, Staphylococcus aureus subsp. aureus Mu50
uuagcuuuugua

SEQ ID NO: 2037519 - RNA, 22 nt, Staphylococcus aureus subsp. aureus Mu50
uuaggcggccaguccauuauug

SEQ ID NO: 2037520 - RNA, 22 nt, Staphylococcus aureus subsp. aureus Mu50
uuagggaaauguagauuacuuu

SEQ ID NO: 2037521 - RNA, 13 nt, Staphylococcus aureus subsp. aureus Mu50
uuaggggcuuuua

SEQ ID NO: 2037522 - RNA, 15 nt, Staphylococcus aureus subsp. aureus Mu50
uuagcuugcuuacaa

SEQ ID NO: 2037523 - RNA, 21 nt, Staphylococcus aureus subsp. aureus Mu50
uuagggugaacaguuagugcu

SEQ ID NO: 2037524 - RNA, 20 nt, Staphylococcus aureus subsp. aureus Mu50
uuaguagauuuauuaaauau

SEQ ID NO: 2037525 - RNA, 17 nt, Staphylococcus aureus subsp. aureus Mu50
uuaguaguguauucauu

SEQ ID NO: 2037526 - RNA, 18 nt, Staphylococcus aureus subsp. aureus Mu50
uuaguaauuuuuaaaucu

SEQ ID NO: 2037527 - RNA, 13 nt, Staphylococcus aureus subsp. aureus Mu50
uuagugauauuuu

SEQ ID NO: 2037528 - RNA, 15 nt, Staphylococcus aureus subsp. aureus Mu50
uuagugcaaguaauu

SEQ ID NO: 2037529 - RNA, 14 nt, Staphylococcus aureus subsp. aureus Mu50
uuaguauaaauaaa

SEQ ID NO: 2037530 - RNA, 17 nt, Staphylococcus aureus subsp. aureus Mu50
uuagcauaccuuuauua

SEQ ID NO: 2037531 - RNA, 18 nt, Staphylococcus aureus subsp. aureus Mu50
uuagcaaucucuuuagau

SEQ ID NO: 2037532 - RNA, 14 nt, Staphylococcus aureus subsp. aureus Mu50
uuagcaauuucauc

SEQ ID NO: 2037533 - RNA, 12 nt, Staphylococcus aureus subsp. aureus Mu50
uuagcauuauua

SEQ ID NO: 2037534 - RNA, 14 nt, Staphylococcus aureus subsp. aureus Mu50
uuagauaauaagga

SEQ ID NO: 2037535 - RNA, 18 nt, Staphylococcus aureus subsp. aureus Mu50
uuagagauuguaagaauu

SEQ ID NO: 2037536 - RNA, 18 nt, Staphylococcus aureus subsp. aureus Mu50
uuagacuaaaaaacuaac

SEQ ID NO: 2037537 - RNA, 22 nt, Staphylococcus aureus subsp. aureus Mu50
uuagacuaaaaaacuaacuuua

SEQ ID NO: 2037538 - RNA, 21 nt, Staphylococcus aureus subsp. aureus Mu50
uuagcaaaaauauuuaaacua

SEQ ID NO: 2037539 - RNA, 17 nt, Staphylococcus aureus subsp. aureus Mu50
uuagaugagauuucguu

SEQ ID NO: 2037540 - RNA, 22 nt, Staphylococcus aureus subsp. aureus Mu50
uuacuaacaaccguuuuaagua

SEQ ID NO: 2037541 - RNA, 23 nt, Staphylococcus aureus subsp. aureus Mu50
uuacuaaccuauuaaaaaaaacc

SEQ ID NO: 2037542 - RNA, 16 nt, Staphylococcus aureus subsp. aureus Mu50
uuacuaaguaaccaag

SEQ ID NO: 2037543 - RNA, 13 nt, Staphylococcus aureus subsp. aureus Mu50
uuacuauaaugau

SEQ ID NO: 2037544 - RNA, 19 nt, Staphylococcus aureus subsp. aureus Mu50
uuacuaucuucaucauauu

SEQ ID NO: 2037545 - RNA, 20 nt, Staphylococcus aureus subsp. aureus Mu50
uuacuauggcauuauugccu

SEQ ID NO: 2037546 - RNA, 15 nt, Staphylococcus aureus subsp. aureus Mu50
uuacuaaaaucacuu

SEQ ID NO: 2037547 - RNA, 20 nt, Staphylococcus aureus subsp. aureus Mu50
uuacuaaaugaauugcuugu

SEQ ID NO: 2037548 - RNA, 21 nt, Staphylococcus aureus subsp. aureus Mu50
uuacgccaacaagguuucaag

SEQ ID NO: 2037549 - RNA, 20 nt, Staphylococcus aureus subsp. aureus Mu50
uuacgcugucucauuaaugu

SEQ ID NO: 2037550 - RNA, 13 nt, Staphylococcus aureus subsp. aureus Mu50
uguucaaauguag

SEQ ID NO: 2037551 - RNA, 15 nt, Staphylococcus aureus subsp. aureus Mu50
uguucaaagacacgg

SEQ ID NO: 2037552 - RNA, 15 nt, Staphylococcus aureus subsp. aureus Mu50
uguuauguaaauaac

SEQ ID NO: 2037553 - RNA, 18 nt, Staphylococcus aureus subsp. aureus Mu50
uguuaugugauuaauuuc

SEQ ID NO: 2037554 - RNA, 18 nt, Staphylococcus aureus subsp. aureus Mu50
uguuauaaaaugaauaau

SEQ ID NO: 2037555 - RNA, 22 nt, Staphylococcus aureus subsp. aureus Mu50
uguuauaaaggaagacauacuc

SEQ ID NO: 2037556 - RNA, 13 nt, Staphylococcus aureus subsp. aureus Mu50
uguuagucuuuuu

SEQ ID NO: 2037557 - RNA, 21 nt, Staphylococcus aureus subsp. aureus Mu50
uguuauauaaauaugguuucu

SEQ ID NO: 2037558 - RNA, 21 nt, Staphylococcus aureus subsp. aureus Mu50
uguuauauucuagauucauau

SEQ ID NO: 2037559 - RNA, 14 nt, Staphylococcus aureus subsp. aureus Mu50
uguuauauuuuuag

SEQ ID NO: 2037560 - RNA, 19 nt, Staphylococcus aureus subsp. aureus Mu50
uguuauugcuuauuuuugu

SEQ ID NO: 2037561 - RNA, 17 nt, Staphylococcus aureus subsp. aureus Mu50
uguucgggaauuuuuua

SEQ ID NO: 2037562 - RNA, 16 nt, Staphylococcus aureus subsp. aureus Mu50
uguuaauuuaauaauu

SEQ ID NO: 2037563 - RNA, 16 nt, Staphylococcus aureus subsp. aureus Mu50
uguuacacaaauuaaa

SEQ ID NO: 2037564 - RNA, 21 nt, Staphylococcus aureus subsp. aureus Mu50
uguuacacaugaguuaaacga

SEQ ID NO: 2037565 - RNA, 15 nt, Staphylococcus aureus subsp. aureus Mu50
uguuacuuauauauu

SEQ ID NO: 2037566 - RNA, 16 nt, Staphylococcus aureus subsp. aureus Mu50
uguuacuuauauauuc

SEQ ID NO: 2037567 - RNA, 17 nt, Staphylococcus aureus subsp. aureus Mu50
uguuagauaaucucauu

SEQ ID NO: 2037568 - RNA, 14 nt, Staphylococcus aureus subsp. aureus Mu50
ugugguaaugauuu

SEQ ID NO: 2037569 - RNA, 22 nt, Staphylococcus aureus subsp. aureus Mu50
uguggguguaccaauugauuuu

SEQ ID NO: 2037570 - RNA, 14 nt, Staphylococcus aureus subsp. aureus Mu50
ugugggcuuuauua

SEQ ID NO: 2037571 - RNA, 15 nt, Staphylococcus aureus subsp. aureus Mu50
uguggcuuuuuauca

SEQ ID NO: 2037572 - RNA, 16 nt, Staphylococcus aureus subsp. aureus Mu50
ugugcuuuaucaacaa

SEQ ID NO: 2037573 - RNA, 17 nt, Staphylococcus aureus subsp. aureus Mu50
ugucaauuuuuucauga

SEQ ID NO: 2037574 - RNA, 21 nt, Staphylococcus aureus subsp. aureus Mu50
ugucacugcaaacacaguaca

SEQ ID NO: 2037575 - RNA, 23 nt, Staphylococcus aureus subsp. aureus Mu50
ugugcaucauuuauaugauguuc

SEQ ID NO: 2037576 - RNA, 15 nt, Staphylococcus aureus subsp. aureus Mu50
ugugauaacuuguaa

SEQ ID NO: 2037577 - RNA, 15 nt, Staphylococcus aureus subsp. aureus Mu50
ugugaugauuaaucg

SEQ ID NO: 2037578 - RNA, 18 nt, Staphylococcus aureus subsp. aureus Mu50
ugugcaauuagaauauau

SEQ ID NO: 2037579 - RNA, 19 nt, Staphylococcus aureus subsp. aureus Mu50
ugugcaauuagaauauaug

SEQ ID NO: 2037580 - RNA, 22 nt, Staphylococcus aureus subsp. aureus Mu50
ugugcaauuagaauauauguau

SEQ ID NO: 2037581 - RNA, 22 nt, Staphylococcus aureus subsp. aureus Mu50
ugugaauguuuucuaaaucuaa

SEQ ID NO: 2037582 - RNA, 21 nt, Staphylococcus aureus subsp. aureus Mu50
ugugagauacguuauuucaau

SEQ ID NO: 2037583 - RNA, 20 nt, Staphylococcus aureus subsp. aureus Mu50
ugucuagauuuuaaaucaau

SEQ ID NO: 2037584 - RNA, 14 nt, Staphylococcus aureus subsp. aureus Mu50
ugucuguacuuuua

SEQ ID NO: 2037585 - RNA, 16 nt, Staphylococcus aureus subsp. aureus Mu50
ugugaaaguuuuuguc

SEQ ID NO: 2037586 - RNA, 23 nt, Staphylococcus aureus subsp. aureus Mu50
ugugaaauuagaaaaauaugauu

SEQ ID NO: 2037587 - RNA, 22 nt, Staphylococcus aureus subsp. aureus Mu50
aauauacaauaguauaaauauc

SEQ ID NO: 2037588 - RNA, 14 nt, Staphylococcus aureus subsp. aureus Mu50
aauauaccaaccaa

SEQ ID NO: 2037589 - RNA, 15 nt, Staphylococcus aureus subsp. aureus Mu50
aauauaccaaccaaa

SEQ ID NO: 2037590 - RNA, 22 nt, Staphylococcus aureus subsp. aureus Mu50
aauauacuugaagcaucgauuu

SEQ ID NO: 2037591 - RNA, 20 nt, Staphylococcus aureus subsp. aureus Mu50
aauauagaagugcgguuuaa

SEQ ID NO: 2037592 - RNA, 16 nt, Staphylococcus aureus subsp. aureus Mu50
aauauagaagauauaa

SEQ ID NO: 2037593 - RNA, 23 nt, Staphylococcus aureus subsp. aureus Mu50
aauauauuagugauauuuuucga

SEQ ID NO: 2037594 - RNA, 17 nt, Staphylococcus aureus subsp. aureus Mu50
aauauauuuauuuuuga

SEQ ID NO: 2037595 - RNA, 12 nt, Staphylococcus aureus subsp. aureus Mu50
aauaucaaaaua

SEQ ID NO: 2037596 - RNA, 21 nt, Staphylococcus aureus subsp. aureus Mu50
aauauaucuagccugaaauag

SEQ ID NO: 2037597 - RNA, 13 nt, Staphylococcus aureus subsp. aureus Mu50
aauauauguauaa

SEQ ID NO: 2037598 - RNA, 20 nt, Staphylococcus aureus subsp. aureus Mu50
ugcucccuucaaaguagaca

SEQ ID NO: 2037599 - RNA, 22 nt, Staphylococcus aureus subsp. aureus Mu50
ugcucccuucaaaguagacauu

SEQ ID NO: 2037600 - RNA, 15 nt, Staphylococcus aureus subsp. aureus Mu50
uggaaagacguuuuu

SEQ ID NO: 2037601 - RNA, 19 nt, Staphylococcus aureus subsp. aureus Mu50
ugcuuuuuuuauaaguauu

SEQ ID NO: 2037602 - RNA, 17 nt, Staphylococcus aureus subsp. aureus Mu50
ugcuuuuccauaaauau

SEQ ID NO: 2037603 - RNA, 20 nt, Staphylococcus aureus subsp. aureus Mu50
ugcuuuguuaggaucaagga

SEQ ID NO: 2037604 - RNA, 20 nt, Staphylococcus aureus subsp. aureus Mu50
ugcuuuguuuaucaauuucu

SEQ ID NO: 2037605 - RNA, 17 nt, Staphylococcus aureus subsp. aureus Mu50
ugcuucucacaacugca

SEQ ID NO: 2037606 - RNA, 20 nt, Staphylococcus aureus subsp. aureus Mu50
ugcuucuguaaacgauacug

SEQ ID NO: 2037607 - RNA, 19 nt, Staphylococcus aureus subsp. aureus Mu50
ugcuuuauuuuaucaucua

SEQ ID NO: 2037608 - RNA, 20 nt, Staphylococcus aureus subsp. aureus Mu50
ugcuuuauuuucuuguguau

SEQ ID NO: 2037609 - RNA, 12 nt, Staphylococcus aureus subsp. aureus Mu50
ugcuuuccaaau

SEQ ID NO: 2037610 - RNA, 20 nt, Staphylococcus aureus subsp. aureus Mu50
ugcuuuagucgguguuuucu

SEQ ID NO: 2037611 - RNA, 14 nt, Staphylococcus aureus subsp. aureus Mu50
ugcuuuaauauaau

SEQ ID NO: 2037612 - RNA, 18 nt, Staphylococcus aureus subsp. aureus Mu50
ugcuugguuugauuuuag

SEQ ID NO: 2037613 - RNA, 18 nt, Staphylococcus aureus subsp. aureus Mu50
ugcuuguccucuaaaaca

SEQ ID NO: 2037614 - RNA, 19 nt, Staphylococcus aureus subsp. aureus Mu50
ugcuuggacauauacucua

SEQ ID NO: 2037615 - RNA, 16 nt, Staphylococcus aureus subsp. aureus Mu50
ugcuuggauaauugca

SEQ ID NO: 2037616 - RNA, 17 nt, Staphylococcus aureus subsp. aureus Mu50
ugcuucgcacaacugca

SEQ ID NO: 2037617 - RNA, 17 nt, Staphylococcus aureus subsp. aureus Mu50
ugcuucgcaucacugca

SEQ ID NO: 2037618 - RNA, 22 nt, Staphylococcus aureus subsp. aureus Mu50
ugcuuaauuuguuuuaaauacu

SEQ ID NO: 2037619 - RNA, 18 nt, Staphylococcus aureus subsp. aureus Mu50
ugcuuaaaccuuaauaau

SEQ ID NO: 2037620 - RNA, 14 nt, Staphylococcus aureus subsp. aureus Mu50
ugcuguuacuucuc

SEQ ID NO: 2037621 - RNA, 13 nt, Staphylococcus aureus subsp. aureus Mu50
ugcuguucuuuuu

SEQ ID NO: 2037622 - RNA, 16 nt, Staphylococcus aureus subsp. aureus Mu50
ugcuguugcaauaaaa

SEQ ID NO: 2037623 - RNA, 16 nt, Staphylococcus aureus subsp. aureus Mu50
aauauaaaaacaaaag

SEQ ID NO: 2037624 - RNA, 14 nt, Staphylococcus aureus subsp. aureus Mu50
aauauaaauaugaa

SEQ ID NO: 2037625 - RNA, 14 nt, Staphylococcus aureus subsp. aureus Mu50
aauauaacaucaaa

SEQ ID NO: 2037626 - RNA, 17 nt, Staphylococcus aureus subsp. aureus Mu50
aauauaacaucaaauag

SEQ ID NO: 2037627 - RNA, 18 nt, Staphylococcus aureus subsp. aureus Mu50
aauauaaccgugaugaug

SEQ ID NO: 2037628 - RNA, 19 nt, Staphylococcus aureus subsp. aureus Mu50
aauauaacugcauguacau

SEQ ID NO: 2037629 - RNA, 15 nt, Staphylococcus aureus subsp. aureus Mu50
aauauaauaccuaca

SEQ ID NO: 2037630 - RNA, 19 nt, Staphylococcus aureus subsp. aureus Mu50
aauauaauuugguuaauac

SEQ ID NO: 2037631 - RNA, 12 nt, Staphylococcus aureus subsp. aureus Mu50
aauauacaauag

SEQ ID NO: 2037632 - RNA, 18 nt, Staphylococcus aureus subsp. aureus Mu50
ugccuuaacuucauaaua

SEQ ID NO: 2037633 - RNA, 22 nt, Staphylococcus aureus subsp. aureus Mu50
ugccuuaacuucauaauauauc

SEQ ID NO: 2037634 - RNA, 13 nt, Staphylococcus aureus subsp. aureus Mu50
aauaggauaugcu

SEQ ID NO: 2037635 - RNA, 13 nt, Staphylococcus aureus subsp. aureus Mu50
aauaggauuauua

SEQ ID NO: 2037636 - RNA, 19 nt, Staphylococcus aureus subsp. aureus Mu50
ugcgaagauuuuuaacauu

SEQ ID NO: 2037637 - RNA, 14 nt, Staphylococcus aureus subsp. aureus Mu50
ugcgaauaauaaua

SEQ ID NO: 2037638 - RNA, 15 nt, Staphylococcus aureus subsp. aureus Mu50
ugcgaauaauaauac

SEQ ID NO: 2037639 - RNA, 15 nt, Staphylococcus aureus subsp. aureus Mu50
ugcgaaaauaucauu

SEQ ID NO: 2037640 - RNA, 13 nt, Staphylococcus aureus subsp. aureus Mu50
aauagcaauugaa

SEQ ID NO: 2037641 - RNA, 15 nt, Staphylococcus aureus subsp. aureus Mu50
aauagcgauuuuaaa

SEQ ID NO: 2037642 - RNA, 14 nt, Staphylococcus aureus subsp. aureus Mu50
ugggguuuuauuuu

SEQ ID NO: 2037643 - RNA, 15 nt, Staphylococcus aureus subsp. aureus Mu50
ugggcugacauuuuu

SEQ ID NO: 2037644 - RNA, 18 nt, Staphylococcus aureus subsp. aureus Mu50
aauauucuuucguuuuca

SEQ ID NO: 2037645 - RNA, 19 nt, Staphylococcus aureus subsp. aureus Mu50
aauaucuucuuuuaauauu

SEQ ID NO: 2037646 - RNA, 24 nt, Staphylococcus aureus subsp. aureus Mu50
aauaucuaauucuguuucaaagcu

SEQ ID NO: 2037647 - RNA, 21 nt, Staphylococcus aureus subsp. aureus Mu50
aauaucgauuuuggcacauaa

SEQ ID NO: 2037648 - RNA, 17 nt, Staphylococcus aureus subsp. aureus Mu50
aauaugauugcaaauua

SEQ ID NO: 2037649 - RNA, 21 nt, Staphylococcus aureus subsp. aureus Mu50
aauaugauugcaaauuaucau

SEQ ID NO: 2037650 - RNA, 21 nt, Staphylococcus aureus subsp. aureus Mu50
aauaugacgcgugaauuaaaa

SEQ ID NO: 2037651 - RNA, 18 nt, Staphylococcus aureus subsp. aureus Mu50
aauaugagacaauacgau

SEQ ID NO: 2037652 - RNA, 18 nt, Staphylococcus aureus subsp. aureus Mu50
aauaucuuacuacuuaau

SEQ ID NO: 2037653 - RNA, 21 nt, Staphylococcus aureus subsp. aureus Mu50
aauaucuuuugcguccucaug

SEQ ID NO: 2037654 - RNA, 17 nt, Staphylococcus aureus subsp. aureus Mu50
aauaucuuuuucuaagu

SEQ ID NO: 2037655 - RNA, 19 nt, Staphylococcus aureus subsp. aureus Mu50
aauaugaaggcuuuuuguu

SEQ ID NO: 2037656 - RNA, 19 nt, Staphylococcus aureus subsp. aureus Mu50
aauaugaauaaugcaauug

SEQ ID NO: 2037657 - RNA, 17 nt, Staphylococcus aureus subsp. aureus Mu50
aauaugaauugcuuguu

SEQ ID NO: 2037658 - RNA, 20 nt, Staphylococcus aureus subsp. aureus Mu50
aauaugaauugcuuguuuua

SEQ ID NO: 2037659 - RNA, 17 nt, Staphylococcus aureus subsp. aureus Mu50
aauaugaauuuguuuua

SEQ ID NO: 2037660 - RNA, 21 nt, Staphylococcus aureus subsp. aureus Mu50
aauaugaccuuuaugugcauc

SEQ ID NO: 2037661 - RNA, 21 nt, Staphylococcus aureus subsp. aureus Mu50
ugggccccaacacagagaauu

SEQ ID NO: 2037662 - RNA, 19 nt, Staphylococcus aureus subsp. aureus Mu50
aauauucuuaucauucauu

SEQ ID NO: 2037663 - RNA, 22 nt, Staphylococcus aureus subsp. aureus Mu50
aauauuuaaccuuuaaaacguu

SEQ ID NO: 2037664 - RNA, 15 nt, Staphylococcus aureus subsp. aureus Mu50
aauauuuaacuuuuu

SEQ ID NO: 2037665 - RNA, 21 nt, Staphylococcus aureus subsp. aureus Mu50
aauauuuagauuggucaaacu

SEQ ID NO: 2037666 - RNA, 15 nt, Staphylococcus aureus subsp. aureus Mu50
aauauuguauugauc

SEQ ID NO: 2037667 - RNA, 17 nt, Staphylococcus aureus subsp. aureus Mu50
aauauuauaaccaccag

SEQ ID NO: 2037668 - RNA, 15 nt, Staphylococcus aureus subsp. aureus Mu50
aauauuauucuuuau

SEQ ID NO: 2037669 - RNA, 23 nt, Staphylococcus aureus subsp. aureus Mu50
aauauuauucuuuauauuuguga

SEQ ID NO: 2037670 - RNA, 18 nt, Staphylococcus aureus subsp. aureus Mu50
aauauuauuuugcaauug

SEQ ID NO: 2037671 - RNA, 19 nt, Staphylococcus aureus subsp. aureus Mu50
aauauuauuuuuaagugau

SEQ ID NO: 2037672 - RNA, 17 nt, Staphylococcus aureus subsp. aureus Mu50
aauauucacgacuugau

SEQ ID NO: 2037673 - RNA, 17 nt, Staphylococcus aureus subsp. aureus Mu50
aauauucagauuuucga

SEQ ID NO: 2037674 - RNA, 20 nt, Staphylococcus aureus subsp. aureus Mu50
aauauucguaaauccuuuau

SEQ ID NO: 2037675 - RNA, 13 nt, Staphylococcus aureus subsp. aureus Mu50
aauauucuuauca

SEQ ID NO: 2037676 - RNA, 17 nt, Staphylococcus aureus subsp. aureus Mu50
aauauuaaauucaucuu

SEQ ID NO: 2037677 - RNA, 16 nt, Staphylococcus aureus subsp. aureus Mu50
aauaugguuucuuauu

SEQ ID NO: 2037678 - RNA, 21 nt, Staphylococcus aureus subsp. aureus Mu50
aauaugucuagacuuauuuga

SEQ ID NO: 2037679 - RNA, 15 nt, Staphylococcus aureus subsp. aureus Mu50
aauauguguuaacug

SEQ ID NO: 2037680 - RNA, 23 nt, Staphylococcus aureus subsp. aureus Mu50
aauauggaauuucauauaaugaa

SEQ ID NO: 2037681 - RNA, 15 nt, Staphylococcus aureus subsp. aureus Mu50
uguaguaguuccguu

SEQ ID NO: 2037682 - RNA, 17 nt, Staphylococcus aureus subsp. aureus Mu50
aaucacgauuuucaagu

SEQ ID NO: 2037683 - RNA, 19 nt, Staphylococcus aureus subsp. aureus Mu50
aaucacgauuuucaaguaa

SEQ ID NO: 2037684 - RNA, 14 nt, Staphylococcus aureus subsp. aureus Mu50
uguacuuaaaaaua

SEQ ID NO: 2037685 - RNA, 19 nt, Staphylococcus aureus subsp. aureus Mu50
uguagauuacuuugcuaaa

SEQ ID NO: 2037686 - RNA, 18 nt, Staphylococcus aureus subsp. aureus Mu50
uguagccaaauaaauuuu

SEQ ID NO: 2037687 - RNA, 20 nt, Staphylococcus aureus subsp. aureus Mu50
uguaagucgcucuagacauu

SEQ ID NO: 2037688 - RNA, 21 nt, Staphylococcus aureus subsp. aureus Mu50
uguaauaccuuuacuuucauu

SEQ ID NO: 2037689 - RNA, 17 nt, Staphylococcus aureus subsp. aureus Mu50
uguaauuuucacuuuca

SEQ ID NO: 2037690 - RNA, 16 nt, Staphylococcus aureus subsp. aureus Mu50
uguaauuaauccaucu

SEQ ID NO: 2037691 - RNA, 18 nt, Staphylococcus aureus subsp. aureus Mu50
uguacaauuuuuaaaaac

SEQ ID NO: 2037692 - RNA, 16 nt, Staphylococcus aureus subsp. aureus Mu50
uguaaugcuuaaaaac

SEQ ID NO: 2037693 - RNA, 18 nt, Staphylococcus aureus subsp. aureus Mu50
uguaaugcuuaaaaacaa

SEQ ID NO: 2037694 - RNA, 20 nt, Staphylococcus aureus subsp. aureus Mu50
uguaaugcuuaaaaacaaua

SEQ ID NO: 2037695 - RNA, 17 nt, Staphylococcus aureus subsp. aureus Mu50
uguaccaguaacaauaa

SEQ ID NO: 2037696 - RNA, 13 nt, Staphylococcus aureus subsp. aureus Mu50
ugguugcuucuua

SEQ ID NO: 2037697 - RNA, 21 nt, Staphylococcus aureus subsp. aureus Mu50
ugguuuaucagcuuuaauaau

SEQ ID NO: 2037698 - RNA, 13 nt, Staphylococcus aureus subsp. aureus Mu50
ugguuuaacuuua

SEQ ID NO: 2037699 - RNA, 17 nt, Staphylococcus aureus subsp. aureus Mu50
ugguuuaacuuuaucua

SEQ ID NO: 2037700 - RNA, 22 nt, Staphylococcus aureus subsp. aureus Mu50
ugguugugauuuguuacuucua

SEQ ID NO: 2037701 - RNA, 12 nt, Staphylococcus aureus subsp. aureus Mu50
uggucaccaaau

SEQ ID NO: 2037702 - RNA, 13 nt, Staphylococcus aureus subsp. aureus Mu50
ugguauugguaaa

SEQ ID NO: 2037703 - RNA, 23 nt, Staphylococcus aureus subsp. aureus Mu50
ugguauuuuaugacguaauuaau

SEQ ID NO: 2037704 - RNA, 21 nt, Staphylococcus aureus subsp. aureus Mu50
uggucauuacuaaaacaaauu

SEQ ID NO: 2037705 - RNA, 15 nt, Staphylococcus aureus subsp. aureus Mu50
uggucugugauauuc

SEQ ID NO: 2037706 - RNA, 20 nt, Staphylococcus aureus subsp. aureus Mu50
uggucuuuuaauuaaaagug

SEQ ID NO: 2037707 - RNA, 13 nt, Staphylococcus aureus subsp. aureus Mu50
uggugcaauaaua

SEQ ID NO: 2037708 - RNA, 21 nt, Staphylococcus aureus subsp. aureus Mu50
aauauuucuaaaccauuuuca

SEQ ID NO: 2037709 - RNA, 19 nt, Staphylococcus aureus subsp. aureus Mu50
aauauuuuuacauauuuau

SEQ ID NO: 2037710 - RNA, 11 nt, Staphylococcus aureus subsp. aureus Mu50
aauauuucugg

SEQ ID NO: 2037711 - RNA, 19 nt, Staphylococcus aureus subsp. aureus Mu50
aauauuugaacgagcaccu

SEQ ID NO: 2037712 - RNA, 16 nt, Staphylococcus aureus subsp. aureus Mu50
aauauuugauaaguag

SEQ ID NO: 2037713 - RNA, 23 nt, Staphylococcus aureus subsp. aureus Mu50
aaaucuuuugagacguuuuccau

SEQ ID NO: 2037714 - RNA, 18 nt, Staphylococcus aureus subsp. aureus Mu50
aaaugaagaauacaaaua

SEQ ID NO: 2037715 - RNA, 17 nt, Staphylococcus aureus subsp. aureus Mu50
aaaugaauaaucaaagu

SEQ ID NO: 2037716 - RNA, 14 nt, Staphylococcus aureus subsp. aureus Mu50
aaaugaauauaaua

SEQ ID NO: 2037717 - RNA, 22 nt, Staphylococcus aureus subsp. aureus Mu50
aaaugccuucuguacguuuuaa

SEQ ID NO: 2037718 - RNA, 21 nt, Staphylococcus aureus subsp. aureus Mu50
aaaucuuaugaugucauguau

SEQ ID NO: 2037719 - RNA, 21 nt, Staphylococcus aureus subsp. aureus Mu50
aaaucugcuuuauuuuaucau

SEQ ID NO: 2037720 - RNA, 14 nt, Staphylococcus aureus subsp. aureus Mu50
aaaucuuuaaaugu

SEQ ID NO: 2037721 - RNA, 16 nt, Staphylococcus aureus subsp. aureus Mu50
aaaucuuuaaauguau

SEQ ID NO: 2037722 - RNA, 18 nt, Staphylococcus aureus subsp. aureus Mu50
aaaucuuuacuuguaauu

SEQ ID NO: 2037723 - RNA, 12 nt, Staphylococcus aureus subsp. aureus Mu50
aaauguauaaau

SEQ ID NO: 2037724 - RNA, 21 nt, Staphylococcus aureus subsp. aureus Mu50
aaaugcuauauuuagaaugau

SEQ ID NO: 2037725 - RNA, 16 nt, Staphylococcus aureus subsp. aureus Mu50
aaaugcucccuucaaa

SEQ ID NO: 2037726 - RNA, 20 nt, Staphylococcus aureus subsp. aureus Mu50
aaauggcuccauuuaauuug

SEQ ID NO: 2037727 - RNA, 13 nt, Staphylococcus aureus subsp. aureus Mu50
aaaugcuguuuua

SEQ ID NO: 2037728 - RNA, 17 nt, Staphylococcus aureus subsp. aureus Mu50
aaauggacuaacgucau

SEQ ID NO: 2037729 - RNA, 14 nt, Staphylococcus aureus subsp. aureus Mu50
aaaucuauugugau

SEQ ID NO: 2037730 - RNA, 13 nt, Staphylococcus aureus subsp. aureus Mu50
aaaucucaaaauu

SEQ ID NO: 2037731 - RNA, 21 nt, Staphylococcus aureus subsp. aureus Mu50
aaaucucgucacauauaaaua

SEQ ID NO: 2037732 - RNA, 16 nt, Staphylococcus aureus subsp. aureus Mu50
aaaucuacaauauuaa

SEQ ID NO: 2037733 - RNA, 16 nt, Staphylococcus aureus subsp. aureus Mu50
aaaucuacuacuaauc

SEQ ID NO: 2037734 - RNA, 17 nt, Staphylococcus aureus subsp. aureus Mu50
aaaucuauaaauaucaa

SEQ ID NO: 2037735 - RNA, 10 nt, Staphylococcus aureus subsp. aureus Mu50
aaaucuauau

SEQ ID NO: 2037736 - RNA, 16 nt, Staphylococcus aureus subsp. aureus Mu50
aaaucuauauaaaguu

SEQ ID NO: 2037737 - RNA, 24 nt, Staphylococcus aureus subsp. aureus Mu50
aaaucuaauccugguauaauggac

SEQ ID NO: 2037738 - RNA, 19 nt, Staphylococcus aureus subsp. aureus Mu50
aaaucgugcccauaugauu

SEQ ID NO: 2037739 - RNA, 16 nt, Staphylococcus aureus subsp. aureus Mu50
aaaucgugcuguuauc

SEQ ID NO: 2037740 - RNA, 19 nt, Staphylococcus aureus subsp. aureus Mu50
aaaucuaacuggaaaugau

SEQ ID NO: 2037741 - RNA, 14 nt, Staphylococcus aureus subsp. aureus Mu50
aaaucaauguacua

SEQ ID NO: 2037742 - RNA, 19 nt, Staphylococcus aureus subsp. aureus Mu50
aaaucacauaugauaauua

SEQ ID NO: 2037743 - RNA, 14 nt, Staphylococcus aureus subsp. aureus Mu50
aaaucacgccauaa

SEQ ID NO: 2037744 - RNA, 23 nt, Staphylococcus aureus subsp. aureus Mu50
aaaucacgcuaacauucagugca

SEQ ID NO: 2037745 - RNA, 22 nt, Staphylococcus aureus subsp. aureus Mu50
aaaucaacccaucauguacagu

SEQ ID NO: 2037746 - RNA, 22 nt, Staphylococcus aureus subsp. aureus Mu50
aaaucaaauauacuuuuaccau

SEQ ID NO: 2037747 - RNA, 18 nt, Staphylococcus aureus subsp. aureus Mu50
aaaucaaacuuuucagca

SEQ ID NO: 2037748 - RNA, 17 nt, Staphylococcus aureus subsp. aureus Mu50
aaauauuuuuaauuauu

SEQ ID NO: 2037749 - RNA, 22 nt, Staphylococcus aureus subsp. aureus Mu50
aaauuauaaauuugguacauaa

SEQ ID NO: 2037750 - RNA, 12 nt, Staphylococcus aureus subsp. aureus Mu50
aaauuauacaaa

SEQ ID NO: 2037751 - RNA, 14 nt, Staphylococcus aureus subsp. aureus Mu50
aaauuauacaaauu

SEQ ID NO: 2037752 - RNA, 20 nt, Staphylococcus aureus subsp. aureus Mu50
aaauuauacaaauuauaaau

SEQ ID NO: 2037753 - RNA, 21 nt, Staphylococcus aureus subsp. aureus Mu50
aaauuaugauuauauuuucuc

SEQ ID NO: 2037754 - RNA, 13 nt, Staphylococcus aureus subsp. aureus Mu50
aaauuauauaaau

SEQ ID NO: 2037755 - RNA, 21 nt, Staphylococcus aureus subsp. aureus Mu50
aaauuauauacccaccacauu

SEQ ID NO: 2037756 - RNA, 14 nt, Staphylococcus aureus subsp. aureus Mu50
aaauucaauauuaa

SEQ ID NO: 2037757 - RNA, 20 nt, Staphylococcus aureus subsp. aureus Mu50
aaauuaucauuaaauugcuu

SEQ ID NO: 2037758 - RNA, 22 nt, Staphylococcus aureus subsp. aureus Mu50
aaauuauuguuuuaauguacuu

SEQ ID NO: 2037759 - RNA, 16 nt, Staphylococcus aureus subsp. aureus Mu50
aaauuauuugauauuu

SEQ ID NO: 2037760 - RNA, 24 nt, Staphylococcus aureus subsp. aureus Mu50
aaauucaucuuaucaagaauauaa

SEQ ID NO: 2037761 - RNA, 18 nt, Staphylococcus aureus subsp. aureus Mu50
aaauuccaagagaauuaa

SEQ ID NO: 2037762 - RNA, 14 nt, Staphylococcus aureus subsp. aureus Mu50
aaauucaguaucua

SEQ ID NO: 2037763 - RNA, 17 nt, Staphylococcus aureus subsp. aureus Mu50
aaauucucuaauuucuc

SEQ ID NO: 2037764 - RNA, 16 nt, Staphylococcus aureus subsp. aureus Mu50
aaauucucuuuuaaau

SEQ ID NO: 2037765 - RNA, 14 nt, Staphylococcus aureus subsp. aureus Mu50
aaauucuacaaaca

SEQ ID NO: 2037766 - RNA, 16 nt, Staphylococcus aureus subsp. aureus Mu50
aaauucuaucuauaaa

SEQ ID NO: 2037767 - RNA, 23 nt, Staphylococcus aureus subsp. aureus Mu50
aaauuccaugucaauuuuuucau

SEQ ID NO: 2037768 - RNA, 17 nt, Staphylococcus aureus subsp. aureus Mu50
aaauucgaacuaucaau

SEQ ID NO: 2037769 - RNA, 19 nt, Staphylococcus aureus subsp. aureus Mu50
aaauucgcuugauuaauuu

SEQ ID NO: 2037770 - RNA, 23 nt, Staphylococcus aureus subsp. aureus Mu50
aaauucuacaggcaaugcaaguu

SEQ ID NO: 2037771 - RNA, 23 nt, Staphylococcus aureus subsp. aureus Mu50
aaauucuacagguaaugcaaguu

SEQ ID NO: 2037772 - RNA, 13 nt, Staphylococcus aureus subsp. aureus Mu50
aaauuguauagaa

SEQ ID NO: 2037773 - RNA, 22 nt, Staphylococcus aureus subsp. aureus Mu50
aaauuguaugaauaauaugguu

SEQ ID NO: 2037774 - RNA, 21 nt, Staphylococcus aureus subsp. aureus Mu50
aaauuguauuucuuaacaucc

SEQ ID NO: 2037775 - RNA, 17 nt, Staphylococcus aureus subsp. aureus Mu50
aaauugcgaauuguuag

SEQ ID NO: 2037776 - RNA, 23 nt, Staphylococcus aureus subsp. aureus Mu50
aaauugauucuuuggugaaguau

SEQ ID NO: 2037777 - RNA, 15 nt, Staphylococcus aureus subsp. aureus Mu50
aaauugcaaugcuau

SEQ ID NO: 2037778 - RNA, 15 nt, Staphylococcus aureus subsp. aureus Mu50
aaaagauuagaugau

SEQ ID NO: 2037779 - RNA, 19 nt, Staphylococcus aureus subsp. aureus Mu50
aaaagccaucuuaccuuua

SEQ ID NO: 2037780 - RNA, 17 nt, Staphylococcus aureus subsp. aureus Mu50
aaauuuuucacuucaaa

SEQ ID NO: 2037781 - RNA, 19 nt, Staphylococcus aureus subsp. aureus Mu50
aaaagaggcgccacaacau

SEQ ID NO: 2037782 - RNA, 18 nt, Staphylococcus aureus subsp. aureus Mu50
aacagggguuuuuauaug

SEQ ID NO: 2037783 - RNA, 16 nt, Staphylococcus aureus subsp. aureus Mu50
aacaguaaucaugcau

SEQ ID NO: 2037784 - RNA, 14 nt, Staphylococcus aureus subsp. aureus Mu50
aacaguccuuauua

SEQ ID NO: 2037785 - RNA, 14 nt, Staphylococcus aureus subsp. aureus Mu50
aacaacuacuuaaa

SEQ ID NO: 2037786 - RNA, 16 nt, Staphylococcus aureus subsp. aureus Mu50
aacaacuuuauuauac

SEQ ID NO: 2037787 - RNA, 20 nt, Staphylococcus aureus subsp. aureus Mu50
aacaagccuuaaaauauuua

SEQ ID NO: 2037788 - RNA, 22 nt, Staphylococcus aureus subsp. aureus Mu50
aacaagcauuuuucaauuauag

SEQ ID NO: 2037789 - RNA, 22 nt, Staphylococcus aureus subsp. aureus Mu50
aacaagcuuuuuucaauucuag

SEQ ID NO: 2037790 - RNA, 17 nt, Staphylococcus aureus subsp. aureus Mu50
aacaauaauuuaauauu

SEQ ID NO: 2037791 - RNA, 22 nt, Staphylococcus aureus subsp. aureus Mu50
aacaauacguuuucggauugaa

SEQ ID NO: 2037792 - RNA, 19 nt, Staphylococcus aureus subsp. aureus Mu50
aacaaucacgauuaauguc

SEQ ID NO: 2037793 - RNA, 15 nt, Staphylococcus aureus subsp. aureus Mu50
aacaaucaguaauaa

SEQ ID NO: 2037794 - RNA, 16 nt, Staphylococcus aureus subsp. aureus Mu50
aacaauauaauauaca

SEQ ID NO: 2037795 - RNA, 12 nt, Staphylococcus aureus subsp. aureus Mu50
aacaaguacaau

SEQ ID NO: 2037796 - RNA, 15 nt, Staphylococcus aureus subsp. aureus Mu50
aacagcacauuuuua

SEQ ID NO: 2037797 - RNA, 19 nt, Staphylococcus aureus subsp. aureus Mu50
aacaaugcagcuguauuua

SEQ ID NO: 2037798 - RNA, 18 nt, Staphylococcus aureus subsp. aureus Mu50
aaauaucaguaauaauac

SEQ ID NO: 2037799 - RNA, 19 nt, Staphylococcus aureus subsp. aureus Mu50
aaauaucauaccguacaaa

SEQ ID NO: 2037800 - RNA, 13 nt, Staphylococcus aureus subsp. aureus Mu50
aaauaugauugaa

SEQ ID NO: 2037801 - RNA, 13 nt, Staphylococcus aureus subsp. aureus Mu50
aaauauuuaaacu

SEQ ID NO: 2037802 - RNA, 20 nt, Staphylococcus aureus subsp. aureus Mu50
aaauauuuaaacuaguaaua

SEQ ID NO: 2037803 - RNA, 12 nt, Staphylococcus aureus subsp. aureus Mu50
aaauauuuacau

SEQ ID NO: 2037804 - RNA, 23 nt, Staphylococcus aureus subsp. aureus Mu50
aaauauuuagauuggucaaacuu

SEQ ID NO: 2037805 - RNA, 13 nt, Staphylococcus aureus subsp. aureus Mu50
aaauauuuaucuu

SEQ ID NO: 2037806 - RNA, 22 nt, Staphylococcus aureus subsp. aureus Mu50
aaauauucuuuaauauagauuu

SEQ ID NO: 2037807 - RNA, 15 nt, Staphylococcus aureus subsp. aureus Mu50
aaauauugaacaauu

SEQ ID NO: 2037808 - RNA, 16 nt, Staphylococcus aureus subsp. aureus Mu50
aaauauugauauaaaa

SEQ ID NO: 2037809 - RNA, 20 nt, Staphylococcus aureus subsp. aureus Mu50
aaauaguucuuuaaauuaua

SEQ ID NO: 2037810 - RNA, 20 nt, Staphylococcus aureus subsp. aureus Mu50
aaauaguuuuucauauucac

SEQ ID NO: 2037811 - RNA, 15 nt, Staphylococcus aureus subsp. aureus Mu50
aaauauaguuaaagu

SEQ ID NO: 2037812 - RNA, 14 nt, Staphylococcus aureus subsp. aureus Mu50
aaauauaucuaaua

SEQ ID NO: 2037813 - RNA, 14 nt, Staphylococcus aureus subsp. aureus Mu50
aaauauauuaguga

SEQ ID NO: 2037814 - RNA, 15 nt, Staphylococcus aureus subsp. aureus Mu50
aaauauaaauaugaa

SEQ ID NO: 2037815 - RNA, 21 nt, Staphylococcus aureus subsp. aureus Mu50
aaauagcuguuugauauugag

SEQ ID NO: 2037816 - RNA, 16 nt, Staphylococcus aureus subsp. aureus Mu50
aaauaguaaagugaaa

SEQ ID NO: 2037817 - RNA, 16 nt, Staphylococcus aureus subsp. aureus Mu50
aaauaggcauaaugaa

SEQ ID NO: 2037818 - RNA, 21 nt, Staphylococcus aureus subsp. aureus Mu50
aaauagcguaauuauuauaau

SEQ ID NO: 2037819 - RNA, 18 nt, Staphylococcus aureus subsp. aureus Mu50
aaauagcuauuaaaauag

SEQ ID NO: 2037820 - RNA, 22 nt, Staphylococcus aureus subsp. aureus Mu50
aaauagcuucuuaaaucaacau

SEQ ID NO: 2037821 - RNA, 21 nt, Staphylococcus aureus subsp. aureus Mu50
aaauacuugcucuaauucaau

SEQ ID NO: 2037822 - RNA, 16 nt, Staphylococcus aureus subsp. aureus Mu50
aaauagaaaaauuuca

SEQ ID NO: 2037823 - RNA, 13 nt, Staphylococcus aureus subsp. aureus Mu50
aaauagauugaaa

SEQ ID NO: 2037824 - RNA, 17 nt, Staphylococcus aureus subsp. aureus Mu50
aaauacuccuuucauac

SEQ ID NO: 2037825 - RNA, 20 nt, Staphylococcus aureus subsp. aureus Mu50
aaauacaugugggauaucuu

SEQ ID NO: 2037826 - RNA, 17 nt, Staphylococcus aureus subsp. aureus Mu50
aaauacaaauuacaaua

SEQ ID NO: 2037827 - RNA, 16 nt, Staphylococcus aureus subsp. aureus Mu50
aaaguuguaauuuaaa

SEQ ID NO: 2037828 - RNA, 16 nt, Staphylococcus aureus subsp. aureus Mu50
aaaguuaucugcuuuu

SEQ ID NO: 2037829 - RNA, 17 nt, Staphylococcus aureus subsp. aureus Mu50
aaaguguuaugaauuag

SEQ ID NO: 2037830 - RNA, 16 nt, Staphylococcus aureus subsp. aureus Mu50
aaaguguugacuuuau

SEQ ID NO: 2037831 - RNA, 15 nt, Staphylococcus aureus subsp. aureus Mu50
aaaguaugaguuauu

SEQ ID NO: 2037832 - RNA, 15 nt, Staphylococcus aureus subsp. aureus Mu50
aaaguauuacuuuau

SEQ ID NO: 2037833 - RNA, 13 nt, Staphylococcus aureus subsp. aureus Mu50
aaagucaacaauu

SEQ ID NO: 2037834 - RNA, 20 nt, Staphylococcus aureus subsp. aureus Mu50
aaagucagcuuacaauaaug

SEQ ID NO: 2037835 - RNA, 15 nt, Staphylococcus aureus subsp. aureus Mu50
aaagucgucucaaua

SEQ ID NO: 2037836 - RNA, 20 nt, Staphylococcus aureus subsp. aureus Mu50
aaagucguuguugaaauuaa

SEQ ID NO: 2037837 - RNA, 14 nt, Staphylococcus aureus subsp. aureus Mu50
aaagugcaauuauu

SEQ ID NO: 2037838 - RNA, 16 nt, Staphylococcus aureus subsp. aureus Mu50
aaagugcgauuaucag

SEQ ID NO: 2037839 - RNA, 21 nt, Staphylococcus aureus subsp. aureus Mu50
aaagugguuuuacugcuucaa

SEQ ID NO: 2037840 - RNA, 16 nt, Staphylococcus aureus subsp. aureus Mu50
aaagcuguuuauuggu

SEQ ID NO: 2037841 - RNA, 16 nt, Staphylococcus aureus subsp. aureus Mu50
aaaggcauaauaacca

SEQ ID NO: 2037842 - RNA, 22 nt, Staphylococcus aureus subsp. aureus Mu50
aaaaaugccgagauuauuaugu

SEQ ID NO: 2037843 - RNA, 19 nt, Staphylococcus aureus subsp. aureus Mu50
aaagcucggcacaccauuu

SEQ ID NO: 2037844 - RNA, 21 nt, Staphylococcus aureus subsp. aureus Mu50
aaaaauagcguaauuauuaua

SEQ ID NO: 2037845 - RNA, 13 nt, Staphylococcus aureus subsp. aureus Mu50
aaaaaaugaaugu

SEQ ID NO: 2037846 - RNA, 12 nt, Staphylococcus aureus subsp. aureus Mu50
aaaaaaugaugu

SEQ ID NO: 2037847 - RNA, 12 nt, Staphylococcus aureus subsp. aureus Mu50
aaaaaauggauu

SEQ ID NO: 2037848 - RNA, 23 nt, Staphylococcus aureus subsp. aureus Mu50
aaaaacauuaaccaguauaauuu

SEQ ID NO: 2037849 - RNA, 21 nt, Staphylococcus aureus subsp. aureus Mu50
aaaaacagcaguaagauauuu

SEQ ID NO: 2037850 - RNA, 14 nt, Staphylococcus aureus subsp. aureus Mu50
aaacguacauuuuu

SEQ ID NO: 2037851 - RNA, 16 nt, Staphylococcus aureus subsp. aureus Mu50
aaacguaucauuuaaa

SEQ ID NO: 2037852 - RNA, 17 nt, Staphylococcus aureus subsp. aureus Mu50
aaacgugacauuuucaa

SEQ ID NO: 2037853 - RNA, 20 nt, Staphylococcus aureus subsp. aureus Mu50
aaacgauugauagacauaac

SEQ ID NO: 2037854 - RNA, 17 nt, Staphylococcus aureus subsp. aureus Mu50
aaacgauucauuauaug

SEQ ID NO: 2037855 - RNA, 19 nt, Staphylococcus aureus subsp. aureus Mu50
aaacgauucauuauauggu

SEQ ID NO: 2037856 - RNA, 16 nt, Staphylococcus aureus subsp. aureus Mu50
aaacgauacugcuuug

SEQ ID NO: 2037857 - RNA, 22 nt, Staphylococcus aureus subsp. aureus Mu50
aaacuauuaucgaagaaacauu

SEQ ID NO: 2037858 - RNA, 18 nt, Staphylococcus aureus subsp. aureus Mu50
aaacguuaguacuuugau

SEQ ID NO: 2037859 - RNA, 15 nt, Staphylococcus aureus subsp. aureus Mu50
aaacugaguucaauu

SEQ ID NO: 2037860 - RNA, 19 nt, Staphylococcus aureus subsp. aureus Mu50
aaacuuaagaauacaugac

SEQ ID NO: 2037861 - RNA, 15 nt, Staphylococcus aureus subsp. aureus Mu50
aaacuucacaucaug

SEQ ID NO: 2037862 - RNA, 21 nt, Staphylococcus aureus subsp. aureus Mu50
aaacucuaaaaguuguaauuu

SEQ ID NO: 2037863 - RNA, 22 nt, Staphylococcus aureus subsp. aureus Mu50
aaacucgcccccguaauaauuu

SEQ ID NO: 2037864 - RNA, 17 nt, Staphylococcus aureus subsp. aureus Mu50
aaagauucggaaaauau

SEQ ID NO: 2037865 - RNA, 20 nt, Staphylococcus aureus subsp. aureus Mu50
aaagauuuuguugaacguuu

SEQ ID NO: 2037866 - RNA, 17 nt, Staphylococcus aureus subsp. aureus Mu50
aaagauuauuauuacaa

SEQ ID NO: 2037867 - RNA, 16 nt, Staphylococcus aureus subsp. aureus Mu50
aaagaugggauuucac

SEQ ID NO: 2037868 - RNA, 22 nt, Staphylococcus aureus subsp. aureus Mu50
aaagaugucgaaaaguauauga

SEQ ID NO: 2037869 - RNA, 23 nt, Staphylococcus aureus subsp. aureus Mu50
aaagaugucgaaaaguauaugaa

SEQ ID NO: 2037870 - RNA, 12 nt, Staphylococcus aureus subsp. aureus Mu50
aaaaauaauccc

SEQ ID NO: 2037871 - RNA, 14 nt, Staphylococcus aureus subsp. aureus Mu50
aaaaauaauuauga

SEQ ID NO: 2037872 - RNA, 14 nt, Staphylococcus aureus subsp. aureus Mu50
aaagauaauauuaa

SEQ ID NO: 2037873 - RNA, 22 nt, Staphylococcus aureus subsp. aureus Mu50
aaacuugauuauguaauucuag

SEQ ID NO: 2037874 - RNA, 19 nt, Staphylococcus aureus subsp. aureus Mu50
aaacuugagcuauucauag

SEQ ID NO: 2037875 - RNA, 18 nt, Staphylococcus aureus subsp. aureus Mu50
aaacuucuauuaauaauu

SEQ ID NO: 2037876 - RNA, 13 nt, Staphylococcus aureus subsp. aureus Mu50
aaccauaacaauu

SEQ ID NO: 2037877 - RNA, 18 nt, Staphylococcus aureus subsp. aureus Mu50
aaccauaguaauaaaaug

SEQ ID NO: 2037878 - RNA, 13 nt, Staphylococcus aureus subsp. aureus Mu50
aaccauagugcgu

SEQ ID NO: 2037879 - RNA, 21 nt, Staphylococcus aureus subsp. aureus Mu50
aaccaucauucauauggaaua

SEQ ID NO: 2037880 - RNA, 14 nt, Staphylococcus aureus subsp. aureus Mu50
aaccaguauaauuu

SEQ ID NO: 2037881 - RNA, 17 nt, Staphylococcus aureus subsp. aureus Mu50
aaccaucucaacuaauc

SEQ ID NO: 2037882 - RNA, 22 nt, Staphylococcus aureus subsp. aureus Mu50
aaccauucgaaagccaauuaau

SEQ ID NO: 2037883 - RNA, 12 nt, Staphylococcus aureus subsp. aureus Mu50
aaccauugaaug

SEQ ID NO: 2037884 - RNA, 21 nt, Staphylococcus aureus subsp. aureus Mu50
aaccauugaaugaaucccaua

SEQ ID NO: 2037885 - RNA, 21 nt, Staphylococcus aureus subsp. aureus Mu50
aaccauuucaucauaauugau

SEQ ID NO: 2037886 - RNA, 13 nt, Staphylococcus aureus subsp. aureus Mu50
aacauaaugacau

SEQ ID NO: 2037887 - RNA, 13 nt, Staphylococcus aureus subsp. aureus Mu50
aacauaauuuuua

SEQ ID NO: 2037888 - RNA, 18 nt, Staphylococcus aureus subsp. aureus Mu50
aacaguuuuauuaucuuu

SEQ ID NO: 2037889 - RNA, 14 nt, Staphylococcus aureus subsp. aureus Mu50
aacauaaaaaugcu

SEQ ID NO: 2037890 - RNA, 12 nt, Staphylococcus aureus subsp. aureus Mu50
aacauaaaauuu

SEQ ID NO: 2037891 - RNA, 14 nt, Staphylococcus aureus subsp. aureus Mu50
aacauauuacccca

SEQ ID NO: 2037892 - RNA, 17 nt, Staphylococcus aureus subsp. aureus Mu50
aacauauucauaauauc

SEQ ID NO: 2037893 - RNA, 19 nt, Staphylococcus aureus subsp. aureus Mu50
aacaucaaauagacaccaa

SEQ ID NO: 2037894 - RNA, 12 nt, Staphylococcus aureus subsp. aureus Mu50
aacauagaauaa

SEQ ID NO: 2037895 - RNA, 23 nt, Staphylococcus aureus subsp. aureus Mu50
aacauaguuucuucuauuauauu

SEQ ID NO: 2037896 - RNA, 17 nt, Staphylococcus aureus subsp. aureus Mu50
aacaucuaauacauuau

SEQ ID NO: 2037897 - RNA, 23 nt, Staphylococcus aureus subsp. aureus Mu50
aacaucuacaucaaauuuuucga

SEQ ID NO: 2037898 - RNA, 16 nt, Staphylococcus aureus subsp. aureus Mu50
aacaucggcaccagua

SEQ ID NO: 2037899 - RNA, 22 nt, Staphylococcus aureus subsp. aureus Mu50
aacaucgauuuaucauuauuug

SEQ ID NO: 2037900 - RNA, 14 nt, Staphylococcus aureus subsp. aureus Mu50
aacaucauuucuga

SEQ ID NO: 2037901 - RNA, 14 nt, Staphylococcus aureus subsp. aureus Mu50
aacaugauugaaau

SEQ ID NO: 2037902 - RNA, 18 nt, Staphylococcus aureus subsp. aureus Mu50
aacaugauugaaauccuu

SEQ ID NO: 2037903 - RNA, 15 nt, Staphylococcus aureus subsp. aureus Mu50
aacaucugaaucuga

SEQ ID NO: 2037904 - RNA, 17 nt, Staphylococcus aureus subsp. aureus Mu50
aacaucuugauauucau

SEQ ID NO: 2037905 - RNA, 18 nt, Staphylococcus aureus subsp. aureus Mu50
aacaugaccuaauauauu

SEQ ID NO: 2037906 - RNA, 18 nt, Staphylococcus aureus subsp. aureus Mu50
aacaugaaugauauugau

SEQ ID NO: 2037907 - RNA, 20 nt, Staphylococcus aureus subsp. aureus Mu50
aacaugaaugauauugauuu

SEQ ID NO: 2037908 - RNA, 12 nt, Staphylococcus aureus subsp. aureus Mu50
aacauuuauaua

SEQ ID NO: 2037909 - RNA, 20 nt, Staphylococcus aureus subsp. aureus Mu50
aacauugaacgauaacaauu

SEQ ID NO: 2037910 - RNA, 14 nt, Staphylococcus aureus subsp. aureus Mu50
aacauuauuuauau

SEQ ID NO: 2037911 - RNA, 14 nt, Staphylococcus aureus subsp. aureus Mu50
aacauuauuuuugu

SEQ ID NO: 2037912 - RNA, 21 nt, Staphylococcus aureus subsp. aureus Mu50
aacauuuugccccucauucac

SEQ ID NO: 2037913 - RNA, 13 nt, Staphylococcus aureus subsp. aureus Mu50
aacauuaaaaugu

SEQ ID NO: 2037914 - RNA, 17 nt, Staphylococcus aureus subsp. aureus Mu50
aacauuaaauuauuaga

SEQ ID NO: 2037915 - RNA, 22 nt, Staphylococcus aureus subsp. aureus Mu50
aacauuacuaauugaucagcau

SEQ ID NO: 2037916 - RNA, 18 nt, Staphylococcus aureus subsp. aureus Mu50
aacauuacuuuaacaguu

SEQ ID NO: 2037917 - RNA, 23 nt, Staphylococcus aureus subsp. aureus Mu50
aaccaaucaucgcaaauacauaa

SEQ ID NO: 2037918 - RNA, 17 nt, Staphylococcus aureus subsp. aureus Mu50
aaccaauuauuaaagcu

SEQ ID NO: 2037919 - RNA, 20 nt, Staphylococcus aureus subsp. aureus Mu50
aacauuuuugaauuuaauac

SEQ ID NO: 2037920 - RNA, 23 nt, Staphylococcus aureus subsp. aureus Mu50
aacauuuuuuauagcaaauugau

SEQ ID NO: 2037921 - RNA, 21 nt, Staphylococcus aureus subsp. aureus Mu50
aaccaaaaaauccaagcgcuu

SEQ ID NO: 2037922 - RNA, 18 nt, Staphylococcus aureus subsp. aureus Mu50
aaccaccaguauaaccau

SEQ ID NO: 2037923 - RNA, 19 nt, Staphylococcus aureus subsp. aureus Mu50
aacgaugcuacuuaaagcu

SEQ ID NO: 2037924 - RNA, 14 nt, Staphylococcus aureus subsp. aureus Mu50
aacgaugcuacuua

SEQ ID NO: 2037925 - RNA, 23 nt, Staphylococcus aureus subsp. aureus Mu50
aacgauagugguacuauuuuuga

SEQ ID NO: 2037926 - RNA, 22 nt, Staphylococcus aureus subsp. aureus Mu50
aaccuuuaaaacguuaguacuu

SEQ ID NO: 2037927 - RNA, 17 nt, Staphylococcus aureus subsp. aureus Mu50
aaccuuuaaaaguaaca

SEQ ID NO: 2037928 - RNA, 13 nt, Staphylococcus aureus subsp. aureus Mu50
aaccuuuucaaau

SEQ ID NO: 2037929 - RNA, 16 nt, Staphylococcus aureus subsp. aureus Mu50
aacguaaacaugguuc

SEQ ID NO: 2037930 - RNA, 14 nt, Staphylococcus aureus subsp. aureus Mu50
aacguacaauguau

SEQ ID NO: 2037931 - RNA, 22 nt, Staphylococcus aureus subsp. aureus Mu50
aacgucacuuuauuaaauaaca

SEQ ID NO: 2037932 - RNA, 20 nt, Staphylococcus aureus subsp. aureus Mu50
aacgucauuuuuaauaaugc

SEQ ID NO: 2037933 - RNA, 22 nt, Staphylococcus aureus subsp. aureus Mu50
aacgugaggcccauaaauuacu

SEQ ID NO: 2037934 - RNA, 15 nt, Staphylococcus aureus subsp. aureus Mu50
aacgguaauuucuau

SEQ ID NO: 2037935 - RNA, 16 nt, Staphylococcus aureus subsp. aureus Mu50
aacggcacauucauac

SEQ ID NO: 2037936 - RNA, 15 nt, Staphylococcus aureus subsp. aureus Mu50
aaucaucgcaaauac

SEQ ID NO: 2037937 - RNA, 16 nt, Staphylococcus aureus subsp. aureus Mu50
aaucaucauuaaaucu

SEQ ID NO: 2037938 - RNA, 14 nt, Staphylococcus aureus subsp. aureus Mu50
aaucaucuguuuua

SEQ ID NO: 2037939 - RNA, 16 nt, Staphylococcus aureus subsp. aureus Mu50
aaucauagcauuaaga

SEQ ID NO: 2037940 - RNA, 17 nt, Staphylococcus aureus subsp. aureus Mu50
aaucauuguguauuguu

SEQ ID NO: 2037941 - RNA, 16 nt, Staphylococcus aureus subsp. aureus Mu50
aaucauuuuagcaccg

SEQ ID NO: 2037942 - RNA, 18 nt, Staphylococcus aureus subsp. aureus Mu50
aauccaauuaaauauuua

SEQ ID NO: 2037943 - RNA, 15 nt, Staphylococcus aureus subsp. aureus Mu50
aaucauucuuuauag

SEQ ID NO: 2037944 - RNA, 15 nt, Staphylococcus aureus subsp. aureus Mu50
aaucauuuaaauuag

SEQ ID NO: 2037945 - RNA, 15 nt, Staphylococcus aureus subsp. aureus Mu50
aaucauuucguucau

SEQ ID NO: 2037946 - RNA, 23 nt, Staphylococcus aureus subsp. aureus Mu50
aaucauuuguguauaaaugucau

SEQ ID NO: 2037947 - RNA, 14 nt, Staphylococcus aureus subsp. aureus Mu50
aaucauugguuuca

SEQ ID NO: 2037948 - RNA, 16 nt, Staphylococcus aureus subsp. aureus Mu50
aaucauugguuucauc

SEQ ID NO: 2037949 - RNA, 12 nt, Staphylococcus aureus subsp. aureus Mu50
aaucccuucaaa

SEQ ID NO: 2037950 - RNA, 15 nt, Staphylococcus aureus subsp. aureus Mu50
aaucccauaccuaca

SEQ ID NO: 2037951 - RNA, 16 nt, Staphylococcus aureus subsp. aureus Mu50
aauccaaaauaaucga

SEQ ID NO: 2037952 - RNA, 14 nt, Staphylococcus aureus subsp. aureus Mu50
aaucccauaaugac

SEQ ID NO: 2037953 - RNA, 22 nt, Staphylococcus aureus subsp. aureus Mu50
aaucccaaguuacaauaucaua

SEQ ID NO: 2037954 - RNA, 13 nt, Staphylococcus aureus subsp. aureus Mu50
aauagcaaaauua

SEQ ID NO: 2037955 - RNA, 16 nt, Staphylococcus aureus subsp. aureus Mu50
aauagcaaccauauuu

SEQ ID NO: 2037956 - RNA, 22 nt, Staphylococcus aureus subsp. aureus Mu50
aauagcuauuaaaauagaguag

SEQ ID NO: 2037957 - RNA, 14 nt, Staphylococcus aureus subsp. aureus Mu50
aauagcuacaauua

SEQ ID NO: 2037958 - RNA, 17 nt, Staphylococcus aureus subsp. aureus Mu50
aauagcuauauuuaaaa

SEQ ID NO: 2037959 - RNA, 17 nt, Staphylococcus aureus subsp. aureus Mu50
aauagcuauauuuuugu

SEQ ID NO: 2037960 - RNA, 17 nt, Staphylococcus aureus subsp. aureus Mu50
aauaguaaugaugugaa

SEQ ID NO: 2037961 - RNA, 15 nt, Staphylococcus aureus subsp. aureus Mu50
aauaguuaacgauag

SEQ ID NO: 2037962 - RNA, 19 nt, Staphylococcus aureus subsp. aureus Mu50
aauaguuaagauuuuaacu

SEQ ID NO: 2037963 - RNA, 14 nt, Staphylococcus aureus subsp. aureus Mu50
aauaguucaaaaua

SEQ ID NO: 2037964 - RNA, 14 nt, Staphylococcus aureus subsp. aureus Mu50
aauaguucuuuaaa

SEQ ID NO: 2037965 - RNA, 17 nt, Staphylococcus aureus subsp. aureus Mu50
aauaguuaccaaaauuu

SEQ ID NO: 2037966 - RNA, 20 nt, Staphylococcus aureus subsp. aureus Mu50
aauaguagccuagauaccaa

SEQ ID NO: 2037967 - RNA, 18 nt, Staphylococcus aureus subsp. aureus Mu50
aaucaguuuuuaaaucaa

SEQ ID NO: 2037968 - RNA, 17 nt, Staphylococcus aureus subsp. aureus Mu50
aaucaguauuuacuuuu

SEQ ID NO: 2037969 - RNA, 12 nt, Staphylococcus aureus subsp. aureus Mu50
aaucagcuuuuu

SEQ ID NO: 2037970 - RNA, 17 nt, Staphylococcus aureus subsp. aureus Mu50
aaucagaugauuuaauu

SEQ ID NO: 2037971 - RNA, 19 nt, Staphylococcus aureus subsp. aureus Mu50
aaucagaguagaaaguguu

SEQ ID NO: 2037972 - RNA, 22 nt, Staphylococcus aureus subsp. aureus Mu50
aauauaaauuucuucauaguuc

SEQ ID NO: 2037973 - RNA, 14 nt, Staphylococcus aureus subsp. aureus Mu50
aauauaaauuuuga

SEQ ID NO: 2037974 - RNA, 13 nt, Staphylococcus aureus subsp. aureus Mu50
aauauaacaucaa

SEQ ID NO: 2037975 - RNA, 17 nt, Staphylococcus aureus subsp. aureus Mu50
aauauaagugauuucuu

SEQ ID NO: 2037976 - RNA, 20 nt, Staphylococcus aureus subsp. aureus Mu50
aauauaacugcauguacauc

SEQ ID NO: 2037977 - RNA, 19 nt, Staphylococcus aureus subsp. aureus Mu50
aauauaacuucuauuaaga

SEQ ID NO: 2037978 - RNA, 21 nt, Staphylococcus aureus subsp. aureus Mu50
aauccucacaaauuugaauau

SEQ ID NO: 2037979 - RNA, 20 nt, Staphylococcus aureus subsp. aureus Mu50
aauccuuuauauuuaguuag

SEQ ID NO: 2037980 - RNA, 21 nt, Staphylococcus aureus subsp. aureus Mu50
aaucgaauugauggaaaaguu

SEQ ID NO: 2037981 - RNA, 14 nt, Staphylococcus aureus subsp. aureus Mu50
aaucgaacagaaaa

SEQ ID NO: 2037982 - RNA, 15 nt, Staphylococcus aureus subsp. aureus Mu50
aaucgauauugagaa

SEQ ID NO: 2037983 - RNA, 16 nt, Staphylococcus aureus subsp. aureus Mu50
aaucgauacuaauauc

SEQ ID NO: 2037984 - RNA, 15 nt, Staphylococcus aureus subsp. aureus Mu50
aaucgauauaaugaa

SEQ ID NO: 2037985 - RNA, 22 nt, Staphylococcus aureus subsp. aureus Mu50
aaucuaacuggaaaugauaauu

SEQ ID NO: 2037986 - RNA, 16 nt, Staphylococcus aureus subsp. aureus Mu50
aaucuauauaaauguu

SEQ ID NO: 2037987 - RNA, 22 nt, Staphylococcus aureus subsp. aureus Mu50
aaucuauauaaauguuuauauc

SEQ ID NO: 2037988 - RNA, 13 nt, Staphylococcus aureus subsp. aureus Mu50
aaucuaccauguu

SEQ ID NO: 2037989 - RNA, 14 nt, Staphylococcus aureus subsp. aureus Mu50
aaucguauucauau

SEQ ID NO: 2037990 - RNA, 17 nt, Staphylococcus aureus subsp. aureus Mu50
aaucguauuuuuaagcu

SEQ ID NO: 2037991 - RNA, 15 nt, Staphylococcus aureus subsp. aureus Mu50
aaucgugcuguuauc

SEQ ID NO: 2037992 - RNA, 16 nt, Staphylococcus aureus subsp. aureus Mu50
aaucgugcuguuauca

SEQ ID NO: 2037993 - RNA, 22 nt, Staphylococcus aureus subsp. aureus Mu50
aaucguuaaaacacccugcuua

SEQ ID NO: 2037994 - RNA, 17 nt, Staphylococcus aureus subsp. aureus Mu50
aaucguuaauuuccaau

SEQ ID NO: 2037995 - RNA, 16 nt, Staphylococcus aureus subsp. aureus Mu50
aaucggaauaaaauaa

SEQ ID NO: 2037996 - RNA, 15 nt, Staphylococcus aureus subsp. aureus Mu50
aaucguaggaugcuu

SEQ ID NO: 2037997 - RNA, 16 nt, Staphylococcus aureus subsp. aureus Mu50
aaucggcuuucuaagu

SEQ ID NO: 2037998 - RNA, 13 nt, Staphylococcus aureus subsp. aureus Mu50
aauuucaaaaaua

SEQ ID NO: 2037999 - RNA, 19 nt, Staphylococcus aureus subsp. aureus Mu50
aauuuauucaaaauucaau

SEQ ID NO: 2038000 - RNA, 20 nt, Staphylococcus aureus subsp. aureus Mu50
aauuuauucaaaucauaagu

SEQ ID NO: 2038001 - RNA, 13 nt, Staphylococcus aureus subsp. aureus Mu50
aauuuauuuugua

SEQ ID NO: 2038002 - RNA, 15 nt, Staphylococcus aureus subsp. aureus Mu50
aauuugagaaaugaa

SEQ ID NO: 2038003 - RNA, 21 nt, Staphylococcus aureus subsp. aureus Mu50
aauuugagcaauucuugaaaa

SEQ ID NO: 2038004 - RNA, 24 nt, Staphylococcus aureus subsp. aureus Mu50
aauuugaggauacauaaaucuaau

SEQ ID NO: 2038005 - RNA, 13 nt, Staphylococcus aureus subsp. aureus Mu50
aauuugaauaugg

SEQ ID NO: 2038006 - RNA, 16 nt, Staphylococcus aureus subsp. aureus Mu50
aauuuaauauuauaag

SEQ ID NO: 2038007 - RNA, 20 nt, Staphylococcus aureus subsp. aureus Mu50
aauuuaccauuuucaauaaa

SEQ ID NO: 2038008 - RNA, 15 nt, Staphylococcus aureus subsp. aureus Mu50
aauuuaauguuuuca

SEQ ID NO: 2038009 - RNA, 19 nt, Staphylococcus aureus subsp. aureus Mu50
aauuuacuccuuacaauaa

SEQ ID NO: 2038010 - RNA, 20 nt, Staphylococcus aureus subsp. aureus Mu50
aauuuacuccuuacaauaaa

SEQ ID NO: 2038011 - RNA, 16 nt, Staphylococcus aureus subsp. aureus Mu50
aauuuaucugcaaaau

SEQ ID NO: 2038012 - RNA, 18 nt, Staphylococcus aureus subsp. aureus Mu50
aauuuauguguugugaua

SEQ ID NO: 2038013 - RNA, 17 nt, Staphylococcus aureus subsp. aureus Mu50
aauuuaucaauuucuau

SEQ ID NO: 2038014 - RNA, 16 nt, Staphylococcus aureus subsp. aureus Mu50
aauuuaguaucuauac

SEQ ID NO: 2038015 - RNA, 21 nt, Staphylococcus aureus subsp. aureus Mu50
aauuuaguaucuauacaauua

SEQ ID NO: 2038016 - RNA, 21 nt, Staphylococcus aureus subsp. aureus Mu50
aauuuagucauuacaaaucau

SEQ ID NO: 2038017 - RNA, 14 nt, Staphylococcus aureus subsp. aureus Mu50
aauucaauaccuaa

SEQ ID NO: 2038018 - RNA, 17 nt, Staphylococcus aureus subsp. aureus Mu50
aauucaaugauuuuuaa

SEQ ID NO: 2038019 - RNA, 22 nt, Staphylococcus aureus subsp. aureus Mu50
aauucagcugaugcuucgaauu

SEQ ID NO: 2038020 - RNA, 19 nt, Staphylococcus aureus subsp. aureus Mu50
aauucuacaaacaaugcaa

SEQ ID NO: 2038021 - RNA, 24 nt, Staphylococcus aureus subsp. aureus Mu50
aauucuauccuaagcauaauucaa

SEQ ID NO: 2038022 - RNA, 14 nt, Staphylococcus aureus subsp. aureus Mu50
aauucuaucuauaa

SEQ ID NO: 2038023 - RNA, 14 nt, Staphylococcus aureus subsp. aureus Mu50
aauucuauuuuuga

SEQ ID NO: 2038024 - RNA, 22 nt, Staphylococcus aureus subsp. aureus Mu50
aauugaaguacauuaaaacaau

SEQ ID NO: 2038025 - RNA, 16 nt, Staphylococcus aureus subsp. aureus Mu50
aauugaaucaaauaca

SEQ ID NO: 2038026 - RNA, 16 nt, Staphylococcus aureus subsp. aureus Mu50
aauugaaauuaacugu

SEQ ID NO: 2038027 - RNA, 13 nt, Staphylococcus aureus subsp. aureus Mu50
aauugaacuuugu

SEQ ID NO: 2038028 - RNA, 21 nt, Staphylococcus aureus subsp. aureus Mu50
aauugaauugauuauaaugau

SEQ ID NO: 2038029 - RNA, 20 nt, Staphylococcus aureus subsp. aureus Mu50
aauugacaguuuccauaaau

SEQ ID NO: 2038030 - RNA, 20 nt, Staphylococcus aureus subsp. aureus Mu50
aauuuaauaggcuauguaaa

SEQ ID NO: 2038031 - RNA, 16 nt, Staphylococcus aureus subsp. aureus Mu50
aauucuuuuucagcua

SEQ ID NO: 2038032 - RNA, 15 nt, Staphylococcus aureus subsp. aureus Mu50
aauugaaaaucuaau

SEQ ID NO: 2038033 - RNA, 13 nt, Staphylococcus aureus subsp. aureus Mu50
aauucucuuuguu

SEQ ID NO: 2038034 - RNA, 13 nt, Staphylococcus aureus subsp. aureus Mu50
aauucucuuuuaa

SEQ ID NO: 2038035 - RNA, 21 nt, Staphylococcus aureus subsp. aureus Mu50
aauucugaaaucaguuuuuga

SEQ ID NO: 2038036 - RNA, 21 nt, Staphylococcus aureus subsp. aureus Mu50
aauuacugucuuuccauaaua

SEQ ID NO: 2038037 - RNA, 15 nt, Staphylococcus aureus subsp. aureus Mu50
aauuacgucauaaaa

SEQ ID NO: 2038038 - RNA, 17 nt, Staphylococcus aureus subsp. aureus Mu50
aauuagaaaaauaugau

SEQ ID NO: 2038039 - RNA, 23 nt, Staphylococcus aureus subsp. aureus Mu50
aauuagaaaaauaugauugcaaa

SEQ ID NO: 2038040 - RNA, 18 nt, Staphylococcus aureus subsp. aureus Mu50
aauuacuuucauuguaaa

SEQ ID NO: 2038041 - RNA, 21 nt, Staphylococcus aureus subsp. aureus Mu50
aauuagucaucaaccucauuu

SEQ ID NO: 2038042 - RNA, 21 nt, Staphylococcus aureus subsp. aureus Mu50
aauuaggaacuacgucauacu

SEQ ID NO: 2038043 - RNA, 20 nt, Staphylococcus aureus subsp. aureus Mu50
aauuagauuuaaaaugucau

SEQ ID NO: 2038044 - RNA, 13 nt, Staphylococcus aureus subsp. aureus Mu50
aauuagauuuugu

SEQ ID NO: 2038045 - RNA, 22 nt, Staphylococcus aureus subsp. aureus Mu50
aauuauaauaaaacuugugaua

SEQ ID NO: 2038046 - RNA, 15 nt, Staphylococcus aureus subsp. aureus Mu50
aauuauacguuacua

SEQ ID NO: 2038047 - RNA, 16 nt, Staphylococcus aureus subsp. aureus Mu50
aauuaucaacauaaua

SEQ ID NO: 2038048 - RNA, 17 nt, Staphylococcus aureus subsp. aureus Mu50
aauuaucagaaucaagu

SEQ ID NO: 2038049 - RNA, 23 nt, Staphylococcus aureus subsp. aureus Mu50
aauuaucauaaagauaagauggu

SEQ ID NO: 2038050 - RNA, 14 nt, Staphylococcus aureus subsp. aureus Mu50
aauuaucuuuacga

SEQ ID NO: 2038051 - RNA, 14 nt, Staphylococcus aureus subsp. aureus Mu50
aauuaucuuuagua

SEQ ID NO: 2038052 - RNA, 21 nt, Staphylococcus aureus subsp. aureus Mu50
aauuaugacuuauuuuucauc

SEQ ID NO: 2038053 - RNA, 20 nt, Staphylococcus aureus subsp. aureus Mu50
aauuauguaaaaaauaucuu

SEQ ID NO: 2038054 - RNA, 13 nt, Staphylococcus aureus subsp. aureus Mu50
aauuauuaauaag

SEQ ID NO: 2038055 - RNA, 16 nt, Staphylococcus aureus subsp. aureus Mu50
aauuauucaaguaaua

SEQ ID NO: 2038056 - RNA, 20 nt, Staphylococcus aureus subsp. aureus Mu50
aauuauucaaguaauaucuu

SEQ ID NO: 2038057 - RNA, 13 nt, Staphylococcus aureus subsp. aureus Mu50
aauuauuguuuua

SEQ ID NO: 2038058 - RNA, 18 nt, Staphylococcus aureus subsp. aureus Mu50
aauuauuucaauuaucaa

SEQ ID NO: 2038059 - RNA, 22 nt, Staphylococcus aureus subsp. aureus Mu50
aauuauugaaaacaaaaagguu

SEQ ID NO: 2038060 - RNA, 22 nt, Staphylococcus aureus subsp. aureus Mu50
aauucaacuuaaauggaugaua

SEQ ID NO: 2038061 - RNA, 20 nt, Staphylococcus aureus subsp. aureus Mu50
aauuauuuucucgauacaaa

SEQ ID NO: 2038062 - RNA, 17 nt, Staphylococcus aureus subsp. aureus Mu50
aauguucaaaaaaugaa

SEQ ID NO: 2038063 - RNA, 21 nt, Staphylococcus aureus subsp. aureus Mu50
aauguuauugcuuauuuuugu

SEQ ID NO: 2038064 - RNA, 19 nt, Staphylococcus aureus subsp. aureus Mu50
aauguuacacaaauuaaaa

SEQ ID NO: 2038065 - RNA, 21 nt, Staphylococcus aureus subsp. aureus Mu50
aauguuacacaaauuaaaacu

SEQ ID NO: 2038066 - RNA, 21 nt, Staphylococcus aureus subsp. aureus Mu50
aauuaauguucaaaaaaugaa

SEQ ID NO: 2038067 - RNA, 14 nt, Staphylococcus aureus subsp. aureus Mu50
aauuaauuacuuuc

SEQ ID NO: 2038068 - RNA, 13 nt, Staphylococcus aureus subsp. aureus Mu50
aauuaauuaucau

SEQ ID NO: 2038069 - RNA, 12 nt, Staphylococcus aureus subsp. aureus Mu50
aauuaauuaucu

SEQ ID NO: 2038070 - RNA, 15 nt, Staphylococcus aureus subsp. aureus Mu50
aauuacaaauuaucu

SEQ ID NO: 2038071 - RNA, 20 nt, Staphylococcus aureus subsp. aureus Mu50
aauuaauucgccuaaauggu

SEQ ID NO: 2038072 - RNA, 20 nt, Staphylococcus aureus subsp. aureus Mu50
aauuaauuuagucauuacaa

SEQ ID NO: 2038073 - RNA, 12 nt, Staphylococcus aureus subsp. aureus Mu50
aauuaauuuugu

SEQ ID NO: 2038074 - RNA, 19 nt, Staphylococcus aureus subsp. aureus Mu50
aaugucgauauuucuaguu

SEQ ID NO: 2038075 - RNA, 14 nt, Staphylococcus aureus subsp. aureus Mu50
aaugucuuacuuuu

SEQ ID NO: 2038076 - RNA, 16 nt, Staphylococcus aureus subsp. aureus Mu50
aaugucuuugaaaaac

SEQ ID NO: 2038077 - RNA, 13 nt, Staphylococcus aureus subsp. aureus Mu50
aaugugcuuguaa

SEQ ID NO: 2038078 - RNA, 17 nt, Staphylococcus aureus subsp. aureus Mu50
aauguuaaucaaaauua

SEQ ID NO: 2038079 - RNA, 17 nt, Staphylococcus aureus subsp. aureus Mu50
aauguguuuucaacagu

SEQ ID NO: 2038080 - RNA, 15 nt, Staphylococcus aureus subsp. aureus Mu50
aauguuaaaauaacu

SEQ ID NO: 2038081 - RNA, 21 nt, Staphylococcus aureus subsp. aureus Mu50
aauguuaacugcaaacuugau

SEQ ID NO: 2038082 - RNA, 17 nt, Staphylococcus aureus subsp. aureus Mu50
aaugaguaugacgaaau

SEQ ID NO: 2038083 - RNA, 16 nt, Staphylococcus aureus subsp. aureus Mu50
aaugagcguuccauua

SEQ ID NO: 2038084 - RNA, 21 nt, Staphylococcus aureus subsp. aureus Mu50
aaugauaucugacauuucauc

SEQ ID NO: 2038085 - RNA, 20 nt, Staphylococcus aureus subsp. aureus Mu50
aaugauacauuauuaaauag

SEQ ID NO: 2038086 - RNA, 17 nt, Staphylococcus aureus subsp. aureus Mu50
aaugauaccuuuaaauc

SEQ ID NO: 2038087 - RNA, 16 nt, Staphylococcus aureus subsp. aureus Mu50
aaugauaaagagccac

SEQ ID NO: 2038088 - RNA, 18 nt, Staphylococcus aureus subsp. aureus Mu50
aaugauauuaccuucaag

SEQ ID NO: 2038089 - RNA, 12 nt, Staphylococcus aureus subsp. aureus Mu50
aaugauuuauaa

SEQ ID NO: 2038090 - RNA, 18 nt, Staphylococcus aureus subsp. aureus Mu50
aaugauuuuauaauauua

SEQ ID NO: 2038091 - RNA, 20 nt, Staphylococcus aureus subsp. aureus Mu50
aaugauuuuauaauauuauu

SEQ ID NO: 2038092 - RNA, 16 nt, Staphylococcus aureus subsp. aureus Mu50
aaugauuguuuuaagu

SEQ ID NO: 2038093 - RNA, 15 nt, Staphylococcus aureus subsp. aureus Mu50
aaugauguauuuuag

SEQ ID NO: 2038094 - RNA, 15 nt, Staphylococcus aureus subsp. aureus Mu50
aaugauuaaaguguu

SEQ ID NO: 2038095 - RNA, 15 nt, Staphylococcus aureus subsp. aureus Mu50
aaucuuaguuaaaau

SEQ ID NO: 2038096 - RNA, 17 nt, Staphylococcus aureus subsp. aureus Mu50
aaucuuaucauaaucuu

SEQ ID NO: 2038097 - RNA, 14 nt, Staphylococcus aureus subsp. aureus Mu50
aaucuuauuuuguu

SEQ ID NO: 2038098 - RNA, 12 nt, Staphylococcus aureus subsp. aureus Mu50
aaugagauuauu

SEQ ID NO: 2038099 - RNA, 12 nt, Staphylococcus aureus subsp. aureus Mu50
aaucuucgucau

SEQ ID NO: 2038100 - RNA, 17 nt, Staphylococcus aureus subsp. aureus Mu50
aaucuucauuaauuaca

SEQ ID NO: 2038101 - RNA, 17 nt, Staphylococcus aureus subsp. aureus Mu50
aaucucguuuuuacaug

SEQ ID NO: 2038102 - RNA, 22 nt, Staphylococcus aureus subsp. aureus Mu50
aaucucucgcuaaauuuauaua

SEQ ID NO: 2038103 - RNA, 15 nt, Staphylococcus aureus subsp. aureus Mu50
aaucuccuugcucau

SEQ ID NO: 2038104 - RNA, 20 nt, Staphylococcus aureus subsp. aureus Mu50
aaucucggcauuuuuauauu

SEQ ID NO: 2038105 - RNA, 21 nt, Staphylococcus aureus subsp. aureus Mu50
aaucucgucacauauaaauau

SEQ ID NO: 2038106 - RNA, 19 nt, Staphylococcus aureus subsp. aureus Mu50
aauggcaccauacuucguu

SEQ ID NO: 2038107 - RNA, 20 nt, Staphylococcus aureus subsp. aureus Mu50
aauggcaauuaaaacuauaa

SEQ ID NO: 2038108 - RNA, 14 nt, Staphylococcus aureus subsp. aureus Mu50
aauggcaccauacu

SEQ ID NO: 2038109 - RNA, 17 nt, Staphylococcus aureus subsp. aureus Mu50
aauguaaauaaaaauua

SEQ ID NO: 2038110 - RNA, 18 nt, Staphylococcus aureus subsp. aureus Mu50
aauguaagcgaauacaau

SEQ ID NO: 2038111 - RNA, 20 nt, Staphylococcus aureus subsp. aureus Mu50
aauguaagcgaauacaauag

SEQ ID NO: 2038112 - RNA, 16 nt, Staphylococcus aureus subsp. aureus Mu50
aauguaaugauacaaa

SEQ ID NO: 2038113 - RNA, 18 nt, Staphylococcus aureus subsp. aureus Mu50
aaugucgauauuucuagu

SEQ ID NO: 2038114 - RNA, 14 nt, Staphylococcus aureus subsp. aureus Mu50
aauguagauuacuu

SEQ ID NO: 2038115 - RNA, 23 nt, Staphylococcus aureus subsp. aureus Mu50
aauguaggcgccauaaucauuag

SEQ ID NO: 2038116 - RNA, 19 nt, Staphylococcus aureus subsp. aureus Mu50
aauguaucaagaucaacaa

SEQ ID NO: 2038117 - RNA, 15 nt, Staphylococcus aureus subsp. aureus Mu50
aauguaucacuugga

SEQ ID NO: 2038118 - RNA, 17 nt, Staphylococcus aureus subsp. aureus Mu50
aauguacauguauaaaa

SEQ ID NO: 2038119 - RNA, 15 nt, Staphylococcus aureus subsp. aureus Mu50
aauguacuaggaccu

SEQ ID NO: 2038120 - RNA, 13 nt, Staphylococcus aureus subsp. aureus Mu50
aauguacuucaau

SEQ ID NO: 2038121 - RNA, 18 nt, Staphylococcus aureus subsp. aureus Mu50
aauguacuucaauuuaug

SEQ ID NO: 2038122 - RNA, 15 nt, Staphylococcus aureus subsp. aureus Mu50
aauguacuuuucugu

SEQ ID NO: 2038123 - RNA, 20 nt, Staphylococcus aureus subsp. aureus Mu50
aauaaguaauaauuuauuga

SEQ ID NO: 2038124 - RNA, 15 nt, Staphylococcus aureus subsp. aureus Mu50
aauaagugauaaaua

SEQ ID NO: 2038125 - RNA, 21 nt, Staphylococcus aureus subsp. aureus Mu50
aauaagguauggcuagucuuu

SEQ ID NO: 2038126 - RNA, 14 nt, Staphylococcus aureus subsp. aureus Mu50
aauaagcgcaauua

SEQ ID NO: 2038127 - RNA, 20 nt, Staphylococcus aureus subsp. aureus Mu50
aauaaggaagcguaugaugu

SEQ ID NO: 2038128 - RNA, 20 nt, Staphylococcus aureus subsp. aureus Mu50
aauaagacuucccuauaugu

SEQ ID NO: 2038129 - RNA, 20 nt, Staphylococcus aureus subsp. aureus Mu50
aauaacugcuaauuuuuuca

SEQ ID NO: 2038130 - RNA, 21 nt, Staphylococcus aureus subsp. aureus Mu50
aauaacucgcuucguucuaaa

SEQ ID NO: 2038131 - RNA, 17 nt, Staphylococcus aureus subsp. aureus Mu50
aauaaaaguuaccuacu

SEQ ID NO: 2038132 - RNA, 14 nt, Staphylococcus aureus subsp. aureus Mu50
aauaaaaugcaaag

SEQ ID NO: 2038133 - RNA, 14 nt, Staphylococcus aureus subsp. aureus Mu50
aauaaaaugcuaca

SEQ ID NO: 2038134 - RNA, 15 nt, Staphylococcus aureus subsp. aureus Mu50
aaguuuuugaauauc

SEQ ID NO: 2038135 - RNA, 23 nt, Staphylococcus aureus subsp. aureus Mu50
aaguuuccaacguuauucguuaa

SEQ ID NO: 2038136 - RNA, 22 nt, Staphylococcus aureus subsp. aureus Mu50
aaguuucggaaaaagaugaaaa

SEQ ID NO: 2038137 - RNA, 18 nt, Staphylococcus aureus subsp. aureus Mu50
aaguuuauacuuaauaua

SEQ ID NO: 2038138 - RNA, 14 nt, Staphylococcus aureus subsp. aureus Mu50
aaguuuauuuaugu

SEQ ID NO: 2038139 - RNA, 14 nt, Staphylococcus aureus subsp. aureus Mu50
aagucagcuuacaa

SEQ ID NO: 2038140 - RNA, 16 nt, Staphylococcus aureus subsp. aureus Mu50
aagucagucaauucaa

SEQ ID NO: 2038141 - RNA, 22 nt, Staphylococcus aureus subsp. aureus Mu50
aagucaguuaacggcguauuca

SEQ ID NO: 2038142 - RNA, 18 nt, Staphylococcus aureus subsp. aureus Mu50
aauaccuaaccauaacaa

SEQ ID NO: 2038143 - RNA, 15 nt, Staphylococcus aureus subsp. aureus Mu50
aauaccgaauaauuu

SEQ ID NO: 2038144 - RNA, 21 nt, Staphylococcus aureus subsp. aureus Mu50
aauaccauugugaugauaauu

SEQ ID NO: 2038145 - RNA, 20 nt, Staphylococcus aureus subsp. aureus Mu50
aauacccuacuauauaucac

SEQ ID NO: 2038146 - RNA, 22 nt, Staphylococcus aureus subsp. aureus Mu50
aauaccuuuuucuaaaccaaca

SEQ ID NO: 2038147 - RNA, 13 nt, Staphylococcus aureus subsp. aureus Mu50
aauacgauaauaa

SEQ ID NO: 2038148 - RNA, 21 nt, Staphylococcus aureus subsp. aureus Mu50
aauacgaaguguuauaaauag

SEQ ID NO: 2038149 - RNA, 22 nt, Staphylococcus aureus subsp. aureus Mu50
aauagaaaugacgauaccuuua

SEQ ID NO: 2038150 - RNA, 15 nt, Staphylococcus aureus subsp. aureus Mu50
aauagaacgaaauag

SEQ ID NO: 2038151 - RNA, 22 nt, Staphylococcus aureus subsp. aureus Mu50
aauagaugagaaaguaaaaguu

SEQ ID NO: 2038152 - RNA, 21 nt, Staphylococcus aureus subsp. aureus Mu50
aauagaugucacuguuaaaga

SEQ ID NO: 2038153 - RNA, 13 nt, Staphylococcus aureus subsp. aureus Mu50
aauagauugaaaa

SEQ ID NO: 2038154 - RNA, 20 nt, Staphylococcus aureus subsp. aureus Mu50
aauagauuuagaaacaaucg

SEQ ID NO: 2038155 - RNA, 14 nt, Staphylococcus aureus subsp. aureus Mu50
aauaccauaauuaa

SEQ ID NO: 2038156 - RNA, 14 nt, Staphylococcus aureus subsp. aureus Mu50
aauacauccauacu

SEQ ID NO: 2038157 - RNA, 21 nt, Staphylococcus aureus subsp. aureus Mu50
aauacauccauacuucuauuu

SEQ ID NO: 2038158 - RNA, 15 nt, Staphylococcus aureus subsp. aureus Mu50
aauacaucuaauaaa

SEQ ID NO: 2038159 - RNA, 20 nt, Staphylococcus aureus subsp. aureus Mu50
aauacaucuaauaaauauag

SEQ ID NO: 2038160 - RNA, 16 nt, Staphylococcus aureus subsp. aureus Mu50
aauacauaauaaaaag

SEQ ID NO: 2038161 - RNA, 13 nt, Staphylococcus aureus subsp. aureus Mu50
aauacauaaucau

SEQ ID NO: 2038162 - RNA, 15 nt, Staphylococcus aureus subsp. aureus Mu50
aauacaaugaauugu

SEQ ID NO: 2038163 - RNA, 13 nt, Staphylococcus aureus subsp. aureus Mu50
aauacaauuucuu

SEQ ID NO: 2038164 - RNA, 18 nt, Staphylococcus aureus subsp. aureus Mu50
aauacaauuucuucauuu

SEQ ID NO: 2038165 - RNA, 17 nt, Staphylococcus aureus subsp. aureus Mu50
aauaauuuaacuaauca

SEQ ID NO: 2038166 - RNA, 19 nt, Staphylococcus aureus subsp. aureus Mu50
aauaauuucggauuaucug

SEQ ID NO: 2038167 - RNA, 13 nt, Staphylococcus aureus subsp. aureus Mu50
aauacaaauauua

SEQ ID NO: 2038168 - RNA, 18 nt, Staphylococcus aureus subsp. aureus Mu50
aauaaguugucaucuaau

SEQ ID NO: 2038169 - RNA, 13 nt, Staphylococcus aureus subsp. aureus Mu50
aauaauaaaauag

SEQ ID NO: 2038170 - RNA, 15 nt, Staphylococcus aureus subsp. aureus Mu50
aauaauacgcuugau

SEQ ID NO: 2038171 - RNA, 18 nt, Staphylococcus aureus subsp. aureus Mu50
aauaauacuacauauaau

SEQ ID NO: 2038172 - RNA, 14 nt, Staphylococcus aureus subsp. aureus Mu50
aauaauagauaaua

SEQ ID NO: 2038173 - RNA, 13 nt, Staphylococcus aureus subsp. aureus Mu50
aauaauuuaaagg

SEQ ID NO: 2038174 - RNA, 15 nt, Staphylococcus aureus subsp. aureus Mu50
aauaauuuaacuaau

SEQ ID NO: 2038175 - RNA, 15 nt, Staphylococcus aureus subsp. aureus Mu50
aaguaccuaaaauag

SEQ ID NO: 2038176 - RNA, 19 nt, Staphylococcus aureus subsp. aureus Mu50
aaguaccuaaaauagaaaa

SEQ ID NO: 2038177 - RNA, 17 nt, Staphylococcus aureus subsp. aureus Mu50
aaguaauggauugauaa

SEQ ID NO: 2038178 - RNA, 18 nt, Staphylococcus aureus subsp. aureus Mu50
aaguagauugauauccuu

SEQ ID NO: 2038179 - RNA, 16 nt, Staphylococcus aureus subsp. aureus Mu50
aaguagacauugaaua

SEQ ID NO: 2038180 - RNA, 16 nt, Staphylococcus aureus subsp. aureus Mu50
aaguacuuuaccacga

SEQ ID NO: 2038181 - RNA, 16 nt, Staphylococcus aureus subsp. aureus Mu50
aaguaaugauacgcac

SEQ ID NO: 2038182 - RNA, 14 nt, Staphylococcus aureus subsp. aureus Mu50
aaguauagcuuuua

SEQ ID NO: 2038183 - RNA, 14 nt, Staphylococcus aureus subsp. aureus Mu50
aaguauauacuaau

SEQ ID NO: 2038184 - RNA, 14 nt, Staphylococcus aureus subsp. aureus Mu50
aaguauaucuuuga

SEQ ID NO: 2038185 - RNA, 20 nt, Staphylococcus aureus subsp. aureus Mu50
aaguauaugaaucgauauaa

SEQ ID NO: 2038186 - RNA, 20 nt, Staphylococcus aureus subsp. aureus Mu50
aaguauauugcuuauguaca

SEQ ID NO: 2038187 - RNA, 17 nt, Staphylococcus aureus subsp. aureus Mu50
aaguaucauaauuuugu

SEQ ID NO: 2038188 - RNA, 18 nt, Staphylococcus aureus subsp. aureus Mu50
aaguaucgccaaucuauu

SEQ ID NO: 2038189 - RNA, 17 nt, Staphylococcus aureus subsp. aureus Mu50
aaguaguggauaaucac

SEQ ID NO: 2038190 - RNA, 15 nt, Staphylococcus aureus subsp. aureus Mu50
aagucaauuuaaaua

SEQ ID NO: 2038191 - RNA, 23 nt, Staphylococcus aureus subsp. aureus Mu50
aaguauuuucuuaguuugacauc

SEQ ID NO: 2038192 - RNA, 19 nt, Staphylococcus aureus subsp. aureus Mu50
aaguauugccaaauuucuc

SEQ ID NO: 2038193 - RNA, 21 nt, Staphylococcus aureus subsp. aureus Mu50
aaguauugccguuauuuucaa

SEQ ID NO: 2038194 - RNA, 13 nt, Staphylococcus aureus subsp. aureus Mu50
aaguauuacuuua

SEQ ID NO: 2038195 - RNA, 17 nt, Staphylococcus aureus subsp. aureus Mu50
aaguaugauagaugaua

SEQ ID NO: 2038196 - RNA, 21 nt, Staphylococcus aureus subsp. aureus Mu50
aaguaugauagaugauacauu

SEQ ID NO: 2038197 - RNA, 23 nt, Staphylococcus aureus subsp. aureus Mu50
aagggguuuuuucuuauguauau

SEQ ID NO: 2038198 - RNA, 18 nt, Staphylococcus aureus subsp. aureus Mu50
aagguuaaauauuuaauu

SEQ ID NO: 2038199 - RNA, 13 nt, Staphylococcus aureus subsp. aureus Mu50
aagguguugaaaa

SEQ ID NO: 2038200 - RNA, 14 nt, Staphylococcus aureus subsp. aureus Mu50
aaguaaucauaaua

SEQ ID NO: 2038201 - RNA, 15 nt, Staphylococcus aureus subsp. aureus Mu50
aaguaaguaaaauaa

SEQ ID NO: 2038202 - RNA, 20 nt, Staphylococcus aureus subsp. aureus Mu50
aaguaauaauuuauugauaa

SEQ ID NO: 2038203 - RNA, 18 nt, Staphylococcus aureus subsp. aureus Mu50
aaguaagcagagccauaa

SEQ ID NO: 2038204 - RNA, 22 nt, Staphylococcus aureus subsp. aureus Mu50
aaguaaagggagguauauacaa

SEQ ID NO: 2038205 - RNA, 21 nt, Staphylococcus aureus subsp. aureus Mu50
aagggagcauuucauuaguuu

SEQ ID NO: 2038206 - RNA, 13 nt, Staphylococcus aureus subsp. aureus Mu50
aagcuguuuauug

SEQ ID NO: 2038207 - RNA, 14 nt, Staphylococcus aureus subsp. aureus Mu50
aagcuuauuaaauc

SEQ ID NO: 2038208 - RNA, 18 nt, Staphylococcus aureus subsp. aureus Mu50
aagcuucacuugaaguga

SEQ ID NO: 2038209 - RNA, 21 nt, Staphylococcus aureus subsp. aureus Mu50
aagcuucauuucccuuaaauc

SEQ ID NO: 2038210 - RNA, 20 nt, Staphylococcus aureus subsp. aureus Mu50
aagcuuguaacaagcauuuu

SEQ ID NO: 2038211 - RNA, 21 nt, Staphylococcus aureus subsp. aureus Mu50
aagaguacagcgguuuguaug

SEQ ID NO: 2038212 - RNA, 15 nt, Staphylococcus aureus subsp. aureus Mu50
aagauacuuuuaaau

SEQ ID NO: 2038213 - RNA, 17 nt, Staphylococcus aureus subsp. aureus Mu50
aagauagauaaaucaag

SEQ ID NO: 2038214 - RNA, 24 nt, Staphylococcus aureus subsp. aureus Mu50
aagagccacuaaugauuuauuaug

SEQ ID NO: 2038215 - RNA, 22 nt, Staphylococcus aureus subsp. aureus Mu50
aacuagauguucacauucuuga

SEQ ID NO: 2038216 - RNA, 16 nt, Staphylococcus aureus subsp. aureus Mu50
aacuacacuuaauaua

SEQ ID NO: 2038217 - RNA, 15 nt, Staphylococcus aureus subsp. aureus Mu50
aacuauaaccuauua

SEQ ID NO: 2038218 - RNA, 19 nt, Staphylococcus aureus subsp. aureus Mu50
aacuaacuaauaacucgcu

SEQ ID NO: 2038219 - RNA, 18 nt, Staphylococcus aureus subsp. aureus Mu50
aacguuauucauuugugu

SEQ ID NO: 2038220 - RNA, 22 nt, Staphylococcus aureus subsp. aureus Mu50
aagauuuguagcuugaauaaua

SEQ ID NO: 2038221 - RNA, 22 nt, Staphylococcus aureus subsp. aureus Mu50
aagauuuuguugaacguuuauu

SEQ ID NO: 2038222 - RNA, 20 nt, Staphylococcus aureus subsp. aureus Mu50
aagcaauacgauugcaauug

SEQ ID NO: 2038223 - RNA, 16 nt, Staphylococcus aureus subsp. aureus Mu50
aagauauguuuauauu

SEQ ID NO: 2038224 - RNA, 21 nt, Staphylococcus aureus subsp. aureus Mu50
aagauauguuuauauugcaaa

SEQ ID NO: 2038225 - RNA, 16 nt, Staphylococcus aureus subsp. aureus Mu50
aagaucaacaaugcca

SEQ ID NO: 2038226 - RNA, 22 nt, Staphylococcus aureus subsp. aureus Mu50
aagauagguuuauuucugacaa

SEQ ID NO: 2038227 - RNA, 20 nt, Staphylococcus aureus subsp. aureus Mu50
aagaucauuuucaacauaau

SEQ ID NO: 2038228 - RNA, 16 nt, Staphylococcus aureus subsp. aureus Mu50
aagaucgauacuuuuu

SEQ ID NO: 2038229 - RNA, 15 nt, Staphylococcus aureus subsp. aureus Mu50
aagaugcucauugca

SEQ ID NO: 2038230 - RNA, 19 nt, Staphylococcus aureus subsp. aureus Mu50
aagauggcugcaucaauau

SEQ ID NO: 2038231 - RNA, 15 nt, Staphylococcus aureus subsp. aureus Mu50
aagcaucgauuuauu

SEQ ID NO: 2038232 - RNA, 21 nt, Staphylococcus aureus subsp. aureus Mu50
aagcaucuucaauauuuaaau

SEQ ID NO: 2038233 - RNA, 16 nt, Staphylococcus aureus subsp. aureus Mu50
aagcaucaugaaauua

SEQ ID NO: 2038234 - RNA, 13 nt, Staphylococcus aureus subsp. aureus Mu50
aagccuuaauauc

SEQ ID NO: 2038235 - RNA, 20 nt, Staphylococcus aureus subsp. aureus Mu50
aagccuuaauaucaugcaca

SEQ ID NO: 2038236 - RNA, 14 nt, Staphylococcus aureus subsp. aureus Mu50
aagccuucuauaua

SEQ ID NO: 2038237 - RNA, 16 nt, Staphylococcus aureus subsp. aureus Mu50
aagcguccucuuguga

SEQ ID NO: 2038238 - RNA, 18 nt, Staphylococcus aureus subsp. aureus Mu50
aagcgucuuuuuuguaug

SEQ ID NO: 2038239 - RNA, 14 nt, Staphylococcus aureus subsp. aureus Mu50
aagcuaauucauau

SEQ ID NO: 2038240 - RNA, 13 nt, Staphylococcus aureus subsp. aureus Mu50
aagcuauacucau

SEQ ID NO: 2038241 - RNA, 14 nt, Staphylococcus aureus subsp. aureus Mu50
aagcugaaaaucau

SEQ ID NO: 2038242 - RNA, 13 nt, Staphylococcus aureus subsp. aureus Mu50
aagcugauuaaaa

SEQ ID NO: 2038243 - RNA, 15 nt, Staphylococcus aureus subsp. aureus Mu50
aagcugauuaaaaug

SEQ ID NO: 2038244 - RNA, 22 nt, Staphylococcus aureus subsp. aureus Mu50
acccauacucugggcauuuuga

SEQ ID NO: 2038245 - RNA, 21 nt, Staphylococcus aureus subsp. aureus Mu50
acccacacagguaaauuuaaa

SEQ ID NO: 2038246 - RNA, 16 nt, Staphylococcus aureus subsp. aureus Mu50
accauuuuuagaaaua

SEQ ID NO: 2038247 - RNA, 14 nt, Staphylococcus aureus subsp. aureus Mu50
acccaaaaaauugu

SEQ ID NO: 2038248 - RNA, 13 nt, Staphylococcus aureus subsp. aureus Mu50
acccuuuaaacau

SEQ ID NO: 2038249 - RNA, 14 nt, Staphylococcus aureus subsp. aureus Mu50
aaaauggauuuggu

SEQ ID NO: 2038250 - RNA, 12 nt, Staphylococcus aureus subsp. aureus Mu50
aaaauguuaaua

SEQ ID NO: 2038251 - RNA, 14 nt, Staphylococcus aureus subsp. aureus Mu50
aaaauguuaauaau

SEQ ID NO: 2038252 - RNA, 20 nt, Staphylococcus aureus subsp. aureus Mu50
aaaaugcucaaguugauuau

SEQ ID NO: 2038253 - RNA, 21 nt, Staphylococcus aureus subsp. aureus Mu50
aaaaugcucaaguugauuauu

SEQ ID NO: 2038254 - RNA, 19 nt, Staphylococcus aureus subsp. aureus Mu50
accaccugauaaugcaugu

SEQ ID NO: 2038255 - RNA, 15 nt, Staphylococcus aureus subsp. aureus Mu50
accaccccaacuugc

SEQ ID NO: 2038256 - RNA, 24 nt, Staphylococcus aureus subsp. aureus Mu50
accaauuaauuguaaagcaugaau

SEQ ID NO: 2038257 - RNA, 21 nt, Staphylococcus aureus subsp. aureus Mu50
accaauugaaauuaacuguau

SEQ ID NO: 2038258 - RNA, 15 nt, Staphylococcus aureus subsp. aureus Mu50
accagcuaaaccauc

SEQ ID NO: 2038259 - RNA, 22 nt, Staphylococcus aureus subsp. aureus Mu50
accagcucguuuuuucauugua

SEQ ID NO: 2038260 - RNA, 20 nt, Staphylococcus aureus subsp. aureus Mu50
accaaugaauaaauugauau

SEQ ID NO: 2038261 - RNA, 11 nt, Staphylococcus aureus subsp. aureus Mu50
accaaucgaag

SEQ ID NO: 2038262 - RNA, 14 nt, Staphylococcus aureus subsp. aureus Mu50
accaauaauccgag

SEQ ID NO: 2038263 - RNA, 23 nt, Staphylococcus aureus subsp. aureus Mu50
accaaaugugguggguauauaau

SEQ ID NO: 2038264 - RNA, 16 nt, Staphylococcus aureus subsp. aureus Mu50
accaacaacuuuguuu

SEQ ID NO: 2038265 - RNA, 21 nt, Staphylococcus aureus subsp. aureus Mu50
acauuuuuauacaacuucacu

SEQ ID NO: 2038266 - RNA, 18 nt, Staphylococcus aureus subsp. aureus Mu50
accaaaaaacagaggucu

SEQ ID NO: 2038267 - RNA, 21 nt, Staphylococcus aureus subsp. aureus Mu50
acauuuauuuucaauaaauaa

SEQ ID NO: 2038268 - RNA, 12 nt, Staphylococcus aureus subsp. aureus Mu50
acauuuucaaaa

SEQ ID NO: 2038269 - RNA, 12 nt, Staphylococcus aureus subsp. aureus Mu50
acauuuuaaauc

SEQ ID NO: 2038270 - RNA, 15 nt, Staphylococcus aureus subsp. aureus Mu50
acauuguuuagucuu

SEQ ID NO: 2038271 - RNA, 12 nt, Staphylococcus aureus subsp. aureus Mu50
acauuuaaauau

SEQ ID NO: 2038272 - RNA, 15 nt, Staphylococcus aureus subsp. aureus Mu50
acauugugaaaguuu

SEQ ID NO: 2038273 - RNA, 18 nt, Staphylococcus aureus subsp. aureus Mu50
acauuggauuacuuccau

SEQ ID NO: 2038274 - RNA, 13 nt, Staphylococcus aureus subsp. aureus Mu50
acauuguaaauau

SEQ ID NO: 2038275 - RNA, 21 nt, Staphylococcus aureus subsp. aureus Mu50
acauucuuauuugaaaugaua

SEQ ID NO: 2038276 - RNA, 21 nt, Staphylococcus aureus subsp. aureus Mu50
acauucuucaaaaaauaauag

SEQ ID NO: 2038277 - RNA, 21 nt, Staphylococcus aureus subsp. aureus Mu50
acauugaacgauaacaauuua

SEQ ID NO: 2038278 - RNA, 22 nt, Staphylococcus aureus subsp. aureus Mu50
acauucauaccgaagaaacuaa

SEQ ID NO: 2038279 - RNA, 20 nt, Staphylococcus aureus subsp. aureus Mu50
acauucauuuaguuaaauac

SEQ ID NO: 2038280 - RNA, 22 nt, Staphylococcus aureus subsp. aureus Mu50
acauucccuuaauaauaaguau

SEQ ID NO: 2038281 - RNA, 16 nt, Staphylococcus aureus subsp. aureus Mu50
acauuagcaugauaaa

SEQ ID NO: 2038282 - RNA, 21 nt, Staphylococcus aureus subsp. aureus Mu50
acauuauaauggacuaauuua

SEQ ID NO: 2038283 - RNA, 22 nt, Staphylococcus aureus subsp. aureus Mu50
acauuaacaaggccugcaucac

SEQ ID NO: 2038284 - RNA, 13 nt, Staphylococcus aureus subsp. aureus Mu50
acauuaaguuaaa

SEQ ID NO: 2038285 - RNA, 19 nt, Staphylococcus aureus subsp. aureus Mu50
acauguauuggccaaacaa

SEQ ID NO: 2038286 - RNA, 22 nt, Staphylococcus aureus subsp. aureus Mu50
acauguauuuaguaucaugaua

SEQ ID NO: 2038287 - RNA, 19 nt, Staphylococcus aureus subsp. aureus Mu50
acauuaaaacaauaauuua

SEQ ID NO: 2038288 - RNA, 19 nt, Staphylococcus aureus subsp. aureus Mu50
acauguaacaaaauacccu

SEQ ID NO: 2038289 - RNA, 14 nt, Staphylococcus aureus subsp. aureus Mu50
acaugguaucuuua

SEQ ID NO: 2038290 - RNA, 19 nt, Staphylococcus aureus subsp. aureus Mu50
acauguacaauuuuuaaaa

SEQ ID NO: 2038291 - RNA, 21 nt, Staphylococcus aureus subsp. aureus Mu50
acauguacguuuuuuuaaaua

SEQ ID NO: 2038292 - RNA, 17 nt, Staphylococcus aureus subsp. aureus Mu50
acauccucauaauuauc

SEQ ID NO: 2038293 - RNA, 19 nt, Staphylococcus aureus subsp. aureus Mu50
acauccucauaauuaucau

SEQ ID NO: 2038294 - RNA, 16 nt, Staphylococcus aureus subsp. aureus Mu50
acaucauuucugaagu

SEQ ID NO: 2038295 - RNA, 17 nt, Staphylococcus aureus subsp. aureus Mu50
acaucauuaaauauuua

SEQ ID NO: 2038296 - RNA, 15 nt, Staphylococcus aureus subsp. aureus Mu50
acaucuaauaaauau

SEQ ID NO: 2038297 - RNA, 13 nt, Staphylococcus aureus subsp. aureus Mu50
acaucugaaaaaa

SEQ ID NO: 2038298 - RNA, 16 nt, Staphylococcus aureus subsp. aureus Mu50
acaugaacaaauaauu

SEQ ID NO: 2038299 - RNA, 14 nt, Staphylococcus aureus subsp. aureus Mu50
acaucuucauguau

SEQ ID NO: 2038300 - RNA, 15 nt, Staphylococcus aureus subsp. aureus Mu50
acaugauucaugaua

SEQ ID NO: 2038301 - RNA, 11 nt, Staphylococcus aureus subsp. aureus Mu50
acaugagauua

SEQ ID NO: 2038302 - RNA, 12 nt, Staphylococcus aureus subsp. aureus Mu50
acauauaaauca

SEQ ID NO: 2038303 - RNA, 13 nt, Staphylococcus aureus subsp. aureus Mu50
acauauaauaugu

SEQ ID NO: 2038304 - RNA, 16 nt, Staphylococcus aureus subsp. aureus Mu50
acauagaccuuuauuu

SEQ ID NO: 2038305 - RNA, 12 nt, Staphylococcus aureus subsp. aureus Mu50
acauacagucaa

SEQ ID NO: 2038306 - RNA, 15 nt, Staphylococcus aureus subsp. aureus Mu50
acauacagucaauac

SEQ ID NO: 2038307 - RNA, 12 nt, Staphylococcus aureus subsp. aureus Mu50
acauauuuucac

SEQ ID NO: 2038308 - RNA, 15 nt, Staphylococcus aureus subsp. aureus Mu50
acauauuuuuuaaau

SEQ ID NO: 2038309 - RNA, 19 nt, Staphylococcus aureus subsp. aureus Mu50
acauauucauaauaucgau

SEQ ID NO: 2038310 - RNA, 22 nt, Staphylococcus aureus subsp. aureus Mu50
acaucacuugcuguugcaauaa

SEQ ID NO: 2038311 - RNA, 21 nt, Staphylococcus aureus subsp. aureus Mu50
acaucacuauacgcaaucauu

SEQ ID NO: 2038312 - RNA, 23 nt, Staphylococcus aureus subsp. aureus Mu50
acaguaaucaugcauucuaugau

SEQ ID NO: 2038313 - RNA, 15 nt, Staphylococcus aureus subsp. aureus Mu50
acaguacaaauaaca

SEQ ID NO: 2038314 - RNA, 15 nt, Staphylococcus aureus subsp. aureus Mu50
acagguaaauuuaaa

SEQ ID NO: 2038315 - RNA, 16 nt, Staphylococcus aureus subsp. aureus Mu50
aauuuucauuguuuca

SEQ ID NO: 2038316 - RNA, 14 nt, Staphylococcus aureus subsp. aureus Mu50
aauuuucucauuaa

SEQ ID NO: 2038317 - RNA, 18 nt, Staphylococcus aureus subsp. aureus Mu50
acaaaauacccugcuuua

SEQ ID NO: 2038318 - RNA, 13 nt, Staphylococcus aureus subsp. aureus Mu50
aauuuuguaauua

SEQ ID NO: 2038319 - RNA, 15 nt, Staphylococcus aureus subsp. aureus Mu50
aauuugucauuucuu

SEQ ID NO: 2038320 - RNA, 14 nt, Staphylococcus aureus subsp. aureus Mu50
aauuuguaaagaca

SEQ ID NO: 2038321 - RNA, 13 nt, Staphylococcus aureus subsp. aureus Mu50
aauuuguaauucc

SEQ ID NO: 2038322 - RNA, 19 nt, Staphylococcus aureus subsp. aureus Mu50
aauuuguguucaaaucaca

SEQ ID NO: 2038323 - RNA, 18 nt, Staphylococcus aureus subsp. aureus Mu50
aauuuguuuuauuuucga

SEQ ID NO: 2038324 - RNA, 12 nt, Staphylococcus aureus subsp. aureus Mu50
aauuuuaauauu

SEQ ID NO: 2038325 - RNA, 15 nt, Staphylococcus aureus subsp. aureus Mu50
aauuuuaccaucaau

SEQ ID NO: 2038326 - RNA, 23 nt, Staphylococcus aureus subsp. aureus Mu50
aauuuuagugaaugggucauuaa

SEQ ID NO: 2038327 - RNA, 20 nt, Staphylococcus aureus subsp. aureus Mu50
aauuuuauaaauuaaaugca

SEQ ID NO: 2038328 - RNA, 16 nt, Staphylococcus aureus subsp. aureus Mu50
aauuuuagccaaauua

SEQ ID NO: 2038329 - RNA, 17 nt, Staphylococcus aureus subsp. aureus Mu50
acaaacgcacugcugca

SEQ ID NO: 2038330 - RNA, 22 nt, Staphylococcus aureus subsp. aureus Mu50
acaaaaucaccuuuuuuaacuu

SEQ ID NO: 2038331 - RNA, 18 nt, Staphylococcus aureus subsp. aureus Mu50
acaaagaaauuaaaguag

SEQ ID NO: 2038332 - RNA, 21 nt, Staphylococcus aureus subsp. aureus Mu50
acaaagaaccacgcaucaugu

SEQ ID NO: 2038333 - RNA, 13 nt, Staphylococcus aureus subsp. aureus Mu50
acgcauuaaugau

SEQ ID NO: 2038334 - RNA, 18 nt, Staphylococcus aureus subsp. aureus Mu50
acgccaaucacaauauaa

SEQ ID NO: 2038335 - RNA, 13 nt, Staphylococcus aureus subsp. aureus Mu50
acgcauuuuaaau

SEQ ID NO: 2038336 - RNA, 14 nt, Staphylococcus aureus subsp. aureus Mu50
accuucauuuucaa

SEQ ID NO: 2038337 - RNA, 23 nt, Staphylococcus aureus subsp. aureus Mu50
accuucccagucaugucccauaa

SEQ ID NO: 2038338 - RNA, 18 nt, Staphylococcus aureus subsp. aureus Mu50
accuucuucuacccauaa

SEQ ID NO: 2038339 - RNA, 16 nt, Staphylococcus aureus subsp. aureus Mu50
accuucgagugcuuuu

SEQ ID NO: 2038340 - RNA, 17 nt, Staphylococcus aureus subsp. aureus Mu50
accuucgagugcuuuua

SEQ ID NO: 2038341 - RNA, 16 nt, Staphylococcus aureus subsp. aureus Mu50
accugugauaaaaauc

SEQ ID NO: 2038342 - RNA, 17 nt, Staphylococcus aureus subsp. aureus Mu50
accugucuuaauucauu

SEQ ID NO: 2038343 - RNA, 15 nt, Staphylococcus aureus subsp. aureus Mu50
accuucaaucaacga

SEQ ID NO: 2038344 - RNA, 19 nt, Staphylococcus aureus subsp. aureus Mu50
accuguuauugcaauaaaa

SEQ ID NO: 2038345 - RNA, 21 nt, Staphylococcus aureus subsp. aureus Mu50
acgauauuuuaaaaaguaauu

SEQ ID NO: 2038346 - RNA, 16 nt, Staphylococcus aureus subsp. aureus Mu50
acgaucauaaauauuu

SEQ ID NO: 2038347 - RNA, 14 nt, Staphylococcus aureus subsp. aureus Mu50
accugcuucuguaa

SEQ ID NO: 2038348 - RNA, 16 nt, Staphylococcus aureus subsp. aureus Mu50
accugcugaaguuuga

SEQ ID NO: 2038349 - RNA, 15 nt, Staphylococcus aureus subsp. aureus Mu50
aaaccaaaaaaucca

SEQ ID NO: 2038350 - RNA, 21 nt, Staphylococcus aureus subsp. aureus Mu50
aaacauguugauaaaaaggau

SEQ ID NO: 2038351 - RNA, 16 nt, Staphylococcus aureus subsp. aureus Mu50
aaacauuaaaauaauu

SEQ ID NO: 2038352 - RNA, 15 nt, Staphylococcus aureus subsp. aureus Mu50
aaacauuaaucuaua

SEQ ID NO: 2038353 - RNA, 19 nt, Staphylococcus aureus subsp. aureus Mu50
aaacaucguaaagaucauu

SEQ ID NO: 2038354 - RNA, 20 nt, Staphylococcus aureus subsp. aureus Mu50
aaacaucuaaauaguuuuuc

SEQ ID NO: 2038355 - RNA, 13 nt, Staphylococcus aureus subsp. aureus Mu50
acgcuaaaauuuc

SEQ ID NO: 2038356 - RNA, 15 nt, Staphylococcus aureus subsp. aureus Mu50
acgcugguaauauuu

SEQ ID NO: 2038357 - RNA, 14 nt, Staphylococcus aureus subsp. aureus Mu50
aaaccaauaauccg

SEQ ID NO: 2038358 - RNA, 17 nt, Staphylococcus aureus subsp. aureus Mu50
aaaccaccaaaaaucau

SEQ ID NO: 2038359 - RNA, 15 nt, Staphylococcus aureus subsp. aureus Mu50
aaaccauagauaauu

SEQ ID NO: 2038360 - RNA, 14 nt, Staphylococcus aureus subsp. aureus Mu50
acguacauuuuuau

SEQ ID NO: 2038361 - RNA, 14 nt, Staphylococcus aureus subsp. aureus Mu50
acguaaaauaugau

SEQ ID NO: 2038362 - RNA, 22 nt, Staphylococcus aureus subsp. aureus Mu50
acguucuucagguguaguagcu

SEQ ID NO: 2038363 - RNA, 23 nt, Staphylococcus aureus subsp. aureus Mu50
acguucuugguauuuuuuaaaug

SEQ ID NO: 2038364 - RNA, 18 nt, Staphylococcus aureus subsp. aureus Mu50
acguguauuguauuuuaa

SEQ ID NO: 2038365 - RNA, 18 nt, Staphylococcus aureus subsp. aureus Mu50
acuccguugaauucaacg

SEQ ID NO: 2038366 - RNA, 18 nt, Staphylococcus aureus subsp. aureus Mu50
acucauuagauaaaauaa

SEQ ID NO: 2038367 - RNA, 17 nt, Staphylococcus aureus subsp. aureus Mu50
acguugcagagaauaua

SEQ ID NO: 2038368 - RNA, 16 nt, Staphylococcus aureus subsp. aureus Mu50
acguugauuaacacau

SEQ ID NO: 2038369 - RNA, 15 nt, Staphylococcus aureus subsp. aureus Mu50
acuauggcauuauug

SEQ ID NO: 2038370 - RNA, 21 nt, Staphylococcus aureus subsp. aureus Mu50
acuauuaaauaaucgcccauc

SEQ ID NO: 2038371 - RNA, 21 nt, Staphylococcus aureus subsp. aureus Mu50
acucaacacgauagucauaac

SEQ ID NO: 2038372 - RNA, 16 nt, Staphylococcus aureus subsp. aureus Mu50
acucaaauauaaauaa

SEQ ID NO: 2038373 - RNA, 11 nt, Staphylococcus aureus subsp. aureus Mu50
acuauuuuuga

SEQ ID NO: 2038374 - RNA, 19 nt, Staphylococcus aureus subsp. aureus Mu50
acuauuuaaucuuaauauu

SEQ ID NO: 2038375 - RNA, 21 nt, Staphylococcus aureus subsp. aureus Mu50
acuauuuguuaugguauuuau

SEQ ID NO: 2038376 - RNA, 15 nt, Staphylococcus aureus subsp. aureus Mu50
acucacugcacuuau

SEQ ID NO: 2038377 - RNA, 16 nt, Staphylococcus aureus subsp. aureus Mu50
acucaccugcagcauc

SEQ ID NO: 2038378 - RNA, 14 nt, Staphylococcus aureus subsp. aureus Mu50
acuguaccaucacu

SEQ ID NO: 2038379 - RNA, 16 nt, Staphylococcus aureus subsp. aureus Mu50
acuguaaaucaucaua

SEQ ID NO: 2038380 - RNA, 19 nt, Staphylococcus aureus subsp. aureus Mu50
acuguaaaucaucauaacc

SEQ ID NO: 2038381 - RNA, 21 nt, Staphylococcus aureus subsp. aureus Mu50
acuguauaccucuuagcacuu

SEQ ID NO: 2038382 - RNA, 13 nt, Staphylococcus aureus subsp. aureus Mu50
acuucaccaucuu

SEQ ID NO: 2038383 - RNA, 17 nt, Staphylococcus aureus subsp. aureus Mu50
acuuauuuuucaucauu

SEQ ID NO: 2038384 - RNA, 18 nt, Staphylococcus aureus subsp. aureus Mu50
acuuauuuuucaucauuu

SEQ ID NO: 2038385 - RNA, 16 nt, Staphylococcus aureus subsp. aureus Mu50
acuucaacauauaaau

SEQ ID NO: 2038386 - RNA, 22 nt, Staphylococcus aureus subsp. aureus Mu50
acuuaucgccuggugcaggcau

SEQ ID NO: 2038387 - RNA, 23 nt, Staphylococcus aureus subsp. aureus Mu50
acuuauggguucaauaucgauuu

SEQ ID NO: 2038388 - RNA, 18 nt, Staphylococcus aureus subsp. aureus Mu50
acuuauuaauuaauagag

SEQ ID NO: 2038389 - RNA, 17 nt, Staphylococcus aureus subsp. aureus Mu50
acuuauuucuuuucauu

SEQ ID NO: 2038390 - RNA, 18 nt, Staphylococcus aureus subsp. aureus Mu50
acuucacuaggaucuuuu

SEQ ID NO: 2038391 - RNA, 14 nt, Staphylococcus aureus subsp. aureus Mu50
acuucguuauaugg

SEQ ID NO: 2038392 - RNA, 17 nt, Staphylococcus aureus subsp. aureus Mu50
acuucuauuaauaauuu

SEQ ID NO: 2038393 - RNA, 13 nt, Staphylococcus aureus subsp. aureus Mu50
acuucuauuuuau

SEQ ID NO: 2038394 - RNA, 21 nt, Staphylococcus aureus subsp. aureus Mu50
acuucucaauuuaguauaaau

SEQ ID NO: 2038395 - RNA, 11 nt, Staphylococcus aureus subsp. aureus Mu50
acuucucuauc

SEQ ID NO: 2038396 - RNA, 20 nt, Staphylococcus aureus subsp. aureus Mu50
acuuuaacauaucgcgcauc

SEQ ID NO: 2038397 - RNA, 22 nt, Staphylococcus aureus subsp. aureus Mu50
acuuuaacauaucgcgcaucaa

SEQ ID NO: 2038398 - RNA, 19 nt, Staphylococcus aureus subsp. aureus Mu50
acuuuagcauauucgcuua

SEQ ID NO: 2038399 - RNA, 13 nt, Staphylococcus aureus subsp. aureus Mu50
acuuguugauaua

SEQ ID NO: 2038400 - RNA, 13 nt, Staphylococcus aureus subsp. aureus Mu50
acuuguaauauaa

SEQ ID NO: 2038401 - RNA, 22 nt, Staphylococcus aureus subsp. aureus Mu50
acuuguccguuuuauauuuauu

SEQ ID NO: 2038402 - RNA, 15 nt, Staphylococcus aureus subsp. aureus Mu50
acuuggcucaaaacu

SEQ ID NO: 2038403 - RNA, 16 nt, Staphylococcus aureus subsp. aureus Mu50
acuugcucuaauucaa

SEQ ID NO: 2038404 - RNA, 22 nt, Staphylococcus aureus subsp. aureus Mu50
acuugcucuaauucaaugauuu

SEQ ID NO: 2038405 - RNA, 22 nt, Staphylococcus aureus subsp. aureus Mu50
acuuggauuaccguuaaaaaag

SEQ ID NO: 2038406 - RNA, 18 nt, Staphylococcus aureus subsp. aureus Mu50
acuuggauucaaaugaca

SEQ ID NO: 2038407 - RNA, 14 nt, Staphylococcus aureus subsp. aureus Mu50
acuugcgcaugcuu

SEQ ID NO: 2038408 - RNA, 20 nt, Staphylococcus aureus subsp. aureus Mu50
acuucuucaggugauucauu

SEQ ID NO: 2038409 - RNA, 19 nt, Staphylococcus aureus subsp. aureus Mu50
acuugauaaaaaaugaaug

SEQ ID NO: 2038410 - RNA, 19 nt, Staphylococcus aureus subsp. aureus Mu50
acuugauaaaacuaaugau

SEQ ID NO: 2038411 - RNA, 16 nt, Staphylococcus aureus subsp. aureus Mu50
acuugauucuacuuca

SEQ ID NO: 2038412 - RNA, 18 nt, Staphylococcus aureus subsp. aureus Mu50
acucuucaguacgaacaa

SEQ ID NO: 2038413 - RNA, 22 nt, Staphylococcus aureus subsp. aureus Mu50
acucuucaguacgaacaacuaa

SEQ ID NO: 2038414 - RNA, 16 nt, Staphylococcus aureus subsp. aureus Mu50
acucugggcauuuuga

SEQ ID NO: 2038415 - RNA, 16 nt, Staphylococcus aureus subsp. aureus Mu50
acucuggucugugaua

SEQ ID NO: 2038416 - RNA, 17 nt, Staphylococcus aureus subsp. aureus Mu50
acucuacacucaaacaa

SEQ ID NO: 2038417 - RNA, 18 nt, Staphylococcus aureus subsp. aureus Mu50
acucuaaauauaauagaa

SEQ ID NO: 2038418 - RNA, 20 nt, Staphylococcus aureus subsp. aureus Mu50
acucuaaaaguuguaauuua

SEQ ID NO: 2038419 - RNA, 15 nt, Staphylococcus aureus subsp. aureus Mu50
acucugaaaagccua

SEQ ID NO: 2038420 - RNA, 14 nt, Staphylococcus aureus subsp. aureus Mu50
acucugauauugau

SEQ ID NO: 2038421 - RNA, 15 nt, Staphylococcus aureus subsp. aureus Mu50
acucugauuacauau

SEQ ID NO: 2038422 - RNA, 16 nt, Staphylococcus aureus subsp. aureus Mu50
acugcucuuuauauau

SEQ ID NO: 2038423 - RNA, 22 nt, Staphylococcus aureus subsp. aureus Mu50
acugcuaauuuuuucaucauuc

SEQ ID NO: 2038424 - RNA, 14 nt, Staphylococcus aureus subsp. aureus Mu50
acugccuuuuugua

SEQ ID NO: 2038425 - RNA, 16 nt, Staphylococcus aureus subsp. aureus Mu50
acugccuuuuuguaau

SEQ ID NO: 2038426 - RNA, 13 nt, Staphylococcus aureus subsp. aureus Mu50
acugcuuuuuuau

SEQ ID NO: 2038427 - RNA, 19 nt, Staphylococcus aureus subsp. aureus Mu50
acugcugcuaaaauaaaau

SEQ ID NO: 2038428 - RNA, 16 nt, Staphylococcus aureus subsp. aureus Mu50
agcacgagaaauguca

SEQ ID NO: 2038429 - RNA, 23 nt, Staphylococcus aureus subsp. aureus Mu50
aaaccgcacuucuauauuaauag

SEQ ID NO: 2038430 - RNA, 13 nt, Staphylococcus aureus subsp. aureus Mu50
aaaccgcuauaaa

SEQ ID NO: 2038431 - RNA, 20 nt, Staphylococcus aureus subsp. aureus Mu50
agcaauugaaucaaauacau

SEQ ID NO: 2038432 - RNA, 15 nt, Staphylococcus aureus subsp. aureus Mu50
agcaauuuucgauau

SEQ ID NO: 2038433 - RNA, 22 nt, Staphylococcus aureus subsp. aureus Mu50
agcaaucaauacaauuuuaccu

SEQ ID NO: 2038434 - RNA, 15 nt, Staphylococcus aureus subsp. aureus Mu50
agcaacugaucauuu

SEQ ID NO: 2038435 - RNA, 14 nt, Staphylococcus aureus subsp. aureus Mu50
acuuuauuaaaaau

SEQ ID NO: 2038436 - RNA, 18 nt, Staphylococcus aureus subsp. aureus Mu50
acuuucaguaauuguuac

SEQ ID NO: 2038437 - RNA, 23 nt, Staphylococcus aureus subsp. aureus Mu50
acuuucgaucuucuaauucguuu

SEQ ID NO: 2038438 - RNA, 18 nt, Staphylococcus aureus subsp. aureus Mu50
acuuuaugaaauuucagu

SEQ ID NO: 2038439 - RNA, 22 nt, Staphylococcus aureus subsp. aureus Mu50
acuuucuaagauacguugaugu

SEQ ID NO: 2038440 - RNA, 14 nt, Staphylococcus aureus subsp. aureus Mu50
acuuucuugaugaa

SEQ ID NO: 2038441 - RNA, 17 nt, Staphylococcus aureus subsp. aureus Mu50
agcaaagguugcugcag

SEQ ID NO: 2038442 - RNA, 19 nt, Staphylococcus aureus subsp. aureus Mu50
agcaaaugcuuaagaaauu

SEQ ID NO: 2038443 - RNA, 22 nt, Staphylococcus aureus subsp. aureus Mu50
agcaccgacaauuauaauaaaa

SEQ ID NO: 2038444 - RNA, 16 nt, Staphylococcus aureus subsp. aureus Mu50
aaaccguauuauugga

SEQ ID NO: 2038445 - RNA, 23 nt, Staphylococcus aureus subsp. aureus Mu50
aaaccuucaaucaacgagucaua

SEQ ID NO: 2038446 - RNA, 13 nt, Staphylococcus aureus subsp. aureus Mu50
aaaccuacuaaua

SEQ ID NO: 2038447 - RNA, 16 nt, Staphylococcus aureus subsp. aureus Mu50
aaaccuagggauaauu

SEQ ID NO: 2038448 - RNA, 20 nt, Staphylococcus aureus subsp. aureus Mu50
aaaccuauucccaaaaugau

SEQ ID NO: 2038449 - RNA, 20 nt, Staphylococcus aureus subsp. aureus Mu50
aaaccucaacauuaaaaugu

SEQ ID NO: 2038450 - RNA, 13 nt, Staphylococcus aureus subsp. aureus Mu50
aaacgacucauua

SEQ ID NO: 2038451 - RNA, 14 nt, Staphylococcus aureus subsp. aureus Mu50
aaacgauaauaaua

SEQ ID NO: 2038452 - RNA, 20 nt, Staphylococcus aureus subsp. aureus Mu50
agcauuauuauuuuaauagc

SEQ ID NO: 2038453 - RNA, 13 nt, Staphylococcus aureus subsp. aureus Mu50
agcauuucauuag

SEQ ID NO: 2038454 - RNA, 17 nt, Staphylococcus aureus subsp. aureus Mu50
agcauuaaauuccaugu

SEQ ID NO: 2038455 - RNA, 23 nt, Staphylococcus aureus subsp. aureus Mu50
agcaucuuuaccauauaauucuu

SEQ ID NO: 2038456 - RNA, 15 nt, Staphylococcus aureus subsp. aureus Mu50
agcaucuccaauuua

SEQ ID NO: 2038457 - RNA, 17 nt, Staphylococcus aureus subsp. aureus Mu50
agcaucguaaaaaacaa

SEQ ID NO: 2038458 - RNA, 13 nt, Staphylococcus aureus subsp. aureus Mu50
agcaucaucaauu

SEQ ID NO: 2038459 - RNA, 15 nt, Staphylococcus aureus subsp. aureus Mu50
agcaucaucaauuua

SEQ ID NO: 2038460 - RNA, 23 nt, Staphylococcus aureus subsp. aureus Mu50
agcaucaucaauuuaguccuucu

SEQ ID NO: 2038461 - RNA, 14 nt, Staphylococcus aureus subsp. aureus Mu50
agcaucgaacaauc

SEQ ID NO: 2038462 - RNA, 14 nt, Staphylococcus aureus subsp. aureus Mu50
agcaguaauauguu

SEQ ID NO: 2038463 - RNA, 18 nt, Staphylococcus aureus subsp. aureus Mu50
agcaguaggauaauuuca

SEQ ID NO: 2038464 - RNA, 24 nt, Staphylococcus aureus subsp. aureus Mu50
agcaguauauaucaaauacauuuc

SEQ ID NO: 2038465 - RNA, 20 nt, Staphylococcus aureus subsp. aureus Mu50
agcagcgauacguuuauauc

SEQ ID NO: 2038466 - RNA, 19 nt, Staphylococcus aureus subsp. aureus Mu50
agcucgcggccuuuuuuau

SEQ ID NO: 2038467 - RNA, 18 nt, Staphylococcus aureus subsp. aureus Mu50
agcugaauuuuagugaau

SEQ ID NO: 2038468 - RNA, 12 nt, Staphylococcus aureus subsp. aureus Mu50
agcucuucaaau

SEQ ID NO: 2038469 - RNA, 13 nt, Staphylococcus aureus subsp. aureus Mu50
agcucuucaaauu

SEQ ID NO: 2038470 - RNA, 14 nt, Staphylococcus aureus subsp. aureus Mu50
agcugcuucaacua

SEQ ID NO: 2038471 - RNA, 19 nt, Staphylococcus aureus subsp. aureus Mu50
agcgugauucaucuauuau

SEQ ID NO: 2038472 - RNA, 19 nt, Staphylococcus aureus subsp. aureus Mu50
agcguuccauuaaugcauu

SEQ ID NO: 2038473 - RNA, 17 nt, Staphylococcus aureus subsp. aureus Mu50
agcguucucuaauuuca

SEQ ID NO: 2038474 - RNA, 16 nt, Staphylococcus aureus subsp. aureus Mu50
agcuauaaaaguacuu

SEQ ID NO: 2038475 - RNA, 24 nt, Staphylococcus aureus subsp. aureus Mu50
agcuaucguaaacaacaucgauuu

SEQ ID NO: 2038476 - RNA, 14 nt, Staphylococcus aureus subsp. aureus Mu50
agcuauacucauuu

SEQ ID NO: 2038477 - RNA, 14 nt, Staphylococcus aureus subsp. aureus Mu50
agcuauccaauacu

SEQ ID NO: 2038478 - RNA, 17 nt, Staphylococcus aureus subsp. aureus Mu50
agcgcgcuuauugaaaa

SEQ ID NO: 2038479 - RNA, 16 nt, Staphylococcus aureus subsp. aureus Mu50
aaacgccuuuccauug

SEQ ID NO: 2038480 - RNA, 13 nt, Staphylococcus aureus subsp. aureus Mu50
aaacgcuucauag

SEQ ID NO: 2038481 - RNA, 17 nt, Staphylococcus aureus subsp. aureus Mu50
aucacugcauauaaagu

SEQ ID NO: 2038482 - RNA, 22 nt, Staphylococcus aureus subsp. aureus Mu50
aucacuccucuauuuuaugauu

SEQ ID NO: 2038483 - RNA, 20 nt, Staphylococcus aureus subsp. aureus Mu50
aucacuaaaguaaauaacac

SEQ ID NO: 2038484 - RNA, 13 nt, Staphylococcus aureus subsp. aureus Mu50
aucagcuuuuuca

SEQ ID NO: 2038485 - RNA, 14 nt, Staphylococcus aureus subsp. aureus Mu50
aucaccuuuuuuaa

SEQ ID NO: 2038486 - RNA, 17 nt, Staphylococcus aureus subsp. aureus Mu50
aucaauuuaguccuucu

SEQ ID NO: 2038487 - RNA, 17 nt, Staphylococcus aureus subsp. aureus Mu50
aucacagcaauaauaau

SEQ ID NO: 2038488 - RNA, 19 nt, Staphylococcus aureus subsp. aureus Mu50
aucaauuuuuacuaaauca

SEQ ID NO: 2038489 - RNA, 17 nt, Staphylococcus aureus subsp. aureus Mu50
aucaauuucuauuucac

SEQ ID NO: 2038490 - RNA, 19 nt, Staphylococcus aureus subsp. aureus Mu50
aucaauuucuguaauaaua

SEQ ID NO: 2038491 - RNA, 17 nt, Staphylococcus aureus subsp. aureus Mu50
aucaagaacuuuaaaaa

SEQ ID NO: 2038492 - RNA, 20 nt, Staphylococcus aureus subsp. aureus Mu50
aucaagaacuuuaaaaauug

SEQ ID NO: 2038493 - RNA, 15 nt, Staphylococcus aureus subsp. aureus Mu50
aucaaugguugaugu

SEQ ID NO: 2038494 - RNA, 12 nt, Staphylococcus aureus subsp. aureus Mu50
aucaauugaaug

SEQ ID NO: 2038495 - RNA, 13 nt, Staphylococcus aureus subsp. aureus Mu50
aucaauuaaacuu

SEQ ID NO: 2038496 - RNA, 20 nt, Staphylococcus aureus subsp. aureus Mu50
auauuaaucguuaauguaua

SEQ ID NO: 2038497 - RNA, 19 nt, Staphylococcus aureus subsp. aureus Mu50
auauuaaugauugacgauu

SEQ ID NO: 2038498 - RNA, 18 nt, Staphylococcus aureus subsp. aureus Mu50
auauuaauguuugaugau

SEQ ID NO: 2038499 - RNA, 17 nt, Staphylococcus aureus subsp. aureus Mu50
auauuaaaauuaaaacu

SEQ ID NO: 2038500 - RNA, 22 nt, Staphylococcus aureus subsp. aureus Mu50
auauuaacaacuuuauuauacu

SEQ ID NO: 2038501 - RNA, 15 nt, Staphylococcus aureus subsp. aureus Mu50
auauguuuuauaaua

SEQ ID NO: 2038502 - RNA, 22 nt, Staphylococcus aureus subsp. aureus Mu50
auauguuuuauaauaaauguca

SEQ ID NO: 2038503 - RNA, 20 nt, Staphylococcus aureus subsp. aureus Mu50
auauguuuuuauuauacacu

SEQ ID NO: 2038504 - RNA, 14 nt, Staphylococcus aureus subsp. aureus Mu50
auauuaaaaauuuc

SEQ ID NO: 2038505 - RNA, 18 nt, Staphylococcus aureus subsp. aureus Mu50
auauuaaaaauuucaaua

SEQ ID NO: 2038506 - RNA, 20 nt, Staphylococcus aureus subsp. aureus Mu50
auauuaaaacaaugaggauu

SEQ ID NO: 2038507 - RNA, 13 nt, Staphylococcus aureus subsp. aureus Mu50
auauuauguuagu

SEQ ID NO: 2038508 - RNA, 13 nt, Staphylococcus aureus subsp. aureus Mu50
auauuauuuuuaa

SEQ ID NO: 2038509 - RNA, 21 nt, Staphylococcus aureus subsp. aureus Mu50
auauuacgccuggaaucgcgu

SEQ ID NO: 2038510 - RNA, 15 nt, Staphylococcus aureus subsp. aureus Mu50
auauuaguauaauuu

SEQ ID NO: 2038511 - RNA, 21 nt, Staphylococcus aureus subsp. aureus Mu50
auauuauaaccaccaguauaa

SEQ ID NO: 2038512 - RNA, 23 nt, Staphylococcus aureus subsp. aureus Mu50
auauuauaaguugcauauaaaaa

SEQ ID NO: 2038513 - RNA, 23 nt, Staphylococcus aureus subsp. aureus Mu50
auauguggguguaccaauugauu

SEQ ID NO: 2038514 - RNA, 17 nt, Staphylococcus aureus subsp. aureus Mu50
auauguguuucuagcuu

SEQ ID NO: 2038515 - RNA, 15 nt, Staphylococcus aureus subsp. aureus Mu50
auauguuuccucuuu

SEQ ID NO: 2038516 - RNA, 16 nt, Staphylococcus aureus subsp. aureus Mu50
auauguuuccucuuua

SEQ ID NO: 2038517 - RNA, 15 nt, Staphylococcus aureus subsp. aureus Mu50
auaugguucguccau

SEQ ID NO: 2038518 - RNA, 22 nt, Staphylococcus aureus subsp. aureus Mu50
auaugguucguccauucaaagu

SEQ ID NO: 2038519 - RNA, 22 nt, Staphylococcus aureus subsp. aureus Mu50
auauguaaucagaguagaaagu

SEQ ID NO: 2038520 - RNA, 14 nt, Staphylococcus aureus subsp. aureus Mu50
aucaaaguaucagu

SEQ ID NO: 2038521 - RNA, 24 nt, Staphylococcus aureus subsp. aureus Mu50
aucaaagggcuucgauucauaaaa

SEQ ID NO: 2038522 - RNA, 21 nt, Staphylococcus aureus subsp. aureus Mu50
aucaaacuuggcaaugaaauu

SEQ ID NO: 2038523 - RNA, 17 nt, Staphylococcus aureus subsp. aureus Mu50
aucaacguauauaaguu

SEQ ID NO: 2038524 - RNA, 16 nt, Staphylococcus aureus subsp. aureus Mu50
aucaacaaauuuaacu

SEQ ID NO: 2038525 - RNA, 11 nt, Staphylococcus aureus subsp. aureus Mu50
aucaaauuacc

SEQ ID NO: 2038526 - RNA, 23 nt, Staphylococcus aureus subsp. aureus Mu50
aucaaauugaccgacaaaacuug

SEQ ID NO: 2038527 - RNA, 17 nt, Staphylococcus aureus subsp. aureus Mu50
auagcgcagcaaaugcu

SEQ ID NO: 2038528 - RNA, 18 nt, Staphylococcus aureus subsp. aureus Mu50
auaguuauuaaaucuuuu

SEQ ID NO: 2038529 - RNA, 16 nt, Staphylococcus aureus subsp. aureus Mu50
auagguauaaucauuu

SEQ ID NO: 2038530 - RNA, 15 nt, Staphylococcus aureus subsp. aureus Mu50
auaguucuuuaaauu

SEQ ID NO: 2038531 - RNA, 13 nt, Staphylococcus aureus subsp. aureus Mu50
auaguuuauaaau

SEQ ID NO: 2038532 - RNA, 21 nt, Staphylococcus aureus subsp. aureus Mu50
auauaaaaagugaaaguauua

SEQ ID NO: 2038533 - RNA, 12 nt, Staphylococcus aureus subsp. aureus Mu50
auaggauauuuu

SEQ ID NO: 2038534 - RNA, 22 nt, Staphylococcus aureus subsp. aureus Mu50
auaggauauuuuuuaauaauca

SEQ ID NO: 2038535 - RNA, 15 nt, Staphylococcus aureus subsp. aureus Mu50
auagguauaaucauu

SEQ ID NO: 2038536 - RNA, 16 nt, Staphylococcus aureus subsp. aureus Mu50
auauaaaacugugcau

SEQ ID NO: 2038537 - RNA, 15 nt, Staphylococcus aureus subsp. aureus Mu50
auauaaauaugguuu

SEQ ID NO: 2038538 - RNA, 13 nt, Staphylococcus aureus subsp. aureus Mu50
auauaaaucauuu

SEQ ID NO: 2038539 - RNA, 21 nt, Staphylococcus aureus subsp. aureus Mu50
auauaaagcugcgauauaacu

SEQ ID NO: 2038540 - RNA, 14 nt, Staphylococcus aureus subsp. aureus Mu50
auauaaauguugac

SEQ ID NO: 2038541 - RNA, 15 nt, Staphylococcus aureus subsp. aureus Mu50
auauaacaucaaaua

SEQ ID NO: 2038542 - RNA, 16 nt, Staphylococcus aureus subsp. aureus Mu50
auauaacaaguauaaa

SEQ ID NO: 2038543 - RNA, 22 nt, Staphylococcus aureus subsp. aureus Mu50
auauaacugcauguacaucuuu

SEQ ID NO: 2038544 - RNA, 18 nt, Staphylococcus aureus subsp. aureus Mu50
auauaagaaauccaccua

SEQ ID NO: 2038545 - RNA, 17 nt, Staphylococcus aureus subsp. aureus Mu50
auauaaccgugaugaug

SEQ ID NO: 2038546 - RNA, 20 nt, Staphylococcus aureus subsp. aureus Mu50
auauaacuauggucaucaau

SEQ ID NO: 2038547 - RNA, 14 nt, Staphylococcus aureus subsp. aureus Mu50
auauacuaaauuug

SEQ ID NO: 2038548 - RNA, 13 nt, Staphylococcus aureus subsp. aureus Mu50
auauacuuaauuu

SEQ ID NO: 2038549 - RNA, 22 nt, Staphylococcus aureus subsp. aureus Mu50
auauagaaggggacuuaaccau

SEQ ID NO: 2038550 - RNA, 15 nt, Staphylococcus aureus subsp. aureus Mu50
auauagcauaaaauu

SEQ ID NO: 2038551 - RNA, 17 nt, Staphylococcus aureus subsp. aureus Mu50
auauagcaucuaugauu

SEQ ID NO: 2038552 - RNA, 12 nt, Staphylococcus aureus subsp. aureus Mu50
auauacgacauu

SEQ ID NO: 2038553 - RNA, 14 nt, Staphylococcus aureus subsp. aureus Mu50
auauacaaugacag

SEQ ID NO: 2038554 - RNA, 20 nt, Staphylococcus aureus subsp. aureus Mu50
auauaauagaaauaaucaca

SEQ ID NO: 2038555 - RNA, 14 nt, Staphylococcus aureus subsp. aureus Mu50
auauaauuuuuuga

SEQ ID NO: 2038556 - RNA, 13 nt, Staphylococcus aureus subsp. aureus Mu50
auauaauuuaaag

SEQ ID NO: 2038557 - RNA, 17 nt, Staphylococcus aureus subsp. aureus Mu50
auauaaggcgcucucuu

SEQ ID NO: 2038558 - RNA, 14 nt, Staphylococcus aureus subsp. aureus Mu50
auauaaguaaucau

SEQ ID NO: 2038559 - RNA, 18 nt, Staphylococcus aureus subsp. aureus Mu50
auauaauaccccaaauag

SEQ ID NO: 2038560 - RNA, 22 nt, Staphylococcus aureus subsp. aureus Mu50
auaucgauaaauguauuaaaca

SEQ ID NO: 2038561 - RNA, 14 nt, Staphylococcus aureus subsp. aureus Mu50
auaucgauuaauag

SEQ ID NO: 2038562 - RNA, 24 nt, Staphylococcus aureus subsp. aureus Mu50
auaucgauuuuggcacauaaauca

SEQ ID NO: 2038563 - RNA, 16 nt, Staphylococcus aureus subsp. aureus Mu50
auauccuguuucauau

SEQ ID NO: 2038564 - RNA, 20 nt, Staphylococcus aureus subsp. aureus Mu50
auaucuaagucgauaaguuu

SEQ ID NO: 2038565 - RNA, 15 nt, Staphylococcus aureus subsp. aureus Mu50
auaucuguugcauua

SEQ ID NO: 2038566 - RNA, 15 nt, Staphylococcus aureus subsp. aureus Mu50
auaucuauuuaucau

SEQ ID NO: 2038567 - RNA, 20 nt, Staphylococcus aureus subsp. aureus Mu50
auaucuacagagaaucaauu

SEQ ID NO: 2038568 - RNA, 13 nt, Staphylococcus aureus subsp. aureus Mu50
auauggaauacua

SEQ ID NO: 2038569 - RNA, 14 nt, Staphylococcus aureus subsp. aureus Mu50
auauggaauacuac

SEQ ID NO: 2038570 - RNA, 16 nt, Staphylococcus aureus subsp. aureus Mu50
auauggaauuucauau

SEQ ID NO: 2038571 - RNA, 18 nt, Staphylococcus aureus subsp. aureus Mu50
auagaugcauaaaaaccu

SEQ ID NO: 2038572 - RNA, 20 nt, Staphylococcus aureus subsp. aureus Mu50
auagaugugucuuuuauuau

SEQ ID NO: 2038573 - RNA, 13 nt, Staphylococcus aureus subsp. aureus Mu50
auagauugaaaaa

SEQ ID NO: 2038574 - RNA, 16 nt, Staphylococcus aureus subsp. aureus Mu50
auagauugccauucau

SEQ ID NO: 2038575 - RNA, 21 nt, Staphylococcus aureus subsp. aureus Mu50
auagauugccauucauacacu

SEQ ID NO: 2038576 - RNA, 19 nt, Staphylococcus aureus subsp. aureus Mu50
auagauuguauuuaauaag

SEQ ID NO: 2038577 - RNA, 18 nt, Staphylococcus aureus subsp. aureus Mu50
auagauuugaauuaaagu

SEQ ID NO: 2038578 - RNA, 20 nt, Staphylococcus aureus subsp. aureus Mu50
auagaugagaaaguaaaagu

SEQ ID NO: 2038579 - RNA, 17 nt, Staphylococcus aureus subsp. aureus Mu50
auagcauuccuaauuau

SEQ ID NO: 2038580 - RNA, 22 nt, Staphylococcus aureus subsp. aureus Mu50
auagcaucuaugauuguaugac

SEQ ID NO: 2038581 - RNA, 14 nt, Staphylococcus aureus subsp. aureus Mu50
auacuuucaaacaa

SEQ ID NO: 2038582 - RNA, 22 nt, Staphylococcus aureus subsp. aureus Mu50
auacuugcucuaauucaaugau

SEQ ID NO: 2038583 - RNA, 22 nt, Staphylococcus aureus subsp. aureus Mu50
auacuugucguauucuucaaua

SEQ ID NO: 2038584 - RNA, 17 nt, Staphylococcus aureus subsp. aureus Mu50
auagaaaauuaacucag

SEQ ID NO: 2038585 - RNA, 14 nt, Staphylococcus aureus subsp. aureus Mu50
auacuuuuaccauu

SEQ ID NO: 2038586 - RNA, 16 nt, Staphylococcus aureus subsp. aureus Mu50
auacuuuuugaugauu

SEQ ID NO: 2038587 - RNA, 13 nt, Staphylococcus aureus subsp. aureus Mu50
auagaaaaauuuc

SEQ ID NO: 2038588 - RNA, 22 nt, Staphylococcus aureus subsp. aureus Mu50
auagaagaacgaagaaugauac

SEQ ID NO: 2038589 - RNA, 23 nt, Staphylococcus aureus subsp. aureus Mu50
auagaaucuaaggccauuuguag

SEQ ID NO: 2038590 - RNA, 15 nt, Staphylococcus aureus subsp. aureus Mu50
auagaaugaauaauu

SEQ ID NO: 2038591 - RNA, 18 nt, Staphylococcus aureus subsp. aureus Mu50
auagaauucacgcaauau

SEQ ID NO: 2038592 - RNA, 16 nt, Staphylococcus aureus subsp. aureus Mu50
auagagaaagaauaaa

SEQ ID NO: 2038593 - RNA, 16 nt, Staphylococcus aureus subsp. aureus Mu50
auagacugccaauaaa

SEQ ID NO: 2038594 - RNA, 14 nt, Staphylococcus aureus subsp. aureus Mu50
auagacguuuuuau

SEQ ID NO: 2038595 - RNA, 16 nt, Staphylococcus aureus subsp. aureus Mu50
auagacuaauuaucuu

SEQ ID NO: 2038596 - RNA, 14 nt, Staphylococcus aureus subsp. aureus Mu50
auagaccuuuauuu

SEQ ID NO: 2038597 - RNA, 18 nt, Staphylococcus aureus subsp. aureus Mu50
auagaccuuuauuuuuau

SEQ ID NO: 2038598 - RNA, 13 nt, Staphylococcus aureus subsp. aureus Mu50
auagacaguaguu

SEQ ID NO: 2038599 - RNA, 15 nt, Staphylococcus aureus subsp. aureus Mu50
auagauaggauauuu

SEQ ID NO: 2038600 - RNA, 15 nt, Staphylococcus aureus subsp. aureus Mu50
auagaggauauuuau

SEQ ID NO: 2038601 - RNA, 19 nt, Staphylococcus aureus subsp. aureus Mu50
auacuucaguacgguuauu

SEQ ID NO: 2038602 - RNA, 15 nt, Staphylococcus aureus subsp. aureus Mu50
auacuuaaagauuua

SEQ ID NO: 2038603 - RNA, 17 nt, Staphylococcus aureus subsp. aureus Mu50
auacuuacugaaacuaa

SEQ ID NO: 2038604 - RNA, 19 nt, Staphylococcus aureus subsp. aureus Mu50
auacuugaugaaacugauu

SEQ ID NO: 2038605 - RNA, 16 nt, Staphylococcus aureus subsp. aureus Mu50
auacucaauaaaauug

SEQ ID NO: 2038606 - RNA, 21 nt, Staphylococcus aureus subsp. aureus Mu50
auacucaucuguccgauaucu

SEQ ID NO: 2038607 - RNA, 18 nt, Staphylococcus aureus subsp. aureus Mu50
auacucccgcauuauuau

SEQ ID NO: 2038608 - RNA, 22 nt, Staphylococcus aureus subsp. aureus Mu50
auacugccccaaauguaagaac

SEQ ID NO: 2038609 - RNA, 16 nt, Staphylococcus aureus subsp. aureus Mu50
auacugaauuuuaacu

SEQ ID NO: 2038610 - RNA, 17 nt, Staphylococcus aureus subsp. aureus Mu50
auacguaucaaaauuuu

SEQ ID NO: 2038611 - RNA, 16 nt, Staphylococcus aureus subsp. aureus Mu50
auacgugcuuuaaagu

SEQ ID NO: 2038612 - RNA, 23 nt, Staphylococcus aureus subsp. aureus Mu50
auacguguguuuucuuuucaaaa

SEQ ID NO: 2038613 - RNA, 21 nt, Staphylococcus aureus subsp. aureus Mu50
auacguuauuucaauaauaau

SEQ ID NO: 2038614 - RNA, 21 nt, Staphylococcus aureus subsp. aureus Mu50
auacguuuugcuaauucaaga

SEQ ID NO: 2038615 - RNA, 13 nt, Staphylococcus aureus subsp. aureus Mu50
auacguuuccaau

SEQ ID NO: 2038616 - RNA, 23 nt, Staphylococcus aureus subsp. aureus Mu50
auacuaagcgcucauaaacgauu

SEQ ID NO: 2038617 - RNA, 17 nt, Staphylococcus aureus subsp. aureus Mu50
auacaaauuuuuuuuau

SEQ ID NO: 2038618 - RNA, 18 nt, Staphylococcus aureus subsp. aureus Mu50
auacagucaauacaaaga

SEQ ID NO: 2038619 - RNA, 23 nt, Staphylococcus aureus subsp. aureus Mu50
auacagucaauacaaagaauuau

SEQ ID NO: 2038620 - RNA, 12 nt, Staphylococcus aureus subsp. aureus Mu50
auacaaaggauu

SEQ ID NO: 2038621 - RNA, 22 nt, Staphylococcus aureus subsp. aureus Mu50
auacaucggaauucaaccaauu

SEQ ID NO: 2038622 - RNA, 14 nt, Staphylococcus aureus subsp. aureus Mu50
auacaucaauaucu

SEQ ID NO: 2038623 - RNA, 12 nt, Staphylococcus aureus subsp. aureus Mu50
auacaucaauuu

SEQ ID NO: 2038624 - RNA, 14 nt, Staphylococcus aureus subsp. aureus Mu50
auacaucaauuucu

SEQ ID NO: 2038625 - RNA, 14 nt, Staphylococcus aureus subsp. aureus Mu50
auaccaaauauauu

SEQ ID NO: 2038626 - RNA, 16 nt, Staphylococcus aureus subsp. aureus Mu50
auacauuaauauaaau

SEQ ID NO: 2038627 - RNA, 12 nt, Staphylococcus aureus subsp. aureus Mu50
auacauugauaa

SEQ ID NO: 2038628 - RNA, 12 nt, Staphylococcus aureus subsp. aureus Mu50
auacauuuuuau

SEQ ID NO: 2038629 - RNA, 23 nt, Staphylococcus aureus subsp. aureus Mu50
auaauuugaauauggaaaaugua

SEQ ID NO: 2038630 - RNA, 17 nt, Staphylococcus aureus subsp. aureus Mu50
auaauuugagaaaugaa

SEQ ID NO: 2038631 - RNA, 14 nt, Staphylococcus aureus subsp. aureus Mu50
auaauuuauaaaaa

SEQ ID NO: 2038632 - RNA, 16 nt, Staphylococcus aureus subsp. aureus Mu50
auaauuuauugauaag

SEQ ID NO: 2038633 - RNA, 19 nt, Staphylococcus aureus subsp. aureus Mu50
auaauuggcugaugaacuu

SEQ ID NO: 2038634 - RNA, 22 nt, Staphylococcus aureus subsp. aureus Mu50
auaauuggcugaugaacuucua

SEQ ID NO: 2038635 - RNA, 12 nt, Staphylococcus aureus subsp. aureus Mu50
auaauuguucau

SEQ ID NO: 2038636 - RNA, 22 nt, Staphylococcus aureus subsp. aureus Mu50
auaauuuaaagaacuauuuuaa

SEQ ID NO: 2038637 - RNA, 19 nt, Staphylococcus aureus subsp. aureus Mu50
auaauuuaaaggcauaaua

SEQ ID NO: 2038638 - RNA, 18 nt, Staphylococcus aureus subsp. aureus Mu50
auaauuuaauaacguaca

SEQ ID NO: 2038639 - RNA, 14 nt, Staphylococcus aureus subsp. aureus Mu50
auaauaagauuuuu

SEQ ID NO: 2038640 - RNA, 12 nt, Staphylococcus aureus subsp. aureus Mu50
auaauaaaucac

SEQ ID NO: 2038641 - RNA, 18 nt, Staphylococcus aureus subsp. aureus Mu50
auaauaaaugcuauauuu

SEQ ID NO: 2038642 - RNA, 13 nt, Staphylococcus aureus subsp. aureus Mu50
auaauaaauguca

SEQ ID NO: 2038643 - RNA, 17 nt, Staphylococcus aureus subsp. aureus Mu50
auaaguuaaaaauguaa

SEQ ID NO: 2038644 - RNA, 12 nt, Staphylococcus aureus subsp. aureus Mu50
auaaguuaaagu

SEQ ID NO: 2038645 - RNA, 24 nt, Staphylococcus aureus subsp. aureus Mu50
auaaguuacuagcauuagcaaaua

SEQ ID NO: 2038646 - RNA, 19 nt, Staphylococcus aureus subsp. aureus Mu50
auaaguuuuugaauaucua

SEQ ID NO: 2038647 - RNA, 18 nt, Staphylococcus aureus subsp. aureus Mu50
auaauaaagauuauaucu

SEQ ID NO: 2038648 - RNA, 21 nt, Staphylococcus aureus subsp. aureus Mu50
auaaguugucaucuaauuaca

SEQ ID NO: 2038649 - RNA, 17 nt, Staphylococcus aureus subsp. aureus Mu50
auaauacgcuugauaaa

SEQ ID NO: 2038650 - RNA, 16 nt, Staphylococcus aureus subsp. aureus Mu50
auaauagcaaaauuau

SEQ ID NO: 2038651 - RNA, 17 nt, Staphylococcus aureus subsp. aureus Mu50
auaauagcaaaauuaug

SEQ ID NO: 2038652 - RNA, 17 nt, Staphylococcus aureus subsp. aureus Mu50
auaauacuguauuuuaa

SEQ ID NO: 2038653 - RNA, 16 nt, Staphylococcus aureus subsp. aureus Mu50
auaauagacuuauauu

SEQ ID NO: 2038654 - RNA, 15 nt, Staphylococcus aureus subsp. aureus Mu50
auaauauaaaaacaa

SEQ ID NO: 2038655 - RNA, 16 nt, Staphylococcus aureus subsp. aureus Mu50
auaauauaacaugcua

SEQ ID NO: 2038656 - RNA, 16 nt, Staphylococcus aureus subsp. aureus Mu50
auaauauacacaaaaa

SEQ ID NO: 2038657 - RNA, 13 nt, Staphylococcus aureus subsp. aureus Mu50
auacccugcuuua

SEQ ID NO: 2038658 - RNA, 16 nt, Staphylococcus aureus subsp. aureus Mu50
auaccaauuguuucag

SEQ ID NO: 2038659 - RNA, 19 nt, Staphylococcus aureus subsp. aureus Mu50
auacgaugaugauuuauaa

SEQ ID NO: 2038660 - RNA, 15 nt, Staphylococcus aureus subsp. aureus Mu50
auacgcaaugauuau

SEQ ID NO: 2038661 - RNA, 15 nt, Staphylococcus aureus subsp. aureus Mu50
auacgacauuuuuag

SEQ ID NO: 2038662 - RNA, 16 nt, Staphylococcus aureus subsp. aureus Mu50
auaccuaaagcuaaua

SEQ ID NO: 2038663 - RNA, 21 nt, Staphylococcus aureus subsp. aureus Mu50
auaccuacaaauauguaauca

SEQ ID NO: 2038664 - RNA, 13 nt, Staphylococcus aureus subsp. aureus Mu50
auaccucuacauu

SEQ ID NO: 2038665 - RNA, 14 nt, Staphylococcus aureus subsp. aureus Mu50
auaccuuuaaaucu

SEQ ID NO: 2038666 - RNA, 16 nt, Staphylococcus aureus subsp. aureus Mu50
auaccuuuaauaucua

SEQ ID NO: 2038667 - RNA, 13 nt, Staphylococcus aureus subsp. aureus Mu50
auaccuuuuaauu

SEQ ID NO: 2038668 - RNA, 19 nt, Staphylococcus aureus subsp. aureus Mu50
auaccuuuugcuagugcuu

SEQ ID NO: 2038669 - RNA, 17 nt, Staphylococcus aureus subsp. aureus Mu50
aguuuugaaccuaaauu

SEQ ID NO: 2038670 - RNA, 14 nt, Staphylococcus aureus subsp. aureus Mu50
aguuuguaauauug

SEQ ID NO: 2038671 - RNA, 13 nt, Staphylococcus aureus subsp. aureus Mu50
aguuuuuaaaauu

SEQ ID NO: 2038672 - RNA, 16 nt, Staphylococcus aureus subsp. aureus Mu50
aguuuuuuaaaauaau

SEQ ID NO: 2038673 - RNA, 20 nt, Staphylococcus aureus subsp. aureus Mu50
aguuuuuuaaaauaaugaua

SEQ ID NO: 2038674 - RNA, 17 nt, Staphylococcus aureus subsp. aureus Mu50
auaaaaaaauuaacuau

SEQ ID NO: 2038675 - RNA, 19 nt, Staphylococcus aureus subsp. aureus Mu50
auaaaaacaaaagaaaguu

SEQ ID NO: 2038676 - RNA, 17 nt, Staphylococcus aureus subsp. aureus Mu50
auaaaaacagcagugaa

SEQ ID NO: 2038677 - RNA, 16 nt, Staphylococcus aureus subsp. aureus Mu50
auaacaugaccuaaua

SEQ ID NO: 2038678 - RNA, 23 nt, Staphylococcus aureus subsp. aureus Mu50
auaacauugaacgauaacaauuu

SEQ ID NO: 2038679 - RNA, 16 nt, Staphylococcus aureus subsp. aureus Mu50
auaacauacguuauuu

SEQ ID NO: 2038680 - RNA, 21 nt, Staphylococcus aureus subsp. aureus Mu50
auaacauccccuucuugagca

SEQ ID NO: 2038681 - RNA, 12 nt, Staphylococcus aureus subsp. aureus Mu50
auaacauuuaag

SEQ ID NO: 2038682 - RNA, 17 nt, Staphylococcus aureus subsp. aureus Mu50
auaaccaaaccauaagu

SEQ ID NO: 2038683 - RNA, 17 nt, Staphylococcus aureus subsp. aureus Mu50
auaacagcuacaaauaa

SEQ ID NO: 2038684 - RNA, 19 nt, Staphylococcus aureus subsp. aureus Mu50
auaacagcuaaaaauucug

SEQ ID NO: 2038685 - RNA, 15 nt, Staphylococcus aureus subsp. aureus Mu50
auaacaccuuucauu

SEQ ID NO: 2038686 - RNA, 16 nt, Staphylococcus aureus subsp. aureus Mu50
auaacaccuuucauuu

SEQ ID NO: 2038687 - RNA, 18 nt, Staphylococcus aureus subsp. aureus Mu50
auaaccauguaaaauuag

SEQ ID NO: 2038688 - RNA, 15 nt, Staphylococcus aureus subsp. aureus Mu50
auaaccauuaugauu

SEQ ID NO: 2038689 - RNA, 17 nt, Staphylococcus aureus subsp. aureus Mu50
auaacccauuuucaaaa

SEQ ID NO: 2038690 - RNA, 16 nt, Staphylococcus aureus subsp. aureus Mu50
auaaccgcuacaauua

SEQ ID NO: 2038691 - RNA, 20 nt, Staphylococcus aureus subsp. aureus Mu50
auaaccgucacaaaccauuc

SEQ ID NO: 2038692 - RNA, 14 nt, Staphylococcus aureus subsp. aureus Mu50
auaacgacacuuuu

SEQ ID NO: 2038693 - RNA, 16 nt, Staphylococcus aureus subsp. aureus Mu50
auaaguaaucauaaua

SEQ ID NO: 2038694 - RNA, 16 nt, Staphylococcus aureus subsp. aureus Mu50
auaaguagaaaauaug

SEQ ID NO: 2038695 - RNA, 20 nt, Staphylococcus aureus subsp. aureus Mu50
auaagucuaauguuggaaaa

SEQ ID NO: 2038696 - RNA, 18 nt, Staphylococcus aureus subsp. aureus Mu50
auaagucuuaacaaauua

SEQ ID NO: 2038697 - RNA, 22 nt, Staphylococcus aureus subsp. aureus Mu50
auaaguagugauuuuuuacauu

SEQ ID NO: 2038698 - RNA, 14 nt, Staphylococcus aureus subsp. aureus Mu50
auaaguauucauac

SEQ ID NO: 2038699 - RNA, 17 nt, Staphylococcus aureus subsp. aureus Mu50
auaagucacauuuauaa

SEQ ID NO: 2038700 - RNA, 15 nt, Staphylococcus aureus subsp. aureus Mu50
auaagaauauuuaag

SEQ ID NO: 2038701 - RNA, 19 nt, Staphylococcus aureus subsp. aureus Mu50
auaacuucguuuuaauaaa

SEQ ID NO: 2038702 - RNA, 16 nt, Staphylococcus aureus subsp. aureus Mu50
auaacuucuauuaaga

SEQ ID NO: 2038703 - RNA, 15 nt, Staphylococcus aureus subsp. aureus Mu50
auaacuguuuaucau

SEQ ID NO: 2038704 - RNA, 20 nt, Staphylococcus aureus subsp. aureus Mu50
auaacuauggucaucaauug

SEQ ID NO: 2038705 - RNA, 14 nt, Staphylococcus aureus subsp. aureus Mu50
auaacguucacuug

SEQ ID NO: 2038706 - RNA, 14 nt, Staphylococcus aureus subsp. aureus Mu50
auaacuagcaauuu

SEQ ID NO: 2038707 - RNA, 19 nt, Staphylococcus aureus subsp. aureus Mu50
aguauuuuugcguuaauaa

SEQ ID NO: 2038708 - RNA, 23 nt, Staphylococcus aureus subsp. aureus Mu50
aguauugccguuauuuucaauaa

SEQ ID NO: 2038709 - RNA, 20 nt, Staphylococcus aureus subsp. aureus Mu50
aguauuuacuuuuccuugau

SEQ ID NO: 2038710 - RNA, 14 nt, Staphylococcus aureus subsp. aureus Mu50
aguauuucaucauu

SEQ ID NO: 2038711 - RNA, 21 nt, Staphylococcus aureus subsp. aureus Mu50
aguauguugucauaccaaaua

SEQ ID NO: 2038712 - RNA, 18 nt, Staphylococcus aureus subsp. aureus Mu50
aguauuagauauauuuga

SEQ ID NO: 2038713 - RNA, 19 nt, Staphylococcus aureus subsp. aureus Mu50
agucaauuuuuucaucuuu

SEQ ID NO: 2038714 - RNA, 16 nt, Staphylococcus aureus subsp. aureus Mu50
agugacuuuuauaauu

SEQ ID NO: 2038715 - RNA, 20 nt, Staphylococcus aureus subsp. aureus Mu50
agugacuuuuauaauucuaa

SEQ ID NO: 2038716 - RNA, 20 nt, Staphylococcus aureus subsp. aureus Mu50
agucuuuuuauuuuaauauu

SEQ ID NO: 2038717 - RNA, 12 nt, Staphylococcus aureus subsp. aureus Mu50
agucugcucuuu

SEQ ID NO: 2038718 - RNA, 15 nt, Staphylococcus aureus subsp. aureus Mu50
agucucguaauaaug

SEQ ID NO: 2038719 - RNA, 22 nt, Staphylococcus aureus subsp. aureus Mu50
agucuucggcuuuguaaaauug

SEQ ID NO: 2038720 - RNA, 14 nt, Staphylococcus aureus subsp. aureus Mu50
agugcuuccauuaa

SEQ ID NO: 2038721 - RNA, 23 nt, Staphylococcus aureus subsp. aureus Mu50
agugagcguauuauuauugaaau

SEQ ID NO: 2038722 - RNA, 17 nt, Staphylococcus aureus subsp. aureus Mu50
aguucuuuuugaugauc

SEQ ID NO: 2038723 - RNA, 15 nt, Staphylococcus aureus subsp. aureus Mu50
aguucuauauaauuu

SEQ ID NO: 2038724 - RNA, 19 nt, Staphylococcus aureus subsp. aureus Mu50
aguuuagguugauuucugc

SEQ ID NO: 2038725 - RNA, 18 nt, Staphylococcus aureus subsp. aureus Mu50
aguugcauaaucaauuuc

SEQ ID NO: 2038726 - RNA, 22 nt, Staphylococcus aureus subsp. aureus Mu50
aguugcauaaucaauuucaccu

SEQ ID NO: 2038727 - RNA, 21 nt, Staphylococcus aureus subsp. aureus Mu50
aguugcacuugguucauaaug

SEQ ID NO: 2038728 - RNA, 15 nt, Staphylococcus aureus subsp. aureus Mu50
agugguguuuauauc

SEQ ID NO: 2038729 - RNA, 22 nt, Staphylococcus aureus subsp. aureus Mu50
aguaguucggaugagaaauguu

SEQ ID NO: 2038730 - RNA, 18 nt, Staphylococcus aureus subsp. aureus Mu50
aguacuuuaaaauuguau

SEQ ID NO: 2038731 - RNA, 20 nt, Staphylococcus aureus subsp. aureus Mu50
aguaguugacugaacgaaaa

SEQ ID NO: 2038732 - RNA, 14 nt, Staphylococcus aureus subsp. aureus Mu50
aguauaaaccaaau

SEQ ID NO: 2038733 - RNA, 16 nt, Staphylococcus aureus subsp. aureus Mu50
aguauaaauaaaaaua

SEQ ID NO: 2038734 - RNA, 22 nt, Staphylococcus aureus subsp. aureus Mu50
aguauagauagacuuucuugau

SEQ ID NO: 2038735 - RNA, 15 nt, Staphylococcus aureus subsp. aureus Mu50
aguauauaucaaaua

SEQ ID NO: 2038736 - RNA, 18 nt, Staphylococcus aureus subsp. aureus Mu50
aguaucauaauuuuguuu

SEQ ID NO: 2038737 - RNA, 13 nt, Staphylococcus aureus subsp. aureus Mu50
aguauauucaaca

SEQ ID NO: 2038738 - RNA, 16 nt, Staphylococcus aureus subsp. aureus Mu50
aguaucuaaauauuaa

SEQ ID NO: 2038739 - RNA, 19 nt, Staphylococcus aureus subsp. aureus Mu50
aguaucuuauauucuuaaa

SEQ ID NO: 2038740 - RNA, 17 nt, Staphylococcus aureus subsp. aureus Mu50
aguauaauuaaacuaau

SEQ ID NO: 2038741 - RNA, 14 nt, Staphylococcus aureus subsp. aureus Mu50
aguauguugucaua

SEQ ID NO: 2038742 - RNA, 12 nt, Staphylococcus aureus subsp. aureus Mu50
aguaacuuuguc

SEQ ID NO: 2038743 - RNA, 23 nt, Staphylococcus aureus subsp. aureus Mu50
aguaacauacuauaaaaauuuau

SEQ ID NO: 2038744 - RNA, 18 nt, Staphylococcus aureus subsp. aureus Mu50
aguaauagcaaccauauu

SEQ ID NO: 2038745 - RNA, 19 nt, Staphylococcus aureus subsp. aureus Mu50
aguaauagcuauauuuuug

SEQ ID NO: 2038746 - RNA, 20 nt, Staphylococcus aureus subsp. aureus Mu50
aguaagauuauuuucaauua

SEQ ID NO: 2038747 - RNA, 17 nt, Staphylococcus aureus subsp. aureus Mu50
aguacuaagcuuucauu

SEQ ID NO: 2038748 - RNA, 22 nt, Staphylococcus aureus subsp. aureus Mu50
aguacuaagcuuucauuaauuu

SEQ ID NO: 2038749 - RNA, 21 nt, Staphylococcus aureus subsp. aureus Mu50
agguuuucauuaaguugaaaa

SEQ ID NO: 2038750 - RNA, 22 nt, Staphylococcus aureus subsp. aureus Mu50
aguaaagggagguauauacaau

SEQ ID NO: 2038751 - RNA, 14 nt, Staphylococcus aureus subsp. aureus Mu50
aguaaaaauacauu

SEQ ID NO: 2038752 - RNA, 18 nt, Staphylococcus aureus subsp. aureus Mu50
agguuguuuuucaucauu

SEQ ID NO: 2038753 - RNA, 22 nt, Staphylococcus aureus subsp. aureus Mu50
agguuguuuuucaucauuaaaa

SEQ ID NO: 2038754 - RNA, 19 nt, Staphylococcus aureus subsp. aureus Mu50
aggugauugaacaauaaua

SEQ ID NO: 2038755 - RNA, 13 nt, Staphylococcus aureus subsp. aureus Mu50
aggucacuuuuau

SEQ ID NO: 2038756 - RNA, 14 nt, Staphylococcus aureus subsp. aureus Mu50
aggugauaauguac

SEQ ID NO: 2038757 - RNA, 23 nt, Staphylococcus aureus subsp. aureus Mu50
aggcuuaugggggauuuuuuuau

SEQ ID NO: 2038758 - RNA, 22 nt, Staphylococcus aureus subsp. aureus Mu50
aggcuuaaauauaaugauccag

SEQ ID NO: 2038759 - RNA, 14 nt, Staphylococcus aureus subsp. aureus Mu50
aggcaggcauaauu

SEQ ID NO: 2038760 - RNA, 16 nt, Staphylococcus aureus subsp. aureus Mu50
augaugauuuauaaaa

SEQ ID NO: 2038761 - RNA, 11 nt, Staphylococcus aureus subsp. aureus Mu50
augaugcacua

SEQ ID NO: 2038762 - RNA, 21 nt, Staphylococcus aureus subsp. aureus Mu50
augaugcuucgcacaacugca

SEQ ID NO: 2038763 - RNA, 17 nt, Staphylococcus aureus subsp. aureus Mu50
augauggguaguuaaua

SEQ ID NO: 2038764 - RNA, 13 nt, Staphylococcus aureus subsp. aureus Mu50
augccgccuaaua

SEQ ID NO: 2038765 - RNA, 17 nt, Staphylococcus aureus subsp. aureus Mu50
augccgccuaauaauaa

SEQ ID NO: 2038766 - RNA, 23 nt, Staphylococcus aureus subsp. aureus Mu50
augcgucguagauugauucuaca

SEQ ID NO: 2038767 - RNA, 15 nt, Staphylococcus aureus subsp. aureus Mu50
augcguagcaacauu

SEQ ID NO: 2038768 - RNA, 19 nt, Staphylococcus aureus subsp. aureus Mu50
augcugucaaacaacaauc

SEQ ID NO: 2038769 - RNA, 20 nt, Staphylococcus aureus subsp. aureus Mu50
augcuguguaucaucauaau

SEQ ID NO: 2038770 - RNA, 18 nt, Staphylococcus aureus subsp. aureus Mu50
augcuuaaaaacaauauu

SEQ ID NO: 2038771 - RNA, 18 nt, Staphylococcus aureus subsp. aureus Mu50
augcuguuggcaaaacaa

SEQ ID NO: 2038772 - RNA, 16 nt, Staphylococcus aureus subsp. aureus Mu50
augcuuaauaaaauca

SEQ ID NO: 2038773 - RNA, 23 nt, Staphylococcus aureus subsp. aureus Mu50
augcuuauauaaacaaaaaucua

SEQ ID NO: 2038774 - RNA, 22 nt, Staphylococcus aureus subsp. aureus Mu50
augcuucgcaucacugcauaua

SEQ ID NO: 2038775 - RNA, 13 nt, Staphylococcus aureus subsp. aureus Mu50
augcuucaauauu

SEQ ID NO: 2038776 - RNA, 21 nt, Staphylococcus aureus subsp. aureus Mu50
augcuugaauguuugaaguga

SEQ ID NO: 2038777 - RNA, 22 nt, Staphylococcus aureus subsp. aureus Mu50
augcuucucacaacugcauaua

SEQ ID NO: 2038778 - RNA, 13 nt, Staphylococcus aureus subsp. aureus Mu50
augcuuuuuuuac

SEQ ID NO: 2038779 - RNA, 13 nt, Staphylococcus aureus subsp. aureus Mu50
auggaaaaguuuu

SEQ ID NO: 2038780 - RNA, 15 nt, Staphylococcus aureus subsp. aureus Mu50
auggcuacuuuuuca

SEQ ID NO: 2038781 - RNA, 13 nt, Staphylococcus aureus subsp. aureus Mu50
augggagaaauuu

SEQ ID NO: 2038782 - RNA, 15 nt, Staphylococcus aureus subsp. aureus Mu50
auggcuucgcuaaua

SEQ ID NO: 2038783 - RNA, 16 nt, Staphylococcus aureus subsp. aureus Mu50
auggaaagacguuuuu

SEQ ID NO: 2038784 - RNA, 23 nt, Staphylococcus aureus subsp. aureus Mu50
auggaaaaguuuuuuacuuuuca

SEQ ID NO: 2038785 - RNA, 20 nt, Staphylococcus aureus subsp. aureus Mu50
auggaaaauguuaucaauau

SEQ ID NO: 2038786 - RNA, 15 nt, Staphylococcus aureus subsp. aureus Mu50
auguacauguauaaa

SEQ ID NO: 2038787 - RNA, 15 nt, Staphylococcus aureus subsp. aureus Mu50
auguaccgaauccuu

SEQ ID NO: 2038788 - RNA, 22 nt, Staphylococcus aureus subsp. aureus Mu50
auguaauuguuuuuucuuauuu

SEQ ID NO: 2038789 - RNA, 15 nt, Staphylococcus aureus subsp. aureus Mu50
auguacaauuuuuaa

SEQ ID NO: 2038790 - RNA, 15 nt, Staphylococcus aureus subsp. aureus Mu50
auguacaauuuuuua

SEQ ID NO: 2038791 - RNA, 17 nt, Staphylococcus aureus subsp. aureus Mu50
auguaaucauuauagca

SEQ ID NO: 2038792 - RNA, 18 nt, Staphylococcus aureus subsp. aureus Mu50
auggugaacuguuaaacu

SEQ ID NO: 2038793 - RNA, 16 nt, Staphylococcus aureus subsp. aureus Mu50
auguacguuuuuuuaa

SEQ ID NO: 2038794 - RNA, 19 nt, Staphylococcus aureus subsp. aureus Mu50
auguacguuuuuuuaaaua

SEQ ID NO: 2038795 - RNA, 19 nt, Staphylococcus aureus subsp. aureus Mu50
auguaggcgccauaaucau

SEQ ID NO: 2038796 - RNA, 16 nt, Staphylococcus aureus subsp. aureus Mu50
auguauaaaacuaauu

SEQ ID NO: 2038797 - RNA, 16 nt, Staphylococcus aureus subsp. aureus Mu50
auguauaacauuauua

SEQ ID NO: 2038798 - RNA, 22 nt, Staphylococcus aureus subsp. aureus Mu50
augucccguuuaccuuaaauac

SEQ ID NO: 2038799 - RNA, 14 nt, Staphylococcus aureus subsp. aureus Mu50
augucucuuucuuu

SEQ ID NO: 2038800 - RNA, 16 nt, Staphylococcus aureus subsp. aureus Mu50
augucuguacuuuuau

SEQ ID NO: 2038801 - RNA, 14 nt, Staphylococcus aureus subsp. aureus Mu50
augucuuacuuuua

SEQ ID NO: 2038802 - RNA, 22 nt, Staphylococcus aureus subsp. aureus Mu50
augucguucaagaacaaucaau

SEQ ID NO: 2038803 - RNA, 14 nt, Staphylococcus aureus subsp. aureus Mu50
augucgaaaauagc

SEQ ID NO: 2038804 - RNA, 20 nt, Staphylococcus aureus subsp. aureus Mu50
augucgaaaauagcuauuaa

SEQ ID NO: 2038805 - RNA, 21 nt, Staphylococcus aureus subsp. aureus Mu50
auguuuuagugacaaacauuu

SEQ ID NO: 2038806 - RNA, 19 nt, Staphylococcus aureus subsp. aureus Mu50
auguuuucguuugcaauca

SEQ ID NO: 2038807 - RNA, 22 nt, Staphylococcus aureus subsp. aureus Mu50
auguuuucguuugcaaucaucu

SEQ ID NO: 2038808 - RNA, 19 nt, Staphylococcus aureus subsp. aureus Mu50
auguuugccagguaaaaau

SEQ ID NO: 2038809 - RNA, 19 nt, Staphylococcus aureus subsp. aureus Mu50
auguuugggauauagaaaa

SEQ ID NO: 2038810 - RNA, 19 nt, Staphylococcus aureus subsp. aureus Mu50
auguuuucuauaauauuua

SEQ ID NO: 2038811 - RNA, 18 nt, Staphylococcus aureus subsp. aureus Mu50
auguuuugagcaauaaug

SEQ ID NO: 2038812 - RNA, 13 nt, Staphylococcus aureus subsp. aureus Mu50
auuaaaauacaaa

SEQ ID NO: 2038813 - RNA, 13 nt, Staphylococcus aureus subsp. aureus Mu50
auuaaaauagagu

SEQ ID NO: 2038814 - RNA, 15 nt, Staphylococcus aureus subsp. aureus Mu50
auuaaaauaugacac

SEQ ID NO: 2038815 - RNA, 22 nt, Staphylococcus aureus subsp. aureus Mu50
auuaaaaggaugugacaaauac

SEQ ID NO: 2038816 - RNA, 14 nt, Staphylococcus aureus subsp. aureus Mu50
auuaaaaaaagauu

SEQ ID NO: 2038817 - RNA, 18 nt, Staphylococcus aureus subsp. aureus Mu50
auuaaaaagguacuaaug

SEQ ID NO: 2038818 - RNA, 18 nt, Staphylococcus aureus subsp. aureus Mu50
auuaaagucaauuuaaau

SEQ ID NO: 2038819 - RNA, 18 nt, Staphylococcus aureus subsp. aureus Mu50
auuaaaguguuucaacau

SEQ ID NO: 2038820 - RNA, 17 nt, Staphylococcus aureus subsp. aureus Mu50
auuaaaugcaauacauu

SEQ ID NO: 2038821 - RNA, 21 nt, Staphylococcus aureus subsp. aureus Mu50
auuaaauaagaugaaauauuc

SEQ ID NO: 2038822 - RNA, 15 nt, Staphylococcus aureus subsp. aureus Mu50
auuaaauauuuagau

SEQ ID NO: 2038823 - RNA, 19 nt, Staphylococcus aureus subsp. aureus Mu50
auuaaaucgauuaagaaug

SEQ ID NO: 2038824 - RNA, 21 nt, Staphylococcus aureus subsp. aureus Mu50
auuaaacuacgaauucucgau

SEQ ID NO: 2038825 - RNA, 16 nt, Staphylococcus aureus subsp. aureus Mu50
auuaaaauucucuuuu

SEQ ID NO: 2038826 - RNA, 14 nt, Staphylococcus aureus subsp. aureus Mu50
auuaaaauuuguua

SEQ ID NO: 2038827 - RNA, 15 nt, Staphylococcus aureus subsp. aureus Mu50
auuaaaauuuguuaa

SEQ ID NO: 2038828 - RNA, 16 nt, Staphylococcus aureus subsp. aureus Mu50
auuaaaccacuuuuuu

SEQ ID NO: 2038829 - RNA, 17 nt, Staphylococcus aureus subsp. aureus Mu50
auuaaacuguuuguuua

SEQ ID NO: 2038830 - RNA, 21 nt, Staphylococcus aureus subsp. aureus Mu50
auuaaaggaaaucaauccauc

SEQ ID NO: 2038831 - RNA, 14 nt, Staphylococcus aureus subsp. aureus Mu50
auguuuaaacauuu

SEQ ID NO: 2038832 - RNA, 21 nt, Staphylococcus aureus subsp. aureus Mu50
auguugucauaccaaauaaau

SEQ ID NO: 2038833 - RNA, 21 nt, Staphylococcus aureus subsp. aureus Mu50
auguuguuucuaaugcucauu

SEQ ID NO: 2038834 - RNA, 18 nt, Staphylococcus aureus subsp. aureus Mu50
auguuucuucguuaguga

SEQ ID NO: 2038835 - RNA, 20 nt, Staphylococcus aureus subsp. aureus Mu50
auguuuccucuuuaaagcua

SEQ ID NO: 2038836 - RNA, 16 nt, Staphylococcus aureus subsp. aureus Mu50
auguuuaaacauuuuu

SEQ ID NO: 2038837 - RNA, 15 nt, Staphylococcus aureus subsp. aureus Mu50
auguuuaauuuucua

SEQ ID NO: 2038838 - RNA, 16 nt, Staphylococcus aureus subsp. aureus Mu50
auguuuaauuuucuaa

SEQ ID NO: 2038839 - RNA, 20 nt, Staphylococcus aureus subsp. aureus Mu50
auguuucauaugcaucaaca

SEQ ID NO: 2038840 - RNA, 17 nt, Staphylococcus aureus subsp. aureus Mu50
auguuuccauuuauuaa

SEQ ID NO: 2038841 - RNA, 17 nt, Staphylococcus aureus subsp. aureus Mu50
auguucccuuaccauuu

SEQ ID NO: 2038842 - RNA, 16 nt, Staphylococcus aureus subsp. aureus Mu50
auguuccgcuacaaaa

SEQ ID NO: 2038843 - RNA, 15 nt, Staphylococcus aureus subsp. aureus Mu50
auguucuuauaaaaa

SEQ ID NO: 2038844 - RNA, 15 nt, Staphylococcus aureus subsp. aureus Mu50
auguugaaagugaca

SEQ ID NO: 2038845 - RNA, 20 nt, Staphylococcus aureus subsp. aureus Mu50
augugccguaucuauaaaaa

SEQ ID NO: 2038846 - RNA, 18 nt, Staphylococcus aureus subsp. aureus Mu50
augugccuuucuaauauu

SEQ ID NO: 2038847 - RNA, 21 nt, Staphylococcus aureus subsp. aureus Mu50
augugccuuugcuuuuuauuu

SEQ ID NO: 2038848 - RNA, 22 nt, Staphylococcus aureus subsp. aureus Mu50
augugagugguuuucuuuauuu

SEQ ID NO: 2038849 - RNA, 19 nt, Staphylococcus aureus subsp. aureus Mu50
augugaaaauuuauucaaa

SEQ ID NO: 2038850 - RNA, 22 nt, Staphylococcus aureus subsp. aureus Mu50
augugaaauaaucccaaccauu

SEQ ID NO: 2038851 - RNA, 22 nt, Staphylococcus aureus subsp. aureus Mu50
augugacauaacagcuaaaaau

SEQ ID NO: 2038852 - RNA, 22 nt, Staphylococcus aureus subsp. aureus Mu50
augugaacaucuaguuauuuca

SEQ ID NO: 2038853 - RNA, 17 nt, Staphylococcus aureus subsp. aureus Mu50
augugcaucauuuauau

SEQ ID NO: 2038854 - RNA, 12 nt, Staphylococcus aureus subsp. aureus Mu50
augugaugauua

SEQ ID NO: 2038855 - RNA, 18 nt, Staphylococcus aureus subsp. aureus Mu50
augugcaaguauaaucca

SEQ ID NO: 2038856 - RNA, 18 nt, Staphylococcus aureus subsp. aureus Mu50
augugucacaaugaccau

SEQ ID NO: 2038857 - RNA, 16 nt, Staphylococcus aureus subsp. aureus Mu50
augugucauaauccau

SEQ ID NO: 2038858 - RNA, 16 nt, Staphylococcus aureus subsp. aureus Mu50
auguguuaaucaacgu

SEQ ID NO: 2038859 - RNA, 14 nt, Staphylococcus aureus subsp. aureus Mu50
auguguuuucaaca

SEQ ID NO: 2038860 - RNA, 21 nt, Staphylococcus aureus subsp. aureus Mu50
auguguuuucaacaguuuuaa

SEQ ID NO: 2038861 - RNA, 19 nt, Staphylococcus aureus subsp. aureus Mu50
auguuaaaauaacugcuaa

SEQ ID NO: 2038862 - RNA, 11 nt, Staphylococcus aureus subsp. aureus Mu50
auguuaaauua

SEQ ID NO: 2038863 - RNA, 22 nt, Staphylococcus aureus subsp. aureus Mu50
auguggguguaccaauugauuu

SEQ ID NO: 2038864 - RNA, 17 nt, Staphylococcus aureus subsp. aureus Mu50
augugguggcuauauaa

SEQ ID NO: 2038865 - RNA, 20 nt, Staphylococcus aureus subsp. aureus Mu50
auguuccauauaaccuauuu

SEQ ID NO: 2038866 - RNA, 13 nt, Staphylococcus aureus subsp. aureus Mu50
auguucaucaaca

SEQ ID NO: 2038867 - RNA, 15 nt, Staphylococcus aureus subsp. aureus Mu50
auguuauaaaaugaa

SEQ ID NO: 2038868 - RNA, 15 nt, Staphylococcus aureus subsp. aureus Mu50
auguuauuaaccauc

SEQ ID NO: 2038869 - RNA, 22 nt, Staphylococcus aureus subsp. aureus Mu50
auguuauugcuuauguuuuuaa

SEQ ID NO: 2038870 - RNA, 20 nt, Staphylococcus aureus subsp. aureus Mu50
auguuauuguuccaaucuuu

SEQ ID NO: 2038871 - RNA, 16 nt, Staphylococcus aureus subsp. aureus Mu50
auuaacauuauccauu

SEQ ID NO: 2038872 - RNA, 13 nt, Staphylococcus aureus subsp. aureus Mu50
auuaacccaacuc

SEQ ID NO: 2038873 - RNA, 16 nt, Staphylococcus aureus subsp. aureus Mu50
auuaacacauucaaau

SEQ ID NO: 2038874 - RNA, 18 nt, Staphylococcus aureus subsp. aureus Mu50
auuaacacauucuuauuu

SEQ ID NO: 2038875 - RNA, 20 nt, Staphylococcus aureus subsp. aureus Mu50
auuaacaacaaauauaaugu

SEQ ID NO: 2038876 - RNA, 16 nt, Staphylococcus aureus subsp. aureus Mu50
auuaacaacuuuauua

SEQ ID NO: 2038877 - RNA, 17 nt, Staphylococcus aureus subsp. aureus Mu50
auuaagcuaugcuuuuu

SEQ ID NO: 2038878 - RNA, 20 nt, Staphylococcus aureus subsp. aureus Mu50
auuaaguugaaaaccucuuu

SEQ ID NO: 2038879 - RNA, 15 nt, Staphylococcus aureus subsp. aureus Mu50
auuaaguaaucugca

SEQ ID NO: 2038880 - RNA, 21 nt, Staphylococcus aureus subsp. aureus Mu50
auuaaggucauuuuuaauuga

SEQ ID NO: 2038881 - RNA, 18 nt, Staphylococcus aureus subsp. aureus Mu50
auuaacuagugccucuuu

SEQ ID NO: 2038882 - RNA, 19 nt, Staphylococcus aureus subsp. aureus Mu50
auuaagauguugaguugua

SEQ ID NO: 2038883 - RNA, 22 nt, Staphylococcus aureus subsp. aureus Mu50
auuaagaaugcaccaacaauag

SEQ ID NO: 2038884 - RNA, 20 nt, Staphylococcus aureus subsp. aureus Mu50
auuagcuuaaguaagauuua

SEQ ID NO: 2038885 - RNA, 13 nt, Staphylococcus aureus subsp. aureus Mu50
auuaggauuaaca

SEQ ID NO: 2038886 - RNA, 16 nt, Staphylococcus aureus subsp. aureus Mu50
auuaggauucaauaau

SEQ ID NO: 2038887 - RNA, 17 nt, Staphylococcus aureus subsp. aureus Mu50
auuaggauucaauaaua

SEQ ID NO: 2038888 - RNA, 22 nt, Staphylococcus aureus subsp. aureus Mu50
auuaggucuacgaucaaaauca

SEQ ID NO: 2038889 - RNA, 17 nt, Staphylococcus aureus subsp. aureus Mu50
auuagguuacuuauuga

SEQ ID NO: 2038890 - RNA, 14 nt, Staphylococcus aureus subsp. aureus Mu50
auuaguaaugauua

SEQ ID NO: 2038891 - RNA, 13 nt, Staphylococcus aureus subsp. aureus Mu50
auuaguccuuaac

SEQ ID NO: 2038892 - RNA, 18 nt, Staphylococcus aureus subsp. aureus Mu50
auuauaaaugaaucgcuu

SEQ ID NO: 2038893 - RNA, 17 nt, Staphylococcus aureus subsp. aureus Mu50
auuaguagccacaauuu

SEQ ID NO: 2038894 - RNA, 21 nt, Staphylococcus aureus subsp. aureus Mu50
auuaguagccacaauuuugac

SEQ ID NO: 2038895 - RNA, 22 nt, Staphylococcus aureus subsp. aureus Mu50
auuagcgcaccaauuaucaaca

SEQ ID NO: 2038896 - RNA, 18 nt, Staphylococcus aureus subsp. aureus Mu50
auuaauaauuuuccaucu

SEQ ID NO: 2038897 - RNA, 19 nt, Staphylococcus aureus subsp. aureus Mu50
auucaauaauuauuaauuu

SEQ ID NO: 2038898 - RNA, 19 nt, Staphylococcus aureus subsp. aureus Mu50
auucaauauuaaucauaau

SEQ ID NO: 2038899 - RNA, 15 nt, Staphylococcus aureus subsp. aureus Mu50
auucaguaucuaaau

SEQ ID NO: 2038900 - RNA, 15 nt, Staphylococcus aureus subsp. aureus Mu50
auucacauacauuuu

SEQ ID NO: 2038901 - RNA, 18 nt, Staphylococcus aureus subsp. aureus Mu50
auucaacgucaucaaaac

SEQ ID NO: 2038902 - RNA, 15 nt, Staphylococcus aureus subsp. aureus Mu50
auucaacuuauuauu

SEQ ID NO: 2038903 - RNA, 21 nt, Staphylococcus aureus subsp. aureus Mu50
auuauuucuagcauguaagcu

SEQ ID NO: 2038904 - RNA, 21 nt, Staphylococcus aureus subsp. aureus Mu50
auucaaacuccuuucuaagau

SEQ ID NO: 2038905 - RNA, 14 nt, Staphylococcus aureus subsp. aureus Mu50
auucaaauaaacac

SEQ ID NO: 2038906 - RNA, 17 nt, Staphylococcus aureus subsp. aureus Mu50
auucaaauaaaucaaac

SEQ ID NO: 2038907 - RNA, 18 nt, Staphylococcus aureus subsp. aureus Mu50
auucauaucuuucaauua

SEQ ID NO: 2038908 - RNA, 13 nt, Staphylococcus aureus subsp. aureus Mu50
auucaucaucauu

SEQ ID NO: 2038909 - RNA, 14 nt, Staphylococcus aureus subsp. aureus Mu50
auucauauuuauau

SEQ ID NO: 2038910 - RNA, 18 nt, Staphylococcus aureus subsp. aureus Mu50
auucaucucagcaauacu

SEQ ID NO: 2038911 - RNA, 23 nt, Staphylococcus aureus subsp. aureus Mu50
auucauacacugcacaucauaau

SEQ ID NO: 2038912 - RNA, 14 nt, Staphylococcus aureus subsp. aureus Mu50
auucaguucaaaca

SEQ ID NO: 2038913 - RNA, 15 nt, Staphylococcus aureus subsp. aureus Mu50
auuauuuaaaaugcu

SEQ ID NO: 2038914 - RNA, 14 nt, Staphylococcus aureus subsp. aureus Mu50
auuauccucaaaua

SEQ ID NO: 2038915 - RNA, 18 nt, Staphylococcus aureus subsp. aureus Mu50
auuaucgaagaaacauua

SEQ ID NO: 2038916 - RNA, 18 nt, Staphylococcus aureus subsp. aureus Mu50
auuauuuaauuuuucuaa

SEQ ID NO: 2038917 - RNA, 17 nt, Staphylococcus aureus subsp. aureus Mu50
auuauugagaauauuua

SEQ ID NO: 2038918 - RNA, 16 nt, Staphylococcus aureus subsp. aureus Mu50
auuauuuauauuuuau

SEQ ID NO: 2038919 - RNA, 14 nt, Staphylococcus aureus subsp. aureus Mu50
auuauuuauucauu

SEQ ID NO: 2038920 - RNA, 19 nt, Staphylococcus aureus subsp. aureus Mu50
auuauuuuguauuuuucaa

SEQ ID NO: 2038921 - RNA, 14 nt, Staphylococcus aureus subsp. aureus Mu50
auuauuuuucaaau

SEQ ID NO: 2038922 - RNA, 15 nt, Staphylococcus aureus subsp. aureus Mu50
auuauuuuucaaaua

SEQ ID NO: 2038923 - RNA, 18 nt, Staphylococcus aureus subsp. aureus Mu50
auuauuuuuuuaaaucua

SEQ ID NO: 2038924 - RNA, 14 nt, Staphylococcus aureus subsp. aureus Mu50
auuaucauugauau

SEQ ID NO: 2038925 - RNA, 15 nt, Staphylococcus aureus subsp. aureus Mu50
auuaucauuguucau

SEQ ID NO: 2038926 - RNA, 13 nt, Staphylococcus aureus subsp. aureus Mu50
auuaucauuaacc

SEQ ID NO: 2038927 - RNA, 11 nt, Staphylococcus aureus subsp. aureus Mu50
auuaucaauug

SEQ ID NO: 2038928 - RNA, 22 nt, Staphylococcus aureus subsp. aureus Mu50
auuauaguguucaagcuuuauu

SEQ ID NO: 2038929 - RNA, 19 nt, Staphylococcus aureus subsp. aureus Mu50
auuauauaauucuucaaau

SEQ ID NO: 2038930 - RNA, 21 nt, Staphylococcus aureus subsp. aureus Mu50
auuauauacuaguucaacuca

SEQ ID NO: 2038931 - RNA, 14 nt, Staphylococcus aureus subsp. aureus Mu50
auuauauagucugc

SEQ ID NO: 2038932 - RNA, 17 nt, Staphylococcus aureus subsp. aureus Mu50
auuauauauauuaaagu

SEQ ID NO: 2038933 - RNA, 17 nt, Staphylococcus aureus subsp. aureus Mu50
auuauaucuuuauauga

SEQ ID NO: 2038934 - RNA, 19 nt, Staphylococcus aureus subsp. aureus Mu50
auuauauuuugaaucagua

SEQ ID NO: 2038935 - RNA, 15 nt, Staphylococcus aureus subsp. aureus Mu50
auuauaauaaaacuu

SEQ ID NO: 2038936 - RNA, 15 nt, Staphylococcus aureus subsp. aureus Mu50
auuauaauagcuuuc

SEQ ID NO: 2038937 - RNA, 13 nt, Staphylococcus aureus subsp. aureus Mu50
auuauaaugauuu

SEQ ID NO: 2038938 - RNA, 23 nt, Staphylococcus aureus subsp. aureus Mu50
auuauaauuuuguuucacuacgu

SEQ ID NO: 2038939 - RNA, 20 nt, Staphylococcus aureus subsp. aureus Mu50
auuagugauauuuuucgaau

SEQ ID NO: 2038940 - RNA, 20 nt, Staphylococcus aureus subsp. aureus Mu50
auuauacaaauuauaaauuu

SEQ ID NO: 2038941 - RNA, 17 nt, Staphylococcus aureus subsp. aureus Mu50
auuauagccuauccauu

SEQ ID NO: 2038942 - RNA, 21 nt, Staphylococcus aureus subsp. aureus Mu50
auucuuauauguuuuaugauu

SEQ ID NO: 2038943 - RNA, 12 nt, Staphylococcus aureus subsp. aureus Mu50
auucuuaucauu

SEQ ID NO: 2038944 - RNA, 12 nt, Staphylococcus aureus subsp. aureus Mu50
auucuuuauauu

SEQ ID NO: 2038945 - RNA, 14 nt, Staphylococcus aureus subsp. aureus Mu50
auucuuuaauauaa

SEQ ID NO: 2038946 - RNA, 22 nt, Staphylococcus aureus subsp. aureus Mu50
auucuuucguuuucaucaacga

SEQ ID NO: 2038947 - RNA, 18 nt, Staphylococcus aureus subsp. aureus Mu50
auugaaauguuuaucaau

SEQ ID NO: 2038948 - RNA, 22 nt, Staphylococcus aureus subsp. aureus Mu50
auugaaauuauccuacugcugu

SEQ ID NO: 2038949 - RNA, 17 nt, Staphylococcus aureus subsp. aureus Mu50
auugaacaauaauaugc

SEQ ID NO: 2038950 - RNA, 18 nt, Staphylococcus aureus subsp. aureus Mu50
auugagauggucuuuuaa

SEQ ID NO: 2038951 - RNA, 17 nt, Staphylococcus aureus subsp. aureus Mu50
auugagaauauuuauug

SEQ ID NO: 2038952 - RNA, 17 nt, Staphylococcus aureus subsp. aureus Mu50
auugacuuacauuuuaa

SEQ ID NO: 2038953 - RNA, 14 nt, Staphylococcus aureus subsp. aureus Mu50
auugaguaucaugc

SEQ ID NO: 2038954 - RNA, 22 nt, Staphylococcus aureus subsp. aureus Mu50
auugauaaauauugaacaauuu

SEQ ID NO: 2038955 - RNA, 16 nt, Staphylococcus aureus subsp. aureus Mu50
auugauaaauuuuuag

SEQ ID NO: 2038956 - RNA, 15 nt, Staphylococcus aureus subsp. aureus Mu50
auugaggauaauuau

SEQ ID NO: 2038957 - RNA, 16 nt, Staphylococcus aureus subsp. aureus Mu50
auugaaugaauucauu

SEQ ID NO: 2038958 - RNA, 14 nt, Staphylococcus aureus subsp. aureus Mu50
auugaauugaaaaa

SEQ ID NO: 2038959 - RNA, 17 nt, Staphylococcus aureus subsp. aureus Mu50
auugaauucucgccaac

SEQ ID NO: 2038960 - RNA, 13 nt, Staphylococcus aureus subsp. aureus Mu50
auugaccaccuuu

SEQ ID NO: 2038961 - RNA, 15 nt, Staphylococcus aureus subsp. aureus Mu50
auugacaguuuccau

SEQ ID NO: 2038962 - RNA, 21 nt, Staphylococcus aureus subsp. aureus Mu50
auucugauacagaaccaacaa

SEQ ID NO: 2038963 - RNA, 16 nt, Staphylococcus aureus subsp. aureus Mu50
auucugaaaucaguuu

SEQ ID NO: 2038964 - RNA, 23 nt, Staphylococcus aureus subsp. aureus Mu50
auucucuaacuuuaccaauauca

SEQ ID NO: 2038965 - RNA, 18 nt, Staphylococcus aureus subsp. aureus Mu50
auucgguccuuugauguu

SEQ ID NO: 2038966 - RNA, 14 nt, Staphylococcus aureus subsp. aureus Mu50
auucgcuuguucag

SEQ ID NO: 2038967 - RNA, 20 nt, Staphylococcus aureus subsp. aureus Mu50
auucgaaaagaaauucuaca

SEQ ID NO: 2038968 - RNA, 18 nt, Staphylococcus aureus subsp. aureus Mu50
auuccuuggugucgaaau

SEQ ID NO: 2038969 - RNA, 13 nt, Staphylococcus aureus subsp. aureus Mu50
auuccuuaaaccg

SEQ ID NO: 2038970 - RNA, 21 nt, Staphylococcus aureus subsp. aureus Mu50
auucauuacuuggaaauguau

SEQ ID NO: 2038971 - RNA, 15 nt, Staphylococcus aureus subsp. aureus Mu50
auuccuauuacuaca

SEQ ID NO: 2038972 - RNA, 16 nt, Staphylococcus aureus subsp. aureus Mu50
auuccugcaaaauguu

SEQ ID NO: 2038973 - RNA, 16 nt, Staphylococcus aureus subsp. aureus Mu50
auuguaaaacaaauua

SEQ ID NO: 2038974 - RNA, 21 nt, Staphylococcus aureus subsp. aureus Mu50
auuguaagauaacgagugaaa

SEQ ID NO: 2038975 - RNA, 22 nt, Staphylococcus aureus subsp. aureus Mu50
auuguaaaugaucaucguauag

SEQ ID NO: 2038976 - RNA, 17 nt, Staphylococcus aureus subsp. aureus Mu50
auugguuugugauuuuu

SEQ ID NO: 2038977 - RNA, 15 nt, Staphylococcus aureus subsp. aureus Mu50
auugguugaucaauu

SEQ ID NO: 2038978 - RNA, 21 nt, Staphylococcus aureus subsp. aureus Mu50
auugcuuaacuuccuuuuuau

SEQ ID NO: 2038979 - RNA, 15 nt, Staphylococcus aureus subsp. aureus Mu50
auuggauaauuucuu

SEQ ID NO: 2038980 - RNA, 18 nt, Staphylococcus aureus subsp. aureus Mu50
auuggauaauuucuucuu

SEQ ID NO: 2038981 - RNA, 20 nt, Staphylococcus aureus subsp. aureus Mu50
auuggauaauuucuucuucu

SEQ ID NO: 2038982 - RNA, 20 nt, Staphylococcus aureus subsp. aureus Mu50
auugcuucuucgucgcugau

SEQ ID NO: 2038983 - RNA, 19 nt, Staphylococcus aureus subsp. aureus Mu50
auuguuagauaaucucauu

SEQ ID NO: 2038984 - RNA, 16 nt, Staphylococcus aureus subsp. aureus Mu50
auuguaagucgaaagu

SEQ ID NO: 2038985 - RNA, 11 nt, Staphylococcus aureus subsp. aureus Mu50
auuguaauaaa

SEQ ID NO: 2038986 - RNA, 21 nt, Staphylococcus aureus subsp. aureus Mu50
auuguaauaaccaugccagcu

SEQ ID NO: 2038987 - RNA, 15 nt, Staphylococcus aureus subsp. aureus Mu50
auuguaauaauaauc

SEQ ID NO: 2038988 - RNA, 14 nt, Staphylococcus aureus subsp. aureus Mu50
auuguaaucuauuu

SEQ ID NO: 2038989 - RNA, 15 nt, Staphylococcus aureus subsp. aureus Mu50
auuguucaauauuua

SEQ ID NO: 2038990 - RNA, 12 nt, Staphylococcus aureus subsp. aureus Mu50
auuguucuaaua

SEQ ID NO: 2038991 - RNA, 20 nt, Staphylococcus aureus subsp. aureus Mu50
auuguuguaauucuuuuuca

SEQ ID NO: 2038992 - RNA, 15 nt, Staphylococcus aureus subsp. aureus Mu50
auuguugcaaugauu

SEQ ID NO: 2038993 - RNA, 16 nt, Staphylococcus aureus subsp. aureus Mu50
auuguugcaaugauua

SEQ ID NO: 2038994 - RNA, 19 nt, Staphylococcus aureus subsp. aureus Mu50
auuuaccauuuucaauaaa

SEQ ID NO: 2038995 - RNA, 22 nt, Staphylococcus aureus subsp. aureus Mu50
auuuaccucuugauaaaauaaa

SEQ ID NO: 2038996 - RNA, 19 nt, Staphylococcus aureus subsp. aureus Mu50
auuuaaagaacuauuuuaa

SEQ ID NO: 2038997 - RNA, 18 nt, Staphylococcus aureus subsp. aureus Mu50
auuuaaaggcauaauaac

SEQ ID NO: 2038998 - RNA, 17 nt, Staphylococcus aureus subsp. aureus Mu50
auuuaaaauauaaauuu

SEQ ID NO: 2038999 - RNA, 22 nt, Staphylococcus aureus subsp. aureus Mu50
auuuaaaauauaaauuucuuca

SEQ ID NO: 2039000 - RNA, 15 nt, Staphylococcus aureus subsp. aureus Mu50
auuuaaaaugauucu

SEQ ID NO: 2039001 - RNA, 22 nt, Staphylococcus aureus subsp. aureus Mu50
auuuaaaagauuagaugauauu

SEQ ID NO: 2039002 - RNA, 18 nt, Staphylococcus aureus subsp. aureus Mu50
auuguuuuacuuucacca

SEQ ID NO: 2039003 - RNA, 17 nt, Staphylococcus aureus subsp. aureus Mu50
auuuaaaaaaugcgcuu

SEQ ID NO: 2039004 - RNA, 17 nt, Staphylococcus aureus subsp. aureus Mu50
auuuaaaaaguuaauaa

SEQ ID NO: 2039005 - RNA, 16 nt, Staphylococcus aureus subsp. aureus Mu50
auuuaaaaaucaaaga

SEQ ID NO: 2039006 - RNA, 17 nt, Staphylococcus aureus subsp. aureus Mu50
auuuaaaaaucgaauuu

SEQ ID NO: 2039007 - RNA, 16 nt, Staphylococcus aureus subsp. aureus Mu50
auuguuuaaacaugua

SEQ ID NO: 2039008 - RNA, 20 nt, Staphylococcus aureus subsp. aureus Mu50
auuguuuaauaacaaaauua

SEQ ID NO: 2039009 - RNA, 14 nt, Staphylococcus aureus subsp. aureus Mu50
auuguuuacaaagu

SEQ ID NO: 2039010 - RNA, 24 nt, Staphylococcus aureus subsp. aureus Mu50
auuguuuauuaggauucaauaaua

SEQ ID NO: 2039011 - RNA, 20 nt, Staphylococcus aureus subsp. aureus Mu50
auugcaacgcaucacaaaau

SEQ ID NO: 2039012 - RNA, 19 nt, Staphylococcus aureus subsp. aureus Mu50
auugcaaugcuaucaugcc

SEQ ID NO: 2039013 - RNA, 15 nt, Staphylococcus aureus subsp. aureus Mu50
auugauuguauuuuu

SEQ ID NO: 2039014 - RNA, 22 nt, Staphylococcus aureus subsp. aureus Mu50
auugauucuacagcaucaccua

SEQ ID NO: 2039015 - RNA, 19 nt, Staphylococcus aureus subsp. aureus Mu50
auugauucaagcaucauuu

SEQ ID NO: 2039016 - RNA, 15 nt, Staphylococcus aureus subsp. aureus Mu50
auugaucugauuuca

SEQ ID NO: 2039017 - RNA, 15 nt, Staphylococcus aureus subsp. aureus Mu50
auugaucgauuguuu

SEQ ID NO: 2039018 - RNA, 18 nt, Staphylococcus aureus subsp. aureus Mu50
auugauauggaucauaau

SEQ ID NO: 2039019 - RNA, 15 nt, Staphylococcus aureus subsp. aureus Mu50
auugauagauagaaa

SEQ ID NO: 2039020 - RNA, 15 nt, Staphylococcus aureus subsp. aureus Mu50
auugcuauauuagua

SEQ ID NO: 2039021 - RNA, 18 nt, Staphylococcus aureus subsp. aureus Mu50
auugccguuauuuucaau

SEQ ID NO: 2039022 - RNA, 21 nt, Staphylococcus aureus subsp. aureus Mu50
aucgcagcaaugacacuaauu

SEQ ID NO: 2039023 - RNA, 17 nt, Staphylococcus aureus subsp. aureus Mu50
aucgcauguuuguaaau

SEQ ID NO: 2039024 - RNA, 20 nt, Staphylococcus aureus subsp. aureus Mu50
aucgcauucuugguuuuuua

SEQ ID NO: 2039025 - RNA, 23 nt, Staphylococcus aureus subsp. aureus Mu50
aucgauuaagaaugcaccaacaa

SEQ ID NO: 2039026 - RNA, 23 nt, Staphylococcus aureus subsp. aureus Mu50
aucgauuuuggcacauaaaucaa

SEQ ID NO: 2039027 - RNA, 20 nt, Staphylococcus aureus subsp. aureus Mu50
aucgauacuggguuuuacca

SEQ ID NO: 2039028 - RNA, 18 nt, Staphylococcus aureus subsp. aureus Mu50
aucgaugacuuugucuuu

SEQ ID NO: 2039029 - RNA, 16 nt, Staphylococcus aureus subsp. aureus Mu50
aucgacuaauuuuucu

SEQ ID NO: 2039030 - RNA, 16 nt, Staphylococcus aureus subsp. aureus Mu50
aucgauacuaauaucu

SEQ ID NO: 2039031 - RNA, 17 nt, Staphylococcus aureus subsp. aureus Mu50
aucgauauucuccaacu

SEQ ID NO: 2039032 - RNA, 16 nt, Staphylococcus aureus subsp. aureus Mu50
aucgauauagcauaaa

SEQ ID NO: 2039033 - RNA, 15 nt, Staphylococcus aureus subsp. aureus Mu50
aucgcuugcuucuuu

SEQ ID NO: 2039034 - RNA, 15 nt, Staphylococcus aureus subsp. aureus Mu50
aucggaucauuauuu

SEQ ID NO: 2039035 - RNA, 16 nt, Staphylococcus aureus subsp. aureus Mu50
aucgccuacuauaaau

SEQ ID NO: 2039036 - RNA, 15 nt, Staphylococcus aureus subsp. aureus Mu50
aucggcucuuuuugu

SEQ ID NO: 2039037 - RNA, 17 nt, Staphylococcus aureus subsp. aureus Mu50
aucggcaccaguagcua

SEQ ID NO: 2039038 - RNA, 17 nt, Staphylococcus aureus subsp. aureus Mu50
aucuacaauauuaaaau

SEQ ID NO: 2039039 - RNA, 20 nt, Staphylococcus aureus subsp. aureus Mu50
aucuacaauauucaauaauu

SEQ ID NO: 2039040 - RNA, 14 nt, Staphylococcus aureus subsp. aureus Mu50
aucuaacaaucguu

SEQ ID NO: 2039041 - RNA, 15 nt, Staphylococcus aureus subsp. aureus Mu50
aucuaauacuuucac

SEQ ID NO: 2039042 - RNA, 21 nt, Staphylococcus aureus subsp. aureus Mu50
aucuaaagcuauaaaaaaucu

SEQ ID NO: 2039043 - RNA, 14 nt, Staphylococcus aureus subsp. aureus Mu50
aucuacaucaaauu

SEQ ID NO: 2039044 - RNA, 18 nt, Staphylococcus aureus subsp. aureus Mu50
aucuacucaaauauaaau

SEQ ID NO: 2039045 - RNA, 20 nt, Staphylococcus aureus subsp. aureus Mu50
aucuauaaauaucaauaauu

SEQ ID NO: 2039046 - RNA, 21 nt, Staphylococcus aureus subsp. aureus Mu50
aucuauugugauauaugaaau

SEQ ID NO: 2039047 - RNA, 17 nt, Staphylococcus aureus subsp. aureus Mu50
aucuaugaaauuuuuua

SEQ ID NO: 2039048 - RNA, 12 nt, Staphylococcus aureus subsp. aureus Mu50
aucuauuuagcu

SEQ ID NO: 2039049 - RNA, 13 nt, Staphylococcus aureus subsp. aureus Mu50
aucuauauaaaaa

SEQ ID NO: 2039050 - RNA, 13 nt, Staphylococcus aureus subsp. aureus Mu50
aucuauauaaaug

SEQ ID NO: 2039051 - RNA, 15 nt, Staphylococcus aureus subsp. aureus Mu50
aucguucgaaguagc

SEQ ID NO: 2039052 - RNA, 18 nt, Staphylococcus aureus subsp. aureus Mu50
aucguucauauauuuugu

SEQ ID NO: 2039053 - RNA, 14 nt, Staphylococcus aureus subsp. aureus Mu50
aucuaaacauuuuu

SEQ ID NO: 2039054 - RNA, 13 nt, Staphylococcus aureus subsp. aureus Mu50
aucgucaucacuu

SEQ ID NO: 2039055 - RNA, 23 nt, Staphylococcus aureus subsp. aureus Mu50
aucgucucacuuaauaaauaauu

SEQ ID NO: 2039056 - RNA, 20 nt, Staphylococcus aureus subsp. aureus Mu50
aucuuuagcuauguaaaauu

SEQ ID NO: 2039057 - RNA, 11 nt, Staphylococcus aureus subsp. aureus Mu50
aucuuuaucag

SEQ ID NO: 2039058 - RNA, 16 nt, Staphylococcus aureus subsp. aureus Mu50
aucuuuaucauuauuc

SEQ ID NO: 2039059 - RNA, 13 nt, Staphylococcus aureus subsp. aureus Mu50
aucuuuaccauau

SEQ ID NO: 2039060 - RNA, 15 nt, Staphylococcus aureus subsp. aureus Mu50
aucuuuaauuuacaa

SEQ ID NO: 2039061 - RNA, 21 nt, Staphylococcus aureus subsp. aureus Mu50
aucuuuaauuuacaauuaauu

SEQ ID NO: 2039062 - RNA, 15 nt, Staphylococcus aureus subsp. aureus Mu50
aucuucuaauuaaga

SEQ ID NO: 2039063 - RNA, 22 nt, Staphylococcus aureus subsp. aureus Mu50
aucuucguauaguacuaaaagu

SEQ ID NO: 2039064 - RNA, 18 nt, Staphylococcus aureus subsp. aureus Mu50
aucuucugauacaucauc

SEQ ID NO: 2039065 - RNA, 22 nt, Staphylococcus aureus subsp. aureus Mu50
aucuucuggauagguaucacua

SEQ ID NO: 2039066 - RNA, 14 nt, Staphylococcus aureus subsp. aureus Mu50
aucuucaugaacag

SEQ ID NO: 2039067 - RNA, 17 nt, Staphylococcus aureus subsp. aureus Mu50
aucuucgacaacugauu

SEQ ID NO: 2039068 - RNA, 15 nt, Staphylococcus aureus subsp. aureus Mu50
aucuucaguuauuug

SEQ ID NO: 2039069 - RNA, 20 nt, Staphylococcus aureus subsp. aureus Mu50
aucuuaaucagcuauaaaag

SEQ ID NO: 2039070 - RNA, 19 nt, Staphylococcus aureus subsp. aureus Mu50
aucuuaggugucaucgcuu

SEQ ID NO: 2039071 - RNA, 15 nt, Staphylococcus aureus subsp. aureus Mu50
aucuuaguacaaaau

SEQ ID NO: 2039072 - RNA, 14 nt, Staphylococcus aureus subsp. aureus Mu50
aucuuaucauaauc

SEQ ID NO: 2039073 - RNA, 16 nt, Staphylococcus aureus subsp. aureus Mu50
aucuucacacuuuuag

SEQ ID NO: 2039074 - RNA, 17 nt, Staphylococcus aureus subsp. aureus Mu50
aucuuaugacugcuuuu

SEQ ID NO: 2039075 - RNA, 18 nt, Staphylococcus aureus subsp. aureus Mu50
aucuuaugauacuuugaa

SEQ ID NO: 2039076 - RNA, 12 nt, Staphylococcus aureus subsp. aureus Mu50
aucuuauuauua

SEQ ID NO: 2039077 - RNA, 14 nt, Staphylococcus aureus subsp. aureus Mu50
aucuguucauaaug

SEQ ID NO: 2039078 - RNA, 16 nt, Staphylococcus aureus subsp. aureus Mu50
aucuguugucaucaug

SEQ ID NO: 2039079 - RNA, 16 nt, Staphylococcus aureus subsp. aureus Mu50
aucuuaacaacuuuaa

SEQ ID NO: 2039080 - RNA, 21 nt, Staphylococcus aureus subsp. aureus Mu50
aucuuaagucaucaaucgcuu

SEQ ID NO: 2039081 - RNA, 13 nt, Staphylococcus aureus subsp. aureus Mu50
aucuguaacuaau

SEQ ID NO: 2039082 - RNA, 17 nt, Staphylococcus aureus subsp. aureus Mu50
aucuguaacuaauauga

SEQ ID NO: 2039083 - RNA, 14 nt, Staphylococcus aureus subsp. aureus Mu50
aucuguaucaaaau

SEQ ID NO: 2039084 - RNA, 16 nt, Staphylococcus aureus subsp. aureus Mu50
aucuguaucaaucaac

SEQ ID NO: 2039085 - RNA, 22 nt, Staphylococcus aureus subsp. aureus Mu50
aucuguaccguuuuuuauaaau

SEQ ID NO: 2039086 - RNA, 19 nt, Staphylococcus aureus subsp. aureus Mu50
aucuguagaaacacuuuua

SEQ ID NO: 2039087 - RNA, 16 nt, Staphylococcus aureus subsp. aureus Mu50
aucugguauuuuauga

SEQ ID NO: 2039088 - RNA, 15 nt, Staphylococcus aureus subsp. aureus Mu50
augaauuaauagcuu

SEQ ID NO: 2039089 - RNA, 21 nt, Staphylococcus aureus subsp. aureus Mu50
augaauguaacguacaauuua

SEQ ID NO: 2039090 - RNA, 22 nt, Staphylococcus aureus subsp. aureus Mu50
augaauugcuuguucuuucuuu

SEQ ID NO: 2039091 - RNA, 21 nt, Staphylococcus aureus subsp. aureus Mu50
augaauugcuuguuuuaaaug

SEQ ID NO: 2039092 - RNA, 21 nt, Staphylococcus aureus subsp. aureus Mu50
augaauuguuaguuuucuuaa

SEQ ID NO: 2039093 - RNA, 20 nt, Staphylococcus aureus subsp. aureus Mu50
augaauuguuguacauguau

SEQ ID NO: 2039094 - RNA, 19 nt, Staphylococcus aureus subsp. aureus Mu50
augaauuuacuccuuacaa

SEQ ID NO: 2039095 - RNA, 22 nt, Staphylococcus aureus subsp. aureus Mu50
augaccauugucaugccuucau

SEQ ID NO: 2039096 - RNA, 19 nt, Staphylococcus aureus subsp. aureus Mu50
aucuuucgagguaauuuca

SEQ ID NO: 2039097 - RNA, 14 nt, Staphylococcus aureus subsp. aureus Mu50
aucuuuauuuuuua

SEQ ID NO: 2039098 - RNA, 13 nt, Staphylococcus aureus subsp. aureus Mu50
aucuuucaaagua

SEQ ID NO: 2039099 - RNA, 18 nt, Staphylococcus aureus subsp. aureus Mu50
aucuuuguuauauuuuua

SEQ ID NO: 2039100 - RNA, 18 nt, Staphylococcus aureus subsp. aureus Mu50
aucuuuguugcaaugcau

SEQ ID NO: 2039101 - RNA, 18 nt, Staphylococcus aureus subsp. aureus Mu50
aucuuuuagguaauaauu

SEQ ID NO: 2039102 - RNA, 21 nt, Staphylococcus aureus subsp. aureus Mu50
aucuuuuauaaugaacaacaa

SEQ ID NO: 2039103 - RNA, 17 nt, Staphylococcus aureus subsp. aureus Mu50
aucuuuucaucguucau

SEQ ID NO: 2039104 - RNA, 17 nt, Staphylococcus aureus subsp. aureus Mu50
aucuuuuuuacuaaaau

SEQ ID NO: 2039105 - RNA, 22 nt, Staphylococcus aureus subsp. aureus Mu50
aucuuuuuuacuaaaaucacuu

SEQ ID NO: 2039106 - RNA, 19 nt, Staphylococcus aureus subsp. aureus Mu50
aucuuuugucuuacuaauu

SEQ ID NO: 2039107 - RNA, 14 nt, Staphylococcus aureus subsp. aureus Mu50
augaaucaacaauu

SEQ ID NO: 2039108 - RNA, 15 nt, Staphylococcus aureus subsp. aureus Mu50
augaauagauaaucg

SEQ ID NO: 2039109 - RNA, 22 nt, Staphylococcus aureus subsp. aureus Mu50
augaauaauuagauuuaaaaug

SEQ ID NO: 2039110 - RNA, 18 nt, Staphylococcus aureus subsp. aureus Mu50
augaauaauugcuaaaau

SEQ ID NO: 2039111 - RNA, 23 nt, Staphylococcus aureus subsp. aureus Mu50
aucuuuugcguccucaugacauu

SEQ ID NO: 2039112 - RNA, 21 nt, Staphylococcus aureus subsp. aureus Mu50
augaaucgauauaaugaaguu

SEQ ID NO: 2039113 - RNA, 22 nt, Staphylococcus aureus subsp. aureus Mu50
augaaucccauaacaaucauuu

SEQ ID NO: 2039114 - RNA, 22 nt, Staphylococcus aureus subsp. aureus Mu50
augaauggcaaucuauauaaau

SEQ ID NO: 2039115 - RNA, 15 nt, Staphylococcus aureus subsp. aureus Mu50
augaaugauugcauu

SEQ ID NO: 2039116 - RNA, 13 nt, Staphylococcus aureus subsp. aureus Mu50
augacuaacgaaa

SEQ ID NO: 2039117 - RNA, 19 nt, Staphylococcus aureus subsp. aureus Mu50
augacugagaaaaauauuu

SEQ ID NO: 2039118 - RNA, 13 nt, Staphylococcus aureus subsp. aureus Mu50
augacugcaaaua

SEQ ID NO: 2039119 - RNA, 11 nt, Staphylococcus aureus subsp. aureus Mu50
augaguacaac

SEQ ID NO: 2039120 - RNA, 16 nt, Staphylococcus aureus subsp. aureus Mu50
augaguaugacgaaau

SEQ ID NO: 2039121 - RNA, 20 nt, Staphylococcus aureus subsp. aureus Mu50
augacuuauuuuucaucauu

SEQ ID NO: 2039122 - RNA, 22 nt, Staphylococcus aureus subsp. aureus Mu50
augacuuauuuuucaucauuua

SEQ ID NO: 2039123 - RNA, 16 nt, Staphylococcus aureus subsp. aureus Mu50
augacuucacauuuau

SEQ ID NO: 2039124 - RNA, 20 nt, Staphylococcus aureus subsp. aureus Mu50
augacuucacauuuauccuu

SEQ ID NO: 2039125 - RNA, 16 nt, Staphylococcus aureus subsp. aureus Mu50
augacuucuuuauauu

SEQ ID NO: 2039126 - RNA, 14 nt, Staphylococcus aureus subsp. aureus Mu50
augauauauucauc

SEQ ID NO: 2039127 - RNA, 22 nt, Staphylococcus aureus subsp. aureus Mu50
augauacaaacccauauaaaug

SEQ ID NO: 2039128 - RNA, 17 nt, Staphylococcus aureus subsp. aureus Mu50
augauaauuuaauaacg

SEQ ID NO: 2039129 - RNA, 17 nt, Staphylococcus aureus subsp. aureus Mu50
augauaauuuaauaaug

SEQ ID NO: 2039130 - RNA, 16 nt, Staphylococcus aureus subsp. aureus Mu50
augauacgcuuuuuaa

SEQ ID NO: 2039131 - RNA, 19 nt, Staphylococcus aureus subsp. aureus Mu50
augauacgugguuuuauuu

SEQ ID NO: 2039132 - RNA, 22 nt, Staphylococcus aureus subsp. aureus Mu50
augauagaauacuaaaaguguu

SEQ ID NO: 2039133 - RNA, 16 nt, Staphylococcus aureus subsp. aureus Mu50
augauagcaaugaauu

SEQ ID NO: 2039134 - RNA, 16 nt, Staphylococcus aureus subsp. aureus Mu50
augauagccgcuucau

SEQ ID NO: 2039135 - RNA, 24 nt, Staphylococcus aureus subsp. aureus Mu50
augaguuucucaucuacuauuuaa

SEQ ID NO: 2039136 - RNA, 20 nt, Staphylococcus aureus subsp. aureus Mu50
augaguucuaguuuuuuuua

SEQ ID NO: 2039137 - RNA, 22 nt, Staphylococcus aureus subsp. aureus Mu50
augaucaagcugagcuuuaauu

SEQ ID NO: 2039138 - RNA, 22 nt, Staphylococcus aureus subsp. aureus Mu50
augauauugauuugauucauua

SEQ ID NO: 2039139 - RNA, 15 nt, Staphylococcus aureus subsp. aureus Mu50
augauccuuuaaugc

SEQ ID NO: 2039140 - RNA, 20 nt, Staphylococcus aureus subsp. aureus Mu50
caccauacuucguugucacu

SEQ ID NO: 2039141 - RNA, 17 nt, Staphylococcus aureus subsp. aureus Mu50
caccauacuaaaacaug

SEQ ID NO: 2039142 - RNA, 14 nt, Staphylococcus aureus subsp. aureus Mu50
caccauaugcuaaa

SEQ ID NO: 2039143 - RNA, 18 nt, Staphylococcus aureus subsp. aureus Mu50
caccauuuacuucauaag

SEQ ID NO: 2039144 - RNA, 21 nt, Staphylococcus aureus subsp. aureus Mu50
caccaguuugugguaaugauu

SEQ ID NO: 2039145 - RNA, 14 nt, Staphylococcus aureus subsp. aureus Mu50
cacaguguugaauu

SEQ ID NO: 2039146 - RNA, 21 nt, Staphylococcus aureus subsp. aureus Mu50
cacaguggauuacagaugaug

SEQ ID NO: 2039147 - RNA, 16 nt, Staphylococcus aureus subsp. aureus Mu50
cacauaaaaauaaucc

SEQ ID NO: 2039148 - RNA, 11 nt, Staphylococcus aureus subsp. aureus Mu50
cacauaaauca

SEQ ID NO: 2039149 - RNA, 14 nt, Staphylococcus aureus subsp. aureus Mu50
cacauacauaucuu

SEQ ID NO: 2039150 - RNA, 20 nt, Staphylococcus aureus subsp. aureus Mu50
cacauccccuuugauaaguu

SEQ ID NO: 2039151 - RNA, 21 nt, Staphylococcus aureus subsp. aureus Mu50
caauuuuuucaugauuuacua

SEQ ID NO: 2039152 - RNA, 18 nt, Staphylococcus aureus subsp. aureus Mu50
caauuuucgauauuuguu

SEQ ID NO: 2039153 - RNA, 19 nt, Staphylococcus aureus subsp. aureus Mu50
cacauucuuauuugaaaug

SEQ ID NO: 2039154 - RNA, 14 nt, Staphylococcus aureus subsp. aureus Mu50
cacauuuacuuaag

SEQ ID NO: 2039155 - RNA, 23 nt, Staphylococcus aureus subsp. aureus Mu50
cacauuuauaacauacguuauuu

SEQ ID NO: 2039156 - RNA, 17 nt, Staphylococcus aureus subsp. aureus Mu50
caacaaauugugauuua

SEQ ID NO: 2039157 - RNA, 20 nt, Staphylococcus aureus subsp. aureus Mu50
caacaaacgcugauuuaaua

SEQ ID NO: 2039158 - RNA, 18 nt, Staphylococcus aureus subsp. aureus Mu50
caacaacuuuacgauaaa

SEQ ID NO: 2039159 - RNA, 18 nt, Staphylococcus aureus subsp. aureus Mu50
caacaacuaagauauauu

SEQ ID NO: 2039160 - RNA, 14 nt, Staphylococcus aureus subsp. aureus Mu50
caacaaucaaauua

SEQ ID NO: 2039161 - RNA, 18 nt, Staphylococcus aureus subsp. aureus Mu50
caacaaucacgauuaaug

SEQ ID NO: 2039162 - RNA, 23 nt, Staphylococcus aureus subsp. aureus Mu50
caaaucucgucacauauaaauau

SEQ ID NO: 2039163 - RNA, 19 nt, Staphylococcus aureus subsp. aureus Mu50
caaaucguuucaugcacuu

SEQ ID NO: 2039164 - RNA, 16 nt, Staphylococcus aureus subsp. aureus Mu50
caaauagacaccaaaa

SEQ ID NO: 2039165 - RNA, 18 nt, Staphylococcus aureus subsp. aureus Mu50
caaauagagaaauacuau

SEQ ID NO: 2039166 - RNA, 10 nt, Staphylococcus aureus subsp. aureus Mu50
caaauacuuc

SEQ ID NO: 2039167 - RNA, 22 nt, Staphylococcus aureus subsp. aureus Mu50
caaaugugguggguauauaauu

SEQ ID NO: 2039168 - RNA, 15 nt, Staphylococcus aureus subsp. aureus Mu50
caaauguaacauuaa

SEQ ID NO: 2039169 - RNA, 16 nt, Staphylococcus aureus subsp. aureus Mu50
caaaugcucccuucaa

SEQ ID NO: 2039170 - RNA, 17 nt, Staphylococcus aureus subsp. aureus Mu50
auuuagucauuacaaau

SEQ ID NO: 2039171 - RNA, 20 nt, Staphylococcus aureus subsp. aureus Mu50
auuuaguuuuuuuaaaguuu

SEQ ID NO: 2039172 - RNA, 17 nt, Staphylococcus aureus subsp. aureus Mu50
auuuagugaaacaauuu

SEQ ID NO: 2039173 - RNA, 15 nt, Staphylococcus aureus subsp. aureus Mu50
auuuaguuauaauuu

SEQ ID NO: 2039174 - RNA, 15 nt, Staphylococcus aureus subsp. aureus Mu50
auuuaguaucucauu

SEQ ID NO: 2039175 - RNA, 15 nt, Staphylococcus aureus subsp. aureus Mu50
auuuagucauuacaa

SEQ ID NO: 2039176 - RNA, 15 nt, Staphylococcus aureus subsp. aureus Mu50
auuuaguaucaugau

SEQ ID NO: 2039177 - RNA, 20 nt, Staphylococcus aureus subsp. aureus Mu50
auuuagauacugaauuuuaa

SEQ ID NO: 2039178 - RNA, 21 nt, Staphylococcus aureus subsp. aureus Mu50
auuuagaagaacaauaauuga

SEQ ID NO: 2039179 - RNA, 15 nt, Staphylococcus aureus subsp. aureus Mu50
auuuacgaaaguaga

SEQ ID NO: 2039180 - RNA, 14 nt, Staphylococcus aureus subsp. aureus Mu50
caaaguuauaaugg

SEQ ID NO: 2039181 - RNA, 17 nt, Staphylococcus aureus subsp. aureus Mu50
caaaguucguaauuguc

SEQ ID NO: 2039182 - RNA, 13 nt, Staphylococcus aureus subsp. aureus Mu50
caaaguuaaccau

SEQ ID NO: 2039183 - RNA, 17 nt, Staphylococcus aureus subsp. aureus Mu50
caaaguuuauacuuaau

SEQ ID NO: 2039184 - RNA, 16 nt, Staphylococcus aureus subsp. aureus Mu50
caaauaacguuaauau

SEQ ID NO: 2039185 - RNA, 19 nt, Staphylococcus aureus subsp. aureus Mu50
caaauaaaugacauuuaau

SEQ ID NO: 2039186 - RNA, 22 nt, Staphylococcus aureus subsp. aureus Mu50
caaauaaaugacauuuaauacu

SEQ ID NO: 2039187 - RNA, 21 nt, Staphylococcus aureus subsp. aureus Mu50
caaauacaugugggauaucuu

SEQ ID NO: 2039188 - RNA, 18 nt, Staphylococcus aureus subsp. aureus Mu50
caaauacauuucaaaaaa

SEQ ID NO: 2039189 - RNA, 17 nt, Staphylococcus aureus subsp. aureus Mu50
caaagcucaauaaauua

SEQ ID NO: 2039190 - RNA, 14 nt, Staphylococcus aureus subsp. aureus Mu50
caaagccuuaauau

SEQ ID NO: 2039191 - RNA, 16 nt, Staphylococcus aureus subsp. aureus Mu50
caacauaauauuucuu

SEQ ID NO: 2039192 - RNA, 22 nt, Staphylococcus aureus subsp. aureus Mu50
caacaucaucuuuaauuuucuu

SEQ ID NO: 2039193 - RNA, 13 nt, Staphylococcus aureus subsp. aureus Mu50
caaccaauuauua

SEQ ID NO: 2039194 - RNA, 12 nt, Staphylococcus aureus subsp. aureus Mu50
caacauuuuuua

SEQ ID NO: 2039195 - RNA, 17 nt, Staphylococcus aureus subsp. aureus Mu50
caacauugagauuaucu

SEQ ID NO: 2039196 - RNA, 13 nt, Staphylococcus aureus subsp. aureus Mu50
caacauuaauaaa

SEQ ID NO: 2039197 - RNA, 17 nt, Staphylococcus aureus subsp. aureus Mu50
caacauuacuaauugau

SEQ ID NO: 2039198 - RNA, 13 nt, Staphylococcus aureus subsp. aureus Mu50
caacaucuucaac

SEQ ID NO: 2039199 - RNA, 13 nt, Staphylococcus aureus subsp. aureus Mu50
caacaucgauuua

SEQ ID NO: 2039200 - RNA, 19 nt, Staphylococcus aureus subsp. aureus Mu50
caacgacacgaacaacauu

SEQ ID NO: 2039201 - RNA, 23 nt, Staphylococcus aureus subsp. aureus Mu50
caacgcauauucuauuguuguuu

SEQ ID NO: 2039202 - RNA, 19 nt, Staphylococcus aureus subsp. aureus Mu50
caaccugugauaaaaaucu

SEQ ID NO: 2039203 - RNA, 18 nt, Staphylococcus aureus subsp. aureus Mu50
caaccucugauguguuau

SEQ ID NO: 2039204 - RNA, 16 nt, Staphylococcus aureus subsp. aureus Mu50
caauaugauuaauaaa

SEQ ID NO: 2039205 - RNA, 16 nt, Staphylococcus aureus subsp. aureus Mu50
caauaucuucuuuuaa

SEQ ID NO: 2039206 - RNA, 24 nt, Staphylococcus aureus subsp. aureus Mu50
caauaucuucuuuuaauauuugau

SEQ ID NO: 2039207 - RNA, 13 nt, Staphylococcus aureus subsp. aureus Mu50
caauauucguaaa

SEQ ID NO: 2039208 - RNA, 12 nt, Staphylococcus aureus subsp. aureus Mu50
caauauuucugg

SEQ ID NO: 2039209 - RNA, 14 nt, Staphylococcus aureus subsp. aureus Mu50
caauauucaauaau

SEQ ID NO: 2039210 - RNA, 17 nt, Staphylococcus aureus subsp. aureus Mu50
caaucacaauauaacau

SEQ ID NO: 2039211 - RNA, 18 nt, Staphylococcus aureus subsp. aureus Mu50
caaucgauuuuauaucuu

SEQ ID NO: 2039212 - RNA, 20 nt, Staphylococcus aureus subsp. aureus Mu50
caauccuauggcgcaauuuu

SEQ ID NO: 2039213 - RNA, 14 nt, Staphylococcus aureus subsp. aureus Mu50
caaguccaaauaau

SEQ ID NO: 2039214 - RNA, 20 nt, Staphylococcus aureus subsp. aureus Mu50
caaguagucuacaguaaauu

SEQ ID NO: 2039215 - RNA, 12 nt, Staphylococcus aureus subsp. aureus Mu50
caagguuucaag

SEQ ID NO: 2039216 - RNA, 22 nt, Staphylococcus aureus subsp. aureus Mu50
caagguguucgggaauuuuuua

SEQ ID NO: 2039217 - RNA, 14 nt, Staphylococcus aureus subsp. aureus Mu50
caauagguucauua

SEQ ID NO: 2039218 - RNA, 17 nt, Staphylococcus aureus subsp. aureus Mu50
caauagguacaacuaaa

SEQ ID NO: 2039219 - RNA, 20 nt, Staphylococcus aureus subsp. aureus Mu50
caauagguacaacuaaauau

SEQ ID NO: 2039220 - RNA, 16 nt, Staphylococcus aureus subsp. aureus Mu50
caauaguuuauaaauu

SEQ ID NO: 2039221 - RNA, 19 nt, Staphylococcus aureus subsp. aureus Mu50
caauauaauuugguuaaua

SEQ ID NO: 2039222 - RNA, 14 nt, Staphylococcus aureus subsp. aureus Mu50
caauauaguaccaa

SEQ ID NO: 2039223 - RNA, 19 nt, Staphylococcus aureus subsp. aureus Mu50
caauagaugaaaauuuaau

SEQ ID NO: 2039224 - RNA, 17 nt, Staphylococcus aureus subsp. aureus Mu50
caauagcgguuuaaaaa

SEQ ID NO: 2039225 - RNA, 18 nt, Staphylococcus aureus subsp. aureus Mu50
caaucuuaguacaaaauu

SEQ ID NO: 2039226 - RNA, 14 nt, Staphylococcus aureus subsp. aureus Mu50
caaucuguucauaa

SEQ ID NO: 2039227 - RNA, 15 nt, Staphylococcus aureus subsp. aureus Mu50
caaucuguucauaau

SEQ ID NO: 2039228 - RNA, 17 nt, Staphylococcus aureus subsp. aureus Mu50
caaucguaacuaacaug

SEQ ID NO: 2039229 - RNA, 21 nt, Staphylococcus aureus subsp. aureus Mu50
caaucuccauuagaacuaaga

SEQ ID NO: 2039230 - RNA, 19 nt, Staphylococcus aureus subsp. aureus Mu50
caaucguugaaaaauaucc

SEQ ID NO: 2039231 - RNA, 16 nt, Staphylococcus aureus subsp. aureus Mu50
caaugcaccuauaaua

SEQ ID NO: 2039232 - RNA, 22 nt, Staphylococcus aureus subsp. aureus Mu50
caaugcagcuguauuuaauaaa

SEQ ID NO: 2039233 - RNA, 19 nt, Staphylococcus aureus subsp. aureus Mu50
caaugauugaauauuguug

SEQ ID NO: 2039234 - RNA, 19 nt, Staphylococcus aureus subsp. aureus Mu50
caaugcuuccaucacauca

SEQ ID NO: 2039235 - RNA, 16 nt, Staphylococcus aureus subsp. aureus Mu50
caauucggauuauauu

SEQ ID NO: 2039236 - RNA, 15 nt, Staphylococcus aureus subsp. aureus Mu50
caauucgcauuaaau

SEQ ID NO: 2039237 - RNA, 17 nt, Staphylococcus aureus subsp. aureus Mu50
caauuauuuuucaaaua

SEQ ID NO: 2039238 - RNA, 11 nt, Staphylococcus aureus subsp. aureus Mu50
caauucaaacu

SEQ ID NO: 2039239 - RNA, 13 nt, Staphylococcus aureus subsp. aureus Mu50
caauuaaagucaa

SEQ ID NO: 2039240 - RNA, 14 nt, Staphylococcus aureus subsp. aureus Mu50
caauuaaagucaau

SEQ ID NO: 2039241 - RNA, 15 nt, Staphylococcus aureus subsp. aureus Mu50
caauuaaaacuauaa

SEQ ID NO: 2039242 - RNA, 19 nt, Staphylococcus aureus subsp. aureus Mu50
caauuaaaacuauaauaaa

SEQ ID NO: 2039243 - RNA, 22 nt, Staphylococcus aureus subsp. aureus Mu50
caauuaauuuagucauuacaaa

SEQ ID NO: 2039244 - RNA, 18 nt, Staphylococcus aureus subsp. aureus Mu50
caauuaauguaaugauac

SEQ ID NO: 2039245 - RNA, 19 nt, Staphylococcus aureus subsp. aureus Mu50
caauuaacuugauaucauc

SEQ ID NO: 2039246 - RNA, 12 nt, Staphylococcus aureus subsp. aureus Mu50
caauuaauguaa

SEQ ID NO: 2039247 - RNA, 15 nt, Staphylococcus aureus subsp. aureus Mu50
caauuaauguaauga

SEQ ID NO: 2039248 - RNA, 15 nt, Staphylococcus aureus subsp. aureus Mu50
caauuauggauaaaa

SEQ ID NO: 2039249 - RNA, 16 nt, Staphylococcus aureus subsp. aureus Mu50
caauuauggauaaaau

SEQ ID NO: 2039250 - RNA, 13 nt, Staphylococcus aureus subsp. aureus Mu50
caauuauuucaau

SEQ ID NO: 2039251 - RNA, 21 nt, Staphylococcus aureus subsp. aureus Mu50
caacguauaagugauaucagu

SEQ ID NO: 2039252 - RNA, 17 nt, Staphylococcus aureus subsp. aureus Mu50
caacuaagauauauugu

SEQ ID NO: 2039253 - RNA, 17 nt, Staphylococcus aureus subsp. aureus Mu50
caacugcauuacgcugu

SEQ ID NO: 2039254 - RNA, 17 nt, Staphylococcus aureus subsp. aureus Mu50
caacugagaaaucuuaa

SEQ ID NO: 2039255 - RNA, 24 nt, Staphylococcus aureus subsp. aureus Mu50
caagauaacuagcaaaugcacugu

SEQ ID NO: 2039256 - RNA, 13 nt, Staphylococcus aureus subsp. aureus Mu50
caagcuuaauaag

SEQ ID NO: 2039257 - RNA, 18 nt, Staphylococcus aureus subsp. aureus Mu50
caagcucgcggccuuuuu

SEQ ID NO: 2039258 - RNA, 22 nt, Staphylococcus aureus subsp. aureus Mu50
caagcugagcuuuaauuuuuug

SEQ ID NO: 2039259 - RNA, 11 nt, Staphylococcus aureus subsp. aureus Mu50
ccaucuuuaag

SEQ ID NO: 2039260 - RNA, 15 nt, Staphylococcus aureus subsp. aureus Mu50
ccaucuuaucuuuau

SEQ ID NO: 2039261 - RNA, 16 nt, Staphylococcus aureus subsp. aureus Mu50
ccaugcccgauaaaac

SEQ ID NO: 2039262 - RNA, 19 nt, Staphylococcus aureus subsp. aureus Mu50
ccaucauaaauguuauuaa

SEQ ID NO: 2039263 - RNA, 22 nt, Staphylococcus aureus subsp. aureus Mu50
aaaucgugcccauaugauuaca

SEQ ID NO: 2039264 - RNA, 15 nt, Staphylococcus aureus subsp. aureus Mu50
cccacuuauaaacaa

SEQ ID NO: 2039265 - RNA, 20 nt, Staphylococcus aureus subsp. aureus Mu50
ccauaaugacuauaacacca

SEQ ID NO: 2039266 - RNA, 12 nt, Staphylococcus aureus subsp. aureus Mu50
ccauaacaauca

SEQ ID NO: 2039267 - RNA, 17 nt, Staphylococcus aureus subsp. aureus Mu50
ccauauuuuuuaguaau

SEQ ID NO: 2039268 - RNA, 19 nt, Staphylococcus aureus subsp. aureus Mu50
ccaucaauauugauaucga

SEQ ID NO: 2039269 - RNA, 17 nt, Staphylococcus aureus subsp. aureus Mu50
ccaucaauuucuguaau

SEQ ID NO: 2039270 - RNA, 20 nt, Staphylococcus aureus subsp. aureus Mu50
ccgaaaauugcuaaaaaaau

SEQ ID NO: 2039271 - RNA, 20 nt, Staphylococcus aureus subsp. aureus Mu50
ccagcaugaaucgcauuuaa

SEQ ID NO: 2039272 - RNA, 20 nt, Staphylococcus aureus subsp. aureus Mu50
aaauagaugagaaaguaaaa

SEQ ID NO: 2039273 - RNA, 15 nt, Staphylococcus aureus subsp. aureus Mu50
aaauagugauugcuu

SEQ ID NO: 2039274 - RNA, 14 nt, Staphylococcus aureus subsp. aureus Mu50
aaauagcuauuaaa

SEQ ID NO: 2039275 - RNA, 16 nt, Staphylococcus aureus subsp. aureus Mu50
aaauagcuauuaaaau

SEQ ID NO: 2039276 - RNA, 19 nt, Staphylococcus aureus subsp. aureus Mu50
aaauauauugcacauaaaa

SEQ ID NO: 2039277 - RNA, 19 nt, Staphylococcus aureus subsp. aureus Mu50
aaauaucaaaauauaaaau

SEQ ID NO: 2039278 - RNA, 21 nt, Staphylococcus aureus subsp. aureus Mu50
aaauaucaguaauaauacgcu

SEQ ID NO: 2039279 - RNA, 21 nt, Staphylococcus aureus subsp. aureus Mu50
aaauauaauagaaauaaucac

SEQ ID NO: 2039280 - RNA, 12 nt, Staphylococcus aureus subsp. aureus Mu50
aaauauaaugau

SEQ ID NO: 2039281 - RNA, 17 nt, Staphylococcus aureus subsp. aureus Mu50
aaauauaauguauaaaa

SEQ ID NO: 2039282 - RNA, 18 nt, Staphylococcus aureus subsp. aureus Mu50
aaauauacuaaauuugaa

SEQ ID NO: 2039283 - RNA, 24 nt, Staphylococcus aureus subsp. aureus Mu50
aaauauucacgacuugauagcauu

SEQ ID NO: 2039284 - RNA, 16 nt, Staphylococcus aureus subsp. aureus Mu50
aaauauuguaaucacu

SEQ ID NO: 2039285 - RNA, 19 nt, Staphylococcus aureus subsp. aureus Mu50
aaauauuuaaaauauuauu

SEQ ID NO: 2039286 - RNA, 12 nt, Staphylococcus aureus subsp. aureus Mu50
aaauauuuaacu

SEQ ID NO: 2039287 - RNA, 13 nt, Staphylococcus aureus subsp. aureus Mu50
aaauauuuagauu

SEQ ID NO: 2039288 - RNA, 23 nt, Staphylococcus aureus subsp. aureus Mu50
aaauauuucuaaaccauuuucaa

SEQ ID NO: 2039289 - RNA, 15 nt, Staphylococcus aureus subsp. aureus Mu50
aaaucaaauauacuu

SEQ ID NO: 2039290 - RNA, 12 nt, Staphylococcus aureus subsp. aureus Mu50
aaauauuccuua

SEQ ID NO: 2039291 - RNA, 16 nt, Staphylococcus aureus subsp. aureus Mu50
aaauauuugaaaauuu

SEQ ID NO: 2039292 - RNA, 19 nt, Staphylococcus aureus subsp. aureus Mu50
aaauauuugaaaauuucac

SEQ ID NO: 2039293 - RNA, 23 nt, Staphylococcus aureus subsp. aureus Mu50
aaauauuuucugcgauauagcuu

SEQ ID NO: 2039294 - RNA, 21 nt, Staphylococcus aureus subsp. aureus Mu50
aaauaugguuucuuauuaaau

SEQ ID NO: 2039295 - RNA, 15 nt, Staphylococcus aureus subsp. aureus Mu50
aaauauuaaauuauu

SEQ ID NO: 2039296 - RNA, 19 nt, Staphylococcus aureus subsp. aureus Mu50
aaauaucuuuuucuaaguu

SEQ ID NO: 2039297 - RNA, 12 nt, Staphylococcus aureus subsp. aureus Mu50
aaauaugauaac

SEQ ID NO: 2039298 - RNA, 20 nt, Staphylococcus aureus subsp. aureus Mu50
aaauaugauuuaaaauauaa

SEQ ID NO: 2039299 - RNA, 13 nt, Staphylococcus aureus subsp. aureus Mu50
ccagaauaaaucc

SEQ ID NO: 2039300 - RNA, 15 nt, Staphylococcus aureus subsp. aureus Mu50
aaauaccucuacauu

SEQ ID NO: 2039301 - RNA, 15 nt, Staphylococcus aureus subsp. aureus Mu50
aaauacgccaaauau

SEQ ID NO: 2039302 - RNA, 14 nt, Staphylococcus aureus subsp. aureus Mu50
aaauacaaauuaca

SEQ ID NO: 2039303 - RNA, 14 nt, Staphylococcus aureus subsp. aureus Mu50
aaauaauuuacauu

SEQ ID NO: 2039304 - RNA, 15 nt, Staphylococcus aureus subsp. aureus Mu50
aaauacuaagauuag

SEQ ID NO: 2039305 - RNA, 15 nt, Staphylococcus aureus subsp. aureus Mu50
aaauacuauacugau

SEQ ID NO: 2039306 - RNA, 19 nt, Staphylococcus aureus subsp. aureus Mu50
aaauacuauauauaaugaa

SEQ ID NO: 2039307 - RNA, 20 nt, Staphylococcus aureus subsp. aureus Mu50
aaauaccucuacauuauauu

SEQ ID NO: 2039308 - RNA, 16 nt, Staphylococcus aureus subsp. aureus Mu50
aaauaacaauagugac

SEQ ID NO: 2039309 - RNA, 21 nt, Staphylococcus aureus subsp. aureus Mu50
aaaguuuucauuuaacaugua

SEQ ID NO: 2039310 - RNA, 16 nt, Staphylococcus aureus subsp. aureus Mu50
aaaguuuuuuacuuuu

SEQ ID NO: 2039311 - RNA, 19 nt, Staphylococcus aureus subsp. aureus Mu50
aaauaaguuaaugugcauu

SEQ ID NO: 2039312 - RNA, 17 nt, Staphylococcus aureus subsp. aureus Mu50
aaauaauagauaauagu

SEQ ID NO: 2039313 - RNA, 20 nt, Staphylococcus aureus subsp. aureus Mu50
ccaccaccugcaauuuguaa

SEQ ID NO: 2039314 - RNA, 17 nt, Staphylococcus aureus subsp. aureus Mu50
ccaauuaaauauuuaac

SEQ ID NO: 2039315 - RNA, 21 nt, Staphylococcus aureus subsp. aureus Mu50
ccaauuaaaucgauuaagaau

SEQ ID NO: 2039316 - RNA, 22 nt, Staphylococcus aureus subsp. aureus Mu50
ccaauuguuucagcuuguccau

SEQ ID NO: 2039317 - RNA, 18 nt, Staphylococcus aureus subsp. aureus Mu50
ccaauagaauucauuaau

SEQ ID NO: 2039318 - RNA, 22 nt, Staphylococcus aureus subsp. aureus Mu50
ccaauagguucauuauuuaaau

SEQ ID NO: 2039319 - RNA, 24 nt, Staphylococcus aureus subsp. aureus Mu50
ccaauacguuuccaaucuauuaau

SEQ ID NO: 2039320 - RNA, 18 nt, Staphylococcus aureus subsp. aureus Mu50
ccaauacagaacuuuaau

SEQ ID NO: 2039321 - RNA, 21 nt, Staphylococcus aureus subsp. aureus Mu50
ccaauacagaacuuuaauaau

SEQ ID NO: 2039322 - RNA, 23 nt, Staphylococcus aureus subsp. aureus Mu50
ccaaggaagucaccauauuuaac

SEQ ID NO: 2039323 - RNA, 11 nt, Staphylococcus aureus subsp. aureus Mu50
ccaaguuaaug

SEQ ID NO: 2039324 - RNA, 22 nt, Staphylococcus aureus subsp. aureus Mu50
ccaacugucgguucaucuaaaa

SEQ ID NO: 2039325 - RNA, 19 nt, Staphylococcus aureus subsp. aureus Mu50
ccaaacugccuaauacacu

SEQ ID NO: 2039326 - RNA, 21 nt, Staphylococcus aureus subsp. aureus Mu50
ccaaaaauuguaaaaccuuac

SEQ ID NO: 2039327 - RNA, 12 nt, Staphylococcus aureus subsp. aureus Mu50
ccaaaaauugua

SEQ ID NO: 2039328 - RNA, 22 nt, Staphylococcus aureus subsp. aureus Mu50
cauuuuucguuguucauaauca

SEQ ID NO: 2039329 - RNA, 23 nt, Staphylococcus aureus subsp. aureus Mu50
cauuuuuuauuuuacuuacuuuu

SEQ ID NO: 2039330 - RNA, 15 nt, Staphylococcus aureus subsp. aureus Mu50
cauuuuuauguuaaa

SEQ ID NO: 2039331 - RNA, 17 nt, Staphylococcus aureus subsp. aureus Mu50
cauuuuuagaaucaaaa

SEQ ID NO: 2039332 - RNA, 15 nt, Staphylococcus aureus subsp. aureus Mu50
cauuugguucuucua

SEQ ID NO: 2039333 - RNA, 16 nt, Staphylococcus aureus subsp. aureus Mu50
cauuuggcguaaugau

SEQ ID NO: 2039334 - RNA, 12 nt, Staphylococcus aureus subsp. aureus Mu50
cauuugauuuuu

SEQ ID NO: 2039335 - RNA, 22 nt, Staphylococcus aureus subsp. aureus Mu50
cauuugcaacaauauaauauac

SEQ ID NO: 2039336 - RNA, 20 nt, Staphylococcus aureus subsp. aureus Mu50
cauuucugaugcuagcuuuc

SEQ ID NO: 2039337 - RNA, 17 nt, Staphylococcus aureus subsp. aureus Mu50
cauuuucauuguauguu

SEQ ID NO: 2039338 - RNA, 23 nt, Staphylococcus aureus subsp. aureus Mu50
cauuugucaucguauuucuagcu

SEQ ID NO: 2039339 - RNA, 21 nt, Staphylococcus aureus subsp. aureus Mu50
cauuuuagugccgagcuuuuu

SEQ ID NO: 2039340 - RNA, 20 nt, Staphylococcus aureus subsp. aureus Mu50
cauuuaguacauauguuguu

SEQ ID NO: 2039341 - RNA, 16 nt, Staphylococcus aureus subsp. aureus Mu50
cauuuaguuaaauaca

SEQ ID NO: 2039342 - RNA, 17 nt, Staphylococcus aureus subsp. aureus Mu50
cauuuaguuaaauacaa

SEQ ID NO: 2039343 - RNA, 21 nt, Staphylococcus aureus subsp. aureus Mu50
cauuuauaacauacguuauuu

SEQ ID NO: 2039344 - RNA, 20 nt, Staphylococcus aureus subsp. aureus Mu50
cauuuauguguuggcuuuua

SEQ ID NO: 2039345 - RNA, 21 nt, Staphylococcus aureus subsp. aureus Mu50
cauuuagauagcggauuuauu

SEQ ID NO: 2039346 - RNA, 16 nt, Staphylococcus aureus subsp. aureus Mu50
cauuuaucuaacaauc

SEQ ID NO: 2039347 - RNA, 14 nt, Staphylococcus aureus subsp. aureus Mu50
cauuuaugauuguu

SEQ ID NO: 2039348 - RNA, 14 nt, Staphylococcus aureus subsp. aureus Mu50
cauuucaucauaau

SEQ ID NO: 2039349 - RNA, 20 nt, Staphylococcus aureus subsp. aureus Mu50
cauuuauuuucaauaaauaa

SEQ ID NO: 2039350 - RNA, 17 nt, Staphylococcus aureus subsp. aureus Mu50
cauuuauucuuucucua

SEQ ID NO: 2039351 - RNA, 16 nt, Staphylococcus aureus subsp. aureus Mu50
cauuuacuucauaagu

SEQ ID NO: 2039352 - RNA, 22 nt, Staphylococcus aureus subsp. aureus Mu50
cauuuaauggucuaauaucaau

SEQ ID NO: 2039353 - RNA, 21 nt, Staphylococcus aureus subsp. aureus Mu50
cauuuaaaauauuuuuucugu

SEQ ID NO: 2039354 - RNA, 16 nt, Staphylococcus aureus subsp. aureus Mu50
cauuguugauaaaugg

SEQ ID NO: 2039355 - RNA, 14 nt, Staphylococcus aureus subsp. aureus Mu50
cauuguggcuuuuu

SEQ ID NO: 2039356 - RNA, 21 nt, Staphylococcus aureus subsp. aureus Mu50
cauuguaaauauaguaauaaa

SEQ ID NO: 2039357 - RNA, 12 nt, Staphylococcus aureus subsp. aureus Mu50
cauuguaaauga

SEQ ID NO: 2039358 - RNA, 12 nt, Staphylococcus aureus subsp. aureus Mu50
cauuguaauaau

SEQ ID NO: 2039359 - RNA, 16 nt, Staphylococcus aureus subsp. aureus Mu50
cauugugaaaguuuuu

SEQ ID NO: 2039360 - RNA, 13 nt, Staphylococcus aureus subsp. aureus Mu50
cauugugaugaua

SEQ ID NO: 2039361 - RNA, 15 nt, Staphylococcus aureus subsp. aureus Mu50
cauuguauguugaaa

SEQ ID NO: 2039362 - RNA, 14 nt, Staphylococcus aureus subsp. aureus Mu50
cauugcuuaacuuc

SEQ ID NO: 2039363 - RNA, 21 nt, Staphylococcus aureus subsp. aureus Mu50
cauuggauuacuuccauugcu

SEQ ID NO: 2039364 - RNA, 22 nt, Staphylococcus aureus subsp. aureus Mu50
caugguuuucuuuuuaucauga

SEQ ID NO: 2039365 - RNA, 19 nt, Staphylococcus aureus subsp. aureus Mu50
cauguaaauaguuaguuua

SEQ ID NO: 2039366 - RNA, 17 nt, Staphylococcus aureus subsp. aureus Mu50
cauguaaugcuuaaaaa

SEQ ID NO: 2039367 - RNA, 15 nt, Staphylococcus aureus subsp. aureus Mu50
cauggauucugauuc

SEQ ID NO: 2039368 - RNA, 13 nt, Staphylococcus aureus subsp. aureus Mu50
caugccuucauga

SEQ ID NO: 2039369 - RNA, 17 nt, Staphylococcus aureus subsp. aureus Mu50
caugcgauucaaucuaa

SEQ ID NO: 2039370 - RNA, 20 nt, Staphylococcus aureus subsp. aureus Mu50
cauugagauggucuuuuaau

SEQ ID NO: 2039371 - RNA, 20 nt, Staphylococcus aureus subsp. aureus Mu50
cauugaaaggaacauuucaa

SEQ ID NO: 2039372 - RNA, 14 nt, Staphylococcus aureus subsp. aureus Mu50
cauucuucaaaaaa

SEQ ID NO: 2039373 - RNA, 13 nt, Staphylococcus aureus subsp. aureus Mu50
cauucuuccaaca

SEQ ID NO: 2039374 - RNA, 18 nt, Staphylococcus aureus subsp. aureus Mu50
cauucuaacgguaaauaa

SEQ ID NO: 2039375 - RNA, 13 nt, Staphylococcus aureus subsp. aureus Mu50
cauucggauaaau

SEQ ID NO: 2039376 - RNA, 18 nt, Staphylococcus aureus subsp. aureus Mu50
cauugaugucaauuucac

SEQ ID NO: 2039377 - RNA, 19 nt, Staphylococcus aureus subsp. aureus Mu50
cauugaucuuuuauaauga

SEQ ID NO: 2039378 - RNA, 17 nt, Staphylococcus aureus subsp. aureus Mu50
cauucccuuaauaauaa

SEQ ID NO: 2039379 - RNA, 14 nt, Staphylococcus aureus subsp. aureus Mu50
cauuauuauuaaau

SEQ ID NO: 2039380 - RNA, 14 nt, Staphylococcus aureus subsp. aureus Mu50
cauuauuugauaaa

SEQ ID NO: 2039381 - RNA, 17 nt, Staphylococcus aureus subsp. aureus Mu50
cauuauuugauaaauaa

SEQ ID NO: 2039382 - RNA, 18 nt, Staphylococcus aureus subsp. aureus Mu50
cauuauuuagaauucuaa

SEQ ID NO: 2039383 - RNA, 13 nt, Staphylococcus aureus subsp. aureus Mu50
cauuauuugauaa

SEQ ID NO: 2039384 - RNA, 21 nt, Staphylococcus aureus subsp. aureus Mu50
cauuauuaaauagaugagaaa

SEQ ID NO: 2039385 - RNA, 21 nt, Staphylococcus aureus subsp. aureus Mu50
cauuauccaaggauguuauaa

SEQ ID NO: 2039386 - RNA, 18 nt, Staphylococcus aureus subsp. aureus Mu50
cauuauccauucuuuguu

SEQ ID NO: 2039387 - RNA, 18 nt, Staphylococcus aureus subsp. aureus Mu50
cauuaucaccuucaaacu

SEQ ID NO: 2039388 - RNA, 23 nt, Staphylococcus aureus subsp. aureus Mu50
cauucaauguuuaauuuucuaaa

SEQ ID NO: 2039389 - RNA, 15 nt, Staphylococcus aureus subsp. aureus Mu50
cauucauaaaugacu

SEQ ID NO: 2039390 - RNA, 15 nt, Staphylococcus aureus subsp. aureus Mu50
cauucauacacuauc

SEQ ID NO: 2039391 - RNA, 21 nt, Staphylococcus aureus subsp. aureus Mu50
cauucauggccaaauguugau

SEQ ID NO: 2039392 - RNA, 22 nt, Staphylococcus aureus subsp. aureus Mu50
cauucauggccaaauguugaua

SEQ ID NO: 2039393 - RNA, 15 nt, Staphylococcus aureus subsp. aureus Mu50
cauuccaaaaauugu

SEQ ID NO: 2039394 - RNA, 22 nt, Staphylococcus aureus subsp. aureus Mu50
cauuccaaacacacuguugaaa

SEQ ID NO: 2039395 - RNA, 21 nt, Staphylococcus aureus subsp. aureus Mu50
cauuaggucuacgaucaaaau

SEQ ID NO: 2039396 - RNA, 22 nt, Staphylococcus aureus subsp. aureus Mu50
cauuauacgugcuuuaaaguug

SEQ ID NO: 2039397 - RNA, 16 nt, Staphylococcus aureus subsp. aureus Mu50
cauuauagaugacugu

SEQ ID NO: 2039398 - RNA, 13 nt, Staphylococcus aureus subsp. aureus Mu50
cauuaucaaauaa

SEQ ID NO: 2039399 - RNA, 17 nt, Staphylococcus aureus subsp. aureus Mu50
cauuagcaugauaaagu

SEQ ID NO: 2039400 - RNA, 22 nt, Staphylococcus aureus subsp. aureus Mu50
cauuacuaauugaucagcauuu

SEQ ID NO: 2039401 - RNA, 21 nt, Staphylococcus aureus subsp. aureus Mu50
cauuacuacuuuauaaauauc

SEQ ID NO: 2039402 - RNA, 14 nt, Staphylococcus aureus subsp. aureus Mu50
cauuaaguugaaaa

SEQ ID NO: 2039403 - RNA, 17 nt, Staphylococcus aureus subsp. aureus Mu50
cauuaauguucaauuua

SEQ ID NO: 2039404 - RNA, 17 nt, Staphylococcus aureus subsp. aureus Mu50
cauuacagauaauuauu

SEQ ID NO: 2039405 - RNA, 16 nt, Staphylococcus aureus subsp. aureus Mu50
cauuaaucguauuuuu

SEQ ID NO: 2039406 - RNA, 18 nt, Staphylococcus aureus subsp. aureus Mu50
cauguuuggaugaacaaa

SEQ ID NO: 2039407 - RNA, 19 nt, Staphylococcus aureus subsp. aureus Mu50
cauguucuuguaauccuaa

SEQ ID NO: 2039408 - RNA, 13 nt, Staphylococcus aureus subsp. aureus Mu50
cauuaaaaauaaa

SEQ ID NO: 2039409 - RNA, 23 nt, Staphylococcus aureus subsp. aureus Mu50
cauguuuuguaccugcuucugua

SEQ ID NO: 2039410 - RNA, 14 nt, Staphylococcus aureus subsp. aureus Mu50
cauuaaaaugauau

SEQ ID NO: 2039411 - RNA, 21 nt, Staphylococcus aureus subsp. aureus Mu50
cauuaaaucugauucauuaaa

SEQ ID NO: 2039412 - RNA, 22 nt, Staphylococcus aureus subsp. aureus Mu50
cauuaaggagcuauaacccuaa

SEQ ID NO: 2039413 - RNA, 18 nt, Staphylococcus aureus subsp. aureus Mu50
cauuaaggauaguucuuu

SEQ ID NO: 2039414 - RNA, 13 nt, Staphylococcus aureus subsp. aureus Mu50
cauuaagaugauu

SEQ ID NO: 2039415 - RNA, 19 nt, Staphylococcus aureus subsp. aureus Mu50
cauuaaauauuauuuugca

SEQ ID NO: 2039416 - RNA, 12 nt, Staphylococcus aureus subsp. aureus Mu50
cauguucauaau

SEQ ID NO: 2039417 - RNA, 15 nt, Staphylococcus aureus subsp. aureus Mu50
cauguuccgcuacaa

SEQ ID NO: 2039418 - RNA, 14 nt, Staphylococcus aureus subsp. aureus Mu50
cauguggacguuga

SEQ ID NO: 2039419 - RNA, 21 nt, Staphylococcus aureus subsp. aureus Mu50
caugugacauaacagcuaaaa

SEQ ID NO: 2039420 - RNA, 19 nt, Staphylococcus aureus subsp. aureus Mu50
cagugaccucagguuguua

SEQ ID NO: 2039421 - RNA, 19 nt, Staphylococcus aureus subsp. aureus Mu50
cagugaucuuuuuuauauu

SEQ ID NO: 2039422 - RNA, 19 nt, Staphylococcus aureus subsp. aureus Mu50
cagugaaguuaacuauaac

SEQ ID NO: 2039423 - RNA, 21 nt, Staphylococcus aureus subsp. aureus Mu50
caguaauugugacgaccgugu

SEQ ID NO: 2039424 - RNA, 15 nt, Staphylococcus aureus subsp. aureus Mu50
caguaauuucuccaa

SEQ ID NO: 2039425 - RNA, 17 nt, Staphylococcus aureus subsp. aureus Mu50
caguaauuuucauuguu

SEQ ID NO: 2039426 - RNA, 23 nt, Staphylococcus aureus subsp. aureus Mu50
caguaaguugauuucuacucgaa

SEQ ID NO: 2039427 - RNA, 22 nt, Staphylococcus aureus subsp. aureus Mu50
caguaauaauacgcuugauaaa

SEQ ID NO: 2039428 - RNA, 12 nt, Staphylococcus aureus subsp. aureus Mu50
caguaaucaaag

SEQ ID NO: 2039429 - RNA, 21 nt, Staphylococcus aureus subsp. aureus Mu50
caguaaucaaagauuuuguug

SEQ ID NO: 2039430 - RNA, 13 nt, Staphylococcus aureus subsp. aureus Mu50
caguaaguaauaa

SEQ ID NO: 2039431 - RNA, 14 nt, Staphylococcus aureus subsp. aureus Mu50
caguaaauugauuc

SEQ ID NO: 2039432 - RNA, 18 nt, Staphylococcus aureus subsp. aureus Mu50
caucaacgauguccuuua

SEQ ID NO: 2039433 - RNA, 19 nt, Staphylococcus aureus subsp. aureus Mu50
caucaaguugauaaugucu

SEQ ID NO: 2039434 - RNA, 18 nt, Staphylococcus aureus subsp. aureus Mu50
cauaugauaguguauguu

SEQ ID NO: 2039435 - RNA, 14 nt, Staphylococcus aureus subsp. aureus Mu50
cauaugauuacaac

SEQ ID NO: 2039436 - RNA, 12 nt, Staphylococcus aureus subsp. aureus Mu50
cauaugauuugc

SEQ ID NO: 2039437 - RNA, 15 nt, Staphylococcus aureus subsp. aureus Mu50
cauauaauaugugca

SEQ ID NO: 2039438 - RNA, 19 nt, Staphylococcus aureus subsp. aureus Mu50
cauauaaagucguaucaua

SEQ ID NO: 2039439 - RNA, 15 nt, Staphylococcus aureus subsp. aureus Mu50
cauauauauauagau

SEQ ID NO: 2039440 - RNA, 14 nt, Staphylococcus aureus subsp. aureus Mu50
cauauauuuuguua

SEQ ID NO: 2039441 - RNA, 13 nt, Staphylococcus aureus subsp. aureus Mu50
cauaugaacaaua

SEQ ID NO: 2039442 - RNA, 17 nt, Staphylococcus aureus subsp. aureus Mu50
cauaugauaauuaauua

SEQ ID NO: 2039443 - RNA, 18 nt, Staphylococcus aureus subsp. aureus Mu50
cauaugauaauuaauuau

SEQ ID NO: 2039444 - RNA, 19 nt, Staphylococcus aureus subsp. aureus Mu50
cauaguucaaauugaacuu

SEQ ID NO: 2039445 - RNA, 17 nt, Staphylococcus aureus subsp. aureus Mu50
cauauaaagucguauca

SEQ ID NO: 2039446 - RNA, 20 nt, Staphylococcus aureus subsp. aureus Mu50
cauaguugaaucggugucuu

SEQ ID NO: 2039447 - RNA, 16 nt, Staphylococcus aureus subsp. aureus Mu50
cauauaaaaaauuauu

SEQ ID NO: 2039448 - RNA, 19 nt, Staphylococcus aureus subsp. aureus Mu50
cauauaaaaaauuauuaaa

SEQ ID NO: 2039449 - RNA, 22 nt, Staphylococcus aureus subsp. aureus Mu50
cauaggcuuaugggggauuuuu

SEQ ID NO: 2039450 - RNA, 20 nt, Staphylococcus aureus subsp. aureus Mu50
cauaguauacauaauucaau

SEQ ID NO: 2039451 - RNA, 16 nt, Staphylococcus aureus subsp. aureus Mu50
cauaguaauaaaauga

SEQ ID NO: 2039452 - RNA, 14 nt, Staphylococcus aureus subsp. aureus Mu50
cauaguaaucgauu

SEQ ID NO: 2039453 - RNA, 14 nt, Staphylococcus aureus subsp. aureus Mu50
cauagcuaaauaaa

SEQ ID NO: 2039454 - RNA, 17 nt, Staphylococcus aureus subsp. aureus Mu50
cauagcuaaauaaauua

SEQ ID NO: 2039455 - RNA, 19 nt, Staphylococcus aureus subsp. aureus Mu50
cauagcgcucuggauuuuu

SEQ ID NO: 2039456 - RNA, 22 nt, Staphylococcus aureus subsp. aureus Mu50
caguuggagguccauaaucuuu

SEQ ID NO: 2039457 - RNA, 15 nt, Staphylococcus aureus subsp. aureus Mu50
caguuguuauuuuug

SEQ ID NO: 2039458 - RNA, 16 nt, Staphylococcus aureus subsp. aureus Mu50
caguuuccauaaauaa

SEQ ID NO: 2039459 - RNA, 21 nt, Staphylococcus aureus subsp. aureus Mu50
caguuucaaucgcauuuuguu

SEQ ID NO: 2039460 - RNA, 18 nt, Staphylococcus aureus subsp. aureus Mu50
caguuuauugaggauaau

SEQ ID NO: 2039461 - RNA, 20 nt, Staphylococcus aureus subsp. aureus Mu50
cauaaucuuuuccuaaaccu

SEQ ID NO: 2039462 - RNA, 23 nt, Staphylococcus aureus subsp. aureus Mu50
cauaaucugcugcuguugaagaa

SEQ ID NO: 2039463 - RNA, 21 nt, Staphylococcus aureus subsp. aureus Mu50
cauaaucauaaaaaucauaaa

SEQ ID NO: 2039464 - RNA, 19 nt, Staphylococcus aureus subsp. aureus Mu50
cauaauacuucucaauuua

SEQ ID NO: 2039465 - RNA, 16 nt, Staphylococcus aureus subsp. aureus Mu50
cauaauauugaugaau

SEQ ID NO: 2039466 - RNA, 18 nt, Staphylococcus aureus subsp. aureus Mu50
cauacccauauuaaauuu

SEQ ID NO: 2039467 - RNA, 20 nt, Staphylococcus aureus subsp. aureus Mu50
cauaccaaaaacauuaacca

SEQ ID NO: 2039468 - RNA, 21 nt, Staphylococcus aureus subsp. aureus Mu50
cauaaaugacugaauuaauau

SEQ ID NO: 2039469 - RNA, 23 nt, Staphylococcus aureus subsp. aureus Mu50
cauaaauauuuaaaauauuauuu

SEQ ID NO: 2039470 - RNA, 14 nt, Staphylococcus aureus subsp. aureus Mu50
cauaaaucaaugua

SEQ ID NO: 2039471 - RNA, 23 nt, Staphylococcus aureus subsp. aureus Mu50
cauaaauaagcguaaaaucaugu

SEQ ID NO: 2039472 - RNA, 18 nt, Staphylococcus aureus subsp. aureus Mu50
cauaaguaaaacugcaau

SEQ ID NO: 2039473 - RNA, 16 nt, Staphylococcus aureus subsp. aureus Mu50
cauaauaaaucuaucu

SEQ ID NO: 2039474 - RNA, 21 nt, Staphylococcus aureus subsp. aureus Mu50
cauaacaauuuuguugcauga

SEQ ID NO: 2039475 - RNA, 17 nt, Staphylococcus aureus subsp. aureus Mu50
caucgcaacugauaauu

SEQ ID NO: 2039476 - RNA, 19 nt, Staphylococcus aureus subsp. aureus Mu50
cauccggaccuuguaaauu

SEQ ID NO: 2039477 - RNA, 19 nt, Staphylococcus aureus subsp. aureus Mu50
caucaauaaauauugauuc

SEQ ID NO: 2039478 - RNA, 23 nt, Staphylococcus aureus subsp. aureus Mu50
caucaguuaauaauuuuggauuu

SEQ ID NO: 2039479 - RNA, 13 nt, Staphylococcus aureus subsp. aureus Mu50
caucaugugcuuu

SEQ ID NO: 2039480 - RNA, 14 nt, Staphylococcus aureus subsp. aureus Mu50
caucaugugcuuug

SEQ ID NO: 2039481 - RNA, 18 nt, Staphylococcus aureus subsp. aureus Mu50
caucauguacaguuacuu

SEQ ID NO: 2039482 - RNA, 16 nt, Staphylococcus aureus subsp. aureus Mu50
caucaugaaauuagau

SEQ ID NO: 2039483 - RNA, 15 nt, Staphylococcus aureus subsp. aureus Mu50
caucauuuaauugau

SEQ ID NO: 2039484 - RNA, 22 nt, Staphylococcus aureus subsp. aureus Mu50
caucauuuuucguuguucauaa

SEQ ID NO: 2039485 - RNA, 15 nt, Staphylococcus aureus subsp. aureus Mu50
cagcgucauauguug

SEQ ID NO: 2039486 - RNA, 16 nt, Staphylococcus aureus subsp. aureus Mu50
cagcguauuuuaauga

SEQ ID NO: 2039487 - RNA, 20 nt, Staphylococcus aureus subsp. aureus Mu50
cagcuaaacgcaauacgaau

SEQ ID NO: 2039488 - RNA, 13 nt, Staphylococcus aureus subsp. aureus Mu50
cagcuuuaauaau

SEQ ID NO: 2039489 - RNA, 20 nt, Staphylococcus aureus subsp. aureus Mu50
caggaauaucuuucaaauua

SEQ ID NO: 2039490 - RNA, 19 nt, Staphylococcus aureus subsp. aureus Mu50
caggagcgagccauuauua

SEQ ID NO: 2039491 - RNA, 14 nt, Staphylococcus aureus subsp. aureus Mu50
cagccucuauaagu

SEQ ID NO: 2039492 - RNA, 18 nt, Staphylococcus aureus subsp. aureus Mu50
cagcaacgcgauugcuaa

SEQ ID NO: 2039493 - RNA, 13 nt, Staphylococcus aureus subsp. aureus Mu50
cagauaauuauuu

SEQ ID NO: 2039494 - RNA, 22 nt, Staphylococcus aureus subsp. aureus Mu50
cagcaugaaucgcauuuaaaua

SEQ ID NO: 2039495 - RNA, 13 nt, Staphylococcus aureus subsp. aureus Mu50
cagcauauaaugg

SEQ ID NO: 2039496 - RNA, 20 nt, Staphylococcus aureus subsp. aureus Mu50
cacguaauugaguuguugca

SEQ ID NO: 2039497 - RNA, 19 nt, Staphylococcus aureus subsp. aureus Mu50
aaacuucuauuaauaauuu

SEQ ID NO: 2039498 - RNA, 16 nt, Staphylococcus aureus subsp. aureus Mu50
aaacuucuaucacacg

SEQ ID NO: 2039499 - RNA, 16 nt, Staphylococcus aureus subsp. aureus Mu50
aaacuuauaacuuuau

SEQ ID NO: 2039500 - RNA, 21 nt, Staphylococcus aureus subsp. aureus Mu50
aaacuucuuuucuuugauaac

SEQ ID NO: 2039501 - RNA, 19 nt, Staphylococcus aureus subsp. aureus Mu50
aaacuuuaauuaauguuca

SEQ ID NO: 2039502 - RNA, 15 nt, Staphylococcus aureus subsp. aureus Mu50
aaacuuaaaaaugaa

SEQ ID NO: 2039503 - RNA, 13 nt, Staphylococcus aureus subsp. aureus Mu50
caccuauuuuuug

SEQ ID NO: 2039504 - RNA, 17 nt, Staphylococcus aureus subsp. aureus Mu50
cacgcugaaauuuuuua

SEQ ID NO: 2039505 - RNA, 17 nt, Staphylococcus aureus subsp. aureus Mu50
cacuaauauuucuuaga

SEQ ID NO: 2039506 - RNA, 17 nt, Staphylococcus aureus subsp. aureus Mu50
cacuaccauagauuaua

SEQ ID NO: 2039507 - RNA, 20 nt, Staphylococcus aureus subsp. aureus Mu50
cacuaccauagauuauauua

SEQ ID NO: 2039508 - RNA, 19 nt, Staphylococcus aureus subsp. aureus Mu50
cacuaaugauuuauuaugu

SEQ ID NO: 2039509 - RNA, 13 nt, Staphylococcus aureus subsp. aureus Mu50
cacuacaaucaua

SEQ ID NO: 2039510 - RNA, 13 nt, Staphylococcus aureus subsp. aureus Mu50
aaagaauaaaugu

SEQ ID NO: 2039511 - RNA, 16 nt, Staphylococcus aureus subsp. aureus Mu50
cacuuaugauacugau

SEQ ID NO: 2039512 - RNA, 12 nt, Staphylococcus aureus subsp. aureus Mu50
cacuuauuauuu

SEQ ID NO: 2039513 - RNA, 19 nt, Staphylococcus aureus subsp. aureus Mu50
cacuuuuauggagugauau

SEQ ID NO: 2039514 - RNA, 21 nt, Staphylococcus aureus subsp. aureus Mu50
cacuuuuuucauuucuuuguu

SEQ ID NO: 2039515 - RNA, 18 nt, Staphylococcus aureus subsp. aureus Mu50
cacuuuuuuuaauuugau

SEQ ID NO: 2039516 - RNA, 21 nt, Staphylococcus aureus subsp. aureus Mu50
cacuuuuugacauauuuuuua

SEQ ID NO: 2039517 - RNA, 22 nt, Staphylococcus aureus subsp. aureus Mu50
cacuguuaaagucuguugguuu

SEQ ID NO: 2039518 - RNA, 16 nt, Staphylococcus aureus subsp. aureus Mu50
cacuguuuuauuauga

SEQ ID NO: 2039519 - RNA, 20 nt, Staphylococcus aureus subsp. aureus Mu50
ccgaggcuaauuuuaauuuu

SEQ ID NO: 2039520 - RNA, 19 nt, Staphylococcus aureus subsp. aureus Mu50
ccgcacuucuauauuaaua

SEQ ID NO: 2039521 - RNA, 23 nt, Staphylococcus aureus subsp. aureus Mu50
ccgauuuuuuuacguaaucuaau

SEQ ID NO: 2039522 - RNA, 17 nt, Staphylococcus aureus subsp. aureus Mu50
ccgcauuauuauuaaau

SEQ ID NO: 2039523 - RNA, 23 nt, Staphylococcus aureus subsp. aureus Mu50
aaaugacgcucgagcucuucaaa

SEQ ID NO: 2039524 - RNA, 23 nt, Staphylococcus aureus subsp. aureus Mu50
aaaugacgauaccuuuaauaaua

SEQ ID NO: 2039525 - RNA, 19 nt, Staphylococcus aureus subsp. aureus Mu50
aaaugaccuggaauauugu

SEQ ID NO: 2039526 - RNA, 12 nt, Staphylococcus aureus subsp. aureus Mu50
aaaugauaauuu

SEQ ID NO: 2039527 - RNA, 22 nt, Staphylococcus aureus subsp. aureus Mu50
aaaugaucuuuguagccuucaa

SEQ ID NO: 2039528 - RNA, 17 nt, Staphylococcus aureus subsp. aureus Mu50
aaaugauaucugacauu

SEQ ID NO: 2039529 - RNA, 21 nt, Staphylococcus aureus subsp. aureus Mu50
aaaugacgugcuuuuaaaugu

SEQ ID NO: 2039530 - RNA, 15 nt, Staphylococcus aureus subsp. aureus Mu50
aaaugaguacaacau

SEQ ID NO: 2039531 - RNA, 21 nt, Staphylococcus aureus subsp. aureus Mu50
aaauggugcgaauaauaauac

SEQ ID NO: 2039532 - RNA, 22 nt, Staphylococcus aureus subsp. aureus Mu50
aaauggaaccacgucuuaaucg

SEQ ID NO: 2039533 - RNA, 21 nt, Staphylococcus aureus subsp. aureus Mu50
aaaugcuggguaauaaauugu

SEQ ID NO: 2039534 - RNA, 21 nt, Staphylococcus aureus subsp. aureus Mu50
aaaugcugguaaauguugaua

SEQ ID NO: 2039535 - RNA, 13 nt, Staphylococcus aureus subsp. aureus Mu50
aaaugcuuauaua

SEQ ID NO: 2039536 - RNA, 15 nt, Staphylococcus aureus subsp. aureus Mu50
aaauggaaagacguu

SEQ ID NO: 2039537 - RNA, 13 nt, Staphylococcus aureus subsp. aureus Mu50
aaauguauuuuua

SEQ ID NO: 2039538 - RNA, 18 nt, Staphylococcus aureus subsp. aureus Mu50
aaauguauuuuuacuuuu

SEQ ID NO: 2039539 - RNA, 13 nt, Staphylococcus aureus subsp. aureus Mu50
aaauguuaacgau

SEQ ID NO: 2039540 - RNA, 14 nt, Staphylococcus aureus subsp. aureus Mu50
aaaugucuuucaaa

SEQ ID NO: 2039541 - RNA, 16 nt, Staphylococcus aureus subsp. aureus Mu50
aaaugguucgaugaau

SEQ ID NO: 2039542 - RNA, 20 nt, Staphylococcus aureus subsp. aureus Mu50
aaauguaaauaaaaauuaua

SEQ ID NO: 2039543 - RNA, 15 nt, Staphylococcus aureus subsp. aureus Mu50
aaauguuaacgauag

SEQ ID NO: 2039544 - RNA, 15 nt, Staphylococcus aureus subsp. aureus Mu50
aaauucaacuaugaa

SEQ ID NO: 2039545 - RNA, 22 nt, Staphylococcus aureus subsp. aureus Mu50
aaauuagccgaaaaacaucauu

SEQ ID NO: 2039546 - RNA, 20 nt, Staphylococcus aureus subsp. aureus Mu50
aaauuauaguacguuugcau

SEQ ID NO: 2039547 - RNA, 13 nt, Staphylococcus aureus subsp. aureus Mu50
aaauuacuugaau

SEQ ID NO: 2039548 - RNA, 19 nt, Staphylococcus aureus subsp. aureus Mu50
aaauuagaaaaauaugauu

SEQ ID NO: 2039549 - RNA, 23 nt, Staphylococcus aureus subsp. aureus Mu50
aaauuagagaacgcuuuauuacu

SEQ ID NO: 2039550 - RNA, 13 nt, Staphylococcus aureus subsp. aureus Mu50
aaauuaauugcuu

SEQ ID NO: 2039551 - RNA, 13 nt, Staphylococcus aureus subsp. aureus Mu50
aaauguuuauauc

SEQ ID NO: 2039552 - RNA, 19 nt, Staphylococcus aureus subsp. aureus Mu50
aaauuaaaaaacaauaaaa

SEQ ID NO: 2039553 - RNA, 16 nt, Staphylococcus aureus subsp. aureus Mu50
aaauuggaauagaugu

SEQ ID NO: 2039554 - RNA, 17 nt, Staphylococcus aureus subsp. aureus Mu50
aaauugaacuuauaagu

SEQ ID NO: 2039555 - RNA, 21 nt, Staphylococcus aureus subsp. aureus Mu50
aaauuguaugaauaauauggu

SEQ ID NO: 2039556 - RNA, 16 nt, Staphylococcus aureus subsp. aureus Mu50
aaauucuuuuguaauu

SEQ ID NO: 2039557 - RNA, 19 nt, Staphylococcus aureus subsp. aureus Mu50
aaauugcuaaaaaaauuaa

SEQ ID NO: 2039558 - RNA, 13 nt, Staphylococcus aureus subsp. aureus Mu50
aaauucucaauua

SEQ ID NO: 2039559 - RNA, 12 nt, Staphylococcus aureus subsp. aureus Mu50
aacaaaagaugu

SEQ ID NO: 2039560 - RNA, 12 nt, Staphylococcus aureus subsp. aureus Mu50
aaauuuuauaua

SEQ ID NO: 2039561 - RNA, 13 nt, Staphylococcus aureus subsp. aureus Mu50
aacaaaaauugcu

SEQ ID NO: 2039562 - RNA, 14 nt, Staphylococcus aureus subsp. aureus Mu50
aacaaaaagaauuu

SEQ ID NO: 2039563 - RNA, 21 nt, Staphylococcus aureus subsp. aureus Mu50
ccgguuaaauuauuuaauuuu

SEQ ID NO: 2039564 - RNA, 20 nt, Staphylococcus aureus subsp. aureus Mu50
ccgucgaauauaauuuuuug

SEQ ID NO: 2039565 - RNA, 14 nt, Staphylococcus aureus subsp. aureus Mu50
ccucauuaauaaau

SEQ ID NO: 2039566 - RNA, 14 nt, Staphylococcus aureus subsp. aureus Mu50
ccuaugaauuuagc

SEQ ID NO: 2039567 - RNA, 14 nt, Staphylococcus aureus subsp. aureus Mu50
ccuauuaauaucau

SEQ ID NO: 2039568 - RNA, 17 nt, Staphylococcus aureus subsp. aureus Mu50
ccuauuuaaaagacaau

SEQ ID NO: 2039569 - RNA, 19 nt, Staphylococcus aureus subsp. aureus Mu50
ccuauuccuauuacuacau

SEQ ID NO: 2039570 - RNA, 19 nt, Staphylococcus aureus subsp. aureus Mu50
ccuaucaucaaucguuaau

SEQ ID NO: 2039571 - RNA, 22 nt, Staphylococcus aureus subsp. aureus Mu50
ccuauuugacacauuauugaaa

SEQ ID NO: 2039572 - RNA, 14 nt, Staphylococcus aureus subsp. aureus Mu50
ccguuauuuucaau

SEQ ID NO: 2039573 - RNA, 16 nt, Staphylococcus aureus subsp. aureus Mu50
ccguuaaaauuuuaau

SEQ ID NO: 2039574 - RNA, 20 nt, Staphylococcus aureus subsp. aureus Mu50
ccguuaaaauuuuaauuaau

SEQ ID NO: 2039575 - RNA, 18 nt, Staphylococcus aureus subsp. aureus Mu50
ccuacuaauauauuaauu

SEQ ID NO: 2039576 - RNA, 16 nt, Staphylococcus aureus subsp. aureus Mu50
ccuacgcccaucauca

SEQ ID NO: 2039577 - RNA, 18 nt, Staphylococcus aureus subsp. aureus Mu50
ccuaauacacuugauaaa

SEQ ID NO: 2039578 - RNA, 21 nt, Staphylococcus aureus subsp. aureus Mu50
ccuaagcauaauucaacuuaa

SEQ ID NO: 2039579 - RNA, 17 nt, Staphylococcus aureus subsp. aureus Mu50
ccuaaaugauuaauaac

SEQ ID NO: 2039580 - RNA, 17 nt, Staphylococcus aureus subsp. aureus Mu50
ccuaaugcuuuaauaaa

SEQ ID NO: 2039581 - RNA, 13 nt, Staphylococcus aureus subsp. aureus Mu50
ccuaaugcgacau

SEQ ID NO: 2039582 - RNA, 19 nt, Staphylococcus aureus subsp. aureus Mu50
ccuaccauuacugcagcau

SEQ ID NO: 2039583 - RNA, 13 nt, Staphylococcus aureus subsp. aureus Mu50
ccuacaacaccaa

SEQ ID NO: 2039584 - RNA, 17 nt, Staphylococcus aureus subsp. aureus Mu50
ccuaaaaauaaaaucaa

SEQ ID NO: 2039585 - RNA, 15 nt, Staphylococcus aureus subsp. aureus Mu50
cgccacaacauguuu

SEQ ID NO: 2039586 - RNA, 18 nt, Staphylococcus aureus subsp. aureus Mu50
cgcacaucuaagugauau

SEQ ID NO: 2039587 - RNA, 22 nt, Staphylococcus aureus subsp. aureus Mu50
cgauuuuaaaagauaaauaaaa

SEQ ID NO: 2039588 - RNA, 16 nt, Staphylococcus aureus subsp. aureus Mu50
cgauuuaucauuauuu

SEQ ID NO: 2039589 - RNA, 21 nt, Staphylococcus aureus subsp. aureus Mu50
cgaggggucuuuuuuuaaugu

SEQ ID NO: 2039590 - RNA, 15 nt, Staphylococcus aureus subsp. aureus Mu50
cgauaacaauuuauu

SEQ ID NO: 2039591 - RNA, 18 nt, Staphylococcus aureus subsp. aureus Mu50
cgauaacaauuuauuaaa

SEQ ID NO: 2039592 - RNA, 22 nt, Staphylococcus aureus subsp. aureus Mu50
cgauaguucuauauaauuuauu

SEQ ID NO: 2039593 - RNA, 20 nt, Staphylococcus aureus subsp. aureus Mu50
cgaucauuagcaauuucauc

SEQ ID NO: 2039594 - RNA, 23 nt, Staphylococcus aureus subsp. aureus Mu50
cgaugaaucccauaacaaucauu

SEQ ID NO: 2039595 - RNA, 18 nt, Staphylococcus aureus subsp. aureus Mu50
cgaucuaacaauugcaga

SEQ ID NO: 2039596 - RNA, 15 nt, Staphylococcus aureus subsp. aureus Mu50
cgaugacuuuuuaau

SEQ ID NO: 2039597 - RNA, 16 nt, Staphylococcus aureus subsp. aureus Mu50
cgaacaugaaugauau

SEQ ID NO: 2039598 - RNA, 12 nt, Staphylococcus aureus subsp. aureus Mu50
cgaaccgacacu

SEQ ID NO: 2039599 - RNA, 17 nt, Staphylococcus aureus subsp. aureus Mu50
cgaaaguuagacuaaaa

SEQ ID NO: 2039600 - RNA, 14 nt, Staphylococcus aureus subsp. aureus Mu50
cgaaauauuguaau

SEQ ID NO: 2039601 - RNA, 13 nt, Staphylococcus aureus subsp. aureus Mu50
cgaaauuacuguu

SEQ ID NO: 2039602 - RNA, 14 nt, Staphylococcus aureus subsp. aureus Mu50
cgaaauuacuguua

SEQ ID NO: 2039603 - RNA, 19 nt, Staphylococcus aureus subsp. aureus Mu50
cgaagcgaguuauauuguu

SEQ ID NO: 2039604 - RNA, 22 nt, Staphylococcus aureus subsp. aureus Mu50
ccuugagcucacgauuaauaaa

SEQ ID NO: 2039605 - RNA, 13 nt, Staphylococcus aureus subsp. aureus Mu50
ccuuuaauaucua

SEQ ID NO: 2039606 - RNA, 19 nt, Staphylococcus aureus subsp. aureus Mu50
ccuuguuuuaaacuuauua

SEQ ID NO: 2039607 - RNA, 19 nt, Staphylococcus aureus subsp. aureus Mu50
ccuuucaaauauaucuaau

SEQ ID NO: 2039608 - RNA, 23 nt, Staphylococcus aureus subsp. aureus Mu50
ccuuuaauuguuaaaucaccaac

SEQ ID NO: 2039609 - RNA, 13 nt, Staphylococcus aureus subsp. aureus Mu50
ccuuuauuauuua

SEQ ID NO: 2039610 - RNA, 12 nt, Staphylococcus aureus subsp. aureus Mu50
ccuuucauuuua

SEQ ID NO: 2039611 - RNA, 17 nt, Staphylococcus aureus subsp. aureus Mu50
ccuuuccauuguugaua

SEQ ID NO: 2039612 - RNA, 15 nt, Staphylococcus aureus subsp. aureus Mu50
ccuuugguucaauca

SEQ ID NO: 2039613 - RNA, 19 nt, Staphylococcus aureus subsp. aureus Mu50
ccuuugccguauuucaaau

SEQ ID NO: 2039614 - RNA, 12 nt, Staphylococcus aureus subsp. aureus Mu50
ccuuuuucuaaa

SEQ ID NO: 2039615 - RNA, 23 nt, Staphylococcus aureus subsp. aureus Mu50
cgaaaaacaucauuucugaaguu

SEQ ID NO: 2039616 - RNA, 16 nt, Staphylococcus aureus subsp. aureus Mu50
cgaaaauaucaauuua

SEQ ID NO: 2039617 - RNA, 18 nt, Staphylococcus aureus subsp. aureus Mu50
cgaaaauaucaauuuauu

SEQ ID NO: 2039618 - RNA, 13 nt, Staphylococcus aureus subsp. aureus Mu50
cgaaaauaucauu

SEQ ID NO: 2039619 - RNA, 16 nt, Staphylococcus aureus subsp. aureus Mu50
cgaaacacacuaaaag

SEQ ID NO: 2039620 - RNA, 12 nt, Staphylococcus aureus subsp. aureus Mu50
cgaaaguacaag

SEQ ID NO: 2039621 - RNA, 21 nt, Staphylococcus aureus subsp. aureus Mu50
cgaaagaugauauauucaucu

SEQ ID NO: 2039622 - RNA, 23 nt, Staphylococcus aureus subsp. aureus Mu50
ccuucgagugcuuuuaaucaaau

SEQ ID NO: 2039623 - RNA, 15 nt, Staphylococcus aureus subsp. aureus Mu50
ccuucaucaauaaau

SEQ ID NO: 2039624 - RNA, 21 nt, Staphylococcus aureus subsp. aureus Mu50
ccuucuauagcaccauuauua

SEQ ID NO: 2039625 - RNA, 17 nt, Staphylococcus aureus subsp. aureus Mu50
ccuucuauauaguaaaa

SEQ ID NO: 2039626 - RNA, 22 nt, Staphylococcus aureus subsp. aureus Mu50
ccuucuauauaguaaaauaaau

SEQ ID NO: 2039627 - RNA, 20 nt, Staphylococcus aureus subsp. aureus Mu50
ccuugaccuacuuuuucaau

SEQ ID NO: 2039628 - RNA, 17 nt, Staphylococcus aureus subsp. aureus Mu50
ccuucuuuauaacuuuc

SEQ ID NO: 2039629 - RNA, 17 nt, Staphylococcus aureus subsp. aureus Mu50
ccuucuuugaaaucaau

SEQ ID NO: 2039630 - RNA, 15 nt, Staphylococcus aureus subsp. aureus Mu50
ccuuaauaauaagua

SEQ ID NO: 2039631 - RNA, 20 nt, Staphylococcus aureus subsp. aureus Mu50
ccuuaucaaaaccgcuauaa

SEQ ID NO: 2039632 - RNA, 23 nt, Staphylococcus aureus subsp. aureus Mu50
ccuucaaauucucaauuaauuua

SEQ ID NO: 2039633 - RNA, 12 nt, Staphylococcus aureus subsp. aureus Mu50
ccuguuggcuuu

SEQ ID NO: 2039634 - RNA, 18 nt, Staphylococcus aureus subsp. aureus Mu50
cgacaucgccaauuugau

SEQ ID NO: 2039635 - RNA, 18 nt, Staphylococcus aureus subsp. aureus Mu50
cgacaaauuaaaaaacaa

SEQ ID NO: 2039636 - RNA, 19 nt, Staphylococcus aureus subsp. aureus Mu50
cgacuaaccacauuauaau

SEQ ID NO: 2039637 - RNA, 19 nt, Staphylococcus aureus subsp. aureus Mu50
aacaaugcccguguaacac

SEQ ID NO: 2039638 - RNA, 14 nt, Staphylococcus aureus subsp. aureus Mu50
aacaaucacgauua

SEQ ID NO: 2039639 - RNA, 12 nt, Staphylococcus aureus subsp. aureus Mu50
aacaauauugac

SEQ ID NO: 2039640 - RNA, 19 nt, Staphylococcus aureus subsp. aureus Mu50
aacaauaccgcgauaaaua

SEQ ID NO: 2039641 - RNA, 20 nt, Staphylococcus aureus subsp. aureus Mu50
aacaauaccgcgauaaauaa

SEQ ID NO: 2039642 - RNA, 20 nt, Staphylococcus aureus subsp. aureus Mu50
aacaaguacaauaauaccuu

SEQ ID NO: 2039643 - RNA, 22 nt, Staphylococcus aureus subsp. aureus Mu50
aacaaguaguaugucauucuag

SEQ ID NO: 2039644 - RNA, 23 nt, Staphylococcus aureus subsp. aureus Mu50
aacaugauacgugguuuuauuug

SEQ ID NO: 2039645 - RNA, 14 nt, Staphylococcus aureus subsp. aureus Mu50
aacaugaacaauca

SEQ ID NO: 2039646 - RNA, 17 nt, Staphylococcus aureus subsp. aureus Mu50
aacaugaacaaucagau

SEQ ID NO: 2039647 - RNA, 14 nt, Staphylococcus aureus subsp. aureus Mu50
aacaugugcaagua

SEQ ID NO: 2039648 - RNA, 22 nt, Staphylococcus aureus subsp. aureus Mu50
aacaugguuuucuuuuuaucau

SEQ ID NO: 2039649 - RNA, 17 nt, Staphylococcus aureus subsp. aureus Mu50
aacauguacaauuuuua

SEQ ID NO: 2039650 - RNA, 19 nt, Staphylococcus aureus subsp. aureus Mu50
aacauucuucaaaaaauaa

SEQ ID NO: 2039651 - RNA, 23 nt, Staphylococcus aureus subsp. aureus Mu50
aacauugaacgauaacaauuuau

SEQ ID NO: 2039652 - RNA, 13 nt, Staphylococcus aureus subsp. aureus Mu50
aacauuacuuuaa

SEQ ID NO: 2039653 - RNA, 17 nt, Staphylococcus aureus subsp. aureus Mu50
aacauuaaaauaauuaa

SEQ ID NO: 2039654 - RNA, 12 nt, Staphylococcus aureus subsp. aureus Mu50
aacauuaaaaug

SEQ ID NO: 2039655 - RNA, 20 nt, Staphylococcus aureus subsp. aureus Mu50
aacauuaaaauguguuuuca

SEQ ID NO: 2039656 - RNA, 14 nt, Staphylococcus aureus subsp. aureus Mu50
aacauuauuaaaca

SEQ ID NO: 2039657 - RNA, 16 nt, Staphylococcus aureus subsp. aureus Mu50
cgggcuauauuugaua

SEQ ID NO: 2039658 - RNA, 19 nt, Staphylococcus aureus subsp. aureus Mu50
cggaucauuauuuagaauu

SEQ ID NO: 2039659 - RNA, 16 nt, Staphylococcus aureus subsp. aureus Mu50
cggauuaacauuaucc

SEQ ID NO: 2039660 - RNA, 22 nt, Staphylococcus aureus subsp. aureus Mu50
cggaccuuguaaauuuaaaugu

SEQ ID NO: 2039661 - RNA, 23 nt, Staphylococcus aureus subsp. aureus Mu50
cgcgauaaauaacuuuaccacca

SEQ ID NO: 2039662 - RNA, 20 nt, Staphylococcus aureus subsp. aureus Mu50
cgcuagugcgcgauaaauaa

SEQ ID NO: 2039663 - RNA, 21 nt, Staphylococcus aureus subsp. aureus Mu50
aacagcggaauacagaugaug

SEQ ID NO: 2039664 - RNA, 16 nt, Staphylococcus aureus subsp. aureus Mu50
aacagcgugaauauaa

SEQ ID NO: 2039665 - RNA, 15 nt, Staphylococcus aureus subsp. aureus Mu50
aacagcuacaaauaa

SEQ ID NO: 2039666 - RNA, 23 nt, Staphylococcus aureus subsp. aureus Mu50
aacagcugcagucgcaauggcaa

SEQ ID NO: 2039667 - RNA, 20 nt, Staphylococcus aureus subsp. aureus Mu50
aacagcacauuuuuaguuag

SEQ ID NO: 2039668 - RNA, 22 nt, Staphylococcus aureus subsp. aureus Mu50
aacacguucuugguauuuuuua

SEQ ID NO: 2039669 - RNA, 18 nt, Staphylococcus aureus subsp. aureus Mu50
aacacuucguauugaaug

SEQ ID NO: 2039670 - RNA, 21 nt, Staphylococcus aureus subsp. aureus Mu50
gcgccuuguucaauucagcaa

SEQ ID NO: 2039671 - RNA, 15 nt, Staphylococcus aureus subsp. aureus Mu50
gcgaucauuagcaau

SEQ ID NO: 2039672 - RNA, 19 nt, Staphylococcus aureus subsp. aureus Mu50
gccguauucuuuaccuuua

SEQ ID NO: 2039673 - RNA, 18 nt, Staphylococcus aureus subsp. aureus Mu50
aagccaucaauauugaua

SEQ ID NO: 2039674 - RNA, 13 nt, Staphylococcus aureus subsp. aureus Mu50
aagcauaccuaca

SEQ ID NO: 2039675 - RNA, 16 nt, Staphylococcus aureus subsp. aureus Mu50
aagcaucgaacaaucg

SEQ ID NO: 2039676 - RNA, 17 nt, Staphylococcus aureus subsp. aureus Mu50
aagcauauuucuaaauu

SEQ ID NO: 2039677 - RNA, 15 nt, Staphylococcus aureus subsp. aureus Mu50
aagcauuuuucaauu

SEQ ID NO: 2039678 - RNA, 16 nt, Staphylococcus aureus subsp. aureus Mu50
aagcauuuuucaauua

SEQ ID NO: 2039679 - RNA, 22 nt, Staphylococcus aureus subsp. aureus Mu50
aagcugauuucuaucaaauaau

SEQ ID NO: 2039680 - RNA, 15 nt, Staphylococcus aureus subsp. aureus Mu50
aagcuaucguuuauu

SEQ ID NO: 2039681 - RNA, 19 nt, Staphylococcus aureus subsp. aureus Mu50
aagcuaucguuuauugaua

SEQ ID NO: 2039682 - RNA, 17 nt, Staphylococcus aureus subsp. aureus Mu50
aagcugucuuacugcug

SEQ ID NO: 2039683 - RNA, 17 nt, Staphylococcus aureus subsp. aureus Mu50
aagccugauguaccacu

SEQ ID NO: 2039684 - RNA, 14 nt, Staphylococcus aureus subsp. aureus Mu50
aagccuuaaaauau

SEQ ID NO: 2039685 - RNA, 19 nt, Staphylococcus aureus subsp. aureus Mu50
gcgcuguuccaaauucauu

SEQ ID NO: 2039686 - RNA, 17 nt, Staphylococcus aureus subsp. aureus Mu50
gcgcuguaauaccuuua

SEQ ID NO: 2039687 - RNA, 15 nt, Staphylococcus aureus subsp. aureus Mu50
gcugcaucaauauga

SEQ ID NO: 2039688 - RNA, 22 nt, Staphylococcus aureus subsp. aureus Mu50
gcugauuucuaucaaauaauga

SEQ ID NO: 2039689 - RNA, 14 nt, Staphylococcus aureus subsp. aureus Mu50
gcugcuuucauaga

SEQ ID NO: 2039690 - RNA, 17 nt, Staphylococcus aureus subsp. aureus Mu50
aagcuuuaguuaaauag

SEQ ID NO: 2039691 - RNA, 16 nt, Staphylococcus aureus subsp. aureus Mu50
aaggaagcaucuccaa

SEQ ID NO: 2039692 - RNA, 23 nt, Staphylococcus aureus subsp. aureus Mu50
gcguauugauucaagcaucauuu

SEQ ID NO: 2039693 - RNA, 13 nt, Staphylococcus aureus subsp. aureus Mu50
gcguauuccauug

SEQ ID NO: 2039694 - RNA, 22 nt, Staphylococcus aureus subsp. aureus Mu50
gcucaaguugauuauucuauau

SEQ ID NO: 2039695 - RNA, 20 nt, Staphylococcus aureus subsp. aureus Mu50
gcuauuuuauacauaaauau

SEQ ID NO: 2039696 - RNA, 14 nt, Staphylococcus aureus subsp. aureus Mu50
gcuauauaauuuau

SEQ ID NO: 2039697 - RNA, 12 nt, Staphylococcus aureus subsp. aureus Mu50
gcuaucaaacuu

SEQ ID NO: 2039698 - RNA, 20 nt, Staphylococcus aureus subsp. aureus Mu50
gcuaucucuaccauuucaac

SEQ ID NO: 2039699 - RNA, 21 nt, Staphylococcus aureus subsp. aureus Mu50
gcuaauuuuuucaucauucaa

SEQ ID NO: 2039700 - RNA, 16 nt, Staphylococcus aureus subsp. aureus Mu50
gcuaauccauacguau

SEQ ID NO: 2039701 - RNA, 14 nt, Staphylococcus aureus subsp. aureus Mu50
gcuauacauugaua

SEQ ID NO: 2039702 - RNA, 20 nt, Staphylococcus aureus subsp. aureus Mu50
gcuagugcgcgauaaauaau

SEQ ID NO: 2039703 - RNA, 19 nt, Staphylococcus aureus subsp. aureus Mu50
gcuauaaaaaaucuuuuga

SEQ ID NO: 2039704 - RNA, 16 nt, Staphylococcus aureus subsp. aureus Mu50
gcuauaacucuaaaua

SEQ ID NO: 2039705 - RNA, 23 nt, Staphylococcus aureus subsp. aureus Mu50
gcuauaacucuaaauauaauaga

SEQ ID NO: 2039706 - RNA, 15 nt, Staphylococcus aureus subsp. aureus Mu50
gcuaaccaucauaaa

SEQ ID NO: 2039707 - RNA, 14 nt, Staphylococcus aureus subsp. aureus Mu50
gcuaaaauaucaaa

SEQ ID NO: 2039708 - RNA, 19 nt, Staphylococcus aureus subsp. aureus Mu50
gucaauuuuuucaugauuu

SEQ ID NO: 2039709 - RNA, 17 nt, Staphylococcus aureus subsp. aureus Mu50
gucaauuuaaauaaguu

SEQ ID NO: 2039710 - RNA, 21 nt, Staphylococcus aureus subsp. aureus Mu50
guaucuaguguucucauuaua

SEQ ID NO: 2039711 - RNA, 22 nt, Staphylococcus aureus subsp. aureus Mu50
guaucauuuaaaauauuuuuuc

SEQ ID NO: 2039712 - RNA, 20 nt, Staphylococcus aureus subsp. aureus Mu50
guaucagaagauaauacguu

SEQ ID NO: 2039713 - RNA, 16 nt, Staphylococcus aureus subsp. aureus Mu50
guauggacuaagauau

SEQ ID NO: 2039714 - RNA, 18 nt, Staphylococcus aureus subsp. aureus Mu50
guaugcgguuauaucauu

SEQ ID NO: 2039715 - RNA, 20 nt, Staphylococcus aureus subsp. aureus Mu50
guauguacacgagucauuaa

SEQ ID NO: 2039716 - RNA, 21 nt, Staphylococcus aureus subsp. aureus Mu50
guauguacacgagucauuaaa

SEQ ID NO: 2039717 - RNA, 13 nt, Staphylococcus aureus subsp. aureus Mu50
guauggauguauu

SEQ ID NO: 2039718 - RNA, 20 nt, Staphylococcus aureus subsp. aureus Mu50
guaucugugaauaugcuuuu

SEQ ID NO: 2039719 - RNA, 18 nt, Staphylococcus aureus subsp. aureus Mu50
gucaaaucgaaauuucca

SEQ ID NO: 2039720 - RNA, 20 nt, Staphylococcus aureus subsp. aureus Mu50
gucaacaucaugaacuuuua

SEQ ID NO: 2039721 - RNA, 16 nt, Staphylococcus aureus subsp. aureus Mu50
gucaacagcauaaaua

SEQ ID NO: 2039722 - RNA, 18 nt, Staphylococcus aureus subsp. aureus Mu50
gucaacagcauaaauaag

SEQ ID NO: 2039723 - RNA, 18 nt, Staphylococcus aureus subsp. aureus Mu50
guauuuaguaucaugaua

SEQ ID NO: 2039724 - RNA, 12 nt, Staphylococcus aureus subsp. aureus Mu50
guauuuaauaag

SEQ ID NO: 2039725 - RNA, 15 nt, Staphylococcus aureus subsp. aureus Mu50
guauuuaauguuuua

SEQ ID NO: 2039726 - RNA, 19 nt, Staphylococcus aureus subsp. aureus Mu50
guauuuuugcguuaauaau

SEQ ID NO: 2039727 - RNA, 20 nt, Staphylococcus aureus subsp. aureus Mu50
guauuuugcgcuucuaguag

SEQ ID NO: 2039728 - RNA, 23 nt, Staphylococcus aureus subsp. aureus Mu50
gucaaacaacaaucaaauuacaa

SEQ ID NO: 2039729 - RNA, 16 nt, Staphylococcus aureus subsp. aureus Mu50
guauucgguuaauauu

SEQ ID NO: 2039730 - RNA, 21 nt, Staphylococcus aureus subsp. aureus Mu50
guauuagccaauaaaauguca

SEQ ID NO: 2039731 - RNA, 21 nt, Staphylococcus aureus subsp. aureus Mu50
guauuaauugaauugauuaua

SEQ ID NO: 2039732 - RNA, 22 nt, Staphylococcus aureus subsp. aureus Mu50
gucauaguauacauaauucaau

SEQ ID NO: 2039733 - RNA, 16 nt, Staphylococcus aureus subsp. aureus Mu50
gucauaugcauacacu

SEQ ID NO: 2039734 - RNA, 18 nt, Staphylococcus aureus subsp. aureus Mu50
guaagauaacgagugaaa

SEQ ID NO: 2039735 - RNA, 17 nt, Staphylococcus aureus subsp. aureus Mu50
guaagacaacaaaucga

SEQ ID NO: 2039736 - RNA, 14 nt, Staphylococcus aureus subsp. aureus Mu50
guaaauuuaucauu

SEQ ID NO: 2039737 - RNA, 20 nt, Staphylococcus aureus subsp. aureus Mu50
guaauaaagcaauguugcau

SEQ ID NO: 2039738 - RNA, 16 nt, Staphylococcus aureus subsp. aureus Mu50
guaauacuauaugaaa

SEQ ID NO: 2039739 - RNA, 21 nt, Staphylococcus aureus subsp. aureus Mu50
guaauacaugacauucauuua

SEQ ID NO: 2039740 - RNA, 14 nt, Staphylococcus aureus subsp. aureus Mu50
guaauaauuuacag

SEQ ID NO: 2039741 - RNA, 15 nt, Staphylococcus aureus subsp. aureus Mu50
guaauaaaaugauga

SEQ ID NO: 2039742 - RNA, 23 nt, Staphylococcus aureus subsp. aureus Mu50
guaaaucccaaguuacaauauca

SEQ ID NO: 2039743 - RNA, 19 nt, Staphylococcus aureus subsp. aureus Mu50
guaaauauucguugauagu

SEQ ID NO: 2039744 - RNA, 17 nt, Staphylococcus aureus subsp. aureus Mu50
guaaaucacgauuuuca

SEQ ID NO: 2039745 - RNA, 21 nt, Staphylococcus aureus subsp. aureus Mu50
guaaaauauacuugaagcauc

SEQ ID NO: 2039746 - RNA, 11 nt, Staphylococcus aureus subsp. aureus Mu50
guaaagcuuua

SEQ ID NO: 2039747 - RNA, 19 nt, Staphylococcus aureus subsp. aureus Mu50
guaaagcuuuaguuaaaua

SEQ ID NO: 2039748 - RNA, 13 nt, Staphylococcus aureus subsp. aureus Mu50
guaaaauauacuu

SEQ ID NO: 2039749 - RNA, 17 nt, Staphylococcus aureus subsp. aureus Mu50
guacacgagucauuaaa

SEQ ID NO: 2039750 - RNA, 24 nt, Staphylococcus aureus subsp. aureus Mu50
guacaaagguaauagaacgaaaua

SEQ ID NO: 2039751 - RNA, 17 nt, Staphylococcus aureus subsp. aureus Mu50
guaaucaagcaaugcau

SEQ ID NO: 2039752 - RNA, 17 nt, Staphylococcus aureus subsp. aureus Mu50
guaauaguuaacgauag

SEQ ID NO: 2039753 - RNA, 15 nt, Staphylococcus aureus subsp. aureus Mu50
guaauaugagugaaa

SEQ ID NO: 2039754 - RNA, 14 nt, Staphylococcus aureus subsp. aureus Mu50
guaaucucaucuaa

SEQ ID NO: 2039755 - RNA, 18 nt, Staphylococcus aureus subsp. aureus Mu50
guaaucucguuuuuacau

SEQ ID NO: 2039756 - RNA, 16 nt, Staphylococcus aureus subsp. aureus Mu50
guacuuccuuccauuc

SEQ ID NO: 2039757 - RNA, 20 nt, Staphylococcus aureus subsp. aureus Mu50
aaguauggacuaagauauaa

SEQ ID NO: 2039758 - RNA, 15 nt, Staphylococcus aureus subsp. aureus Mu50
aaguauguugucaua

SEQ ID NO: 2039759 - RNA, 13 nt, Staphylococcus aureus subsp. aureus Mu50
aaguauuuaaaua

SEQ ID NO: 2039760 - RNA, 19 nt, Staphylococcus aureus subsp. aureus Mu50
aaguauuagauauauuuga

SEQ ID NO: 2039761 - RNA, 17 nt, Staphylococcus aureus subsp. aureus Mu50
aaguaugagugauagaa

SEQ ID NO: 2039762 - RNA, 16 nt, Staphylococcus aureus subsp. aureus Mu50
aaguaugaguuauuaa

SEQ ID NO: 2039763 - RNA, 18 nt, Staphylococcus aureus subsp. aureus Mu50
aaguaguucagcaaguuu

SEQ ID NO: 2039764 - RNA, 15 nt, Staphylococcus aureus subsp. aureus Mu50
aaguauauacuaauc

SEQ ID NO: 2039765 - RNA, 17 nt, Staphylococcus aureus subsp. aureus Mu50
aaguaguuucauugcuu

SEQ ID NO: 2039766 - RNA, 14 nt, Staphylococcus aureus subsp. aureus Mu50
aaguccaaauaaua

SEQ ID NO: 2039767 - RNA, 22 nt, Staphylococcus aureus subsp. aureus Mu50
aagucaguauaaguuucuggca

SEQ ID NO: 2039768 - RNA, 20 nt, Staphylococcus aureus subsp. aureus Mu50
aagucgcucuagacauuaca

SEQ ID NO: 2039769 - RNA, 21 nt, Staphylococcus aureus subsp. aureus Mu50
guauauaucaaauacauuuca

SEQ ID NO: 2039770 - RNA, 20 nt, Staphylococcus aureus subsp. aureus Mu50
guauauucuuuuuaacuaug

SEQ ID NO: 2039771 - RNA, 16 nt, Staphylococcus aureus subsp. aureus Mu50
guauaugaaucgauau

SEQ ID NO: 2039772 - RNA, 20 nt, Staphylococcus aureus subsp. aureus Mu50
aagucguucaauuguugauu

SEQ ID NO: 2039773 - RNA, 13 nt, Staphylococcus aureus subsp. aureus Mu50
gucgaauauaauu

SEQ ID NO: 2039774 - RNA, 22 nt, Staphylococcus aureus subsp. aureus Mu50
gucaucaaaacguuugaagaau

SEQ ID NO: 2039775 - RNA, 14 nt, Staphylococcus aureus subsp. aureus Mu50
gucgauaaguuuuu

SEQ ID NO: 2039776 - RNA, 19 nt, Staphylococcus aureus subsp. aureus Mu50
ggucuaucgccuaaaaaua

SEQ ID NO: 2039777 - RNA, 17 nt, Staphylococcus aureus subsp. aureus Mu50
ggugauugaacaauaau

SEQ ID NO: 2039778 - RNA, 20 nt, Staphylococcus aureus subsp. aureus Mu50
gguaacuuuuuacauuuuca

SEQ ID NO: 2039779 - RNA, 17 nt, Staphylococcus aureus subsp. aureus Mu50
gguaaauuuaucauuuu

SEQ ID NO: 2039780 - RNA, 15 nt, Staphylococcus aureus subsp. aureus Mu50
aaguaccaucucuau

SEQ ID NO: 2039781 - RNA, 16 nt, Staphylococcus aureus subsp. aureus Mu50
aaguaauagcaaccau

SEQ ID NO: 2039782 - RNA, 14 nt, Staphylococcus aureus subsp. aureus Mu50
aaguaauuaaauac

SEQ ID NO: 2039783 - RNA, 14 nt, Staphylococcus aureus subsp. aureus Mu50
aaguaauaaaauaa

SEQ ID NO: 2039784 - RNA, 17 nt, Staphylococcus aureus subsp. aureus Mu50
aaguaauaaguaauaau

SEQ ID NO: 2039785 - RNA, 15 nt, Staphylococcus aureus subsp. aureus Mu50
aaguacuuacaaaua

SEQ ID NO: 2039786 - RNA, 15 nt, Staphylococcus aureus subsp. aureus Mu50
aaguagaaaauauga

SEQ ID NO: 2039787 - RNA, 15 nt, Staphylococcus aureus subsp. aureus Mu50
aaguagaaccuauau

SEQ ID NO: 2039788 - RNA, 18 nt, Staphylococcus aureus subsp. aureus Mu50
gguauucuauuuuucaau

SEQ ID NO: 2039789 - RNA, 17 nt, Staphylococcus aureus subsp. aureus Mu50
gguaucuuuaauuucau

SEQ ID NO: 2039790 - RNA, 15 nt, Staphylococcus aureus subsp. aureus Mu50
ggucaauuuuaccau

SEQ ID NO: 2039791 - RNA, 15 nt, Staphylococcus aureus subsp. aureus Mu50
gguauuuauagauuu

SEQ ID NO: 2039792 - RNA, 18 nt, Staphylococcus aureus subsp. aureus Mu50
gguauauuaaaaauuuca

SEQ ID NO: 2039793 - RNA, 20 nt, Staphylococcus aureus subsp. aureus Mu50
gguauauuaaaaauuucaau

SEQ ID NO: 2039794 - RNA, 18 nt, Staphylococcus aureus subsp. aureus Mu50
gguagccaauaucauauu

SEQ ID NO: 2039795 - RNA, 15 nt, Staphylococcus aureus subsp. aureus Mu50
gggcgauaaaaguug

SEQ ID NO: 2039796 - RNA, 19 nt, Staphylococcus aureus subsp. aureus Mu50
aaguaagcagagccauaau

SEQ ID NO: 2039797 - RNA, 21 nt, Staphylococcus aureus subsp. aureus Mu50
aaguaaauguuuuauguauuu

SEQ ID NO: 2039798 - RNA, 15 nt, Staphylococcus aureus subsp. aureus Mu50
aaguaaaauauacuu

SEQ ID NO: 2039799 - RNA, 21 nt, Staphylococcus aureus subsp. aureus Mu50
ggggaagaccauuuuauauuu

SEQ ID NO: 2039800 - RNA, 20 nt, Staphylococcus aureus subsp. aureus Mu50
ggacaguuuuuauauuaaga

SEQ ID NO: 2039801 - RNA, 19 nt, Staphylococcus aureus subsp. aureus Mu50
ggaauugggaaauauuuga

SEQ ID NO: 2039802 - RNA, 11 nt, Staphylococcus aureus subsp. aureus Mu50
ggacaauguag

SEQ ID NO: 2039803 - RNA, 18 nt, Staphylococcus aureus subsp. aureus Mu50
ggaccuauuguauuguuu

SEQ ID NO: 2039804 - RNA, 16 nt, Staphylococcus aureus subsp. aureus Mu50
ggaacaugauucauga

SEQ ID NO: 2039805 - RNA, 14 nt, Staphylococcus aureus subsp. aureus Mu50
ggaaggacaggaau

SEQ ID NO: 2039806 - RNA, 14 nt, Staphylococcus aureus subsp. aureus Mu50
ggaagcauauuucu

SEQ ID NO: 2039807 - RNA, 16 nt, Staphylococcus aureus subsp. aureus Mu50
ggaauauuaacaccag

SEQ ID NO: 2039808 - RNA, 16 nt, Staphylococcus aureus subsp. aureus Mu50
ggagugggacagaaau

SEQ ID NO: 2039809 - RNA, 19 nt, Staphylococcus aureus subsp. aureus Mu50
aaggauguuauaaaaugaa

SEQ ID NO: 2039810 - RNA, 12 nt, Staphylococcus aureus subsp. aureus Mu50
ggcaauugauug

SEQ ID NO: 2039811 - RNA, 13 nt, Staphylococcus aureus subsp. aureus Mu50
aagggaguauuuu

SEQ ID NO: 2039812 - RNA, 13 nt, Staphylococcus aureus subsp. aureus Mu50
aagggagcauuuc

SEQ ID NO: 2039813 - RNA, 12 nt, Staphylococcus aureus subsp. aureus Mu50
aagggcaaaaaa

SEQ ID NO: 2039814 - RNA, 18 nt, Staphylococcus aureus subsp. aureus Mu50
aaggggguaauacuauau

SEQ ID NO: 2039815 - RNA, 23 nt, Staphylococcus aureus subsp. aureus Mu50
aaggggguaauacuauaugaaaa

SEQ ID NO: 2039816 - RNA, 23 nt, Staphylococcus aureus subsp. aureus Mu50
aagguauggcuagucuuuaacuu

SEQ ID NO: 2039817 - RNA, 21 nt, Staphylococcus aureus subsp. aureus Mu50
aagguauaucuucauuuaaaa

SEQ ID NO: 2039818 - RNA, 22 nt, Staphylococcus aureus subsp. aureus Mu50
aagguuaauuggguuuaauaac

SEQ ID NO: 2039819 - RNA, 20 nt, Staphylococcus aureus subsp. aureus Mu50
aaggucuauguacaauaauu

SEQ ID NO: 2039820 - RNA, 23 nt, Staphylococcus aureus subsp. aureus Mu50
ggcggggccccaacacagagaau

SEQ ID NO: 2039821 - RNA, 17 nt, Staphylococcus aureus subsp. aureus Mu50
gcaacuugggauuuuuu

SEQ ID NO: 2039822 - RNA, 22 nt, Staphylococcus aureus subsp. aureus Mu50
gcaacuuguccguuuuuaguau

SEQ ID NO: 2039823 - RNA, 23 nt, Staphylococcus aureus subsp. aureus Mu50
gcaacgauaccaaauauauuuuu

SEQ ID NO: 2039824 - RNA, 20 nt, Staphylococcus aureus subsp. aureus Mu50
gcaauaacaccaauugaaua

SEQ ID NO: 2039825 - RNA, 23 nt, Staphylococcus aureus subsp. aureus Mu50
gcaagugcuuccacuucaucuaa

SEQ ID NO: 2039826 - RNA, 23 nt, Staphylococcus aureus subsp. aureus Mu50
gcaaucaccuuuggcuacugcac

SEQ ID NO: 2039827 - RNA, 21 nt, Staphylococcus aureus subsp. aureus Mu50
gcaauuagaauauauguauaa

SEQ ID NO: 2039828 - RNA, 21 nt, Staphylococcus aureus subsp. aureus Mu50
gcaaucucuuuagaugagauu

SEQ ID NO: 2039829 - RNA, 14 nt, Staphylococcus aureus subsp. aureus Mu50
gcaaucguugaaaa

SEQ ID NO: 2039830 - RNA, 20 nt, Staphylococcus aureus subsp. aureus Mu50
gauugcucuaauccaaaaua

SEQ ID NO: 2039831 - RNA, 17 nt, Staphylococcus aureus subsp. aureus Mu50
gauuguauuuaauaagu

SEQ ID NO: 2039832 - RNA, 18 nt, Staphylococcus aureus subsp. aureus Mu50
gauuuggguaauguuuuu

SEQ ID NO: 2039833 - RNA, 19 nt, Staphylococcus aureus subsp. aureus Mu50
gauuucuuuaugauaauaa

SEQ ID NO: 2039834 - RNA, 23 nt, Staphylococcus aureus subsp. aureus Mu50
gauuucguuagacucacuucuua

SEQ ID NO: 2039835 - RNA, 14 nt, Staphylococcus aureus subsp. aureus Mu50
gauucguuaucuaa

SEQ ID NO: 2039836 - RNA, 14 nt, Staphylococcus aureus subsp. aureus Mu50
gauucccaaauagu

SEQ ID NO: 2039837 - RNA, 20 nt, Staphylococcus aureus subsp. aureus Mu50
gauuauuuuuuuaaaucuau

SEQ ID NO: 2039838 - RNA, 14 nt, Staphylococcus aureus subsp. aureus Mu50
gauuauauuuuucu

SEQ ID NO: 2039839 - RNA, 19 nt, Staphylococcus aureus subsp. aureus Mu50
gauuauuauuacaaugaaa

SEQ ID NO: 2039840 - RNA, 22 nt, Staphylococcus aureus subsp. aureus Mu50
gauuauuauuacaaugaaaaaa

SEQ ID NO: 2039841 - RNA, 15 nt, Staphylococcus aureus subsp. aureus Mu50
gcaaaauuauguaaa

SEQ ID NO: 2039842 - RNA, 19 nt, Staphylococcus aureus subsp. aureus Mu50
gcaaaacuugcgcaugcuu

SEQ ID NO: 2039843 - RNA, 14 nt, Staphylococcus aureus subsp. aureus Mu50
gcaaagucauuaaa

SEQ ID NO: 2039844 - RNA, 14 nt, Staphylococcus aureus subsp. aureus Mu50
gcaaagcuucauuu

SEQ ID NO: 2039845 - RNA, 11 nt, Staphylococcus aureus subsp. aureus Mu50
gcaacauuuga

SEQ ID NO: 2039846 - RNA, 20 nt, Staphylococcus aureus subsp. aureus Mu50
gaugcuuuucuauccauagu

SEQ ID NO: 2039847 - RNA, 23 nt, Staphylococcus aureus subsp. aureus Mu50
aacuuagcuuagucaauguauau

SEQ ID NO: 2039848 - RNA, 16 nt, Staphylococcus aureus subsp. aureus Mu50
aacuuagaauuuacaa

SEQ ID NO: 2039849 - RNA, 17 nt, Staphylococcus aureus subsp. aureus Mu50
aacuuagguuauuauaa

SEQ ID NO: 2039850 - RNA, 16 nt, Staphylococcus aureus subsp. aureus Mu50
gaugugaauguuuugu

SEQ ID NO: 2039851 - RNA, 22 nt, Staphylococcus aureus subsp. aureus Mu50
aacuuuuuaauaauuguaucgu

SEQ ID NO: 2039852 - RNA, 20 nt, Staphylococcus aureus subsp. aureus Mu50
gaucgcccauacuaaauaag

SEQ ID NO: 2039853 - RNA, 18 nt, Staphylococcus aureus subsp. aureus Mu50
gaucauuagcaauuucau

SEQ ID NO: 2039854 - RNA, 23 nt, Staphylococcus aureus subsp. aureus Mu50
gaucaugccuucaugaauaaaua

SEQ ID NO: 2039855 - RNA, 18 nt, Staphylococcus aureus subsp. aureus Mu50
gaucacgauaauguauau

SEQ ID NO: 2039856 - RNA, 19 nt, Staphylococcus aureus subsp. aureus Mu50
gaucacuuacugugaaaau

SEQ ID NO: 2039857 - RNA, 18 nt, Staphylococcus aureus subsp. aureus Mu50
gaucguaacauuagcaug

SEQ ID NO: 2039858 - RNA, 15 nt, Staphylococcus aureus subsp. aureus Mu50
gauagguaacuaaaa

SEQ ID NO: 2039859 - RNA, 13 nt, Staphylococcus aureus subsp. aureus Mu50
gauaggauuuaca

SEQ ID NO: 2039860 - RNA, 15 nt, Staphylococcus aureus subsp. aureus Mu50
gauagaugauacauu

SEQ ID NO: 2039861 - RNA, 19 nt, Staphylococcus aureus subsp. aureus Mu50
gauaucuuaaucuaaaaau

SEQ ID NO: 2039862 - RNA, 18 nt, Staphylococcus aureus subsp. aureus Mu50
gauaaugcaccugugaua

SEQ ID NO: 2039863 - RNA, 21 nt, Staphylococcus aureus subsp. aureus Mu50
gauaauacuguuuaaauaaaa

SEQ ID NO: 2039864 - RNA, 16 nt, Staphylococcus aureus subsp. aureus Mu50
gauaaguggauuuucu

SEQ ID NO: 2039865 - RNA, 14 nt, Staphylococcus aureus subsp. aureus Mu50
gauacgcacguaua

SEQ ID NO: 2039866 - RNA, 13 nt, Staphylococcus aureus subsp. aureus Mu50
gauaaaaugauau

SEQ ID NO: 2039867 - RNA, 13 nt, Staphylococcus aureus subsp. aureus Mu50
gauaaauaaugca

SEQ ID NO: 2039868 - RNA, 15 nt, Staphylococcus aureus subsp. aureus Mu50
gauaaauaauaaguu

SEQ ID NO: 2039869 - RNA, 17 nt, Staphylococcus aureus subsp. aureus Mu50
gauaaauaaaaggcauu

SEQ ID NO: 2039870 - RNA, 16 nt, Staphylococcus aureus subsp. aureus Mu50
gauaaaucaagaaaug

SEQ ID NO: 2039871 - RNA, 14 nt, Staphylococcus aureus subsp. aureus Mu50
gauaaaucaucauu

SEQ ID NO: 2039872 - RNA, 16 nt, Staphylococcus aureus subsp. aureus Mu50
gaguauuuuuuauguu

SEQ ID NO: 2039873 - RNA, 18 nt, Staphylococcus aureus subsp. aureus Mu50
gacuuauuuuucaucauu

SEQ ID NO: 2039874 - RNA, 23 nt, Staphylococcus aureus subsp. aureus Mu50
gacuuaacuuaagcucauuucaa

SEQ ID NO: 2039875 - RNA, 18 nt, Staphylococcus aureus subsp. aureus Mu50
gacuuacauuuuaauaaa

SEQ ID NO: 2039876 - RNA, 21 nt, Staphylococcus aureus subsp. aureus Mu50
gacuguuaaacgcugauuuua

SEQ ID NO: 2039877 - RNA, 16 nt, Staphylococcus aureus subsp. aureus Mu50
aacuauaugaaauguu

SEQ ID NO: 2039878 - RNA, 18 nt, Staphylococcus aureus subsp. aureus Mu50
aacuagaacaagaauuau

SEQ ID NO: 2039879 - RNA, 18 nt, Staphylococcus aureus subsp. aureus Mu50
aacuagcaguaauauguu

SEQ ID NO: 2039880 - RNA, 14 nt, Staphylococcus aureus subsp. aureus Mu50
aacuaucaauauaa

SEQ ID NO: 2039881 - RNA, 21 nt, Staphylococcus aureus subsp. aureus Mu50
aacuauugaaaauagaaagaa

SEQ ID NO: 2039882 - RNA, 17 nt, Staphylococcus aureus subsp. aureus Mu50
aacuauuuuaaauuaca

SEQ ID NO: 2039883 - RNA, 12 nt, Staphylococcus aureus subsp. aureus Mu50
aacuaaaauguc

SEQ ID NO: 2039884 - RNA, 15 nt, Staphylococcus aureus subsp. aureus Mu50
aacuaaacauugcuu

SEQ ID NO: 2039885 - RNA, 10 nt, Staphylococcus aureus subsp. aureus Mu50
aacuaaacca

SEQ ID NO: 2039886 - RNA, 14 nt, Staphylococcus aureus subsp. aureus Mu50
aacuaagauauauu

SEQ ID NO: 2039887 - RNA, 16 nt, Staphylococcus aureus subsp. aureus Mu50
aacuaauaacaaauag

SEQ ID NO: 2039888 - RNA, 12 nt, Staphylococcus aureus subsp. aureus Mu50
aacuaauagcau

SEQ ID NO: 2039889 - RNA, 20 nt, Staphylococcus aureus subsp. aureus Mu50
aacuaaucguguauuauuga

SEQ ID NO: 2039890 - RNA, 23 nt, Staphylococcus aureus subsp. aureus Mu50
aacuacgauaccggcaacugguc

SEQ ID NO: 2039891 - RNA, 14 nt, Staphylococcus aureus subsp. aureus Mu50
aacguucacuuggu

SEQ ID NO: 2039892 - RNA, 22 nt, Staphylococcus aureus subsp. aureus Mu50
aacguguuugaauggcaaauau

SEQ ID NO: 2039893 - RNA, 22 nt, Staphylococcus aureus subsp. aureus Mu50
aacguugaguauuacuugaaaa

SEQ ID NO: 2039894 - RNA, 17 nt, Staphylococcus aureus subsp. aureus Mu50
gacuuuaaaguuaaagu

SEQ ID NO: 2039895 - RNA, 15 nt, Staphylococcus aureus subsp. aureus Mu50
gacuuuuagauuauc

SEQ ID NO: 2039896 - RNA, 15 nt, Staphylococcus aureus subsp. aureus Mu50
gacuucccaaucgau

SEQ ID NO: 2039897 - RNA, 19 nt, Staphylococcus aureus subsp. aureus Mu50
gacugaaagaaaagugaaa

SEQ ID NO: 2039898 - RNA, 14 nt, Staphylococcus aureus subsp. aureus Mu50
gacugacuaauaaa

SEQ ID NO: 2039899 - RNA, 19 nt, Staphylococcus aureus subsp. aureus Mu50
gacugagaaaaauauuucu

SEQ ID NO: 2039900 - RNA, 16 nt, Staphylococcus aureus subsp. aureus Mu50
gacuacaaguuuauaa

SEQ ID NO: 2039901 - RNA, 23 nt, Staphylococcus aureus subsp. aureus Mu50
gacuaauuaucuucaucauugua

SEQ ID NO: 2039902 - RNA, 17 nt, Staphylococcus aureus subsp. aureus Mu50
gacuaaccacauuauaa

SEQ ID NO: 2039903 - RNA, 14 nt, Staphylococcus aureus subsp. aureus Mu50
gacucaauuucauu

SEQ ID NO: 2039904 - RNA, 15 nt, Staphylococcus aureus subsp. aureus Mu50
aacucacguaaaaug

SEQ ID NO: 2039905 - RNA, 24 nt, Staphylococcus aureus subsp. aureus Mu50
aacucagacugggacauagaucaa

SEQ ID NO: 2039906 - RNA, 21 nt, Staphylococcus aureus subsp. aureus Mu50
gagauauauuaauguuugaug

SEQ ID NO: 2039907 - RNA, 13 nt, Staphylococcus aureus subsp. aureus Mu50
gagaauuaauaau

SEQ ID NO: 2039908 - RNA, 14 nt, Staphylococcus aureus subsp. aureus Mu50
gagauuuucaacac

SEQ ID NO: 2039909 - RNA, 20 nt, Staphylococcus aureus subsp. aureus Mu50
gagcaauucuugaaaaguuu

SEQ ID NO: 2039910 - RNA, 14 nt, Staphylococcus aureus subsp. aureus Mu50
gagcacuuaauaag

SEQ ID NO: 2039911 - RNA, 13 nt, Staphylococcus aureus subsp. aureus Mu50
aagagguuugaca

SEQ ID NO: 2039912 - RNA, 13 nt, Staphylococcus aureus subsp. aureus Mu50
aagacuacgaaua

SEQ ID NO: 2039913 - RNA, 18 nt, Staphylococcus aureus subsp. aureus Mu50
aagagaacuuuucaaaca

SEQ ID NO: 2039914 - RNA, 12 nt, Staphylococcus aureus subsp. aureus Mu50
aagaugaaaaag

SEQ ID NO: 2039915 - RNA, 14 nt, Staphylococcus aureus subsp. aureus Mu50
aagaauauuuaagu

SEQ ID NO: 2039916 - RNA, 20 nt, Staphylococcus aureus subsp. aureus Mu50
aagaauaugauauugauugu

SEQ ID NO: 2039917 - RNA, 15 nt, Staphylococcus aureus subsp. aureus Mu50
aagaauaaacaacau

SEQ ID NO: 2039918 - RNA, 21 nt, Staphylococcus aureus subsp. aureus Mu50
gccaugacguauacaaauuga

SEQ ID NO: 2039919 - RNA, 12 nt, Staphylococcus aureus subsp. aureus Mu50
gccaucaauauu

SEQ ID NO: 2039920 - RNA, 21 nt, Staphylococcus aureus subsp. aureus Mu50
gccauaaucuucauuaauuac

SEQ ID NO: 2039921 - RNA, 16 nt, Staphylococcus aureus subsp. aureus Mu50
gcaucacugcauauaa

SEQ ID NO: 2039922 - RNA, 21 nt, Staphylococcus aureus subsp. aureus Mu50
gcauaucuuuaucauuauucg

SEQ ID NO: 2039923 - RNA, 22 nt, Staphylococcus aureus subsp. aureus Mu50
gcauacugucaucuuucaacgc

SEQ ID NO: 2039924 - RNA, 14 nt, Staphylococcus aureus subsp. aureus Mu50
gcauagcucuugcu

SEQ ID NO: 2039925 - RNA, 16 nt, Staphylococcus aureus subsp. aureus Mu50
gcauaauucaacuuaa

SEQ ID NO: 2039926 - RNA, 22 nt, Staphylococcus aureus subsp. aureus Mu50
gcagugaucuuuuuuauauuca

SEQ ID NO: 2039927 - RNA, 13 nt, Staphylococcus aureus subsp. aureus Mu50
gcaguugaaaaag

SEQ ID NO: 2039928 - RNA, 15 nt, Staphylococcus aureus subsp. aureus Mu50
gcaugaaucgcauuu

SEQ ID NO: 2039929 - RNA, 22 nt, Staphylococcus aureus subsp. aureus Mu50
gcauguuuaaauaucaugcaaa

SEQ ID NO: 2039930 - RNA, 20 nt, Staphylococcus aureus subsp. aureus Mu50
gcauuacuaucuucaucaua

SEQ ID NO: 2039931 - RNA, 15 nt, Staphylococcus aureus subsp. aureus Mu50
gcauuacuacaaacu

SEQ ID NO: 2039932 - RNA, 16 nt, Staphylococcus aureus subsp. aureus Mu50
gcauuccuaauuauau

SEQ ID NO: 2039933 - RNA, 18 nt, Staphylococcus aureus subsp. aureus Mu50
gcauuauuauuaaauuau

SEQ ID NO: 2039934 - RNA, 20 nt, Staphylococcus aureus subsp. aureus Mu50
gcauuauugccuaaccuguu

SEQ ID NO: 2039935 - RNA, 14 nt, Staphylococcus aureus subsp. aureus Mu50
gcauguaagcuauc

SEQ ID NO: 2039936 - RNA, 23 nt, Staphylococcus aureus subsp. aureus Mu50
gccaaucacaauauaacaucaaa

SEQ ID NO: 2039937 - RNA, 16 nt, Staphylococcus aureus subsp. aureus Mu50
gcauuuaaacaaagcu

SEQ ID NO: 2039938 - RNA, 22 nt, Staphylococcus aureus subsp. aureus Mu50
gcauuuagacuuggauaaaaau

SEQ ID NO: 2039939 - RNA, 12 nt, Staphylococcus aureus subsp. aureus Mu50
gcauuuaaauau

SEQ ID NO: 2039940 - RNA, 15 nt, Staphylococcus aureus subsp. aureus Mu50
gcauuucuuuauuag

SEQ ID NO: 2039941 - RNA, 19 nt, Staphylococcus aureus subsp. aureus Mu50
gcauuuuguuucaacauuu

SEQ ID NO: 2039942 - RNA, 18 nt, Staphylococcus aureus subsp. aureus Mu50
gcauuuuuucauuauuaa

SEQ ID NO: 2039943 - RNA, 14 nt, Staphylococcus aureus subsp. aureus Mu50
gcauuuuaaauaaa

SEQ ID NO: 2039944 - RNA, 16 nt, Staphylococcus aureus subsp. aureus Mu50
gaaagacauuuaaaua

SEQ ID NO: 2039945 - RNA, 21 nt, Staphylococcus aureus subsp. aureus Mu50
gaaagauuuguagcuugaaua

SEQ ID NO: 2039946 - RNA, 18 nt, Staphylococcus aureus subsp. aureus Mu50
gaaagucguuguugaaau

SEQ ID NO: 2039947 - RNA, 20 nt, Staphylococcus aureus subsp. aureus Mu50
gaaagucaacaauugcuaau

SEQ ID NO: 2039948 - RNA, 14 nt, Staphylococcus aureus subsp. aureus Mu50
gaaaguaauaagua

SEQ ID NO: 2039949 - RNA, 15 nt, Staphylococcus aureus subsp. aureus Mu50
gaaaguagaauuauu

SEQ ID NO: 2039950 - RNA, 14 nt, Staphylococcus aureus subsp. aureus Mu50
gaaaggaacauuuc

SEQ ID NO: 2039951 - RNA, 14 nt, Staphylococcus aureus subsp. aureus Mu50
cuuguuuaaguuuu

SEQ ID NO: 2039952 - RNA, 21 nt, Staphylococcus aureus subsp. aureus Mu50
cuuguuggcuuuuuuaauuuc

SEQ ID NO: 2039953 - RNA, 15 nt, Staphylococcus aureus subsp. aureus Mu50
cuuguugguauuuuu

SEQ ID NO: 2039954 - RNA, 21 nt, Staphylococcus aureus subsp. aureus Mu50
cuuguuuuaaacuuauuaauu

SEQ ID NO: 2039955 - RNA, 17 nt, Staphylococcus aureus subsp. aureus Mu50
cuuguuucaaacaaagc

SEQ ID NO: 2039956 - RNA, 18 nt, Staphylococcus aureus subsp. aureus Mu50
cuuuaaaacaucauucac

SEQ ID NO: 2039957 - RNA, 20 nt, Staphylococcus aureus subsp. aureus Mu50
cuugugcgguaaccauuuuu

SEQ ID NO: 2039958 - RNA, 17 nt, Staphylococcus aureus subsp. aureus Mu50
gaaaccuuguuuuacaa

SEQ ID NO: 2039959 - RNA, 16 nt, Staphylococcus aureus subsp. aureus Mu50
gaacauaccugcauau

SEQ ID NO: 2039960 - RNA, 21 nt, Staphylococcus aureus subsp. aureus Mu50
gaacaguacgauuauuuggau

SEQ ID NO: 2039961 - RNA, 21 nt, Staphylococcus aureus subsp. aureus Mu50
gaaauccguuaaaauuuuaau

SEQ ID NO: 2039962 - RNA, 16 nt, Staphylococcus aureus subsp. aureus Mu50
gaaauccgcauaaauu

SEQ ID NO: 2039963 - RNA, 17 nt, Staphylococcus aureus subsp. aureus Mu50
gaaaucuuaaagauuuu

SEQ ID NO: 2039964 - RNA, 21 nt, Staphylococcus aureus subsp. aureus Mu50
gaacaugaaugauauugauuu

SEQ ID NO: 2039965 - RNA, 20 nt, Staphylococcus aureus subsp. aureus Mu50
gaacuugcuuuguuaggauc

SEQ ID NO: 2039966 - RNA, 17 nt, Staphylococcus aureus subsp. aureus Mu50
gaagacaccuuaucacu

SEQ ID NO: 2039967 - RNA, 22 nt, Staphylococcus aureus subsp. aureus Mu50
gaagaaugccuuuuauuuaucu

SEQ ID NO: 2039968 - RNA, 21 nt, Staphylococcus aureus subsp. aureus Mu50
gaacucguucguauauuacau

SEQ ID NO: 2039969 - RNA, 17 nt, Staphylococcus aureus subsp. aureus Mu50
gaacucugauauugauc

SEQ ID NO: 2039970 - RNA, 20 nt, Staphylococcus aureus subsp. aureus Mu50
gaaugaaaaaguugaucuac

SEQ ID NO: 2039971 - RNA, 15 nt, Staphylococcus aureus subsp. aureus Mu50
gaaugaaaauaagcu

SEQ ID NO: 2039972 - RNA, 14 nt, Staphylococcus aureus subsp. aureus Mu50
gaaguaauguuaaa

SEQ ID NO: 2039973 - RNA, 14 nt, Staphylococcus aureus subsp. aureus Mu50
gaaggaaaauaaaa

SEQ ID NO: 2039974 - RNA, 13 nt, Staphylococcus aureus subsp. aureus Mu50
gaagaugauuauu

SEQ ID NO: 2039975 - RNA, 14 nt, Staphylococcus aureus subsp. aureus Mu50
aacgacaacuugaa

SEQ ID NO: 2039976 - RNA, 22 nt, Staphylococcus aureus subsp. aureus Mu50
gaauuaauauccaaaauccuga

SEQ ID NO: 2039977 - RNA, 18 nt, Staphylococcus aureus subsp. aureus Mu50
gaaugugcuuguaacaag

SEQ ID NO: 2039978 - RNA, 16 nt, Staphylococcus aureus subsp. aureus Mu50
gaauguguaugguuuu

SEQ ID NO: 2039979 - RNA, 13 nt, Staphylococcus aureus subsp. aureus Mu50
gacauguccuguu

SEQ ID NO: 2039980 - RNA, 22 nt, Staphylococcus aureus subsp. aureus Mu50
gacauugaugucaauuucacgc

SEQ ID NO: 2039981 - RNA, 17 nt, Staphylococcus aureus subsp. aureus Mu50
aacgauaagaauuaaca

SEQ ID NO: 2039982 - RNA, 13 nt, Staphylococcus aureus subsp. aureus Mu50
aacgagauuacac

SEQ ID NO: 2039983 - RNA, 24 nt, Staphylococcus aureus subsp. aureus Mu50
aacgagcaguauauaucaaauaca

SEQ ID NO: 2039984 - RNA, 22 nt, Staphylococcus aureus subsp. aureus Mu50
aacgagacaucaucuauuuuua

SEQ ID NO: 2039985 - RNA, 19 nt, Staphylococcus aureus subsp. aureus Mu50
aacgacguaauccuuggaa

SEQ ID NO: 2039986 - RNA, 17 nt, Staphylococcus aureus subsp. aureus Mu50
gaccaccugauaaugca

SEQ ID NO: 2039987 - RNA, 17 nt, Staphylococcus aureus subsp. aureus Mu50
gaccacggucuugauau

SEQ ID NO: 2039988 - RNA, 13 nt, Staphylococcus aureus subsp. aureus Mu50
gaccguugaaaug

SEQ ID NO: 2039989 - RNA, 23 nt, Staphylococcus aureus subsp. aureus Mu50
gaccuacaauuuuccuuccaaua

SEQ ID NO: 2039990 - RNA, 17 nt, Staphylococcus aureus subsp. aureus Mu50
aacgcuugaaaaauuuu

SEQ ID NO: 2039991 - RNA, 18 nt, Staphylococcus aureus subsp. aureus Mu50
cugcuucaacuacuucau

SEQ ID NO: 2039992 - RNA, 23 nt, Staphylococcus aureus subsp. aureus Mu50
cugcuuuuuuauucuaauacaaa

SEQ ID NO: 2039993 - RNA, 16 nt, Staphylococcus aureus subsp. aureus Mu50
cugcuucuaaaacauc

SEQ ID NO: 2039994 - RNA, 20 nt, Staphylococcus aureus subsp. aureus Mu50
cugcugcuaaaauaaaauua

SEQ ID NO: 2039995 - RNA, 20 nt, Staphylococcus aureus subsp. aureus Mu50
cugcuaauauuagauaucuu

SEQ ID NO: 2039996 - RNA, 18 nt, Staphylococcus aureus subsp. aureus Mu50
cugcuacaacuucuucuc

SEQ ID NO: 2039997 - RNA, 15 nt, Staphylococcus aureus subsp. aureus Mu50
aaccgcuacaauuau

SEQ ID NO: 2039998 - RNA, 13 nt, Staphylococcus aureus subsp. aureus Mu50
cugaaacuuuaau

SEQ ID NO: 2039999 - RNA, 16 nt, Staphylococcus aureus subsp. aureus Mu50
cugaaacuuuaauacu

SEQ ID NO: 2040000 - RNA, 19 nt, Staphylococcus aureus subsp. aureus Mu50
cugaaauuucauaaaguuu

SEQ ID NO: 2040001 - RNA, 17 nt, Staphylococcus aureus subsp. aureus Mu50
cugaaaugauacauuau

SEQ ID NO: 2040002 - RNA, 20 nt, Staphylococcus aureus subsp. aureus Mu50
cuucuaaucguuaauaaacc

SEQ ID NO: 2040003 - RNA, 15 nt, Staphylococcus aureus subsp. aureus Mu50
cuucuaauucguuuu

SEQ ID NO: 2040004 - RNA, 20 nt, Staphylococcus aureus subsp. aureus Mu50
cuucuacccuugcaaauaua

SEQ ID NO: 2040005 - RNA, 17 nt, Staphylococcus aureus subsp. aureus Mu50
cuucuaaguaauauaau

SEQ ID NO: 2040006 - RNA, 14 nt, Staphylococcus aureus subsp. aureus Mu50
cuucuaaccacuuc

SEQ ID NO: 2040007 - RNA, 15 nt, Staphylococcus aureus subsp. aureus Mu50
cuucuauuauauuga

SEQ ID NO: 2040008 - RNA, 17 nt, Staphylococcus aureus subsp. aureus Mu50
cuucucaucauuuucaa

SEQ ID NO: 2040009 - RNA, 14 nt, Staphylococcus aureus subsp. aureus Mu50
cuucucaauuuagu

SEQ ID NO: 2040010 - RNA, 13 nt, Staphylococcus aureus subsp. aureus Mu50
cuucuuggcauuu

SEQ ID NO: 2040011 - RNA, 20 nt, Staphylococcus aureus subsp. aureus Mu50
cuucuucgucgcugauacau

SEQ ID NO: 2040012 - RNA, 15 nt, Staphylococcus aureus subsp. aureus Mu50
cuucuuuuugcguuu

SEQ ID NO: 2040013 - RNA, 23 nt, Staphylococcus aureus subsp. aureus Mu50
cuucuuuuuuuguuuauuuagaa

SEQ ID NO: 2040014 - RNA, 17 nt, Staphylococcus aureus subsp. aureus Mu50
cuucuuugaaaucaaug

SEQ ID NO: 2040015 - RNA, 20 nt, Staphylococcus aureus subsp. aureus Mu50
cuugaaguacuuuaccacga

SEQ ID NO: 2040016 - RNA, 14 nt, Staphylococcus aureus subsp. aureus Mu50
cuugaauauuauuc

SEQ ID NO: 2040017 - RNA, 22 nt, Staphylococcus aureus subsp. aureus Mu50
cuugaauagugagcguauuauu

SEQ ID NO: 2040018 - RNA, 16 nt, Staphylococcus aureus subsp. aureus Mu50
cuucccaaucgaugcg

SEQ ID NO: 2040019 - RNA, 22 nt, Staphylococcus aureus subsp. aureus Mu50
cuucacuguuuuauuaugaauu

SEQ ID NO: 2040020 - RNA, 22 nt, Staphylococcus aureus subsp. aureus Mu50
cuucgauaguuuauuaauauua

SEQ ID NO: 2040021 - RNA, 13 nt, Staphylococcus aureus subsp. aureus Mu50
cuucgagugcuuu

SEQ ID NO: 2040022 - RNA, 23 nt, Staphylococcus aureus subsp. aureus Mu50
cuuguaaauuuauuuuuaauuuc

SEQ ID NO: 2040023 - RNA, 13 nt, Staphylococcus aureus subsp. aureus Mu50
cuuguaaaauuuu

SEQ ID NO: 2040024 - RNA, 16 nt, Staphylococcus aureus subsp. aureus Mu50
cuugguucauaaugau

SEQ ID NO: 2040025 - RNA, 15 nt, Staphylococcus aureus subsp. aureus Mu50
cuugccaucaauuuc

SEQ ID NO: 2040026 - RNA, 19 nt, Staphylococcus aureus subsp. aureus Mu50
cuugcaaagacucaauuuc

SEQ ID NO: 2040027 - RNA, 23 nt, Staphylococcus aureus subsp. aureus Mu50
cuugauaucaucugcaagugcuu

SEQ ID NO: 2040028 - RNA, 15 nt, Staphylococcus aureus subsp. aureus Mu50
cuugauaaaauaaau

SEQ ID NO: 2040029 - RNA, 20 nt, Staphylococcus aureus subsp. aureus Mu50
cuugaucauuauaaaauggu

SEQ ID NO: 2040030 - RNA, 17 nt, Staphylococcus aureus subsp. aureus Mu50
cuuacccaaaaaauugu

SEQ ID NO: 2040031 - RNA, 15 nt, Staphylococcus aureus subsp. aureus Mu50
cuuacuacuuaauua

SEQ ID NO: 2040032 - RNA, 15 nt, Staphylococcus aureus subsp. aureus Mu50
cuuacuuuuaaauua

SEQ ID NO: 2040033 - RNA, 13 nt, Staphylococcus aureus subsp. aureus Mu50
cuuacugcuuuuu

SEQ ID NO: 2040034 - RNA, 23 nt, Staphylococcus aureus subsp. aureus Mu50
cuuagacaaacgacuaaccacau

SEQ ID NO: 2040035 - RNA, 15 nt, Staphylococcus aureus subsp. aureus Mu50
cuuagauaaauuaau

SEQ ID NO: 2040036 - RNA, 21 nt, Staphylococcus aureus subsp. aureus Mu50
cuuagauuccccuuuuugucu

SEQ ID NO: 2040037 - RNA, 22 nt, Staphylococcus aureus subsp. aureus Mu50
cuuagcacuuggauuuuaauua

SEQ ID NO: 2040038 - RNA, 16 nt, Staphylococcus aureus subsp. aureus Mu50
cuuacaauaaucacuu

SEQ ID NO: 2040039 - RNA, 13 nt, Staphylococcus aureus subsp. aureus Mu50
cuuacaauaaugu

SEQ ID NO: 2040040 - RNA, 20 nt, Staphylococcus aureus subsp. aureus Mu50
cuuacaaccuuugguuguua

SEQ ID NO: 2040041 - RNA, 18 nt, Staphylococcus aureus subsp. aureus Mu50
cuuaauuuguuuuaaaua

SEQ ID NO: 2040042 - RNA, 20 nt, Staphylococcus aureus subsp. aureus Mu50
cuuaauuuugcaacauuaaa

SEQ ID NO: 2040043 - RNA, 18 nt, Staphylococcus aureus subsp. aureus Mu50
cuuaauuacaauauaauu

SEQ ID NO: 2040044 - RNA, 16 nt, Staphylococcus aureus subsp. aureus Mu50
cuguugcaguuucaau

SEQ ID NO: 2040045 - RNA, 22 nt, Staphylococcus aureus subsp. aureus Mu50
cuuaguuuagguugauuucugc

SEQ ID NO: 2040046 - RNA, 17 nt, Staphylococcus aureus subsp. aureus Mu50
cuuaguaauaagacaau

SEQ ID NO: 2040047 - RNA, 15 nt, Staphylococcus aureus subsp. aureus Mu50
cuuauauaaacaaaa

SEQ ID NO: 2040048 - RNA, 22 nt, Staphylococcus aureus subsp. aureus Mu50
cuuauauacguugauuaacaca

SEQ ID NO: 2040049 - RNA, 22 nt, Staphylococcus aureus subsp. aureus Mu50
cuuaucaaaaccgcuauaaaau

SEQ ID NO: 2040050 - RNA, 23 nt, Staphylococcus aureus subsp. aureus Mu50
cuuaucaacagcuucaaaaucaa

SEQ ID NO: 2040051 - RNA, 16 nt, Staphylococcus aureus subsp. aureus Mu50
cuuaucaagaauauaa

SEQ ID NO: 2040052 - RNA, 21 nt, Staphylococcus aureus subsp. aureus Mu50
cuucacaucaugugucuucca

SEQ ID NO: 2040053 - RNA, 23 nt, Staphylococcus aureus subsp. aureus Mu50
cuguaauaaagaauaaacaacau

SEQ ID NO: 2040054 - RNA, 16 nt, Staphylococcus aureus subsp. aureus Mu50
cuguaacauaaacaau

SEQ ID NO: 2040055 - RNA, 17 nt, Staphylococcus aureus subsp. aureus Mu50
cuguaaccaaaagaaau

SEQ ID NO: 2040056 - RNA, 18 nt, Staphylococcus aureus subsp. aureus Mu50
cuguaaagcuauccaugu

SEQ ID NO: 2040057 - RNA, 22 nt, Staphylococcus aureus subsp. aureus Mu50
cuguaaaacauucccuuaauaa

SEQ ID NO: 2040058 - RNA, 23 nt, Staphylococcus aureus subsp. aureus Mu50
cuguaaaacauucccuuaauaau

SEQ ID NO: 2040059 - RNA, 15 nt, Staphylococcus aureus subsp. aureus Mu50
cuguugacauuugac

SEQ ID NO: 2040060 - RNA, 20 nt, Staphylococcus aureus subsp. aureus Mu50
cuguuccaccagucguaaug

SEQ ID NO: 2040061 - RNA, 19 nt, Staphylococcus aureus subsp. aureus Mu50
cugucuuaauucauuccaa

SEQ ID NO: 2040062 - RNA, 15 nt, Staphylococcus aureus subsp. aureus Mu50
cuggucguacuuuca

SEQ ID NO: 2040063 - RNA, 18 nt, Staphylococcus aureus subsp. aureus Mu50
cgucguaaugaagauuuu

SEQ ID NO: 2040064 - RNA, 23 nt, Staphylococcus aureus subsp. aureus Mu50
cgucguaaugaagauuuuguuga

SEQ ID NO: 2040065 - RNA, 19 nt, Staphylococcus aureus subsp. aureus Mu50
cgucaucaaaacguuugaa

SEQ ID NO: 2040066 - RNA, 12 nt, Staphylococcus aureus subsp. aureus Mu50
cgucaaguuuuc

SEQ ID NO: 2040067 - RNA, 16 nt, Staphylococcus aureus subsp. aureus Mu50
cgucacauauaaauau

SEQ ID NO: 2040068 - RNA, 17 nt, Staphylococcus aureus subsp. aureus Mu50
cguauuagccaauaaaa

SEQ ID NO: 2040069 - RNA, 22 nt, Staphylococcus aureus subsp. aureus Mu50
cguauaauuuuaauauuauguu

SEQ ID NO: 2040070 - RNA, 22 nt, Staphylococcus aureus subsp. aureus Mu50
cguaagguauuucauugauaag

SEQ ID NO: 2040071 - RNA, 23 nt, Staphylococcus aureus subsp. aureus Mu50
cgguuaaauuauuuaauuuuucu

SEQ ID NO: 2040072 - RNA, 16 nt, Staphylococcus aureus subsp. aureus Mu50
cggugcuugccuuuuu

SEQ ID NO: 2040073 - RNA, 13 nt, Staphylococcus aureus subsp. aureus Mu50
cguuugauuucac

SEQ ID NO: 2040074 - RNA, 15 nt, Staphylococcus aureus subsp. aureus Mu50
cguuuucuaauuguu

SEQ ID NO: 2040075 - RNA, 15 nt, Staphylococcus aureus subsp. aureus Mu50
cguuuuauauuuauu

SEQ ID NO: 2040076 - RNA, 22 nt, Staphylococcus aureus subsp. aureus Mu50
cguuuuucgaacuuuuguucua

SEQ ID NO: 2040077 - RNA, 19 nt, Staphylococcus aureus subsp. aureus Mu50
cguuuugcuaaccaucaua

SEQ ID NO: 2040078 - RNA, 16 nt, Staphylococcus aureus subsp. aureus Mu50
cuaaacuuuucuucaa

SEQ ID NO: 2040079 - RNA, 23 nt, Staphylococcus aureus subsp. aureus Mu50
cuaaauaguagacgguaucaucu

SEQ ID NO: 2040080 - RNA, 17 nt, Staphylococcus aureus subsp. aureus Mu50
cuaaaguuauaaauuau

SEQ ID NO: 2040081 - RNA, 15 nt, Staphylococcus aureus subsp. aureus Mu50
cuaaagcuaaugcaa

SEQ ID NO: 2040082 - RNA, 21 nt, Staphylococcus aureus subsp. aureus Mu50
cuaaagcuugcuguucaacau

SEQ ID NO: 2040083 - RNA, 18 nt, Staphylococcus aureus subsp. aureus Mu50
cuaaagcuuuaucgaauu

SEQ ID NO: 2040084 - RNA, 22 nt, Staphylococcus aureus subsp. aureus Mu50
cuaaagggacaggcguaucugu

SEQ ID NO: 2040085 - RNA, 17 nt, Staphylococcus aureus subsp. aureus Mu50
cuaaacgcaauacgaau

SEQ ID NO: 2040086 - RNA, 21 nt, Staphylococcus aureus subsp. aureus Mu50
cuaaacgcaauacgaauaucu

SEQ ID NO: 2040087 - RNA, 13 nt, Staphylococcus aureus subsp. aureus Mu50
cuaaacauuuuau

SEQ ID NO: 2040088 - RNA, 14 nt, Staphylococcus aureus subsp. aureus Mu50
cuaaaaguuguaau

SEQ ID NO: 2040089 - RNA, 19 nt, Staphylococcus aureus subsp. aureus Mu50
cuaaaaugucuuugaaaaa

SEQ ID NO: 2040090 - RNA, 16 nt, Staphylococcus aureus subsp. aureus Mu50
cuaacagcuuaauuuu

SEQ ID NO: 2040091 - RNA, 13 nt, Staphylococcus aureus subsp. aureus Mu50
cuaaauuaaaagu

SEQ ID NO: 2040092 - RNA, 14 nt, Staphylococcus aureus subsp. aureus Mu50
cuaaauucaauaau

SEQ ID NO: 2040093 - RNA, 11 nt, Staphylococcus aureus subsp. aureus Mu50
cguuguugaaa

SEQ ID NO: 2040094 - RNA, 19 nt, Staphylococcus aureus subsp. aureus Mu50
cguuuaagaaaucaacaac

SEQ ID NO: 2040095 - RNA, 21 nt, Staphylococcus aureus subsp. aureus Mu50
cguuuaaucacaucuuuuuga

SEQ ID NO: 2040096 - RNA, 23 nt, Staphylococcus aureus subsp. aureus Mu50
cguuucaaugaguucuaguuuuu

SEQ ID NO: 2040097 - RNA, 19 nt, Staphylococcus aureus subsp. aureus Mu50
cuacuuugaagggagcauu

SEQ ID NO: 2040098 - RNA, 22 nt, Staphylococcus aureus subsp. aureus Mu50
cuacuuugaagggagcauuuca

SEQ ID NO: 2040099 - RNA, 15 nt, Staphylococcus aureus subsp. aureus Mu50
cuacuuuauaaauau

SEQ ID NO: 2040100 - RNA, 19 nt, Staphylococcus aureus subsp. aureus Mu50
cuacuucguuuacgauacg

SEQ ID NO: 2040101 - RNA, 16 nt, Staphylococcus aureus subsp. aureus Mu50
cuaggauuaaaagcau

SEQ ID NO: 2040102 - RNA, 17 nt, Staphylococcus aureus subsp. aureus Mu50
cuaggucacuuuuaugg

SEQ ID NO: 2040103 - RNA, 14 nt, Staphylococcus aureus subsp. aureus Mu50
cuaccgauuguuaa

SEQ ID NO: 2040104 - RNA, 22 nt, Staphylococcus aureus subsp. aureus Mu50
cuaaugaucaucuauauuuaau

SEQ ID NO: 2040105 - RNA, 15 nt, Staphylococcus aureus subsp. aureus Mu50
cuaaucguuaauaaa

SEQ ID NO: 2040106 - RNA, 15 nt, Staphylococcus aureus subsp. aureus Mu50
cuaaucuuaauuguc

SEQ ID NO: 2040107 - RNA, 22 nt, Staphylococcus aureus subsp. aureus Mu50
cuaaucuuuuuuuaauuaaguu

SEQ ID NO: 2040108 - RNA, 16 nt, Staphylococcus aureus subsp. aureus Mu50
cuaauacuuucacuuu

SEQ ID NO: 2040109 - RNA, 21 nt, Staphylococcus aureus subsp. aureus Mu50
cuaauggaugaauauauugag

SEQ ID NO: 2040110 - RNA, 16 nt, Staphylococcus aureus subsp. aureus Mu50
cuaauggcacuuaaua

SEQ ID NO: 2040111 - RNA, 15 nt, Staphylococcus aureus subsp. aureus Mu50
cuaauguuaaucaaa

SEQ ID NO: 2040112 - RNA, 20 nt, Staphylococcus aureus subsp. aureus Mu50
cuaauuaguugguaucgauu

SEQ ID NO: 2040113 - RNA, 20 nt, Staphylococcus aureus subsp. aureus Mu50
cuaauugaucagcauuuaag

SEQ ID NO: 2040114 - RNA, 12 nt, Staphylococcus aureus subsp. aureus Mu50
cuaauaauuguc

SEQ ID NO: 2040115 - RNA, 15 nt, Staphylococcus aureus subsp. aureus Mu50
cuaaguaauauaauu

SEQ ID NO: 2040116 - RNA, 20 nt, Staphylococcus aureus subsp. aureus Mu50
cuaagugauauacgacaauc

SEQ ID NO: 2040117 - RNA, 13 nt, Staphylococcus aureus subsp. aureus Mu50
cuaagugguugaa

SEQ ID NO: 2040118 - RNA, 18 nt, Staphylococcus aureus subsp. aureus Mu50
cuaagcugauuaaaaugu

SEQ ID NO: 2040119 - RNA, 16 nt, Staphylococcus aureus subsp. aureus Mu50
cuaagcuuucauuaau

SEQ ID NO: 2040120 - RNA, 18 nt, Staphylococcus aureus subsp. aureus Mu50
cuaagagguauacaguua

SEQ ID NO: 2040121 - RNA, 19 nt, Staphylococcus aureus subsp. aureus Mu50
cuaacuuuagggugcuuuu

SEQ ID NO: 2040122 - RNA, 23 nt, Staphylococcus aureus subsp. aureus Mu50
cuaccaauacguuuccaaucuau

SEQ ID NO: 2040123 - RNA, 17 nt, Staphylococcus aureus subsp. aureus Mu50
cuacauuauuacugauu

SEQ ID NO: 2040124 - RNA, 20 nt, Staphylococcus aureus subsp. aureus Mu50
cuacaguuuuaugaauauca

SEQ ID NO: 2040125 - RNA, 19 nt, Staphylococcus aureus subsp. aureus Mu50
cuacaaucauaccggcaaa

SEQ ID NO: 2040126 - RNA, 14 nt, Staphylococcus aureus subsp. aureus Mu50
cuacaauuauaugu

SEQ ID NO: 2040127 - RNA, 17 nt, Staphylococcus aureus subsp. aureus Mu50
cuacacuccccuuauca

SEQ ID NO: 2040128 - RNA, 14 nt, Staphylococcus aureus subsp. aureus Mu50
cuaauuuguuaguu

SEQ ID NO: 2040129 - RNA, 23 nt, Staphylococcus aureus subsp. aureus Mu50
cuaauuucuaauacauacugauu

SEQ ID NO: 2040130 - RNA, 14 nt, Staphylococcus aureus subsp. aureus Mu50
cuaauuuauuaauu

SEQ ID NO: 2040131 - RNA, 17 nt, Staphylococcus aureus subsp. aureus Mu50
cuacaacuguuggaaua

SEQ ID NO: 2040132 - RNA, 21 nt, Staphylococcus aureus subsp. aureus Mu50
cguguauuauugaaacuaaua

SEQ ID NO: 2040133 - RNA, 15 nt, Staphylococcus aureus subsp. aureus Mu50
cguguaaaaugcaau

SEQ ID NO: 2040134 - RNA, 19 nt, Staphylococcus aureus subsp. aureus Mu50
cguucauauaugauaaaua

SEQ ID NO: 2040135 - RNA, 15 nt, Staphylococcus aureus subsp. aureus Mu50
cguucucuuaaauau

SEQ ID NO: 2040136 - RNA, 18 nt, Staphylococcus aureus subsp. aureus Mu50
cucccuucaaaguuuuca

SEQ ID NO: 2040137 - RNA, 17 nt, Staphylococcus aureus subsp. aureus Mu50
cuaguaaugccauuaau

SEQ ID NO: 2040138 - RNA, 14 nt, Staphylococcus aureus subsp. aureus Mu50
cuagucauaauuua

SEQ ID NO: 2040139 - RNA, 19 nt, Staphylococcus aureus subsp. aureus Mu50
cucaucuauuuaauaaugu

SEQ ID NO: 2040140 - RNA, 14 nt, Staphylococcus aureus subsp. aureus Mu50
cucgcuaaauuuau

SEQ ID NO: 2040141 - RNA, 13 nt, Staphylococcus aureus subsp. aureus Mu50
cucguaaauuguu

SEQ ID NO: 2040142 - RNA, 23 nt, Staphylococcus aureus subsp. aureus Mu50
cucugaaggagacauuucccauu

SEQ ID NO: 2040143 - RNA, 12 nt, Staphylococcus aureus subsp. aureus Mu50
cucugauaaaug

SEQ ID NO: 2040144 - RNA, 21 nt, Staphylococcus aureus subsp. aureus Mu50
cucguuuuuucauuguaauaa

SEQ ID NO: 2040145 - RNA, 19 nt, Staphylococcus aureus subsp. aureus Mu50
cucuaaaacauguugauaa

SEQ ID NO: 2040146 - RNA, 20 nt, Staphylococcus aureus subsp. aureus Mu50
cucuaaacuucuauuaauaa

SEQ ID NO: 2040147 - RNA, 19 nt, Staphylococcus aureus subsp. aureus Mu50
cucuaaaggaaagccauua

SEQ ID NO: 2040148 - RNA, 18 nt, Staphylococcus aureus subsp. aureus Mu50
uuuuuauuuauacuaaau

SEQ ID NO: 2040149 - RNA, 14 nt, Staphylococcus aureus subsp. aureus Mu50
uuuuuauuauuaug

SEQ ID NO: 2040150 - RNA, 22 nt, Staphylococcus aureus subsp. aureus Mu50
uuuuuauauugcgaaaaauaau

SEQ ID NO: 2040151 - RNA, 20 nt, Staphylococcus aureus subsp. aureus Mu50
uuuuuaugcuuuaaaucgau

SEQ ID NO: 2040152 - RNA, 15 nt, Staphylococcus aureus subsp. aureus Mu50
uuuuucccaaucgau

SEQ ID NO: 2040153 - RNA, 19 nt, Staphylococcus aureus subsp. aureus Mu50
uuuuucaugauuuacuaau

SEQ ID NO: 2040154 - RNA, 20 nt, Staphylococcus aureus subsp. aureus Mu50
uuuuucauaauuaauaacau

SEQ ID NO: 2040155 - RNA, 19 nt, Staphylococcus aureus subsp. aureus Mu50
uuuuuaacuuuaacaucug

SEQ ID NO: 2040156 - RNA, 23 nt, Staphylococcus aureus subsp. aureus Mu50
uuuuuaauuuugacauaaaaaau

SEQ ID NO: 2040157 - RNA, 14 nt, Staphylococcus aureus subsp. aureus Mu50
uuuuuacguuuucu

SEQ ID NO: 2040158 - RNA, 15 nt, Staphylococcus aureus subsp. aureus Mu50
uuuuuacuaaaucau

SEQ ID NO: 2040159 - RNA, 23 nt, Staphylococcus aureus subsp. aureus Mu50
uuuuuacuaaaucauuuugccuc

SEQ ID NO: 2040160 - RNA, 16 nt, Staphylococcus aureus subsp. aureus Mu50
uuuuuacuauaauaau

SEQ ID NO: 2040161 - RNA, 19 nt, Staphylococcus aureus subsp. aureus Mu50
uuuuuagacauuaaaaaau

SEQ ID NO: 2040162 - RNA, 22 nt, Staphylococcus aureus subsp. aureus Mu50
uuuuuaacaaaauauacuaaau

SEQ ID NO: 2040163 - RNA, 21 nt, Staphylococcus aureus subsp. aureus Mu50
uuuuuaaaaaauuuaaauaau

SEQ ID NO: 2040164 - RNA, 13 nt, Staphylococcus aureus subsp. aureus Mu50
uuuuuaaaauaau

SEQ ID NO: 2040165 - RNA, 21 nt, Staphylococcus aureus subsp. aureus Mu50
uuuuuaaaaucucauaauaau

SEQ ID NO: 2040166 - RNA, 18 nt, Staphylococcus aureus subsp. aureus Mu50
uuuuuaaaguuuaaauau

SEQ ID NO: 2040167 - RNA, 16 nt, Staphylococcus aureus subsp. aureus Mu50
uuuuguccaauaaauu

SEQ ID NO: 2040168 - RNA, 16 nt, Staphylococcus aureus subsp. aureus Mu50
uuuuguuaauuuuuua

SEQ ID NO: 2040169 - RNA, 13 nt, Staphylococcus aureus subsp. aureus Mu50
uuuuguucaauca

SEQ ID NO: 2040170 - RNA, 16 nt, Staphylococcus aureus subsp. aureus Mu50
uuuuguucuaaguguu

SEQ ID NO: 2040171 - RNA, 12 nt, Staphylococcus aureus subsp. aureus Mu50
uuuuguugcuca

SEQ ID NO: 2040172 - RNA, 13 nt, Staphylococcus aureus subsp. aureus Mu50
uuuugucuuuuau

SEQ ID NO: 2040173 - RNA, 17 nt, Staphylococcus aureus subsp. aureus Mu50
uuuugugaauuuauuuu

SEQ ID NO: 2040174 - RNA, 17 nt, Staphylococcus aureus subsp. aureus Mu50
uuuucauagcuuuuuua

SEQ ID NO: 2040175 - RNA, 12 nt, Staphylococcus aureus subsp. aureus Mu50
uuuuaauauauu

SEQ ID NO: 2040176 - RNA, 18 nt, Staphylococcus aureus subsp. aureus Mu50
uuuucacuguuuuaucua

SEQ ID NO: 2040177 - RNA, 19 nt, Staphylococcus aureus subsp. aureus Mu50
uuuucagcaguugcacaaa

SEQ ID NO: 2040178 - RNA, 14 nt, Staphylococcus aureus subsp. aureus Mu50
uuuucaugauuuac

SEQ ID NO: 2040179 - RNA, 13 nt, Staphylococcus aureus subsp. aureus Mu50
uuuucauuauuaa

SEQ ID NO: 2040180 - RNA, 23 nt, Staphylococcus aureus subsp. aureus Mu50
uuuucauuuuuaucccacuccuu

SEQ ID NO: 2040181 - RNA, 12 nt, Staphylococcus aureus subsp. aureus Mu50
uuuucaucauaa

SEQ ID NO: 2040182 - RNA, 12 nt, Staphylococcus aureus subsp. aureus Mu50
uuuucaucauua

SEQ ID NO: 2040183 - RNA, 15 nt, Staphylococcus aureus subsp. aureus Mu50
uuuucaucaaucccu

SEQ ID NO: 2040184 - RNA, 18 nt, Staphylococcus aureus subsp. aureus Mu50
uuuuaaaguuuaaauauu

SEQ ID NO: 2040185 - RNA, 11 nt, Staphylococcus aureus subsp. aureus Mu50
uuuuaaauaaa

SEQ ID NO: 2040186 - RNA, 17 nt, Staphylococcus aureus subsp. aureus Mu50
uuuuaaauuacuauauu

SEQ ID NO: 2040187 - RNA, 17 nt, Staphylococcus aureus subsp. aureus Mu50
uuuuaacaaaauauacu

SEQ ID NO: 2040188 - RNA, 21 nt, Staphylococcus aureus subsp. aureus Mu50
uuuuaacccacauuaaauauu

SEQ ID NO: 2040189 - RNA, 22 nt, Staphylococcus aureus subsp. aureus Mu50
uuuuaacgucauuuuuaauaau

SEQ ID NO: 2040190 - RNA, 23 nt, Staphylococcus aureus subsp. aureus Mu50
uuuguuggggcccacaccccaac

SEQ ID NO: 2040191 - RNA, 20 nt, Staphylococcus aureus subsp. aureus Mu50
uuuguucaguuaaaucugua

SEQ ID NO: 2040192 - RNA, 20 nt, Staphylococcus aureus subsp. aureus Mu50
uuuguuguuuuaauuucacu

SEQ ID NO: 2040193 - RNA, 23 nt, Staphylococcus aureus subsp. aureus Mu50
uuuuaaaaaacaguguagcacaa

SEQ ID NO: 2040194 - RNA, 18 nt, Staphylococcus aureus subsp. aureus Mu50
uuuuaaaagauaaauaaa

SEQ ID NO: 2040195 - RNA, 20 nt, Staphylococcus aureus subsp. aureus Mu50
uuuuaaaauaaaucuuuuga

SEQ ID NO: 2040196 - RNA, 20 nt, Staphylococcus aureus subsp. aureus Mu50
uuuuaaaauaaugauauauu

SEQ ID NO: 2040197 - RNA, 14 nt, Staphylococcus aureus subsp. aureus Mu50
uuuuaaaauuauca

SEQ ID NO: 2040198 - RNA, 18 nt, Staphylococcus aureus subsp. aureus Mu50
uuuuaaaaaguaauuaau

SEQ ID NO: 2040199 - RNA, 21 nt, Staphylococcus aureus subsp. aureus Mu50
uuuuaaaauuaugauuauauu

SEQ ID NO: 2040200 - RNA, 15 nt, Staphylococcus aureus subsp. aureus Mu50
uuuucgguuuauuua

SEQ ID NO: 2040201 - RNA, 17 nt, Staphylococcus aureus subsp. aureus Mu50
uuuucuagguaauacga

SEQ ID NO: 2040202 - RNA, 16 nt, Staphylococcus aureus subsp. aureus Mu50
uuuucuaaauaaacga

SEQ ID NO: 2040203 - RNA, 21 nt, Staphylococcus aureus subsp. aureus Mu50
uuuucuaaaugauuuauucua

SEQ ID NO: 2040204 - RNA, 22 nt, Staphylococcus aureus subsp. aureus Mu50
uuuuccuuccaauaauaaauca

SEQ ID NO: 2040205 - RNA, 13 nt, Staphylococcus aureus subsp. aureus Mu50
uuuugcuuuauuu

SEQ ID NO: 2040206 - RNA, 21 nt, Staphylococcus aureus subsp. aureus Mu50
uuuugcuuuauuuucuugugu

SEQ ID NO: 2040207 - RNA, 19 nt, Staphylococcus aureus subsp. aureus Mu50
uuuugcuuuguuugcuucu

SEQ ID NO: 2040208 - RNA, 19 nt, Staphylococcus aureus subsp. aureus Mu50
uuuugcucuuuaaacucgu

SEQ ID NO: 2040209 - RNA, 16 nt, Staphylococcus aureus subsp. aureus Mu50
uuuugcuguuuaguua

SEQ ID NO: 2040210 - RNA, 20 nt, Staphylococcus aureus subsp. aureus Mu50
uuuuguaauuguaaucuauu

SEQ ID NO: 2040211 - RNA, 16 nt, Staphylococcus aureus subsp. aureus Mu50
uuuuggcgaaccauac

SEQ ID NO: 2040212 - RNA, 13 nt, Staphylococcus aureus subsp. aureus Mu50
uuuugguuguucu

SEQ ID NO: 2040213 - RNA, 15 nt, Staphylococcus aureus subsp. aureus Mu50
uuucucgauuaauuu

SEQ ID NO: 2040214 - RNA, 17 nt, Staphylococcus aureus subsp. aureus Mu50
uuucugcgauauagcuu

SEQ ID NO: 2040215 - RNA, 19 nt, Staphylococcus aureus subsp. aureus Mu50
uuucuccaguuuucaauuu

SEQ ID NO: 2040216 - RNA, 13 nt, Staphylococcus aureus subsp. aureus Mu50
uuucuuauaaaaa

SEQ ID NO: 2040217 - RNA, 18 nt, Staphylococcus aureus subsp. aureus Mu50
uuucugggcuuucuuuuu

SEQ ID NO: 2040218 - RNA, 12 nt, Staphylococcus aureus subsp. aureus Mu50
uuucuuaauuag

SEQ ID NO: 2040219 - RNA, 14 nt, Staphylococcus aureus subsp. aureus Mu50
uuucuauaaagaau

SEQ ID NO: 2040220 - RNA, 23 nt, Staphylococcus aureus subsp. aureus Mu50
uuucuauaauauuuaaccacuuu

SEQ ID NO: 2040221 - RNA, 15 nt, Staphylococcus aureus subsp. aureus Mu50
uuucuaucaaauaau

SEQ ID NO: 2040222 - RNA, 20 nt, Staphylococcus aureus subsp. aureus Mu50
uuucuaaguuugaaucauuu

SEQ ID NO: 2040223 - RNA, 20 nt, Staphylococcus aureus subsp. aureus Mu50
uuucuagcaacugaucauuu

SEQ ID NO: 2040224 - RNA, 14 nt, Staphylococcus aureus subsp. aureus Mu50
uuucuacccguuuu

SEQ ID NO: 2040225 - RNA, 17 nt, Staphylococcus aureus subsp. aureus Mu50
uuuccauuuaucaacaa

SEQ ID NO: 2040226 - RNA, 18 nt, Staphylococcus aureus subsp. aureus Mu50
uuuccauuuaucaacaau

SEQ ID NO: 2040227 - RNA, 16 nt, Staphylococcus aureus subsp. aureus Mu50
uuucguuuucaucaac

SEQ ID NO: 2040228 - RNA, 16 nt, Staphylococcus aureus subsp. aureus Mu50
uuugaauaugauauua

SEQ ID NO: 2040229 - RNA, 21 nt, Staphylococcus aureus subsp. aureus Mu50
uuugacaaguugcugaauaaa

SEQ ID NO: 2040230 - RNA, 18 nt, Staphylococcus aureus subsp. aureus Mu50
uuugaaucauuugaugcu

SEQ ID NO: 2040231 - RNA, 18 nt, Staphylococcus aureus subsp. aureus Mu50
uuugacauaucgauauuc

SEQ ID NO: 2040232 - RNA, 19 nt, Staphylococcus aureus subsp. aureus Mu50
uuugacauaucgauauucu

SEQ ID NO: 2040233 - RNA, 18 nt, Staphylococcus aureus subsp. aureus Mu50
uuugagauauauuaaugu

SEQ ID NO: 2040234 - RNA, 17 nt, Staphylococcus aureus subsp. aureus Mu50
uuugacucuuuucugca

SEQ ID NO: 2040235 - RNA, 14 nt, Staphylococcus aureus subsp. aureus Mu50
uuugaaaauuucac

SEQ ID NO: 2040236 - RNA, 16 nt, Staphylococcus aureus subsp. aureus Mu50
uuugaaacaucuaaau

SEQ ID NO: 2040237 - RNA, 12 nt, Staphylococcus aureus subsp. aureus Mu50
uuugaaaucaau

SEQ ID NO: 2040238 - RNA, 13 nt, Staphylococcus aureus subsp. aureus Mu50
uuugaaauuuauu

SEQ ID NO: 2040239 - RNA, 18 nt, Staphylococcus aureus subsp. aureus Mu50
uuucuuugauaacaauuu

SEQ ID NO: 2040240 - RNA, 18 nt, Staphylococcus aureus subsp. aureus Mu50
uuucuugaaguacuuuac

SEQ ID NO: 2040241 - RNA, 14 nt, Staphylococcus aureus subsp. aureus Mu50
uuucuuaucaguuu

SEQ ID NO: 2040242 - RNA, 19 nt, Staphylococcus aureus subsp. aureus Mu50
uuugcaaaacgcauuucau

SEQ ID NO: 2040243 - RNA, 13 nt, Staphylococcus aureus subsp. aureus Mu50
uuugauuaaauuc

SEQ ID NO: 2040244 - RNA, 13 nt, Staphylococcus aureus subsp. aureus Mu50
uuugauauuucau

SEQ ID NO: 2040245 - RNA, 14 nt, Staphylococcus aureus subsp. aureus Mu50
uuugaguauccaau

SEQ ID NO: 2040246 - RNA, 13 nt, Staphylococcus aureus subsp. aureus Mu50
uuugauaagugau

SEQ ID NO: 2040247 - RNA, 19 nt, Staphylococcus aureus subsp. aureus Mu50
uuugcucuaaacuucuauu

SEQ ID NO: 2040248 - RNA, 17 nt, Staphylococcus aureus subsp. aureus Mu50
uuugcuguccacuauau

SEQ ID NO: 2040249 - RNA, 15 nt, Staphylococcus aureus subsp. aureus Mu50
uuugcuuuuuauuuu

SEQ ID NO: 2040250 - RNA, 14 nt, Staphylococcus aureus subsp. aureus Mu50
uuuggaaauuuauu

SEQ ID NO: 2040251 - RNA, 15 nt, Staphylococcus aureus subsp. aureus Mu50
uuuggauuucuuuuu

SEQ ID NO: 2040252 - RNA, 16 nt, Staphylococcus aureus subsp. aureus Mu50
uuuggaugaacaaaau

SEQ ID NO: 2040253 - RNA, 12 nt, Staphylococcus aureus subsp. aureus Mu50
uucuuugucauc

SEQ ID NO: 2040254 - RNA, 16 nt, Staphylococcus aureus subsp. aureus Mu50
uucuuuucaaaauaau

SEQ ID NO: 2040255 - RNA, 21 nt, Staphylococcus aureus subsp. aureus Mu50
uucuuuaacaauugauugcuc

SEQ ID NO: 2040256 - RNA, 15 nt, Staphylococcus aureus subsp. aureus Mu50
uugaaauguuuauca

SEQ ID NO: 2040257 - RNA, 15 nt, Staphylococcus aureus subsp. aureus Mu50
uugaaacaagaaguu

SEQ ID NO: 2040258 - RNA, 19 nt, Staphylococcus aureus subsp. aureus Mu50
uugaaacaucuaaauaguu

SEQ ID NO: 2040259 - RNA, 18 nt, Staphylococcus aureus subsp. aureus Mu50
uucuuuuuuuguuaccaa

SEQ ID NO: 2040260 - RNA, 14 nt, Staphylococcus aureus subsp. aureus Mu50
uucuuuuuaucaug

SEQ ID NO: 2040261 - RNA, 16 nt, Staphylococcus aureus subsp. aureus Mu50
uucuuuuuauuuacuc

SEQ ID NO: 2040262 - RNA, 21 nt, Staphylococcus aureus subsp. aureus Mu50
uucuuuuucgaggucaucaaa

SEQ ID NO: 2040263 - RNA, 24 nt, Staphylococcus aureus subsp. aureus Mu50
uuguagccuccgccaccaaacaua

SEQ ID NO: 2040264 - RNA, 23 nt, Staphylococcus aureus subsp. aureus Mu50
uuguaaagcuuuaguuaaauagu

SEQ ID NO: 2040265 - RNA, 14 nt, Staphylococcus aureus subsp. aureus Mu50
uuguaaauuuuuaa

SEQ ID NO: 2040266 - RNA, 17 nt, Staphylococcus aureus subsp. aureus Mu50
uuguaacacacuuauaa

SEQ ID NO: 2040267 - RNA, 21 nt, Staphylococcus aureus subsp. aureus Mu50
uuguaacucaauaugaaaccu

SEQ ID NO: 2040268 - RNA, 16 nt, Staphylococcus aureus subsp. aureus Mu50
uuggcuuuuauuuaua

SEQ ID NO: 2040269 - RNA, 14 nt, Staphylococcus aureus subsp. aureus Mu50
uuucaauuuggaaa

SEQ ID NO: 2040270 - RNA, 17 nt, Staphylococcus aureus subsp. aureus Mu50
uuucaauguaucaagau

SEQ ID NO: 2040271 - RNA, 17 nt, Staphylococcus aureus subsp. aureus Mu50
uuuaugcgauucucauu

SEQ ID NO: 2040272 - RNA, 14 nt, Staphylococcus aureus subsp. aureus Mu50
uuuaugauuugauu

SEQ ID NO: 2040273 - RNA, 17 nt, Staphylococcus aureus subsp. aureus Mu50
uuuauggauuucuuauu

SEQ ID NO: 2040274 - RNA, 14 nt, Staphylococcus aureus subsp. aureus Mu50
uuuauguauuuauu

SEQ ID NO: 2040275 - RNA, 20 nt, Staphylococcus aureus subsp. aureus Mu50
uuuauuaaagaaacaugauu

SEQ ID NO: 2040276 - RNA, 21 nt, Staphylococcus aureus subsp. aureus Mu50
uuucacguagcuuuucauuua

SEQ ID NO: 2040277 - RNA, 14 nt, Staphylococcus aureus subsp. aureus Mu50
uuucaccuuguaaa

SEQ ID NO: 2040278 - RNA, 16 nt, Staphylococcus aureus subsp. aureus Mu50
uuucacgauuucuuua

SEQ ID NO: 2040279 - RNA, 21 nt, Staphylococcus aureus subsp. aureus Mu50
uuuagaagaaacuuaaucaag

SEQ ID NO: 2040280 - RNA, 17 nt, Staphylococcus aureus subsp. aureus Mu50
uuuacuuuuccuugauu

SEQ ID NO: 2040281 - RNA, 17 nt, Staphylococcus aureus subsp. aureus Mu50
uuuagacaucauuguuu

SEQ ID NO: 2040282 - RNA, 20 nt, Staphylococcus aureus subsp. aureus Mu50
uuuagcaccggcaucuugaa

SEQ ID NO: 2040283 - RNA, 15 nt, Staphylococcus aureus subsp. aureus Mu50
uuuauccaaaccaau

SEQ ID NO: 2040284 - RNA, 19 nt, Staphylococcus aureus subsp. aureus Mu50
uuuaucuccuaaagguaac

SEQ ID NO: 2040285 - RNA, 22 nt, Staphylococcus aureus subsp. aureus Mu50
uuuaucuaaagguaccacugua

SEQ ID NO: 2040286 - RNA, 18 nt, Staphylococcus aureus subsp. aureus Mu50
uuguucucucaaugcauu

SEQ ID NO: 2040287 - RNA, 18 nt, Staphylococcus aureus subsp. aureus Mu50
uuguuggaucuuucaaag

SEQ ID NO: 2040288 - RNA, 14 nt, Staphylococcus aureus subsp. aureus Mu50
uuuaauauaaauuu

SEQ ID NO: 2040289 - RNA, 15 nt, Staphylococcus aureus subsp. aureus Mu50
uuuaauauauuuauu

SEQ ID NO: 2040290 - RNA, 18 nt, Staphylococcus aureus subsp. aureus Mu50
uuuaauauuguuaauuca

SEQ ID NO: 2040291 - RNA, 23 nt, Staphylococcus aureus subsp. aureus Mu50
uuguuggggcccacaccccaacu

SEQ ID NO: 2040292 - RNA, 16 nt, Staphylococcus aureus subsp. aureus Mu50
uuguuuauuacauaau

SEQ ID NO: 2040293 - RNA, 16 nt, Staphylococcus aureus subsp. aureus Mu50
uuguuaauucaacgga

SEQ ID NO: 2040294 - RNA, 22 nt, Staphylococcus aureus subsp. aureus Mu50
uuguuaaaaaauggauuugguc

SEQ ID NO: 2040295 - RNA, 16 nt, Staphylococcus aureus subsp. aureus Mu50
uuguuaauuuaauaau

SEQ ID NO: 2040296 - RNA, 23 nt, Staphylococcus aureus subsp. aureus Mu50
uuguuaccaaacaauacauaaug

SEQ ID NO: 2040297 - RNA, 14 nt, Staphylococcus aureus subsp. aureus Mu50
uuguuauccaaaac

SEQ ID NO: 2040298 - RNA, 13 nt, Staphylococcus aureus subsp. aureus Mu50
uuguuaaaauaau

SEQ ID NO: 2040299 - RNA, 20 nt, Staphylococcus aureus subsp. aureus Mu50
uuuacauggcuuagguuuaa

SEQ ID NO: 2040300 - RNA, 16 nt, Staphylococcus aureus subsp. aureus Mu50
uuuaauuuuucauuaa

SEQ ID NO: 2040301 - RNA, 23 nt, Staphylococcus aureus subsp. aureus Mu50
uuuaauugaaugaaaaaguugau

SEQ ID NO: 2040302 - RNA, 21 nt, Staphylococcus aureus subsp. aureus Mu50
uuuaauuauuucccuggaaaa

SEQ ID NO: 2040303 - RNA, 18 nt, Staphylococcus aureus subsp. aureus Mu50
uuuaaucgcauuguuaaa

SEQ ID NO: 2040304 - RNA, 21 nt, Staphylococcus aureus subsp. aureus Mu50
uuuaauccuucuccaaaaaua

SEQ ID NO: 2040305 - RNA, 22 nt, Staphylococcus aureus subsp. aureus Mu50
uuuaaugagcuuuucuaaugcu

SEQ ID NO: 2040306 - RNA, 18 nt, Staphylococcus aureus subsp. aureus Mu50
uuuaaugccggucauaac

SEQ ID NO: 2040307 - RNA, 17 nt, Staphylococcus aureus subsp. aureus Mu50
uuuaaugcgaaaaaacc

SEQ ID NO: 2040308 - RNA, 19 nt, Staphylococcus aureus subsp. aureus Mu50
uuuaauguauaaauuaguu

SEQ ID NO: 2040309 - RNA, 13 nt, Staphylococcus aureus subsp. aureus Mu50
uuuacuaaagaua

SEQ ID NO: 2040310 - RNA, 20 nt, Staphylococcus aureus subsp. aureus Mu50
uuuacauuuucaaaaccaau

SEQ ID NO: 2040311 - RNA, 17 nt, Staphylococcus aureus subsp. aureus Mu50
uuuaccacuuauaacau

SEQ ID NO: 2040312 - RNA, 23 nt, Staphylococcus aureus subsp. aureus Mu50
uucgaaauucucuuuguuggggc

SEQ ID NO: 2040313 - RNA, 19 nt, Staphylococcus aureus subsp. aureus Mu50
uucgaaaagaaauucuaca

SEQ ID NO: 2040314 - RNA, 22 nt, Staphylococcus aureus subsp. aureus Mu50
uucgaaaagaaauucuacaaac

SEQ ID NO: 2040315 - RNA, 21 nt, Staphylococcus aureus subsp. aureus Mu50
uucgaguaugguugauuacaa

SEQ ID NO: 2040316 - RNA, 17 nt, Staphylococcus aureus subsp. aureus Mu50
uucgaggucaucaaaag

SEQ ID NO: 2040317 - RNA, 13 nt, Staphylococcus aureus subsp. aureus Mu50
uuccuuucuuuuu

SEQ ID NO: 2040318 - RNA, 19 nt, Staphylococcus aureus subsp. aureus Mu50
uuccccauuaauuaacaaa

SEQ ID NO: 2040319 - RNA, 13 nt, Staphylococcus aureus subsp. aureus Mu50
uucggacgauuga

SEQ ID NO: 2040320 - RNA, 18 nt, Staphylococcus aureus subsp. aureus Mu50
uucgcuucaucaguugug

SEQ ID NO: 2040321 - RNA, 21 nt, Staphylococcus aureus subsp. aureus Mu50
uucgccucaucuaauuuauga

SEQ ID NO: 2040322 - RNA, 19 nt, Staphylococcus aureus subsp. aureus Mu50
uucguuuuaauaaauuguu

SEQ ID NO: 2040323 - RNA, 13 nt, Staphylococcus aureus subsp. aureus Mu50
uucguuucuuuua

SEQ ID NO: 2040324 - RNA, 13 nt, Staphylococcus aureus subsp. aureus Mu50
uucuaaaaguuga

SEQ ID NO: 2040325 - RNA, 22 nt, Staphylococcus aureus subsp. aureus Mu50
uucuaaauaaacgauugauuau

SEQ ID NO: 2040326 - RNA, 20 nt, Staphylococcus aureus subsp. aureus Mu50
uucuaacaccugauugacaa

SEQ ID NO: 2040327 - RNA, 13 nt, Staphylococcus aureus subsp. aureus Mu50
uucuaauacaaac

SEQ ID NO: 2040328 - RNA, 15 nt, Staphylococcus aureus subsp. aureus Mu50
uucuaauuaagaaug

SEQ ID NO: 2040329 - RNA, 17 nt, Staphylococcus aureus subsp. aureus Mu50
uucuaacgguaaauaac

SEQ ID NO: 2040330 - RNA, 21 nt, Staphylococcus aureus subsp. aureus Mu50
uucuacucuagcggaacguaa

SEQ ID NO: 2040331 - RNA, 16 nt, Staphylococcus aureus subsp. aureus Mu50
uucuagauucauauuu

SEQ ID NO: 2040332 - RNA, 18 nt, Staphylococcus aureus subsp. aureus Mu50
uucuagcaucgauguuau

SEQ ID NO: 2040333 - RNA, 16 nt, Staphylococcus aureus subsp. aureus Mu50
uucuaguagcuugaau

SEQ ID NO: 2040334 - RNA, 15 nt, Staphylococcus aureus subsp. aureus Mu50
uucguacuuccaaua

SEQ ID NO: 2040335 - RNA, 20 nt, Staphylococcus aureus subsp. aureus Mu50
uucguaauaaacauguguau

SEQ ID NO: 2040336 - RNA, 16 nt, Staphylococcus aureus subsp. aureus Mu50
uucgucaaauucaacg

SEQ ID NO: 2040337 - RNA, 20 nt, Staphylococcus aureus subsp. aureus Mu50
uucugucccacucccuaaua

SEQ ID NO: 2040338 - RNA, 17 nt, Staphylococcus aureus subsp. aureus Mu50
uucuguccaaaaagguu

SEQ ID NO: 2040339 - RNA, 20 nt, Staphylococcus aureus subsp. aureus Mu50
uucuguacguuuuaaauaaa

SEQ ID NO: 2040340 - RNA, 16 nt, Staphylococcus aureus subsp. aureus Mu50
uucugcuuuuucuuua

SEQ ID NO: 2040341 - RNA, 20 nt, Staphylococcus aureus subsp. aureus Mu50
uucugcuuuuucuuuaucua

SEQ ID NO: 2040342 - RNA, 16 nt, Staphylococcus aureus subsp. aureus Mu50
uucuggaauugggaaa

SEQ ID NO: 2040343 - RNA, 23 nt, Staphylococcus aureus subsp. aureus Mu50
uucuucaccaguuucugguaaug

SEQ ID NO: 2040344 - RNA, 14 nt, Staphylococcus aureus subsp. aureus Mu50
uucuugagcuguua

SEQ ID NO: 2040345 - RNA, 17 nt, Staphylococcus aureus subsp. aureus Mu50
uucuugccaucaauuuc

SEQ ID NO: 2040346 - RNA, 17 nt, Staphylococcus aureus subsp. aureus Mu50
uucuucuuuuuuaucua

SEQ ID NO: 2040347 - RNA, 14 nt, Staphylococcus aureus subsp. aureus Mu50
uucuuaacauaaaa

SEQ ID NO: 2040348 - RNA, 17 nt, Staphylococcus aureus subsp. aureus Mu50
uucuuaucaacaacaag

SEQ ID NO: 2040349 - RNA, 20 nt, Staphylococcus aureus subsp. aureus Mu50
uucuucaauaacaccuuuca

SEQ ID NO: 2040350 - RNA, 18 nt, Staphylococcus aureus subsp. aureus Mu50
uucuuauuuauucauaac

SEQ ID NO: 2040351 - RNA, 16 nt, Staphylococcus aureus subsp. aureus Mu50
uucuucagguguuuua

SEQ ID NO: 2040352 - RNA, 16 nt, Staphylococcus aureus subsp. aureus Mu50
uucuucaccaacuuuu

SEQ ID NO: 2040353 - RNA, 17 nt, Staphylococcus aureus subsp. aureus Mu50
uucucaccagcucguuu

SEQ ID NO: 2040354 - RNA, 17 nt, Staphylococcus aureus subsp. aureus Mu50
uucuccaacgucauaac

SEQ ID NO: 2040355 - RNA, 22 nt, Staphylococcus aureus subsp. aureus Mu50
uucuauguagcaggcaacuuuu

SEQ ID NO: 2040356 - RNA, 15 nt, Staphylococcus aureus subsp. aureus Mu50
uucuaucuauaaacg

SEQ ID NO: 2040357 - RNA, 20 nt, Staphylococcus aureus subsp. aureus Mu50
uucuauaaagaaugauuuau

SEQ ID NO: 2040358 - RNA, 16 nt, Staphylococcus aureus subsp. aureus Mu50
uucuauaauaaaucga

SEQ ID NO: 2040359 - RNA, 18 nt, Staphylococcus aureus subsp. aureus Mu50
uucuauaauauuuaacca

SEQ ID NO: 2040360 - RNA, 20 nt, Staphylococcus aureus subsp. aureus Mu50
uucuauagcaccauuauuaa

SEQ ID NO: 2040361 - RNA, 18 nt, Staphylococcus aureus subsp. aureus Mu50
uucuauauaauuuauuua

SEQ ID NO: 2040362 - RNA, 23 nt, Staphylococcus aureus subsp. aureus Mu50
uucuauaucuauuuaucauacuu

SEQ ID NO: 2040363 - RNA, 22 nt, Staphylococcus aureus subsp. aureus Mu50
uucucgccaacccgcuuuauga

SEQ ID NO: 2040364 - RNA, 15 nt, Staphylococcus aureus subsp. aureus Mu50
uucuccguuaauuua

SEQ ID NO: 2040365 - RNA, 12 nt, Staphylococcus aureus subsp. aureus Mu50
uucugacuuuua

SEQ ID NO: 2040366 - RNA, 21 nt, Staphylococcus aureus subsp. aureus Mu50
uucucugcuucuaaaacauca

SEQ ID NO: 2040367 - RNA, 17 nt, Staphylococcus aureus subsp. aureus Mu50
uucucuaacuuuaccaa

SEQ ID NO: 2040368 - RNA, 16 nt, Staphylococcus aureus subsp. aureus Mu50
uuaauuauuauauaau

SEQ ID NO: 2040369 - RNA, 11 nt, Staphylococcus aureus subsp. aureus Mu50
uuaauuauuuc

SEQ ID NO: 2040370 - RNA, 14 nt, Staphylococcus aureus subsp. aureus Mu50
uuaauuacgucaua

SEQ ID NO: 2040371 - RNA, 19 nt, Staphylococcus aureus subsp. aureus Mu50
uuaauguguaaauuuugua

SEQ ID NO: 2040372 - RNA, 21 nt, Staphylococcus aureus subsp. aureus Mu50
uuaauuaauaauuuaacuaau

SEQ ID NO: 2040373 - RNA, 17 nt, Staphylococcus aureus subsp. aureus Mu50
uuaauuucugguaaaaa

SEQ ID NO: 2040374 - RNA, 15 nt, Staphylococcus aureus subsp. aureus Mu50
uuaauuucaacauua

SEQ ID NO: 2040375 - RNA, 15 nt, Staphylococcus aureus subsp. aureus Mu50
uuaauuguuaaauca

SEQ ID NO: 2040376 - RNA, 13 nt, Staphylococcus aureus subsp. aureus Mu50
uuaauuuaauaau

SEQ ID NO: 2040377 - RNA, 17 nt, Staphylococcus aureus subsp. aureus Mu50
uuaauuuaguuauaauu

SEQ ID NO: 2040378 - RNA, 13 nt, Staphylococcus aureus subsp. aureus Mu50
uuaauuuaucguu

SEQ ID NO: 2040379 - RNA, 20 nt, Staphylococcus aureus subsp. aureus Mu50
uuaccuuuaccaguaucauu

SEQ ID NO: 2040380 - RNA, 13 nt, Staphylococcus aureus subsp. aureus Mu50
uuaccuuucaaau

SEQ ID NO: 2040381 - RNA, 15 nt, Staphylococcus aureus subsp. aureus Mu50
uuaccuuuuaaaccu

SEQ ID NO: 2040382 - RNA, 17 nt, Staphylococcus aureus subsp. aureus Mu50
uuaauugcuguaaauau

SEQ ID NO: 2040383 - RNA, 21 nt, Staphylococcus aureus subsp. aureus Mu50
uuacgaaaguagaauuauuua

SEQ ID NO: 2040384 - RNA, 13 nt, Staphylococcus aureus subsp. aureus Mu50
uuaauuuuauguc

SEQ ID NO: 2040385 - RNA, 14 nt, Staphylococcus aureus subsp. aureus Mu50
uuaauuuuaaauau

SEQ ID NO: 2040386 - RNA, 16 nt, Staphylococcus aureus subsp. aureus Mu50
uuaauuuucuaaauau

SEQ ID NO: 2040387 - RNA, 20 nt, Staphylococcus aureus subsp. aureus Mu50
uuaauuuugacauaaaaaau

SEQ ID NO: 2040388 - RNA, 17 nt, Staphylococcus aureus subsp. aureus Mu50
uuaauuuugcaacauua

SEQ ID NO: 2040389 - RNA, 18 nt, Staphylococcus aureus subsp. aureus Mu50
uuacuaguuuguaauaau

SEQ ID NO: 2040390 - RNA, 16 nt, Staphylococcus aureus subsp. aureus Mu50
uuacuacuuaauuaau

SEQ ID NO: 2040391 - RNA, 22 nt, Staphylococcus aureus subsp. aureus Mu50
uuacuacaaacuugauuaugua

SEQ ID NO: 2040392 - RNA, 12 nt, Staphylococcus aureus subsp. aureus Mu50
uuacuaaaauca

SEQ ID NO: 2040393 - RNA, 14 nt, Staphylococcus aureus subsp. aureus Mu50
uuacuaaaugaauu

SEQ ID NO: 2040394 - RNA, 17 nt, Staphylococcus aureus subsp. aureus Mu50
uuacuaaaugaauugcu

SEQ ID NO: 2040395 - RNA, 15 nt, Staphylococcus aureus subsp. aureus Mu50
uuacgaaguuuaaau

SEQ ID NO: 2040396 - RNA, 21 nt, Staphylococcus aureus subsp. aureus Mu50
uuacgcuguguacguuucaau

SEQ ID NO: 2040397 - RNA, 19 nt, Staphylococcus aureus subsp. aureus Mu50
uuauaacauuuaagaaacg

SEQ ID NO: 2040398 - RNA, 14 nt, Staphylococcus aureus subsp. aureus Mu50
uuauccaaaccaau

SEQ ID NO: 2040399 - RNA, 18 nt, Staphylococcus aureus subsp. aureus Mu50
uuauccauucuuuguugu

SEQ ID NO: 2040400 - RNA, 17 nt, Staphylococcus aureus subsp. aureus Mu50
uuauacagugaaucuaa

SEQ ID NO: 2040401 - RNA, 14 nt, Staphylococcus aureus subsp. aureus Mu50
uuauacauaaauau

SEQ ID NO: 2040402 - RNA, 23 nt, Staphylococcus aureus subsp. aureus Mu50
uuauacuuaauauaguuaaugua

SEQ ID NO: 2040403 - RNA, 21 nt, Staphylococcus aureus subsp. aureus Mu50
uuauagauucauguaaauagu

SEQ ID NO: 2040404 - RNA, 23 nt, Staphylococcus aureus subsp. aureus Mu50
uuauagcaaauugauuaaauaaa

SEQ ID NO: 2040405 - RNA, 14 nt, Staphylococcus aureus subsp. aureus Mu50
uuaucauuaaauug

SEQ ID NO: 2040406 - RNA, 17 nt, Staphylococcus aureus subsp. aureus Mu50
uuaucauuauuugauaa

SEQ ID NO: 2040407 - RNA, 19 nt, Staphylococcus aureus subsp. aureus Mu50
uuaguucguguuugaaugu

SEQ ID NO: 2040408 - RNA, 15 nt, Staphylococcus aureus subsp. aureus Mu50
uuaguuaauuauuua

SEQ ID NO: 2040409 - RNA, 20 nt, Staphylococcus aureus subsp. aureus Mu50
uuauaaaaugaauaauugcu

SEQ ID NO: 2040410 - RNA, 17 nt, Staphylococcus aureus subsp. aureus Mu50
uuaguuuucuuaaaaga

SEQ ID NO: 2040411 - RNA, 17 nt, Staphylococcus aureus subsp. aureus Mu50
uuauaaaugaaucgcuu

SEQ ID NO: 2040412 - RNA, 13 nt, Staphylococcus aureus subsp. aureus Mu50
uuauaagccuuuu

SEQ ID NO: 2040413 - RNA, 15 nt, Staphylococcus aureus subsp. aureus Mu50
uuauaaguaaauaau

SEQ ID NO: 2040414 - RNA, 17 nt, Staphylococcus aureus subsp. aureus Mu50
uuauaauggcaguaguu

SEQ ID NO: 2040415 - RNA, 16 nt, Staphylococcus aureus subsp. aureus Mu50
uuauaaucuuuuaguc

SEQ ID NO: 2040416 - RNA, 16 nt, Staphylococcus aureus subsp. aureus Mu50
uuacugaaacuaaauu

SEQ ID NO: 2040417 - RNA, 23 nt, Staphylococcus aureus subsp. aureus Mu50
uuagccacagcuaauguguacuu

SEQ ID NO: 2040418 - RNA, 13 nt, Staphylococcus aureus subsp. aureus Mu50
uuagcauuauuug

SEQ ID NO: 2040419 - RNA, 21 nt, Staphylococcus aureus subsp. aureus Mu50
uuagcauaccuuuauuauuua

SEQ ID NO: 2040420 - RNA, 22 nt, Staphylococcus aureus subsp. aureus Mu50
uuagcauauucgcuuaaaaacg

SEQ ID NO: 2040421 - RNA, 20 nt, Staphylococcus aureus subsp. aureus Mu50
uuagcaaaaauauuuaaacu

SEQ ID NO: 2040422 - RNA, 13 nt, Staphylococcus aureus subsp. aureus Mu50
uuagaugauauuu

SEQ ID NO: 2040423 - RNA, 14 nt, Staphylococcus aureus subsp. aureus Mu50
uuagaugcauaaaa

SEQ ID NO: 2040424 - RNA, 19 nt, Staphylococcus aureus subsp. aureus Mu50
uuagcagcgauacguuuau

SEQ ID NO: 2040425 - RNA, 18 nt, Staphylococcus aureus subsp. aureus Mu50
uuagauagcggauuuauu

SEQ ID NO: 2040426 - RNA, 14 nt, Staphylococcus aureus subsp. aureus Mu50
uuagcgcaagagau

SEQ ID NO: 2040427 - RNA, 14 nt, Staphylococcus aureus subsp. aureus Mu50
uuagcgcaccaauu

SEQ ID NO: 2040428 - RNA, 15 nt, Staphylococcus aureus subsp. aureus Mu50
uuaaaaacagcagua

SEQ ID NO: 2040429 - RNA, 20 nt, Staphylococcus aureus subsp. aureus Mu50
uguuuagcgcaauuugguga

SEQ ID NO: 2040430 - RNA, 22 nt, Staphylococcus aureus subsp. aureus Mu50
uuaaaaagguacuaauguuaau

SEQ ID NO: 2040431 - RNA, 22 nt, Staphylococcus aureus subsp. aureus Mu50
uuaaaaauauguguuaacugau

SEQ ID NO: 2040432 - RNA, 16 nt, Staphylococcus aureus subsp. aureus Mu50
uguuuugaauguuucu

SEQ ID NO: 2040433 - RNA, 15 nt, Staphylococcus aureus subsp. aureus Mu50
uguuuuuacaaaugu

SEQ ID NO: 2040434 - RNA, 15 nt, Staphylococcus aureus subsp. aureus Mu50
uguuuauaucuuugu

SEQ ID NO: 2040435 - RNA, 23 nt, Staphylococcus aureus subsp. aureus Mu50
uguuuaucaugaugauaaauuga

SEQ ID NO: 2040436 - RNA, 17 nt, Staphylococcus aureus subsp. aureus Mu50
uguuuaaauuuaaaaga

SEQ ID NO: 2040437 - RNA, 17 nt, Staphylococcus aureus subsp. aureus Mu50
uguuguacauguauugg

SEQ ID NO: 2040438 - RNA, 22 nt, Staphylococcus aureus subsp. aureus Mu50
uguugguguuuagucuuuuuua

SEQ ID NO: 2040439 - RNA, 22 nt, Staphylococcus aureus subsp. aureus Mu50
uguuguaaaccagcuaaaccau

SEQ ID NO: 2040440 - RNA, 20 nt, Staphylococcus aureus subsp. aureus Mu50
uguugucaucauguuuaucu

SEQ ID NO: 2040441 - RNA, 19 nt, Staphylococcus aureus subsp. aureus Mu50
uguuuaauuaaaauacaaa

SEQ ID NO: 2040442 - RNA, 11 nt, Staphylococcus aureus subsp. aureus Mu50
uguuuaauuug

SEQ ID NO: 2040443 - RNA, 21 nt, Staphylococcus aureus subsp. aureus Mu50
uguuuaauuugauuaaauuca

SEQ ID NO: 2040444 - RNA, 16 nt, Staphylococcus aureus subsp. aureus Mu50
uguuguuuuaauuguu

SEQ ID NO: 2040445 - RNA, 12 nt, Staphylococcus aureus subsp. aureus Mu50
uguuuaaauaaa

SEQ ID NO: 2040446 - RNA, 13 nt, Staphylococcus aureus subsp. aureus Mu50
ugugcuuguaaca

SEQ ID NO: 2040447 - RNA, 22 nt, Staphylococcus aureus subsp. aureus Mu50
ugugcgguaaccauuuuuuuau

SEQ ID NO: 2040448 - RNA, 12 nt, Staphylococcus aureus subsp. aureus Mu50
uuaaaucuacaa

SEQ ID NO: 2040449 - RNA, 14 nt, Staphylococcus aureus subsp. aureus Mu50
uuaaaucaacauca

SEQ ID NO: 2040450 - RNA, 15 nt, Staphylococcus aureus subsp. aureus Mu50
uuaaauacaauuucu

SEQ ID NO: 2040451 - RNA, 23 nt, Staphylococcus aureus subsp. aureus Mu50
uuaaauaggugauuauauauauu

SEQ ID NO: 2040452 - RNA, 18 nt, Staphylococcus aureus subsp. aureus Mu50
uuaaagaacuaacauaau

SEQ ID NO: 2040453 - RNA, 15 nt, Staphylococcus aureus subsp. aureus Mu50
uuaaagguuaaauau

SEQ ID NO: 2040454 - RNA, 17 nt, Staphylococcus aureus subsp. aureus Mu50
uuaaauaauaauucaua

SEQ ID NO: 2040455 - RNA, 14 nt, Staphylococcus aureus subsp. aureus Mu50
uuaaauaaugauaa

SEQ ID NO: 2040456 - RNA, 15 nt, Staphylococcus aureus subsp. aureus Mu50
uuaaaauuuaaauau

SEQ ID NO: 2040457 - RNA, 12 nt, Staphylococcus aureus subsp. aureus Mu50
uuaaacaaauaa

SEQ ID NO: 2040458 - RNA, 16 nt, Staphylococcus aureus subsp. aureus Mu50
uuaaaauuaugauuau

SEQ ID NO: 2040459 - RNA, 19 nt, Staphylococcus aureus subsp. aureus Mu50
uuaaaauucaguaucuaaa

SEQ ID NO: 2040460 - RNA, 17 nt, Staphylococcus aureus subsp. aureus Mu50
uuaaaacuuucagagau

SEQ ID NO: 2040461 - RNA, 16 nt, Staphylococcus aureus subsp. aureus Mu50
uuaaaagauaaauaaa

SEQ ID NO: 2040462 - RNA, 17 nt, Staphylococcus aureus subsp. aureus Mu50
uuaaaaauuucaauaau

SEQ ID NO: 2040463 - RNA, 14 nt, Staphylococcus aureus subsp. aureus Mu50
uuaaaaguaacaua

SEQ ID NO: 2040464 - RNA, 20 nt, Staphylococcus aureus subsp. aureus Mu50
uuaaaagugguuuuacugcu

SEQ ID NO: 2040465 - RNA, 18 nt, Staphylococcus aureus subsp. aureus Mu50
uuaaacuuauuaauuaau

SEQ ID NO: 2040466 - RNA, 18 nt, Staphylococcus aureus subsp. aureus Mu50
uuaaacucucuaaaaagc

SEQ ID NO: 2040467 - RNA, 15 nt, Staphylococcus aureus subsp. aureus Mu50
uuaaaccuuaauaau

SEQ ID NO: 2040468 - RNA, 20 nt, Staphylococcus aureus subsp. aureus Mu50
uuaaacucaaaaagccaaca

SEQ ID NO: 2040469 - RNA, 18 nt, Staphylococcus aureus subsp. aureus Mu50
uuaaacccucauuuuuau

SEQ ID NO: 2040470 - RNA, 23 nt, Staphylococcus aureus subsp. aureus Mu50
uuaaacccucauuuuuauaaauu

SEQ ID NO: 2040471 - RNA, 16 nt, Staphylococcus aureus subsp. aureus Mu50
uuaauaagcugaaaua

SEQ ID NO: 2040472 - RNA, 16 nt, Staphylococcus aureus subsp. aureus Mu50
uuaauacgauaauaac

SEQ ID NO: 2040473 - RNA, 22 nt, Staphylococcus aureus subsp. aureus Mu50
uuaauagagaaagaauaaaugu

SEQ ID NO: 2040474 - RNA, 16 nt, Staphylococcus aureus subsp. aureus Mu50
uuaauaguguuauauu

SEQ ID NO: 2040475 - RNA, 18 nt, Staphylococcus aureus subsp. aureus Mu50
uuaauauuugauaacaaa

SEQ ID NO: 2040476 - RNA, 15 nt, Staphylococcus aureus subsp. aureus Mu50
uuaauauccaaaauc

SEQ ID NO: 2040477 - RNA, 14 nt, Staphylococcus aureus subsp. aureus Mu50
uuaauaugaacaaa

SEQ ID NO: 2040478 - RNA, 17 nt, Staphylococcus aureus subsp. aureus Mu50
uuaauguuucuucaauu

SEQ ID NO: 2040479 - RNA, 13 nt, Staphylococcus aureus subsp. aureus Mu50
uuaauuaaaaaau

SEQ ID NO: 2040480 - RNA, 21 nt, Staphylococcus aureus subsp. aureus Mu50
uuaauauuuagauacugaauu

SEQ ID NO: 2040481 - RNA, 12 nt, Staphylococcus aureus subsp. aureus Mu50
uuaaucaauuua

SEQ ID NO: 2040482 - RNA, 20 nt, Staphylococcus aureus subsp. aureus Mu50
uuaaaugauuucacuucaua

SEQ ID NO: 2040483 - RNA, 15 nt, Staphylococcus aureus subsp. aureus Mu50
uuaaguacaacaguu

SEQ ID NO: 2040484 - RNA, 18 nt, Staphylococcus aureus subsp. aureus Mu50
uuaaguaguuguuauauu

SEQ ID NO: 2040485 - RNA, 13 nt, Staphylococcus aureus subsp. aureus Mu50
uuaaaucaaguau

SEQ ID NO: 2040486 - RNA, 20 nt, Staphylococcus aureus subsp. aureus Mu50
uuaaaucaccaacaacuuug

SEQ ID NO: 2040487 - RNA, 21 nt, Staphylococcus aureus subsp. aureus Mu50
uuaaguuugucuuugaacaua

SEQ ID NO: 2040488 - RNA, 14 nt, Staphylococcus aureus subsp. aureus Mu50
uuaaguuuucaauu

SEQ ID NO: 2040489 - RNA, 13 nt, Staphylococcus aureus subsp. aureus Mu50
uuaaguuaaaaua

SEQ ID NO: 2040490 - RNA, 21 nt, Staphylococcus aureus subsp. aureus Mu50
uuaaguuaaaauaaaaugguu

SEQ ID NO: 2040491 - RNA, 13 nt, Staphylococcus aureus subsp. aureus Mu50
uuaaguuaauuuu

SEQ ID NO: 2040492 - RNA, 20 nt, Staphylococcus aureus subsp. aureus Mu50
uuaauaauaucuuuugcguc

SEQ ID NO: 2040493 - RNA, 16 nt, Staphylococcus aureus subsp. aureus Mu50
uuaauacaagucuuua

SEQ ID NO: 2040494 - RNA, 13 nt, Staphylococcus aureus subsp. aureus Mu50
uuaauaacgauaa

SEQ ID NO: 2040495 - RNA, 20 nt, Staphylococcus aureus subsp. aureus Mu50
uucaagaccaaauauuuuau

SEQ ID NO: 2040496 - RNA, 16 nt, Staphylococcus aureus subsp. aureus Mu50
uucaauacuugaaaga

SEQ ID NO: 2040497 - RNA, 13 nt, Staphylococcus aureus subsp. aureus Mu50
uucaaguuaugcu

SEQ ID NO: 2040498 - RNA, 15 nt, Staphylococcus aureus subsp. aureus Mu50
uucaaguuuaaaaua

SEQ ID NO: 2040499 - RNA, 20 nt, Staphylococcus aureus subsp. aureus Mu50
uucaauucuagucaaccuug

SEQ ID NO: 2040500 - RNA, 16 nt, Staphylococcus aureus subsp. aureus Mu50
uucaaugucuacuuug

SEQ ID NO: 2040501 - RNA, 13 nt, Staphylococcus aureus subsp. aureus Mu50
uucaauugauuac

SEQ ID NO: 2040502 - RNA, 15 nt, Staphylococcus aureus subsp. aureus Mu50
uucaauuauuucauc

SEQ ID NO: 2040503 - RNA, 13 nt, Staphylococcus aureus subsp. aureus Mu50
uucacgauuucuu

SEQ ID NO: 2040504 - RNA, 21 nt, Staphylococcus aureus subsp. aureus Mu50
uucacgauuuuuaaaaugcuu

SEQ ID NO: 2040505 - RNA, 22 nt, Staphylococcus aureus subsp. aureus Mu50
uuauuuacaccugcuaguucag

SEQ ID NO: 2040506 - RNA, 16 nt, Staphylococcus aureus subsp. aureus Mu50
uuauuguuuuuaaaau

SEQ ID NO: 2040507 - RNA, 13 nt, Staphylococcus aureus subsp. aureus Mu50
uuauuuaaaaugc

SEQ ID NO: 2040508 - RNA, 15 nt, Staphylococcus aureus subsp. aureus Mu50
uuauuuauaaacaau

SEQ ID NO: 2040509 - RNA, 14 nt, Staphylococcus aureus subsp. aureus Mu50
uuauuuaugaguuu

SEQ ID NO: 2040510 - RNA, 13 nt, Staphylococcus aureus subsp. aureus Mu50
uuauuuuaucauc

SEQ ID NO: 2040511 - RNA, 15 nt, Staphylococcus aureus subsp. aureus Mu50
uuauuuuaucaucua

SEQ ID NO: 2040512 - RNA, 12 nt, Staphylococcus aureus subsp. aureus Mu50
uuauuuuauguu

SEQ ID NO: 2040513 - RNA, 15 nt, Staphylococcus aureus subsp. aureus Mu50
uucaaaguagacauu

SEQ ID NO: 2040514 - RNA, 17 nt, Staphylococcus aureus subsp. aureus Mu50
uucaaaguagauauuga

SEQ ID NO: 2040515 - RNA, 13 nt, Staphylococcus aureus subsp. aureus Mu50
uucaaauaaauca

SEQ ID NO: 2040516 - RNA, 15 nt, Staphylococcus aureus subsp. aureus Mu50
uuauuauuaaauuau

SEQ ID NO: 2040517 - RNA, 20 nt, Staphylococcus aureus subsp. aureus Mu50
uuauucaacguauaagugau

SEQ ID NO: 2040518 - RNA, 14 nt, Staphylococcus aureus subsp. aureus Mu50
uuauuaugaauuau

SEQ ID NO: 2040519 - RNA, 18 nt, Staphylococcus aureus subsp. aureus Mu50
uuauuauaaaauaaauau

SEQ ID NO: 2040520 - RNA, 15 nt, Staphylococcus aureus subsp. aureus Mu50
uuauuauaauagcuu

SEQ ID NO: 2040521 - RNA, 23 nt, Staphylococcus aureus subsp. aureus Mu50
uuauuaucaaagaaauguaugau

SEQ ID NO: 2040522 - RNA, 13 nt, Staphylococcus aureus subsp. aureus Mu50
uuauugccauaaa

SEQ ID NO: 2040523 - RNA, 16 nt, Staphylococcus aureus subsp. aureus Mu50
uuauugguugaaauua

SEQ ID NO: 2040524 - RNA, 17 nt, Staphylococcus aureus subsp. aureus Mu50
uuauugaaacuaauaau

SEQ ID NO: 2040525 - RNA, 16 nt, Staphylococcus aureus subsp. aureus Mu50
uuauucuucccaaaaa

SEQ ID NO: 2040526 - RNA, 13 nt, Staphylococcus aureus subsp. aureus Mu50
uuaucguuuagua

SEQ ID NO: 2040527 - RNA, 22 nt, Staphylococcus aureus subsp. aureus Mu50
uucauuauagucuuaaacauaa

SEQ ID NO: 2040528 - RNA, 22 nt, Staphylococcus aureus subsp. aureus Mu50
uucauguaaauaguuaguuuau

SEQ ID NO: 2040529 - RNA, 15 nt, Staphylococcus aureus subsp. aureus Mu50
uucauguaaauaguu

SEQ ID NO: 2040530 - RNA, 15 nt, Staphylococcus aureus subsp. aureus Mu50
uucauguucauaaua

SEQ ID NO: 2040531 - RNA, 15 nt, Staphylococcus aureus subsp. aureus Mu50
uucauuacaaacuug

SEQ ID NO: 2040532 - RNA, 13 nt, Staphylococcus aureus subsp. aureus Mu50
uucauugaugaug

SEQ ID NO: 2040533 - RNA, 13 nt, Staphylococcus aureus subsp. aureus Mu50
uucauugcuuggu

SEQ ID NO: 2040534 - RNA, 16 nt, Staphylococcus aureus subsp. aureus Mu50
uucauuugaaauaguu

SEQ ID NO: 2040535 - RNA, 17 nt, Staphylococcus aureus subsp. aureus Mu50
uucccaaucgauuuuau

SEQ ID NO: 2040536 - RNA, 18 nt, Staphylococcus aureus subsp. aureus Mu50
uuccauaaauaaaaugcu

SEQ ID NO: 2040537 - RNA, 13 nt, Staphylococcus aureus subsp. aureus Mu50
uuccauucauaaa

SEQ ID NO: 2040538 - RNA, 13 nt, Staphylococcus aureus subsp. aureus Mu50
uuccaugaguuua

SEQ ID NO: 2040539 - RNA, 21 nt, Staphylococcus aureus subsp. aureus Mu50
uuccauuucgaacuugauuaa

SEQ ID NO: 2040540 - RNA, 20 nt, Staphylococcus aureus subsp. aureus Mu50
uuccauuggaaguucuuuug

SEQ ID NO: 2040541 - RNA, 21 nt, Staphylococcus aureus subsp. aureus Mu50
uucauggccaaauguugauaa

SEQ ID NO: 2040542 - RNA, 14 nt, Staphylococcus aureus subsp. aureus Mu50
uucaugauuuacua

SEQ ID NO: 2040543 - RNA, 15 nt, Staphylococcus aureus subsp. aureus Mu50
uucaugaaaaguuga

SEQ ID NO: 2040544 - RNA, 15 nt, Staphylococcus aureus subsp. aureus Mu50
uucaucucagcaaua

SEQ ID NO: 2040545 - RNA, 21 nt, Staphylococcus aureus subsp. aureus Mu50
uucaucuaacgacccaaauua

SEQ ID NO: 2040546 - RNA, 19 nt, Staphylococcus aureus subsp. aureus Mu50
uucaggaauuguuaaauga

SEQ ID NO: 2040547 - RNA, 23 nt, Staphylococcus aureus subsp. aureus Mu50
uucagcgauaacguacaauguau

SEQ ID NO: 2040548 - RNA, 22 nt, Staphylococcus aureus subsp. aureus Mu50
ugugaaaauaccaagugcuuuu

SEQ ID NO: 2040549 - RNA, 13 nt, Staphylococcus aureus subsp. aureus Mu50
ugugaaaucuauu

SEQ ID NO: 2040550 - RNA, 16 nt, Staphylococcus aureus subsp. aureus Mu50
ugucuucuuuuuuucu

SEQ ID NO: 2040551 - RNA, 13 nt, Staphylococcus aureus subsp. aureus Mu50
ugucuuacuaauu

SEQ ID NO: 2040552 - RNA, 21 nt, Staphylococcus aureus subsp. aureus Mu50
ugucuuccaaucaacuucaua

SEQ ID NO: 2040553 - RNA, 19 nt, Staphylococcus aureus subsp. aureus Mu50
ugucuaaaaacauaaaaau

SEQ ID NO: 2040554 - RNA, 22 nt, Staphylococcus aureus subsp. aureus Mu50
ugucuaaaaacauaaaaaucca

SEQ ID NO: 2040555 - RNA, 20 nt, Staphylococcus aureus subsp. aureus Mu50
ugucguuguacaucauuaaa

SEQ ID NO: 2040556 - RNA, 19 nt, Staphylococcus aureus subsp. aureus Mu50
ugucuagguuagaauuauu

SEQ ID NO: 2040557 - RNA, 20 nt, Staphylococcus aureus subsp. aureus Mu50
ugucaauagcgguuuaaaaa

SEQ ID NO: 2040558 - RNA, 19 nt, Staphylococcus aureus subsp. aureus Mu50
ugucccaaugcugaauaaa

SEQ ID NO: 2040559 - RNA, 21 nt, Staphylococcus aureus subsp. aureus Mu50
uguaaaugaaauaggcgcuug

SEQ ID NO: 2040560 - RNA, 21 nt, Staphylococcus aureus subsp. aureus Mu50
uguaaauuacaaaaguaugau

SEQ ID NO: 2040561 - RNA, 16 nt, Staphylococcus aureus subsp. aureus Mu50
uguaaaucgugcuguu

SEQ ID NO: 2040562 - RNA, 16 nt, Staphylococcus aureus subsp. aureus Mu50
uguaagacaacaaauc

SEQ ID NO: 2040563 - RNA, 22 nt, Staphylococcus aureus subsp. aureus Mu50
uguaagcuaucguaaacaacau

SEQ ID NO: 2040564 - RNA, 22 nt, Staphylococcus aureus subsp. aureus Mu50
uguaacuuggcuuaaucucuuu

SEQ ID NO: 2040565 - RNA, 16 nt, Staphylococcus aureus subsp. aureus Mu50
uguauaacauuauuaa

SEQ ID NO: 2040566 - RNA, 17 nt, Staphylococcus aureus subsp. aureus Mu50
uguaggcuuuuuauuuu

SEQ ID NO: 2040567 - RNA, 23 nt, Staphylococcus aureus subsp. aureus Mu50
uguaggcgccauaaucauuaguu

SEQ ID NO: 2040568 - RNA, 16 nt, Staphylococcus aureus subsp. aureus Mu50
uguaugaguccuuuuu

SEQ ID NO: 2040569 - RNA, 14 nt, Staphylococcus aureus subsp. aureus Mu50
uguaugauaaccau

SEQ ID NO: 2040570 - RNA, 21 nt, Staphylococcus aureus subsp. aureus Mu50
uguauaugaauuuuauaaauu

SEQ ID NO: 2040571 - RNA, 21 nt, Staphylococcus aureus subsp. aureus Mu50
uguaucuguaacauaaacaau

SEQ ID NO: 2040572 - RNA, 19 nt, Staphylococcus aureus subsp. aureus Mu50
uguaucacauucaauauuu

SEQ ID NO: 2040573 - RNA, 18 nt, Staphylococcus aureus subsp. aureus Mu50
uguaugccgccuaauaau

SEQ ID NO: 2040574 - RNA, 18 nt, Staphylococcus aureus subsp. aureus Mu50
uguauugaucuacauaau

SEQ ID NO: 2040575 - RNA, 21 nt, Staphylococcus aureus subsp. aureus Mu50
uguauuauugaaacuaauaau

SEQ ID NO: 2040576 - RNA, 20 nt, Staphylococcus aureus subsp. aureus Mu50
uguauuauccucaaauauau

SEQ ID NO: 2040577 - RNA, 19 nt, Staphylococcus aureus subsp. aureus Mu50
ugucaaaucggcuauacau

SEQ ID NO: 2040578 - RNA, 17 nt, Staphylococcus aureus subsp. aureus Mu50
ugguauugguaaauuua

SEQ ID NO: 2040579 - RNA, 18 nt, Staphylococcus aureus subsp. aureus Mu50
uggugagaaauugaauuc

SEQ ID NO: 2040580 - RNA, 14 nt, Staphylococcus aureus subsp. aureus Mu50
uggucuaauaucaa

SEQ ID NO: 2040581 - RNA, 19 nt, Staphylococcus aureus subsp. aureus Mu50
uggucuaucgccuaaaaau

SEQ ID NO: 2040582 - RNA, 18 nt, Staphylococcus aureus subsp. aureus Mu50
ugguuagagaaaaaucug

SEQ ID NO: 2040583 - RNA, 21 nt, Staphylococcus aureus subsp. aureus Mu50
ugguuauuaaaauuaaauaau

SEQ ID NO: 2040584 - RNA, 15 nt, Staphylococcus aureus subsp. aureus Mu50
uguaaaauaaaucau

SEQ ID NO: 2040585 - RNA, 22 nt, Staphylococcus aureus subsp. aureus Mu50
uguaaaacauucccuuaauaau

SEQ ID NO: 2040586 - RNA, 16 nt, Staphylococcus aureus subsp. aureus Mu50
ugcuuuuuauuauuau

SEQ ID NO: 2040587 - RNA, 16 nt, Staphylococcus aureus subsp. aureus Mu50
ugcuuuuucaaauaau

SEQ ID NO: 2040588 - RNA, 15 nt, Staphylococcus aureus subsp. aureus Mu50
ugcuuuuauaauaau

SEQ ID NO: 2040589 - RNA, 16 nt, Staphylococcus aureus subsp. aureus Mu50
ugcuuuuaauaguguu

SEQ ID NO: 2040590 - RNA, 20 nt, Staphylococcus aureus subsp. aureus Mu50
uggaaagaugggauuucacu

SEQ ID NO: 2040591 - RNA, 20 nt, Staphylococcus aureus subsp. aureus Mu50
uggaaaauuauuugauauuu

SEQ ID NO: 2040592 - RNA, 16 nt, Staphylococcus aureus subsp. aureus Mu50
uggguaauaaauugua

SEQ ID NO: 2040593 - RNA, 18 nt, Staphylococcus aureus subsp. aureus Mu50
ugguagccaauaucauau

SEQ ID NO: 2040594 - RNA, 16 nt, Staphylococcus aureus subsp. aureus Mu50
uggcgggcccccaaca

SEQ ID NO: 2040595 - RNA, 19 nt, Staphylococcus aureus subsp. aureus Mu50
uggcggggccccaacacag

SEQ ID NO: 2040596 - RNA, 19 nt, Staphylococcus aureus subsp. aureus Mu50
uggcuugaaguuguuucuc

SEQ ID NO: 2040597 - RNA, 22 nt, Staphylococcus aureus subsp. aureus Mu50
uaaaaaaacgucgugucugaau

SEQ ID NO: 2040598 - RNA, 15 nt, Staphylococcus aureus subsp. aureus Mu50
uaaaaaaagacauga

SEQ ID NO: 2040599 - RNA, 16 nt, Staphylococcus aureus subsp. aureus Mu50
guuuuugguagcauuu

SEQ ID NO: 2040600 - RNA, 17 nt, Staphylococcus aureus subsp. aureus Mu50
uaaaaacguucaaucgu

SEQ ID NO: 2040601 - RNA, 23 nt, Staphylococcus aureus subsp. aureus Mu50
uaaaaacaaagguuuguaagaca

SEQ ID NO: 2040602 - RNA, 18 nt, Staphylococcus aureus subsp. aureus Mu50
uaaaaaaucaguuuuuaa

SEQ ID NO: 2040603 - RNA, 19 nt, Staphylococcus aureus subsp. aureus Mu50
uaaaaaagaacauaaaaaa

SEQ ID NO: 2040604 - RNA, 23 nt, Staphylococcus aureus subsp. aureus Mu50
uaaaaaaccugaaacaaauuagu

SEQ ID NO: 2040605 - RNA, 15 nt, Staphylococcus aureus subsp. aureus Mu50
uaaaacugcaauaau

SEQ ID NO: 2040606 - RNA, 23 nt, Staphylococcus aureus subsp. aureus Mu50
uaaaacuuacauuacauauauca

SEQ ID NO: 2040607 - RNA, 22 nt, Staphylococcus aureus subsp. aureus Mu50
uaaaacguuaguacuuugauau

SEQ ID NO: 2040608 - RNA, 15 nt, Staphylococcus aureus subsp. aureus Mu50
uaaaacuauguguau

SEQ ID NO: 2040609 - RNA, 16 nt, Staphylococcus aureus subsp. aureus Mu50
uaaaaccuuuucaaau

SEQ ID NO: 2040610 - RNA, 19 nt, Staphylococcus aureus subsp. aureus Mu50
uaaaacgaaguuauuuauu

SEQ ID NO: 2040611 - RNA, 22 nt, Staphylococcus aureus subsp. aureus Mu50
uaaaaugauaucugacauuuca

SEQ ID NO: 2040612 - RNA, 21 nt, Staphylococcus aureus subsp. aureus Mu50
uaaaaugucuuugaaaaacug

SEQ ID NO: 2040613 - RNA, 20 nt, Staphylococcus aureus subsp. aureus Mu50
uaaaauguguuuucaacagu

SEQ ID NO: 2040614 - RNA, 16 nt, Staphylococcus aureus subsp. aureus Mu50
uaaaauguuaauaaug

SEQ ID NO: 2040615 - RNA, 17 nt, Staphylococcus aureus subsp. aureus Mu50
uaaaaugcucccuucaa

SEQ ID NO: 2040616 - RNA, 17 nt, Staphylococcus aureus subsp. aureus Mu50
uaaaaugcaauuuuuca

SEQ ID NO: 2040617 - RNA, 22 nt, Staphylococcus aureus subsp. aureus Mu50
uaaaaugcuuuuuugaaauggu

SEQ ID NO: 2040618 - RNA, 20 nt, Staphylococcus aureus subsp. aureus Mu50
uaaauaucauaccguacaaa

SEQ ID NO: 2040619 - RNA, 12 nt, Staphylococcus aureus subsp. aureus Mu50
uaaauaucaugc

SEQ ID NO: 2040620 - RNA, 15 nt, Staphylococcus aureus subsp. aureus Mu50
uaaauauaaugaucc

SEQ ID NO: 2040621 - RNA, 23 nt, Staphylococcus aureus subsp. aureus Mu50
uaaauauauugcacauaaaaaau

SEQ ID NO: 2040622 - RNA, 20 nt, Staphylococcus aureus subsp. aureus Mu50
uaaauaucauaaaugcauac

SEQ ID NO: 2040623 - RNA, 20 nt, Staphylococcus aureus subsp. aureus Mu50
uaaaggaagacauacucaca

SEQ ID NO: 2040624 - RNA, 21 nt, Staphylococcus aureus subsp. aureus Mu50
uaaagcuggggaagaccauuu

SEQ ID NO: 2040625 - RNA, 18 nt, Staphylococcus aureus subsp. aureus Mu50
uaaagcugauuuuucauu

SEQ ID NO: 2040626 - RNA, 18 nt, Staphylococcus aureus subsp. aureus Mu50
uaaagcugcgauauaacu

SEQ ID NO: 2040627 - RNA, 15 nt, Staphylococcus aureus subsp. aureus Mu50
uaaagcuaaugcaag

SEQ ID NO: 2040628 - RNA, 16 nt, Staphylococcus aureus subsp. aureus Mu50
uaaagcauaucucaag

SEQ ID NO: 2040629 - RNA, 13 nt, Staphylococcus aureus subsp. aureus Mu50
uaaacguaucauu

SEQ ID NO: 2040630 - RNA, 14 nt, Staphylococcus aureus subsp. aureus Mu50
uaaacgauacugcu

SEQ ID NO: 2040631 - RNA, 13 nt, Staphylococcus aureus subsp. aureus Mu50
uaaacgaucaacu

SEQ ID NO: 2040632 - RNA, 14 nt, Staphylococcus aureus subsp. aureus Mu50
uaaacgcuaaaauu

SEQ ID NO: 2040633 - RNA, 14 nt, Staphylococcus aureus subsp. aureus Mu50
uaaacaaauaaaug

SEQ ID NO: 2040634 - RNA, 18 nt, Staphylococcus aureus subsp. aureus Mu50
uaaacaagccaagauaaa

SEQ ID NO: 2040635 - RNA, 15 nt, Staphylococcus aureus subsp. aureus Mu50
uaaaauuuuaauuaa

SEQ ID NO: 2040636 - RNA, 23 nt, Staphylococcus aureus subsp. aureus Mu50
uaaaauugguuuggauaaaauga

SEQ ID NO: 2040637 - RNA, 13 nt, Staphylococcus aureus subsp. aureus Mu50
uaaacaauaacug

SEQ ID NO: 2040638 - RNA, 17 nt, Staphylococcus aureus subsp. aureus Mu50
uaaacaaugaugggaaa

SEQ ID NO: 2040639 - RNA, 21 nt, Staphylococcus aureus subsp. aureus Mu50
uaacuucugauucuucacuaa

SEQ ID NO: 2040640 - RNA, 17 nt, Staphylococcus aureus subsp. aureus Mu50
uaacuuguguuauguau

SEQ ID NO: 2040641 - RNA, 13 nt, Staphylococcus aureus subsp. aureus Mu50
uaacuuuaucacu

SEQ ID NO: 2040642 - RNA, 22 nt, Staphylococcus aureus subsp. aureus Mu50
uaacuuuaucuaguuguuuuau

SEQ ID NO: 2040643 - RNA, 18 nt, Staphylococcus aureus subsp. aureus Mu50
uaacuuuuuaauaauugu

SEQ ID NO: 2040644 - RNA, 14 nt, Staphylococcus aureus subsp. aureus Mu50
uaaccgcacuuucu

SEQ ID NO: 2040645 - RNA, 14 nt, Staphylococcus aureus subsp. aureus Mu50
uaaccuauuucauu

SEQ ID NO: 2040646 - RNA, 14 nt, Staphylococcus aureus subsp. aureus Mu50
uaaccuacuuugau

SEQ ID NO: 2040647 - RNA, 18 nt, Staphylococcus aureus subsp. aureus Mu50
uaacccauggauucugau

SEQ ID NO: 2040648 - RNA, 16 nt, Staphylococcus aureus subsp. aureus Mu50
uaacauguuauugcuu

SEQ ID NO: 2040649 - RNA, 14 nt, Staphylococcus aureus subsp. aureus Mu50
uaacauuaaaauga

SEQ ID NO: 2040650 - RNA, 14 nt, Staphylococcus aureus subsp. aureus Mu50
uaacauuuaaaaaa

SEQ ID NO: 2040651 - RNA, 17 nt, Staphylococcus aureus subsp. aureus Mu50
uaacauuuaaaaaaugc

SEQ ID NO: 2040652 - RNA, 19 nt, Staphylococcus aureus subsp. aureus Mu50
uaacauucuucaaaaaaua

SEQ ID NO: 2040653 - RNA, 21 nt, Staphylococcus aureus subsp. aureus Mu50
uaaaugguuuucuuuuucuau

SEQ ID NO: 2040654 - RNA, 13 nt, Staphylococcus aureus subsp. aureus Mu50
uaaauguaacgag

SEQ ID NO: 2040655 - RNA, 14 nt, Staphylococcus aureus subsp. aureus Mu50
uaaauguaucacuu

SEQ ID NO: 2040656 - RNA, 21 nt, Staphylococcus aureus subsp. aureus Mu50
uaaauuacccacaucuuuuua

SEQ ID NO: 2040657 - RNA, 19 nt, Staphylococcus aureus subsp. aureus Mu50
uaaauguuuauaucuuuua

SEQ ID NO: 2040658 - RNA, 18 nt, Staphylococcus aureus subsp. aureus Mu50
uaaauuaaaucgauauuu

SEQ ID NO: 2040659 - RNA, 20 nt, Staphylococcus aureus subsp. aureus Mu50
uaaauucuaucuauaaacgu

SEQ ID NO: 2040660 - RNA, 21 nt, Staphylococcus aureus subsp. aureus Mu50
uaaauucaucuugcaaguauu

SEQ ID NO: 2040661 - RNA, 16 nt, Staphylococcus aureus subsp. aureus Mu50
uaaaucaaacuuuuca

SEQ ID NO: 2040662 - RNA, 21 nt, Staphylococcus aureus subsp. aureus Mu50
uaaauauugauucuagugaaa

SEQ ID NO: 2040663 - RNA, 19 nt, Staphylococcus aureus subsp. aureus Mu50
uaaauauuuaaaauauuau

SEQ ID NO: 2040664 - RNA, 14 nt, Staphylococcus aureus subsp. aureus Mu50
uaaauauugauaua

SEQ ID NO: 2040665 - RNA, 19 nt, Staphylococcus aureus subsp. aureus Mu50
uaaaucaagaaauguuaaa

SEQ ID NO: 2040666 - RNA, 23 nt, Staphylococcus aureus subsp. aureus Mu50
uaaaucauuucguucauauggca

SEQ ID NO: 2040667 - RNA, 23 nt, Staphylococcus aureus subsp. aureus Mu50
uaaauaugauguuaaaaaauaug

SEQ ID NO: 2040668 - RNA, 16 nt, Staphylococcus aureus subsp. aureus Mu50
uaaaucacgauuuuca

SEQ ID NO: 2040669 - RNA, 20 nt, Staphylococcus aureus subsp. aureus Mu50
uaaauucuuuucaagaaauu

SEQ ID NO: 2040670 - RNA, 18 nt, Staphylococcus aureus subsp. aureus Mu50
uaaauugaaguacauuaa

SEQ ID NO: 2040671 - RNA, 21 nt, Staphylococcus aureus subsp. aureus Mu50
uaaauugaaguacauuaaaac

SEQ ID NO: 2040672 - RNA, 16 nt, Staphylococcus aureus subsp. aureus Mu50
uaacagcuaaaaauuc

SEQ ID NO: 2040673 - RNA, 23 nt, Staphylococcus aureus subsp. aureus Mu50
uaacauaaaaaggucuauguaca

SEQ ID NO: 2040674 - RNA, 16 nt, Staphylococcus aureus subsp. aureus Mu50
uaacauauguacuauu

SEQ ID NO: 2040675 - RNA, 21 nt, Staphylococcus aureus subsp. aureus Mu50
uaacaugugcaaguauaaucc

SEQ ID NO: 2040676 - RNA, 19 nt, Staphylococcus aureus subsp. aureus Mu50
uaaucuauauaaaaacugu

SEQ ID NO: 2040677 - RNA, 23 nt, Staphylococcus aureus subsp. aureus Mu50
uaaucuauggaaaauguuaucaa

SEQ ID NO: 2040678 - RNA, 22 nt, Staphylococcus aureus subsp. aureus Mu50
uaaucguuccaacaacuaagau

SEQ ID NO: 2040679 - RNA, 22 nt, Staphylococcus aureus subsp. aureus Mu50
uaaucuaaaaauagauguacaa

SEQ ID NO: 2040680 - RNA, 17 nt, Staphylococcus aureus subsp. aureus Mu50
uaaucuuaggugucauc

SEQ ID NO: 2040681 - RNA, 12 nt, Staphylococcus aureus subsp. aureus Mu50
uaaucuuauucg

SEQ ID NO: 2040682 - RNA, 22 nt, Staphylococcus aureus subsp. aureus Mu50
uaaucuucauuaauuacagcgu

SEQ ID NO: 2040683 - RNA, 18 nt, Staphylococcus aureus subsp. aureus Mu50
uaaucuuguuuucauuua

SEQ ID NO: 2040684 - RNA, 20 nt, Staphylococcus aureus subsp. aureus Mu50
uaaucuuuaacauuuauucu

SEQ ID NO: 2040685 - RNA, 23 nt, Staphylococcus aureus subsp. aureus Mu50
uaaucucuucaauuuauuuuuau

SEQ ID NO: 2040686 - RNA, 17 nt, Staphylococcus aureus subsp. aureus Mu50
uaaucucuuuacaccau

SEQ ID NO: 2040687 - RNA, 17 nt, Staphylococcus aureus subsp. aureus Mu50
uaaucaaaccaccaaaa

SEQ ID NO: 2040688 - RNA, 14 nt, Staphylococcus aureus subsp. aureus Mu50
uaaucaacuuuuug

SEQ ID NO: 2040689 - RNA, 17 nt, Staphylococcus aureus subsp. aureus Mu50
uaaucaagaauauaagu

SEQ ID NO: 2040690 - RNA, 22 nt, Staphylococcus aureus subsp. aureus Mu50
uaaucaacgauaacgauauugu

SEQ ID NO: 2040691 - RNA, 16 nt, Staphylococcus aureus subsp. aureus Mu50
uaaucaaagaaaaagu

SEQ ID NO: 2040692 - RNA, 14 nt, Staphylococcus aureus subsp. aureus Mu50
uaauaaauuuccaa

SEQ ID NO: 2040693 - RNA, 12 nt, Staphylococcus aureus subsp. aureus Mu50
uaauaaggcauc

SEQ ID NO: 2040694 - RNA, 15 nt, Staphylococcus aureus subsp. aureus Mu50
uaauaaccauguaaa

SEQ ID NO: 2040695 - RNA, 17 nt, Staphylococcus aureus subsp. aureus Mu50
uaauaacccauuuucaa

SEQ ID NO: 2040696 - RNA, 18 nt, Staphylococcus aureus subsp. aureus Mu50
uaauaaccgaaauauugu

SEQ ID NO: 2040697 - RNA, 21 nt, Staphylococcus aureus subsp. aureus Mu50
uaauaagaauauucgauacau

SEQ ID NO: 2040698 - RNA, 16 nt, Staphylococcus aureus subsp. aureus Mu50
uaauaccaauuguuuc

SEQ ID NO: 2040699 - RNA, 21 nt, Staphylococcus aureus subsp. aureus Mu50
uaauaccagcauccauugcac

SEQ ID NO: 2040700 - RNA, 14 nt, Staphylococcus aureus subsp. aureus Mu50
uaauacauacugau

SEQ ID NO: 2040701 - RNA, 14 nt, Staphylococcus aureus subsp. aureus Mu50
uaauaaguaauaau

SEQ ID NO: 2040702 - RNA, 14 nt, Staphylococcus aureus subsp. aureus Mu50
uaauaagugcuguu

SEQ ID NO: 2040703 - RNA, 17 nt, Staphylococcus aureus subsp. aureus Mu50
uaauaauaaaauagcug

SEQ ID NO: 2040704 - RNA, 14 nt, Staphylococcus aureus subsp. aureus Mu50
uaauaaucguaaac

SEQ ID NO: 2040705 - RNA, 12 nt, Staphylococcus aureus subsp. aureus Mu50
uaauaaugaauu

SEQ ID NO: 2040706 - RNA, 20 nt, Staphylococcus aureus subsp. aureus Mu50
uaauaauggcaauuaaaacu

SEQ ID NO: 2040707 - RNA, 19 nt, Staphylococcus aureus subsp. aureus Mu50
uaauaccuuuacuuucauu

SEQ ID NO: 2040708 - RNA, 20 nt, Staphylococcus aureus subsp. aureus Mu50
uaauaccuuuacuuucauua

SEQ ID NO: 2040709 - RNA, 21 nt, Staphylococcus aureus subsp. aureus Mu50
uaauaucuaauucuguuucaa

SEQ ID NO: 2040710 - RNA, 21 nt, Staphylococcus aureus subsp. aureus Mu50
uaauaucuucuuuauuuacac

SEQ ID NO: 2040711 - RNA, 20 nt, Staphylococcus aureus subsp. aureus Mu50
uaauaccuaugauauaugcu

SEQ ID NO: 2040712 - RNA, 18 nt, Staphylococcus aureus subsp. aureus Mu50
uaauauguugcuuaucaa

SEQ ID NO: 2040713 - RNA, 17 nt, Staphylococcus aureus subsp. aureus Mu50
uaauauuauaaccacca

SEQ ID NO: 2040714 - RNA, 17 nt, Staphylococcus aureus subsp. aureus Mu50
uaauauuauucuuuaua

SEQ ID NO: 2040715 - RNA, 14 nt, Staphylococcus aureus subsp. aureus Mu50
uaauauuuaaccac

SEQ ID NO: 2040716 - RNA, 19 nt, Staphylococcus aureus subsp. aureus Mu50
uaauauucaacuuguuaag

SEQ ID NO: 2040717 - RNA, 14 nt, Staphylococcus aureus subsp. aureus Mu50
uaagguauuucauu

SEQ ID NO: 2040718 - RNA, 19 nt, Staphylococcus aureus subsp. aureus Mu50
uaaguaaucauaauaaucg

SEQ ID NO: 2040719 - RNA, 18 nt, Staphylococcus aureus subsp. aureus Mu50
uaaguaagauuuaaacau

SEQ ID NO: 2040720 - RNA, 21 nt, Staphylococcus aureus subsp. aureus Mu50
uaauaaauaggaugaaaaaga

SEQ ID NO: 2040721 - RNA, 16 nt, Staphylococcus aureus subsp. aureus Mu50
uaauaaauaucuuagu

SEQ ID NO: 2040722 - RNA, 19 nt, Staphylococcus aureus subsp. aureus Mu50
uaagcuucuguguuggggc

SEQ ID NO: 2040723 - RNA, 15 nt, Staphylococcus aureus subsp. aureus Mu50
uaagcucaugaauca

SEQ ID NO: 2040724 - RNA, 22 nt, Staphylococcus aureus subsp. aureus Mu50
uaagcaucacauauguccauaa

SEQ ID NO: 2040725 - RNA, 16 nt, Staphylococcus aureus subsp. aureus Mu50
uaagcuauacucauuu

SEQ ID NO: 2040726 - RNA, 15 nt, Staphylococcus aureus subsp. aureus Mu50
uaagcaucguaaaaa

SEQ ID NO: 2040727 - RNA, 17 nt, Staphylococcus aureus subsp. aureus Mu50
uaagcauuaauguucaa

SEQ ID NO: 2040728 - RNA, 18 nt, Staphylococcus aureus subsp. aureus Mu50
uaagaugacugaaccaau

SEQ ID NO: 2040729 - RNA, 16 nt, Staphylococcus aureus subsp. aureus Mu50
uaagcacgauaaaaau

SEQ ID NO: 2040730 - RNA, 12 nt, Staphylococcus aureus subsp. aureus Mu50
uaagauuauuuu

SEQ ID NO: 2040731 - RNA, 16 nt, Staphylococcus aureus subsp. aureus Mu50
uaagaugacugaacca

SEQ ID NO: 2040732 - RNA, 14 nt, Staphylococcus aureus subsp. aureus Mu50
uaagacauaugcag

SEQ ID NO: 2040733 - RNA, 21 nt, Staphylococcus aureus subsp. aureus Mu50
uaagaacaugauacugaaauu

SEQ ID NO: 2040734 - RNA, 23 nt, Staphylococcus aureus subsp. aureus Mu50
uaagaaauuuuuucuauggcaca

SEQ ID NO: 2040735 - RNA, 16 nt, Staphylococcus aureus subsp. aureus Mu50
uaagaauguguuaauc

SEQ ID NO: 2040736 - RNA, 22 nt, Staphylococcus aureus subsp. aureus Mu50
uaagaauuguugaucaugagac

SEQ ID NO: 2040737 - RNA, 16 nt, Staphylococcus aureus subsp. aureus Mu50
uacaaaccuaucauca

SEQ ID NO: 2040738 - RNA, 23 nt, Staphylococcus aureus subsp. aureus Mu50
uacaaaauaaaacgacucauuau

SEQ ID NO: 2040739 - RNA, 21 nt, Staphylococcus aureus subsp. aureus Mu50
uacaaaguuuauacuuaauau

SEQ ID NO: 2040740 - RNA, 15 nt, Staphylococcus aureus subsp. aureus Mu50
uacaacaccaauuga

SEQ ID NO: 2040741 - RNA, 13 nt, Staphylococcus aureus subsp. aureus Mu50
uacaaauauuucu

SEQ ID NO: 2040742 - RNA, 21 nt, Staphylococcus aureus subsp. aureus Mu50
uacaaaucgauauugagaaua

SEQ ID NO: 2040743 - RNA, 13 nt, Staphylococcus aureus subsp. aureus Mu50
uacaacauacaug

SEQ ID NO: 2040744 - RNA, 17 nt, Staphylococcus aureus subsp. aureus Mu50
uaauuguaaucuauuuu

SEQ ID NO: 2040745 - RNA, 19 nt, Staphylococcus aureus subsp. aureus Mu50
uaauuguaaucuauuuucu

SEQ ID NO: 2040746 - RNA, 19 nt, Staphylococcus aureus subsp. aureus Mu50
uaauuggguuuaauaacau

SEQ ID NO: 2040747 - RNA, 12 nt, Staphylococcus aureus subsp. aureus Mu50
uaauuuaaaaua

SEQ ID NO: 2040748 - RNA, 14 nt, Staphylococcus aureus subsp. aureus Mu50
uaauuuaaaauagu

SEQ ID NO: 2040749 - RNA, 23 nt, Staphylococcus aureus subsp. aureus Mu50
uaauuuaaaggcauaauaaccau

SEQ ID NO: 2040750 - RNA, 21 nt, Staphylococcus aureus subsp. aureus Mu50
uaauuguuaaacccucauuuu

SEQ ID NO: 2040751 - RNA, 21 nt, Staphylococcus aureus subsp. aureus Mu50
uaauuguuacuaguucuaagu

SEQ ID NO: 2040752 - RNA, 17 nt, Staphylococcus aureus subsp. aureus Mu50
uaauuguuuuuucuuau

SEQ ID NO: 2040753 - RNA, 17 nt, Staphylococcus aureus subsp. aureus Mu50
uaauuuccuaaaaacug

SEQ ID NO: 2040754 - RNA, 13 nt, Staphylococcus aureus subsp. aureus Mu50
uaauuucaacauu

SEQ ID NO: 2040755 - RNA, 14 nt, Staphylococcus aureus subsp. aureus Mu50
uaauuuaaaucugu

SEQ ID NO: 2040756 - RNA, 13 nt, Staphylococcus aureus subsp. aureus Mu50
uaauuuacauuaa

SEQ ID NO: 2040757 - RNA, 17 nt, Staphylococcus aureus subsp. aureus Mu50
uaauuuagucauuacaa

SEQ ID NO: 2040758 - RNA, 20 nt, Staphylococcus aureus subsp. aureus Mu50
uaauuuagucauuacaaauc

SEQ ID NO: 2040759 - RNA, 17 nt, Staphylococcus aureus subsp. aureus Mu50
uaaugcucuauauaucc

SEQ ID NO: 2040760 - RNA, 16 nt, Staphylococcus aureus subsp. aureus Mu50
uaauggacuaauuuau

SEQ ID NO: 2040761 - RNA, 17 nt, Staphylococcus aureus subsp. aureus Mu50
uaaugggcgauaaaagu

SEQ ID NO: 2040762 - RNA, 23 nt, Staphylococcus aureus subsp. aureus Mu50
uaaugguucucugucaaauugga

SEQ ID NO: 2040763 - RNA, 15 nt, Staphylococcus aureus subsp. aureus Mu50
uaauguaauuauuuu

SEQ ID NO: 2040764 - RNA, 13 nt, Staphylococcus aureus subsp. aureus Mu50
uaauugaugauua

SEQ ID NO: 2040765 - RNA, 17 nt, Staphylococcus aureus subsp. aureus Mu50
uaauugcuaaaauauca

SEQ ID NO: 2040766 - RNA, 17 nt, Staphylococcus aureus subsp. aureus Mu50
uaaugcuaauuuaacug

SEQ ID NO: 2040767 - RNA, 15 nt, Staphylococcus aureus subsp. aureus Mu50
uacaggcaaugcaag

SEQ ID NO: 2040768 - RNA, 22 nt, Staphylococcus aureus subsp. aureus Mu50
uacaggagcgagccauuauuau

SEQ ID NO: 2040769 - RNA, 14 nt, Staphylococcus aureus subsp. aureus Mu50
uacagagaaucaau

SEQ ID NO: 2040770 - RNA, 22 nt, Staphylococcus aureus subsp. aureus Mu50
uacagcguauuuuaaugauuuu

SEQ ID NO: 2040771 - RNA, 17 nt, Staphylococcus aureus subsp. aureus Mu50
uacaccuacaaauauuu

SEQ ID NO: 2040772 - RNA, 17 nt, Staphylococcus aureus subsp. aureus Mu50
uacaccuacaacuguug

SEQ ID NO: 2040773 - RNA, 17 nt, Staphylococcus aureus subsp. aureus Mu50
uacaccugcaauauagc

SEQ ID NO: 2040774 - RNA, 16 nt, Staphylococcus aureus subsp. aureus Mu50
uacaagucauuaucca

SEQ ID NO: 2040775 - RNA, 14 nt, Staphylococcus aureus subsp. aureus Mu50
uacaagucuuauuu

SEQ ID NO: 2040776 - RNA, 19 nt, Staphylococcus aureus subsp. aureus Mu50
uacaaguggauauuguguc

SEQ ID NO: 2040777 - RNA, 19 nt, Staphylococcus aureus subsp. aureus Mu50
uacaaguuuauaaucuuuu

SEQ ID NO: 2040778 - RNA, 13 nt, Staphylococcus aureus subsp. aureus Mu50
uacaagaucgugg

SEQ ID NO: 2040779 - RNA, 19 nt, Staphylococcus aureus subsp. aureus Mu50
uacacgcauuacuuuagaa

SEQ ID NO: 2040780 - RNA, 17 nt, Staphylococcus aureus subsp. aureus Mu50
uacacgggcauuguuuu

SEQ ID NO: 2040781 - RNA, 20 nt, Staphylococcus aureus subsp. aureus Mu50
uacacuguuuuauaaaugaa

SEQ ID NO: 2040782 - RNA, 14 nt, Staphylococcus aureus subsp. aureus Mu50
uacacuaucauuau

SEQ ID NO: 2040783 - RNA, 18 nt, Staphylococcus aureus subsp. aureus Mu50
uacacucaaacaagauuc

SEQ ID NO: 2040784 - RNA, 19 nt, Staphylococcus aureus subsp. aureus Mu50
uacacguuucguugcugau

SEQ ID NO: 2040785 - RNA, 20 nt, Staphylococcus aureus subsp. aureus Mu50
guuuguggcaccucuuuugu

SEQ ID NO: 2040786 - RNA, 20 nt, Staphylococcus aureus subsp. aureus Mu50
guuuuaauaauaucuuuugc

SEQ ID NO: 2040787 - RNA, 14 nt, Staphylococcus aureus subsp. aureus Mu50
guuuguuuauugag

SEQ ID NO: 2040788 - RNA, 17 nt, Staphylococcus aureus subsp. aureus Mu50
guuuuaaauaaaugacu

SEQ ID NO: 2040789 - RNA, 18 nt, Staphylococcus aureus subsp. aureus Mu50
guuuuaccccuguugaau

SEQ ID NO: 2040790 - RNA, 17 nt, Staphylococcus aureus subsp. aureus Mu50
guuuuauucaauugauu

SEQ ID NO: 2040791 - RNA, 12 nt, Staphylococcus aureus subsp. aureus Mu50
guuuucaucaac

SEQ ID NO: 2040792 - RNA, 16 nt, Staphylococcus aureus subsp. aureus Mu50
guuuuauuuucuuuuu

SEQ ID NO: 2040793 - RNA, 17 nt, Staphylococcus aureus subsp. aureus Mu50
guuuucaugaaaaguug

SEQ ID NO: 2040794 - RNA, 14 nt, Staphylococcus aureus subsp. aureus Mu50
guuuugcaacauuu

SEQ ID NO: 2040795 - RNA, 18 nt, Staphylococcus aureus subsp. aureus Mu50
guuuugcuaaccaucaua

SEQ ID NO: 2040796 - RNA, 17 nt, Staphylococcus aureus subsp. aureus Mu50
guuuugcuaaccaucau

SEQ ID NO: 2040797 - RNA, 21 nt, Staphylococcus aureus subsp. aureus Mu50
guuugguuucuuaacauaaaa

SEQ ID NO: 2040798 - RNA, 22 nt, Staphylococcus aureus subsp. aureus Mu50
guuuguaagacaacaaaucgau

SEQ ID NO: 2040799 - RNA, 13 nt, Staphylococcus aureus subsp. aureus Mu50
guuuguaauaauu

SEQ ID NO: 2040800 - RNA, 18 nt, Staphylococcus aureus subsp. aureus Mu50
guuuggauaaaaugauau

SEQ ID NO: 2040801 - RNA, 20 nt, Staphylococcus aureus subsp. aureus Mu50
guuugaacaacaucuuuugu

SEQ ID NO: 2040802 - RNA, 18 nt, Staphylococcus aureus subsp. aureus Mu50
guuucuuccgcacugccu

SEQ ID NO: 2040803 - RNA, 15 nt, Staphylococcus aureus subsp. aureus Mu50
guuugacucuuuucu

SEQ ID NO: 2040804 - RNA, 19 nt, Staphylococcus aureus subsp. aureus Mu50
guuugaagugauuugccaa

SEQ ID NO: 2040805 - RNA, 14 nt, Staphylococcus aureus subsp. aureus Mu50
guuugaauguuuuu

SEQ ID NO: 2040806 - RNA, 20 nt, Staphylococcus aureus subsp. aureus Mu50
guuugaaggugauaauguac

SEQ ID NO: 2040807 - RNA, 15 nt, Staphylococcus aureus subsp. aureus Mu50
guuuacgaucauaaa

SEQ ID NO: 2040808 - RNA, 19 nt, Staphylococcus aureus subsp. aureus Mu50
guuuacgaucauaaauauu

SEQ ID NO: 2040809 - RNA, 15 nt, Staphylococcus aureus subsp. aureus Mu50
guuuauaaucuuuuu

SEQ ID NO: 2040810 - RNA, 19 nt, Staphylococcus aureus subsp. aureus Mu50
guuuaucaauuucucuuuc

SEQ ID NO: 2040811 - RNA, 18 nt, Staphylococcus aureus subsp. aureus Mu50
guuuauccauauaugaug

SEQ ID NO: 2040812 - RNA, 16 nt, Staphylococcus aureus subsp. aureus Mu50
guuuaauuuuaaauau

SEQ ID NO: 2040813 - RNA, 20 nt, Staphylococcus aureus subsp. aureus Mu50
guugucauaccaaauaaaua

SEQ ID NO: 2040814 - RNA, 19 nt, Staphylococcus aureus subsp. aureus Mu50
guugucacuauugcagcaa

SEQ ID NO: 2040815 - RNA, 13 nt, Staphylococcus aureus subsp. aureus Mu50
guuguaaguuauu

SEQ ID NO: 2040816 - RNA, 18 nt, Staphylococcus aureus subsp. aureus Mu50
guuguacaucauuaaaua

SEQ ID NO: 2040817 - RNA, 19 nt, Staphylococcus aureus subsp. aureus Mu50
guugguguuuagucuuuuu

SEQ ID NO: 2040818 - RNA, 16 nt, Staphylococcus aureus subsp. aureus Mu50
guuguacuucuuuggu

SEQ ID NO: 2040819 - RNA, 23 nt, Staphylococcus aureus subsp. aureus Mu50
guuggcaucagacuaaaaugaau

SEQ ID NO: 2040820 - RNA, 16 nt, Staphylococcus aureus subsp. aureus Mu50
guugcauauaaaaacc

SEQ ID NO: 2040821 - RNA, 21 nt, Staphylococcus aureus subsp. aureus Mu50
guugcauuaagugcaauaaca

SEQ ID NO: 2040822 - RNA, 18 nt, Staphylococcus aureus subsp. aureus Mu50
guugauuuaagauuuaau

SEQ ID NO: 2040823 - RNA, 23 nt, Staphylococcus aureus subsp. aureus Mu50
guugcacaaauugcaauggcaac

SEQ ID NO: 2040824 - RNA, 20 nt, Staphylococcus aureus subsp. aureus Mu50
guuggaaaaggucaaaaaau

SEQ ID NO: 2040825 - RNA, 12 nt, Staphylococcus aureus subsp. aureus Mu50
guucuaaaauaa

SEQ ID NO: 2040826 - RNA, 13 nt, Staphylococcus aureus subsp. aureus Mu50
guucuaaguguuu

SEQ ID NO: 2040827 - RNA, 20 nt, Staphylococcus aureus subsp. aureus Mu50
guucuauuccacaacaauca

SEQ ID NO: 2040828 - RNA, 15 nt, Staphylococcus aureus subsp. aureus Mu50
guugacugaacgaaa

SEQ ID NO: 2040829 - RNA, 15 nt, Staphylococcus aureus subsp. aureus Mu50
uaguauaaauaucau

SEQ ID NO: 2040830 - RNA, 14 nt, Staphylococcus aureus subsp. aureus Mu50
uaguauggaauaaa

SEQ ID NO: 2040831 - RNA, 23 nt, Staphylococcus aureus subsp. aureus Mu50
uagucauuacaaaucaugacaua

SEQ ID NO: 2040832 - RNA, 16 nt, Staphylococcus aureus subsp. aureus Mu50
uagucaucuguuaauu

SEQ ID NO: 2040833 - RNA, 22 nt, Staphylococcus aureus subsp. aureus Mu50
uaguacggcugcuuuaacugua

SEQ ID NO: 2040834 - RNA, 17 nt, Staphylococcus aureus subsp. aureus Mu50
uaguacggcugcuuuaa

SEQ ID NO: 2040835 - RNA, 20 nt, Staphylococcus aureus subsp. aureus Mu50
uaguacggcugcuuuaacug

SEQ ID NO: 2040836 - RNA, 12 nt, Staphylococcus aureus subsp. aureus Mu50
uaguaguguauu

SEQ ID NO: 2040837 - RNA, 22 nt, Staphylococcus aureus subsp. aureus Mu50
uaguaggguauugaaauaauau

SEQ ID NO: 2040838 - RNA, 19 nt, Staphylococcus aureus subsp. aureus Mu50
uaguacacgaauucauuaa

SEQ ID NO: 2040839 - RNA, 19 nt, Staphylococcus aureus subsp. aureus Mu50
uaguaccaagcuucauuag

SEQ ID NO: 2040840 - RNA, 22 nt, Staphylococcus aureus subsp. aureus Mu50
uaguaaucucucgcuaaauuua

SEQ ID NO: 2040841 - RNA, 14 nt, Staphylococcus aureus subsp. aureus Mu50
uaguaauaagacaa

SEQ ID NO: 2040842 - RNA, 17 nt, Staphylococcus aureus subsp. aureus Mu50
uaguacaaaauugucuc

SEQ ID NO: 2040843 - RNA, 18 nt, Staphylococcus aureus subsp. aureus Mu50
uaggugucaucgcuuuaa

SEQ ID NO: 2040844 - RNA, 20 nt, Staphylococcus aureus subsp. aureus Mu50
uaguaaaccuacuaauauau

SEQ ID NO: 2040845 - RNA, 13 nt, Staphylococcus aureus subsp. aureus Mu50
uaguaauaaaaug

SEQ ID NO: 2040846 - RNA, 20 nt, Staphylococcus aureus subsp. aureus Mu50
uaguaaagugaaauaaagcg

SEQ ID NO: 2040847 - RNA, 14 nt, Staphylococcus aureus subsp. aureus Mu50
uaguaaauauaguu

SEQ ID NO: 2040848 - RNA, 23 nt, Staphylococcus aureus subsp. aureus Mu50
uaggucuugguguagauaaaucg

SEQ ID NO: 2040849 - RNA, 14 nt, Staphylococcus aureus subsp. aureus Mu50
uagguauaaucauu

SEQ ID NO: 2040850 - RNA, 20 nt, Staphylococcus aureus subsp. aureus Mu50
uagguaaccuuaaauauagu

SEQ ID NO: 2040851 - RNA, 15 nt, Staphylococcus aureus subsp. aureus Mu50
uagucucguaauaau

SEQ ID NO: 2040852 - RNA, 13 nt, Staphylococcus aureus subsp. aureus Mu50
uagugagcguauu

SEQ ID NO: 2040853 - RNA, 21 nt, Staphylococcus aureus subsp. aureus Mu50
uagucuuuuuuaagcuuauca

SEQ ID NO: 2040854 - RNA, 11 nt, Staphylococcus aureus subsp. aureus Mu50
uagugaaaaag

SEQ ID NO: 2040855 - RNA, 23 nt, Staphylococcus aureus subsp. aureus Mu50
uagugaaauucgaacuaucaaua

SEQ ID NO: 2040856 - RNA, 18 nt, Staphylococcus aureus subsp. aureus Mu50
uaguguuuuauucgauaa

SEQ ID NO: 2040857 - RNA, 17 nt, Staphylococcus aureus subsp. aureus Mu50
uaguguuauauuguauu

SEQ ID NO: 2040858 - RNA, 22 nt, Staphylococcus aureus subsp. aureus Mu50
uagugguagccaauaucauauu

SEQ ID NO: 2040859 - RNA, 21 nt, Staphylococcus aureus subsp. aureus Mu50
uaguggaauacuugucaaaau

SEQ ID NO: 2040860 - RNA, 16 nt, Staphylococcus aureus subsp. aureus Mu50
uagugcuuguuuauua

SEQ ID NO: 2040861 - RNA, 21 nt, Staphylococcus aureus subsp. aureus Mu50
uagugccucuuuuauuauuua

SEQ ID NO: 2040862 - RNA, 21 nt, Staphylococcus aureus subsp. aureus Mu50
uaguuaauucuccuaauaauu

SEQ ID NO: 2040863 - RNA, 20 nt, Staphylococcus aureus subsp. aureus Mu50
uaguuaaaguacuuacaaau

SEQ ID NO: 2040864 - RNA, 20 nt, Staphylococcus aureus subsp. aureus Mu50
uaguuagcccuauucaacua

SEQ ID NO: 2040865 - RNA, 21 nt, Staphylococcus aureus subsp. aureus Mu50
uaguucaaauugaacuucuuu

SEQ ID NO: 2040866 - RNA, 23 nt, Staphylococcus aureus subsp. aureus Mu50
uaguucuggcaaagaauccuuaa

SEQ ID NO: 2040867 - RNA, 23 nt, Staphylococcus aureus subsp. aureus Mu50
uaguugaucaaaaagacagcagu

SEQ ID NO: 2040868 - RNA, 20 nt, Staphylococcus aureus subsp. aureus Mu50
uaguucggaugagaaauguu

SEQ ID NO: 2040869 - RNA, 14 nt, Staphylococcus aureus subsp. aureus Mu50
uaguuguacuucuu

SEQ ID NO: 2040870 - RNA, 15 nt, Staphylococcus aureus subsp. aureus Mu50
uaguuguacuucuuu

SEQ ID NO: 2040871 - RNA, 15 nt, Staphylococcus aureus subsp. aureus Mu50
uauacguuacuaaac

SEQ ID NO: 2040872 - RNA, 22 nt, Staphylococcus aureus subsp. aureus Mu50
uauacguugauuaacacauucu

SEQ ID NO: 2040873 - RNA, 20 nt, Staphylococcus aureus subsp. aureus Mu50
uauagaaaaaguauuacuuu

SEQ ID NO: 2040874 - RNA, 20 nt, Staphylococcus aureus subsp. aureus Mu50
uauacuaagcgcucauaaac

SEQ ID NO: 2040875 - RNA, 22 nt, Staphylococcus aureus subsp. aureus Mu50
uauacuauaaauacaaauauau

SEQ ID NO: 2040876 - RNA, 20 nt, Staphylococcus aureus subsp. aureus Mu50
uauaccaaggguuucuggcu

SEQ ID NO: 2040877 - RNA, 19 nt, Staphylococcus aureus subsp. aureus Mu50
uauacgauugaguugaaaa

SEQ ID NO: 2040878 - RNA, 13 nt, Staphylococcus aureus subsp. aureus Mu50
uauagauauuagc

SEQ ID NO: 2040879 - RNA, 22 nt, Staphylococcus aureus subsp. aureus Mu50
uauagaggauauuuauucuaag

SEQ ID NO: 2040880 - RNA, 15 nt, Staphylococcus aureus subsp. aureus Mu50
uauagauuaaaccgc

SEQ ID NO: 2040881 - RNA, 18 nt, Staphylococcus aureus subsp. aureus Mu50
uauagauugccauucaua

SEQ ID NO: 2040882 - RNA, 22 nt, Staphylococcus aureus subsp. aureus Mu50
uauagauuuuguauuagcaucu

SEQ ID NO: 2040883 - RNA, 21 nt, Staphylococcus aureus subsp. aureus Mu50
uauaggcccuaacgguagaau

SEQ ID NO: 2040884 - RNA, 23 nt, Staphylococcus aureus subsp. aureus Mu50
uauagcugugauuugaucaaccu

SEQ ID NO: 2040885 - RNA, 22 nt, Staphylococcus aureus subsp. aureus Mu50
uauauuguauuuuauuuauuuu

SEQ ID NO: 2040886 - RNA, 12 nt, Staphylococcus aureus subsp. aureus Mu50
uauauuaagcau

SEQ ID NO: 2040887 - RNA, 17 nt, Staphylococcus aureus subsp. aureus Mu50
uauauuaaggucauuuu

SEQ ID NO: 2040888 - RNA, 11 nt, Staphylococcus aureus subsp. aureus Mu50
uauauuaaugu

SEQ ID NO: 2040889 - RNA, 20 nt, Staphylococcus aureus subsp. aureus Mu50
uauauuacucaaaauuaaag

SEQ ID NO: 2040890 - RNA, 21 nt, Staphylococcus aureus subsp. aureus Mu50
uauauguaaagcuaauuuuuu

SEQ ID NO: 2040891 - RNA, 20 nt, Staphylococcus aureus subsp. aureus Mu50
uauauguaacauaaagcugu

SEQ ID NO: 2040892 - RNA, 17 nt, Staphylococcus aureus subsp. aureus Mu50
uauaugucucucuuucu

SEQ ID NO: 2040893 - RNA, 12 nt, Staphylococcus aureus subsp. aureus Mu50
uauauuaaaaau

SEQ ID NO: 2040894 - RNA, 16 nt, Staphylococcus aureus subsp. aureus Mu50
uauaugccgauugcuc

SEQ ID NO: 2040895 - RNA, 17 nt, Staphylococcus aureus subsp. aureus Mu50
uauauccugccaauaua

SEQ ID NO: 2040896 - RNA, 17 nt, Staphylococcus aureus subsp. aureus Mu50
uauaucuaauacuuuca

SEQ ID NO: 2040897 - RNA, 16 nt, Staphylococcus aureus subsp. aureus Mu50
uauauauuaaaacaau

SEQ ID NO: 2040898 - RNA, 12 nt, Staphylococcus aureus subsp. aureus Mu50
uauauauucaau

SEQ ID NO: 2040899 - RNA, 15 nt, Staphylococcus aureus subsp. aureus Mu50
uauauauucaauaau

SEQ ID NO: 2040900 - RNA, 18 nt, Staphylococcus aureus subsp. aureus Mu50
uauauauuccuuaaaccg

SEQ ID NO: 2040901 - RNA, 13 nt, Staphylococcus aureus subsp. aureus Mu50
uauagcaccauua

SEQ ID NO: 2040902 - RNA, 18 nt, Staphylococcus aureus subsp. aureus Mu50
uauaguaagaaaagucac

SEQ ID NO: 2040903 - RNA, 21 nt, Staphylococcus aureus subsp. aureus Mu50
uauauacguugauuaacacau

SEQ ID NO: 2040904 - RNA, 17 nt, Staphylococcus aureus subsp. aureus Mu50
uauagucauuacauuuu

SEQ ID NO: 2040905 - RNA, 15 nt, Staphylococcus aureus subsp. aureus Mu50
uauauauccauucaa

SEQ ID NO: 2040906 - RNA, 18 nt, Staphylococcus aureus subsp. aureus Mu50
uauauaguaaaauaaaua

SEQ ID NO: 2040907 - RNA, 20 nt, Staphylococcus aureus subsp. aureus Mu50
uauauagucuaugaauaaug

SEQ ID NO: 2040908 - RNA, 18 nt, Staphylococcus aureus subsp. aureus Mu50
uauagucuaugaauaaug

SEQ ID NO: 2040909 - RNA, 16 nt, Staphylococcus aureus subsp. aureus Mu50
uauaguugagcguuua

SEQ ID NO: 2040910 - RNA, 12 nt, Staphylococcus aureus subsp. aureus Mu50
uauauaaaaaga

SEQ ID NO: 2040911 - RNA, 16 nt, Staphylococcus aureus subsp. aureus Mu50
uauauaaaaucauuaa

SEQ ID NO: 2040912 - RNA, 20 nt, Staphylococcus aureus subsp. aureus Mu50
uauauaaaaucauuaauaau

SEQ ID NO: 2040913 - RNA, 18 nt, Staphylococcus aureus subsp. aureus Mu50
uauauaauuuauuuagca

SEQ ID NO: 2040914 - RNA, 23 nt, Staphylococcus aureus subsp. aureus Mu50
uaguuuauugccgguuaaauuau

SEQ ID NO: 2040915 - RNA, 21 nt, Staphylococcus aureus subsp. aureus Mu50
uaguuguccauuuuaugcacu

SEQ ID NO: 2040916 - RNA, 20 nt, Staphylococcus aureus subsp. aureus Mu50
uaguuguuuuauagcauuuc

SEQ ID NO: 2040917 - RNA, 13 nt, Staphylococcus aureus subsp. aureus Mu50
uaguuuucaugaa

SEQ ID NO: 2040918 - RNA, 12 nt, Staphylococcus aureus subsp. aureus Mu50
uauaaaauaaau

SEQ ID NO: 2040919 - RNA, 14 nt, Staphylococcus aureus subsp. aureus Mu50
uauaaaauaaauau

SEQ ID NO: 2040920 - RNA, 22 nt, Staphylococcus aureus subsp. aureus Mu50
uauaaaaucaucguauuucaua

SEQ ID NO: 2040921 - RNA, 18 nt, Staphylococcus aureus subsp. aureus Mu50
uauaaaaucauuaauaau

SEQ ID NO: 2040922 - RNA, 18 nt, Staphylococcus aureus subsp. aureus Mu50
uauaaaaucuauaccauu

SEQ ID NO: 2040923 - RNA, 14 nt, Staphylococcus aureus subsp. aureus Mu50
uauaaaauucacca

SEQ ID NO: 2040924 - RNA, 14 nt, Staphylococcus aureus subsp. aureus Mu50
uauaaaaacuguuc

SEQ ID NO: 2040925 - RNA, 15 nt, Staphylococcus aureus subsp. aureus Mu50
uauaaaaacuuauuu

SEQ ID NO: 2040926 - RNA, 21 nt, Staphylococcus aureus subsp. aureus Mu50
uauaaaaagaauaugauauug

SEQ ID NO: 2040927 - RNA, 13 nt, Staphylococcus aureus subsp. aureus Mu50
uauaaauguuuau

SEQ ID NO: 2040928 - RNA, 22 nt, Staphylococcus aureus subsp. aureus Mu50
uauaaauguuuauaucuuuuau

SEQ ID NO: 2040929 - RNA, 16 nt, Staphylococcus aureus subsp. aureus Mu50
uauaaauuucuucaua

SEQ ID NO: 2040930 - RNA, 14 nt, Staphylococcus aureus subsp. aureus Mu50
uauaaagaaauaau

SEQ ID NO: 2040931 - RNA, 14 nt, Staphylococcus aureus subsp. aureus Mu50
uauaaauaauaaau

SEQ ID NO: 2040932 - RNA, 15 nt, Staphylococcus aureus subsp. aureus Mu50
uauaaauaugguuuc

SEQ ID NO: 2040933 - RNA, 13 nt, Staphylococcus aureus subsp. aureus Mu50
uauaaaucauuuc

SEQ ID NO: 2040934 - RNA, 18 nt, Staphylococcus aureus subsp. aureus Mu50
uauaaauggcgcgaacau

SEQ ID NO: 2040935 - RNA, 18 nt, Staphylococcus aureus subsp. aureus Mu50
uauaaaggaauagcuaca

SEQ ID NO: 2040936 - RNA, 19 nt, Staphylococcus aureus subsp. aureus Mu50
uauaaagucguaucauaua

SEQ ID NO: 2040937 - RNA, 20 nt, Staphylococcus aureus subsp. aureus Mu50
uauaaaguugacaauacaaa

SEQ ID NO: 2040938 - RNA, 14 nt, Staphylococcus aureus subsp. aureus Mu50
uauaaauaaaaaua

SEQ ID NO: 2040939 - RNA, 17 nt, Staphylococcus aureus subsp. aureus Mu50
uauaaauaaaaauacau

SEQ ID NO: 2040940 - RNA, 20 nt, Staphylococcus aureus subsp. aureus Mu50
uauaaauaaaaauacauaau

SEQ ID NO: 2040941 - RNA, 17 nt, Staphylococcus aureus subsp. aureus Mu50
uauaaaccuaaugcuuu

SEQ ID NO: 2040942 - RNA, 20 nt, Staphylococcus aureus subsp. aureus Mu50
uauaaacguccaaacacaaa

SEQ ID NO: 2040943 - RNA, 22 nt, Staphylococcus aureus subsp. aureus Mu50
uauaaacguccaaacacaaaua

SEQ ID NO: 2040944 - RNA, 14 nt, Staphylococcus aureus subsp. aureus Mu50
uauaaacaauaaaa

SEQ ID NO: 2040945 - RNA, 20 nt, Staphylococcus aureus subsp. aureus Mu50
uauaaaccagcugauuccau

SEQ ID NO: 2040946 - RNA, 17 nt, Staphylococcus aureus subsp. aureus Mu50
uauaacauuaaaaugau

SEQ ID NO: 2040947 - RNA, 14 nt, Staphylococcus aureus subsp. aureus Mu50
uauaaccgcuacaa

SEQ ID NO: 2040948 - RNA, 21 nt, Staphylococcus aureus subsp. aureus Mu50
uauaaccgugaugaugugcaa

SEQ ID NO: 2040949 - RNA, 16 nt, Staphylococcus aureus subsp. aureus Mu50
uauaaccuauuucauu

SEQ ID NO: 2040950 - RNA, 20 nt, Staphylococcus aureus subsp. aureus Mu50
uauaagaaucagcuaaauau

SEQ ID NO: 2040951 - RNA, 18 nt, Staphylococcus aureus subsp. aureus Mu50
uauaagaauuuaaaagag

SEQ ID NO: 2040952 - RNA, 20 nt, Staphylococcus aureus subsp. aureus Mu50
uauaagauagauaaaucaag

SEQ ID NO: 2040953 - RNA, 17 nt, Staphylococcus aureus subsp. aureus Mu50
uauaagauauagaaggg

SEQ ID NO: 2040954 - RNA, 21 nt, Staphylococcus aureus subsp. aureus Mu50
uauaaagacgauuuauuaguu

SEQ ID NO: 2040955 - RNA, 16 nt, Staphylococcus aureus subsp. aureus Mu50
uauaaguacaaauaau

SEQ ID NO: 2040956 - RNA, 13 nt, Staphylococcus aureus subsp. aureus Mu50
uauaaguagcuca

SEQ ID NO: 2040957 - RNA, 23 nt, Staphylococcus aureus subsp. aureus Mu50
uauaauacuguauuuuaacguca

SEQ ID NO: 2040958 - RNA, 18 nt, Staphylococcus aureus subsp. aureus Mu50
uauaaguagcucaaaaca

SEQ ID NO: 2040959 - RNA, 14 nt, Staphylococcus aureus subsp. aureus Mu50
uauaaguauaauga

SEQ ID NO: 2040960 - RNA, 21 nt, Staphylococcus aureus subsp. aureus Mu50
uauaagugauuucuucauuau

SEQ ID NO: 2040961 - RNA, 22 nt, Staphylococcus aureus subsp. aureus Mu50
uauaagugauuucuucauuauc

SEQ ID NO: 2040962 - RNA, 13 nt, Staphylococcus aureus subsp. aureus Mu50
uauaaguuaaaaa

SEQ ID NO: 2040963 - RNA, 15 nt, Staphylococcus aureus subsp. aureus Mu50
uauaaguuaaaaaug

SEQ ID NO: 2040964 - RNA, 20 nt, Staphylococcus aureus subsp. aureus Mu50
uauacaauuauggauaaaau

SEQ ID NO: 2040965 - RNA, 12 nt, Staphylococcus aureus subsp. aureus Mu50
uauacaaauuau

SEQ ID NO: 2040966 - RNA, 18 nt, Staphylococcus aureus subsp. aureus Mu50
uauacaacaguaaucaug

SEQ ID NO: 2040967 - RNA, 18 nt, Staphylococcus aureus subsp. aureus Mu50
uauaauuucuuaauuagu

SEQ ID NO: 2040968 - RNA, 17 nt, Staphylococcus aureus subsp. aureus Mu50
uauaauuuauaaaaaga

SEQ ID NO: 2040969 - RNA, 19 nt, Staphylococcus aureus subsp. aureus Mu50
uauaauuuauuuagcaucu

SEQ ID NO: 2040970 - RNA, 17 nt, Staphylococcus aureus subsp. aureus Mu50
uauaaucauuaaguaau

SEQ ID NO: 2040971 - RNA, 18 nt, Staphylococcus aureus subsp. aureus Mu50
uauaaugccaaauauagu

SEQ ID NO: 2040972 - RNA, 17 nt, Staphylococcus aureus subsp. aureus Mu50
uauaauuauuaaacuuu

SEQ ID NO: 2040973 - RNA, 22 nt, Staphylococcus aureus subsp. aureus Mu50
uauaauucacuuuacccucuuu

SEQ ID NO: 2040974 - RNA, 18 nt, Staphylococcus aureus subsp. aureus Mu50
uauaauuccugauacaau

SEQ ID NO: 2040975 - RNA, 22 nt, Staphylococcus aureus subsp. aureus Mu50
uauaauucgucuguuucauaua

SEQ ID NO: 2040976 - RNA, 13 nt, Staphylococcus aureus subsp. aureus Mu50
uaugaaggcuuuu

SEQ ID NO: 2040977 - RNA, 19 nt, Staphylococcus aureus subsp. aureus Mu50
uaugaaauuggaauagaug

SEQ ID NO: 2040978 - RNA, 14 nt, Staphylococcus aureus subsp. aureus Mu50
uaucuuuugcuucg

SEQ ID NO: 2040979 - RNA, 19 nt, Staphylococcus aureus subsp. aureus Mu50
uaucuaguguucucauuau

SEQ ID NO: 2040980 - RNA, 23 nt, Staphylococcus aureus subsp. aureus Mu50
uaucuaguguucucauuauaaug

SEQ ID NO: 2040981 - RNA, 23 nt, Staphylococcus aureus subsp. aureus Mu50
uaucuaacaaucguuuuaaugcc

SEQ ID NO: 2040982 - RNA, 18 nt, Staphylococcus aureus subsp. aureus Mu50
uaucuaaaccuuuuuuaa

SEQ ID NO: 2040983 - RNA, 15 nt, Staphylococcus aureus subsp. aureus Mu50
uaucguuaccuuuua

SEQ ID NO: 2040984 - RNA, 15 nt, Staphylococcus aureus subsp. aureus Mu50
uauccucaaauauau

SEQ ID NO: 2040985 - RNA, 16 nt, Staphylococcus aureus subsp. aureus Mu50
uauccccauuuaugug

SEQ ID NO: 2040986 - RNA, 11 nt, Staphylococcus aureus subsp. aureus Mu50
uaucaauuuau

SEQ ID NO: 2040987 - RNA, 14 nt, Staphylococcus aureus subsp. aureus Mu50
uaucacaacacaua

SEQ ID NO: 2040988 - RNA, 13 nt, Staphylococcus aureus subsp. aureus Mu50
uaucacuuauuau

SEQ ID NO: 2040989 - RNA, 20 nt, Staphylococcus aureus subsp. aureus Mu50
uaucacuauacaaucauaaa

SEQ ID NO: 2040990 - RNA, 19 nt, Staphylococcus aureus subsp. aureus Mu50
uauauuuuuaggugcuuua

SEQ ID NO: 2040991 - RNA, 15 nt, Staphylococcus aureus subsp. aureus Mu50
uauauuuuuaucauc

SEQ ID NO: 2040992 - RNA, 23 nt, Staphylococcus aureus subsp. aureus Mu50
uaucaaaaaauacguuuaaugua

SEQ ID NO: 2040993 - RNA, 18 nt, Staphylococcus aureus subsp. aureus Mu50
uaucaagaacuuuaaaaa

SEQ ID NO: 2040994 - RNA, 18 nt, Staphylococcus aureus subsp. aureus Mu50
uaucaagaauauaacgaa

SEQ ID NO: 2040995 - RNA, 19 nt, Staphylococcus aureus subsp. aureus Mu50
uaucaagaauauaacgaau

SEQ ID NO: 2040996 - RNA, 22 nt, Staphylococcus aureus subsp. aureus Mu50
uaucaacgauugaauuguagau

SEQ ID NO: 2040997 - RNA, 22 nt, Staphylococcus aureus subsp. aureus Mu50
uaucaacgauuuugucuuuuau

SEQ ID NO: 2040998 - RNA, 12 nt, Staphylococcus aureus subsp. aureus Mu50
uaucaaguuuua

SEQ ID NO: 2040999 - RNA, 11 nt, Staphylococcus aureus subsp. aureus Mu50
uaucaauaaau

SEQ ID NO: 2041000 - RNA, 13 nt, Staphylococcus aureus subsp. aureus Mu50
uaucaauauaauu

SEQ ID NO: 2041001 - RNA, 13 nt, Staphylococcus aureus subsp. aureus Mu50
uaucaacauuaau

SEQ ID NO: 2041002 - RNA, 16 nt, Staphylococcus aureus subsp. aureus Mu50
uaucaagauguuugca

SEQ ID NO: 2041003 - RNA, 22 nt, Staphylococcus aureus subsp. aureus Mu50
uaucaagauguuugcaacauau

SEQ ID NO: 2041004 - RNA, 14 nt, Staphylococcus aureus subsp. aureus Mu50
uaucagugugauuu

SEQ ID NO: 2041005 - RNA, 18 nt, Staphylococcus aureus subsp. aureus Mu50
uaucaguuuguccuuuaa

SEQ ID NO: 2041006 - RNA, 12 nt, Staphylococcus aureus subsp. aureus Mu50
uaucauaaaugc

SEQ ID NO: 2041007 - RNA, 18 nt, Staphylococcus aureus subsp. aureus Mu50
uaucauuaaguacuuuua

SEQ ID NO: 2041008 - RNA, 18 nt, Staphylococcus aureus subsp. aureus Mu50
uaucaucugcauuuaauu

SEQ ID NO: 2041009 - RNA, 14 nt, Staphylococcus aureus subsp. aureus Mu50
uaucaguaauaaua

SEQ ID NO: 2041010 - RNA, 23 nt, Staphylococcus aureus subsp. aureus Mu50
uaucauauaaaucaaauauacuu

SEQ ID NO: 2041011 - RNA, 16 nt, Staphylococcus aureus subsp. aureus Mu50
uaucauaugaacaaua

SEQ ID NO: 2041012 - RNA, 21 nt, Staphylococcus aureus subsp. aureus Mu50
uauccaaaauccugaaauuaa

SEQ ID NO: 2041013 - RNA, 20 nt, Staphylococcus aureus subsp. aureus Mu50
uauccaaggauguuauaaaa

SEQ ID NO: 2041014 - RNA, 14 nt, Staphylococcus aureus subsp. aureus Mu50
uauuaacgcaaaaa

SEQ ID NO: 2041015 - RNA, 15 nt, Staphylococcus aureus subsp. aureus Mu50
uauuaacugaccuaa

SEQ ID NO: 2041016 - RNA, 17 nt, Staphylococcus aureus subsp. aureus Mu50
uauuaacuguuuaucca

SEQ ID NO: 2041017 - RNA, 18 nt, Staphylococcus aureus subsp. aureus Mu50
uauuaacuuuuccuuguu

SEQ ID NO: 2041018 - RNA, 13 nt, Staphylococcus aureus subsp. aureus Mu50
uauuaauauuagu

SEQ ID NO: 2041019 - RNA, 17 nt, Staphylococcus aureus subsp. aureus Mu50
uauuaagucuagcauua

SEQ ID NO: 2041020 - RNA, 16 nt, Staphylococcus aureus subsp. aureus Mu50
uauuaagugaguuuua

SEQ ID NO: 2041021 - RNA, 13 nt, Staphylococcus aureus subsp. aureus Mu50
uauguuuguuaug

SEQ ID NO: 2041022 - RNA, 22 nt, Staphylococcus aureus subsp. aureus Mu50
uauuaaacacgcgguaaaacga

SEQ ID NO: 2041023 - RNA, 15 nt, Staphylococcus aureus subsp. aureus Mu50
uauuaaauuauuguu

SEQ ID NO: 2041024 - RNA, 20 nt, Staphylococcus aureus subsp. aureus Mu50
uauuaaaguaaaauauacuu

SEQ ID NO: 2041025 - RNA, 13 nt, Staphylococcus aureus subsp. aureus Mu50
uauuaaauaaucg

SEQ ID NO: 2041026 - RNA, 23 nt, Staphylococcus aureus subsp. aureus Mu50
uauguuacuuauauauucaauaa

SEQ ID NO: 2041027 - RNA, 22 nt, Staphylococcus aureus subsp. aureus Mu50
uaugucucggggcagaucauaa

SEQ ID NO: 2041028 - RNA, 14 nt, Staphylococcus aureus subsp. aureus Mu50
uaugugacauacca

SEQ ID NO: 2041029 - RNA, 14 nt, Staphylococcus aureus subsp. aureus Mu50
uaugugauuaauuu

SEQ ID NO: 2041030 - RNA, 21 nt, Staphylococcus aureus subsp. aureus Mu50
uaugugcagcuugaucuaaau

SEQ ID NO: 2041031 - RNA, 13 nt, Staphylococcus aureus subsp. aureus Mu50
uauguuguuucua

SEQ ID NO: 2041032 - RNA, 18 nt, Staphylococcus aureus subsp. aureus Mu50
uauguucgauuauucuua

SEQ ID NO: 2041033 - RNA, 22 nt, Staphylococcus aureus subsp. aureus Mu50
uauguucagaaauuuaauauug

SEQ ID NO: 2041034 - RNA, 18 nt, Staphylococcus aureus subsp. aureus Mu50
uauguuuaucuacugaug

SEQ ID NO: 2041035 - RNA, 15 nt, Staphylococcus aureus subsp. aureus Mu50
uauguugcuuaucaa

SEQ ID NO: 2041036 - RNA, 23 nt, Staphylococcus aureus subsp. aureus Mu50
uauggcgcaauuuuuaacaaaau

SEQ ID NO: 2041037 - RNA, 17 nt, Staphylococcus aureus subsp. aureus Mu50
uauggcacaaaugaaug

SEQ ID NO: 2041038 - RNA, 13 nt, Staphylococcus aureus subsp. aureus Mu50
uauggauuucuua

SEQ ID NO: 2041039 - RNA, 23 nt, Staphylococcus aureus subsp. aureus Mu50
uauguaacauaaagcuguuuauu

SEQ ID NO: 2041040 - RNA, 16 nt, Staphylococcus aureus subsp. aureus Mu50
uaugacguaauuaaua

SEQ ID NO: 2041041 - RNA, 20 nt, Staphylococcus aureus subsp. aureus Mu50
uaugacggugaaaguucauu

SEQ ID NO: 2041042 - RNA, 13 nt, Staphylococcus aureus subsp. aureus Mu50
uaugaaucauuuu

SEQ ID NO: 2041043 - RNA, 14 nt, Staphylococcus aureus subsp. aureus Mu50
uaugaaucauuuua

SEQ ID NO: 2041044 - RNA, 21 nt, Staphylococcus aureus subsp. aureus Mu50
uaugaauugaguauuaaauuu

SEQ ID NO: 2041045 - RNA, 18 nt, Staphylococcus aureus subsp. aureus Mu50
uaugacuuauuuuucauc

SEQ ID NO: 2041046 - RNA, 23 nt, Staphylococcus aureus subsp. aureus Mu50
uaugauaaauauuguguuuagga

SEQ ID NO: 2041047 - RNA, 15 nt, Staphylococcus aureus subsp. aureus Mu50
uaugauaaccaaacc

SEQ ID NO: 2041048 - RNA, 17 nt, Staphylococcus aureus subsp. aureus Mu50
uauucauaauauauuaa

SEQ ID NO: 2041049 - RNA, 21 nt, Staphylococcus aureus subsp. aureus Mu50
uauucauaauaucgaugacuu

SEQ ID NO: 2041050 - RNA, 19 nt, Staphylococcus aureus subsp. aureus Mu50
uauucacgcguucaaaugu

SEQ ID NO: 2041051 - RNA, 15 nt, Staphylococcus aureus subsp. aureus Mu50
uauucaucucuuaua

SEQ ID NO: 2041052 - RNA, 15 nt, Staphylococcus aureus subsp. aureus Mu50
uauucccaaaaugau

SEQ ID NO: 2041053 - RNA, 18 nt, Staphylococcus aureus subsp. aureus Mu50
uauuauuuuaauagcauu

SEQ ID NO: 2041054 - RNA, 19 nt, Staphylococcus aureus subsp. aureus Mu50
uauuauuuaaauuuucauc

SEQ ID NO: 2041055 - RNA, 15 nt, Staphylococcus aureus subsp. aureus Mu50
uauuauuauaauuuu

SEQ ID NO: 2041056 - RNA, 13 nt, Staphylococcus aureus subsp. aureus Mu50
uauuauugucauc

SEQ ID NO: 2041057 - RNA, 19 nt, Staphylococcus aureus subsp. aureus Mu50
uauuaaugauugacgauuu

SEQ ID NO: 2041058 - RNA, 18 nt, Staphylococcus aureus subsp. aureus Mu50
uauuaauguuugaugauu

SEQ ID NO: 2041059 - RNA, 23 nt, Staphylococcus aureus subsp. aureus Mu50
uauuaauugaauugauuauaaug

SEQ ID NO: 2041060 - RNA, 16 nt, Staphylococcus aureus subsp. aureus Mu50
uauuauuacuuaucug

SEQ ID NO: 2041061 - RNA, 15 nt, Staphylococcus aureus subsp. aureus Mu50
uauuauucucucauu

SEQ ID NO: 2041062 - RNA, 17 nt, Staphylococcus aureus subsp. aureus Mu50
uauuauuggauuugaag

SEQ ID NO: 2041063 - RNA, 14 nt, Staphylococcus aureus subsp. aureus Mu50
uauucaaaucauaa

SEQ ID NO: 2041064 - RNA, 15 nt, Staphylococcus aureus subsp. aureus Mu50
uauucaacuuauuau

SEQ ID NO: 2041065 - RNA, 16 nt, Staphylococcus aureus subsp. aureus Mu50
uauucaacuuauuauu

SEQ ID NO: 2041066 - RNA, 17 nt, Staphylococcus aureus subsp. aureus Mu50
uauuauucauaauauau

SEQ ID NO: 2041067 - RNA, 15 nt, Staphylococcus aureus subsp. aureus Mu50
uauucaauuguaaau

SEQ ID NO: 2041068 - RNA, 15 nt, Staphylococcus aureus subsp. aureus Mu50
uauucauaucauuag

SEQ ID NO: 2041069 - RNA, 19 nt, Staphylococcus aureus subsp. aureus Mu50
uauucgaacgauauuuuaa

SEQ ID NO: 2041070 - RNA, 17 nt, Staphylococcus aureus subsp. aureus Mu50
uauucgauaauauaacu

SEQ ID NO: 2041071 - RNA, 20 nt, Staphylococcus aureus subsp. aureus Mu50
uauucguuaacaaucaguaa

SEQ ID NO: 2041072 - RNA, 16 nt, Staphylococcus aureus subsp. aureus Mu50
uauucuaaaaaauuaa

SEQ ID NO: 2041073 - RNA, 15 nt, Staphylococcus aureus subsp. aureus Mu50
uauucuauuuuucaa

SEQ ID NO: 2041074 - RNA, 14 nt, Staphylococcus aureus subsp. aureus Mu50
uauucuaauacaaa

SEQ ID NO: 2041075 - RNA, 15 nt, Staphylococcus aureus subsp. aureus Mu50
uauucuaaucuaaau

SEQ ID NO: 2041076 - RNA, 16 nt, Staphylococcus aureus subsp. aureus Mu50
uauugcguuuaauuua

SEQ ID NO: 2041077 - RNA, 22 nt, Staphylococcus aureus subsp. aureus Mu50
uauuguaaucacuaucuguugu

SEQ ID NO: 2041078 - RNA, 15 nt, Staphylococcus aureus subsp. aureus Mu50
uauugucgacuuuua

SEQ ID NO: 2041079 - RNA, 20 nt, Staphylococcus aureus subsp. aureus Mu50
uagauguugaugaaguaguu

SEQ ID NO: 2041080 - RNA, 21 nt, Staphylococcus aureus subsp. aureus Mu50
uagauugauuguauuuuucaa

SEQ ID NO: 2041081 - RNA, 17 nt, Staphylococcus aureus subsp. aureus Mu50
uagauuuaucaccuuua

SEQ ID NO: 2041082 - RNA, 19 nt, Staphylococcus aureus subsp. aureus Mu50
uagauuucaugauguuaag

SEQ ID NO: 2041083 - RNA, 19 nt, Staphylococcus aureus subsp. aureus Mu50
uagaucaauauucuaugcu

SEQ ID NO: 2041084 - RNA, 14 nt, Staphylococcus aureus subsp. aureus Mu50
uagauauagcaucu

SEQ ID NO: 2041085 - RNA, 20 nt, Staphylococcus aureus subsp. aureus Mu50
uagauggacaguuuuuauau

SEQ ID NO: 2041086 - RNA, 12 nt, Staphylococcus aureus subsp. aureus Mu50
uagaugauauuu

SEQ ID NO: 2041087 - RNA, 22 nt, Staphylococcus aureus subsp. aureus Mu50
uagccugaaauagaaaugucau

SEQ ID NO: 2041088 - RNA, 16 nt, Staphylococcus aureus subsp. aureus Mu50
uagcuauauuuuugua

SEQ ID NO: 2041089 - RNA, 17 nt, Staphylococcus aureus subsp. aureus Mu50
uagcucaaaacaauuua

SEQ ID NO: 2041090 - RNA, 18 nt, Staphylococcus aureus subsp. aureus Mu50
uagcucaaaacaauuuaa

SEQ ID NO: 2041091 - RNA, 12 nt, Staphylococcus aureus subsp. aureus Mu50
uagcuaaugcau

SEQ ID NO: 2041092 - RNA, 17 nt, Staphylococcus aureus subsp. aureus Mu50
uaggggcuuuuaugcau

SEQ ID NO: 2041093 - RNA, 20 nt, Staphylococcus aureus subsp. aureus Mu50
uagcuggcuuuuuaauuguu

SEQ ID NO: 2041094 - RNA, 19 nt, Staphylococcus aureus subsp. aureus Mu50
uagcuucuuaaaucaacau

SEQ ID NO: 2041095 - RNA, 14 nt, Staphylococcus aureus subsp. aureus Mu50
uagcuugaauaaua

SEQ ID NO: 2041096 - RNA, 18 nt, Staphylococcus aureus subsp. aureus Mu50
uagcuugagcaucuuuua

SEQ ID NO: 2041097 - RNA, 22 nt, Staphylococcus aureus subsp. aureus Mu50
uagcuuaauaauuaauaagcau

SEQ ID NO: 2041098 - RNA, 16 nt, Staphylococcus aureus subsp. aureus Mu50
uaggaccuacaauuuu

SEQ ID NO: 2041099 - RNA, 13 nt, Staphylococcus aureus subsp. aureus Mu50
uaggcauaaugaa

SEQ ID NO: 2041100 - RNA, 15 nt, Staphylococcus aureus subsp. aureus Mu50
uaggcaggaaugaua

SEQ ID NO: 2041101 - RNA, 18 nt, Staphylococcus aureus subsp. aureus Mu50
uaggauguucaucaacau

SEQ ID NO: 2041102 - RNA, 13 nt, Staphylococcus aureus subsp. aureus Mu50
uacuguuuaaaua

SEQ ID NO: 2041103 - RNA, 21 nt, Staphylococcus aureus subsp. aureus Mu50
uacuguuuaaauaaaauuguu

SEQ ID NO: 2041104 - RNA, 15 nt, Staphylococcus aureus subsp. aureus Mu50
uacuguauaagugcu

SEQ ID NO: 2041105 - RNA, 20 nt, Staphylococcus aureus subsp. aureus Mu50
uacuuaccuuucaaauauau

SEQ ID NO: 2041106 - RNA, 17 nt, Staphylococcus aureus subsp. aureus Mu50
uacuuaucuguagauua

SEQ ID NO: 2041107 - RNA, 17 nt, Staphylococcus aureus subsp. aureus Mu50
uacuuauuucuuuucau

SEQ ID NO: 2041108 - RNA, 18 nt, Staphylococcus aureus subsp. aureus Mu50
uacuuaaagcuaguaaug

SEQ ID NO: 2041109 - RNA, 23 nt, Staphylococcus aureus subsp. aureus Mu50
uacucuucguuuuaauaaagcac

SEQ ID NO: 2041110 - RNA, 17 nt, Staphylococcus aureus subsp. aureus Mu50
uacuucaccaucuuuaa

SEQ ID NO: 2041111 - RNA, 14 nt, Staphylococcus aureus subsp. aureus Mu50
uacuucucaauuua

SEQ ID NO: 2041112 - RNA, 13 nt, Staphylococcus aureus subsp. aureus Mu50
uagaaacacuuuu

SEQ ID NO: 2041113 - RNA, 19 nt, Staphylococcus aureus subsp. aureus Mu50
uagaaauaaucacauuaau

SEQ ID NO: 2041114 - RNA, 13 nt, Staphylococcus aureus subsp. aureus Mu50
uagaauaaacuuu

SEQ ID NO: 2041115 - RNA, 15 nt, Staphylococcus aureus subsp. aureus Mu50
uacguaucaagaaaa

SEQ ID NO: 2041116 - RNA, 17 nt, Staphylococcus aureus subsp. aureus Mu50
uacgucauaaaauacca

SEQ ID NO: 2041117 - RNA, 18 nt, Staphylococcus aureus subsp. aureus Mu50
uacuaacucgaagucagc

SEQ ID NO: 2041118 - RNA, 15 nt, Staphylococcus aureus subsp. aureus Mu50
uacuaacugaagaca

SEQ ID NO: 2041119 - RNA, 16 nt, Staphylococcus aureus subsp. aureus Mu50
uacguuuaauaauggu

SEQ ID NO: 2041120 - RNA, 15 nt, Staphylococcus aureus subsp. aureus Mu50
uacguuuuaaauaaa

SEQ ID NO: 2041121 - RNA, 13 nt, Staphylococcus aureus subsp. aureus Mu50
uacuaaaccgauu

SEQ ID NO: 2041122 - RNA, 15 nt, Staphylococcus aureus subsp. aureus Mu50
uacgguuauggugug

SEQ ID NO: 2041123 - RNA, 19 nt, Staphylococcus aureus subsp. aureus Mu50
uaccucgaaauuacuguua

SEQ ID NO: 2041124 - RNA, 13 nt, Staphylococcus aureus subsp. aureus Mu50
uaccucuugauaa

SEQ ID NO: 2041125 - RNA, 20 nt, Staphylococcus aureus subsp. aureus Mu50
uaccuuaucaguguaaguuu

SEQ ID NO: 2041126 - RNA, 14 nt, Staphylococcus aureus subsp. aureus Mu50
uaccuuuaauuguu

SEQ ID NO: 2041127 - RNA, 17 nt, Staphylococcus aureus subsp. aureus Mu50
uaccuuuacuuucauua

SEQ ID NO: 2041128 - RNA, 22 nt, Staphylococcus aureus subsp. aureus Mu50
uacgaaaucaaaaauaauuaug

SEQ ID NO: 2041129 - RNA, 20 nt, Staphylococcus aureus subsp. aureus Mu50
uacgaaguuucauguuugau

SEQ ID NO: 2041130 - RNA, 16 nt, Staphylococcus aureus subsp. aureus Mu50
uaccuauuaauaucau

SEQ ID NO: 2041131 - RNA, 21 nt, Staphylococcus aureus subsp. aureus Mu50
uaccaaacaauacauaauggu

SEQ ID NO: 2041132 - RNA, 19 nt, Staphylococcus aureus subsp. aureus Mu50
uaccaacaagguucuaaau

SEQ ID NO: 2041133 - RNA, 20 nt, Staphylococcus aureus subsp. aureus Mu50
uacauuuuuauacaacuuca

SEQ ID NO: 2041134 - RNA, 16 nt, Staphylococcus aureus subsp. aureus Mu50
uaccaaaaacauuaac

SEQ ID NO: 2041135 - RNA, 14 nt, Staphylococcus aureus subsp. aureus Mu50
uaccaaaaaguauu

SEQ ID NO: 2041136 - RNA, 24 nt, Staphylococcus aureus subsp. aureus Mu50
uacauugguuuuuacuauaauaau

SEQ ID NO: 2041137 - RNA, 14 nt, Staphylococcus aureus subsp. aureus Mu50
uacauuguaaauau

SEQ ID NO: 2041138 - RNA, 23 nt, Staphylococcus aureus subsp. aureus Mu50
uacauuuauuuucaauaaauaaa

SEQ ID NO: 2041139 - RNA, 22 nt, Staphylococcus aureus subsp. aureus Mu50
uacauuuuaauaaaaucaucuu

SEQ ID NO: 2041140 - RNA, 20 nt, Staphylococcus aureus subsp. aureus Mu50
uacauuuucaaaaccaauua

SEQ ID NO: 2041141 - RNA, 16 nt, Staphylococcus aureus subsp. aureus Mu50
uacaucuaauaaauau

SEQ ID NO: 2041142 - RNA, 17 nt, Staphylococcus aureus subsp. aureus Mu50
uacauuacauauaucaa

SEQ ID NO: 2041143 - RNA, 22 nt, Staphylococcus aureus subsp. aureus Mu50
uccuggaaucgaaaauaucaau

SEQ ID NO: 2041144 - RNA, 22 nt, Staphylococcus aureus subsp. aureus Mu50
uccuuuuuaguaguuuauauca

SEQ ID NO: 2041145 - RNA, 13 nt, Staphylococcus aureus subsp. aureus Mu50
uccuuuauauuua

SEQ ID NO: 2041146 - RNA, 14 nt, Staphylococcus aureus subsp. aureus Mu50
uccuuugauguuca

SEQ ID NO: 2041147 - RNA, 18 nt, Staphylococcus aureus subsp. aureus Mu50
uccuuggugucgaaauug

SEQ ID NO: 2041148 - RNA, 23 nt, Staphylococcus aureus subsp. aureus Mu50
uccuuguuggucugauuuugcau

SEQ ID NO: 2041149 - RNA, 20 nt, Staphylococcus aureus subsp. aureus Mu50
ucgaacauaaauaaacuuua

SEQ ID NO: 2041150 - RNA, 22 nt, Staphylococcus aureus subsp. aureus Mu50
ucgaaauauuuauucgcuuguu

SEQ ID NO: 2041151 - RNA, 14 nt, Staphylococcus aureus subsp. aureus Mu50
uccucuauuguauc

SEQ ID NO: 2041152 - RNA, 20 nt, Staphylococcus aureus subsp. aureus Mu50
uccugcuuauuaauuguugg

SEQ ID NO: 2041153 - RNA, 17 nt, Staphylococcus aureus subsp. aureus Mu50
ucgaauaacuguuuauc

SEQ ID NO: 2041154 - RNA, 21 nt, Staphylococcus aureus subsp. aureus Mu50
ucgaacuaguacgaaaugcaa

SEQ ID NO: 2041155 - RNA, 16 nt, Staphylococcus aureus subsp. aureus Mu50
ucgaacuaucaauaua

SEQ ID NO: 2041156 - RNA, 14 nt, Staphylococcus aureus subsp. aureus Mu50
ucgaacuuuuguuc

SEQ ID NO: 2041157 - RNA, 16 nt, Staphylococcus aureus subsp. aureus Mu50
ucgaacuuuuguucua

SEQ ID NO: 2041158 - RNA, 13 nt, Staphylococcus aureus subsp. aureus Mu50
ucgacaucuagau

SEQ ID NO: 2041159 - RNA, 15 nt, Staphylococcus aureus subsp. aureus Mu50
uccguuuuauauuua

SEQ ID NO: 2041160 - RNA, 17 nt, Staphylococcus aureus subsp. aureus Mu50
uccuaauaaauaucuua

SEQ ID NO: 2041161 - RNA, 16 nt, Staphylococcus aureus subsp. aureus Mu50
uccuaauuuuucucca

SEQ ID NO: 2041162 - RNA, 12 nt, Staphylococcus aureus subsp. aureus Mu50
uccggaacaaua

SEQ ID NO: 2041163 - RNA, 17 nt, Staphylococcus aureus subsp. aureus Mu50
ucccuucaaaguagaca

SEQ ID NO: 2041164 - RNA, 19 nt, Staphylococcus aureus subsp. aureus Mu50
ucccuuaaauacaauuucu

SEQ ID NO: 2041165 - RNA, 21 nt, Staphylococcus aureus subsp. aureus Mu50
ucccuuaaauacaauuucuuc

SEQ ID NO: 2041166 - RNA, 22 nt, Staphylococcus aureus subsp. aureus Mu50
ucccuuaaaucaaguauaucuu

SEQ ID NO: 2041167 - RNA, 17 nt, Staphylococcus aureus subsp. aureus Mu50
ucccuuaauaauaagua

SEQ ID NO: 2041168 - RNA, 20 nt, Staphylococcus aureus subsp. aureus Mu50
uccgacuugauaaaaaauga

SEQ ID NO: 2041169 - RNA, 12 nt, Staphylococcus aureus subsp. aureus Mu50
uccgacuuuuga

SEQ ID NO: 2041170 - RNA, 19 nt, Staphylococcus aureus subsp. aureus Mu50
uccgacuuuugauuuugaa

SEQ ID NO: 2041171 - RNA, 16 nt, Staphylococcus aureus subsp. aureus Mu50
uccgcaucuuuugguu

SEQ ID NO: 2041172 - RNA, 16 nt, Staphylococcus aureus subsp. aureus Mu50
uccaagaaucucuauc

SEQ ID NO: 2041173 - RNA, 20 nt, Staphylococcus aureus subsp. aureus Mu50
uccaagaaucucuaucauau

SEQ ID NO: 2041174 - RNA, 18 nt, Staphylococcus aureus subsp. aureus Mu50
uccaagagaauuaauaau

SEQ ID NO: 2041175 - RNA, 16 nt, Staphylococcus aureus subsp. aureus Mu50
uccaagcaucauugaa

SEQ ID NO: 2041176 - RNA, 13 nt, Staphylococcus aureus subsp. aureus Mu50
uccacggcauuua

SEQ ID NO: 2041177 - RNA, 13 nt, Staphylococcus aureus subsp. aureus Mu50
uccacgcucacau

SEQ ID NO: 2041178 - RNA, 16 nt, Staphylococcus aureus subsp. aureus Mu50
uccacgcucacauuaa

SEQ ID NO: 2041179 - RNA, 21 nt, Staphylococcus aureus subsp. aureus Mu50
ucagucucuaaaacuuuuuca

SEQ ID NO: 2041180 - RNA, 22 nt, Staphylococcus aureus subsp. aureus Mu50
ucaucaauaaauauugauucua

SEQ ID NO: 2041181 - RNA, 11 nt, Staphylococcus aureus subsp. aureus Mu50
ucaucacuaug

SEQ ID NO: 2041182 - RNA, 21 nt, Staphylococcus aureus subsp. aureus Mu50
ucauaaaugacugaauuaaua

SEQ ID NO: 2041183 - RNA, 20 nt, Staphylococcus aureus subsp. aureus Mu50
ucauaaaaaucauaaauaac

SEQ ID NO: 2041184 - RNA, 16 nt, Staphylococcus aureus subsp. aureus Mu50
ucauaaucauaaaaau

SEQ ID NO: 2041185 - RNA, 15 nt, Staphylococcus aureus subsp. aureus Mu50
ucauaauaauucagu

SEQ ID NO: 2041186 - RNA, 22 nt, Staphylococcus aureus subsp. aureus Mu50
ucaguugagucaauuucuuuaa

SEQ ID NO: 2041187 - RNA, 17 nt, Staphylococcus aureus subsp. aureus Mu50
ucaguuagaagaugauu

SEQ ID NO: 2041188 - RNA, 16 nt, Staphylococcus aureus subsp. aureus Mu50
ucaugcauaagaaaua

SEQ ID NO: 2041189 - RNA, 16 nt, Staphylococcus aureus subsp. aureus Mu50
ucaugcauaaucauca

SEQ ID NO: 2041190 - RNA, 20 nt, Staphylococcus aureus subsp. aureus Mu50
ucaugcaaaacuaaucaaau

SEQ ID NO: 2041191 - RNA, 13 nt, Staphylococcus aureus subsp. aureus Mu50
ucaugcaaaauaa

SEQ ID NO: 2041192 - RNA, 16 nt, Staphylococcus aureus subsp. aureus Mu50
ucaugagcacaaacua

SEQ ID NO: 2041193 - RNA, 14 nt, Staphylococcus aureus subsp. aureus Mu50
ucaugaauuuucau

SEQ ID NO: 2041194 - RNA, 22 nt, Staphylococcus aureus subsp. aureus Mu50
ucaucguuaucuuuaaguaauu

SEQ ID NO: 2041195 - RNA, 19 nt, Staphylococcus aureus subsp. aureus Mu50
ucaucauuguaaaacaaau

SEQ ID NO: 2041196 - RNA, 13 nt, Staphylococcus aureus subsp. aureus Mu50
ucaucauguuuau

SEQ ID NO: 2041197 - RNA, 13 nt, Staphylococcus aureus subsp. aureus Mu50
ucaucauguucua

SEQ ID NO: 2041198 - RNA, 18 nt, Staphylococcus aureus subsp. aureus Mu50
ucaugggcaguaauuuuc

SEQ ID NO: 2041199 - RNA, 17 nt, Staphylococcus aureus subsp. aureus Mu50
ucauggggcuuaugcau

SEQ ID NO: 2041200 - RNA, 14 nt, Staphylococcus aureus subsp. aureus Mu50
ucauucacaaugau

SEQ ID NO: 2041201 - RNA, 23 nt, Staphylococcus aureus subsp. aureus Mu50
ucauguccaucuuuuauuaaaga

SEQ ID NO: 2041202 - RNA, 16 nt, Staphylococcus aureus subsp. aureus Mu50
ucaugugucauaaucc

SEQ ID NO: 2041203 - RNA, 18 nt, Staphylococcus aureus subsp. aureus Mu50
ucauucuagcaucgaugu

SEQ ID NO: 2041204 - RNA, 22 nt, Staphylococcus aureus subsp. aureus Mu50
ucauugaucgauuguuuauuag

SEQ ID NO: 2041205 - RNA, 17 nt, Staphylococcus aureus subsp. aureus Mu50
ucauucuguguaaauau

SEQ ID NO: 2041206 - RNA, 21 nt, Staphylococcus aureus subsp. aureus Mu50
ucauucuaguagcuagaacag

SEQ ID NO: 2041207 - RNA, 21 nt, Staphylococcus aureus subsp. aureus Mu50
ucauucucgauaacuuacuau

SEQ ID NO: 2041208 - RNA, 17 nt, Staphylococcus aureus subsp. aureus Mu50
uccaaaacaaaaauaau

SEQ ID NO: 2041209 - RNA, 18 nt, Staphylococcus aureus subsp. aureus Mu50
ucacgauuaauaaaauuc

SEQ ID NO: 2041210 - RNA, 19 nt, Staphylococcus aureus subsp. aureus Mu50
ucacgauuuuuaaaaugcu

SEQ ID NO: 2041211 - RNA, 22 nt, Staphylococcus aureus subsp. aureus Mu50
ucaccuuuagacaauauuuuua

SEQ ID NO: 2041212 - RNA, 16 nt, Staphylococcus aureus subsp. aureus Mu50
uauuuucaaugauuaa

SEQ ID NO: 2041213 - RNA, 15 nt, Staphylococcus aureus subsp. aureus Mu50
uauuuucaauaaaua

SEQ ID NO: 2041214 - RNA, 12 nt, Staphylococcus aureus subsp. aureus Mu50
uauuuuaauagc

SEQ ID NO: 2041215 - RNA, 14 nt, Staphylococcus aureus subsp. aureus Mu50
uauuuguuuauuag

SEQ ID NO: 2041216 - RNA, 23 nt, Staphylococcus aureus subsp. aureus Mu50
uauuuggguaacauuagcauuaa

SEQ ID NO: 2041217 - RNA, 13 nt, Staphylococcus aureus subsp. aureus Mu50
uauuugucuuuga

SEQ ID NO: 2041218 - RNA, 14 nt, Staphylococcus aureus subsp. aureus Mu50
uauuugaaaauauu

SEQ ID NO: 2041219 - RNA, 21 nt, Staphylococcus aureus subsp. aureus Mu50
uauuuuaaauuacaacuuuua

SEQ ID NO: 2041220 - RNA, 18 nt, Staphylococcus aureus subsp. aureus Mu50
uauuucuugcuucauuga

SEQ ID NO: 2041221 - RNA, 17 nt, Staphylococcus aureus subsp. aureus Mu50
uauuucuuuucauuauc

SEQ ID NO: 2041222 - RNA, 15 nt, Staphylococcus aureus subsp. aureus Mu50
uauuugaucguugaa

SEQ ID NO: 2041223 - RNA, 21 nt, Staphylococcus aureus subsp. aureus Mu50
uauuugauuauucuucauuua

SEQ ID NO: 2041224 - RNA, 18 nt, Staphylococcus aureus subsp. aureus Mu50
uauuugccuuuugaauaa

SEQ ID NO: 2041225 - RNA, 14 nt, Staphylococcus aureus subsp. aureus Mu50
uauuugcuuuuugu

SEQ ID NO: 2041226 - RNA, 21 nt, Staphylococcus aureus subsp. aureus Mu50
uauuuaaauuuucaucauaau

SEQ ID NO: 2041227 - RNA, 19 nt, Staphylococcus aureus subsp. aureus Mu50
uauuuaaaggguguuuaga

SEQ ID NO: 2041228 - RNA, 11 nt, Staphylococcus aureus subsp. aureus Mu50
uauuguuuuca

SEQ ID NO: 2041229 - RNA, 20 nt, Staphylococcus aureus subsp. aureus Mu50
uauuuaaaaugcuuguucaa

SEQ ID NO: 2041230 - RNA, 16 nt, Staphylococcus aureus subsp. aureus Mu50
uauuucugaaaugaua

SEQ ID NO: 2041231 - RNA, 15 nt, Staphylococcus aureus subsp. aureus Mu50
uauuucugaauuuuu

SEQ ID NO: 2041232 - RNA, 14 nt, Staphylococcus aureus subsp. aureus Mu50
uauuucugggcuuu

SEQ ID NO: 2041233 - RNA, 14 nt, Staphylococcus aureus subsp. aureus Mu50
uauuuaauguuuua

SEQ ID NO: 2041234 - RNA, 16 nt, Staphylococcus aureus subsp. aureus Mu50
uauuuaaucuuaauau

SEQ ID NO: 2041235 - RNA, 18 nt, Staphylococcus aureus subsp. aureus Mu50
uauuuaaucuuaauauug

SEQ ID NO: 2041236 - RNA, 21 nt, Staphylococcus aureus subsp. aureus Mu50
uauuuaaucuuaauauugauu

SEQ ID NO: 2041237 - RNA, 19 nt, Staphylococcus aureus subsp. aureus Mu50
ucacuugcgucguuuauua

SEQ ID NO: 2041238 - RNA, 22 nt, Staphylococcus aureus subsp. aureus Mu50
ucacugcuguucuuuuuauuua

SEQ ID NO: 2041239 - RNA, 20 nt, Staphylococcus aureus subsp. aureus Mu50
ugcuagcuuucuuuuucauc

SEQ ID NO: 2041240 - RNA, 15 nt, Staphylococcus aureus subsp. aureus Mu50
ugcuaaaauaucaaa

SEQ ID NO: 2041241 - RNA, 16 nt, Staphylococcus aureus subsp. aureus Mu50
ugcuaaaaaaauuaaa

SEQ ID NO: 2041242 - RNA, 20 nt, Staphylococcus aureus subsp. aureus Mu50
ugcuaaaaauauugaauaau

SEQ ID NO: 2041243 - RNA, 24 nt, Staphylococcus aureus subsp. aureus Mu50
ugcuauauuuaguuaauuauuuag

SEQ ID NO: 2041244 - RNA, 16 nt, Staphylococcus aureus subsp. aureus Mu50
ugcguugguauucauc

SEQ ID NO: 2041245 - RNA, 18 nt, Staphylococcus aureus subsp. aureus Mu50
ugcgugcuuaauuacaau

SEQ ID NO: 2041246 - RNA, 23 nt, Staphylococcus aureus subsp. aureus Mu50
ugcucuaaacuucuauuaauaau

SEQ ID NO: 2041247 - RNA, 18 nt, Staphylococcus aureus subsp. aureus Mu50
ugcucuaauccaaaauaa

SEQ ID NO: 2041248 - RNA, 15 nt, Staphylococcus aureus subsp. aureus Mu50
ugcugaauaaauaac

SEQ ID NO: 2041249 - RNA, 14 nt, Staphylococcus aureus subsp. aureus Mu50
ugcucuuuaacaau

SEQ ID NO: 2041250 - RNA, 18 nt, Staphylococcus aureus subsp. aureus Mu50
ugcugcuguacaauuucg

SEQ ID NO: 2041251 - RNA, 21 nt, Staphylococcus aureus subsp. aureus Mu50
ugcugaucgcauguuuguaaa

SEQ ID NO: 2041252 - RNA, 18 nt, Staphylococcus aureus subsp. aureus Mu50
ugcuggcgcaaugauauc

SEQ ID NO: 2041253 - RNA, 22 nt, Staphylococcus aureus subsp. aureus Mu50
ugcugucaaacaacaaucaaau

SEQ ID NO: 2041254 - RNA, 22 nt, Staphylococcus aureus subsp. aureus Mu50
ugcuguccaucgucaucacuuu

SEQ ID NO: 2041255 - RNA, 23 nt, Staphylococcus aureus subsp. aureus Mu50
ugcuuuaaggaaucguaaagcug

SEQ ID NO: 2041256 - RNA, 12 nt, Staphylococcus aureus subsp. aureus Mu50
ugcuuuaauuug

SEQ ID NO: 2041257 - RNA, 15 nt, Staphylococcus aureus subsp. aureus Mu50
ugcuuuaucaauaau

SEQ ID NO: 2041258 - RNA, 13 nt, Staphylococcus aureus subsp. aureus Mu50
ugcuuuaacugua

SEQ ID NO: 2041259 - RNA, 23 nt, Staphylococcus aureus subsp. aureus Mu50
ugcuuguuuauuacauaauuuau

SEQ ID NO: 2041260 - RNA, 14 nt, Staphylococcus aureus subsp. aureus Mu50
ugcuugguuugauu

SEQ ID NO: 2041261 - RNA, 15 nt, Staphylococcus aureus subsp. aureus Mu50
ugcuucuuaucaaca

SEQ ID NO: 2041262 - RNA, 14 nt, Staphylococcus aureus subsp. aureus Mu50
ugcuucuuuccucu

SEQ ID NO: 2041263 - RNA, 14 nt, Staphylococcus aureus subsp. aureus Mu50
ugcuugaaauuauu

SEQ ID NO: 2041264 - RNA, 18 nt, Staphylococcus aureus subsp. aureus Mu50
ugcuucguuuuuaguguu

SEQ ID NO: 2041265 - RNA, 23 nt, Staphylococcus aureus subsp. aureus Mu50
ugcuuccacuucaucuaaaugau

SEQ ID NO: 2041266 - RNA, 17 nt, Staphylococcus aureus subsp. aureus Mu50
ugcuuaauuuauguguu

SEQ ID NO: 2041267 - RNA, 16 nt, Staphylococcus aureus subsp. aureus Mu50
ugcuguuuuauucaau

SEQ ID NO: 2041268 - RNA, 17 nt, Staphylococcus aureus subsp. aureus Mu50
ugcuguuaauaaaucau

SEQ ID NO: 2041269 - RNA, 20 nt, Staphylococcus aureus subsp. aureus Mu50
ugcgauauacgaauccucau

SEQ ID NO: 2041270 - RNA, 13 nt, Staphylococcus aureus subsp. aureus Mu50
ugcgaguuggggu

SEQ ID NO: 2041271 - RNA, 20 nt, Staphylococcus aureus subsp. aureus Mu50
ugccguaucuauaaaaagaa

SEQ ID NO: 2041272 - RNA, 15 nt, Staphylococcus aureus subsp. aureus Mu50
ugccuuuugaauaau

SEQ ID NO: 2041273 - RNA, 15 nt, Staphylococcus aureus subsp. aureus Mu50
ugccuuugauuuuac

SEQ ID NO: 2041274 - RNA, 14 nt, Staphylococcus aureus subsp. aureus Mu50
ugccauuaaacgaa

SEQ ID NO: 2041275 - RNA, 14 nt, Staphylococcus aureus subsp. aureus Mu50
ugccaucaauuucu

SEQ ID NO: 2041276 - RNA, 19 nt, Staphylococcus aureus subsp. aureus Mu50
ugcagauuuugcaaucuuu

SEQ ID NO: 2041277 - RNA, 20 nt, Staphylococcus aureus subsp. aureus Mu50
ugcagcuugaucuaaaugau

SEQ ID NO: 2041278 - RNA, 21 nt, Staphylococcus aureus subsp. aureus Mu50
ugcauuuugcccaugucauga

SEQ ID NO: 2041279 - RNA, 18 nt, Staphylococcus aureus subsp. aureus Mu50
ugccaaaaaguauucauu

SEQ ID NO: 2041280 - RNA, 15 nt, Staphylococcus aureus subsp. aureus Mu50
ugcauguuuaaauau

SEQ ID NO: 2041281 - RNA, 17 nt, Staphylococcus aureus subsp. aureus Mu50
ugcauguuuaaauauca

SEQ ID NO: 2041282 - RNA, 18 nt, Staphylococcus aureus subsp. aureus Mu50
ugcauguuuaaauaucau

SEQ ID NO: 2041283 - RNA, 20 nt, Staphylococcus aureus subsp. aureus Mu50
ugcauuuaauuuaauuuuag

SEQ ID NO: 2041284 - RNA, 22 nt, Staphylococcus aureus subsp. aureus Mu50
ugcauuacuacuuuauaaauau

SEQ ID NO: 2041285 - RNA, 21 nt, Staphylococcus aureus subsp. aureus Mu50
ugauauugaaaguguaugcau

SEQ ID NO: 2041286 - RNA, 22 nt, Staphylococcus aureus subsp. aureus Mu50
ugauaucacuauacaaucauaa

SEQ ID NO: 2041287 - RNA, 23 nt, Staphylococcus aureus subsp. aureus Mu50
ugauaucgaaacgcuuugcagau

SEQ ID NO: 2041288 - RNA, 23 nt, Staphylococcus aureus subsp. aureus Mu50
ugauauuaccuucaaguuggugu

SEQ ID NO: 2041289 - RNA, 21 nt, Staphylococcus aureus subsp. aureus Mu50
ugauauucgcgaacguuauuu

SEQ ID NO: 2041290 - RNA, 21 nt, Staphylococcus aureus subsp. aureus Mu50
ugauauuuagaauaagaaaua

SEQ ID NO: 2041291 - RNA, 16 nt, Staphylococcus aureus subsp. aureus Mu50
ugauauuucaacuuuu

SEQ ID NO: 2041292 - RNA, 23 nt, Staphylococcus aureus subsp. aureus Mu50
ugauauuucgguuagucuuaauc

SEQ ID NO: 2041293 - RNA, 17 nt, Staphylococcus aureus subsp. aureus Mu50
ugauauagauggcuuuu

SEQ ID NO: 2041294 - RNA, 20 nt, Staphylococcus aureus subsp. aureus Mu50
ugauauagucaaugaauaau

SEQ ID NO: 2041295 - RNA, 23 nt, Staphylococcus aureus subsp. aureus Mu50
ugauauauaacaaguacaauaau

SEQ ID NO: 2041296 - RNA, 13 nt, Staphylococcus aureus subsp. aureus Mu50
ugauagugaauaa

SEQ ID NO: 2041297 - RNA, 16 nt, Staphylococcus aureus subsp. aureus Mu50
ugauagcuaaugcauu

SEQ ID NO: 2041298 - RNA, 19 nt, Staphylococcus aureus subsp. aureus Mu50
ugauagcaccguaacauau

SEQ ID NO: 2041299 - RNA, 21 nt, Staphylococcus aureus subsp. aureus Mu50
ugauagccgcuucauugauga

SEQ ID NO: 2041300 - RNA, 23 nt, Staphylococcus aureus subsp. aureus Mu50
ugauacguacguugauguguugc

SEQ ID NO: 2041301 - RNA, 14 nt, Staphylococcus aureus subsp. aureus Mu50
ugauacugauauuu

SEQ ID NO: 2041302 - RNA, 18 nt, Staphylococcus aureus subsp. aureus Mu50
ugauacugcuucgcuaau

SEQ ID NO: 2041303 - RNA, 16 nt, Staphylococcus aureus subsp. aureus Mu50
ugauacgccuaaauau

SEQ ID NO: 2041304 - RNA, 21 nt, Staphylococcus aureus subsp. aureus Mu50
ugauaauacuguuuaaauaaa

SEQ ID NO: 2041305 - RNA, 16 nt, Staphylococcus aureus subsp. aureus Mu50
ugauaauguaauuguu

SEQ ID NO: 2041306 - RNA, 20 nt, Staphylococcus aureus subsp. aureus Mu50
ugauaauguucccuuaccau

SEQ ID NO: 2041307 - RNA, 13 nt, Staphylococcus aureus subsp. aureus Mu50
ugauaauuuuuag

SEQ ID NO: 2041308 - RNA, 21 nt, Staphylococcus aureus subsp. aureus Mu50
ugauaauuuuucuucuuuuuu

SEQ ID NO: 2041309 - RNA, 23 nt, Staphylococcus aureus subsp. aureus Mu50
ugaggagauaguaucuuauauuc

SEQ ID NO: 2041310 - RNA, 19 nt, Staphylococcus aureus subsp. aureus Mu50
ugaggaauaugaauugcuu

SEQ ID NO: 2041311 - RNA, 17 nt, Staphylococcus aureus subsp. aureus Mu50
ugaggaauaugaauugc

SEQ ID NO: 2041312 - RNA, 19 nt, Staphylococcus aureus subsp. aureus Mu50
ugaguacaacauagaauaa

SEQ ID NO: 2041313 - RNA, 18 nt, Staphylococcus aureus subsp. aureus Mu50
ugaguaucaugcuuuuaa

SEQ ID NO: 2041314 - RNA, 15 nt, Staphylococcus aureus subsp. aureus Mu50
ugaguaugacgaaau

SEQ ID NO: 2041315 - RNA, 15 nt, Staphylococcus aureus subsp. aureus Mu50
ugaguauuaaauuug

SEQ ID NO: 2041316 - RNA, 23 nt, Staphylococcus aureus subsp. aureus Mu50
ugaguauuaaauuugaaaguaaa

SEQ ID NO: 2041317 - RNA, 22 nt, Staphylococcus aureus subsp. aureus Mu50
ugacuagggguuuuuaauauau

SEQ ID NO: 2041318 - RNA, 20 nt, Staphylococcus aureus subsp. aureus Mu50
ugacgugcuuuuaaauguau

SEQ ID NO: 2041319 - RNA, 22 nt, Staphylococcus aureus subsp. aureus Mu50
ugagauacguuauuucaauaau

SEQ ID NO: 2041320 - RNA, 21 nt, Staphylococcus aureus subsp. aureus Mu50
ugacuuuaucaauugaaugaa

SEQ ID NO: 2041321 - RNA, 18 nt, Staphylococcus aureus subsp. aureus Mu50
ugcacuucaaaagaaauu

SEQ ID NO: 2041322 - RNA, 19 nt, Staphylococcus aureus subsp. aureus Mu50
ugcacgucuuguaucaaca

SEQ ID NO: 2041323 - RNA, 22 nt, Staphylococcus aureus subsp. aureus Mu50
ugauuggcuugaaguuguuucu

SEQ ID NO: 2041324 - RNA, 14 nt, Staphylococcus aureus subsp. aureus Mu50
ugauuucacuacca

SEQ ID NO: 2041325 - RNA, 13 nt, Staphylococcus aureus subsp. aureus Mu50
ugauuuaaaaaau

SEQ ID NO: 2041326 - RNA, 19 nt, Staphylococcus aureus subsp. aureus Mu50
ugauuuagcagcgauacgu

SEQ ID NO: 2041327 - RNA, 13 nt, Staphylococcus aureus subsp. aureus Mu50
ugauuuagcauac

SEQ ID NO: 2041328 - RNA, 15 nt, Staphylococcus aureus subsp. aureus Mu50
ugauuuagcauacau

SEQ ID NO: 2041329 - RNA, 17 nt, Staphylococcus aureus subsp. aureus Mu50
ugauuuauucuaaauau

SEQ ID NO: 2041330 - RNA, 19 nt, Staphylococcus aureus subsp. aureus Mu50
ugauuuauucuaaauauau

SEQ ID NO: 2041331 - RNA, 12 nt, Staphylococcus aureus subsp. aureus Mu50
ugcaacauuuug

SEQ ID NO: 2041332 - RNA, 16 nt, Staphylococcus aureus subsp. aureus Mu50
ugcaacauuaaauuau

SEQ ID NO: 2041333 - RNA, 19 nt, Staphylococcus aureus subsp. aureus Mu50
ugcaacaccacacagcauu

SEQ ID NO: 2041334 - RNA, 20 nt, Staphylococcus aureus subsp. aureus Mu50
ugcaacaccugguacauaaa

SEQ ID NO: 2041335 - RNA, 14 nt, Staphylococcus aureus subsp. aureus Mu50
ugcaaauuaucauu

SEQ ID NO: 2041336 - RNA, 21 nt, Staphylococcus aureus subsp. aureus Mu50
ugcaaauuggauaauuucuuc

SEQ ID NO: 2041337 - RNA, 16 nt, Staphylococcus aureus subsp. aureus Mu50
ugcaacuacgauaccg

SEQ ID NO: 2041338 - RNA, 22 nt, Staphylococcus aureus subsp. aureus Mu50
ugaugauaaaaauaaaaccgag

SEQ ID NO: 2041339 - RNA, 18 nt, Staphylococcus aureus subsp. aureus Mu50
ugaugagauaaaaucaua

SEQ ID NO: 2041340 - RNA, 19 nt, Staphylococcus aureus subsp. aureus Mu50
ugaugagauaaaaucauau

SEQ ID NO: 2041341 - RNA, 14 nt, Staphylococcus aureus subsp. aureus Mu50
ugaugaugugcuuu

SEQ ID NO: 2041342 - RNA, 13 nt, Staphylococcus aureus subsp. aureus Mu50
ugaugaaugauug

SEQ ID NO: 2041343 - RNA, 14 nt, Staphylococcus aureus subsp. aureus Mu50
ugaugaaugauugc

SEQ ID NO: 2041344 - RNA, 19 nt, Staphylococcus aureus subsp. aureus Mu50
ugauugcaaauuaucauua

SEQ ID NO: 2041345 - RNA, 16 nt, Staphylococcus aureus subsp. aureus Mu50
ugauugaauguuuggu

SEQ ID NO: 2041346 - RNA, 21 nt, Staphylococcus aureus subsp. aureus Mu50
ugauugaaauccuuaacuuua

SEQ ID NO: 2041347 - RNA, 12 nt, Staphylococcus aureus subsp. aureus Mu50
ugauugaacaau

SEQ ID NO: 2041348 - RNA, 15 nt, Staphylococcus aureus subsp. aureus Mu50
ugauuaaaaaucaaa

SEQ ID NO: 2041349 - RNA, 23 nt, Staphylococcus aureus subsp. aureus Mu50
ugauuaaaaguguugacuuuauc

SEQ ID NO: 2041350 - RNA, 22 nt, Staphylococcus aureus subsp. aureus Mu50
ugauucuucacuaaaaauauau

SEQ ID NO: 2041351 - RNA, 13 nt, Staphylococcus aureus subsp. aureus Mu50
ugauguuacaauc

SEQ ID NO: 2041352 - RNA, 16 nt, Staphylococcus aureus subsp. aureus Mu50
ugaugucauguauugu

SEQ ID NO: 2041353 - RNA, 16 nt, Staphylococcus aureus subsp. aureus Mu50
ugaugucuguacuuuu

SEQ ID NO: 2041354 - RNA, 20 nt, Staphylococcus aureus subsp. aureus Mu50
ugaaacaucuugauauucau

SEQ ID NO: 2041355 - RNA, 22 nt, Staphylococcus aureus subsp. aureus Mu50
ugaaaauuuaaugcguugaugu

SEQ ID NO: 2041356 - RNA, 12 nt, Staphylococcus aureus subsp. aureus Mu50
ugaaaaguaauu

SEQ ID NO: 2041357 - RNA, 17 nt, Staphylococcus aureus subsp. aureus Mu50
ugaaaaugacgugcuuu

SEQ ID NO: 2041358 - RNA, 15 nt, Staphylococcus aureus subsp. aureus Mu50
ugaaaaguugauugc

SEQ ID NO: 2041359 - RNA, 18 nt, Staphylococcus aureus subsp. aureus Mu50
ugaaaaguugauugccau

SEQ ID NO: 2041360 - RNA, 21 nt, Staphylococcus aureus subsp. aureus Mu50
ugaaaauaagcuuguaacaag

SEQ ID NO: 2041361 - RNA, 18 nt, Staphylococcus aureus subsp. aureus Mu50
ugaaaauaccucuacauu

SEQ ID NO: 2041362 - RNA, 17 nt, Staphylococcus aureus subsp. aureus Mu50
ucuuuaauguaauuauu

SEQ ID NO: 2041363 - RNA, 14 nt, Staphylococcus aureus subsp. aureus Mu50
ucuuuaauauaaau

SEQ ID NO: 2041364 - RNA, 22 nt, Staphylococcus aureus subsp. aureus Mu50
ucuuuaagcccuuccccuacaa

SEQ ID NO: 2041365 - RNA, 17 nt, Staphylococcus aureus subsp. aureus Mu50
ucuuuaagcuuaaauag

SEQ ID NO: 2041366 - RNA, 18 nt, Staphylococcus aureus subsp. aureus Mu50
ucuuuaagcuuaaauagu

SEQ ID NO: 2041367 - RNA, 19 nt, Staphylococcus aureus subsp. aureus Mu50
ucuuguuucaaacaaagcu

SEQ ID NO: 2041368 - RNA, 16 nt, Staphylococcus aureus subsp. aureus Mu50
ucuuguucuaauuguu

SEQ ID NO: 2041369 - RNA, 14 nt, Staphylococcus aureus subsp. aureus Mu50
ucuuggugauaguc

SEQ ID NO: 2041370 - RNA, 22 nt, Staphylococcus aureus subsp. aureus Mu50
ucuuuucgaaauucucuuuguu

SEQ ID NO: 2041371 - RNA, 22 nt, Staphylococcus aureus subsp. aureus Mu50
ucuuuaucuauaugcauauauu

SEQ ID NO: 2041372 - RNA, 13 nt, Staphylococcus aureus subsp. aureus Mu50
ucuuuaucauuau

SEQ ID NO: 2041373 - RNA, 18 nt, Staphylococcus aureus subsp. aureus Mu50
ucuuuacuuguaauuaau

SEQ ID NO: 2041374 - RNA, 21 nt, Staphylococcus aureus subsp. aureus Mu50
ucuuuacuuguaauuaauaca

SEQ ID NO: 2041375 - RNA, 15 nt, Staphylococcus aureus subsp. aureus Mu50
ucuuuuguuguuuuu

SEQ ID NO: 2041376 - RNA, 23 nt, Staphylococcus aureus subsp. aureus Mu50
ucuuuuguuuaguauggaauaaa

SEQ ID NO: 2041377 - RNA, 19 nt, Staphylococcus aureus subsp. aureus Mu50
ucuuuugauagcuaaugca

SEQ ID NO: 2041378 - RNA, 13 nt, Staphylococcus aureus subsp. aureus Mu50
ucuuuuguuuuca

SEQ ID NO: 2041379 - RNA, 21 nt, Staphylococcus aureus subsp. aureus Mu50
ucuuuuguuuucacuguuuua

SEQ ID NO: 2041380 - RNA, 13 nt, Staphylococcus aureus subsp. aureus Mu50
ucuuuuuaaaagg

SEQ ID NO: 2041381 - RNA, 13 nt, Staphylococcus aureus subsp. aureus Mu50
ucuuuuucuaaau

SEQ ID NO: 2041382 - RNA, 16 nt, Staphylococcus aureus subsp. aureus Mu50
ucuuuuucuaaauaaa

SEQ ID NO: 2041383 - RNA, 22 nt, Staphylococcus aureus subsp. aureus Mu50
ucuuuuugcguuuuuaaauaau

SEQ ID NO: 2041384 - RNA, 15 nt, Staphylococcus aureus subsp. aureus Mu50
ucuuuuuguuuaucu

SEQ ID NO: 2041385 - RNA, 17 nt, Staphylococcus aureus subsp. aureus Mu50
ucuucugaauuuaauag

SEQ ID NO: 2041386 - RNA, 22 nt, Staphylococcus aureus subsp. aureus Mu50
ucuucucaacaaaucuauaaau

SEQ ID NO: 2041387 - RNA, 21 nt, Staphylococcus aureus subsp. aureus Mu50
ucuucgcgaccguguuguuga

SEQ ID NO: 2041388 - RNA, 23 nt, Staphylococcus aureus subsp. aureus Mu50
ucuugaaaaguuuggcuuuuuau

SEQ ID NO: 2041389 - RNA, 21 nt, Staphylococcus aureus subsp. aureus Mu50
ucuuggacuaauaauugucca

SEQ ID NO: 2041390 - RNA, 17 nt, Staphylococcus aureus subsp. aureus Mu50
ucuucaaacagacuuaa

SEQ ID NO: 2041391 - RNA, 22 nt, Staphylococcus aureus subsp. aureus Mu50
ucuucaacuuuaucuaaaggua

SEQ ID NO: 2041392 - RNA, 17 nt, Staphylococcus aureus subsp. aureus Mu50
ucuuaguuugacaucua

SEQ ID NO: 2041393 - RNA, 22 nt, Staphylococcus aureus subsp. aureus Mu50
ucuuaucuuuaugauaauuaau

SEQ ID NO: 2041394 - RNA, 20 nt, Staphylococcus aureus subsp. aureus Mu50
ucuuaucaguuugcacuuca

SEQ ID NO: 2041395 - RNA, 22 nt, Staphylococcus aureus subsp. aureus Mu50
ucuuaucauaaucuucaguaua

SEQ ID NO: 2041396 - RNA, 12 nt, Staphylococcus aureus subsp. aureus Mu50
ucuuauuauuaa

SEQ ID NO: 2041397 - RNA, 15 nt, Staphylococcus aureus subsp. aureus Mu50
ucuuauuuauucaua

SEQ ID NO: 2041398 - RNA, 17 nt, Staphylococcus aureus subsp. aureus Mu50
ucuucauuaucaauaga

SEQ ID NO: 2041399 - RNA, 13 nt, Staphylococcus aureus subsp. aureus Mu50
ucugcuuuauuuu

SEQ ID NO: 2041400 - RNA, 14 nt, Staphylococcus aureus subsp. aureus Mu50
ucugcuuuaauaua

SEQ ID NO: 2041401 - RNA, 17 nt, Staphylococcus aureus subsp. aureus Mu50
ucuggucugugauauuc

SEQ ID NO: 2041402 - RNA, 17 nt, Staphylococcus aureus subsp. aureus Mu50
ucugguaaaaaaauaac

SEQ ID NO: 2041403 - RNA, 15 nt, Staphylococcus aureus subsp. aureus Mu50
ucuguaauaaagaau

SEQ ID NO: 2041404 - RNA, 20 nt, Staphylococcus aureus subsp. aureus Mu50
ucugguucuuuacuaaagau

SEQ ID NO: 2041405 - RNA, 15 nt, Staphylococcus aureus subsp. aureus Mu50
ucuguaucaaaaucg

SEQ ID NO: 2041406 - RNA, 22 nt, Staphylococcus aureus subsp. aureus Mu50
ucuguauggaugcacuccuauu

SEQ ID NO: 2041407 - RNA, 21 nt, Staphylococcus aureus subsp. aureus Mu50
ucugucuaaaaacauaaaaau

SEQ ID NO: 2041408 - RNA, 22 nt, Staphylococcus aureus subsp. aureus Mu50
ucugugaauaugcuuuuaauag

SEQ ID NO: 2041409 - RNA, 15 nt, Staphylococcus aureus subsp. aureus Mu50
ucuguugcauuaagu

SEQ ID NO: 2041410 - RNA, 13 nt, Staphylococcus aureus subsp. aureus Mu50
ucuguuuaaauuu

SEQ ID NO: 2041411 - RNA, 14 nt, Staphylococcus aureus subsp. aureus Mu50
ucuguuuaaauuua

SEQ ID NO: 2041412 - RNA, 19 nt, Staphylococcus aureus subsp. aureus Mu50
ucuguuuaaauuuaaaaga

SEQ ID NO: 2041413 - RNA, 16 nt, Staphylococcus aureus subsp. aureus Mu50
ucuuaucaauuagcca

SEQ ID NO: 2041414 - RNA, 19 nt, Staphylococcus aureus subsp. aureus Mu50
ucuuaguuuagguugauuu

SEQ ID NO: 2041415 - RNA, 17 nt, Staphylococcus aureus subsp. aureus Mu50
ucuuacuacuuaauuaa

SEQ ID NO: 2041416 - RNA, 19 nt, Staphylococcus aureus subsp. aureus Mu50
ucuuacugcuguucucuau

SEQ ID NO: 2041417 - RNA, 22 nt, Staphylococcus aureus subsp. aureus Mu50
ucuuagauuuuauauaaaaaga

SEQ ID NO: 2041418 - RNA, 20 nt, Staphylococcus aureus subsp. aureus Mu50
ucuuacauugauaaaauaau

SEQ ID NO: 2041419 - RNA, 16 nt, Staphylococcus aureus subsp. aureus Mu50
ucuuaaagaauuaagu

SEQ ID NO: 2041420 - RNA, 13 nt, Staphylococcus aureus subsp. aureus Mu50
ucuuaaaucacua

SEQ ID NO: 2041421 - RNA, 22 nt, Staphylococcus aureus subsp. aureus Mu50
ucucuuuuaaauucuuauaaaa

SEQ ID NO: 2041422 - RNA, 20 nt, Staphylococcus aureus subsp. aureus Mu50
ucucuuuuugauuauauuua

SEQ ID NO: 2041423 - RNA, 18 nt, Staphylococcus aureus subsp. aureus Mu50
ucugaaaaaauuaauaau

SEQ ID NO: 2041424 - RNA, 16 nt, Staphylococcus aureus subsp. aureus Mu50
ucugaaaaacuucuua

SEQ ID NO: 2041425 - RNA, 14 nt, Staphylococcus aureus subsp. aureus Mu50
ucugacauuguugc

SEQ ID NO: 2041426 - RNA, 20 nt, Staphylococcus aureus subsp. aureus Mu50
ucugacauuucaucaauaau

SEQ ID NO: 2041427 - RNA, 12 nt, Staphylococcus aureus subsp. aureus Mu50
ucugaaucugaa

SEQ ID NO: 2041428 - RNA, 15 nt, Staphylococcus aureus subsp. aureus Mu50
ucugcaauuucauag

SEQ ID NO: 2041429 - RNA, 20 nt, Staphylococcus aureus subsp. aureus Mu50
ucugauucuucacuaaaaau

SEQ ID NO: 2041430 - RNA, 22 nt, Staphylococcus aureus subsp. aureus Mu50
ucucgucacauauaaauauuuu

SEQ ID NO: 2041431 - RNA, 12 nt, Staphylococcus aureus subsp. aureus Mu50
ucucggcauuuu

SEQ ID NO: 2041432 - RNA, 16 nt, Staphylococcus aureus subsp. aureus Mu50
ucucggcauuuuuaua

SEQ ID NO: 2041433 - RNA, 20 nt, Staphylococcus aureus subsp. aureus Mu50
ucuaaugcuaauuuaacugc

SEQ ID NO: 2041434 - RNA, 20 nt, Staphylococcus aureus subsp. aureus Mu50
ucuaauuguuguaauucuuu

SEQ ID NO: 2041435 - RNA, 22 nt, Staphylococcus aureus subsp. aureus Mu50
ucuaauucguuuugcuaaccau

SEQ ID NO: 2041436 - RNA, 14 nt, Staphylococcus aureus subsp. aureus Mu50
ucuacaacuucauu

SEQ ID NO: 2041437 - RNA, 11 nt, Staphylococcus aureus subsp. aureus Mu50
ucuacagguaa

SEQ ID NO: 2041438 - RNA, 14 nt, Staphylococcus aureus subsp. aureus Mu50
ucguugaauacuuc

SEQ ID NO: 2041439 - RNA, 16 nt, Staphylococcus aureus subsp. aureus Mu50
ucuaucgccuaaaaau

SEQ ID NO: 2041440 - RNA, 18 nt, Staphylococcus aureus subsp. aureus Mu50
ucuaucuucacacuuuua

SEQ ID NO: 2041441 - RNA, 15 nt, Staphylococcus aureus subsp. aureus Mu50
ucuauguacaauaau

SEQ ID NO: 2041442 - RNA, 18 nt, Staphylococcus aureus subsp. aureus Mu50
ucuauguacaauaauuag

SEQ ID NO: 2041443 - RNA, 23 nt, Staphylococcus aureus subsp. aureus Mu50
ucuauuaaacauuuuugaauuua

SEQ ID NO: 2041444 - RNA, 21 nt, Staphylococcus aureus subsp. aureus Mu50
ucuauuaacugaccuaacaau

SEQ ID NO: 2041445 - RNA, 23 nt, Staphylococcus aureus subsp. aureus Mu50
ucuauuaaugcucuauauaucca

SEQ ID NO: 2041446 - RNA, 21 nt, Staphylococcus aureus subsp. aureus Mu50
ucuauuuucugccauaaacau

SEQ ID NO: 2041447 - RNA, 13 nt, Staphylococcus aureus subsp. aureus Mu50
ucuacauuaaaga

SEQ ID NO: 2041448 - RNA, 13 nt, Staphylococcus aureus subsp. aureus Mu50
ucuacccuugcaa

SEQ ID NO: 2041449 - RNA, 21 nt, Staphylococcus aureus subsp. aureus Mu50
ucuaccucuaggauuaaaagc

SEQ ID NO: 2041450 - RNA, 21 nt, Staphylococcus aureus subsp. aureus Mu50
ucuacuaagugccauugaaaa

SEQ ID NO: 2041451 - RNA, 19 nt, Staphylococcus aureus subsp. aureus Mu50
ucguuaauguauaaaaagu

SEQ ID NO: 2041452 - RNA, 20 nt, Staphylococcus aureus subsp. aureus Mu50
ucguuauaaguacaaauaau

SEQ ID NO: 2041453 - RNA, 15 nt, Staphylococcus aureus subsp. aureus Mu50
ucguucuuugauuag

SEQ ID NO: 2041454 - RNA, 17 nt, Staphylococcus aureus subsp. aureus Mu50
ucguugaagauguauuu

SEQ ID NO: 2041455 - RNA, 14 nt, Staphylococcus aureus subsp. aureus Mu50
ucguucguauauua

SEQ ID NO: 2041456 - RNA, 18 nt, Staphylococcus aureus subsp. aureus Mu50
ucgguauuuaauguuuua

SEQ ID NO: 2041457 - RNA, 17 nt, Staphylococcus aureus subsp. aureus Mu50
ucgguauuuuaaauuua

SEQ ID NO: 2041458 - RNA, 18 nt, Staphylococcus aureus subsp. aureus Mu50
ucguaacauuuaaaaaau

SEQ ID NO: 2041459 - RNA, 18 nt, Staphylococcus aureus subsp. aureus Mu50
ucguaccaacucgcuaua

SEQ ID NO: 2041460 - RNA, 19 nt, Staphylococcus aureus subsp. aureus Mu50
ucguaaugaugacaucaau

SEQ ID NO: 2041461 - RNA, 18 nt, Staphylococcus aureus subsp. aureus Mu50
ucguacaccauaaaugua

SEQ ID NO: 2041462 - RNA, 21 nt, Staphylococcus aureus subsp. aureus Mu50
ucgcucuagacauuacauuua

SEQ ID NO: 2041463 - RNA, 21 nt, Staphylococcus aureus subsp. aureus Mu50
ucgcuaaauuuauauagucua

SEQ ID NO: 2041464 - RNA, 16 nt, Staphylococcus aureus subsp. aureus Mu50
ucgcuuccaaugaauc

SEQ ID NO: 2041465 - RNA, 20 nt, Staphylococcus aureus subsp. aureus Mu50
ucggauuauauuuagauuua

SEQ ID NO: 2041466 - RNA, 21 nt, Staphylococcus aureus subsp. aureus Mu50
ucggauugagggauuuuuaua

SEQ ID NO: 2041467 - RNA, 17 nt, Staphylococcus aureus subsp. aureus Mu50
gcuuuuuuauucuaaua

SEQ ID NO: 2041468 - RNA, 19 nt, Staphylococcus aureus subsp. aureus Mu50
gcuuuuaugcaugcgcaaa

SEQ ID NO: 2041469 - RNA, 17 nt, Staphylococcus aureus subsp. aureus Mu50
gcuuuaugaaucauuuu

SEQ ID NO: 2041470 - RNA, 21 nt, Staphylococcus aureus subsp. aureus Mu50
gcuguuuaguuaauguaaagu

SEQ ID NO: 2041471 - RNA, 15 nt, Staphylococcus aureus subsp. aureus Mu50
gcuugauuaacauuu

SEQ ID NO: 2041472 - RNA, 15 nt, Staphylococcus aureus subsp. aureus Mu50
gcuugauuaauuuua

SEQ ID NO: 2041473 - RNA, 17 nt, Staphylococcus aureus subsp. aureus Mu50
ggaaaaagaugaaaaag

SEQ ID NO: 2041474 - RNA, 20 nt, Staphylococcus aureus subsp. aureus Mu50
gcuuuuuucaauucuaguca

SEQ ID NO: 2041475 - RNA, 20 nt, Staphylococcus aureus subsp. aureus Mu50
ggagugggacagaaaugaua

SEQ ID NO: 2041476 - RNA, 16 nt, Staphylococcus aureus subsp. aureus Mu50
gcuguauuuaauaaac

SEQ ID NO: 2041477 - RNA, 22 nt, Staphylococcus aureus subsp. aureus Mu50
gcucuucaaauuuaccgucauu

SEQ ID NO: 2041478 - RNA, 19 nt, Staphylococcus aureus subsp. aureus Mu50
gcucuuuuuugauuuggaa

SEQ ID NO: 2041479 - RNA, 17 nt, Staphylococcus aureus subsp. aureus Mu50
gcuauaacucuaaauau

SEQ ID NO: 2041480 - RNA, 13 nt, Staphylococcus aureus subsp. aureus Mu50
gcucaaaacuuuu

SEQ ID NO: 2041481 - RNA, 17 nt, Staphylococcus aureus subsp. aureus Mu50
gcuauguaaaauuauug

SEQ ID NO: 2041482 - RNA, 18 nt, Staphylococcus aureus subsp. aureus Mu50
gcucaaucgcaucuguua

SEQ ID NO: 2041483 - RNA, 15 nt, Staphylococcus aureus subsp. aureus Mu50
gcuagcauaucuuua

SEQ ID NO: 2041484 - RNA, 21 nt, Staphylococcus aureus subsp. aureus Mu50
gcgcucuggauuuuucuuaua

SEQ ID NO: 2041485 - RNA, 13 nt, Staphylococcus aureus subsp. aureus Mu50
gcgagaauucaau

SEQ ID NO: 2041486 - RNA, 15 nt, Staphylococcus aureus subsp. aureus Mu50
gccugcuaaaaaguu

SEQ ID NO: 2041487 - RNA, 17 nt, Staphylococcus aureus subsp. aureus Mu50
gccuuaacuucauaaua

SEQ ID NO: 2041488 - RNA, 18 nt, Staphylococcus aureus subsp. aureus Mu50
gccuacuguuucacguaa

SEQ ID NO: 2041489 - RNA, 14 nt, Staphylococcus aureus subsp. aureus Mu50
ggcuuaauagaggu

SEQ ID NO: 2041490 - RNA, 24 nt, Staphylococcus aureus subsp. aureus Mu50
gggaugggccccaacacagagaau

SEQ ID NO: 2041491 - RNA, 17 nt, Staphylococcus aureus subsp. aureus Mu50
gggagugggacagaaau

SEQ ID NO: 2041492 - RNA, 18 nt, Staphylococcus aureus subsp. aureus Mu50
ggggugggacgacgaaau

SEQ ID NO: 2041493 - RNA, 14 nt, Staphylococcus aureus subsp. aureus Mu50
ggcguacauauaau

SEQ ID NO: 2041494 - RNA, 12 nt, Staphylococcus aureus subsp. aureus Mu50
ggcgacauaaau

SEQ ID NO: 2041495 - RNA, 13 nt, Staphylococcus aureus subsp. aureus Mu50
gguucuauaauaa

SEQ ID NO: 2041496 - RNA, 17 nt, Staphylococcus aureus subsp. aureus Mu50
gguguuaaguuuucaau

SEQ ID NO: 2041497 - RNA, 13 nt, Staphylococcus aureus subsp. aureus Mu50
gguucaaaaauca

SEQ ID NO: 2041498 - RNA, 18 nt, Staphylococcus aureus subsp. aureus Mu50
guaaacggaauaacuuuu

SEQ ID NO: 2041499 - RNA, 17 nt, Staphylococcus aureus subsp. aureus Mu50
guaaacgauacugcuuu

SEQ ID NO: 2041500 - RNA, 19 nt, Staphylococcus aureus subsp. aureus Mu50
guaaaccuacuaauauauu

SEQ ID NO: 2041501 - RNA, 17 nt, Staphylococcus aureus subsp. aureus Mu50
guaaacauaaugacauc

SEQ ID NO: 2041502 - RNA, 16 nt, Staphylococcus aureus subsp. aureus Mu50
guaaacacuuuaguau

SEQ ID NO: 2041503 - RNA, 20 nt, Staphylococcus aureus subsp. aureus Mu50
guaaacacuuuaguauuaua

SEQ ID NO: 2041504 - RNA, 13 nt, Staphylococcus aureus subsp. aureus Mu50
guaacaagcauuu

SEQ ID NO: 2041505 - RNA, 22 nt, Staphylococcus aureus subsp. aureus Mu50
guaacaagcauuuuucaauuau

SEQ ID NO: 2041506 - RNA, 12 nt, Staphylococcus aureus subsp. aureus Mu50
guaacaagcuuu

SEQ ID NO: 2041507 - RNA, 23 nt, Staphylococcus aureus subsp. aureus Mu50
guaacaauuuagcaaauauuucu

SEQ ID NO: 2041508 - RNA, 12 nt, Staphylococcus aureus subsp. aureus Mu50
guaacauaaaca

SEQ ID NO: 2041509 - RNA, 24 nt, Staphylococcus aureus subsp. aureus Mu50
gguuuaucagcuuuaauaauauga

SEQ ID NO: 2041510 - RNA, 17 nt, Staphylococcus aureus subsp. aureus Mu50
guaaaauauacuugaag

SEQ ID NO: 2041511 - RNA, 20 nt, Staphylococcus aureus subsp. aureus Mu50
guaaaaaaagacaugagauu

SEQ ID NO: 2041512 - RNA, 15 nt, Staphylococcus aureus subsp. aureus Mu50
guaaucaaagauuuu

SEQ ID NO: 2041513 - RNA, 19 nt, Staphylococcus aureus subsp. aureus Mu50
guaauauuuuuguugcaau

SEQ ID NO: 2041514 - RNA, 15 nt, Staphylococcus aureus subsp. aureus Mu50
guaauagaacgaaau

SEQ ID NO: 2041515 - RNA, 16 nt, Staphylococcus aureus subsp. aureus Mu50
guaauagcaaccauau

SEQ ID NO: 2041516 - RNA, 17 nt, Staphylococcus aureus subsp. aureus Mu50
guaauagcaaccauauu

SEQ ID NO: 2041517 - RNA, 14 nt, Staphylococcus aureus subsp. aureus Mu50
guaauaaaaugaug

SEQ ID NO: 2041518 - RNA, 21 nt, Staphylococcus aureus subsp. aureus Mu50
guaaucauugguuucaucaua

SEQ ID NO: 2041519 - RNA, 17 nt, Staphylococcus aureus subsp. aureus Mu50
guagcugaggauuuuuu

SEQ ID NO: 2041520 - RNA, 18 nt, Staphylococcus aureus subsp. aureus Mu50
guagcuaaugcaacuaaa

SEQ ID NO: 2041521 - RNA, 21 nt, Staphylococcus aureus subsp. aureus Mu50
gucacuugucaugccgucgau

SEQ ID NO: 2041522 - RNA, 15 nt, Staphylococcus aureus subsp. aureus Mu50
gucaauaaauuguuu

SEQ ID NO: 2041523 - RNA, 13 nt, Staphylococcus aureus subsp. aureus Mu50
guauuuuaauauu

SEQ ID NO: 2041524 - RNA, 20 nt, Staphylococcus aureus subsp. aureus Mu50
gucaaaaaaucgaacaaaug

SEQ ID NO: 2041525 - RNA, 20 nt, Staphylococcus aureus subsp. aureus Mu50
guauucaaaguuuucauuua

SEQ ID NO: 2041526 - RNA, 16 nt, Staphylococcus aureus subsp. aureus Mu50
guauucuuuuaauaga

SEQ ID NO: 2041527 - RNA, 22 nt, Staphylococcus aureus subsp. aureus Mu50
guauuagcaauuuggucauaua

SEQ ID NO: 2041528 - RNA, 16 nt, Staphylococcus aureus subsp. aureus Mu50
guaucuauacaauuau

SEQ ID NO: 2041529 - RNA, 18 nt, Staphylococcus aureus subsp. aureus Mu50
guaucuaugaaauuuuuu

SEQ ID NO: 2041530 - RNA, 14 nt, Staphylococcus aureus subsp. aureus Mu50
guaucucauuuuuu

SEQ ID NO: 2041531 - RNA, 15 nt, Staphylococcus aureus subsp. aureus Mu50
guccauuuucuuuuu

SEQ ID NO: 2041532 - RNA, 15 nt, Staphylococcus aureus subsp. aureus Mu50
guccaaaaugaacaa

SEQ ID NO: 2041533 - RNA, 18 nt, Staphylococcus aureus subsp. aureus Mu50
guccaauuccaauaaaca

SEQ ID NO: 2041534 - RNA, 14 nt, Staphylococcus aureus subsp. aureus Mu50
gucauuacaaauca

SEQ ID NO: 2041535 - RNA, 20 nt, Staphylococcus aureus subsp. aureus Mu50
gucauuacaaaucaugacau

SEQ ID NO: 2041536 - RNA, 16 nt, Staphylococcus aureus subsp. aureus Mu50
gucauuucuucuuuuu

SEQ ID NO: 2041537 - RNA, 17 nt, Staphylococcus aureus subsp. aureus Mu50
gucauaaugaacgauau

SEQ ID NO: 2041538 - RNA, 15 nt, Staphylococcus aureus subsp. aureus Mu50
gucauagaaauuuua

SEQ ID NO: 2041539 - RNA, 19 nt, Staphylococcus aureus subsp. aureus Mu50
gucauaucuuuauuugauu

SEQ ID NO: 2041540 - RNA, 20 nt, Staphylococcus aureus subsp. aureus Mu50
gugauauuaauugaaaaacc

SEQ ID NO: 2041541 - RNA, 23 nt, Staphylococcus aureus subsp. aureus Mu50
gugauauuaauugaaaaaccaag

SEQ ID NO: 2041542 - RNA, 18 nt, Staphylococcus aureus subsp. aureus Mu50
guggcucgaaaauaaaac

SEQ ID NO: 2041543 - RNA, 15 nt, Staphylococcus aureus subsp. aureus Mu50
guggaaauaaaacaa

SEQ ID NO: 2041544 - RNA, 22 nt, Staphylococcus aureus subsp. aureus Mu50
gucuuccaaucaacuucauaua

SEQ ID NO: 2041545 - RNA, 17 nt, Staphylococcus aureus subsp. aureus Mu50
gugaaaacccugaagau

SEQ ID NO: 2041546 - RNA, 13 nt, Staphylococcus aureus subsp. aureus Mu50
gucuuuuauuaug

SEQ ID NO: 2041547 - RNA, 20 nt, Staphylococcus aureus subsp. aureus Mu50
gucuuguaaacuucuuuucu

SEQ ID NO: 2041548 - RNA, 19 nt, Staphylococcus aureus subsp. aureus Mu50
gugaaaguuuuugucuuaa

SEQ ID NO: 2041549 - RNA, 18 nt, Staphylococcus aureus subsp. aureus Mu50
gucucuugucauuucaau

SEQ ID NO: 2041550 - RNA, 20 nt, Staphylococcus aureus subsp. aureus Mu50
gucuauguacaauaauuagu

SEQ ID NO: 2041551 - RNA, 18 nt, Staphylococcus aureus subsp. aureus Mu50
gucguucucguguaaaau

SEQ ID NO: 2041552 - RNA, 20 nt, Staphylococcus aureus subsp. aureus Mu50
cgguaaccauuuuuuuaucu

SEQ ID NO: 2041553 - RNA, 15 nt, Staphylococcus aureus subsp. aureus Mu50
cgcuuagauaaauua

SEQ ID NO: 2041554 - RNA, 15 nt, Staphylococcus aureus subsp. aureus Mu50
cgcuuuauuacuuua

SEQ ID NO: 2041555 - RNA, 18 nt, Staphylococcus aureus subsp. aureus Mu50
cgcuuuuuuuuauaaguu

SEQ ID NO: 2041556 - RNA, 20 nt, Staphylococcus aureus subsp. aureus Mu50
cgcuucuucuucagaaauac

SEQ ID NO: 2041557 - RNA, 14 nt, Staphylococcus aureus subsp. aureus Mu50
cgcuaaauuuauau

SEQ ID NO: 2041558 - RNA, 22 nt, Staphylococcus aureus subsp. aureus Mu50
cgcugccauuaaacgaaugauu

SEQ ID NO: 2041559 - RNA, 23 nt, Staphylococcus aureus subsp. aureus Mu50
cgccucaaacggagcaacgauac

SEQ ID NO: 2041560 - RNA, 15 nt, Staphylococcus aureus subsp. aureus Mu50
ccgugauguuaaaau

SEQ ID NO: 2041561 - RNA, 16 nt, Staphylococcus aureus subsp. aureus Mu50
ccucacaaauuugaau

SEQ ID NO: 2041562 - RNA, 21 nt, Staphylococcus aureus subsp. aureus Mu50
ccuauuuuuugagcacuuaau

SEQ ID NO: 2041563 - RNA, 16 nt, Staphylococcus aureus subsp. aureus Mu50
ccuauuccuaauaaau

SEQ ID NO: 2041564 - RNA, 21 nt, Staphylococcus aureus subsp. aureus Mu50
ccuaaaucuuuaaauguauca

SEQ ID NO: 2041565 - RNA, 20 nt, Staphylococcus aureus subsp. aureus Mu50
ccuaagcaagauaauagcaa

SEQ ID NO: 2041566 - RNA, 21 nt, Staphylococcus aureus subsp. aureus Mu50
ccuaagcaagauaauagcaau

SEQ ID NO: 2041567 - RNA, 17 nt, Staphylococcus aureus subsp. aureus Mu50
ccuaagcugauuaaaau

SEQ ID NO: 2041568 - RNA, 14 nt, Staphylococcus aureus subsp. aureus Mu50
ccuaaguuaauuua

SEQ ID NO: 2041569 - RNA, 14 nt, Staphylococcus aureus subsp. aureus Mu50
ccuaauaauaaaau

SEQ ID NO: 2041570 - RNA, 13 nt, Staphylococcus aureus subsp. aureus Mu50
ccuaauuuuguga

SEQ ID NO: 2041571 - RNA, 18 nt, Staphylococcus aureus subsp. aureus Mu50
ccuaaugcuuuaauaaau

SEQ ID NO: 2041572 - RNA, 22 nt, Staphylococcus aureus subsp. aureus Mu50
ccuaauguguggauuuaauuuu

SEQ ID NO: 2041573 - RNA, 21 nt, Staphylococcus aureus subsp. aureus Mu50
ccuacacuguuuuauaaauga

SEQ ID NO: 2041574 - RNA, 16 nt, Staphylococcus aureus subsp. aureus Mu50
ccguugaauuaacaau

SEQ ID NO: 2041575 - RNA, 23 nt, Staphylococcus aureus subsp. aureus Mu50
ccguuuuaaguacagcauauaau

SEQ ID NO: 2041576 - RNA, 21 nt, Staphylococcus aureus subsp. aureus Mu50
ccuaaaauagaaaaauuucaa

SEQ ID NO: 2041577 - RNA, 13 nt, Staphylococcus aureus subsp. aureus Mu50
ccuggaaaaugau

SEQ ID NO: 2041578 - RNA, 19 nt, Staphylococcus aureus subsp. aureus Mu50
ccugcaauuuguaauacaa

SEQ ID NO: 2041579 - RNA, 20 nt, Staphylococcus aureus subsp. aureus Mu50
ccugcaauuuguaauacaag

SEQ ID NO: 2041580 - RNA, 17 nt, Staphylococcus aureus subsp. aureus Mu50
ccugagccauaacugaa

SEQ ID NO: 2041581 - RNA, 17 nt, Staphylococcus aureus subsp. aureus Mu50
ccguauccuguguaaaa

SEQ ID NO: 2041582 - RNA, 22 nt, Staphylococcus aureus subsp. aureus Mu50
ccgauuguuaauuuaaagucuu

SEQ ID NO: 2041583 - RNA, 23 nt, Staphylococcus aureus subsp. aureus Mu50
ccgauuuauuuauaaaauaaaau

SEQ ID NO: 2041584 - RNA, 15 nt, Staphylococcus aureus subsp. aureus Mu50
ccgcaaauauuaaau

SEQ ID NO: 2041585 - RNA, 23 nt, Staphylococcus aureus subsp. aureus Mu50
ccgcuucuuuuaaguuaucaaau

SEQ ID NO: 2041586 - RNA, 17 nt, Staphylococcus aureus subsp. aureus Mu50
cgaugaaucccauaaca

SEQ ID NO: 2041587 - RNA, 19 nt, Staphylococcus aureus subsp. aureus Mu50
cgaugagcgcauaaauuuu

SEQ ID NO: 2041588 - RNA, 22 nt, Staphylococcus aureus subsp. aureus Mu50
cgaucagucucuaaaacuuuuu

SEQ ID NO: 2041589 - RNA, 14 nt, Staphylococcus aureus subsp. aureus Mu50
cgauaaauuaacuu

SEQ ID NO: 2041590 - RNA, 17 nt, Staphylococcus aureus subsp. aureus Mu50
cgauaaugaaauacgau

SEQ ID NO: 2041591 - RNA, 17 nt, Staphylococcus aureus subsp. aureus Mu50
cgauacaaaggauuauu

SEQ ID NO: 2041592 - RNA, 22 nt, Staphylococcus aureus subsp. aureus Mu50
cgauacaaaggauuauuaacuu

SEQ ID NO: 2041593 - RNA, 20 nt, Staphylococcus aureus subsp. aureus Mu50
cgauaauguauaucgacacc

SEQ ID NO: 2041594 - RNA, 20 nt, Staphylococcus aureus subsp. aureus Mu50
cgauaucaauguauuguaau

SEQ ID NO: 2041595 - RNA, 21 nt, Staphylococcus aureus subsp. aureus Mu50
cgauucauuuaaaaaucaaag

SEQ ID NO: 2041596 - RNA, 20 nt, Staphylococcus aureus subsp. aureus Mu50
cgauuuuuuuacguaaucua

SEQ ID NO: 2041597 - RNA, 13 nt, Staphylococcus aureus subsp. aureus Mu50
cgauuuuuaaugc

SEQ ID NO: 2041598 - RNA, 16 nt, Staphylococcus aureus subsp. aureus Mu50
cgauuuaauuaaaaca

SEQ ID NO: 2041599 - RNA, 19 nt, Staphylococcus aureus subsp. aureus Mu50
cgcaauaucauaccgacac

SEQ ID NO: 2041600 - RNA, 15 nt, Staphylococcus aureus subsp. aureus Mu50
cgcaaugauuauaaa

SEQ ID NO: 2041601 - RNA, 20 nt, Staphylococcus aureus subsp. aureus Mu50
cgcaaugauuauaaauacau

SEQ ID NO: 2041602 - RNA, 13 nt, Staphylococcus aureus subsp. aureus Mu50
cgcaauuaaaagu

SEQ ID NO: 2041603 - RNA, 15 nt, Staphylococcus aureus subsp. aureus Mu50
cgcagcuucuuuaac

SEQ ID NO: 2041604 - RNA, 16 nt, Staphylococcus aureus subsp. aureus Mu50
cgccaucaauauuuau

SEQ ID NO: 2041605 - RNA, 20 nt, Staphylococcus aureus subsp. aureus Mu50
cgccauaaucuucauuaauu

SEQ ID NO: 2041606 - RNA, 16 nt, Staphylococcus aureus subsp. aureus Mu50
cgagauuuuauaagua

SEQ ID NO: 2041607 - RNA, 14 nt, Staphylococcus aureus subsp. aureus Mu50
cgaacaugaaugau

SEQ ID NO: 2041608 - RNA, 19 nt, Staphylococcus aureus subsp. aureus Mu50
cgaacaucuaauacauuau

SEQ ID NO: 2041609 - RNA, 18 nt, Staphylococcus aureus subsp. aureus Mu50
ccuuuuuuuauguuuaaa

SEQ ID NO: 2041610 - RNA, 19 nt, Staphylococcus aureus subsp. aureus Mu50
ccuuuuuauuaucuuuaau

SEQ ID NO: 2041611 - RNA, 18 nt, Staphylococcus aureus subsp. aureus Mu50
ccuuugcuuaaaccuuaa

SEQ ID NO: 2041612 - RNA, 14 nt, Staphylococcus aureus subsp. aureus Mu50
ccugucuuaauuca

SEQ ID NO: 2041613 - RNA, 19 nt, Staphylococcus aureus subsp. aureus Mu50
ccuguuauugcaauaaaau

SEQ ID NO: 2041614 - RNA, 15 nt, Staphylococcus aureus subsp. aureus Mu50
ccuuagcaauaucau

SEQ ID NO: 2041615 - RNA, 19 nt, Staphylococcus aureus subsp. aureus Mu50
ccuguucuuuauuuaaagg

SEQ ID NO: 2041616 - RNA, 18 nt, Staphylococcus aureus subsp. aureus Mu50
ccuuacaauaaagacaua

SEQ ID NO: 2041617 - RNA, 17 nt, Staphylococcus aureus subsp. aureus Mu50
ccuuaauaucaugcaca

SEQ ID NO: 2041618 - RNA, 16 nt, Staphylococcus aureus subsp. aureus Mu50
ccuuaacuucauaaua

SEQ ID NO: 2041619 - RNA, 20 nt, Staphylococcus aureus subsp. aureus Mu50
ccuuaugucauauacuauau

SEQ ID NO: 2041620 - RNA, 20 nt, Staphylococcus aureus subsp. aureus Mu50
ccuucaaagauuuuaccuug

SEQ ID NO: 2041621 - RNA, 22 nt, Staphylococcus aureus subsp. aureus Mu50
ccuucuccaaaaauaauuaaau

SEQ ID NO: 2041622 - RNA, 19 nt, Staphylococcus aureus subsp. aureus Mu50
ccuucgauaguuuauuaau

SEQ ID NO: 2041623 - RNA, 23 nt, Staphylococcus aureus subsp. aureus Mu50
ccuucgauaguuuauuaauauua

SEQ ID NO: 2041624 - RNA, 18 nt, Staphylococcus aureus subsp. aureus Mu50
cgaagggcggucaauuuu

SEQ ID NO: 2041625 - RNA, 20 nt, Staphylococcus aureus subsp. aureus Mu50
cgacauuuuuagacauuaaa

SEQ ID NO: 2041626 - RNA, 22 nt, Staphylococcus aureus subsp. aureus Mu50
cuuuuuaaaggaccacuuagau

SEQ ID NO: 2041627 - RNA, 16 nt, Staphylococcus aureus subsp. aureus Mu50
cuuuuguuuaguaugg

SEQ ID NO: 2041628 - RNA, 14 nt, Staphylococcus aureus subsp. aureus Mu50
cuuuuguaauugaa

SEQ ID NO: 2041629 - RNA, 19 nt, Staphylococcus aureus subsp. aureus Mu50
cuuuuguaauugaaaugau

SEQ ID NO: 2041630 - RNA, 19 nt, Staphylococcus aureus subsp. aureus Mu50
cuuuuccuugauucuuaua

SEQ ID NO: 2041631 - RNA, 18 nt, Staphylococcus aureus subsp. aureus Mu50
cuuuucuuugauaacaau

SEQ ID NO: 2041632 - RNA, 20 nt, Staphylococcus aureus subsp. aureus Mu50
cuuuugauguuuaugacaaa

SEQ ID NO: 2041633 - RNA, 15 nt, Staphylococcus aureus subsp. aureus Mu50
cuuuuagauuaucuu

SEQ ID NO: 2041634 - RNA, 20 nt, Staphylococcus aureus subsp. aureus Mu50
cuuuuaaucaaauuaucugu

SEQ ID NO: 2041635 - RNA, 20 nt, Staphylococcus aureus subsp. aureus Mu50
cuuuuauauuuuuaucaucu

SEQ ID NO: 2041636 - RNA, 11 nt, Staphylococcus aureus subsp. aureus Mu50
cuuuuaugcau

SEQ ID NO: 2041637 - RNA, 17 nt, Staphylococcus aureus subsp. aureus Mu50
cuuuuauggagugauau

SEQ ID NO: 2041638 - RNA, 23 nt, Staphylococcus aureus subsp. aureus Mu50
cuuuaucuauaugcauauauuga

SEQ ID NO: 2041639 - RNA, 15 nt, Staphylococcus aureus subsp. aureus Mu50
cuuuaucgaauucuu

SEQ ID NO: 2041640 - RNA, 14 nt, Staphylococcus aureus subsp. aureus Mu50
cuuuauauuuauca

SEQ ID NO: 2041641 - RNA, 19 nt, Staphylococcus aureus subsp. aureus Mu50
cuuuaugcaaaauuaauga

SEQ ID NO: 2041642 - RNA, 15 nt, Staphylococcus aureus subsp. aureus Mu50
cuuuauuacuuuaau

SEQ ID NO: 2041643 - RNA, 13 nt, Staphylococcus aureus subsp. aureus Mu50
cuuuauuauacau

SEQ ID NO: 2041644 - RNA, 16 nt, Staphylococcus aureus subsp. aureus Mu50
cuuuuaauaguguuau

SEQ ID NO: 2041645 - RNA, 11 nt, Staphylococcus aureus subsp. aureus Mu50
cuuuuaaauuu

SEQ ID NO: 2041646 - RNA, 16 nt, Staphylococcus aureus subsp. aureus Mu50
cuuuauuuuuaugauu

SEQ ID NO: 2041647 - RNA, 17 nt, Staphylococcus aureus subsp. aureus Mu50
cuuuauuuuuuaucauu

SEQ ID NO: 2041648 - RNA, 16 nt, Staphylococcus aureus subsp. aureus Mu50
cuuuuaaauucuuaua

SEQ ID NO: 2041649 - RNA, 13 nt, Staphylococcus aureus subsp. aureus Mu50
cuuuuuguuaauu

SEQ ID NO: 2041650 - RNA, 15 nt, Staphylococcus aureus subsp. aureus Mu50
cuuuuuuaucuacau

SEQ ID NO: 2041651 - RNA, 13 nt, Staphylococcus aureus subsp. aureus Mu50
cuuuuuaucauga

SEQ ID NO: 2041652 - RNA, 17 nt, Staphylococcus aureus subsp. aureus Mu50
cuuuuuaggaaugauag

SEQ ID NO: 2041653 - RNA, 19 nt, Staphylococcus aureus subsp. aureus Mu50
cuuuuucuaaauaaacgau

SEQ ID NO: 2041654 - RNA, 17 nt, Staphylococcus aureus subsp. aureus Mu50
gaaaagaaauucuacaa

SEQ ID NO: 2041655 - RNA, 16 nt, Staphylococcus aureus subsp. aureus Mu50
gaaaagaacacgauau

SEQ ID NO: 2041656 - RNA, 19 nt, Staphylococcus aureus subsp. aureus Mu50
gaaaagcagucgaacaaug

SEQ ID NO: 2041657 - RNA, 23 nt, Staphylococcus aureus subsp. aureus Mu50
gaaagauuuguagcuugaauaau

SEQ ID NO: 2041658 - RNA, 21 nt, Staphylococcus aureus subsp. aureus Mu50
gaaacugauugggcugauaau

SEQ ID NO: 2041659 - RNA, 23 nt, Staphylococcus aureus subsp. aureus Mu50
gaaacuuuaagcugucauaccuu

SEQ ID NO: 2041660 - RNA, 14 nt, Staphylococcus aureus subsp. aureus Mu50
gaaauagaaauguc

SEQ ID NO: 2041661 - RNA, 19 nt, Staphylococcus aureus subsp. aureus Mu50
gaaauaauuuaaaggcaua

SEQ ID NO: 2041662 - RNA, 13 nt, Staphylococcus aureus subsp. aureus Mu50
gaaauacauccau

SEQ ID NO: 2041663 - RNA, 16 nt, Staphylococcus aureus subsp. aureus Mu50
gaaaucaccagauuuu

SEQ ID NO: 2041664 - RNA, 13 nt, Staphylococcus aureus subsp. aureus Mu50
gaaauauuuaucu

SEQ ID NO: 2041665 - RNA, 16 nt, Staphylococcus aureus subsp. aureus Mu50
gaaauauuuaucuuua

SEQ ID NO: 2041666 - RNA, 13 nt, Staphylococcus aureus subsp. aureus Mu50
gaaauauuugaaa

SEQ ID NO: 2041667 - RNA, 23 nt, Staphylococcus aureus subsp. aureus Mu50
gaaauauuugaaaauuucaccgc

SEQ ID NO: 2041668 - RNA, 18 nt, Staphylococcus aureus subsp. aureus Mu50
gaaaucaguuuuugaaua

SEQ ID NO: 2041669 - RNA, 22 nt, Staphylococcus aureus subsp. aureus Mu50
gaaagguauaucuucauuuaaa

SEQ ID NO: 2041670 - RNA, 15 nt, Staphylococcus aureus subsp. aureus Mu50
gaaaguucauuacaa

SEQ ID NO: 2041671 - RNA, 20 nt, Staphylococcus aureus subsp. aureus Mu50
gaaaguagaauuauuuagaa

SEQ ID NO: 2041672 - RNA, 13 nt, Staphylococcus aureus subsp. aureus Mu50
cuugcuaucaaac

SEQ ID NO: 2041673 - RNA, 17 nt, Staphylococcus aureus subsp. aureus Mu50
cuucuaaaacaucacuu

SEQ ID NO: 2041674 - RNA, 22 nt, Staphylococcus aureus subsp. aureus Mu50
cuucuacccauaauuuaaauga

SEQ ID NO: 2041675 - RNA, 22 nt, Staphylococcus aureus subsp. aureus Mu50
cuugugauucaaauaaaucaaa

SEQ ID NO: 2041676 - RNA, 15 nt, Staphylococcus aureus subsp. aureus Mu50
cuugugauaauucuu

SEQ ID NO: 2041677 - RNA, 23 nt, Staphylococcus aureus subsp. aureus Mu50
cuugguuauuaaaauuaaauaau

SEQ ID NO: 2041678 - RNA, 23 nt, Staphylococcus aureus subsp. aureus Mu50
cuuuaauuuuucauuaauacaag

SEQ ID NO: 2041679 - RNA, 16 nt, Staphylococcus aureus subsp. aureus Mu50
cuuuaaucauagcauu

SEQ ID NO: 2041680 - RNA, 18 nt, Staphylococcus aureus subsp. aureus Mu50
cuuuaauuuucuugccau

SEQ ID NO: 2041681 - RNA, 13 nt, Staphylococcus aureus subsp. aureus Mu50
cuuuacuuucauu

SEQ ID NO: 2041682 - RNA, 18 nt, Staphylococcus aureus subsp. aureus Mu50
cuuuacucuacacucaaa

SEQ ID NO: 2041683 - RNA, 18 nt, Staphylococcus aureus subsp. aureus Mu50
cuuuagcaauugaaucaa

SEQ ID NO: 2041684 - RNA, 14 nt, Staphylococcus aureus subsp. aureus Mu50
cuuuaguguguuua

SEQ ID NO: 2041685 - RNA, 18 nt, Staphylococcus aureus subsp. aureus Mu50
cuuuaguuaauucuccua

SEQ ID NO: 2041686 - RNA, 15 nt, Staphylococcus aureus subsp. aureus Mu50
cuuuauaaauaucuu

SEQ ID NO: 2041687 - RNA, 17 nt, Staphylococcus aureus subsp. aureus Mu50
cuuuauaaauaucuuuu

SEQ ID NO: 2041688 - RNA, 23 nt, Staphylococcus aureus subsp. aureus Mu50
cuuuauaaauaucuuuuucuaag

SEQ ID NO: 2041689 - RNA, 15 nt, Staphylococcus aureus subsp. aureus Mu50
cuuguucuaauuguu

SEQ ID NO: 2041690 - RNA, 20 nt, Staphylococcus aureus subsp. aureus Mu50
cuuguuuauuacauaauuua

SEQ ID NO: 2041691 - RNA, 14 nt, Staphylococcus aureus subsp. aureus Mu50
cuuguuuuaaacuu

SEQ ID NO: 2041692 - RNA, 20 nt, Staphylococcus aureus subsp. aureus Mu50
cuuguugugaauaaaauugu

SEQ ID NO: 2041693 - RNA, 18 nt, Staphylococcus aureus subsp. aureus Mu50
cuuguuuggaugacguuu

SEQ ID NO: 2041694 - RNA, 23 nt, Staphylococcus aureus subsp. aureus Mu50
cuuuaaacucauaccaaaaacau

SEQ ID NO: 2041695 - RNA, 12 nt, Staphylococcus aureus subsp. aureus Mu50
cuuuaaaauugu

SEQ ID NO: 2041696 - RNA, 17 nt, Staphylococcus aureus subsp. aureus Mu50
cuuuaaaguuguugaaa

SEQ ID NO: 2041697 - RNA, 15 nt, Staphylococcus aureus subsp. aureus Mu50
cuuuaaaauucucua

SEQ ID NO: 2041698 - RNA, 14 nt, Staphylococcus aureus subsp. aureus Mu50
cuuuaacauuuauu

SEQ ID NO: 2041699 - RNA, 22 nt, Staphylococcus aureus subsp. aureus Mu50
cuuuaaaucuuguucuaauugu

SEQ ID NO: 2041700 - RNA, 20 nt, Staphylococcus aureus subsp. aureus Mu50
cuuuaacuucuuuuguuuua

SEQ ID NO: 2041701 - RNA, 16 nt, Staphylococcus aureus subsp. aureus Mu50
cuuuaagaacauaacc

SEQ ID NO: 2041702 - RNA, 20 nt, Staphylococcus aureus subsp. aureus Mu50
gaaauggugaacuaaauuga

SEQ ID NO: 2041703 - RNA, 15 nt, Staphylococcus aureus subsp. aureus Mu50
gaaauguagauuacu

SEQ ID NO: 2041704 - RNA, 22 nt, Staphylococcus aureus subsp. aureus Mu50
gaaaugucauagccuauuuaaa

SEQ ID NO: 2041705 - RNA, 16 nt, Staphylococcus aureus subsp. aureus Mu50
gaaauucuuuuguaau

SEQ ID NO: 2041706 - RNA, 21 nt, Staphylococcus aureus subsp. aureus Mu50
gaaauucuuuuguaauugaaa

SEQ ID NO: 2041707 - RNA, 23 nt, Staphylococcus aureus subsp. aureus Mu50
gaaauuaauuaucuuaagucauc

SEQ ID NO: 2041708 - RNA, 13 nt, Staphylococcus aureus subsp. aureus Mu50
gaaaucauuuaaa

SEQ ID NO: 2041709 - RNA, 12 nt, Staphylococcus aureus subsp. aureus Mu50
gaaauuuuuaau

SEQ ID NO: 2041710 - RNA, 20 nt, Staphylococcus aureus subsp. aureus Mu50
gaaauuucauaaaguuuauu

SEQ ID NO: 2041711 - RNA, 15 nt, Staphylococcus aureus subsp. aureus Mu50
gaacaucugaaaaaa

SEQ ID NO: 2041712 - RNA, 15 nt, Staphylococcus aureus subsp. aureus Mu50
gaacaucuaguuauu

SEQ ID NO: 2041713 - RNA, 12 nt, Staphylococcus aureus subsp. aureus Mu50
gaacaucugaaa

SEQ ID NO: 2041714 - RNA, 21 nt, Staphylococcus aureus subsp. aureus Mu50
gaaccagcuaaccaaauaauu

SEQ ID NO: 2041715 - RNA, 20 nt, Staphylococcus aureus subsp. aureus Mu50
gaaccacgcaucauguauau

SEQ ID NO: 2041716 - RNA, 16 nt, Staphylococcus aureus subsp. aureus Mu50
cugguacuacuaucca

SEQ ID NO: 2041717 - RNA, 19 nt, Staphylococcus aureus subsp. aureus Mu50
cuggugguaacguaaacau

SEQ ID NO: 2041718 - RNA, 13 nt, Staphylococcus aureus subsp. aureus Mu50
cugggacauuaau

SEQ ID NO: 2041719 - RNA, 16 nt, Staphylococcus aureus subsp. aureus Mu50
cugguaaauguugaua

SEQ ID NO: 2041720 - RNA, 22 nt, Staphylococcus aureus subsp. aureus Mu50
cuucaguuaaaucuuuaacuuc

SEQ ID NO: 2041721 - RNA, 20 nt, Staphylococcus aureus subsp. aureus Mu50
cuucauaagucacaguaucu

SEQ ID NO: 2041722 - RNA, 22 nt, Staphylococcus aureus subsp. aureus Mu50
cuuaucaauuagccaauaccga

SEQ ID NO: 2041723 - RNA, 14 nt, Staphylococcus aureus subsp. aureus Mu50
cuuaucaaaaccgc

SEQ ID NO: 2041724 - RNA, 18 nt, Staphylococcus aureus subsp. aureus Mu50
cuuaguuuagguugauuu

SEQ ID NO: 2041725 - RNA, 14 nt, Staphylococcus aureus subsp. aureus Mu50
cuuauauaaacaaa

SEQ ID NO: 2041726 - RNA, 21 nt, Staphylococcus aureus subsp. aureus Mu50
cuuauacguuacggcuuugua

SEQ ID NO: 2041727 - RNA, 17 nt, Staphylococcus aureus subsp. aureus Mu50
cuucacugcuguuuuua

SEQ ID NO: 2041728 - RNA, 22 nt, Staphylococcus aureus subsp. aureus Mu50
cuucacuaaaaauauauuucaa

SEQ ID NO: 2041729 - RNA, 18 nt, Staphylococcus aureus subsp. aureus Mu50
cuucgcuaauaucaucuu

SEQ ID NO: 2041730 - RNA, 14 nt, Staphylococcus aureus subsp. aureus Mu50
cuucgauaucaaug

SEQ ID NO: 2041731 - RNA, 17 nt, Staphylococcus aureus subsp. aureus Mu50
cuucgauaucaauguau

SEQ ID NO: 2041732 - RNA, 21 nt, Staphylococcus aureus subsp. aureus Mu50
cuuccuaaaauuuacaaaugu

SEQ ID NO: 2041733 - RNA, 15 nt, Staphylococcus aureus subsp. aureus Mu50
cuguaauaauaucac

SEQ ID NO: 2041734 - RNA, 14 nt, Staphylococcus aureus subsp. aureus Mu50
cuguaauaccuuua

SEQ ID NO: 2041735 - RNA, 13 nt, Staphylococcus aureus subsp. aureus Mu50
cuguaaagcuauc

SEQ ID NO: 2041736 - RNA, 23 nt, Staphylococcus aureus subsp. aureus Mu50
cuguaacauaaacaauaacuguu

SEQ ID NO: 2041737 - RNA, 23 nt, Staphylococcus aureus subsp. aureus Mu50
cuguaaccaaaagaaauucgcuu

SEQ ID NO: 2041738 - RNA, 14 nt, Staphylococcus aureus subsp. aureus Mu50
cuguaaauuaucua

SEQ ID NO: 2041739 - RNA, 16 nt, Staphylococcus aureus subsp. aureus Mu50
cuguaacaaagucucu

SEQ ID NO: 2041740 - RNA, 18 nt, Staphylococcus aureus subsp. aureus Mu50
cuguccgaggcuaauuuu

SEQ ID NO: 2041741 - RNA, 17 nt, Staphylococcus aureus subsp. aureus Mu50
cuguacgauucaauuua

SEQ ID NO: 2041742 - RNA, 14 nt, Staphylococcus aureus subsp. aureus Mu50
cuguagauaucaaa

SEQ ID NO: 2041743 - RNA, 22 nt, Staphylococcus aureus subsp. aureus Mu50
cuguacuuuuauguuguuauaa

SEQ ID NO: 2041744 - RNA, 23 nt, Staphylococcus aureus subsp. aureus Mu50
cuguacuuuuauguuguuauaaa

SEQ ID NO: 2041745 - RNA, 15 nt, Staphylococcus aureus subsp. aureus Mu50
cuguagguaagaaaa

SEQ ID NO: 2041746 - RNA, 17 nt, Staphylococcus aureus subsp. aureus Mu50
cuguuuuuagguuauau

SEQ ID NO: 2041747 - RNA, 16 nt, Staphylococcus aureus subsp. aureus Mu50
cuuaaauacaauuucu

SEQ ID NO: 2041748 - RNA, 14 nt, Staphylococcus aureus subsp. aureus Mu50
cuuaaauauaauga

SEQ ID NO: 2041749 - RNA, 12 nt, Staphylococcus aureus subsp. aureus Mu50
cuuaguaauaag

SEQ ID NO: 2041750 - RNA, 16 nt, Staphylococcus aureus subsp. aureus Mu50
cuuaguacaaaauugu

SEQ ID NO: 2041751 - RNA, 17 nt, Staphylococcus aureus subsp. aureus Mu50
cuuauaacaaaaauugc

SEQ ID NO: 2041752 - RNA, 16 nt, Staphylococcus aureus subsp. aureus Mu50
cuuaaccauuuaaaaa

SEQ ID NO: 2041753 - RNA, 18 nt, Staphylococcus aureus subsp. aureus Mu50
cuuaacaacuuuaauuuu

SEQ ID NO: 2041754 - RNA, 21 nt, Staphylococcus aureus subsp. aureus Mu50
cuuaaaauuucccuuuauacu

SEQ ID NO: 2041755 - RNA, 23 nt, Staphylococcus aureus subsp. aureus Mu50
gacuuuccaccagccucuguguu

SEQ ID NO: 2041756 - RNA, 23 nt, Staphylococcus aureus subsp. aureus Mu50
gacuuuuaaaaaacauaccugca

SEQ ID NO: 2041757 - RNA, 19 nt, Staphylococcus aureus subsp. aureus Mu50
gacuuuuagauuaucuuuc

SEQ ID NO: 2041758 - RNA, 14 nt, Staphylococcus aureus subsp. aureus Mu50
gagaaacaaaacaa

SEQ ID NO: 2041759 - RNA, 23 nt, Staphylococcus aureus subsp. aureus Mu50
gacugagaaaaauauuucuaaua

SEQ ID NO: 2041760 - RNA, 20 nt, Staphylococcus aureus subsp. aureus Mu50
gacugauucaccagguuuuu

SEQ ID NO: 2041761 - RNA, 20 nt, Staphylococcus aureus subsp. aureus Mu50
gacugaaugagaaugugcuu

SEQ ID NO: 2041762 - RNA, 20 nt, Staphylococcus aureus subsp. aureus Mu50
gacugaacgaaaauucgcuu

SEQ ID NO: 2041763 - RNA, 20 nt, Staphylococcus aureus subsp. aureus Mu50
gacugaacgaaaaugcgcuu

SEQ ID NO: 2041764 - RNA, 19 nt, Staphylococcus aureus subsp. aureus Mu50
gacugaacgaaaaugcgcu

SEQ ID NO: 2041765 - RNA, 17 nt, Staphylococcus aureus subsp. aureus Mu50
gacucaagugaaucuaa

SEQ ID NO: 2041766 - RNA, 13 nt, Staphylococcus aureus subsp. aureus Mu50
gacucaguuauau

SEQ ID NO: 2041767 - RNA, 16 nt, Staphylococcus aureus subsp. aureus Mu50
gacuacuaaucuuagu

SEQ ID NO: 2041768 - RNA, 20 nt, Staphylococcus aureus subsp. aureus Mu50
gacuacuaaucuuaguuaaa

SEQ ID NO: 2041769 - RNA, 15 nt, Staphylococcus aureus subsp. aureus Mu50
gacuaaaaagaagcu

SEQ ID NO: 2041770 - RNA, 14 nt, Staphylococcus aureus subsp. aureus Mu50
gagaaucaauuauu

SEQ ID NO: 2041771 - RNA, 13 nt, Staphylococcus aureus subsp. aureus Mu50
gagaucuaacaau

SEQ ID NO: 2041772 - RNA, 19 nt, Staphylococcus aureus subsp. aureus Mu50
gacguaaguguaaaugaaa

SEQ ID NO: 2041773 - RNA, 14 nt, Staphylococcus aureus subsp. aureus Mu50
gacgguauuuucaa

SEQ ID NO: 2041774 - RNA, 20 nt, Staphylococcus aureus subsp. aureus Mu50
gacgaaacacacuaaaagcu

SEQ ID NO: 2041775 - RNA, 20 nt, Staphylococcus aureus subsp. aureus Mu50
gacaaucacagcaauaauaa

SEQ ID NO: 2041776 - RNA, 19 nt, Staphylococcus aureus subsp. aureus Mu50
gacaaguugcugaauaaaa

SEQ ID NO: 2041777 - RNA, 20 nt, Staphylococcus aureus subsp. aureus Mu50
gacacaucacuauacgcaau

SEQ ID NO: 2041778 - RNA, 13 nt, Staphylococcus aureus subsp. aureus Mu50
gacaacuucacgc

SEQ ID NO: 2041779 - RNA, 16 nt, Staphylococcus aureus subsp. aureus Mu50
gaaugucgauauuucu

SEQ ID NO: 2041780 - RNA, 22 nt, Staphylococcus aureus subsp. aureus Mu50
gaauuuagcaucaaaaauaaaa

SEQ ID NO: 2041781 - RNA, 21 nt, Staphylococcus aureus subsp. aureus Mu50
gaauuuagggaauugaucgaa

SEQ ID NO: 2041782 - RNA, 16 nt, Staphylococcus aureus subsp. aureus Mu50
gaauuugcacaaagau

SEQ ID NO: 2041783 - RNA, 23 nt, Staphylococcus aureus subsp. aureus Mu50
gaauuuuuauuuuuaguaauagu

SEQ ID NO: 2041784 - RNA, 21 nt, Staphylococcus aureus subsp. aureus Mu50
gaauuuuucaaagcgaucauu

SEQ ID NO: 2041785 - RNA, 19 nt, Staphylococcus aureus subsp. aureus Mu50
gaauaacuguuuaucauga

SEQ ID NO: 2041786 - RNA, 20 nt, Staphylococcus aureus subsp. aureus Mu50
gaauaauguuuccauuuauu

SEQ ID NO: 2041787 - RNA, 18 nt, Staphylococcus aureus subsp. aureus Mu50
gaauaauauauuuaggac

SEQ ID NO: 2041788 - RNA, 21 nt, Staphylococcus aureus subsp. aureus Mu50
gaauaaucauccauauaugcc

SEQ ID NO: 2041789 - RNA, 17 nt, Staphylococcus aureus subsp. aureus Mu50
gaauacuuuauuugaua

SEQ ID NO: 2041790 - RNA, 17 nt, Staphylococcus aureus subsp. aureus Mu50
gaauccuucaucaauaa

SEQ ID NO: 2041791 - RNA, 22 nt, Staphylococcus aureus subsp. aureus Mu50
gaaucuaacugugcaacaaacg

SEQ ID NO: 2041792 - RNA, 13 nt, Staphylococcus aureus subsp. aureus Mu50
gacaucauaaaug

SEQ ID NO: 2041793 - RNA, 15 nt, Staphylococcus aureus subsp. aureus Mu50
gacaucaucuauaau

SEQ ID NO: 2041794 - RNA, 14 nt, Staphylococcus aureus subsp. aureus Mu50
cucaucuauuuaau

SEQ ID NO: 2041795 - RNA, 22 nt, Staphylococcus aureus subsp. aureus Mu50
cucaugcauaagaaauacuaau

SEQ ID NO: 2041796 - RNA, 11 nt, Staphylococcus aureus subsp. aureus Mu50
cucacauuaag

SEQ ID NO: 2041797 - RNA, 18 nt, Staphylococcus aureus subsp. aureus Mu50
cucaaugugagauauaaa

SEQ ID NO: 2041798 - RNA, 16 nt, Staphylococcus aureus subsp. aureus Mu50
cucaauuucauuugaa

SEQ ID NO: 2041799 - RNA, 17 nt, Staphylococcus aureus subsp. aureus Mu50
cucacugcacuuaugau

SEQ ID NO: 2041800 - RNA, 13 nt, Staphylococcus aureus subsp. aureus Mu50
cucauucuuuaau

SEQ ID NO: 2041801 - RNA, 16 nt, Staphylococcus aureus subsp. aureus Mu50
cucauugugcuugaua

SEQ ID NO: 2041802 - RNA, 23 nt, Staphylococcus aureus subsp. aureus Mu50
cucauuaaccuuacauaggauau

SEQ ID NO: 2041803 - RNA, 18 nt, Staphylococcus aureus subsp. aureus Mu50
cuccauuuaauuuguuag

SEQ ID NO: 2041804 - RNA, 13 nt, Staphylococcus aureus subsp. aureus Mu50
cuacuauuaaaua

SEQ ID NO: 2041805 - RNA, 15 nt, Staphylococcus aureus subsp. aureus Mu50
cuacuauuaaauaau

SEQ ID NO: 2041806 - RNA, 22 nt, Staphylococcus aureus subsp. aureus Mu50
cuacuaaucguuguggcuuuuu

SEQ ID NO: 2041807 - RNA, 18 nt, Staphylococcus aureus subsp. aureus Mu50
cuaccgauuguuaauuua

SEQ ID NO: 2041808 - RNA, 22 nt, Staphylococcus aureus subsp. aureus Mu50
cuagaacuuaguacguaucauu

SEQ ID NO: 2041809 - RNA, 14 nt, Staphylococcus aureus subsp. aureus Mu50
cuacuugaauaccu

SEQ ID NO: 2041810 - RNA, 20 nt, Staphylococcus aureus subsp. aureus Mu50
cuacugcuugugugaaauua

SEQ ID NO: 2041811 - RNA, 12 nt, Staphylococcus aureus subsp. aureus Mu50
cuacuuaaauua

SEQ ID NO: 2041812 - RNA, 18 nt, Staphylococcus aureus subsp. aureus Mu50
cuacacucaaacaagauu

SEQ ID NO: 2041813 - RNA, 13 nt, Staphylococcus aureus subsp. aureus Mu50
cuacaguaaauug

SEQ ID NO: 2041814 - RNA, 19 nt, Staphylococcus aureus subsp. aureus Mu50
cuacaguaaauugauucuu

SEQ ID NO: 2041815 - RNA, 22 nt, Staphylococcus aureus subsp. aureus Mu50
cuacauuauauugagacaacau

SEQ ID NO: 2041816 - RNA, 23 nt, Staphylococcus aureus subsp. aureus Mu50
cucaauccugauuccacuacaau

SEQ ID NO: 2041817 - RNA, 22 nt, Staphylococcus aureus subsp. aureus Mu50
cucaauuaauuuagucauuaca

SEQ ID NO: 2041818 - RNA, 15 nt, Staphylococcus aureus subsp. aureus Mu50
cucaagauauccauu

SEQ ID NO: 2041819 - RNA, 20 nt, Staphylococcus aureus subsp. aureus Mu50
cuauggaaaauguuaucaau

SEQ ID NO: 2041820 - RNA, 15 nt, Staphylococcus aureus subsp. aureus Mu50
cuaugaaauuuuuua

SEQ ID NO: 2041821 - RNA, 19 nt, Staphylococcus aureus subsp. aureus Mu50
cuaugaauuuagcaucaaa

SEQ ID NO: 2041822 - RNA, 14 nt, Staphylococcus aureus subsp. aureus Mu50
cuaugaccaugaua

SEQ ID NO: 2041823 - RNA, 15 nt, Staphylococcus aureus subsp. aureus Mu50
cuaucugacauuuaa

SEQ ID NO: 2041824 - RNA, 18 nt, Staphylococcus aureus subsp. aureus Mu50
cuauauaguaaaauaaau

SEQ ID NO: 2041825 - RNA, 22 nt, Staphylococcus aureus subsp. aureus Mu50
cuauauaguaaaauaaauacaa

SEQ ID NO: 2041826 - RNA, 18 nt, Staphylococcus aureus subsp. aureus Mu50
cuauauauauaugcaucc

SEQ ID NO: 2041827 - RNA, 17 nt, Staphylococcus aureus subsp. aureus Mu50
cuauauuuagaaugaug

SEQ ID NO: 2041828 - RNA, 16 nt, Staphylococcus aureus subsp. aureus Mu50
cuauauuuaguuaauu

SEQ ID NO: 2041829 - RNA, 20 nt, Staphylococcus aureus subsp. aureus Mu50
cuauauuuaguuaauuauuu

SEQ ID NO: 2041830 - RNA, 12 nt, Staphylococcus aureus subsp. aureus Mu50
cuauauaaaugu

SEQ ID NO: 2041831 - RNA, 14 nt, Staphylococcus aureus subsp. aureus Mu50
cuaucaacgauuga

SEQ ID NO: 2041832 - RNA, 12 nt, Staphylococcus aureus subsp. aureus Mu50
cuaucaaauaau

SEQ ID NO: 2041833 - RNA, 21 nt, Staphylococcus aureus subsp. aureus Mu50
cuauacaaugaauuucuaauu

SEQ ID NO: 2041834 - RNA, 18 nt, Staphylococcus aureus subsp. aureus Mu50
cuauaauuuuaauuauuu

SEQ ID NO: 2041835 - RNA, 21 nt, Staphylococcus aureus subsp. aureus Mu50
cuauaauuuuaauuauuuucu

SEQ ID NO: 2041836 - RNA, 17 nt, Staphylococcus aureus subsp. aureus Mu50
cuagccguuauuuuuuu

SEQ ID NO: 2041837 - RNA, 18 nt, Staphylococcus aureus subsp. aureus Mu50
cuagcaacugaucauuuu

SEQ ID NO: 2041838 - RNA, 18 nt, Staphylococcus aureus subsp. aureus Mu50
cucgaaaauaaaacaaau

SEQ ID NO: 2041839 - RNA, 17 nt, Staphylococcus aureus subsp. aureus Mu50
cucgcauacugucaucu

SEQ ID NO: 2041840 - RNA, 21 nt, Staphylococcus aureus subsp. aureus Mu50
cugcauagcgcucuggauuuu

SEQ ID NO: 2041841 - RNA, 17 nt, Staphylococcus aureus subsp. aureus Mu50
cugaucgcauguuugua

SEQ ID NO: 2041842 - RNA, 21 nt, Staphylococcus aureus subsp. aureus Mu50
cugcaaacuugauucaauaua

SEQ ID NO: 2041843 - RNA, 20 nt, Staphylococcus aureus subsp. aureus Mu50
cugcaaauacgaguguuuua

SEQ ID NO: 2041844 - RNA, 18 nt, Staphylococcus aureus subsp. aureus Mu50
cugcacaucauaauaaau

SEQ ID NO: 2041845 - RNA, 15 nt, Staphylococcus aureus subsp. aureus Mu50
cucuaaaagccaucu

SEQ ID NO: 2041846 - RNA, 23 nt, Staphylococcus aureus subsp. aureus Mu50
cucuaacuuuaccaauaucaugc

SEQ ID NO: 2041847 - RNA, 15 nt, Staphylococcus aureus subsp. aureus Mu50
cucuagugcuuuguc

SEQ ID NO: 2041848 - RNA, 20 nt, Staphylococcus aureus subsp. aureus Mu50
cucuuuuuuauguacuacau

SEQ ID NO: 2041849 - RNA, 13 nt, Staphylococcus aureus subsp. aureus Mu50
cucuuuuaaauuc

SEQ ID NO: 2041850 - RNA, 15 nt, Staphylococcus aureus subsp. aureus Mu50
cugaacauaaaaaau

SEQ ID NO: 2041851 - RNA, 19 nt, Staphylococcus aureus subsp. aureus Mu50
cucuuuccacugcaacauu

SEQ ID NO: 2041852 - RNA, 13 nt, Staphylococcus aureus subsp. aureus Mu50
cucuuguguuuca

SEQ ID NO: 2041853 - RNA, 15 nt, Staphylococcus aureus subsp. aureus Mu50
cucuugucauuucaa

SEQ ID NO: 2041854 - RNA, 23 nt, Staphylococcus aureus subsp. aureus Mu50
cucugauuacauauacgacauuu

SEQ ID NO: 2041855 - RNA, 16 nt, Staphylococcus aureus subsp. aureus Mu50
cucuauuaauuuacuc

SEQ ID NO: 2041856 - RNA, 20 nt, Staphylococcus aureus subsp. aureus Mu50
cucuauuuuaugauuugauu

SEQ ID NO: 2041857 - RNA, 21 nt, Staphylococcus aureus subsp. aureus Mu50
cugaacgaaaauucgcuugua

SEQ ID NO: 2041858 - RNA, 22 nt, Staphylococcus aureus subsp. aureus Mu50
cugaaguuaucggcuaaaguua

SEQ ID NO: 2041859 - RNA, 11 nt, Staphylococcus aureus subsp. aureus Mu50
cugaauuuagg

SEQ ID NO: 2041860 - RNA, 23 nt, Staphylococcus aureus subsp. aureus Mu50
cugaauuuuaacuaagauuagua

SEQ ID NO: 2041861 - RNA, 12 nt, Staphylococcus aureus subsp. aureus Mu50
cugaauuuuacu

SEQ ID NO: 2041862 - RNA, 20 nt, Staphylococcus aureus subsp. aureus Mu50
cgucuauacuccaguuuaua

SEQ ID NO: 2041863 - RNA, 16 nt, Staphylococcus aureus subsp. aureus Mu50
cgucuuaauucuucug

SEQ ID NO: 2041864 - RNA, 13 nt, Staphylococcus aureus subsp. aureus Mu50
cgucuguuucaua

SEQ ID NO: 2041865 - RNA, 21 nt, Staphylococcus aureus subsp. aureus Mu50
cguuauaaguacaaauaauac

SEQ ID NO: 2041866 - RNA, 20 nt, Staphylococcus aureus subsp. aureus Mu50
cguuacuaccuauuaauauc

SEQ ID NO: 2041867 - RNA, 19 nt, Staphylococcus aureus subsp. aureus Mu50
cguuaauauaauuaauuuu

SEQ ID NO: 2041868 - RNA, 17 nt, Staphylococcus aureus subsp. aureus Mu50
cguuaaaucacauauga

SEQ ID NO: 2041869 - RNA, 15 nt, Staphylococcus aureus subsp. aureus Mu50
cgguuauuuaauaau

SEQ ID NO: 2041870 - RNA, 16 nt, Staphylococcus aureus subsp. aureus Mu50
cgguuuauuuaauaac

SEQ ID NO: 2041871 - RNA, 18 nt, Staphylococcus aureus subsp. aureus Mu50
cgguuuaaucuauauaua

SEQ ID NO: 2041872 - RNA, 17 nt, Staphylococcus aureus subsp. aureus Mu50
cguaagcaguuaauaag

SEQ ID NO: 2041873 - RNA, 17 nt, Staphylococcus aureus subsp. aureus Mu50
cguaacucuuuaauuuu

SEQ ID NO: 2041874 - RNA, 13 nt, Staphylococcus aureus subsp. aureus Mu50
cguaacauuuaaa

SEQ ID NO: 2041875 - RNA, 14 nt, Staphylococcus aureus subsp. aureus Mu50
cguauguaacaauu

SEQ ID NO: 2041876 - RNA, 12 nt, Staphylococcus aureus subsp. aureus Mu50
cguauuccauug

SEQ ID NO: 2041877 - RNA, 13 nt, Staphylococcus aureus subsp. aureus Mu50
cguauuauuauug

SEQ ID NO: 2041878 - RNA, 23 nt, Staphylococcus aureus subsp. aureus Mu50
gccccuuguucuccgaucaugcc

SEQ ID NO: 2041879 - RNA, 12 nt, Staphylococcus aureus subsp. aureus Mu50
gccauucuuuuu

SEQ ID NO: 2041880 - RNA, 19 nt, Staphylococcus aureus subsp. aureus Mu50
gccauuaaaccuaaucuac

SEQ ID NO: 2041881 - RNA, 23 nt, Staphylococcus aureus subsp. aureus Mu50
gcaucuuuuacugcuucgacauu

SEQ ID NO: 2041882 - RNA, 15 nt, Staphylococcus aureus subsp. aureus Mu50
gcauuaaauuccaug

SEQ ID NO: 2041883 - RNA, 14 nt, Staphylococcus aureus subsp. aureus Mu50
gcauugaccaccuu

SEQ ID NO: 2041884 - RNA, 19 nt, Staphylococcus aureus subsp. aureus Mu50
gcauugccccaucuauuag

SEQ ID NO: 2041885 - RNA, 21 nt, Staphylococcus aureus subsp. aureus Mu50
gcauuaauguucaauuuauau

SEQ ID NO: 2041886 - RNA, 16 nt, Staphylococcus aureus subsp. aureus Mu50
gcauuuacgaaguuua

SEQ ID NO: 2041887 - RNA, 17 nt, Staphylococcus aureus subsp. aureus Mu50
gcauaagauuuugaauu

SEQ ID NO: 2041888 - RNA, 14 nt, Staphylococcus aureus subsp. aureus Mu50
gcaucccgaaaguu

SEQ ID NO: 2041889 - RNA, 14 nt, Staphylococcus aureus subsp. aureus Mu50
gcagacguaucauc

SEQ ID NO: 2041890 - RNA, 17 nt, Staphylococcus aureus subsp. aureus Mu50
gcagacguaucaucaaa

SEQ ID NO: 2041891 - RNA, 13 nt, Staphylococcus aureus subsp. aureus Mu50
gcaccuauuuuuu

SEQ ID NO: 2041892 - RNA, 15 nt, Staphylococcus aureus subsp. aureus Mu50
gcaacgguuugaaaa

SEQ ID NO: 2041893 - RNA, 16 nt, Staphylococcus aureus subsp. aureus Mu50
gcaaucguugaaaaau

SEQ ID NO: 2041894 - RNA, 20 nt, Staphylococcus aureus subsp. aureus Mu50
gcaagucguucucuuaaaua

SEQ ID NO: 2041895 - RNA, 19 nt, Staphylococcus aureus subsp. aureus Mu50
gcaagugaguaacauuugc

SEQ ID NO: 2041896 - RNA, 21 nt, Staphylococcus aureus subsp. aureus Mu50
gcaauugauuguggugaaaua

SEQ ID NO: 2041897 - RNA, 18 nt, Staphylococcus aureus subsp. aureus Mu50
gcaauuuaauauuauaag

SEQ ID NO: 2041898 - RNA, 16 nt, Staphylococcus aureus subsp. aureus Mu50
gcaauugguagucauc

SEQ ID NO: 2041899 - RNA, 13 nt, Staphylococcus aureus subsp. aureus Mu50
gcaagauaauagc

SEQ ID NO: 2041900 - RNA, 16 nt, Staphylococcus aureus subsp. aureus Mu50
gcaaauauuaaauuau

SEQ ID NO: 2041901 - RNA, 22 nt, Staphylococcus aureus subsp. aureus Mu50
gcaaaucccuucucaacgauaa

SEQ ID NO: 2041902 - RNA, 18 nt, Staphylococcus aureus subsp. aureus Mu50
gcaaauugauuaaauaaa

SEQ ID NO: 2041903 - RNA, 16 nt, Staphylococcus aureus subsp. aureus Mu50
gcaaauuaucauuaaa

SEQ ID NO: 2041904 - RNA, 13 nt, Staphylococcus aureus subsp. aureus Mu50
gauuuauuauuac

SEQ ID NO: 2041905 - RNA, 14 nt, Staphylococcus aureus subsp. aureus Mu50
gauuuaucauuauu

SEQ ID NO: 2041906 - RNA, 16 nt, Staphylococcus aureus subsp. aureus Mu50
gauuucacuucauaaa

SEQ ID NO: 2041907 - RNA, 21 nt, Staphylococcus aureus subsp. aureus Mu50
gauuuaucaccuuuaggcaaa

SEQ ID NO: 2041908 - RNA, 21 nt, Staphylococcus aureus subsp. aureus Mu50
gauuucuucauuaucaauaga

SEQ ID NO: 2041909 - RNA, 17 nt, Staphylococcus aureus subsp. aureus Mu50
gauguucaguuguuuuu

SEQ ID NO: 2041910 - RNA, 18 nt, Staphylococcus aureus subsp. aureus Mu50
gauuauagguauaagaau

SEQ ID NO: 2041911 - RNA, 15 nt, Staphylococcus aureus subsp. aureus Mu50
gauuauuuagauaaa

SEQ ID NO: 2041912 - RNA, 23 nt, Staphylococcus aureus subsp. aureus Mu50
gauuaucauaugaacaauaagug

SEQ ID NO: 2041913 - RNA, 20 nt, Staphylococcus aureus subsp. aureus Mu50
gauuaucauuguucauacgc

SEQ ID NO: 2041914 - RNA, 17 nt, Staphylococcus aureus subsp. aureus Mu50
gauucuuaucauuucaa

SEQ ID NO: 2041915 - RNA, 14 nt, Staphylococcus aureus subsp. aureus Mu50
gauucuucacuaaa

SEQ ID NO: 2041916 - RNA, 16 nt, Staphylococcus aureus subsp. aureus Mu50
gauuguaagaauuaau

SEQ ID NO: 2041917 - RNA, 23 nt, Staphylococcus aureus subsp. aureus Mu50
gauuuaaaaaauuuaauguuuuc

SEQ ID NO: 2041918 - RNA, 19 nt, Staphylococcus aureus subsp. aureus Mu50
gauuuaaaaaguuaauaaa

SEQ ID NO: 2041919 - RNA, 17 nt, Staphylococcus aureus subsp. aureus Mu50
gauuuaacauaaaaaug

SEQ ID NO: 2041920 - RNA, 18 nt, Staphylococcus aureus subsp. aureus Mu50
gauuuaagauuuaauaaa

SEQ ID NO: 2041921 - RNA, 11 nt, Staphylococcus aureus subsp. aureus Mu50
gauuuaauaau

SEQ ID NO: 2041922 - RNA, 22 nt, Staphylococcus aureus subsp. aureus Mu50
gauucuaacggcguuuguuucu

SEQ ID NO: 2041923 - RNA, 20 nt, Staphylococcus aureus subsp. aureus Mu50
gaugcuaauguaaucugaac

SEQ ID NO: 2041924 - RNA, 19 nt, Staphylococcus aureus subsp. aureus Mu50
gaucauuuucaacauaaua

SEQ ID NO: 2041925 - RNA, 17 nt, Staphylococcus aureus subsp. aureus Mu50
gaucauuuucauuuaau

SEQ ID NO: 2041926 - RNA, 14 nt, Staphylococcus aureus subsp. aureus Mu50
gaucgcauguuugu

SEQ ID NO: 2041927 - RNA, 13 nt, Staphylococcus aureus subsp. aureus Mu50
gaucugauuucac

SEQ ID NO: 2041928 - RNA, 17 nt, Staphylococcus aureus subsp. aureus Mu50
gaugaaucccauaacaa

SEQ ID NO: 2041929 - RNA, 21 nt, Staphylococcus aureus subsp. aureus Mu50
gaugaaugauugcauugauuu

SEQ ID NO: 2041930 - RNA, 13 nt, Staphylococcus aureus subsp. aureus Mu50
gagguauaauuaa

SEQ ID NO: 2041931 - RNA, 17 nt, Staphylococcus aureus subsp. aureus Mu50
gaggucaucaaaaguuu

SEQ ID NO: 2041932 - RNA, 13 nt, Staphylococcus aureus subsp. aureus Mu50
gauaaaacuaaug

SEQ ID NO: 2041933 - RNA, 12 nt, Staphylococcus aureus subsp. aureus Mu50
gauaaaauaaau

SEQ ID NO: 2041934 - RNA, 17 nt, Staphylococcus aureus subsp. aureus Mu50
gaguuuaaucgcauugu

SEQ ID NO: 2041935 - RNA, 18 nt, Staphylococcus aureus subsp. aureus Mu50
gauacauaaaauggcauc

SEQ ID NO: 2041936 - RNA, 22 nt, Staphylococcus aureus subsp. aureus Mu50
gauaaauugaguuuuuuaaaau

SEQ ID NO: 2041937 - RNA, 21 nt, Staphylococcus aureus subsp. aureus Mu50
gauaacaauuuuaaaucuuuu

SEQ ID NO: 2041938 - RNA, 17 nt, Staphylococcus aureus subsp. aureus Mu50
gauaaauguauuaaaca

SEQ ID NO: 2041939 - RNA, 13 nt, Staphylococcus aureus subsp. aureus Mu50
gauaaauuaauau

SEQ ID NO: 2041940 - RNA, 19 nt, Staphylococcus aureus subsp. aureus Mu50
gauaaaugaauugucuuaa

SEQ ID NO: 2041941 - RNA, 22 nt, Staphylococcus aureus subsp. aureus Mu50
gauaaaugaauugucuuaauau

SEQ ID NO: 2041942 - RNA, 18 nt, Staphylococcus aureus subsp. aureus Mu50
gauaaaguaugagugaua

SEQ ID NO: 2041943 - RNA, 21 nt, Staphylococcus aureus subsp. aureus Mu50
gauaaauaacuuuaccaccau

SEQ ID NO: 2041944 - RNA, 21 nt, Staphylococcus aureus subsp. aureus Mu50
gauacuguauuuauaauuuca

SEQ ID NO: 2041945 - RNA, 21 nt, Staphylococcus aureus subsp. aureus Mu50
gauacuuuggcagacguauca

SEQ ID NO: 2041946 - RNA, 18 nt, Staphylococcus aureus subsp. aureus Mu50
gauauucgcgaacguuau

SEQ ID NO: 2041947 - RNA, 20 nt, Staphylococcus aureus subsp. aureus Mu50
gauauaacauuaaaaugaua

SEQ ID NO: 2041948 - RNA, 16 nt, Staphylococcus aureus subsp. aureus Mu50
gauauaaaaaaccgua

SEQ ID NO: 2041949 - RNA, 23 nt, Staphylococcus aureus subsp. aureus Mu50
gauauaaaaagugaaaguauuag

SEQ ID NO: 2041950 - RNA, 20 nt, Staphylococcus aureus subsp. aureus Mu50
gauauauguaacauaaagcu

SEQ ID NO: 2041951 - RNA, 21 nt, Staphylococcus aureus subsp. aureus Mu50
gauaucagcuaaguuaaauau

SEQ ID NO: 2041952 - RNA, 16 nt, Staphylococcus aureus subsp. aureus Mu50
cagaaaauuauacugu

SEQ ID NO: 2041953 - RNA, 18 nt, Staphylococcus aureus subsp. aureus Mu50
cacuuuuuuguucaauca

SEQ ID NO: 2041954 - RNA, 19 nt, Staphylococcus aureus subsp. aureus Mu50
cacuuuuuuuaauuugauu

SEQ ID NO: 2041955 - RNA, 14 nt, Staphylococcus aureus subsp. aureus Mu50
cagaaauaccacga

SEQ ID NO: 2041956 - RNA, 13 nt, Staphylococcus aureus subsp. aureus Mu50
cagaaaguugcac

SEQ ID NO: 2041957 - RNA, 16 nt, Staphylococcus aureus subsp. aureus Mu50
cacucauauuacuuug

SEQ ID NO: 2041958 - RNA, 23 nt, Staphylococcus aureus subsp. aureus Mu50
cagcaaauaaaaucauaacgaca

SEQ ID NO: 2041959 - RNA, 17 nt, Staphylococcus aureus subsp. aureus Mu50
cagacuucuuucaauua

SEQ ID NO: 2041960 - RNA, 17 nt, Staphylococcus aureus subsp. aureus Mu50
cacguauauacgauuga

SEQ ID NO: 2041961 - RNA, 20 nt, Staphylococcus aureus subsp. aureus Mu50
cacguucuugguauuuuuua

SEQ ID NO: 2041962 - RNA, 15 nt, Staphylococcus aureus subsp. aureus Mu50
cacuaaaguaaauaa

SEQ ID NO: 2041963 - RNA, 18 nt, Staphylococcus aureus subsp. aureus Mu50
cacuaauggauaugauaa

SEQ ID NO: 2041964 - RNA, 17 nt, Staphylococcus aureus subsp. aureus Mu50
cacuaauggcacuuaau

SEQ ID NO: 2041965 - RNA, 22 nt, Staphylococcus aureus subsp. aureus Mu50
cacuauaaaauucaccaacuga

SEQ ID NO: 2041966 - RNA, 21 nt, Staphylococcus aureus subsp. aureus Mu50
cacuaucuguuguuauauaaa

SEQ ID NO: 2041967 - RNA, 14 nt, Staphylococcus aureus subsp. aureus Mu50
cacuauaauuucuu

SEQ ID NO: 2041968 - RNA, 17 nt, Staphylococcus aureus subsp. aureus Mu50
cacuauacaaucauaaa

SEQ ID NO: 2041969 - RNA, 22 nt, Staphylococcus aureus subsp. aureus Mu50
cagcgaucuuuuuuauuuaauu

SEQ ID NO: 2041970 - RNA, 21 nt, Staphylococcus aureus subsp. aureus Mu50
cauagaugacgaucuauaauu

SEQ ID NO: 2041971 - RNA, 13 nt, Staphylococcus aureus subsp. aureus Mu50
cauagaguaauuu

SEQ ID NO: 2041972 - RNA, 15 nt, Staphylococcus aureus subsp. aureus Mu50
cauagauuauauuau

SEQ ID NO: 2041973 - RNA, 17 nt, Staphylococcus aureus subsp. aureus Mu50
caucaauaaauauugau

SEQ ID NO: 2041974 - RNA, 14 nt, Staphylococcus aureus subsp. aureus Mu50
caucaauaacuaua

SEQ ID NO: 2041975 - RNA, 14 nt, Staphylococcus aureus subsp. aureus Mu50
caucaaguugauaa

SEQ ID NO: 2041976 - RNA, 21 nt, Staphylococcus aureus subsp. aureus Mu50
caucaccugaugaauagauaa

SEQ ID NO: 2041977 - RNA, 13 nt, Staphylococcus aureus subsp. aureus Mu50
caucaauauugau

SEQ ID NO: 2041978 - RNA, 16 nt, Staphylococcus aureus subsp. aureus Mu50
cauccucauaauuauc

SEQ ID NO: 2041979 - RNA, 20 nt, Staphylococcus aureus subsp. aureus Mu50
cagguguuuuaccuuuaauu

SEQ ID NO: 2041980 - RNA, 12 nt, Staphylococcus aureus subsp. aureus Mu50
caguaucuaaau

SEQ ID NO: 2041981 - RNA, 23 nt, Staphylococcus aureus subsp. aureus Mu50
caguauaaguuucuggcauaucg

SEQ ID NO: 2041982 - RNA, 20 nt, Staphylococcus aureus subsp. aureus Mu50
caguauacgaguuauaucuu

SEQ ID NO: 2041983 - RNA, 21 nt, Staphylococcus aureus subsp. aureus Mu50
caguaguuaauugaaugaaaa

SEQ ID NO: 2041984 - RNA, 23 nt, Staphylococcus aureus subsp. aureus Mu50
caguaaucuuguuuucauuuaaa

SEQ ID NO: 2041985 - RNA, 19 nt, Staphylococcus aureus subsp. aureus Mu50
caguaaucaaaguaucagu

SEQ ID NO: 2041986 - RNA, 18 nt, Staphylococcus aureus subsp. aureus Mu50
caguauuugccuuuugaa

SEQ ID NO: 2041987 - RNA, 13 nt, Staphylococcus aureus subsp. aureus Mu50
caguaauauguug

SEQ ID NO: 2041988 - RNA, 15 nt, Staphylococcus aureus subsp. aureus Mu50
caguaauauguugcu

SEQ ID NO: 2041989 - RNA, 14 nt, Staphylococcus aureus subsp. aureus Mu50
caguaagauuauuu

SEQ ID NO: 2041990 - RNA, 22 nt, Staphylococcus aureus subsp. aureus Mu50
caguaaauugauucuuugguga

SEQ ID NO: 2041991 - RNA, 23 nt, Staphylococcus aureus subsp. aureus Mu50
cagguuuuuuauuuucauauaaa

SEQ ID NO: 2041992 - RNA, 13 nt, Staphylococcus aureus subsp. aureus Mu50
caguuuuuaaauc

SEQ ID NO: 2041993 - RNA, 18 nt, Staphylococcus aureus subsp. aureus Mu50
cauaaaguuuauuuaugu

SEQ ID NO: 2041994 - RNA, 23 nt, Staphylococcus aureus subsp. aureus Mu50
cauaaauaacacgauuugguuga

SEQ ID NO: 2041995 - RNA, 19 nt, Staphylococcus aureus subsp. aureus Mu50
cauaaaauuaacuuaaaau

SEQ ID NO: 2041996 - RNA, 18 nt, Staphylococcus aureus subsp. aureus Mu50
cauaaaauuuaaaacaau

SEQ ID NO: 2041997 - RNA, 18 nt, Staphylococcus aureus subsp. aureus Mu50
cauaaaaaucauaaauaa

SEQ ID NO: 2041998 - RNA, 22 nt, Staphylococcus aureus subsp. aureus Mu50
cauaaggucuuggacuaauaau

SEQ ID NO: 2041999 - RNA, 14 nt, Staphylococcus aureus subsp. aureus Mu50
cauaaauauuuucu

SEQ ID NO: 2042000 - RNA, 17 nt, Staphylococcus aureus subsp. aureus Mu50
cauaauacuucucaauu

SEQ ID NO: 2042001 - RNA, 16 nt, Staphylococcus aureus subsp. aureus Mu50
cauaauagauaaugca

SEQ ID NO: 2042002 - RNA, 22 nt, Staphylococcus aureus subsp. aureus Mu50
cauaauaaaucuaucuacucaa

SEQ ID NO: 2042003 - RNA, 17 nt, Staphylococcus aureus subsp. aureus Mu50
cauaauauugaugaaua

SEQ ID NO: 2042004 - RNA, 19 nt, Staphylococcus aureus subsp. aureus Mu50
cauaauauugaugaauaaa

SEQ ID NO: 2042005 - RNA, 20 nt, Staphylococcus aureus subsp. aureus Mu50
cauaauauugaugaauaaau

SEQ ID NO: 2042006 - RNA, 22 nt, Staphylococcus aureus subsp. aureus Mu50
cauaauauugaugaauaaauag

SEQ ID NO: 2042007 - RNA, 22 nt, Staphylococcus aureus subsp. aureus Mu50
cauaauauuucuuaccauuuau

SEQ ID NO: 2042008 - RNA, 14 nt, Staphylococcus aureus subsp. aureus Mu50
cauacgcaaugauu

SEQ ID NO: 2042009 - RNA, 16 nt, Staphylococcus aureus subsp. aureus Mu50
cauacgaauuaaaaua

SEQ ID NO: 2042010 - RNA, 17 nt, Staphylococcus aureus subsp. aureus Mu50
cauacgaauuaaaauaa

SEQ ID NO: 2042011 - RNA, 16 nt, Staphylococcus aureus subsp. aureus Mu50
cauacagccauugaca

SEQ ID NO: 2042012 - RNA, 17 nt, Staphylococcus aureus subsp. aureus Mu50
cauaccuaauaacgcau

SEQ ID NO: 2042013 - RNA, 14 nt, Staphylococcus aureus subsp. aureus Mu50
cauaccugcauauu

SEQ ID NO: 2042014 - RNA, 14 nt, Staphylococcus aureus subsp. aureus Mu50
cauaauuaucauau

SEQ ID NO: 2042015 - RNA, 22 nt, Staphylococcus aureus subsp. aureus Mu50
cauaauuugauguucuugaaaa

SEQ ID NO: 2042016 - RNA, 15 nt, Staphylococcus aureus subsp. aureus Mu50
cauaauuuaaaugau

SEQ ID NO: 2042017 - RNA, 21 nt, Staphylococcus aureus subsp. aureus Mu50
cauaauuuaaaugauauugaa

SEQ ID NO: 2042018 - RNA, 12 nt, Staphylococcus aureus subsp. aureus Mu50
cauaauuuaucu

SEQ ID NO: 2042019 - RNA, 23 nt, Staphylococcus aureus subsp. aureus Mu50
cauacacaaugcccuuaaagcac

SEQ ID NO: 2042020 - RNA, 14 nt, Staphylococcus aureus subsp. aureus Mu50
cauacacuaucauu

SEQ ID NO: 2042021 - RNA, 19 nt, Staphylococcus aureus subsp. aureus Mu50
cauaaugaauaauuaaaaa

SEQ ID NO: 2042022 - RNA, 17 nt, Staphylococcus aureus subsp. aureus Mu50
cauaaugaauucauuca

SEQ ID NO: 2042023 - RNA, 21 nt, Staphylococcus aureus subsp. aureus Mu50
cauaaucaagucugcauuaau

SEQ ID NO: 2042024 - RNA, 21 nt, Staphylococcus aureus subsp. aureus Mu50
cauaaucguauucauaucauu

SEQ ID NO: 2042025 - RNA, 11 nt, Staphylococcus aureus subsp. aureus Mu50
cauaaucaauu

SEQ ID NO: 2042026 - RNA, 13 nt, Staphylococcus aureus subsp. aureus Mu50
cauaaucaauuuc

SEQ ID NO: 2042027 - RNA, 17 nt, Staphylococcus aureus subsp. aureus Mu50
cauaauccauucuucuu

SEQ ID NO: 2042028 - RNA, 21 nt, Staphylococcus aureus subsp. aureus Mu50
cauaauaucuuacuacuuaau

SEQ ID NO: 2042029 - RNA, 11 nt, Staphylococcus aureus subsp. aureus Mu50
caguuaauaau

SEQ ID NO: 2042030 - RNA, 11 nt, Staphylococcus aureus subsp. aureus Mu50
caguuaaauua

SEQ ID NO: 2042031 - RNA, 19 nt, Staphylococcus aureus subsp. aureus Mu50
caggaauaucuuucaaauu

SEQ ID NO: 2042032 - RNA, 14 nt, Staphylococcus aureus subsp. aureus Mu50
caggcaacuuuuau

SEQ ID NO: 2042033 - RNA, 15 nt, Staphylococcus aureus subsp. aureus Mu50
cagcucuuaaaucac

SEQ ID NO: 2042034 - RNA, 20 nt, Staphylococcus aureus subsp. aureus Mu50
cagcuucuuuaacaauugau

SEQ ID NO: 2042035 - RNA, 18 nt, Staphylococcus aureus subsp. aureus Mu50
caggcguaucuguuuaug

SEQ ID NO: 2042036 - RNA, 17 nt, Staphylococcus aureus subsp. aureus Mu50
ccaaugaauaaauugau

SEQ ID NO: 2042037 - RNA, 19 nt, Staphylococcus aureus subsp. aureus Mu50
ccaaucuauuuuaaacuca

SEQ ID NO: 2042038 - RNA, 18 nt, Staphylococcus aureus subsp. aureus Mu50
ccaaugauagugaauaau

SEQ ID NO: 2042039 - RNA, 21 nt, Staphylococcus aureus subsp. aureus Mu50
ccaauuaaccuugauuuaauu

SEQ ID NO: 2042040 - RNA, 23 nt, Staphylococcus aureus subsp. aureus Mu50
ccaauucauuuuauaaaucaaag

SEQ ID NO: 2042041 - RNA, 16 nt, Staphylococcus aureus subsp. aureus Mu50
ccaauuccgccacacc

SEQ ID NO: 2042042 - RNA, 21 nt, Staphylococcus aureus subsp. aureus Mu50
ccaauuccuuggugucgaaau

SEQ ID NO: 2042043 - RNA, 12 nt, Staphylococcus aureus subsp. aureus Mu50
ccaauuuguuga

SEQ ID NO: 2042044 - RNA, 18 nt, Staphylococcus aureus subsp. aureus Mu50
ccaauaucuucuuuuaau

SEQ ID NO: 2042045 - RNA, 14 nt, Staphylococcus aureus subsp. aureus Mu50
caugauuucuucuc

SEQ ID NO: 2042046 - RNA, 15 nt, Staphylococcus aureus subsp. aureus Mu50
caugugucauaaucc

SEQ ID NO: 2042047 - RNA, 16 nt, Staphylococcus aureus subsp. aureus Mu50
caugugucuuccaauc

SEQ ID NO: 2042048 - RNA, 16 nt, Staphylococcus aureus subsp. aureus Mu50
cauggcgauuccaauc

SEQ ID NO: 2042049 - RNA, 15 nt, Staphylococcus aureus subsp. aureus Mu50
cauugauaagucuug

SEQ ID NO: 2042050 - RNA, 17 nt, Staphylococcus aureus subsp. aureus Mu50
cauugagauuaucuuua

SEQ ID NO: 2042051 - RNA, 21 nt, Staphylococcus aureus subsp. aureus Mu50
cauuguuucagcugcaauuuu

SEQ ID NO: 2042052 - RNA, 14 nt, Staphylococcus aureus subsp. aureus Mu50
cauuuaauuuguua

SEQ ID NO: 2042053 - RNA, 18 nt, Staphylococcus aureus subsp. aureus Mu50
cauuuaaaauauuuuuuc

SEQ ID NO: 2042054 - RNA, 17 nt, Staphylococcus aureus subsp. aureus Mu50
cauugcacuaugcauaa

SEQ ID NO: 2042055 - RNA, 22 nt, Staphylococcus aureus subsp. aureus Mu50
cauuuagaugauucuuaucauu

SEQ ID NO: 2042056 - RNA, 18 nt, Staphylococcus aureus subsp. aureus Mu50
cauuuaguuaaauacaaa

SEQ ID NO: 2042057 - RNA, 14 nt, Staphylococcus aureus subsp. aureus Mu50
cauuuauuuucaau

SEQ ID NO: 2042058 - RNA, 19 nt, Staphylococcus aureus subsp. aureus Mu50
cauuuauuuucuuugguga

SEQ ID NO: 2042059 - RNA, 14 nt, Staphylococcus aureus subsp. aureus Mu50
cauuucaauauuaa

SEQ ID NO: 2042060 - RNA, 17 nt, Staphylococcus aureus subsp. aureus Mu50
cauuuauaugauguuca

SEQ ID NO: 2042061 - RNA, 19 nt, Staphylococcus aureus subsp. aureus Mu50
cauuuaucaacaauggaaa

SEQ ID NO: 2042062 - RNA, 23 nt, Staphylococcus aureus subsp. aureus Mu50
cauuuuuagaaucaaaaaagaca

SEQ ID NO: 2042063 - RNA, 14 nt, Staphylococcus aureus subsp. aureus Mu50
cauuuuuauauuga

SEQ ID NO: 2042064 - RNA, 20 nt, Staphylococcus aureus subsp. aureus Mu50
cauuuuuaucccacuccuua

SEQ ID NO: 2042065 - RNA, 13 nt, Staphylococcus aureus subsp. aureus Mu50
cauuuuuggcuua

SEQ ID NO: 2042066 - RNA, 12 nt, Staphylococcus aureus subsp. aureus Mu50
cauuuuguuuca

SEQ ID NO: 2042067 - RNA, 18 nt, Staphylococcus aureus subsp. aureus Mu50
cauuuuuucgagaugaua

SEQ ID NO: 2042068 - RNA, 22 nt, Staphylococcus aureus subsp. aureus Mu50
ccaacaauagguacaacuaaau

SEQ ID NO: 2042069 - RNA, 16 nt, Staphylococcus aureus subsp. aureus Mu50
ccaaaaugguuaaaau

SEQ ID NO: 2042070 - RNA, 21 nt, Staphylococcus aureus subsp. aureus Mu50
ccaaauugaugacuuacuaau

SEQ ID NO: 2042071 - RNA, 16 nt, Staphylococcus aureus subsp. aureus Mu50
ccaacacccauauaau

SEQ ID NO: 2042072 - RNA, 16 nt, Staphylococcus aureus subsp. aureus Mu50
cauuaaucuauauaaa

SEQ ID NO: 2042073 - RNA, 19 nt, Staphylococcus aureus subsp. aureus Mu50
cauuaaugauagcaaugaa

SEQ ID NO: 2042074 - RNA, 16 nt, Staphylococcus aureus subsp. aureus Mu50
cauuaauuggauuaaa

SEQ ID NO: 2042075 - RNA, 14 nt, Staphylococcus aureus subsp. aureus Mu50
cauuaauuucaugu

SEQ ID NO: 2042076 - RNA, 23 nt, Staphylococcus aureus subsp. aureus Mu50
cauuacauuuggcguaaugauau

SEQ ID NO: 2042077 - RNA, 19 nt, Staphylococcus aureus subsp. aureus Mu50
cauuaauuugucauuucuu

SEQ ID NO: 2042078 - RNA, 22 nt, Staphylococcus aureus subsp. aureus Mu50
cauuaauuugucauuucuucuu

SEQ ID NO: 2042079 - RNA, 17 nt, Staphylococcus aureus subsp. aureus Mu50
cauuacaaaucaugaca

SEQ ID NO: 2042080 - RNA, 17 nt, Staphylococcus aureus subsp. aureus Mu50
cauuaauuucaugugca

SEQ ID NO: 2042081 - RNA, 17 nt, Staphylococcus aureus subsp. aureus Mu50
cauuagcauuauuauuu

SEQ ID NO: 2042082 - RNA, 20 nt, Staphylococcus aureus subsp. aureus Mu50
cauuacuuggaaauguauau

SEQ ID NO: 2042083 - RNA, 18 nt, Staphylococcus aureus subsp. aureus Mu50
cauuagcaaauauuauua

SEQ ID NO: 2042084 - RNA, 20 nt, Staphylococcus aureus subsp. aureus Mu50
cauuagcaaauauuauuaaa

SEQ ID NO: 2042085 - RNA, 13 nt, Staphylococcus aureus subsp. aureus Mu50
cauuagauaauaa

SEQ ID NO: 2042086 - RNA, 21 nt, Staphylococcus aureus subsp. aureus Mu50
cauuacgccaccaguuucaag

SEQ ID NO: 2042087 - RNA, 23 nt, Staphylococcus aureus subsp. aureus Mu50
cauuaaccaguauaauuuucugu

SEQ ID NO: 2042088 - RNA, 15 nt, Staphylococcus aureus subsp. aureus Mu50
cauuaaaucugauuc

SEQ ID NO: 2042089 - RNA, 13 nt, Staphylococcus aureus subsp. aureus Mu50
cauuaaauugcuu

SEQ ID NO: 2042090 - RNA, 19 nt, Staphylococcus aureus subsp. aureus Mu50
cauguuuggaugaacaaaa

SEQ ID NO: 2042091 - RNA, 16 nt, Staphylococcus aureus subsp. aureus Mu50
cauuaaaauugcagcu

SEQ ID NO: 2042092 - RNA, 23 nt, Staphylococcus aureus subsp. aureus Mu50
cauguuuaaauaucaugcaaaac

SEQ ID NO: 2042093 - RNA, 14 nt, Staphylococcus aureus subsp. aureus Mu50
cauuauuuaaauaa

SEQ ID NO: 2042094 - RNA, 15 nt, Staphylococcus aureus subsp. aureus Mu50
cauucaaauaaauga

SEQ ID NO: 2042095 - RNA, 20 nt, Staphylococcus aureus subsp. aureus Mu50
cauuauuacugauuguuaac

SEQ ID NO: 2042096 - RNA, 15 nt, Staphylococcus aureus subsp. aureus Mu50
cauuaguucuguuga

SEQ ID NO: 2042097 - RNA, 20 nt, Staphylococcus aureus subsp. aureus Mu50
cauuaguucuguugauauuu

SEQ ID NO: 2042098 - RNA, 17 nt, Staphylococcus aureus subsp. aureus Mu50
cauuauauaauucuuca

SEQ ID NO: 2042099 - RNA, 20 nt, Staphylococcus aureus subsp. aureus Mu50
cauuauaauggacuaauuua

SEQ ID NO: 2042100 - RNA, 18 nt, Staphylococcus aureus subsp. aureus Mu50
cauuauaguguucaagcu

SEQ ID NO: 2042101 - RNA, 14 nt, Staphylococcus aureus subsp. aureus Mu50
cauugaauaaauga

SEQ ID NO: 2042102 - RNA, 18 nt, Staphylococcus aureus subsp. aureus Mu50
cauugaccaccuuuaucu

SEQ ID NO: 2042103 - RNA, 16 nt, Staphylococcus aureus subsp. aureus Mu50
cauucacuucaaguua

SEQ ID NO: 2042104 - RNA, 13 nt, Staphylococcus aureus subsp. aureus Mu50
cauucacuucaag

SEQ ID NO: 2042105 - RNA, 23 nt, Staphylococcus aureus subsp. aureus Mu50
cauucgaugcuaaaaauauugaa

SEQ ID NO: 2042106 - RNA, 20 nt, Staphylococcus aureus subsp. aureus Mu50
ccagcuugaccgccuaugau

SEQ ID NO: 2042107 - RNA, 15 nt, Staphylococcus aureus subsp. aureus Mu50
ccacuucaucuaaau

SEQ ID NO: 2042108 - RNA, 20 nt, Staphylococcus aureus subsp. aureus Mu50
ccagauucauaucuuucaau

SEQ ID NO: 2042109 - RNA, 15 nt, Staphylococcus aureus subsp. aureus Mu50
ccauuaguacuaaac

SEQ ID NO: 2042110 - RNA, 18 nt, Staphylococcus aureus subsp. aureus Mu50
ccauuaguucuguugaua

SEQ ID NO: 2042111 - RNA, 23 nt, Staphylococcus aureus subsp. aureus Mu50
ccauuaucaagaacuuuaaaaau

SEQ ID NO: 2042112 - RNA, 23 nt, Staphylococcus aureus subsp. aureus Mu50
ccauuacugcagcaucauaaucu

SEQ ID NO: 2042113 - RNA, 11 nt, Staphylococcus aureus subsp. aureus Mu50
ccaucuuuaau

SEQ ID NO: 2042114 - RNA, 20 nt, Staphylococcus aureus subsp. aureus Mu50
ccauacuucuauuuuauaau

SEQ ID NO: 2042115 - RNA, 16 nt, Staphylococcus aureus subsp. aureus Mu50
ccauaaugacuauaac

SEQ ID NO: 2042116 - RNA, 21 nt, Staphylococcus aureus subsp. aureus Mu50
ccaucauguacaguuacuuuc

SEQ ID NO: 2042117 - RNA, 19 nt, Staphylococcus aureus subsp. aureus Mu50
ccaucaucucugcuuuaau

SEQ ID NO: 2042118 - RNA, 14 nt, Staphylococcus aureus subsp. aureus Mu50
ccaucauaaauguu

SEQ ID NO: 2042119 - RNA, 21 nt, Staphylococcus aureus subsp. aureus Mu50
ccccauuuauguguuggcuuu

SEQ ID NO: 2042120 - RNA, 15 nt, Staphylococcus aureus subsp. aureus Mu50
cccauuugucuuaau

SEQ ID NO: 2042121 - RNA, 18 nt, Staphylococcus aureus subsp. aureus Mu50
cccagauucauaucuuuc

SEQ ID NO: 2042122 - RNA, 21 nt, Staphylococcus aureus subsp. aureus Mu50
cccagauucauaucuuucaau

SEQ ID NO: 2042123 - RNA, 23 nt, Staphylococcus aureus subsp. aureus Mu50
ccauugaaugaaucccauaauga

SEQ ID NO: 2042124 - RNA, 11 nt, Staphylococcus aureus subsp. aureus Mu50
cccuuaauaau

SEQ ID NO: 2042125 - RNA, 12 nt, Staphylococcus aureus subsp. aureus Mu50
cccuuaauaaua

SEQ ID NO: 2042126 - RNA, 18 nt, Staphylococcus aureus subsp. aureus Mu50
cccuuaaaucaaguauau

SEQ ID NO: 2042127 - RNA, 20 nt, Staphylococcus aureus subsp. aureus Mu50
aucacaucauaccaauccga

SEQ ID NO: 2042128 - RNA, 15 nt, Staphylococcus aureus subsp. aureus Mu50
aucacagcaauaaua

SEQ ID NO: 2042129 - RNA, 18 nt, Staphylococcus aureus subsp. aureus Mu50
aucacauaugauaauuaa

SEQ ID NO: 2042130 - RNA, 15 nt, Staphylococcus aureus subsp. aureus Mu50
aucacauucaauauu

SEQ ID NO: 2042131 - RNA, 19 nt, Staphylococcus aureus subsp. aureus Mu50
aucaccugaugaauagaua

SEQ ID NO: 2042132 - RNA, 16 nt, Staphylococcus aureus subsp. aureus Mu50
aucacgauaauguaua

SEQ ID NO: 2042133 - RNA, 14 nt, Staphylococcus aureus subsp. aureus Mu50
aucacgauuuucaa

SEQ ID NO: 2042134 - RNA, 16 nt, Staphylococcus aureus subsp. aureus Mu50
aucacgauuuucaagu

SEQ ID NO: 2042135 - RNA, 17 nt, Staphylococcus aureus subsp. aureus Mu50
aucacuaaaguaaauaa

SEQ ID NO: 2042136 - RNA, 15 nt, Staphylococcus aureus subsp. aureus Mu50
aucacuguagauuca

SEQ ID NO: 2042137 - RNA, 19 nt, Staphylococcus aureus subsp. aureus Mu50
auauuuaaacucucuaaaa

SEQ ID NO: 2042138 - RNA, 14 nt, Staphylococcus aureus subsp. aureus Mu50
auauuuaaaugucu

SEQ ID NO: 2042139 - RNA, 19 nt, Staphylococcus aureus subsp. aureus Mu50
auauuuauucuaaguuaaa

SEQ ID NO: 2042140 - RNA, 13 nt, Staphylococcus aureus subsp. aureus Mu50
auauuuauuuuaa

SEQ ID NO: 2042141 - RNA, 15 nt, Staphylococcus aureus subsp. aureus Mu50
auauuuauuuuauaa

SEQ ID NO: 2042142 - RNA, 12 nt, Staphylococcus aureus subsp. aureus Mu50
auauuucuaaau

SEQ ID NO: 2042143 - RNA, 13 nt, Staphylococcus aureus subsp. aureus Mu50
auauuucuaaauu

SEQ ID NO: 2042144 - RNA, 14 nt, Staphylococcus aureus subsp. aureus Mu50
auauuucuaaauua

SEQ ID NO: 2042145 - RNA, 15 nt, Staphylococcus aureus subsp. aureus Mu50
auauuuaacaaaauu

SEQ ID NO: 2042146 - RNA, 16 nt, Staphylococcus aureus subsp. aureus Mu50
auauuuaacaaaauua

SEQ ID NO: 2042147 - RNA, 13 nt, Staphylococcus aureus subsp. aureus Mu50
auauuuaaccuuu

SEQ ID NO: 2042148 - RNA, 20 nt, Staphylococcus aureus subsp. aureus Mu50
auauuauaaaccuaaugcuu

SEQ ID NO: 2042149 - RNA, 12 nt, Staphylococcus aureus subsp. aureus Mu50
auauuuaaacuc

SEQ ID NO: 2042150 - RNA, 13 nt, Staphylococcus aureus subsp. aureus Mu50
auauuaauuuuac

SEQ ID NO: 2042151 - RNA, 16 nt, Staphylococcus aureus subsp. aureus Mu50
auauuagugacauuug

SEQ ID NO: 2042152 - RNA, 23 nt, Staphylococcus aureus subsp. aureus Mu50
auauuagugacauuugcaugcuu

SEQ ID NO: 2042153 - RNA, 20 nt, Staphylococcus aureus subsp. aureus Mu50
auauguauguuuuaucaaua

SEQ ID NO: 2042154 - RNA, 16 nt, Staphylococcus aureus subsp. aureus Mu50
auauguuguuucuaau

SEQ ID NO: 2042155 - RNA, 16 nt, Staphylococcus aureus subsp. aureus Mu50
auauguuuuaugauuu

SEQ ID NO: 2042156 - RNA, 19 nt, Staphylococcus aureus subsp. aureus Mu50
auauuaaggucauuuuuaa

SEQ ID NO: 2042157 - RNA, 22 nt, Staphylococcus aureus subsp. aureus Mu50
auauuaagucuagcauuagaau

SEQ ID NO: 2042158 - RNA, 16 nt, Staphylococcus aureus subsp. aureus Mu50
auauuaauauaaaaua

SEQ ID NO: 2042159 - RNA, 17 nt, Staphylococcus aureus subsp. aureus Mu50
auauuaaaaauuucaau

SEQ ID NO: 2042160 - RNA, 15 nt, Staphylococcus aureus subsp. aureus Mu50
auauuaaacuuauaa

SEQ ID NO: 2042161 - RNA, 17 nt, Staphylococcus aureus subsp. aureus Mu50
auauuaaacuuauaacu

SEQ ID NO: 2042162 - RNA, 20 nt, Staphylococcus aureus subsp. aureus Mu50
auauuaaauuauuguuuuaa

SEQ ID NO: 2042163 - RNA, 21 nt, Staphylococcus aureus subsp. aureus Mu50
auaugcaaugcaccuauaaua

SEQ ID NO: 2042164 - RNA, 14 nt, Staphylococcus aureus subsp. aureus Mu50
auaugauugcaaau

SEQ ID NO: 2042165 - RNA, 21 nt, Staphylococcus aureus subsp. aureus Mu50
auaugauuuaaaauauaaauu

SEQ ID NO: 2042166 - RNA, 15 nt, Staphylococcus aureus subsp. aureus Mu50
auaugcaacuuauaa

SEQ ID NO: 2042167 - RNA, 21 nt, Staphylococcus aureus subsp. aureus Mu50
auaugcaacuuauaauauuaa

SEQ ID NO: 2042168 - RNA, 15 nt, Staphylococcus aureus subsp. aureus Mu50
auaugcauccuaaaa

SEQ ID NO: 2042169 - RNA, 16 nt, Staphylococcus aureus subsp. aureus Mu50
auaugccauaguaaua

SEQ ID NO: 2042170 - RNA, 22 nt, Staphylococcus aureus subsp. aureus Mu50
auaugaauugcuuguuuuaaau

SEQ ID NO: 2042171 - RNA, 17 nt, Staphylococcus aureus subsp. aureus Mu50
auaugauaaccaaacca

SEQ ID NO: 2042172 - RNA, 14 nt, Staphylococcus aureus subsp. aureus Mu50
auaugauauuaagu

SEQ ID NO: 2042173 - RNA, 19 nt, Staphylococcus aureus subsp. aureus Mu50
auaugauccuuuaaugcuu

SEQ ID NO: 2042174 - RNA, 22 nt, Staphylococcus aureus subsp. aureus Mu50
auauguggcgcucuuauaaaga

SEQ ID NO: 2042175 - RNA, 18 nt, Staphylococcus aureus subsp. aureus Mu50
auaugguuguuuuccaau

SEQ ID NO: 2042176 - RNA, 21 nt, Staphylococcus aureus subsp. aureus Mu50
auaugcguagcaacauuauuu

SEQ ID NO: 2042177 - RNA, 18 nt, Staphylococcus aureus subsp. aureus Mu50
auaugcucucuucaaagu

SEQ ID NO: 2042178 - RNA, 12 nt, Staphylococcus aureus subsp. aureus Mu50
auaucauuuuau

SEQ ID NO: 2042179 - RNA, 20 nt, Staphylococcus aureus subsp. aureus Mu50
auaucauuuuauccaaacca

SEQ ID NO: 2042180 - RNA, 20 nt, Staphylococcus aureus subsp. aureus Mu50
auaucaauuuauuauuaacu

SEQ ID NO: 2042181 - RNA, 16 nt, Staphylococcus aureus subsp. aureus Mu50
auaucacaacacauaa

SEQ ID NO: 2042182 - RNA, 17 nt, Staphylococcus aureus subsp. aureus Mu50
auaucaucauuuaaaua

SEQ ID NO: 2042183 - RNA, 15 nt, Staphylococcus aureus subsp. aureus Mu50
auaucaugaauguca

SEQ ID NO: 2042184 - RNA, 11 nt, Staphylococcus aureus subsp. aureus Mu50
auaucaauaau

SEQ ID NO: 2042185 - RNA, 14 nt, Staphylococcus aureus subsp. aureus Mu50
auaucaccuuuuuu

SEQ ID NO: 2042186 - RNA, 16 nt, Staphylococcus aureus subsp. aureus Mu50
auaucaccuuuuuuaa

SEQ ID NO: 2042187 - RNA, 19 nt, Staphylococcus aureus subsp. aureus Mu50
auaucacgaucuuuaaagu

SEQ ID NO: 2042188 - RNA, 17 nt, Staphylococcus aureus subsp. aureus Mu50
auaucauaccaaaaagu

SEQ ID NO: 2042189 - RNA, 23 nt, Staphylococcus aureus subsp. aureus Mu50
auaucauauuugaauacuuuauu

SEQ ID NO: 2042190 - RNA, 23 nt, Staphylococcus aureus subsp. aureus Mu50
aucaagauguuugcaacauauuu

SEQ ID NO: 2042191 - RNA, 14 nt, Staphylococcus aureus subsp. aureus Mu50
aucaagaaaaaguu

SEQ ID NO: 2042192 - RNA, 20 nt, Staphylococcus aureus subsp. aureus Mu50
aucaagaauauaagugauuu

SEQ ID NO: 2042193 - RNA, 20 nt, Staphylococcus aureus subsp. aureus Mu50
aucaauuuuuacuaaaucau

SEQ ID NO: 2042194 - RNA, 16 nt, Staphylococcus aureus subsp. aureus Mu50
aucaauuucuauuuca

SEQ ID NO: 2042195 - RNA, 20 nt, Staphylococcus aureus subsp. aureus Mu50
aucaauuagccaauaccgaa

SEQ ID NO: 2042196 - RNA, 17 nt, Staphylococcus aureus subsp. aureus Mu50
aucaauccaucaauacc

SEQ ID NO: 2042197 - RNA, 22 nt, Staphylococcus aureus subsp. aureus Mu50
aucaaugagcaagucuucuaaa

SEQ ID NO: 2042198 - RNA, 15 nt, Staphylococcus aureus subsp. aureus Mu50
aucaauauaauuugg

SEQ ID NO: 2042199 - RNA, 24 nt, Staphylococcus aureus subsp. aureus Mu50
aucaauaugaccuuuaugugcauc

SEQ ID NO: 2042200 - RNA, 13 nt, Staphylococcus aureus subsp. aureus Mu50
aucaauauugaua

SEQ ID NO: 2042201 - RNA, 15 nt, Staphylococcus aureus subsp. aureus Mu50
aucaauauuuauauu

SEQ ID NO: 2042202 - RNA, 18 nt, Staphylococcus aureus subsp. aureus Mu50
aucaaagauuuuguugaa

SEQ ID NO: 2042203 - RNA, 17 nt, Staphylococcus aureus subsp. aureus Mu50
aucaaacaacaucacuu

SEQ ID NO: 2042204 - RNA, 23 nt, Staphylococcus aureus subsp. aureus Mu50
auauuuuucgaauuuaaccaguu

SEQ ID NO: 2042205 - RNA, 13 nt, Staphylococcus aureus subsp. aureus Mu50
auauuuuuuaaaa

SEQ ID NO: 2042206 - RNA, 21 nt, Staphylococcus aureus subsp. aureus Mu50
auauuuuuuaaaaugauagcu

SEQ ID NO: 2042207 - RNA, 12 nt, Staphylococcus aureus subsp. aureus Mu50
auauuuuuuuac

SEQ ID NO: 2042208 - RNA, 18 nt, Staphylococcus aureus subsp. aureus Mu50
aucaaaaauaaaaaugcc

SEQ ID NO: 2042209 - RNA, 12 nt, Staphylococcus aureus subsp. aureus Mu50
aucaaaaccgcu

SEQ ID NO: 2042210 - RNA, 19 nt, Staphylococcus aureus subsp. aureus Mu50
auauuuucauguccaucuu

SEQ ID NO: 2042211 - RNA, 20 nt, Staphylococcus aureus subsp. aureus Mu50
auauuugauaaguagaaaau

SEQ ID NO: 2042212 - RNA, 22 nt, Staphylococcus aureus subsp. aureus Mu50
auauuugauaucacuauacaau

SEQ ID NO: 2042213 - RNA, 18 nt, Staphylococcus aureus subsp. aureus Mu50
aucaaccuguucuuuauu

SEQ ID NO: 2042214 - RNA, 14 nt, Staphylococcus aureus subsp. aureus Mu50
aucaaccguuuuau

SEQ ID NO: 2042215 - RNA, 18 nt, Staphylococcus aureus subsp. aureus Mu50
aucaaauuaccauucauc

SEQ ID NO: 2042216 - RNA, 12 nt, Staphylococcus aureus subsp. aureus Mu50
aucaacaacaag

SEQ ID NO: 2042217 - RNA, 14 nt, Staphylococcus aureus subsp. aureus Mu50
aucaacaacaaguu

SEQ ID NO: 2042218 - RNA, 20 nt, Staphylococcus aureus subsp. aureus Mu50
aucaacaguuuuauuaucuu

SEQ ID NO: 2042219 - RNA, 15 nt, Staphylococcus aureus subsp. aureus Mu50
aucaacauaauauuu

SEQ ID NO: 2042220 - RNA, 17 nt, Staphylococcus aureus subsp. aureus Mu50
aucaacaaucuuuuuca

SEQ ID NO: 2042221 - RNA, 22 nt, Staphylococcus aureus subsp. aureus Mu50
auacugcucuuuauauauaaaa

SEQ ID NO: 2042222 - RNA, 17 nt, Staphylococcus aureus subsp. aureus Mu50
auacuccuuucauacau

SEQ ID NO: 2042223 - RNA, 21 nt, Staphylococcus aureus subsp. aureus Mu50
auacucuucaaucuaccaaua

SEQ ID NO: 2042224 - RNA, 17 nt, Staphylococcus aureus subsp. aureus Mu50
auacuucuauuuuauaa

SEQ ID NO: 2042225 - RNA, 23 nt, Staphylococcus aureus subsp. aureus Mu50
auacuucuauuuuauaauaaauu

SEQ ID NO: 2042226 - RNA, 22 nt, Staphylococcus aureus subsp. aureus Mu50
auacuggguuuuaccauaaauu

SEQ ID NO: 2042227 - RNA, 18 nt, Staphylococcus aureus subsp. aureus Mu50
auacugccccaaauguaa

SEQ ID NO: 2042228 - RNA, 13 nt, Staphylococcus aureus subsp. aureus Mu50
auacuucaauaac

SEQ ID NO: 2042229 - RNA, 15 nt, Staphylococcus aureus subsp. aureus Mu50
auacuucaccaucuu

SEQ ID NO: 2042230 - RNA, 16 nt, Staphylococcus aureus subsp. aureus Mu50
auacuucaccaucuuu

SEQ ID NO: 2042231 - RNA, 22 nt, Staphylococcus aureus subsp. aureus Mu50
auagaugcuaauguaaucugaa

SEQ ID NO: 2042232 - RNA, 19 nt, Staphylococcus aureus subsp. aureus Mu50
auagauucugauacagaac

SEQ ID NO: 2042233 - RNA, 13 nt, Staphylococcus aureus subsp. aureus Mu50
auagauuuuguau

SEQ ID NO: 2042234 - RNA, 19 nt, Staphylococcus aureus subsp. aureus Mu50
auagcaaccauauuuuuag

SEQ ID NO: 2042235 - RNA, 18 nt, Staphylococcus aureus subsp. aureus Mu50
auagcaaugaauuaauag

SEQ ID NO: 2042236 - RNA, 23 nt, Staphylococcus aureus subsp. aureus Mu50
auagcaauuugagccauuguuau

SEQ ID NO: 2042237 - RNA, 17 nt, Staphylococcus aureus subsp. aureus Mu50
auagcaaguuuauaaau

SEQ ID NO: 2042238 - RNA, 15 nt, Staphylococcus aureus subsp. aureus Mu50
auacguauauagagu

SEQ ID NO: 2042239 - RNA, 14 nt, Staphylococcus aureus subsp. aureus Mu50
auacguaucaaaau

SEQ ID NO: 2042240 - RNA, 16 nt, Staphylococcus aureus subsp. aureus Mu50
auacguuauuucaaua

SEQ ID NO: 2042241 - RNA, 22 nt, Staphylococcus aureus subsp. aureus Mu50
auacucaacacgauagucauaa

SEQ ID NO: 2042242 - RNA, 18 nt, Staphylococcus aureus subsp. aureus Mu50
auacguugauguaauucu

SEQ ID NO: 2042243 - RNA, 17 nt, Staphylococcus aureus subsp. aureus Mu50
auacguuuccaaucuau

SEQ ID NO: 2042244 - RNA, 12 nt, Staphylococcus aureus subsp. aureus Mu50
auacuauaaaaa

SEQ ID NO: 2042245 - RNA, 13 nt, Staphylococcus aureus subsp. aureus Mu50
auacuauaaauac

SEQ ID NO: 2042246 - RNA, 22 nt, Staphylococcus aureus subsp. aureus Mu50
auacuauaaauacaaauauauc

SEQ ID NO: 2042247 - RNA, 13 nt, Staphylococcus aureus subsp. aureus Mu50
auacuauaagcaa

SEQ ID NO: 2042248 - RNA, 22 nt, Staphylococcus aureus subsp. aureus Mu50
auacuauaugucuuaucaauua

SEQ ID NO: 2042249 - RNA, 15 nt, Staphylococcus aureus subsp. aureus Mu50
auacuaucuacaaua

SEQ ID NO: 2042250 - RNA, 22 nt, Staphylococcus aureus subsp. aureus Mu50
auacuaucuacaauaaccauuu

SEQ ID NO: 2042251 - RNA, 14 nt, Staphylococcus aureus subsp. aureus Mu50
auaccgaauaauuu

SEQ ID NO: 2042252 - RNA, 22 nt, Staphylococcus aureus subsp. aureus Mu50
auaccauugugaugauaauuaa

SEQ ID NO: 2042253 - RNA, 13 nt, Staphylococcus aureus subsp. aureus Mu50
auacauaaucauu

SEQ ID NO: 2042254 - RNA, 14 nt, Staphylococcus aureus subsp. aureus Mu50
auacauccauacuu

SEQ ID NO: 2042255 - RNA, 14 nt, Staphylococcus aureus subsp. aureus Mu50
auacaucaucaagu

SEQ ID NO: 2042256 - RNA, 18 nt, Staphylococcus aureus subsp. aureus Mu50
auacauaucggcccauaa

SEQ ID NO: 2042257 - RNA, 16 nt, Staphylococcus aureus subsp. aureus Mu50
auacaugguacugcuu

SEQ ID NO: 2042258 - RNA, 18 nt, Staphylococcus aureus subsp. aureus Mu50
auaaucucuucaauuuau

SEQ ID NO: 2042259 - RNA, 12 nt, Staphylococcus aureus subsp. aureus Mu50
auaaucucuuua

SEQ ID NO: 2042260 - RNA, 13 nt, Staphylococcus aureus subsp. aureus Mu50
auaaucuauaaau

SEQ ID NO: 2042261 - RNA, 18 nt, Staphylococcus aureus subsp. aureus Mu50
auaaugacucaagugaau

SEQ ID NO: 2042262 - RNA, 13 nt, Staphylococcus aureus subsp. aureus Mu50
auaaucuuuuuua

SEQ ID NO: 2042263 - RNA, 15 nt, Staphylococcus aureus subsp. aureus Mu50
auaaucuuuuuuacu

SEQ ID NO: 2042264 - RNA, 15 nt, Staphylococcus aureus subsp. aureus Mu50
auaaucuuuaacauu

SEQ ID NO: 2042265 - RNA, 16 nt, Staphylococcus aureus subsp. aureus Mu50
auaaucuuuaacauuu

SEQ ID NO: 2042266 - RNA, 18 nt, Staphylococcus aureus subsp. aureus Mu50
auaaugauuuuuauuauu

SEQ ID NO: 2042267 - RNA, 24 nt, Staphylococcus aureus subsp. aureus Mu50
auaaugauuuuuauuauugucauc

SEQ ID NO: 2042268 - RNA, 14 nt, Staphylococcus aureus subsp. aureus Mu50
auaaugaucaagua

SEQ ID NO: 2042269 - RNA, 15 nt, Staphylococcus aureus subsp. aureus Mu50
auaauuaaacauuua

SEQ ID NO: 2042270 - RNA, 11 nt, Staphylococcus aureus subsp. aureus Mu50
auaauuaaugu

SEQ ID NO: 2042271 - RNA, 14 nt, Staphylococcus aureus subsp. aureus Mu50
auaauuaaauauaa

SEQ ID NO: 2042272 - RNA, 23 nt, Staphylococcus aureus subsp. aureus Mu50
auaauuaacugcggcaugcgauu

SEQ ID NO: 2042273 - RNA, 16 nt, Staphylococcus aureus subsp. aureus Mu50
auaaugggaauuguau

SEQ ID NO: 2042274 - RNA, 15 nt, Staphylococcus aureus subsp. aureus Mu50
auaaugguucuauaa

SEQ ID NO: 2042275 - RNA, 21 nt, Staphylococcus aureus subsp. aureus Mu50
auaauguaagcgaauacaaua

SEQ ID NO: 2042276 - RNA, 12 nt, Staphylococcus aureus subsp. aureus Mu50
auaauguacaug

SEQ ID NO: 2042277 - RNA, 15 nt, Staphylococcus aureus subsp. aureus Mu50
auaauguacauguau

SEQ ID NO: 2042278 - RNA, 20 nt, Staphylococcus aureus subsp. aureus Mu50
auaauggacgguauuuucaa

SEQ ID NO: 2042279 - RNA, 15 nt, Staphylococcus aureus subsp. aureus Mu50
auaaugugucaaaua

SEQ ID NO: 2042280 - RNA, 20 nt, Staphylococcus aureus subsp. aureus Mu50
auacacuuuuugacauauuu

SEQ ID NO: 2042281 - RNA, 15 nt, Staphylococcus aureus subsp. aureus Mu50
auacagaugaugcuu

SEQ ID NO: 2042282 - RNA, 20 nt, Staphylococcus aureus subsp. aureus Mu50
auaauuuaaaggcauaauaa

SEQ ID NO: 2042283 - RNA, 23 nt, Staphylococcus aureus subsp. aureus Mu50
auaauuuaauaacguacauuuau

SEQ ID NO: 2042284 - RNA, 17 nt, Staphylococcus aureus subsp. aureus Mu50
auaauuuaauaauguac

SEQ ID NO: 2042285 - RNA, 18 nt, Staphylococcus aureus subsp. aureus Mu50
auaauuuaauaauguaca

SEQ ID NO: 2042286 - RNA, 12 nt, Staphylococcus aureus subsp. aureus Mu50
auaauuuaucuu

SEQ ID NO: 2042287 - RNA, 17 nt, Staphylococcus aureus subsp. aureus Mu50
auaauuuaucuuaauca

SEQ ID NO: 2042288 - RNA, 15 nt, Staphylococcus aureus subsp. aureus Mu50
auacacuuacaaaua

SEQ ID NO: 2042289 - RNA, 17 nt, Staphylococcus aureus subsp. aureus Mu50
auacacugcacaucaua

SEQ ID NO: 2042290 - RNA, 15 nt, Staphylococcus aureus subsp. aureus Mu50
auaauugcuaaaaua

SEQ ID NO: 2042291 - RNA, 17 nt, Staphylococcus aureus subsp. aureus Mu50
auaauuggcagauagaa

SEQ ID NO: 2042292 - RNA, 19 nt, Staphylococcus aureus subsp. aureus Mu50
auaauuuaaagaacuauuu

SEQ ID NO: 2042293 - RNA, 17 nt, Staphylococcus aureus subsp. aureus Mu50
auaauucuucaaauuua

SEQ ID NO: 2042294 - RNA, 20 nt, Staphylococcus aureus subsp. aureus Mu50
auaauugauggcuucucuua

SEQ ID NO: 2042295 - RNA, 19 nt, Staphylococcus aureus subsp. aureus Mu50
auaauucgucuguuucaua

SEQ ID NO: 2042296 - RNA, 22 nt, Staphylococcus aureus subsp. aureus Mu50
auaauuaggauuaacauaacua

SEQ ID NO: 2042297 - RNA, 12 nt, Staphylococcus aureus subsp. aureus Mu50
auaauuaucaua

SEQ ID NO: 2042298 - RNA, 23 nt, Staphylococcus aureus subsp. aureus Mu50
auaauuaacuuacuuuuguaaaa

SEQ ID NO: 2042299 - RNA, 20 nt, Staphylococcus aureus subsp. aureus Mu50
auaauuccugauacaaugau

SEQ ID NO: 2042300 - RNA, 23 nt, Staphylococcus aureus subsp. aureus Mu50
auaauucaucaaguugauaaugu

SEQ ID NO: 2042301 - RNA, 12 nt, Staphylococcus aureus subsp. aureus Mu50
auaaucgccauc

SEQ ID NO: 2042302 - RNA, 20 nt, Staphylococcus aureus subsp. aureus Mu50
auaaucguauucauaucauu

SEQ ID NO: 2042303 - RNA, 13 nt, Staphylococcus aureus subsp. aureus Mu50
auaaucauuuaaa

SEQ ID NO: 2042304 - RNA, 22 nt, Staphylococcus aureus subsp. aureus Mu50
auaaucauaauaagauuuuuua

SEQ ID NO: 2042305 - RNA, 14 nt, Staphylococcus aureus subsp. aureus Mu50
auaaucaauuucac

SEQ ID NO: 2042306 - RNA, 18 nt, Staphylococcus aureus subsp. aureus Mu50
auaagcacgauaaaaaua

SEQ ID NO: 2042307 - RNA, 15 nt, Staphylococcus aureus subsp. aureus Mu50
auaagccauaugcuu

SEQ ID NO: 2042308 - RNA, 14 nt, Staphylococcus aureus subsp. aureus Mu50
auaacaaaacgauu

SEQ ID NO: 2042309 - RNA, 14 nt, Staphylococcus aureus subsp. aureus Mu50
auaacacgauaauu

SEQ ID NO: 2042310 - RNA, 22 nt, Staphylococcus aureus subsp. aureus Mu50
auaagcugaaaaucaucauuau

SEQ ID NO: 2042311 - RNA, 23 nt, Staphylococcus aureus subsp. aureus Mu50
auaagcuacuaagcguuuaauca

SEQ ID NO: 2042312 - RNA, 13 nt, Staphylococcus aureus subsp. aureus Mu50
auaacaaaaauug

SEQ ID NO: 2042313 - RNA, 13 nt, Staphylococcus aureus subsp. aureus Mu50
auaaauugauauu

SEQ ID NO: 2042314 - RNA, 15 nt, Staphylococcus aureus subsp. aureus Mu50
auaaauuuagauauu

SEQ ID NO: 2042315 - RNA, 23 nt, Staphylococcus aureus subsp. aureus Mu50
auaaauuauauuuauuuguacau

SEQ ID NO: 2042316 - RNA, 18 nt, Staphylococcus aureus subsp. aureus Mu50
auaaauuaggucauuuuu

SEQ ID NO: 2042317 - RNA, 21 nt, Staphylococcus aureus subsp. aureus Mu50
auaaauuaaaugcaauacauu

SEQ ID NO: 2042318 - RNA, 15 nt, Staphylococcus aureus subsp. aureus Mu50
auaaauuaaauuuug

SEQ ID NO: 2042319 - RNA, 20 nt, Staphylococcus aureus subsp. aureus Mu50
auaaaugcacaaacaaaagc

SEQ ID NO: 2042320 - RNA, 20 nt, Staphylococcus aureus subsp. aureus Mu50
aguuuuuuagucucguaaua

SEQ ID NO: 2042321 - RNA, 17 nt, Staphylococcus aureus subsp. aureus Mu50
aguuuucaauuuauuaa

SEQ ID NO: 2042322 - RNA, 18 nt, Staphylococcus aureus subsp. aureus Mu50
auaaaaacucuaaaaguu

SEQ ID NO: 2042323 - RNA, 17 nt, Staphylococcus aureus subsp. aureus Mu50
aguuuuugaauaucuaa

SEQ ID NO: 2042324 - RNA, 19 nt, Staphylococcus aureus subsp. aureus Mu50
auaaaaaacgguacagaua

SEQ ID NO: 2042325 - RNA, 21 nt, Staphylococcus aureus subsp. aureus Mu50
auaaaacuuacauuacauaua

SEQ ID NO: 2042326 - RNA, 15 nt, Staphylococcus aureus subsp. aureus Mu50
auaaaagccaugaua

SEQ ID NO: 2042327 - RNA, 20 nt, Staphylococcus aureus subsp. aureus Mu50
auaaaagccucuaaugauua

SEQ ID NO: 2042328 - RNA, 20 nt, Staphylococcus aureus subsp. aureus Mu50
auaaaaguacuuuaaaauug

SEQ ID NO: 2042329 - RNA, 18 nt, Staphylococcus aureus subsp. aureus Mu50
auaaaagucgauaaauau

SEQ ID NO: 2042330 - RNA, 21 nt, Staphylococcus aureus subsp. aureus Mu50
auaaaacaagacuacgaauac

SEQ ID NO: 2042331 - RNA, 15 nt, Staphylococcus aureus subsp. aureus Mu50
aguuuucucuauuga

SEQ ID NO: 2042332 - RNA, 18 nt, Staphylococcus aureus subsp. aureus Mu50
auaaaaaucuuaugaugu

SEQ ID NO: 2042333 - RNA, 16 nt, Staphylococcus aureus subsp. aureus Mu50
aguuguugaaauuucu

SEQ ID NO: 2042334 - RNA, 18 nt, Staphylococcus aureus subsp. aureus Mu50
aguuguugaaauuucugu

SEQ ID NO: 2042335 - RNA, 13 nt, Staphylococcus aureus subsp. aureus Mu50
aguuguguaauaa

SEQ ID NO: 2042336 - RNA, 21 nt, Staphylococcus aureus subsp. aureus Mu50
aguuguuauauucuagauuca

SEQ ID NO: 2042337 - RNA, 17 nt, Staphylococcus aureus subsp. aureus Mu50
aguuguaauuuaaaaua

SEQ ID NO: 2042338 - RNA, 19 nt, Staphylococcus aureus subsp. aureus Mu50
aguuuucaggaauuguuaa

SEQ ID NO: 2042339 - RNA, 22 nt, Staphylococcus aureus subsp. aureus Mu50
aguuuucauuuuuucaaugucu

SEQ ID NO: 2042340 - RNA, 21 nt, Staphylococcus aureus subsp. aureus Mu50
aguuuauaaucuuuuuuacua

SEQ ID NO: 2042341 - RNA, 14 nt, Staphylococcus aureus subsp. aureus Mu50
aguuuauuaauauu

SEQ ID NO: 2042342 - RNA, 19 nt, Staphylococcus aureus subsp. aureus Mu50
aguuuauuaauauuaguga

SEQ ID NO: 2042343 - RNA, 16 nt, Staphylococcus aureus subsp. aureus Mu50
aguuuacgaucauaaa

SEQ ID NO: 2042344 - RNA, 12 nt, Staphylococcus aureus subsp. aureus Mu50
aguuuaagucua

SEQ ID NO: 2042345 - RNA, 14 nt, Staphylococcus aureus subsp. aureus Mu50
aguuuaaaguauaa

SEQ ID NO: 2042346 - RNA, 18 nt, Staphylococcus aureus subsp. aureus Mu50
auaaacuuuaugaaauuu

SEQ ID NO: 2042347 - RNA, 14 nt, Staphylococcus aureus subsp. aureus Mu50
auaaagaaugauuu

SEQ ID NO: 2042348 - RNA, 15 nt, Staphylococcus aureus subsp. aureus Mu50
auaaagcuuugacau

SEQ ID NO: 2042349 - RNA, 19 nt, Staphylococcus aureus subsp. aureus Mu50
auaaagcugauuuuucauu

SEQ ID NO: 2042350 - RNA, 17 nt, Staphylococcus aureus subsp. aureus Mu50
auaaagcugcgauauaa

SEQ ID NO: 2042351 - RNA, 22 nt, Staphylococcus aureus subsp. aureus Mu50
auaaaguauccagaguuaaagu

SEQ ID NO: 2042352 - RNA, 14 nt, Staphylococcus aureus subsp. aureus Mu50
auaaauauaaaaua

SEQ ID NO: 2042353 - RNA, 13 nt, Staphylococcus aureus subsp. aureus Mu50
auaaauaucaauu

SEQ ID NO: 2042354 - RNA, 15 nt, Staphylococcus aureus subsp. aureus Mu50
auaaaucaauguacu

SEQ ID NO: 2042355 - RNA, 13 nt, Staphylococcus aureus subsp. aureus Mu50
auaaaucaauguu

SEQ ID NO: 2042356 - RNA, 13 nt, Staphylococcus aureus subsp. aureus Mu50
auaaauagauaau

SEQ ID NO: 2042357 - RNA, 22 nt, Staphylococcus aureus subsp. aureus Mu50
auaaauaacuuuaccaccauuu

SEQ ID NO: 2042358 - RNA, 21 nt, Staphylococcus aureus subsp. aureus Mu50
auaaauaagcaguaagaugac

SEQ ID NO: 2042359 - RNA, 21 nt, Staphylococcus aureus subsp. aureus Mu50
auaaaucaucauucucaaagg

SEQ ID NO: 2042360 - RNA, 20 nt, Staphylococcus aureus subsp. aureus Mu50
auaaaucgauaaaauguacg

SEQ ID NO: 2042361 - RNA, 18 nt, Staphylococcus aureus subsp. aureus Mu50
auaaaugacuucacauuu

SEQ ID NO: 2042362 - RNA, 22 nt, Staphylococcus aureus subsp. aureus Mu50
auaaaauuuuuuucauaauuaa

SEQ ID NO: 2042363 - RNA, 23 nt, Staphylococcus aureus subsp. aureus Mu50
auaaaaugcuacaauuuccuacc

SEQ ID NO: 2042364 - RNA, 13 nt, Staphylococcus aureus subsp. aureus Mu50
auaaaauggcauc

SEQ ID NO: 2042365 - RNA, 16 nt, Staphylococcus aureus subsp. aureus Mu50
auaaacucaccaaguu

SEQ ID NO: 2042366 - RNA, 17 nt, Staphylococcus aureus subsp. aureus Mu50
auaaacgucacuuuauu

SEQ ID NO: 2042367 - RNA, 17 nt, Staphylococcus aureus subsp. aureus Mu50
auaaacguccaaacaca

SEQ ID NO: 2042368 - RNA, 17 nt, Staphylococcus aureus subsp. aureus Mu50
auaaacuuuaugaaauu

SEQ ID NO: 2042369 - RNA, 21 nt, Staphylococcus aureus subsp. aureus Mu50
auaaacucuaaaagccaucuu

SEQ ID NO: 2042370 - RNA, 14 nt, Staphylococcus aureus subsp. aureus Mu50
auaaaccuacaaua

SEQ ID NO: 2042371 - RNA, 22 nt, Staphylococcus aureus subsp. aureus Mu50
aguucuuagauuuucacuaaua

SEQ ID NO: 2042372 - RNA, 15 nt, Staphylococcus aureus subsp. aureus Mu50
aguugaauauaaaaa

SEQ ID NO: 2042373 - RNA, 22 nt, Staphylococcus aureus subsp. aureus Mu50
aguugaagcuaauucauauuca

SEQ ID NO: 2042374 - RNA, 16 nt, Staphylococcus aureus subsp. aureus Mu50
aguugaagaaauuuga

SEQ ID NO: 2042375 - RNA, 18 nt, Staphylococcus aureus subsp. aureus Mu50
aguuccguugaauuaaca

SEQ ID NO: 2042376 - RNA, 16 nt, Staphylococcus aureus subsp. aureus Mu50
aguuccucgguauuca

SEQ ID NO: 2042377 - RNA, 17 nt, Staphylococcus aureus subsp. aureus Mu50
aguucuagauuauuuaa

SEQ ID NO: 2042378 - RNA, 21 nt, Staphylococcus aureus subsp. aureus Mu50
aguucuaguuuuuuuuauaug

SEQ ID NO: 2042379 - RNA, 21 nt, Staphylococcus aureus subsp. aureus Mu50
aguucuauagguuuauaaaaa

SEQ ID NO: 2042380 - RNA, 16 nt, Staphylococcus aureus subsp. aureus Mu50
aguucuauauaauuua

SEQ ID NO: 2042381 - RNA, 14 nt, Staphylococcus aureus subsp. aureus Mu50
aguccuuuuuuuau

SEQ ID NO: 2042382 - RNA, 13 nt, Staphylococcus aureus subsp. aureus Mu50
agugucuauguug

SEQ ID NO: 2042383 - RNA, 19 nt, Staphylococcus aureus subsp. aureus Mu50
aguguauucauuuuaaauu

SEQ ID NO: 2042384 - RNA, 19 nt, Staphylococcus aureus subsp. aureus Mu50
aguguagggggcauuauua

SEQ ID NO: 2042385 - RNA, 19 nt, Staphylococcus aureus subsp. aureus Mu50
agguuuauaaaaaaucagu

SEQ ID NO: 2042386 - RNA, 18 nt, Staphylococcus aureus subsp. aureus Mu50
agguuuguaagacaacaa

SEQ ID NO: 2042387 - RNA, 21 nt, Staphylococcus aureus subsp. aureus Mu50
agguuuuuuauuuucauauaa

SEQ ID NO: 2042388 - RNA, 21 nt, Staphylococcus aureus subsp. aureus Mu50
aguaaaauaaauacaauagaa

SEQ ID NO: 2042389 - RNA, 14 nt, Staphylococcus aureus subsp. aureus Mu50
aguaaaaacgaaau

SEQ ID NO: 2042390 - RNA, 14 nt, Staphylococcus aureus subsp. aureus Mu50
agguugauuucugc

SEQ ID NO: 2042391 - RNA, 20 nt, Staphylococcus aureus subsp. aureus Mu50
agguuaaauauuuaauugga

SEQ ID NO: 2042392 - RNA, 15 nt, Staphylococcus aureus subsp. aureus Mu50
agguucauuauuuaa

SEQ ID NO: 2042393 - RNA, 14 nt, Staphylococcus aureus subsp. aureus Mu50
aguaucgccaucau

SEQ ID NO: 2042394 - RNA, 16 nt, Staphylococcus aureus subsp. aureus Mu50
aguaucgccaucauuc

SEQ ID NO: 2042395 - RNA, 16 nt, Staphylococcus aureus subsp. aureus Mu50
aguauacgaguuauau

SEQ ID NO: 2042396 - RNA, 20 nt, Staphylococcus aureus subsp. aureus Mu50
aguauagcgcagcaaaugcu

SEQ ID NO: 2042397 - RNA, 17 nt, Staphylococcus aureus subsp. aureus Mu50
aguauauccgcaucuuu

SEQ ID NO: 2042398 - RNA, 17 nt, Staphylococcus aureus subsp. aureus Mu50
aguaucauaauuuuguu

SEQ ID NO: 2042399 - RNA, 20 nt, Staphylococcus aureus subsp. aureus Mu50
aguauccagaguuaaaguca

SEQ ID NO: 2042400 - RNA, 21 nt, Staphylococcus aureus subsp. aureus Mu50
aguauccagaguuaaagucau

SEQ ID NO: 2042401 - RNA, 22 nt, Staphylococcus aureus subsp. aureus Mu50
aguacauaaaugcuaaaaguau

SEQ ID NO: 2042402 - RNA, 15 nt, Staphylococcus aureus subsp. aureus Mu50
aguacacgaauacca

SEQ ID NO: 2042403 - RNA, 18 nt, Staphylococcus aureus subsp. aureus Mu50
aguacagcgguuuguaug

SEQ ID NO: 2042404 - RNA, 17 nt, Staphylococcus aureus subsp. aureus Mu50
aguaauaaguaauaauu

SEQ ID NO: 2042405 - RNA, 15 nt, Staphylococcus aureus subsp. aureus Mu50
aguaauauauaaaag

SEQ ID NO: 2042406 - RNA, 20 nt, Staphylococcus aureus subsp. aureus Mu50
aguaauauauaaaagucguc

SEQ ID NO: 2042407 - RNA, 17 nt, Staphylococcus aureus subsp. aureus Mu50
aguaauauucaacuugu

SEQ ID NO: 2042408 - RNA, 19 nt, Staphylococcus aureus subsp. aureus Mu50
aguaagcagagccauaaug

SEQ ID NO: 2042409 - RNA, 14 nt, Staphylococcus aureus subsp. aureus Mu50
aguaauaaaaugau

SEQ ID NO: 2042410 - RNA, 23 nt, Staphylococcus aureus subsp. aureus Mu50
aguaacuuugucuguauuauuau

SEQ ID NO: 2042411 - RNA, 22 nt, Staphylococcus aureus subsp. aureus Mu50
aguaaucugcaaaugccucuuu

SEQ ID NO: 2042412 - RNA, 20 nt, Staphylococcus aureus subsp. aureus Mu50
aguaaucguaucuucacuug

SEQ ID NO: 2042413 - RNA, 18 nt, Staphylococcus aureus subsp. aureus Mu50
aguaauguuccauauaac

SEQ ID NO: 2042414 - RNA, 22 nt, Staphylococcus aureus subsp. aureus Mu50
aguacaaguugaucaaaaaugu

SEQ ID NO: 2042415 - RNA, 22 nt, Staphylococcus aureus subsp. aureus Mu50
aguaauuuucauuguuucagcu

SEQ ID NO: 2042416 - RNA, 20 nt, Staphylococcus aureus subsp. aureus Mu50
agucaggggccccaacacag

SEQ ID NO: 2042417 - RNA, 17 nt, Staphylococcus aureus subsp. aureus Mu50
agucaguauaaguuucu

SEQ ID NO: 2042418 - RNA, 18 nt, Staphylococcus aureus subsp. aureus Mu50
aguaugauagaugauaca

SEQ ID NO: 2042419 - RNA, 21 nt, Staphylococcus aureus subsp. aureus Mu50
agucauacgcaaugauuauaa

SEQ ID NO: 2042420 - RNA, 17 nt, Staphylococcus aureus subsp. aureus Mu50
aguaugacgaaaugaau

SEQ ID NO: 2042421 - RNA, 18 nt, Staphylococcus aureus subsp. aureus Mu50
aguaugagacgcauugca

SEQ ID NO: 2042422 - RNA, 16 nt, Staphylococcus aureus subsp. aureus Mu50
aguauuaaauuugugu

SEQ ID NO: 2042423 - RNA, 14 nt, Staphylococcus aureus subsp. aureus Mu50
agucauaugcauac

SEQ ID NO: 2042424 - RNA, 16 nt, Staphylococcus aureus subsp. aureus Mu50
agucauaugugccaua

SEQ ID NO: 2042425 - RNA, 22 nt, Staphylococcus aureus subsp. aureus Mu50
agucaucuuagacgcuguuuua

SEQ ID NO: 2042426 - RNA, 17 nt, Staphylococcus aureus subsp. aureus Mu50
agucauuguauaaaaag

SEQ ID NO: 2042427 - RNA, 15 nt, Staphylococcus aureus subsp. aureus Mu50
agucauuaaauguac

SEQ ID NO: 2042428 - RNA, 19 nt, Staphylococcus aureus subsp. aureus Mu50
agucauuugauuuaaaaag

SEQ ID NO: 2042429 - RNA, 21 nt, Staphylococcus aureus subsp. aureus Mu50
agucauuugauuuaaaaaguu

SEQ ID NO: 2042430 - RNA, 22 nt, Staphylococcus aureus subsp. aureus Mu50
agucaucaaccucauuugacau

SEQ ID NO: 2042431 - RNA, 20 nt, Staphylococcus aureus subsp. aureus Mu50
agggguauauuaaaaauuuc

SEQ ID NO: 2042432 - RNA, 15 nt, Staphylococcus aureus subsp. aureus Mu50
aggggcuuuuaugca

SEQ ID NO: 2042433 - RNA, 16 nt, Staphylococcus aureus subsp. aureus Mu50
aggggucuuuuuuuaa

SEQ ID NO: 2042434 - RNA, 17 nt, Staphylococcus aureus subsp. aureus Mu50
aggcauucaucuaacga

SEQ ID NO: 2042435 - RNA, 19 nt, Staphylococcus aureus subsp. aureus Mu50
agcugauuucuaucaaaua

SEQ ID NO: 2042436 - RNA, 14 nt, Staphylococcus aureus subsp. aureus Mu50
agcugcaauuuuag

SEQ ID NO: 2042437 - RNA, 18 nt, Staphylococcus aureus subsp. aureus Mu50
aggauguuauaaaaugaa

SEQ ID NO: 2042438 - RNA, 15 nt, Staphylococcus aureus subsp. aureus Mu50
aggauguucaucaac

SEQ ID NO: 2042439 - RNA, 14 nt, Staphylococcus aureus subsp. aureus Mu50
aggauuauuaucaa

SEQ ID NO: 2042440 - RNA, 15 nt, Staphylococcus aureus subsp. aureus Mu50
agcaaugaguugauc

SEQ ID NO: 2042441 - RNA, 18 nt, Staphylococcus aureus subsp. aureus Mu50
agcaauucuugaaaaguu

SEQ ID NO: 2042442 - RNA, 20 nt, Staphylococcus aureus subsp. aureus Mu50
agcaauucuugaaaaguuug

SEQ ID NO: 2042443 - RNA, 16 nt, Staphylococcus aureus subsp. aureus Mu50
agcaauaucaucauuu

SEQ ID NO: 2042444 - RNA, 21 nt, Staphylococcus aureus subsp. aureus Mu50
agcaaucgacacuuccaucaa

SEQ ID NO: 2042445 - RNA, 21 nt, Staphylococcus aureus subsp. aureus Mu50
agcaauuugcuguccacuaua

SEQ ID NO: 2042446 - RNA, 21 nt, Staphylococcus aureus subsp. aureus Mu50
agaugucgaaaaguauaugaa

SEQ ID NO: 2042447 - RNA, 19 nt, Staphylococcus aureus subsp. aureus Mu50
agauguuucaaaauaauuu

SEQ ID NO: 2042448 - RNA, 14 nt, Staphylococcus aureus subsp. aureus Mu50
agauucaaacguuu

SEQ ID NO: 2042449 - RNA, 23 nt, Staphylococcus aureus subsp. aureus Mu50
agauuauuuaaaacuuguaaauu

SEQ ID NO: 2042450 - RNA, 16 nt, Staphylococcus aureus subsp. aureus Mu50
agauuaagcaauguaa

SEQ ID NO: 2042451 - RNA, 18 nt, Staphylococcus aureus subsp. aureus Mu50
agcaaauuaguaugacuu

SEQ ID NO: 2042452 - RNA, 13 nt, Staphylococcus aureus subsp. aureus Mu50
agcaaccauauuu

SEQ ID NO: 2042453 - RNA, 16 nt, Staphylococcus aureus subsp. aureus Mu50
agcaccgacaauuaua

SEQ ID NO: 2042454 - RNA, 17 nt, Staphylococcus aureus subsp. aureus Mu50
agcacuagccguuauuu

SEQ ID NO: 2042455 - RNA, 21 nt, Staphylococcus aureus subsp. aureus Mu50
agaugaauaauguuuccauuu

SEQ ID NO: 2042456 - RNA, 12 nt, Staphylococcus aureus subsp. aureus Mu50
agaucaauauca

SEQ ID NO: 2042457 - RNA, 15 nt, Staphylococcus aureus subsp. aureus Mu50
agaaacggaaaugac

SEQ ID NO: 2042458 - RNA, 16 nt, Staphylococcus aureus subsp. aureus Mu50
agaaaccguaaaauca

SEQ ID NO: 2042459 - RNA, 19 nt, Staphylococcus aureus subsp. aureus Mu50
agacuaguguaccuuguuu

SEQ ID NO: 2042460 - RNA, 13 nt, Staphylococcus aureus subsp. aureus Mu50
agacucaauuuca

SEQ ID NO: 2042461 - RNA, 24 nt, Staphylococcus aureus subsp. aureus Mu50
agagguuuugcacuaauggcacuu

SEQ ID NO: 2042462 - RNA, 16 nt, Staphylococcus aureus subsp. aureus Mu50
agcauaucuuuaucau

SEQ ID NO: 2042463 - RNA, 16 nt, Staphylococcus aureus subsp. aureus Mu50
agcauuuuucaauuau

SEQ ID NO: 2042464 - RNA, 17 nt, Staphylococcus aureus subsp. aureus Mu50
agccaaaggcaaaaugu

SEQ ID NO: 2042465 - RNA, 16 nt, Staphylococcus aureus subsp. aureus Mu50
agcauuugcuguuaau

SEQ ID NO: 2042466 - RNA, 14 nt, Staphylococcus aureus subsp. aureus Mu50
agcauuucuuuauu

SEQ ID NO: 2042467 - RNA, 15 nt, Staphylococcus aureus subsp. aureus Mu50
agcaugaaucgcauu

SEQ ID NO: 2042468 - RNA, 21 nt, Staphylococcus aureus subsp. aureus Mu50
agcaugaauagcuuguugaac

SEQ ID NO: 2042469 - RNA, 20 nt, Staphylococcus aureus subsp. aureus Mu50
agcaguaagacagcuucuca

SEQ ID NO: 2042470 - RNA, 15 nt, Staphylococcus aureus subsp. aureus Mu50
agcaguaagauaauu

SEQ ID NO: 2042471 - RNA, 20 nt, Staphylococcus aureus subsp. aureus Mu50
agcaguaagauaauuuucaa

SEQ ID NO: 2042472 - RNA, 19 nt, Staphylococcus aureus subsp. aureus Mu50
agccauaccuuauuucagc

SEQ ID NO: 2042473 - RNA, 14 nt, Staphylococcus aureus subsp. aureus Mu50
agccgauaauuuga

SEQ ID NO: 2042474 - RNA, 23 nt, Staphylococcus aureus subsp. aureus Mu50
agcgauaccuuuaauaucuaauu

SEQ ID NO: 2042475 - RNA, 20 nt, Staphylococcus aureus subsp. aureus Mu50
agcgaucauuagcaauuuca

SEQ ID NO: 2042476 - RNA, 17 nt, Staphylococcus aureus subsp. aureus Mu50
agcgauacguuuauauc

SEQ ID NO: 2042477 - RNA, 20 nt, Staphylococcus aureus subsp. aureus Mu50
agcggaaauaugauugaaug

SEQ ID NO: 2042478 - RNA, 18 nt, Staphylococcus aureus subsp. aureus Mu50
agcggugugaauugauuu

SEQ ID NO: 2042479 - RNA, 16 nt, Staphylococcus aureus subsp. aureus Mu50
agcugaacguaaguuu

SEQ ID NO: 2042480 - RNA, 23 nt, Staphylococcus aureus subsp. aureus Mu50
agcucauguuucaguauacucau

SEQ ID NO: 2042481 - RNA, 19 nt, Staphylococcus aureus subsp. aureus Mu50
agcuauaacucuaaauaua

SEQ ID NO: 2042482 - RNA, 14 nt, Staphylococcus aureus subsp. aureus Mu50
agcuauauuuuuuu

SEQ ID NO: 2042483 - RNA, 20 nt, Staphylococcus aureus subsp. aureus Mu50
agcuauaaaaaaucuuuuga

SEQ ID NO: 2042484 - RNA, 14 nt, Staphylococcus aureus subsp. aureus Mu50
agcuauuaaaauag

SEQ ID NO: 2042485 - RNA, 12 nt, Staphylococcus aureus subsp. aureus Mu50
agcuaaugcauu

SEQ ID NO: 2042486 - RNA, 12 nt, Staphylococcus aureus subsp. aureus Mu50
agcuaaguuaaa

SEQ ID NO: 2042487 - RNA, 19 nt, Staphylococcus aureus subsp. aureus Mu50
agcuaauucauauucaaau

SEQ ID NO: 2042488 - RNA, 13 nt, Staphylococcus aureus subsp. aureus Mu50
agcuacaauuaaa

SEQ ID NO: 2042489 - RNA, 20 nt, Staphylococcus aureus subsp. aureus Mu50
agcguuuaagaaaucaacaa

SEQ ID NO: 2042490 - RNA, 18 nt, Staphylococcus aureus subsp. aureus Mu50
aucgccuaaaaauaaaau

SEQ ID NO: 2042491 - RNA, 19 nt, Staphylococcus aureus subsp. aureus Mu50
aucgcgcaucaaaaaugag

SEQ ID NO: 2042492 - RNA, 22 nt, Staphylococcus aureus subsp. aureus Mu50
aucgagcguaauggauuauuau

SEQ ID NO: 2042493 - RNA, 15 nt, Staphylococcus aureus subsp. aureus Mu50
aucgacuuugucauu

SEQ ID NO: 2042494 - RNA, 22 nt, Staphylococcus aureus subsp. aureus Mu50
aucgaagggcggucaauuuuac

SEQ ID NO: 2042495 - RNA, 18 nt, Staphylococcus aureus subsp. aureus Mu50
aucgaauuaagaaaaguu

SEQ ID NO: 2042496 - RNA, 21 nt, Staphylococcus aureus subsp. aureus Mu50
aucgaauucauuugcagaacg

SEQ ID NO: 2042497 - RNA, 20 nt, Staphylococcus aureus subsp. aureus Mu50
aucgacauagcguauugauu

SEQ ID NO: 2042498 - RNA, 13 nt, Staphylococcus aureus subsp. aureus Mu50
aucgaacagaaaa

SEQ ID NO: 2042499 - RNA, 22 nt, Staphylococcus aureus subsp. aureus Mu50
aucgaacagaaaaucguuauaa

SEQ ID NO: 2042500 - RNA, 20 nt, Staphylococcus aureus subsp. aureus Mu50
auccuaagcauaauucaacu

SEQ ID NO: 2042501 - RNA, 18 nt, Staphylococcus aureus subsp. aureus Mu50
auccuaagcaucguaaaa

SEQ ID NO: 2042502 - RNA, 15 nt, Staphylococcus aureus subsp. aureus Mu50
auccucaaauauauu

SEQ ID NO: 2042503 - RNA, 19 nt, Staphylococcus aureus subsp. aureus Mu50
auccuaaaaaggcaagcac

SEQ ID NO: 2042504 - RNA, 14 nt, Staphylococcus aureus subsp. aureus Mu50
auccucauaauuau

SEQ ID NO: 2042505 - RNA, 16 nt, Staphylococcus aureus subsp. aureus Mu50
auccucauaauuauca

SEQ ID NO: 2042506 - RNA, 21 nt, Staphylococcus aureus subsp. aureus Mu50
auccucauaauuaucauauaa

SEQ ID NO: 2042507 - RNA, 23 nt, Staphylococcus aureus subsp. aureus Mu50
aucuggaauaccuaaccauaaca

SEQ ID NO: 2042508 - RNA, 21 nt, Staphylococcus aureus subsp. aureus Mu50
aucuguuacagguuuuaaaau

SEQ ID NO: 2042509 - RNA, 17 nt, Staphylococcus aureus subsp. aureus Mu50
aucuguccgacuuuuga

SEQ ID NO: 2042510 - RNA, 18 nt, Staphylococcus aureus subsp. aureus Mu50
aucuguaccguauuuuaa

SEQ ID NO: 2042511 - RNA, 19 nt, Staphylococcus aureus subsp. aureus Mu50
aucuguacuucuaauuugc

SEQ ID NO: 2042512 - RNA, 19 nt, Staphylococcus aureus subsp. aureus Mu50
aucuguaucaaaaucgguu

SEQ ID NO: 2042513 - RNA, 12 nt, Staphylococcus aureus subsp. aureus Mu50
aucuucauguau

SEQ ID NO: 2042514 - RNA, 14 nt, Staphylococcus aureus subsp. aureus Mu50
aucuucauuuaaaa

SEQ ID NO: 2042515 - RNA, 17 nt, Staphylococcus aureus subsp. aureus Mu50
aucuucaacuucgauau

SEQ ID NO: 2042516 - RNA, 16 nt, Staphylococcus aureus subsp. aureus Mu50
aucuuaucggcucuuu

SEQ ID NO: 2042517 - RNA, 19 nt, Staphylococcus aureus subsp. aureus Mu50
aucuuaugaugucauguau

SEQ ID NO: 2042518 - RNA, 16 nt, Staphylococcus aureus subsp. aureus Mu50
aucuuaguacaaaauu

SEQ ID NO: 2042519 - RNA, 12 nt, Staphylococcus aureus subsp. aureus Mu50
aucuuaucaaga

SEQ ID NO: 2042520 - RNA, 21 nt, Staphylococcus aureus subsp. aureus Mu50
aucuguuuuagguuuguugcu

SEQ ID NO: 2042521 - RNA, 15 nt, Staphylococcus aureus subsp. aureus Mu50
aucuuaaagaauuaa

SEQ ID NO: 2042522 - RNA, 23 nt, Staphylococcus aureus subsp. aureus Mu50
aucuuaaucgcucuaaauaguag

SEQ ID NO: 2042523 - RNA, 18 nt, Staphylococcus aureus subsp. aureus Mu50
aucuuacauugauaaaau

SEQ ID NO: 2042524 - RNA, 13 nt, Staphylococcus aureus subsp. aureus Mu50
aucuucuucaaaa

SEQ ID NO: 2042525 - RNA, 22 nt, Staphylococcus aureus subsp. aureus Mu50
aucuucuccaaucaucauuaaa

SEQ ID NO: 2042526 - RNA, 15 nt, Staphylococcus aureus subsp. aureus Mu50
aucuugcaaguauuu

SEQ ID NO: 2042527 - RNA, 22 nt, Staphylococcus aureus subsp. aureus Mu50
aucuugcuuauugauauaagau

SEQ ID NO: 2042528 - RNA, 22 nt, Staphylococcus aureus subsp. aureus Mu50
aucuugcuuggauaauugcauu

SEQ ID NO: 2042529 - RNA, 23 nt, Staphylococcus aureus subsp. aureus Mu50
aucggcuauacauugauaaauuu

SEQ ID NO: 2042530 - RNA, 15 nt, Staphylococcus aureus subsp. aureus Mu50
aucuaaagauuucag

SEQ ID NO: 2042531 - RNA, 16 nt, Staphylococcus aureus subsp. aureus Mu50
aucuaaagcuauaaaa

SEQ ID NO: 2042532 - RNA, 12 nt, Staphylococcus aureus subsp. aureus Mu50
aucuaaaaugag

SEQ ID NO: 2042533 - RNA, 13 nt, Staphylococcus aureus subsp. aureus Mu50
aucguuguaccac

SEQ ID NO: 2042534 - RNA, 16 nt, Staphylococcus aureus subsp. aureus Mu50
aucguuguaccacccc

SEQ ID NO: 2042535 - RNA, 16 nt, Staphylococcus aureus subsp. aureus Mu50
aucguuucaugcacuu

SEQ ID NO: 2042536 - RNA, 19 nt, Staphylococcus aureus subsp. aureus Mu50
aucuacaauauucaauaau

SEQ ID NO: 2042537 - RNA, 13 nt, Staphylococcus aureus subsp. aureus Mu50
aucuacauaauuu

SEQ ID NO: 2042538 - RNA, 17 nt, Staphylococcus aureus subsp. aureus Mu50
aucuacaucaaauuuuu

SEQ ID NO: 2042539 - RNA, 21 nt, Staphylococcus aureus subsp. aureus Mu50
aucuaacuggaaaugauaauu

SEQ ID NO: 2042540 - RNA, 21 nt, Staphylococcus aureus subsp. aureus Mu50
aucuauuauuauguuauaaau

SEQ ID NO: 2042541 - RNA, 12 nt, Staphylococcus aureus subsp. aureus Mu50
aucuauucaacu

SEQ ID NO: 2042542 - RNA, 18 nt, Staphylococcus aureus subsp. aureus Mu50
aucuauuuuaaacucauc

SEQ ID NO: 2042543 - RNA, 17 nt, Staphylococcus aureus subsp. aureus Mu50
aucuauaauaccuaauu

SEQ ID NO: 2042544 - RNA, 18 nt, Staphylococcus aureus subsp. aureus Mu50
aucuauacaacaguaauc

SEQ ID NO: 2042545 - RNA, 23 nt, Staphylococcus aureus subsp. aureus Mu50
aucuauacaauuauggauaaaau

SEQ ID NO: 2042546 - RNA, 18 nt, Staphylococcus aureus subsp. aureus Mu50
aucuauuuaauaauguau

SEQ ID NO: 2042547 - RNA, 16 nt, Staphylococcus aureus subsp. aureus Mu50
aucuauuuaucauacu

SEQ ID NO: 2042548 - RNA, 23 nt, Staphylococcus aureus subsp. aureus Mu50
aucuacuuuguucugcuuuuucu

SEQ ID NO: 2042549 - RNA, 14 nt, Staphylococcus aureus subsp. aureus Mu50
aucuagaauauaac

SEQ ID NO: 2042550 - RNA, 22 nt, Staphylococcus aureus subsp. aureus Mu50
aucuaagucgauaaguuuuuga

SEQ ID NO: 2042551 - RNA, 19 nt, Staphylococcus aureus subsp. aureus Mu50
aucuaauccugguauaaug

SEQ ID NO: 2042552 - RNA, 17 nt, Staphylococcus aureus subsp. aureus Mu50
aucuacuacuaaucguu

SEQ ID NO: 2042553 - RNA, 15 nt, Staphylococcus aureus subsp. aureus Mu50
aucuacucaaauaua

SEQ ID NO: 2042554 - RNA, 21 nt, Staphylococcus aureus subsp. aureus Mu50
aucuacuaaagagaaucgaac

SEQ ID NO: 2042555 - RNA, 13 nt, Staphylococcus aureus subsp. aureus Mu50
aucuaccauguuu

SEQ ID NO: 2042556 - RNA, 16 nt, Staphylococcus aureus subsp. aureus Mu50
augcauauauauauag

SEQ ID NO: 2042557 - RNA, 21 nt, Staphylococcus aureus subsp. aureus Mu50
augcaugccagaugcaaugau

SEQ ID NO: 2042558 - RNA, 18 nt, Staphylococcus aureus subsp. aureus Mu50
augcaugcuucucaauuu

SEQ ID NO: 2042559 - RNA, 20 nt, Staphylococcus aureus subsp. aureus Mu50
augcaugcuucucaauuugu

SEQ ID NO: 2042560 - RNA, 14 nt, Staphylococcus aureus subsp. aureus Mu50
augcauaauaccaa

SEQ ID NO: 2042561 - RNA, 14 nt, Staphylococcus aureus subsp. aureus Mu50
augcacugcuaaua

SEQ ID NO: 2042562 - RNA, 15 nt, Staphylococcus aureus subsp. aureus Mu50
augcacuuuuuuuaa

SEQ ID NO: 2042563 - RNA, 16 nt, Staphylococcus aureus subsp. aureus Mu50
augauuaaaaaucaaa

SEQ ID NO: 2042564 - RNA, 24 nt, Staphylococcus aureus subsp. aureus Mu50
augauuaaaaaucaaagaggcuuu

SEQ ID NO: 2042565 - RNA, 14 nt, Staphylococcus aureus subsp. aureus Mu50
augauuaauaaagu

SEQ ID NO: 2042566 - RNA, 14 nt, Staphylococcus aureus subsp. aureus Mu50
augauuaauaacau

SEQ ID NO: 2042567 - RNA, 23 nt, Staphylococcus aureus subsp. aureus Mu50
augauuagcgcaccaauuaucaa

SEQ ID NO: 2042568 - RNA, 21 nt, Staphylococcus aureus subsp. aureus Mu50
augaugcuucgcaucacugca

SEQ ID NO: 2042569 - RNA, 21 nt, Staphylococcus aureus subsp. aureus Mu50
augaugcuucucacaacugca

SEQ ID NO: 2042570 - RNA, 15 nt, Staphylococcus aureus subsp. aureus Mu50
augauggguauuuug

SEQ ID NO: 2042571 - RNA, 23 nt, Staphylococcus aureus subsp. aureus Mu50
augaugugcuuuaucaacaaauu

SEQ ID NO: 2042572 - RNA, 16 nt, Staphylococcus aureus subsp. aureus Mu50
augauguucaauauuu

SEQ ID NO: 2042573 - RNA, 22 nt, Staphylococcus aureus subsp. aureus Mu50
augauaacucguaaucauagca

SEQ ID NO: 2042574 - RNA, 12 nt, Staphylococcus aureus subsp. aureus Mu50
augauaaccauu

SEQ ID NO: 2042575 - RNA, 19 nt, Staphylococcus aureus subsp. aureus Mu50
augaguuaguggaucacga

SEQ ID NO: 2042576 - RNA, 15 nt, Staphylococcus aureus subsp. aureus Mu50
augauaaguggauuu

SEQ ID NO: 2042577 - RNA, 14 nt, Staphylococcus aureus subsp. aureus Mu50
augauacuguauuu

SEQ ID NO: 2042578 - RNA, 11 nt, Staphylococcus aureus subsp. aureus Mu50
augauaauuaa

SEQ ID NO: 2042579 - RNA, 22 nt, Staphylococcus aureus subsp. aureus Mu50
augauaauuuaauaacguacau

SEQ ID NO: 2042580 - RNA, 18 nt, Staphylococcus aureus subsp. aureus Mu50
augauagcuaaacauuuu

SEQ ID NO: 2042581 - RNA, 15 nt, Staphylococcus aureus subsp. aureus Mu50
augauaguacauuua

SEQ ID NO: 2042582 - RNA, 22 nt, Staphylococcus aureus subsp. aureus Mu50
augacgcucgagcucuucaaau

SEQ ID NO: 2042583 - RNA, 21 nt, Staphylococcus aureus subsp. aureus Mu50
augaguccuuuuuaguaguuu

SEQ ID NO: 2042584 - RNA, 14 nt, Staphylococcus aureus subsp. aureus Mu50
augauauuucuaaa

SEQ ID NO: 2042585 - RNA, 16 nt, Staphylococcus aureus subsp. aureus Mu50
augacgauaccuuuaa

SEQ ID NO: 2042586 - RNA, 20 nt, Staphylococcus aureus subsp. aureus Mu50
augacgagaauuaaagucug

SEQ ID NO: 2042587 - RNA, 19 nt, Staphylococcus aureus subsp. aureus Mu50
augacauugugaaaguuuu

SEQ ID NO: 2042588 - RNA, 19 nt, Staphylococcus aureus subsp. aureus Mu50
augacauaggcgcuuuuuu

SEQ ID NO: 2042589 - RNA, 22 nt, Staphylococcus aureus subsp. aureus Mu50
augacauaggcgcuuuuuuuua

SEQ ID NO: 2042590 - RNA, 21 nt, Staphylococcus aureus subsp. aureus Mu50
augacaucaauaucuucuucu

SEQ ID NO: 2042591 - RNA, 16 nt, Staphylococcus aureus subsp. aureus Mu50
augacaccuaauacca

SEQ ID NO: 2042592 - RNA, 21 nt, Staphylococcus aureus subsp. aureus Mu50
augaauugaguauuaaauuug

SEQ ID NO: 2042593 - RNA, 23 nt, Staphylococcus aureus subsp. aureus Mu50
augaaucccauaacaaucauuuc

SEQ ID NO: 2042594 - RNA, 19 nt, Staphylococcus aureus subsp. aureus Mu50
augacaaauuaucacucau

SEQ ID NO: 2042595 - RNA, 22 nt, Staphylococcus aureus subsp. aureus Mu50
augacaacuucacgcaaaacaa

SEQ ID NO: 2042596 - RNA, 15 nt, Staphylococcus aureus subsp. aureus Mu50
augaauuuuauaaau

SEQ ID NO: 2042597 - RNA, 17 nt, Staphylococcus aureus subsp. aureus Mu50
augaauuggauguaaua

SEQ ID NO: 2042598 - RNA, 12 nt, Staphylococcus aureus subsp. aureus Mu50
augaauuuacuc

SEQ ID NO: 2042599 - RNA, 14 nt, Staphylococcus aureus subsp. aureus Mu50
augaauaaauacaa

SEQ ID NO: 2042600 - RNA, 18 nt, Staphylococcus aureus subsp. aureus Mu50
augaauaagucuaauguu

SEQ ID NO: 2042601 - RNA, 18 nt, Staphylococcus aureus subsp. aureus Mu50
augaauaaucaaaguucg

SEQ ID NO: 2042602 - RNA, 15 nt, Staphylococcus aureus subsp. aureus Mu50
augaaucaacaauuu

SEQ ID NO: 2042603 - RNA, 15 nt, Staphylococcus aureus subsp. aureus Mu50
augaauaaugcaauu

SEQ ID NO: 2042604 - RNA, 15 nt, Staphylococcus aureus subsp. aureus Mu50
augaauauaauaaca

SEQ ID NO: 2042605 - RNA, 17 nt, Staphylococcus aureus subsp. aureus Mu50
augaagugaaaucauuu

SEQ ID NO: 2042606 - RNA, 20 nt, Staphylococcus aureus subsp. aureus Mu50
augaaguaauauauaaaagu

SEQ ID NO: 2042607 - RNA, 19 nt, Staphylococcus aureus subsp. aureus Mu50
augaagcguuuuuauuaca

SEQ ID NO: 2042608 - RNA, 14 nt, Staphylococcus aureus subsp. aureus Mu50
aucuuuuucaugcu

SEQ ID NO: 2042609 - RNA, 18 nt, Staphylococcus aureus subsp. aureus Mu50
aucuuuuucaugcuauuu

SEQ ID NO: 2042610 - RNA, 16 nt, Staphylococcus aureus subsp. aureus Mu50
aucuuuuuuacuaaaa

SEQ ID NO: 2042611 - RNA, 18 nt, Staphylococcus aureus subsp. aureus Mu50
aucuuugacauguguuaa

SEQ ID NO: 2042612 - RNA, 16 nt, Staphylococcus aureus subsp. aureus Mu50
aucuuuuauaaugaac

SEQ ID NO: 2042613 - RNA, 17 nt, Staphylococcus aureus subsp. aureus Mu50
aucuuuguaaauuuuua

SEQ ID NO: 2042614 - RNA, 21 nt, Staphylococcus aureus subsp. aureus Mu50
aucuuuguaaccuaaaaacaa

SEQ ID NO: 2042615 - RNA, 21 nt, Staphylococcus aureus subsp. aureus Mu50
aucuuugugucgcaagcguuc

SEQ ID NO: 2042616 - RNA, 23 nt, Staphylococcus aureus subsp. aureus Mu50
aucuuuuauccaauguauaaaac

SEQ ID NO: 2042617 - RNA, 13 nt, Staphylococcus aureus subsp. aureus Mu50
aucuuuuccaaaa

SEQ ID NO: 2042618 - RNA, 19 nt, Staphylococcus aureus subsp. aureus Mu50
aucuuuuccauucauaaaa

SEQ ID NO: 2042619 - RNA, 18 nt, Staphylococcus aureus subsp. aureus Mu50
aucuuuacgauaaacuaa

SEQ ID NO: 2042620 - RNA, 18 nt, Staphylococcus aureus subsp. aureus Mu50
aucuuuaauaaccuuuaa

SEQ ID NO: 2042621 - RNA, 17 nt, Staphylococcus aureus subsp. aureus Mu50
aucuuuaguauuucauc

SEQ ID NO: 2042622 - RNA, 18 nt, Staphylococcus aureus subsp. aureus Mu50
aucuuuaguauuucauca

SEQ ID NO: 2042623 - RNA, 19 nt, Staphylococcus aureus subsp. aureus Mu50
aucuuguuuucauuuaaaa

SEQ ID NO: 2042624 - RNA, 18 nt, Staphylococcus aureus subsp. aureus Mu50
aucuuuaauuuacaauua

SEQ ID NO: 2042625 - RNA, 16 nt, Staphylococcus aureus subsp. aureus Mu50
aucuuuaugcaaaauu

SEQ ID NO: 2042626 - RNA, 18 nt, Staphylococcus aureus subsp. aureus Mu50
aucuuuauugguaggagg

SEQ ID NO: 2042627 - RNA, 12 nt, Staphylococcus aureus subsp. aureus Mu50
aucuuucaaagu

SEQ ID NO: 2042628 - RNA, 14 nt, Staphylococcus aureus subsp. aureus Mu50
aucuuucaaaguau

SEQ ID NO: 2042629 - RNA, 15 nt, Staphylococcus aureus subsp. aureus Mu50
aucuuucaauuaauu

SEQ ID NO: 2042630 - RNA, 17 nt, Staphylococcus aureus subsp. aureus Mu50
aucuuucaauuaauuua

SEQ ID NO: 2042631 - RNA, 22 nt, Staphylococcus aureus subsp. aureus Mu50
aucuuucuuuguguuugcuuuu

SEQ ID NO: 2042632 - RNA, 17 nt, Staphylococcus aureus subsp. aureus Mu50
augaaaauaagcuugua

SEQ ID NO: 2042633 - RNA, 20 nt, Staphylococcus aureus subsp. aureus Mu50
augaaaauaagcuuguaaca

SEQ ID NO: 2042634 - RNA, 20 nt, Staphylococcus aureus subsp. aureus Mu50
augaaaauaccucuacauua

SEQ ID NO: 2042635 - RNA, 21 nt, Staphylococcus aureus subsp. aureus Mu50
augaaauuucaguaucauguu

SEQ ID NO: 2042636 - RNA, 14 nt, Staphylococcus aureus subsp. aureus Mu50
augaaauuuuuuau

SEQ ID NO: 2042637 - RNA, 22 nt, Staphylococcus aureus subsp. aureus Mu50
augaaauuggaauagauguuga

SEQ ID NO: 2042638 - RNA, 15 nt, Staphylococcus aureus subsp. aureus Mu50
augaaauaacuagau

SEQ ID NO: 2042639 - RNA, 18 nt, Staphylococcus aureus subsp. aureus Mu50
augaaauaacuagauguu

SEQ ID NO: 2042640 - RNA, 13 nt, Staphylococcus aureus subsp. aureus Mu50
augaagaauacaa

SEQ ID NO: 2042641 - RNA, 12 nt, Staphylococcus aureus subsp. aureus Mu50
augaacuuuuau

SEQ ID NO: 2042642 - RNA, 17 nt, Staphylococcus aureus subsp. aureus Mu50
augaacuuuuauugcca

SEQ ID NO: 2042643 - RNA, 19 nt, Staphylococcus aureus subsp. aureus Mu50
auugaugugccuuucuaau

SEQ ID NO: 2042644 - RNA, 21 nt, Staphylococcus aureus subsp. aureus Mu50
auugauauaaauuaucagaau

SEQ ID NO: 2042645 - RNA, 21 nt, Staphylococcus aureus subsp. aureus Mu50
auugauauuaugccauucauu

SEQ ID NO: 2042646 - RNA, 16 nt, Staphylococcus aureus subsp. aureus Mu50
auugauaccuuuugcu

SEQ ID NO: 2042647 - RNA, 12 nt, Staphylococcus aureus subsp. aureus Mu50
auugaucugauu

SEQ ID NO: 2042648 - RNA, 13 nt, Staphylococcus aureus subsp. aureus Mu50
auugcaaugaaua

SEQ ID NO: 2042649 - RNA, 21 nt, Staphylococcus aureus subsp. aureus Mu50
auugcaaaguaacaauacgca

SEQ ID NO: 2042650 - RNA, 15 nt, Staphylococcus aureus subsp. aureus Mu50
auugcaaaugcaaua

SEQ ID NO: 2042651 - RNA, 16 nt, Staphylococcus aureus subsp. aureus Mu50
auugcaaauuaucauu

SEQ ID NO: 2042652 - RNA, 16 nt, Staphylococcus aureus subsp. aureus Mu50
auugauuauaaugauu

SEQ ID NO: 2042653 - RNA, 17 nt, Staphylococcus aureus subsp. aureus Mu50
auugauuucagcaccga

SEQ ID NO: 2042654 - RNA, 22 nt, Staphylococcus aureus subsp. aureus Mu50
auugcacgucuuguaucaacau

SEQ ID NO: 2042655 - RNA, 16 nt, Staphylococcus aureus subsp. aureus Mu50
auugaaucuuuguuau

SEQ ID NO: 2042656 - RNA, 13 nt, Staphylococcus aureus subsp. aureus Mu50
auugaauaaucau

SEQ ID NO: 2042657 - RNA, 15 nt, Staphylococcus aureus subsp. aureus Mu50
auugaauugaaaaau

SEQ ID NO: 2042658 - RNA, 13 nt, Staphylococcus aureus subsp. aureus Mu50
auugaacuucuaa

SEQ ID NO: 2042659 - RNA, 14 nt, Staphylococcus aureus subsp. aureus Mu50
auugaaacuaauaa

SEQ ID NO: 2042660 - RNA, 20 nt, Staphylococcus aureus subsp. aureus Mu50
auugaaaugagcuuaaguua

SEQ ID NO: 2042661 - RNA, 14 nt, Staphylococcus aureus subsp. aureus Mu50
auugaaauuuuuaa

SEQ ID NO: 2042662 - RNA, 17 nt, Staphylococcus aureus subsp. aureus Mu50
auucuuggcguauuuuu

SEQ ID NO: 2042663 - RNA, 14 nt, Staphylococcus aureus subsp. aureus Mu50
auucuuuuuaacua

SEQ ID NO: 2042664 - RNA, 16 nt, Staphylococcus aureus subsp. aureus Mu50
auucuuuuuaacuaug

SEQ ID NO: 2042665 - RNA, 13 nt, Staphylococcus aureus subsp. aureus Mu50
auucuucaauaac

SEQ ID NO: 2042666 - RNA, 16 nt, Staphylococcus aureus subsp. aureus Mu50
auucuucaauuucauu

SEQ ID NO: 2042667 - RNA, 16 nt, Staphylococcus aureus subsp. aureus Mu50
auucuugaauaaauuu

SEQ ID NO: 2042668 - RNA, 15 nt, Staphylococcus aureus subsp. aureus Mu50
auucuuacaccugca

SEQ ID NO: 2042669 - RNA, 16 nt, Staphylococcus aureus subsp. aureus Mu50
auucuucaucaugacu

SEQ ID NO: 2042670 - RNA, 13 nt, Staphylococcus aureus subsp. aureus Mu50
auugacuuacauu

SEQ ID NO: 2042671 - RNA, 20 nt, Staphylococcus aureus subsp. aureus Mu50
auugacuaaguuuguuuucu

SEQ ID NO: 2042672 - RNA, 20 nt, Staphylococcus aureus subsp. aureus Mu50
auugaccaccuguaucuaau

SEQ ID NO: 2042673 - RNA, 17 nt, Staphylococcus aureus subsp. aureus Mu50
auugaccaccuuuaucu

SEQ ID NO: 2042674 - RNA, 21 nt, Staphylococcus aureus subsp. aureus Mu50
auugaccgacaaaacuuguaa

SEQ ID NO: 2042675 - RNA, 13 nt, Staphylococcus aureus subsp. aureus Mu50
auugagagaaguu

SEQ ID NO: 2042676 - RNA, 20 nt, Staphylococcus aureus subsp. aureus Mu50
auugagacaacauuguugau

SEQ ID NO: 2042677 - RNA, 19 nt, Staphylococcus aureus subsp. aureus Mu50
auugauaaaauaaucggua

SEQ ID NO: 2042678 - RNA, 20 nt, Staphylococcus aureus subsp. aureus Mu50
auugaguaucaugcuuuuaa

SEQ ID NO: 2042679 - RNA, 18 nt, Staphylococcus aureus subsp. aureus Mu50
auugauaaauauugaaca

SEQ ID NO: 2042680 - RNA, 21 nt, Staphylococcus aureus subsp. aureus Mu50
auugcuauauuaguauaauuu

SEQ ID NO: 2042681 - RNA, 17 nt, Staphylococcus aureus subsp. aureus Mu50
auugcuaauccauacgu

SEQ ID NO: 2042682 - RNA, 14 nt, Staphylococcus aureus subsp. aureus Mu50
auugcuaauccaua

SEQ ID NO: 2042683 - RNA, 19 nt, Staphylococcus aureus subsp. aureus Mu50
auugcuguaaauauucguu

SEQ ID NO: 2042684 - RNA, 16 nt, Staphylococcus aureus subsp. aureus Mu50
auugcuuaauaucaug

SEQ ID NO: 2042685 - RNA, 18 nt, Staphylococcus aureus subsp. aureus Mu50
auugcugcuguacaauuu

SEQ ID NO: 2042686 - RNA, 18 nt, Staphylococcus aureus subsp. aureus Mu50
auugcucuaauccaaaau

SEQ ID NO: 2042687 - RNA, 19 nt, Staphylococcus aureus subsp. aureus Mu50
auugcucuaauccaaaaua

SEQ ID NO: 2042688 - RNA, 21 nt, Staphylococcus aureus subsp. aureus Mu50
auugccuaaggacuuuaugcc

SEQ ID NO: 2042689 - RNA, 17 nt, Staphylococcus aureus subsp. aureus Mu50
auugucgacuuuuagau

SEQ ID NO: 2042690 - RNA, 14 nt, Staphylococcus aureus subsp. aureus Mu50
auugugaauaauuu

SEQ ID NO: 2042691 - RNA, 22 nt, Staphylococcus aureus subsp. aureus Mu50
auuguagccuccgccaccaaac

SEQ ID NO: 2042692 - RNA, 12 nt, Staphylococcus aureus subsp. aureus Mu50
auuguauaaugu

SEQ ID NO: 2042693 - RNA, 20 nt, Staphylococcus aureus subsp. aureus Mu50
auuguaucguuaccuuuuaa

SEQ ID NO: 2042694 - RNA, 16 nt, Staphylococcus aureus subsp. aureus Mu50
auuguauuagcaauuu

SEQ ID NO: 2042695 - RNA, 20 nt, Staphylococcus aureus subsp. aureus Mu50
auuguauuauccucaaauau

SEQ ID NO: 2042696 - RNA, 15 nt, Staphylococcus aureus subsp. aureus Mu50
auugucauauaaaac

SEQ ID NO: 2042697 - RNA, 14 nt, Staphylococcus aureus subsp. aureus Mu50
auuguaguaaugaa

SEQ ID NO: 2042698 - RNA, 16 nt, Staphylococcus aureus subsp. aureus Mu50
auugucacaaucuguu

SEQ ID NO: 2042699 - RNA, 21 nt, Staphylococcus aureus subsp. aureus Mu50
auuguaaaaauacauaauaaa

SEQ ID NO: 2042700 - RNA, 13 nt, Staphylococcus aureus subsp. aureus Mu50
auuguaaucuauu

SEQ ID NO: 2042701 - RNA, 19 nt, Staphylococcus aureus subsp. aureus Mu50
auugguaaauuuaucauuu

SEQ ID NO: 2042702 - RNA, 23 nt, Staphylococcus aureus subsp. aureus Mu50
auugggagcaaucaauacaauuu

SEQ ID NO: 2042703 - RNA, 16 nt, Staphylococcus aureus subsp. aureus Mu50
auuggcaguaguugac

SEQ ID NO: 2042704 - RNA, 23 nt, Staphylococcus aureus subsp. aureus Mu50
auucaccagguuuuuuauuuuca

SEQ ID NO: 2042705 - RNA, 12 nt, Staphylococcus aureus subsp. aureus Mu50
auucacuuuuuu

SEQ ID NO: 2042706 - RNA, 17 nt, Staphylococcus aureus subsp. aureus Mu50
auuauuauaauuuuguu

SEQ ID NO: 2042707 - RNA, 17 nt, Staphylococcus aureus subsp. aureus Mu50
auuauugguugaaauua

SEQ ID NO: 2042708 - RNA, 19 nt, Staphylococcus aureus subsp. aureus Mu50
auuauuuaaaaugcuuguu

SEQ ID NO: 2042709 - RNA, 15 nt, Staphylococcus aureus subsp. aureus Mu50
auuauuuaacgucua

SEQ ID NO: 2042710 - RNA, 15 nt, Staphylococcus aureus subsp. aureus Mu50
auuauuuaaucuauu

SEQ ID NO: 2042711 - RNA, 19 nt, Staphylococcus aureus subsp. aureus Mu50
auuauuuaauuuuucuaaa

SEQ ID NO: 2042712 - RNA, 20 nt, Staphylococcus aureus subsp. aureus Mu50
auuauuuaauuuuucuaaau

SEQ ID NO: 2042713 - RNA, 17 nt, Staphylococcus aureus subsp. aureus Mu50
auuaugauacgcuuuuu

SEQ ID NO: 2042714 - RNA, 21 nt, Staphylococcus aureus subsp. aureus Mu50
auuaucuuuaauuuacaauua

SEQ ID NO: 2042715 - RNA, 23 nt, Staphylococcus aureus subsp. aureus Mu50
auuaucuuuacgauaaacuaaaa

SEQ ID NO: 2042716 - RNA, 15 nt, Staphylococcus aureus subsp. aureus Mu50
auuaugaaaacauua

SEQ ID NO: 2042717 - RNA, 15 nt, Staphylococcus aureus subsp. aureus Mu50
auuaugacaacauaa

SEQ ID NO: 2042718 - RNA, 16 nt, Staphylococcus aureus subsp. aureus Mu50
auuaugacaacauaac

SEQ ID NO: 2042719 - RNA, 13 nt, Staphylococcus aureus subsp. aureus Mu50
auuauuaaaugcu

SEQ ID NO: 2042720 - RNA, 14 nt, Staphylococcus aureus subsp. aureus Mu50
auuauuaacgcaaa

SEQ ID NO: 2042721 - RNA, 16 nt, Staphylococcus aureus subsp. aureus Mu50
auuaugccuuugauuu

SEQ ID NO: 2042722 - RNA, 22 nt, Staphylococcus aureus subsp. aureus Mu50
auuaugcauauguaauacaaaa

SEQ ID NO: 2042723 - RNA, 12 nt, Staphylococcus aureus subsp. aureus Mu50
auuauuaauaag

SEQ ID NO: 2042724 - RNA, 17 nt, Staphylococcus aureus subsp. aureus Mu50
auuauuaauuccuucua

SEQ ID NO: 2042725 - RNA, 14 nt, Staphylococcus aureus subsp. aureus Mu50
auuauuaccauaac

SEQ ID NO: 2042726 - RNA, 20 nt, Staphylococcus aureus subsp. aureus Mu50
auuaacauaacuagcaauuu

SEQ ID NO: 2042727 - RNA, 14 nt, Staphylococcus aureus subsp. aureus Mu50
auuaacacauucuu

SEQ ID NO: 2042728 - RNA, 16 nt, Staphylococcus aureus subsp. aureus Mu50
auuaacacauucuuau

SEQ ID NO: 2042729 - RNA, 23 nt, Staphylococcus aureus subsp. aureus Mu50
auuaacacauucuuauuugaaau

SEQ ID NO: 2042730 - RNA, 13 nt, Staphylococcus aureus subsp. aureus Mu50
auuaaauucaucu

SEQ ID NO: 2042731 - RNA, 20 nt, Staphylococcus aureus subsp. aureus Mu50
auuaaauuccaugucaauuu

SEQ ID NO: 2042732 - RNA, 14 nt, Staphylococcus aureus subsp. aureus Mu50
auuaaauuuuguua

SEQ ID NO: 2042733 - RNA, 15 nt, Staphylococcus aureus subsp. aureus Mu50
auuaaauaacuuuuu

SEQ ID NO: 2042734 - RNA, 16 nt, Staphylococcus aureus subsp. aureus Mu50
auuaaauaagaugaaa

SEQ ID NO: 2042735 - RNA, 18 nt, Staphylococcus aureus subsp. aureus Mu50
auuaaaucugauucauua

SEQ ID NO: 2042736 - RNA, 19 nt, Staphylococcus aureus subsp. aureus Mu50
auuaaauauuuagauuggu

SEQ ID NO: 2042737 - RNA, 14 nt, Staphylococcus aureus subsp. aureus Mu50
auuaaauguacauu

SEQ ID NO: 2042738 - RNA, 23 nt, Staphylococcus aureus subsp. aureus Mu50
auuaaauugcuugaaauuauuau

SEQ ID NO: 2042739 - RNA, 17 nt, Staphylococcus aureus subsp. aureus Mu50
auuaaacuuccuuuuuu

SEQ ID NO: 2042740 - RNA, 15 nt, Staphylococcus aureus subsp. aureus Mu50
auuaaacauuuagau

SEQ ID NO: 2042741 - RNA, 20 nt, Staphylococcus aureus subsp. aureus Mu50
auuaaaccgcacuucuauau

SEQ ID NO: 2042742 - RNA, 15 nt, Staphylococcus aureus subsp. aureus Mu50
auuaaagcgauaaua

SEQ ID NO: 2042743 - RNA, 16 nt, Staphylococcus aureus subsp. aureus Mu50
auguugcuuaucaaca

SEQ ID NO: 2042744 - RNA, 22 nt, Staphylococcus aureus subsp. aureus Mu50
auguuggaaaaggucaaaaaau

SEQ ID NO: 2042745 - RNA, 22 nt, Staphylococcus aureus subsp. aureus Mu50
auguuggaucggcauuguaaaa

SEQ ID NO: 2042746 - RNA, 19 nt, Staphylococcus aureus subsp. aureus Mu50
auguugguucaucaaacaa

SEQ ID NO: 2042747 - RNA, 22 nt, Staphylococcus aureus subsp. aureus Mu50
auucauggccaaauguugauaa

SEQ ID NO: 2042748 - RNA, 14 nt, Staphylococcus aureus subsp. aureus Mu50
auucauguaaauag

SEQ ID NO: 2042749 - RNA, 22 nt, Staphylococcus aureus subsp. aureus Mu50
auucauguucuuguaauccuaa

SEQ ID NO: 2042750 - RNA, 20 nt, Staphylococcus aureus subsp. aureus Mu50
auucauuaagcuuuguuuga

SEQ ID NO: 2042751 - RNA, 16 nt, Staphylococcus aureus subsp. aureus Mu50
auucaucuguugauaa

SEQ ID NO: 2042752 - RNA, 16 nt, Staphylococcus aureus subsp. aureus Mu50
auucauuacaaccauu

SEQ ID NO: 2042753 - RNA, 13 nt, Staphylococcus aureus subsp. aureus Mu50
auucaguaucuaa

SEQ ID NO: 2042754 - RNA, 14 nt, Staphylococcus aureus subsp. aureus Mu50
auucagucaguaaa

SEQ ID NO: 2042755 - RNA, 13 nt, Staphylococcus aureus subsp. aureus Mu50
auucauaaaauuu

SEQ ID NO: 2042756 - RNA, 23 nt, Staphylococcus aureus subsp. aureus Mu50
auucauaaaauuuaaaacaauga

SEQ ID NO: 2042757 - RNA, 13 nt, Staphylococcus aureus subsp. aureus Mu50
auucauaaaugcu

SEQ ID NO: 2042758 - RNA, 14 nt, Staphylococcus aureus subsp. aureus Mu50
auucauaaaugcuu

SEQ ID NO: 2042759 - RNA, 17 nt, Staphylococcus aureus subsp. aureus Mu50
auucauacacuaucauu

SEQ ID NO: 2042760 - RNA, 20 nt, Staphylococcus aureus subsp. aureus Mu50
auucauagaccuaugaauuu

SEQ ID NO: 2042761 - RNA, 15 nt, Staphylococcus aureus subsp. aureus Mu50
auucauauuuauauu

SEQ ID NO: 2042762 - RNA, 15 nt, Staphylococcus aureus subsp. aureus Mu50
auucuguuucaaagc

SEQ ID NO: 2042763 - RNA, 19 nt, Staphylococcus aureus subsp. aureus Mu50
auucugguuuaaugagcuu

SEQ ID NO: 2042764 - RNA, 19 nt, Staphylococcus aureus subsp. aureus Mu50
auucucuagugcuuugucu

SEQ ID NO: 2042765 - RNA, 19 nt, Staphylococcus aureus subsp. aureus Mu50
auucugcagcgacaucuuu

SEQ ID NO: 2042766 - RNA, 22 nt, Staphylococcus aureus subsp. aureus Mu50
auucucuguagauaucaaagua

SEQ ID NO: 2042767 - RNA, 12 nt, Staphylococcus aureus subsp. aureus Mu50
auucuccuaaua

SEQ ID NO: 2042768 - RNA, 13 nt, Staphylococcus aureus subsp. aureus Mu50
auucucgauuuuu

SEQ ID NO: 2042769 - RNA, 14 nt, Staphylococcus aureus subsp. aureus Mu50
auucuacaaacaau

SEQ ID NO: 2042770 - RNA, 15 nt, Staphylococcus aureus subsp. aureus Mu50
auucucaauuaauuu

SEQ ID NO: 2042771 - RNA, 21 nt, Staphylococcus aureus subsp. aureus Mu50
auucgucuacauauuggcuug

SEQ ID NO: 2042772 - RNA, 12 nt, Staphylococcus aureus subsp. aureus Mu50
auucuauaauuu

SEQ ID NO: 2042773 - RNA, 15 nt, Staphylococcus aureus subsp. aureus Mu50
auucuauaauuuuaa

SEQ ID NO: 2042774 - RNA, 22 nt, Staphylococcus aureus subsp. aureus Mu50
auucuagagauaacuagaauga

SEQ ID NO: 2042775 - RNA, 19 nt, Staphylococcus aureus subsp. aureus Mu50
auucuagauucauauuuau

SEQ ID NO: 2042776 - RNA, 19 nt, Staphylococcus aureus subsp. aureus Mu50
auucuagagauaacuagaa

SEQ ID NO: 2042777 - RNA, 17 nt, Staphylococcus aureus subsp. aureus Mu50
auucuaaauaaucgaag

SEQ ID NO: 2042778 - RNA, 18 nt, Staphylococcus aureus subsp. aureus Mu50
auucuaauacaaaccuau

SEQ ID NO: 2042779 - RNA, 13 nt, Staphylococcus aureus subsp. aureus Mu50
auucgcuuguuca

SEQ ID NO: 2042780 - RNA, 17 nt, Staphylococcus aureus subsp. aureus Mu50
auucgaacuaucaauau

SEQ ID NO: 2042781 - RNA, 18 nt, Staphylococcus aureus subsp. aureus Mu50
auuccugauacaaugauu

SEQ ID NO: 2042782 - RNA, 18 nt, Staphylococcus aureus subsp. aureus Mu50
auuccuggugcaauaaua

SEQ ID NO: 2042783 - RNA, 12 nt, Staphylococcus aureus subsp. aureus Mu50
auuccuaauaaa

SEQ ID NO: 2042784 - RNA, 15 nt, Staphylococcus aureus subsp. aureus Mu50
auuccuaauaaauau

SEQ ID NO: 2042785 - RNA, 15 nt, Staphylococcus aureus subsp. aureus Mu50
auuccuaauuauauu

SEQ ID NO: 2042786 - RNA, 19 nt, Staphylococcus aureus subsp. aureus Mu50
auucgaugcuaaaaauauu

SEQ ID NO: 2042787 - RNA, 15 nt, Staphylococcus aureus subsp. aureus Mu50
auucgauaauauaac

SEQ ID NO: 2042788 - RNA, 15 nt, Staphylococcus aureus subsp. aureus Mu50
auucgacucaaacaa

SEQ ID NO: 2042789 - RNA, 18 nt, Staphylococcus aureus subsp. aureus Mu50
auucgacucaaacaauaa

SEQ ID NO: 2042790 - RNA, 16 nt, Staphylococcus aureus subsp. aureus Mu50
augcauggaaaagugc

SEQ ID NO: 2042791 - RNA, 14 nt, Staphylococcus aureus subsp. aureus Mu50
augcauuuaauuua

SEQ ID NO: 2042792 - RNA, 16 nt, Staphylococcus aureus subsp. aureus Mu50
auggaauagucccuuu

SEQ ID NO: 2042793 - RNA, 18 nt, Staphylococcus aureus subsp. aureus Mu50
auggauacuuaaagauuu

SEQ ID NO: 2042794 - RNA, 15 nt, Staphylococcus aureus subsp. aureus Mu50
auggacuaauuuauu

SEQ ID NO: 2042795 - RNA, 20 nt, Staphylococcus aureus subsp. aureus Mu50
augcuuguugugaauaaaau

SEQ ID NO: 2042796 - RNA, 22 nt, Staphylococcus aureus subsp. aureus Mu50
augcuucgcacaacugcauaaa

SEQ ID NO: 2042797 - RNA, 12 nt, Staphylococcus aureus subsp. aureus Mu50
augcuucaaagu

SEQ ID NO: 2042798 - RNA, 21 nt, Staphylococcus aureus subsp. aureus Mu50
augcuucaauauucuuaucau

SEQ ID NO: 2042799 - RNA, 15 nt, Staphylococcus aureus subsp. aureus Mu50
auggaaaguaauaag

SEQ ID NO: 2042800 - RNA, 20 nt, Staphylococcus aureus subsp. aureus Mu50
augcuuuuuuuacaauauga

SEQ ID NO: 2042801 - RNA, 18 nt, Staphylococcus aureus subsp. aureus Mu50
augcuuccuuuuuguuau

SEQ ID NO: 2042802 - RNA, 17 nt, Staphylococcus aureus subsp. aureus Mu50
augcuucgaauuuaaca

SEQ ID NO: 2042803 - RNA, 18 nt, Staphylococcus aureus subsp. aureus Mu50
augcuuaauuuguuuuaa

SEQ ID NO: 2042804 - RNA, 21 nt, Staphylococcus aureus subsp. aureus Mu50
augcuuagcgaacgcuagcau

SEQ ID NO: 2042805 - RNA, 14 nt, Staphylococcus aureus subsp. aureus Mu50
augcuggguaauaa

SEQ ID NO: 2042806 - RNA, 20 nt, Staphylococcus aureus subsp. aureus Mu50
auggcaucaucaccauacua

SEQ ID NO: 2042807 - RNA, 14 nt, Staphylococcus aureus subsp. aureus Mu50
auggauugauaaua

SEQ ID NO: 2042808 - RNA, 19 nt, Staphylococcus aureus subsp. aureus Mu50
auggaugccgcucuuuuuu

SEQ ID NO: 2042809 - RNA, 20 nt, Staphylococcus aureus subsp. aureus Mu50
auggaugccgcucuuuuuua

SEQ ID NO: 2042810 - RNA, 23 nt, Staphylococcus aureus subsp. aureus Mu50
auggcaguuuuggcgaaccauac

SEQ ID NO: 2042811 - RNA, 13 nt, Staphylococcus aureus subsp. aureus Mu50
auggguauuuugu

SEQ ID NO: 2042812 - RNA, 15 nt, Staphylococcus aureus subsp. aureus Mu50
augguacuaaaguug

SEQ ID NO: 2042813 - RNA, 16 nt, Staphylococcus aureus subsp. aureus Mu50
augguaaguauaauua

SEQ ID NO: 2042814 - RNA, 20 nt, Staphylococcus aureus subsp. aureus Mu50
augguaaguauaauuaaacu

SEQ ID NO: 2042815 - RNA, 22 nt, Staphylococcus aureus subsp. aureus Mu50
auggucaaucacuccucuauuu

SEQ ID NO: 2042816 - RNA, 14 nt, Staphylococcus aureus subsp. aureus Mu50
auguaaagcuaauu

SEQ ID NO: 2042817 - RNA, 20 nt, Staphylococcus aureus subsp. aureus Mu50
auguaaagcuaauuuuuuau

SEQ ID NO: 2042818 - RNA, 20 nt, Staphylococcus aureus subsp. aureus Mu50
auguauauuuaacaucaauu

SEQ ID NO: 2042819 - RNA, 15 nt, Staphylococcus aureus subsp. aureus Mu50
auguaucaccuaauu

SEQ ID NO: 2042820 - RNA, 12 nt, Staphylococcus aureus subsp. aureus Mu50
auguaugugagu

SEQ ID NO: 2042821 - RNA, 23 nt, Staphylococcus aureus subsp. aureus Mu50
augucaauagcgguuuaaaaaug

SEQ ID NO: 2042822 - RNA, 20 nt, Staphylococcus aureus subsp. aureus Mu50
augucacauaugacuuuauu

SEQ ID NO: 2042823 - RNA, 14 nt, Staphylococcus aureus subsp. aureus Mu50
auguauuuuuauuu

SEQ ID NO: 2042824 - RNA, 20 nt, Staphylococcus aureus subsp. aureus Mu50
augucaaaucggcuauacau

SEQ ID NO: 2042825 - RNA, 17 nt, Staphylococcus aureus subsp. aureus Mu50
augguucguccauucaa

SEQ ID NO: 2042826 - RNA, 20 nt, Staphylococcus aureus subsp. aureus Mu50
augguugaauaacacuagaa

SEQ ID NO: 2042827 - RNA, 20 nt, Staphylococcus aureus subsp. aureus Mu50
augguuaucuuaucgaaaga

SEQ ID NO: 2042828 - RNA, 17 nt, Staphylococcus aureus subsp. aureus Mu50
auggucaacuuuuuuaa

SEQ ID NO: 2042829 - RNA, 14 nt, Staphylococcus aureus subsp. aureus Mu50
auggugguaccaca

SEQ ID NO: 2042830 - RNA, 19 nt, Staphylococcus aureus subsp. aureus Mu50
augggagugggacagaaau

SEQ ID NO: 2042831 - RNA, 22 nt, Staphylococcus aureus subsp. aureus Mu50
augggaauuguauuagcaauuu

SEQ ID NO: 2042832 - RNA, 16 nt, Staphylococcus aureus subsp. aureus Mu50
auggcuucgcuaauaa

SEQ ID NO: 2042833 - RNA, 21 nt, Staphylococcus aureus subsp. aureus Mu50
augggccccaacacagagaau

SEQ ID NO: 2042834 - RNA, 13 nt, Staphylococcus aureus subsp. aureus Mu50
augucauucuagu

SEQ ID NO: 2042835 - RNA, 17 nt, Staphylococcus aureus subsp. aureus Mu50
augucauaucuuuauuu

SEQ ID NO: 2042836 - RNA, 17 nt, Staphylococcus aureus subsp. aureus Mu50
augucacugcaaacaca

SEQ ID NO: 2042837 - RNA, 20 nt, Staphylococcus aureus subsp. aureus Mu50
augucacuguuaaagauguc

SEQ ID NO: 2042838 - RNA, 17 nt, Staphylococcus aureus subsp. aureus Mu50
augucuucauaaucgua

SEQ ID NO: 2042839 - RNA, 13 nt, Staphylococcus aureus subsp. aureus Mu50
augucuuucaaau

SEQ ID NO: 2042840 - RNA, 22 nt, Staphylococcus aureus subsp. aureus Mu50
augucucuuucuuuuagcaauc

SEQ ID NO: 2042841 - RNA, 23 nt, Staphylococcus aureus subsp. aureus Mu50
augugacauaacagcuaaaaauu

SEQ ID NO: 2042842 - RNA, 13 nt, Staphylococcus aureus subsp. aureus Mu50
augugaaaauuua

SEQ ID NO: 2042843 - RNA, 22 nt, Staphylococcus aureus subsp. aureus Mu50
augugacuuuaaaucuuguucu

SEQ ID NO: 2042844 - RNA, 16 nt, Staphylococcus aureus subsp. aureus Mu50
augucuagacuuauuu

SEQ ID NO: 2042845 - RNA, 21 nt, Staphylococcus aureus subsp. aureus Mu50
auguugcauccccagccauuu

SEQ ID NO: 2042846 - RNA, 21 nt, Staphylococcus aureus subsp. aureus Mu50
auguugaauguggaacaugau

SEQ ID NO: 2042847 - RNA, 22 nt, Staphylococcus aureus subsp. aureus Mu50
auguucuuuucaacauuuuuua

SEQ ID NO: 2042848 - RNA, 23 nt, Staphylococcus aureus subsp. aureus Mu50
auguuccuuguuuuaaacuuauu

SEQ ID NO: 2042849 - RNA, 21 nt, Staphylococcus aureus subsp. aureus Mu50
auguucgauuauucuuaauuu

SEQ ID NO: 2042850 - RNA, 20 nt, Staphylococcus aureus subsp. aureus Mu50
auguuacugcacggauaccu

SEQ ID NO: 2042851 - RNA, 13 nt, Staphylococcus aureus subsp. aureus Mu50
auguuauaaaaug

SEQ ID NO: 2042852 - RNA, 20 nt, Staphylococcus aureus subsp. aureus Mu50
auguuauaaaaugaauaauu

SEQ ID NO: 2042853 - RNA, 19 nt, Staphylococcus aureus subsp. aureus Mu50
auguuauaaauucuaucua

SEQ ID NO: 2042854 - RNA, 20 nt, Staphylococcus aureus subsp. aureus Mu50
auguuauauuaaacuuauaa

SEQ ID NO: 2042855 - RNA, 16 nt, Staphylococcus aureus subsp. aureus Mu50
auguuaaauucuaaaa

SEQ ID NO: 2042856 - RNA, 12 nt, Staphylococcus aureus subsp. aureus Mu50
auguuaauaaug

SEQ ID NO: 2042857 - RNA, 14 nt, Staphylococcus aureus subsp. aureus Mu50
auguuacacaaauu

SEQ ID NO: 2042858 - RNA, 18 nt, Staphylococcus aureus subsp. aureus Mu50
auguuacacaaauuaaaa

SEQ ID NO: 2042859 - RNA, 12 nt, Staphylococcus aureus subsp. aureus Mu50
auguucauaaua

SEQ ID NO: 2042860 - RNA, 18 nt, Staphylococcus aureus subsp. aureus Mu50
auguucauaauauaacau

SEQ ID NO: 2042861 - RNA, 22 nt, Staphylococcus aureus subsp. aureus Mu50
auguucaaauguaguuaagaua

SEQ ID NO: 2042862 - RNA, 16 nt, Staphylococcus aureus subsp. aureus Mu50
augugcuuuaucaaca

SEQ ID NO: 2042863 - RNA, 17 nt, Staphylococcus aureus subsp. aureus Mu50
auguguaugaucaagcu

SEQ ID NO: 2042864 - RNA, 24 nt, Staphylococcus aureus subsp. aureus Mu50
auguguuaaucaacguauauaagu

SEQ ID NO: 2042865 - RNA, 18 nt, Staphylococcus aureus subsp. aureus Mu50
auguguuauguuagauga

SEQ ID NO: 2042866 - RNA, 15 nt, Staphylococcus aureus subsp. aureus Mu50
auguguuuuaauaau

SEQ ID NO: 2042867 - RNA, 16 nt, Staphylococcus aureus subsp. aureus Mu50
auguguuuuaauaaua

SEQ ID NO: 2042868 - RNA, 14 nt, Staphylococcus aureus subsp. aureus Mu50
auguuaaacaauac

SEQ ID NO: 2042869 - RNA, 21 nt, Staphylococcus aureus subsp. aureus Mu50
augugcuuuguuuaucaauuu

SEQ ID NO: 2042870 - RNA, 15 nt, Staphylococcus aureus subsp. aureus Mu50
augugcuaaucuauu

SEQ ID NO: 2042871 - RNA, 13 nt, Staphylococcus aureus subsp. aureus Mu50
caaauaauauaaa

SEQ ID NO: 2042872 - RNA, 14 nt, Staphylococcus aureus subsp. aureus Mu50
caaauaauaucuca

SEQ ID NO: 2042873 - RNA, 23 nt, Staphylococcus aureus subsp. aureus Mu50
caaaggcgcaccaugugccuuug

SEQ ID NO: 2042874 - RNA, 17 nt, Staphylococcus aureus subsp. aureus Mu50
caaagcugucaacuugu

SEQ ID NO: 2042875 - RNA, 23 nt, Staphylococcus aureus subsp. aureus Mu50
caaagaaagcuaauaucaauaau

SEQ ID NO: 2042876 - RNA, 23 nt, Staphylococcus aureus subsp. aureus Mu50
caaagcuauauaugaauugagua

SEQ ID NO: 2042877 - RNA, 22 nt, Staphylococcus aureus subsp. aureus Mu50
caaagcucguugcagauuuugc

SEQ ID NO: 2042878 - RNA, 12 nt, Staphylococcus aureus subsp. aureus Mu50
caaacguaugua

SEQ ID NO: 2042879 - RNA, 18 nt, Staphylococcus aureus subsp. aureus Mu50
caaacucuagacgcguuu

SEQ ID NO: 2042880 - RNA, 22 nt, Staphylococcus aureus subsp. aureus Mu50
auuguuaaagagcaauuaaagu

SEQ ID NO: 2042881 - RNA, 14 nt, Staphylococcus aureus subsp. aureus Mu50
auuguuaacgaaua

SEQ ID NO: 2042882 - RNA, 17 nt, Staphylococcus aureus subsp. aureus Mu50
auuguuccuucgauagu

SEQ ID NO: 2042883 - RNA, 21 nt, Staphylococcus aureus subsp. aureus Mu50
auuguucuaauacaccaaauc

SEQ ID NO: 2042884 - RNA, 16 nt, Staphylococcus aureus subsp. aureus Mu50
auuguuauuauaaacu

SEQ ID NO: 2042885 - RNA, 14 nt, Staphylococcus aureus subsp. aureus Mu50
auuuaaaaaaugcg

SEQ ID NO: 2042886 - RNA, 14 nt, Staphylococcus aureus subsp. aureus Mu50
auuuaaaaaauuua

SEQ ID NO: 2042887 - RNA, 21 nt, Staphylococcus aureus subsp. aureus Mu50
auuuaaaaagcaguaaguuga

SEQ ID NO: 2042888 - RNA, 14 nt, Staphylococcus aureus subsp. aureus Mu50
auuuaaaaaucaaa

SEQ ID NO: 2042889 - RNA, 14 nt, Staphylococcus aureus subsp. aureus Mu50
auuguuguaaauga

SEQ ID NO: 2042890 - RNA, 22 nt, Staphylococcus aureus subsp. aureus Mu50
auuuaaacgaucuucccaucuu

SEQ ID NO: 2042891 - RNA, 14 nt, Staphylococcus aureus subsp. aureus Mu50
auuuaaacuaguaa

SEQ ID NO: 2042892 - RNA, 15 nt, Staphylococcus aureus subsp. aureus Mu50
auuuaaaacuuguaa

SEQ ID NO: 2042893 - RNA, 13 nt, Staphylococcus aureus subsp. aureus Mu50
auuuaaaaguuua

SEQ ID NO: 2042894 - RNA, 14 nt, Staphylococcus aureus subsp. aureus Mu50
caaaaugaacaaua

SEQ ID NO: 2042895 - RNA, 18 nt, Staphylococcus aureus subsp. aureus Mu50
auuuaaaauaguucuuua

SEQ ID NO: 2042896 - RNA, 19 nt, Staphylococcus aureus subsp. aureus Mu50
auuuaaaggguguuuagau

SEQ ID NO: 2042897 - RNA, 14 nt, Staphylococcus aureus subsp. aureus Mu50
caaaauuauguaaa

SEQ ID NO: 2042898 - RNA, 21 nt, Staphylococcus aureus subsp. aureus Mu50
caaacaaaucuuuuaaauuua

SEQ ID NO: 2042899 - RNA, 11 nt, Staphylococcus aureus subsp. aureus Mu50
caaacaacauc

SEQ ID NO: 2042900 - RNA, 21 nt, Staphylococcus aureus subsp. aureus Mu50
caaacaaccugugauaaaaau

SEQ ID NO: 2042901 - RNA, 22 nt, Staphylococcus aureus subsp. aureus Mu50
auuuaaauaauaauucauaaau

SEQ ID NO: 2042902 - RNA, 16 nt, Staphylococcus aureus subsp. aureus Mu50
caaaaugguaucaaua

SEQ ID NO: 2042903 - RNA, 18 nt, Staphylococcus aureus subsp. aureus Mu50
caaaccauuccaauuuca

SEQ ID NO: 2042904 - RNA, 19 nt, Staphylococcus aureus subsp. aureus Mu50
caaauccaaaaucuuuacu

SEQ ID NO: 2042905 - RNA, 18 nt, Staphylococcus aureus subsp. aureus Mu50
caaaucaaauacaucaau

SEQ ID NO: 2042906 - RNA, 17 nt, Staphylococcus aureus subsp. aureus Mu50
caaauauaauguauaaa

SEQ ID NO: 2042907 - RNA, 14 nt, Staphylococcus aureus subsp. aureus Mu50
caaauaauuuacau

SEQ ID NO: 2042908 - RNA, 12 nt, Staphylococcus aureus subsp. aureus Mu50
caaauacuucaa

SEQ ID NO: 2042909 - RNA, 19 nt, Staphylococcus aureus subsp. aureus Mu50
caaauguugacuacucaau

SEQ ID NO: 2042910 - RNA, 14 nt, Staphylococcus aureus subsp. aureus Mu50
caaauguugauaau

SEQ ID NO: 2042911 - RNA, 15 nt, Staphylococcus aureus subsp. aureus Mu50
caaaugcuuaauaaa

SEQ ID NO: 2042912 - RNA, 20 nt, Staphylococcus aureus subsp. aureus Mu50
caaaugagcguuccauuaau

SEQ ID NO: 2042913 - RNA, 14 nt, Staphylococcus aureus subsp. aureus Mu50
caaaucgauuaauu

SEQ ID NO: 2042914 - RNA, 23 nt, Staphylococcus aureus subsp. aureus Mu50
caaaucggcuauacauugauaaa

SEQ ID NO: 2042915 - RNA, 21 nt, Staphylococcus aureus subsp. aureus Mu50
caaaucguuucaugcacuuua

SEQ ID NO: 2042916 - RNA, 14 nt, Staphylococcus aureus subsp. aureus Mu50
caaaucguaaacau

SEQ ID NO: 2042917 - RNA, 22 nt, Staphylococcus aureus subsp. aureus Mu50
caacaaugcauccaaauauuaa

SEQ ID NO: 2042918 - RNA, 12 nt, Staphylococcus aureus subsp. aureus Mu50
caacaauucgau

SEQ ID NO: 2042919 - RNA, 20 nt, Staphylococcus aureus subsp. aureus Mu50
caacaaucacgauuaauguc

SEQ ID NO: 2042920 - RNA, 15 nt, Staphylococcus aureus subsp. aureus Mu50
caacaauugacgugu

SEQ ID NO: 2042921 - RNA, 14 nt, Staphylococcus aureus subsp. aureus Mu50
caacacauaaauua

SEQ ID NO: 2042922 - RNA, 19 nt, Staphylococcus aureus subsp. aureus Mu50
caacacauaaauuaagcau

SEQ ID NO: 2042923 - RNA, 17 nt, Staphylococcus aureus subsp. aureus Mu50
caacaccaauugaaauu

SEQ ID NO: 2042924 - RNA, 15 nt, Staphylococcus aureus subsp. aureus Mu50
caacacccauauaau

SEQ ID NO: 2042925 - RNA, 22 nt, Staphylococcus aureus subsp. aureus Mu50
caaauucauuuguauuaauuug

SEQ ID NO: 2042926 - RNA, 22 nt, Staphylococcus aureus subsp. aureus Mu50
caaauucgacucaaacaauaaa

SEQ ID NO: 2042927 - RNA, 15 nt, Staphylococcus aureus subsp. aureus Mu50
caaauugaacuucuu

SEQ ID NO: 2042928 - RNA, 18 nt, Staphylococcus aureus subsp. aureus Mu50
caacaaagugcaauuauu

SEQ ID NO: 2042929 - RNA, 19 nt, Staphylococcus aureus subsp. aureus Mu50
caacaaagugcaauuauuu

SEQ ID NO: 2042930 - RNA, 14 nt, Staphylococcus aureus subsp. aureus Mu50
caacaagguuucaa

SEQ ID NO: 2042931 - RNA, 14 nt, Staphylococcus aureus subsp. aureus Mu50
caacauuugauaac

SEQ ID NO: 2042932 - RNA, 15 nt, Staphylococcus aureus subsp. aureus Mu50
caacaugauuucuuc

SEQ ID NO: 2042933 - RNA, 23 nt, Staphylococcus aureus subsp. aureus Mu50
caacgauguccuuuaguguguuu

SEQ ID NO: 2042934 - RNA, 18 nt, Staphylococcus aureus subsp. aureus Mu50
caacgucaucugcuugua

SEQ ID NO: 2042935 - RNA, 19 nt, Staphylococcus aureus subsp. aureus Mu50
caacguuauucguuaacaa

SEQ ID NO: 2042936 - RNA, 16 nt, Staphylococcus aureus subsp. aureus Mu50
caacuaagaugacuga

SEQ ID NO: 2042937 - RNA, 15 nt, Staphylococcus aureus subsp. aureus Mu50
caacuaauguuaaaa

SEQ ID NO: 2042938 - RNA, 18 nt, Staphylococcus aureus subsp. aureus Mu50
caacuauauauaguugau

SEQ ID NO: 2042939 - RNA, 16 nt, Staphylococcus aureus subsp. aureus Mu50
caagcuuuauuuuuug

SEQ ID NO: 2042940 - RNA, 18 nt, Staphylococcus aureus subsp. aureus Mu50
caaguaauuuaauugguu

SEQ ID NO: 2042941 - RNA, 14 nt, Staphylococcus aureus subsp. aureus Mu50
caagucauuaucca

SEQ ID NO: 2042942 - RNA, 20 nt, Staphylococcus aureus subsp. aureus Mu50
caagugacuuaauaucauau

SEQ ID NO: 2042943 - RNA, 22 nt, Staphylococcus aureus subsp. aureus Mu50
caagucuuuacucuacacucaa

SEQ ID NO: 2042944 - RNA, 17 nt, Staphylococcus aureus subsp. aureus Mu50
caagucuaguucgaaca

SEQ ID NO: 2042945 - RNA, 16 nt, Staphylococcus aureus subsp. aureus Mu50
caauagcaauugaaua

SEQ ID NO: 2042946 - RNA, 15 nt, Staphylococcus aureus subsp. aureus Mu50
caauagaugaaaauu

SEQ ID NO: 2042947 - RNA, 16 nt, Staphylococcus aureus subsp. aureus Mu50
caauacgaauaucugu

SEQ ID NO: 2042948 - RNA, 20 nt, Staphylococcus aureus subsp. aureus Mu50
caauacgaaaucaaaaauaa

SEQ ID NO: 2042949 - RNA, 19 nt, Staphylococcus aureus subsp. aureus Mu50
caauacgaaguguuauaaa

SEQ ID NO: 2042950 - RNA, 18 nt, Staphylococcus aureus subsp. aureus Mu50
caauacgaaguuucaugu

SEQ ID NO: 2042951 - RNA, 17 nt, Staphylococcus aureus subsp. aureus Mu50
caauaccgcgauaaaua

SEQ ID NO: 2042952 - RNA, 19 nt, Staphylococcus aureus subsp. aureus Mu50
caauaccgcgauaaauaac

SEQ ID NO: 2042953 - RNA, 16 nt, Staphylococcus aureus subsp. aureus Mu50
caauagguacaacuaa

SEQ ID NO: 2042954 - RNA, 18 nt, Staphylococcus aureus subsp. aureus Mu50
caauagguacaacuaaau

SEQ ID NO: 2042955 - RNA, 15 nt, Staphylococcus aureus subsp. aureus Mu50
caauaguauaaauau

SEQ ID NO: 2042956 - RNA, 18 nt, Staphylococcus aureus subsp. aureus Mu50
caauaguauuaacuauaa

SEQ ID NO: 2042957 - RNA, 15 nt, Staphylococcus aureus subsp. aureus Mu50
caauauacuuuuuaa

SEQ ID NO: 2042958 - RNA, 19 nt, Staphylococcus aureus subsp. aureus Mu50
caauauacuuuuuaaauga

SEQ ID NO: 2042959 - RNA, 17 nt, Staphylococcus aureus subsp. aureus Mu50
caauaucaucauuuaaa

SEQ ID NO: 2042960 - RNA, 20 nt, Staphylococcus aureus subsp. aureus Mu50
caauaucaucauuuaaauau

SEQ ID NO: 2042961 - RNA, 20 nt, Staphylococcus aureus subsp. aureus Mu50
caauaugaccuuuaugugca

SEQ ID NO: 2042962 - RNA, 18 nt, Staphylococcus aureus subsp. aureus Mu50
caauaucuucagcuaaaa

SEQ ID NO: 2042963 - RNA, 19 nt, Staphylococcus aureus subsp. aureus Mu50
caauaucuucuaauuccau

SEQ ID NO: 2042964 - RNA, 15 nt, Staphylococcus aureus subsp. aureus Mu50
caauauugauaucga

SEQ ID NO: 2042965 - RNA, 21 nt, Staphylococcus aureus subsp. aureus Mu50
caauaugauuaauaaaguaau

SEQ ID NO: 2042966 - RNA, 15 nt, Staphylococcus aureus subsp. aureus Mu50
caauaccauaauuaa

SEQ ID NO: 2042967 - RNA, 14 nt, Staphylococcus aureus subsp. aureus Mu50
caauacaaaucgau

SEQ ID NO: 2042968 - RNA, 12 nt, Staphylococcus aureus subsp. aureus Mu50
caauaaugugca

SEQ ID NO: 2042969 - RNA, 17 nt, Staphylococcus aureus subsp. aureus Mu50
caauaauguuacgcugu

SEQ ID NO: 2042970 - RNA, 16 nt, Staphylococcus aureus subsp. aureus Mu50
caauaauuagucauca

SEQ ID NO: 2042971 - RNA, 14 nt, Staphylococcus aureus subsp. aureus Mu50
caauaauuauuaau

SEQ ID NO: 2042972 - RNA, 15 nt, Staphylococcus aureus subsp. aureus Mu50
caauaacaggugcuu

SEQ ID NO: 2042973 - RNA, 15 nt, Staphylococcus aureus subsp. aureus Mu50
caauaauaaaccuaa

SEQ ID NO: 2042974 - RNA, 17 nt, Staphylococcus aureus subsp. aureus Mu50
caauaagcgcaauuaaa

SEQ ID NO: 2042975 - RNA, 17 nt, Staphylococcus aureus subsp. aureus Mu50
caaguguuguuugccuu

SEQ ID NO: 2042976 - RNA, 23 nt, Staphylococcus aureus subsp. aureus Mu50
caaguguaucgcccauaccacca

SEQ ID NO: 2042977 - RNA, 16 nt, Staphylococcus aureus subsp. aureus Mu50
caaguuguuuuuuguu

SEQ ID NO: 2042978 - RNA, 21 nt, Staphylococcus aureus subsp. aureus Mu50
caaguuuacagguugaauaaa

SEQ ID NO: 2042979 - RNA, 17 nt, Staphylococcus aureus subsp. aureus Mu50
caaguuuacgaucauaa

SEQ ID NO: 2042980 - RNA, 19 nt, Staphylococcus aureus subsp. aureus Mu50
caaguuuauaaauuucgau

SEQ ID NO: 2042981 - RNA, 22 nt, Staphylococcus aureus subsp. aureus Mu50
caaucgcuuuagcaauugaauc

SEQ ID NO: 2042982 - RNA, 14 nt, Staphylococcus aureus subsp. aureus Mu50
caaucguugaaaaa

SEQ ID NO: 2042983 - RNA, 18 nt, Staphylococcus aureus subsp. aureus Mu50
caaucgucacaucacguu

SEQ ID NO: 2042984 - RNA, 14 nt, Staphylococcus aureus subsp. aureus Mu50
caaucuauuuuaaa

SEQ ID NO: 2042985 - RNA, 22 nt, Staphylococcus aureus subsp. aureus Mu50
caaugccacgcucauuuucugu

SEQ ID NO: 2042986 - RNA, 14 nt, Staphylococcus aureus subsp. aureus Mu50
caaucucuuuagau

SEQ ID NO: 2042987 - RNA, 13 nt, Staphylococcus aureus subsp. aureus Mu50
caaugcauuuaau

SEQ ID NO: 2042988 - RNA, 20 nt, Staphylococcus aureus subsp. aureus Mu50
caaugcagcuguauuuaaua

SEQ ID NO: 2042989 - RNA, 18 nt, Staphylococcus aureus subsp. aureus Mu50
caaucuuaucauaaucuu

SEQ ID NO: 2042990 - RNA, 17 nt, Staphylococcus aureus subsp. aureus Mu50
caaucaucgcaaauaca

SEQ ID NO: 2042991 - RNA, 23 nt, Staphylococcus aureus subsp. aureus Mu50
caaucaucgcaaauacauaauca

SEQ ID NO: 2042992 - RNA, 22 nt, Staphylococcus aureus subsp. aureus Mu50
caauauuuuuacauauuuauac

SEQ ID NO: 2042993 - RNA, 21 nt, Staphylococcus aureus subsp. aureus Mu50
caaucaacgagucauaaauau

SEQ ID NO: 2042994 - RNA, 15 nt, Staphylococcus aureus subsp. aureus Mu50
caaucaacuucauau

SEQ ID NO: 2042995 - RNA, 21 nt, Staphylococcus aureus subsp. aureus Mu50
caaucaaauuacaaauuaucu

SEQ ID NO: 2042996 - RNA, 21 nt, Staphylococcus aureus subsp. aureus Mu50
caauccaauauacaaugcuga

SEQ ID NO: 2042997 - RNA, 23 nt, Staphylococcus aureus subsp. aureus Mu50
caaucgaggggucuuuuuuuaau

SEQ ID NO: 2042998 - RNA, 15 nt, Staphylococcus aureus subsp. aureus Mu50
caauccuuuguuugu

SEQ ID NO: 2042999 - RNA, 14 nt, Staphylococcus aureus subsp. aureus Mu50
caauugcaaugaau

SEQ ID NO: 2043000 - RNA, 21 nt, Staphylococcus aureus subsp. aureus Mu50
caauuuuagccaaauuacugu

SEQ ID NO: 2043001 - RNA, 20 nt, Staphylococcus aureus subsp. aureus Mu50
caauuuggucauauaaacaa

SEQ ID NO: 2043002 - RNA, 15 nt, Staphylococcus aureus subsp. aureus Mu50
caauuucauuugaaa

SEQ ID NO: 2043003 - RNA, 20 nt, Staphylococcus aureus subsp. aureus Mu50
caauuuauguaaauucaaaa

SEQ ID NO: 2043004 - RNA, 22 nt, Staphylococcus aureus subsp. aureus Mu50
caauuucucuuucgacuucgau

SEQ ID NO: 2043005 - RNA, 22 nt, Staphylococcus aureus subsp. aureus Mu50
cacaagcaucuacaauauucaa

SEQ ID NO: 2043006 - RNA, 14 nt, Staphylococcus aureus subsp. aureus Mu50
caccacauaaaaau

SEQ ID NO: 2043007 - RNA, 12 nt, Staphylococcus aureus subsp. aureus Mu50
cacacuauuaua

SEQ ID NO: 2043008 - RNA, 15 nt, Staphylococcus aureus subsp. aureus Mu50
accaauugaauauuu

SEQ ID NO: 2043009 - RNA, 14 nt, Staphylococcus aureus subsp. aureus Mu50
accaccaccuguga

SEQ ID NO: 2043010 - RNA, 13 nt, Staphylococcus aureus subsp. aureus Mu50
acauucaauauuu

SEQ ID NO: 2043011 - RNA, 22 nt, Staphylococcus aureus subsp. aureus Mu50
acauuauugaaauuuuuaauau

SEQ ID NO: 2043012 - RNA, 22 nt, Staphylococcus aureus subsp. aureus Mu50
acauuauuuauauuuagaauau

SEQ ID NO: 2043013 - RNA, 16 nt, Staphylococcus aureus subsp. aureus Mu50
acauuagcauuaaauu

SEQ ID NO: 2043014 - RNA, 15 nt, Staphylococcus aureus subsp. aureus Mu50
acauuagccacagcu

SEQ ID NO: 2043015 - RNA, 18 nt, Staphylococcus aureus subsp. aureus Mu50
acauuacauuuaguacau

SEQ ID NO: 2043016 - RNA, 17 nt, Staphylococcus aureus subsp. aureus Mu50
acauuaaaacaauaauu

SEQ ID NO: 2043017 - RNA, 16 nt, Staphylococcus aureus subsp. aureus Mu50
acauuaaaauguguuu

SEQ ID NO: 2043018 - RNA, 12 nt, Staphylococcus aureus subsp. aureus Mu50
acauuaauauaa

SEQ ID NO: 2043019 - RNA, 17 nt, Staphylococcus aureus subsp. aureus Mu50
acauuaagcuaugcuuu

SEQ ID NO: 2043020 - RNA, 16 nt, Staphylococcus aureus subsp. aureus Mu50
acauguuccgcuacaa

SEQ ID NO: 2043021 - RNA, 16 nt, Staphylococcus aureus subsp. aureus Mu50
accaauuguuucagcu

SEQ ID NO: 2043022 - RNA, 22 nt, Staphylococcus aureus subsp. aureus Mu50
acauucgagcuaggguuaaaau

SEQ ID NO: 2043023 - RNA, 20 nt, Staphylococcus aureus subsp. aureus Mu50
accauaacuuuauauauaaa

SEQ ID NO: 2043024 - RNA, 20 nt, Staphylococcus aureus subsp. aureus Mu50
accauauuuaugguguagcu

SEQ ID NO: 2043025 - RNA, 22 nt, Staphylococcus aureus subsp. aureus Mu50
accaguuugugguaaugauuuu

SEQ ID NO: 2043026 - RNA, 17 nt, Staphylococcus aureus subsp. aureus Mu50
accaguuugaucauaau

SEQ ID NO: 2043027 - RNA, 16 nt, Staphylococcus aureus subsp. aureus Mu50
accauuccaaaaauug

SEQ ID NO: 2043028 - RNA, 21 nt, Staphylococcus aureus subsp. aureus Mu50
accauuucguguuccaauuuu

SEQ ID NO: 2043029 - RNA, 16 nt, Staphylococcus aureus subsp. aureus Mu50
accauuuaaaaauuga

SEQ ID NO: 2043030 - RNA, 17 nt, Staphylococcus aureus subsp. aureus Mu50
accaguagcuaaugcaa

SEQ ID NO: 2043031 - RNA, 18 nt, Staphylococcus aureus subsp. aureus Mu50
acaccuaauucauauaua

SEQ ID NO: 2043032 - RNA, 22 nt, Staphylococcus aureus subsp. aureus Mu50
acaccaucaacgccauauuuau

SEQ ID NO: 2043033 - RNA, 19 nt, Staphylococcus aureus subsp. aureus Mu50
acaccagauaucauaauau

SEQ ID NO: 2043034 - RNA, 19 nt, Staphylococcus aureus subsp. aureus Mu50
aauuugaggauacauaaau

SEQ ID NO: 2043035 - RNA, 16 nt, Staphylococcus aureus subsp. aureus Mu50
aauuucuguaaccaaa

SEQ ID NO: 2043036 - RNA, 21 nt, Staphylococcus aureus subsp. aureus Mu50
aauuucuguaauaauaucacc

SEQ ID NO: 2043037 - RNA, 16 nt, Staphylococcus aureus subsp. aureus Mu50
aauuugcaaaaucaac

SEQ ID NO: 2043038 - RNA, 19 nt, Staphylococcus aureus subsp. aureus Mu50
aauuugauguucuugaaaa

SEQ ID NO: 2043039 - RNA, 16 nt, Staphylococcus aureus subsp. aureus Mu50
aauuugauuaaauucu

SEQ ID NO: 2043040 - RNA, 21 nt, Staphylococcus aureus subsp. aureus Mu50
aauuucucccguuugauuuca

SEQ ID NO: 2043041 - RNA, 14 nt, Staphylococcus aureus subsp. aureus Mu50
aauuucgacaucua

SEQ ID NO: 2043042 - RNA, 23 nt, Staphylococcus aureus subsp. aureus Mu50
aauuucuaugaaaaaaaucgaau

SEQ ID NO: 2043043 - RNA, 15 nt, Staphylococcus aureus subsp. aureus Mu50
aauuugaaauugaca

SEQ ID NO: 2043044 - RNA, 18 nt, Staphylococcus aureus subsp. aureus Mu50
aauuuguaacuauugaaa

SEQ ID NO: 2043045 - RNA, 13 nt, Staphylococcus aureus subsp. aureus Mu50
aauuuguaccaaa

SEQ ID NO: 2043046 - RNA, 18 nt, Staphylococcus aureus subsp. aureus Mu50
aauuuguaccaaauaaau

SEQ ID NO: 2043047 - RNA, 21 nt, Staphylococcus aureus subsp. aureus Mu50
aauuuguaccaaauaaauuaa

SEQ ID NO: 2043048 - RNA, 17 nt, Staphylococcus aureus subsp. aureus Mu50
aauuuguguucaaauca

SEQ ID NO: 2043049 - RNA, 23 nt, Staphylococcus aureus subsp. aureus Mu50
aauuuuaaaaauaaaaaaccaau

SEQ ID NO: 2043050 - RNA, 15 nt, Staphylococcus aureus subsp. aureus Mu50
aauuuuaaaauaaau

SEQ ID NO: 2043051 - RNA, 15 nt, Staphylococcus aureus subsp. aureus Mu50
aauuuuaaguuaauu

SEQ ID NO: 2043052 - RNA, 22 nt, Staphylococcus aureus subsp. aureus Mu50
aauuuuaaugggcgugccauua

SEQ ID NO: 2043053 - RNA, 12 nt, Staphylococcus aureus subsp. aureus Mu50
aauuuugauaua

SEQ ID NO: 2043054 - RNA, 15 nt, Staphylococcus aureus subsp. aureus Mu50
aauuuugcaacauua

SEQ ID NO: 2043055 - RNA, 20 nt, Staphylococcus aureus subsp. aureus Mu50
aauuuuggaccucuugaaaa

SEQ ID NO: 2043056 - RNA, 22 nt, Staphylococcus aureus subsp. aureus Mu50
aauuuuauaaauuaaaugcaau

SEQ ID NO: 2043057 - RNA, 14 nt, Staphylococcus aureus subsp. aureus Mu50
aauuuucuaaaugu

SEQ ID NO: 2043058 - RNA, 20 nt, Staphylococcus aureus subsp. aureus Mu50
aauuuuagccaaauuacugu

SEQ ID NO: 2043059 - RNA, 19 nt, Staphylococcus aureus subsp. aureus Mu50
aauuuuccuuccaauaaua

SEQ ID NO: 2043060 - RNA, 19 nt, Staphylococcus aureus subsp. aureus Mu50
acacaucgaucuaaauaua

SEQ ID NO: 2043061 - RNA, 12 nt, Staphylococcus aureus subsp. aureus Mu50
acacauuuacuu

SEQ ID NO: 2043062 - RNA, 16 nt, Staphylococcus aureus subsp. aureus Mu50
acacauuauugaaauu

SEQ ID NO: 2043063 - RNA, 20 nt, Staphylococcus aureus subsp. aureus Mu50
acacaguacaaauaacaaac

SEQ ID NO: 2043064 - RNA, 14 nt, Staphylococcus aureus subsp. aureus Mu50
aauuuuuauucugu

SEQ ID NO: 2043065 - RNA, 22 nt, Staphylococcus aureus subsp. aureus Mu50
aauuuuguuuugcuucuuuaaa

SEQ ID NO: 2043066 - RNA, 12 nt, Staphylococcus aureus subsp. aureus Mu50
aauuuuuaaugu

SEQ ID NO: 2043067 - RNA, 15 nt, Staphylococcus aureus subsp. aureus Mu50
acacuuuucuuauca

SEQ ID NO: 2043068 - RNA, 17 nt, Staphylococcus aureus subsp. aureus Mu50
acacuugauaaaacuaa

SEQ ID NO: 2043069 - RNA, 17 nt, Staphylococcus aureus subsp. aureus Mu50
acacuuuaaacaagcau

SEQ ID NO: 2043070 - RNA, 22 nt, Staphylococcus aureus subsp. aureus Mu50
acacguguauuguauuuuaaug

SEQ ID NO: 2043071 - RNA, 13 nt, Staphylococcus aureus subsp. aureus Mu50
acaccuucaauau

SEQ ID NO: 2043072 - RNA, 15 nt, Staphylococcus aureus subsp. aureus Mu50
acaccuucaauaucu

SEQ ID NO: 2043073 - RNA, 16 nt, Staphylococcus aureus subsp. aureus Mu50
acaccuucaauaucug

SEQ ID NO: 2043074 - RNA, 21 nt, Staphylococcus aureus subsp. aureus Mu50
acagaugcgucguagauugau

SEQ ID NO: 2043075 - RNA, 23 nt, Staphylococcus aureus subsp. aureus Mu50
acagagaaauucgaaaagaaauu

SEQ ID NO: 2043076 - RNA, 21 nt, Staphylococcus aureus subsp. aureus Mu50
acagauaagaauauuuaaguu

SEQ ID NO: 2043077 - RNA, 21 nt, Staphylococcus aureus subsp. aureus Mu50
acagcaucaccuaaagcuuua

SEQ ID NO: 2043078 - RNA, 19 nt, Staphylococcus aureus subsp. aureus Mu50
acagcgugaauauaaguaa

SEQ ID NO: 2043079 - RNA, 23 nt, Staphylococcus aureus subsp. aureus Mu50
acagcuaauguguacuuaaaaau

SEQ ID NO: 2043080 - RNA, 14 nt, Staphylococcus aureus subsp. aureus Mu50
acagcuacaaauaa

SEQ ID NO: 2043081 - RNA, 21 nt, Staphylococcus aureus subsp. aureus Mu50
acaugguuuucaccagaccaa

SEQ ID NO: 2043082 - RNA, 22 nt, Staphylococcus aureus subsp. aureus Mu50
acauguacguuuuuuuaaauac

SEQ ID NO: 2043083 - RNA, 23 nt, Staphylococcus aureus subsp. aureus Mu50
acauguacguuuuuuuaaauaca

SEQ ID NO: 2043084 - RNA, 17 nt, Staphylococcus aureus subsp. aureus Mu50
acauccacuuuauaauu

SEQ ID NO: 2043085 - RNA, 16 nt, Staphylococcus aureus subsp. aureus Mu50
acaucauugauagaua

SEQ ID NO: 2043086 - RNA, 23 nt, Staphylococcus aureus subsp. aureus Mu50
acaucaugugucuuccaaucaac

SEQ ID NO: 2043087 - RNA, 14 nt, Staphylococcus aureus subsp. aureus Mu50
acaucauuaaauau

SEQ ID NO: 2043088 - RNA, 16 nt, Staphylococcus aureus subsp. aureus Mu50
acaucauuaaauauuu

SEQ ID NO: 2043089 - RNA, 15 nt, Staphylococcus aureus subsp. aureus Mu50
acauauuuuaacuau

SEQ ID NO: 2043090 - RNA, 17 nt, Staphylococcus aureus subsp. aureus Mu50
acauauuuuaacuauga

SEQ ID NO: 2043091 - RNA, 21 nt, Staphylococcus aureus subsp. aureus Mu50
acauauuggcuugcuucauua

SEQ ID NO: 2043092 - RNA, 20 nt, Staphylococcus aureus subsp. aureus Mu50
acaucaaauuuuucgacauc

SEQ ID NO: 2043093 - RNA, 18 nt, Staphylococcus aureus subsp. aureus Mu50
acauauuuuaacuaugaa

SEQ ID NO: 2043094 - RNA, 19 nt, Staphylococcus aureus subsp. aureus Mu50
acaucaucuauaauaccua

SEQ ID NO: 2043095 - RNA, 15 nt, Staphylococcus aureus subsp. aureus Mu50
acaucaucuuuaauu

SEQ ID NO: 2043096 - RNA, 11 nt, Staphylococcus aureus subsp. aureus Mu50
acaucauaaau

SEQ ID NO: 2043097 - RNA, 22 nt, Staphylococcus aureus subsp. aureus Mu50
acaucauaauaaaucuaucuac

SEQ ID NO: 2043098 - RNA, 20 nt, Staphylococcus aureus subsp. aureus Mu50
acaucacuauacgcaaucau

SEQ ID NO: 2043099 - RNA, 17 nt, Staphylococcus aureus subsp. aureus Mu50
acaucagauauaaguag

SEQ ID NO: 2043100 - RNA, 14 nt, Staphylococcus aureus subsp. aureus Mu50
acccuugcaaauau

SEQ ID NO: 2043101 - RNA, 13 nt, Staphylococcus aureus subsp. aureus Mu50
acccucauuuuua

SEQ ID NO: 2043102 - RNA, 12 nt, Staphylococcus aureus subsp. aureus Mu50
acccaaauuaua

SEQ ID NO: 2043103 - RNA, 18 nt, Staphylococcus aureus subsp. aureus Mu50
acccaccguuaaaauaua

SEQ ID NO: 2043104 - RNA, 15 nt, Staphylococcus aureus subsp. aureus Mu50
acccaccacauuugg

SEQ ID NO: 2043105 - RNA, 16 nt, Staphylococcus aureus subsp. aureus Mu50
accgaguauugcugca

SEQ ID NO: 2043106 - RNA, 23 nt, Staphylococcus aureus subsp. aureus Mu50
accgagcggccgugguaugauuu

SEQ ID NO: 2043107 - RNA, 20 nt, Staphylococcus aureus subsp. aureus Mu50
accgauuguuaauuuaaagu

SEQ ID NO: 2043108 - RNA, 16 nt, Staphylococcus aureus subsp. aureus Mu50
accggcauauaaucca

SEQ ID NO: 2043109 - RNA, 13 nt, Staphylococcus aureus subsp. aureus Mu50
accguuaaaauau

SEQ ID NO: 2043110 - RNA, 14 nt, Staphylococcus aureus subsp. aureus Mu50
accguuaaaauaua

SEQ ID NO: 2043111 - RNA, 14 nt, Staphylococcus aureus subsp. aureus Mu50
accgugguucaaaa

SEQ ID NO: 2043112 - RNA, 16 nt, Staphylococcus aureus subsp. aureus Mu50
accguauuuuaauauu

SEQ ID NO: 2043113 - RNA, 19 nt, Staphylococcus aureus subsp. aureus Mu50
acuuuuccuugauucuuau

SEQ ID NO: 2043114 - RNA, 12 nt, Staphylococcus aureus subsp. aureus Mu50
acuuuucuaaac

SEQ ID NO: 2043115 - RNA, 18 nt, Staphylococcus aureus subsp. aureus Mu50
acuuuuacaaacuucaca

SEQ ID NO: 2043116 - RNA, 20 nt, Staphylococcus aureus subsp. aureus Mu50
acuuuuauugccauaaagua

SEQ ID NO: 2043117 - RNA, 22 nt, Staphylococcus aureus subsp. aureus Mu50
acuuuuauuuuuuauaaagaua

SEQ ID NO: 2043118 - RNA, 16 nt, Staphylococcus aureus subsp. aureus Mu50
acuuuuauaauucuaa

SEQ ID NO: 2043119 - RNA, 15 nt, Staphylococcus aureus subsp. aureus Mu50
acuuuuauagaaaau

SEQ ID NO: 2043120 - RNA, 20 nt, Staphylococcus aureus subsp. aureus Mu50
acuuuuauagaaaauuaacu

SEQ ID NO: 2043121 - RNA, 14 nt, Staphylococcus aureus subsp. aureus Mu50
acuuuuauuacuua

SEQ ID NO: 2043122 - RNA, 17 nt, Staphylococcus aureus subsp. aureus Mu50
acuuuggacuuuaaagu

SEQ ID NO: 2043123 - RNA, 13 nt, Staphylococcus aureus subsp. aureus Mu50
acuuuguucaugu

SEQ ID NO: 2043124 - RNA, 16 nt, Staphylococcus aureus subsp. aureus Mu50
acuuugucugcaauuu

SEQ ID NO: 2043125 - RNA, 14 nt, Staphylococcus aureus subsp. aureus Mu50
acuuuuugaugauu

SEQ ID NO: 2043126 - RNA, 19 nt, Staphylococcus aureus subsp. aureus Mu50
acuuuuuugagcauuuuua

SEQ ID NO: 2043127 - RNA, 14 nt, Staphylococcus aureus subsp. aureus Mu50
acuuuuuuuaaauc

SEQ ID NO: 2043128 - RNA, 16 nt, Staphylococcus aureus subsp. aureus Mu50
acuuuugggaagcguc

SEQ ID NO: 2043129 - RNA, 20 nt, Staphylococcus aureus subsp. aureus Mu50
acuuuuuacuaggaauauaa

SEQ ID NO: 2043130 - RNA, 14 nt, Staphylococcus aureus subsp. aureus Mu50
acuuuuuaauaaua

SEQ ID NO: 2043131 - RNA, 16 nt, Staphylococcus aureus subsp. aureus Mu50
acuuuuucagaaugaa

SEQ ID NO: 2043132 - RNA, 11 nt, Staphylococcus aureus subsp. aureus Mu50
agaaaaaguuu

SEQ ID NO: 2043133 - RNA, 12 nt, Staphylococcus aureus subsp. aureus Mu50
acuuuaauaaug

SEQ ID NO: 2043134 - RNA, 16 nt, Staphylococcus aureus subsp. aureus Mu50
acuuuaauuuuucauu

SEQ ID NO: 2043135 - RNA, 17 nt, Staphylococcus aureus subsp. aureus Mu50
acuuuaauuuuucauua

SEQ ID NO: 2043136 - RNA, 20 nt, Staphylococcus aureus subsp. aureus Mu50
acuuuaauuuuucauuaaua

SEQ ID NO: 2043137 - RNA, 14 nt, Staphylococcus aureus subsp. aureus Mu50
acuuuaaaauugua

SEQ ID NO: 2043138 - RNA, 20 nt, Staphylococcus aureus subsp. aureus Mu50
acuuuaaaauuguauagaau

SEQ ID NO: 2043139 - RNA, 16 nt, Staphylococcus aureus subsp. aureus Mu50
acuuucacucauauua

SEQ ID NO: 2043140 - RNA, 17 nt, Staphylococcus aureus subsp. aureus Mu50
acuuucaaauaauguga

SEQ ID NO: 2043141 - RNA, 15 nt, Staphylococcus aureus subsp. aureus Mu50
acuuucuaauuguuu

SEQ ID NO: 2043142 - RNA, 15 nt, Staphylococcus aureus subsp. aureus Mu50
acuuucuauuaauau

SEQ ID NO: 2043143 - RNA, 22 nt, Staphylococcus aureus subsp. aureus Mu50
acuuugaagggagcauuucauu

SEQ ID NO: 2043144 - RNA, 15 nt, Staphylococcus aureus subsp. aureus Mu50
acuuucacuuuuuau

SEQ ID NO: 2043145 - RNA, 14 nt, Staphylococcus aureus subsp. aureus Mu50
acuucuuaaaauau

SEQ ID NO: 2043146 - RNA, 19 nt, Staphylococcus aureus subsp. aureus Mu50
acuucucaucgaauucauu

SEQ ID NO: 2043147 - RNA, 17 nt, Staphylococcus aureus subsp. aureus Mu50
acuucucccuuaaauac

SEQ ID NO: 2043148 - RNA, 14 nt, Staphylococcus aureus subsp. aureus Mu50
acuucuaauaguaa

SEQ ID NO: 2043149 - RNA, 15 nt, Staphylococcus aureus subsp. aureus Mu50
acuugagcuauucau

SEQ ID NO: 2043150 - RNA, 22 nt, Staphylococcus aureus subsp. aureus Mu50
acuugaaaauagccauauucau

SEQ ID NO: 2043151 - RNA, 17 nt, Staphylococcus aureus subsp. aureus Mu50
acuugauaaaaaaugaa

SEQ ID NO: 2043152 - RNA, 15 nt, Staphylococcus aureus subsp. aureus Mu50
acuugauagcauuuc

SEQ ID NO: 2043153 - RNA, 13 nt, Staphylococcus aureus subsp. aureus Mu50
acuugauaucauc

SEQ ID NO: 2043154 - RNA, 21 nt, Staphylococcus aureus subsp. aureus Mu50
acuugaauaccuuuuauuauu

SEQ ID NO: 2043155 - RNA, 23 nt, Staphylococcus aureus subsp. aureus Mu50
acuugaauauagcugugauuuga

SEQ ID NO: 2043156 - RNA, 21 nt, Staphylococcus aureus subsp. aureus Mu50
acuucuuguucgauaaucguu

SEQ ID NO: 2043157 - RNA, 13 nt, Staphylococcus aureus subsp. aureus Mu50
acuucuuucaaaa

SEQ ID NO: 2043158 - RNA, 16 nt, Staphylococcus aureus subsp. aureus Mu50
acuucuuucaauuaau

SEQ ID NO: 2043159 - RNA, 19 nt, Staphylococcus aureus subsp. aureus Mu50
acuugcgccugcuaaaaag

SEQ ID NO: 2043160 - RNA, 19 nt, Staphylococcus aureus subsp. aureus Mu50
acuugcgguucuuugucau

SEQ ID NO: 2043161 - RNA, 19 nt, Staphylococcus aureus subsp. aureus Mu50
acuuguugauauauauuuu

SEQ ID NO: 2043162 - RNA, 15 nt, Staphylococcus aureus subsp. aureus Mu50
acuugucguauucuu

SEQ ID NO: 2043163 - RNA, 21 nt, Staphylococcus aureus subsp. aureus Mu50
acuugucuaccgaaugaguuu

SEQ ID NO: 2043164 - RNA, 18 nt, Staphylococcus aureus subsp. aureus Mu50
acuuguaucaucgccaug

SEQ ID NO: 2043165 - RNA, 18 nt, Staphylococcus aureus subsp. aureus Mu50
acuuggauuaccguuaaa

SEQ ID NO: 2043166 - RNA, 20 nt, Staphylococcus aureus subsp. aureus Mu50
acuugcuguugcaauaaaau

SEQ ID NO: 2043167 - RNA, 21 nt, Staphylococcus aureus subsp. aureus Mu50
acuugcuguugcaauaaaauc

SEQ ID NO: 2043168 - RNA, 14 nt, Staphylococcus aureus subsp. aureus Mu50
acuugcuuuguuag

SEQ ID NO: 2043169 - RNA, 18 nt, Staphylococcus aureus subsp. aureus Mu50
acuucauauccuucauua

SEQ ID NO: 2043170 - RNA, 15 nt, Staphylococcus aureus subsp. aureus Mu50
acuucauauaaugcu

SEQ ID NO: 2043171 - RNA, 14 nt, Staphylococcus aureus subsp. aureus Mu50
acuucccaaucgau

SEQ ID NO: 2043172 - RNA, 13 nt, Staphylococcus aureus subsp. aureus Mu50
acuuccaucaauc

SEQ ID NO: 2043173 - RNA, 20 nt, Staphylococcus aureus subsp. aureus Mu50
acuuccaucaauccaacuac

SEQ ID NO: 2043174 - RNA, 21 nt, Staphylococcus aureus subsp. aureus Mu50
acuucaucuguaucaaucaac

SEQ ID NO: 2043175 - RNA, 15 nt, Staphylococcus aureus subsp. aureus Mu50
acuuccuuuuuuuaa

SEQ ID NO: 2043176 - RNA, 20 nt, Staphylococcus aureus subsp. aureus Mu50
acuguaugccgccuaauaau

SEQ ID NO: 2043177 - RNA, 16 nt, Staphylococcus aureus subsp. aureus Mu50
acuuacaagucuaguu

SEQ ID NO: 2043178 - RNA, 15 nt, Staphylococcus aureus subsp. aureus Mu50
acuuaacuuaagcuc

SEQ ID NO: 2043179 - RNA, 19 nt, Staphylococcus aureus subsp. aureus Mu50
acuuacugugaaaauacca

SEQ ID NO: 2043180 - RNA, 21 nt, Staphylococcus aureus subsp. aureus Mu50
acuuacauuuuaauaaaauca

SEQ ID NO: 2043181 - RNA, 18 nt, Staphylococcus aureus subsp. aureus Mu50
acuuaaauggaugauagu

SEQ ID NO: 2043182 - RNA, 19 nt, Staphylococcus aureus subsp. aureus Mu50
acuguuuaucaugaugaua

SEQ ID NO: 2043183 - RNA, 12 nt, Staphylococcus aureus subsp. aureus Mu50
acuuaaaauuua

SEQ ID NO: 2043184 - RNA, 16 nt, Staphylococcus aureus subsp. aureus Mu50
acuucaccaucuuuaa

SEQ ID NO: 2043185 - RNA, 23 nt, Staphylococcus aureus subsp. aureus Mu50
acuucaauuuaugguaaaaccca

SEQ ID NO: 2043186 - RNA, 17 nt, Staphylococcus aureus subsp. aureus Mu50
acuuaccuuucaaauau

SEQ ID NO: 2043187 - RNA, 21 nt, Staphylococcus aureus subsp. aureus Mu50
acuuaucuguagauuagcuua

SEQ ID NO: 2043188 - RNA, 23 nt, Staphylococcus aureus subsp. aureus Mu50
acuuauuuuauacgaaucacagu

SEQ ID NO: 2043189 - RNA, 16 nt, Staphylococcus aureus subsp. aureus Mu50
acucacuucuuaaaau

SEQ ID NO: 2043190 - RNA, 16 nt, Staphylococcus aureus subsp. aureus Mu50
acucaaugauuguaau

SEQ ID NO: 2043191 - RNA, 13 nt, Staphylococcus aureus subsp. aureus Mu50
acuauuuuaaauu

SEQ ID NO: 2043192 - RNA, 16 nt, Staphylococcus aureus subsp. aureus Mu50
acucaaaauuaaagcu

SEQ ID NO: 2043193 - RNA, 14 nt, Staphylococcus aureus subsp. aureus Mu50
acucaaauauaaau

SEQ ID NO: 2043194 - RNA, 20 nt, Staphylococcus aureus subsp. aureus Mu50
acucggggaauuuuuaugca

SEQ ID NO: 2043195 - RNA, 20 nt, Staphylococcus aureus subsp. aureus Mu50
acugauaauacuguuuaaau

SEQ ID NO: 2043196 - RNA, 13 nt, Staphylococcus aureus subsp. aureus Mu50
acugauaauugau

SEQ ID NO: 2043197 - RNA, 16 nt, Staphylococcus aureus subsp. aureus Mu50
acugacuagccuucaa

SEQ ID NO: 2043198 - RNA, 19 nt, Staphylococcus aureus subsp. aureus Mu50
acugagaaaucuuaaagau

SEQ ID NO: 2043199 - RNA, 13 nt, Staphylococcus aureus subsp. aureus Mu50
acucuaaaaguug

SEQ ID NO: 2043200 - RNA, 14 nt, Staphylococcus aureus subsp. aureus Mu50
acucuaaaaguugu

SEQ ID NO: 2043201 - RNA, 16 nt, Staphylococcus aureus subsp. aureus Mu50
acucguuauucaauau

SEQ ID NO: 2043202 - RNA, 20 nt, Staphylococcus aureus subsp. aureus Mu50
acucguugaccuuguucuuu

SEQ ID NO: 2043203 - RNA, 15 nt, Staphylococcus aureus subsp. aureus Mu50
acucguaaucauagc

SEQ ID NO: 2043204 - RNA, 16 nt, Staphylococcus aureus subsp. aureus Mu50
acugcacaucauaaua

SEQ ID NO: 2043205 - RNA, 15 nt, Staphylococcus aureus subsp. aureus Mu50
acugcaccuccaacc

SEQ ID NO: 2043206 - RNA, 22 nt, Staphylococcus aureus subsp. aureus Mu50
acugccaaaaugguuaaaaucg

SEQ ID NO: 2043207 - RNA, 21 nt, Staphylococcus aureus subsp. aureus Mu50
acuggaucgcccauacuaaau

SEQ ID NO: 2043208 - RNA, 22 nt, Staphylococcus aureus subsp. aureus Mu50
acgucuuguaucaacauuaaua

SEQ ID NO: 2043209 - RNA, 17 nt, Staphylococcus aureus subsp. aureus Mu50
acguaauuaauagguua

SEQ ID NO: 2043210 - RNA, 16 nt, Staphylococcus aureus subsp. aureus Mu50
acguaaucuaauacau

SEQ ID NO: 2043211 - RNA, 16 nt, Staphylococcus aureus subsp. aureus Mu50
acguaaugaaucaauu

SEQ ID NO: 2043212 - RNA, 19 nt, Staphylococcus aureus subsp. aureus Mu50
acgucacuuuauuaaauaa

SEQ ID NO: 2043213 - RNA, 24 nt, Staphylococcus aureus subsp. aureus Mu50
acguugaguauuacuugaaaauag

SEQ ID NO: 2043214 - RNA, 17 nt, Staphylococcus aureus subsp. aureus Mu50
acuaauuuaaagcauca

SEQ ID NO: 2043215 - RNA, 22 nt, Staphylococcus aureus subsp. aureus Mu50
acuaaucguuguggcuuuuuau

SEQ ID NO: 2043216 - RNA, 20 nt, Staphylococcus aureus subsp. aureus Mu50
acuaauggcacuuaauauaa

SEQ ID NO: 2043217 - RNA, 15 nt, Staphylococcus aureus subsp. aureus Mu50
acuaagcuuucauua

SEQ ID NO: 2043218 - RNA, 13 nt, Staphylococcus aureus subsp. aureus Mu50
acuaauaauuugu

SEQ ID NO: 2043219 - RNA, 16 nt, Staphylococcus aureus subsp. aureus Mu50
acuaauaauuuguaau

SEQ ID NO: 2043220 - RNA, 16 nt, Staphylococcus aureus subsp. aureus Mu50
acuauucccacucaau

SEQ ID NO: 2043221 - RNA, 17 nt, Staphylococcus aureus subsp. aureus Mu50
acuauuaucuauccauu

SEQ ID NO: 2043222 - RNA, 17 nt, Staphylococcus aureus subsp. aureus Mu50
acuaugcauaauaccaa

SEQ ID NO: 2043223 - RNA, 14 nt, Staphylococcus aureus subsp. aureus Mu50
acuaccuuccauuu

SEQ ID NO: 2043224 - RNA, 23 nt, Staphylococcus aureus subsp. aureus Mu50
acuacauuauuacugauuguuaa

SEQ ID NO: 2043225 - RNA, 20 nt, Staphylococcus aureus subsp. aureus Mu50
acuaauuuagacaucauugu

SEQ ID NO: 2043226 - RNA, 22 nt, Staphylococcus aureus subsp. aureus Mu50
acuaauuuagacaucauuguuu

SEQ ID NO: 2043227 - RNA, 14 nt, Staphylococcus aureus subsp. aureus Mu50
acuaccuauuaaua

SEQ ID NO: 2043228 - RNA, 16 nt, Staphylococcus aureus subsp. aureus Mu50
acguuaguauaaacgu

SEQ ID NO: 2043229 - RNA, 15 nt, Staphylococcus aureus subsp. aureus Mu50
acguggucuacuucg

SEQ ID NO: 2043230 - RNA, 19 nt, Staphylococcus aureus subsp. aureus Mu50
acggcaaauucaacuuuaa

SEQ ID NO: 2043231 - RNA, 16 nt, Staphylococcus aureus subsp. aureus Mu50
acgguuguauuucauc

SEQ ID NO: 2043232 - RNA, 22 nt, Staphylococcus aureus subsp. aureus Mu50
acgaagcgggccucaucgaguu

SEQ ID NO: 2043233 - RNA, 17 nt, Staphylococcus aureus subsp. aureus Mu50
acgagugcuuucaccuu

SEQ ID NO: 2043234 - RNA, 12 nt, Staphylococcus aureus subsp. aureus Mu50
acgauaacaauu

SEQ ID NO: 2043235 - RNA, 16 nt, Staphylococcus aureus subsp. aureus Mu50
acgauaacuacacuua

SEQ ID NO: 2043236 - RNA, 22 nt, Staphylococcus aureus subsp. aureus Mu50
acgauaacuacacuuaauauau

SEQ ID NO: 2043237 - RNA, 23 nt, Staphylococcus aureus subsp. aureus Mu50
acgauacaucguguugcucgccu

SEQ ID NO: 2043238 - RNA, 20 nt, Staphylococcus aureus subsp. aureus Mu50
acgagaaaugucaguuuuga

SEQ ID NO: 2043239 - RNA, 16 nt, Staphylococcus aureus subsp. aureus Mu50
acgagaauuucguuau

SEQ ID NO: 2043240 - RNA, 15 nt, Staphylococcus aureus subsp. aureus Mu50
acgagcaacaucuuu

SEQ ID NO: 2043241 - RNA, 14 nt, Staphylococcus aureus subsp. aureus Mu50
accguuuuuauaua

SEQ ID NO: 2043242 - RNA, 20 nt, Staphylococcus aureus subsp. aureus Mu50
accuucugauacuucaucug

SEQ ID NO: 2043243 - RNA, 22 nt, Staphylococcus aureus subsp. aureus Mu50
accuucgucgcuaagaaccuuu

SEQ ID NO: 2043244 - RNA, 14 nt, Staphylococcus aureus subsp. aureus Mu50
accuaauaacgcau

SEQ ID NO: 2043245 - RNA, 18 nt, Staphylococcus aureus subsp. aureus Mu50
accuugauuuaauuuuua

SEQ ID NO: 2043246 - RNA, 20 nt, Staphylococcus aureus subsp. aureus Mu50
acgaaaauucgcuuguaaca

SEQ ID NO: 2043247 - RNA, 19 nt, Staphylococcus aureus subsp. aureus Mu50
acgaaacacacuaaaagcu

SEQ ID NO: 2043248 - RNA, 15 nt, Staphylococcus aureus subsp. aureus Mu50
acgaaauaguucaaa

SEQ ID NO: 2043249 - RNA, 21 nt, Staphylococcus aureus subsp. aureus Mu50
acgcacuauuuuuauaaguau

SEQ ID NO: 2043250 - RNA, 19 nt, Staphylococcus aureus subsp. aureus Mu50
acgcauuuuaaauaaaaug

SEQ ID NO: 2043251 - RNA, 13 nt, Staphylococcus aureus subsp. aureus Mu50
acgaugaugauuu

SEQ ID NO: 2043252 - RNA, 22 nt, Staphylococcus aureus subsp. aureus Mu50
acgauagugguacuauuuuuga

SEQ ID NO: 2043253 - RNA, 20 nt, Staphylococcus aureus subsp. aureus Mu50
acgauuuucaaguaaugaua

SEQ ID NO: 2043254 - RNA, 16 nt, Staphylococcus aureus subsp. aureus Mu50
acgauuucuaguuuau

SEQ ID NO: 2043255 - RNA, 20 nt, Staphylococcus aureus subsp. aureus Mu50
acgauuuugucuuuuauauu

SEQ ID NO: 2043256 - RNA, 19 nt, Staphylococcus aureus subsp. aureus Mu50
acgauuuuuaaaaugcuuu

SEQ ID NO: 2043257 - RNA, 14 nt, Staphylococcus aureus subsp. aureus Mu50
acgcaaaacaauau

SEQ ID NO: 2043258 - RNA, 23 nt, Staphylococcus aureus subsp. aureus Mu50
acgcugaaauuuuuuagugaaaa

SEQ ID NO: 2043259 - RNA, 19 nt, Staphylococcus aureus subsp. aureus Mu50
acgcugguaauauuuuugu

SEQ ID NO: 2043260 - RNA, 12 nt, Staphylococcus aureus subsp. aureus Mu50
acggaaaugacu

SEQ ID NO: 2043261 - RNA, 21 nt, Staphylococcus aureus subsp. aureus Mu50
acgcuaauggaugaauauauu

SEQ ID NO: 2043262 - RNA, 21 nt, Staphylococcus aureus subsp. aureus Mu50
acgcuagcauaucuuuaucau

SEQ ID NO: 2043263 - RNA, 17 nt, Staphylococcus aureus subsp. aureus Mu50
acgcucaaucgcaucug

SEQ ID NO: 2043264 - RNA, 23 nt, Staphylococcus aureus subsp. aureus Mu50
acgccuggaaucgcguuuaacaa

SEQ ID NO: 2043265 - RNA, 16 nt, Staphylococcus aureus subsp. aureus Mu50
uuaauaaucaaaccac

SEQ ID NO: 2043266 - RNA, 14 nt, Staphylococcus aureus subsp. aureus Mu50
uuaauguaaucauu

SEQ ID NO: 2043267 - RNA, 21 nt, Staphylococcus aureus subsp. aureus Mu50
uuaauaaccuuuaaaacauca

SEQ ID NO: 2043268 - RNA, 12 nt, Staphylococcus aureus subsp. aureus Mu50
uuaauaaauaau

SEQ ID NO: 2043269 - RNA, 21 nt, Staphylococcus aureus subsp. aureus Mu50
uuaauaaauuguaugaauaau

SEQ ID NO: 2043270 - RNA, 20 nt, Staphylococcus aureus subsp. aureus Mu50
uuaauaacaaaauuaaauau

SEQ ID NO: 2043271 - RNA, 12 nt, Staphylococcus aureus subsp. aureus Mu50
uuaauuaucauu

SEQ ID NO: 2043272 - RNA, 14 nt, Staphylococcus aureus subsp. aureus Mu50
uuaaugucuucaua

SEQ ID NO: 2043273 - RNA, 15 nt, Staphylococcus aureus subsp. aureus Mu50
uuaauguuaaacaau

SEQ ID NO: 2043274 - RNA, 18 nt, Staphylococcus aureus subsp. aureus Mu50
uuaauuuuucuaaaugau

SEQ ID NO: 2043275 - RNA, 13 nt, Staphylococcus aureus subsp. aureus Mu50
uuacaauaaucac

SEQ ID NO: 2043276 - RNA, 19 nt, Staphylococcus aureus subsp. aureus Mu50
uuaauuuguuuuaaauacu

SEQ ID NO: 2043277 - RNA, 15 nt, Staphylococcus aureus subsp. aureus Mu50
uuaauuuuaccauca

SEQ ID NO: 2043278 - RNA, 14 nt, Staphylococcus aureus subsp. aureus Mu50
uuaauuucacuuua

SEQ ID NO: 2043279 - RNA, 15 nt, Staphylococcus aureus subsp. aureus Mu50
uuaauuuccaauauc

SEQ ID NO: 2043280 - RNA, 14 nt, Staphylococcus aureus subsp. aureus Mu50
uuaauuuucuuuuu

SEQ ID NO: 2043281 - RNA, 23 nt, Staphylococcus aureus subsp. aureus Mu50
uuaauuuugcaacauuaaauuau

SEQ ID NO: 2043282 - RNA, 13 nt, Staphylococcus aureus subsp. aureus Mu50
uuaauuuacaauu

SEQ ID NO: 2043283 - RNA, 18 nt, Staphylococcus aureus subsp. aureus Mu50
uuaauucgccuaaauggu

SEQ ID NO: 2043284 - RNA, 14 nt, Staphylococcus aureus subsp. aureus Mu50
uuaaggucauuuuu

SEQ ID NO: 2043285 - RNA, 20 nt, Staphylococcus aureus subsp. aureus Mu50
uuaaggaaagcuucauauuu

SEQ ID NO: 2043286 - RNA, 17 nt, Staphylococcus aureus subsp. aureus Mu50
uuaaguauuuaaauaac

SEQ ID NO: 2043287 - RNA, 18 nt, Staphylococcus aureus subsp. aureus Mu50
uuaagugcaauaacacca

SEQ ID NO: 2043288 - RNA, 20 nt, Staphylococcus aureus subsp. aureus Mu50
uuaagugcaauaacaccaau

SEQ ID NO: 2043289 - RNA, 18 nt, Staphylococcus aureus subsp. aureus Mu50
uuaagugucuauguugaa

SEQ ID NO: 2043290 - RNA, 16 nt, Staphylococcus aureus subsp. aureus Mu50
uuaauaaaaucaucuu

SEQ ID NO: 2043291 - RNA, 13 nt, Staphylococcus aureus subsp. aureus Mu50
uuaauaaaguaau

SEQ ID NO: 2043292 - RNA, 21 nt, Staphylococcus aureus subsp. aureus Mu50
uuaagaauaaucgaacauaaa

SEQ ID NO: 2043293 - RNA, 15 nt, Staphylococcus aureus subsp. aureus Mu50
uuaagaauacaugac

SEQ ID NO: 2043294 - RNA, 20 nt, Staphylococcus aureus subsp. aureus Mu50
uuaacuguacgauucaauuu

SEQ ID NO: 2043295 - RNA, 16 nt, Staphylococcus aureus subsp. aureus Mu50
uuaacuuccuaaaauu

SEQ ID NO: 2043296 - RNA, 15 nt, Staphylococcus aureus subsp. aureus Mu50
uuaacguuauucauu

SEQ ID NO: 2043297 - RNA, 18 nt, Staphylococcus aureus subsp. aureus Mu50
uuaacuauguuacuuaua

SEQ ID NO: 2043298 - RNA, 15 nt, Staphylococcus aureus subsp. aureus Mu50
uuaacugauaaaagg

SEQ ID NO: 2043299 - RNA, 20 nt, Staphylococcus aureus subsp. aureus Mu50
uuaacugguugauaaauaaa

SEQ ID NO: 2043300 - RNA, 23 nt, Staphylococcus aureus subsp. aureus Mu50
uuaacugguugauaaauaaacuc

SEQ ID NO: 2043301 - RNA, 15 nt, Staphylococcus aureus subsp. aureus Mu50
uguuucaacauuuca

SEQ ID NO: 2043302 - RNA, 18 nt, Staphylococcus aureus subsp. aureus Mu50
uguuuauuacauaauuua

SEQ ID NO: 2043303 - RNA, 12 nt, Staphylococcus aureus subsp. aureus Mu50
uguuucuaaauu

SEQ ID NO: 2043304 - RNA, 18 nt, Staphylococcus aureus subsp. aureus Mu50
uguuucuaaauucuuuuu

SEQ ID NO: 2043305 - RNA, 18 nt, Staphylococcus aureus subsp. aureus Mu50
uguuugaauggcaaauau

SEQ ID NO: 2043306 - RNA, 15 nt, Staphylococcus aureus subsp. aureus Mu50
uguuugcaacauauu

SEQ ID NO: 2043307 - RNA, 17 nt, Staphylococcus aureus subsp. aureus Mu50
uguuuggauaucuuugu

SEQ ID NO: 2043308 - RNA, 19 nt, Staphylococcus aureus subsp. aureus Mu50
uguuuguaaaucaaguguu

SEQ ID NO: 2043309 - RNA, 15 nt, Staphylococcus aureus subsp. aureus Mu50
uguuuuaaaauuauu

SEQ ID NO: 2043310 - RNA, 17 nt, Staphylococcus aureus subsp. aureus Mu50
uguuuuaaacuuauuaa

SEQ ID NO: 2043311 - RNA, 22 nt, Staphylococcus aureus subsp. aureus Mu50
uguuugacaaguugcugaauaa

SEQ ID NO: 2043312 - RNA, 15 nt, Staphylococcus aureus subsp. aureus Mu50
uguuuuaugauuuuc

SEQ ID NO: 2043313 - RNA, 19 nt, Staphylococcus aureus subsp. aureus Mu50
uguuuuauuaugaauuauu

SEQ ID NO: 2043314 - RNA, 17 nt, Staphylococcus aureus subsp. aureus Mu50
uuaacgucaacagcaua

SEQ ID NO: 2043315 - RNA, 18 nt, Staphylococcus aureus subsp. aureus Mu50
uuaacggcguauucaauu

SEQ ID NO: 2043316 - RNA, 16 nt, Staphylococcus aureus subsp. aureus Mu50
uuaacguuuugauguu

SEQ ID NO: 2043317 - RNA, 18 nt, Staphylococcus aureus subsp. aureus Mu50
uuaacggaaauacaauga

SEQ ID NO: 2043318 - RNA, 13 nt, Staphylococcus aureus subsp. aureus Mu50
uuaaaaugauugu

SEQ ID NO: 2043319 - RNA, 18 nt, Staphylococcus aureus subsp. aureus Mu50
uuaaaaucucauaauaau

SEQ ID NO: 2043320 - RNA, 21 nt, Staphylococcus aureus subsp. aureus Mu50
uuaaaaucugcuuuauuuuau

SEQ ID NO: 2043321 - RNA, 12 nt, Staphylococcus aureus subsp. aureus Mu50
uuaaaauacaaa

SEQ ID NO: 2043322 - RNA, 21 nt, Staphylococcus aureus subsp. aureus Mu50
uuaaaagugucugguucuuua

SEQ ID NO: 2043323 - RNA, 16 nt, Staphylococcus aureus subsp. aureus Mu50
uuaaaaaguaauuaau

SEQ ID NO: 2043324 - RNA, 13 nt, Staphylococcus aureus subsp. aureus Mu50
uuaaaaauucaua

SEQ ID NO: 2043325 - RNA, 22 nt, Staphylococcus aureus subsp. aureus Mu50
uuaaaaagcaguaaguugauuu

SEQ ID NO: 2043326 - RNA, 13 nt, Staphylococcus aureus subsp. aureus Mu50
uguuuuuauauua

SEQ ID NO: 2043327 - RNA, 22 nt, Staphylococcus aureus subsp. aureus Mu50
uguuuucaucaugcauaaucau

SEQ ID NO: 2043328 - RNA, 15 nt, Staphylococcus aureus subsp. aureus Mu50
uguuuucuaaaucua

SEQ ID NO: 2043329 - RNA, 14 nt, Staphylococcus aureus subsp. aureus Mu50
uguuuucaauaauu

SEQ ID NO: 2043330 - RNA, 18 nt, Staphylococcus aureus subsp. aureus Mu50
uguuuuuuuguuuggugu

SEQ ID NO: 2043331 - RNA, 19 nt, Staphylococcus aureus subsp. aureus Mu50
uuaaaaaaccugaaacaaa

SEQ ID NO: 2043332 - RNA, 16 nt, Staphylococcus aureus subsp. aureus Mu50
uguuuuucaucauuaa

SEQ ID NO: 2043333 - RNA, 16 nt, Staphylococcus aureus subsp. aureus Mu50
ugucgcuucuucuuca

SEQ ID NO: 2043334 - RNA, 17 nt, Staphylococcus aureus subsp. aureus Mu50
uguguuaauacuucaua

SEQ ID NO: 2043335 - RNA, 24 nt, Staphylococcus aureus subsp. aureus Mu50
ugugucauaauccauucuucuugu

SEQ ID NO: 2043336 - RNA, 19 nt, Staphylococcus aureus subsp. aureus Mu50
uguguaucaguuauuuuaa

SEQ ID NO: 2043337 - RNA, 13 nt, Staphylococcus aureus subsp. aureus Mu50
ugugguucauuag

SEQ ID NO: 2043338 - RNA, 15 nt, Staphylococcus aureus subsp. aureus Mu50
uguuaaacccucauu

SEQ ID NO: 2043339 - RNA, 18 nt, Staphylococcus aureus subsp. aureus Mu50
uguuaaacuagaaaacau

SEQ ID NO: 2043340 - RNA, 19 nt, Staphylococcus aureus subsp. aureus Mu50
uguuaaauuaaaucgauau

SEQ ID NO: 2043341 - RNA, 16 nt, Staphylococcus aureus subsp. aureus Mu50
uguuaaguagaugauu

SEQ ID NO: 2043342 - RNA, 14 nt, Staphylococcus aureus subsp. aureus Mu50
uguuaauaaaucau

SEQ ID NO: 2043343 - RNA, 15 nt, Staphylococcus aureus subsp. aureus Mu50
uguuaauaaaucauu

SEQ ID NO: 2043344 - RNA, 19 nt, Staphylococcus aureus subsp. aureus Mu50
uguuaauaaccgaaauauu

SEQ ID NO: 2043345 - RNA, 13 nt, Staphylococcus aureus subsp. aureus Mu50
uguuaaucaaaau

SEQ ID NO: 2043346 - RNA, 17 nt, Staphylococcus aureus subsp. aureus Mu50
uguuuaauaacaaaauu

SEQ ID NO: 2043347 - RNA, 19 nt, Staphylococcus aureus subsp. aureus Mu50
uguuuaauuuucuaaauau

SEQ ID NO: 2043348 - RNA, 21 nt, Staphylococcus aureus subsp. aureus Mu50
uguuuaauuuucuaaauauau

SEQ ID NO: 2043349 - RNA, 21 nt, Staphylococcus aureus subsp. aureus Mu50
uguuuaugagcuuaauaaauu

SEQ ID NO: 2043350 - RNA, 24 nt, Staphylococcus aureus subsp. aureus Mu50
uguuuaugagcuuaauaaauugua

SEQ ID NO: 2043351 - RNA, 19 nt, Staphylococcus aureus subsp. aureus Mu50
uguuguucuguaaugauau

SEQ ID NO: 2043352 - RNA, 16 nt, Staphylococcus aureus subsp. aureus Mu50
uguuuaggcuuauuaa

SEQ ID NO: 2043353 - RNA, 12 nt, Staphylococcus aureus subsp. aureus Mu50
uguuuauaucuu

SEQ ID NO: 2043354 - RNA, 21 nt, Staphylococcus aureus subsp. aureus Mu50
uguuuauauugcaaaaauaau

SEQ ID NO: 2043355 - RNA, 16 nt, Staphylococcus aureus subsp. aureus Mu50
uguuguuauuuauuug

SEQ ID NO: 2043356 - RNA, 12 nt, Staphylococcus aureus subsp. aureus Mu50
uguugugaauaa

SEQ ID NO: 2043357 - RNA, 20 nt, Staphylococcus aureus subsp. aureus Mu50
uguugguguuuagucuuuuu

SEQ ID NO: 2043358 - RNA, 20 nt, Staphylococcus aureus subsp. aureus Mu50
uguuguaagguggacuucua

SEQ ID NO: 2043359 - RNA, 22 nt, Staphylococcus aureus subsp. aureus Mu50
uguuggucuaucgccuaaaaau

SEQ ID NO: 2043360 - RNA, 17 nt, Staphylococcus aureus subsp. aureus Mu50
uguugguauuuuuuuau

SEQ ID NO: 2043361 - RNA, 15 nt, Staphylococcus aureus subsp. aureus Mu50
uguucccauuuuuaa

SEQ ID NO: 2043362 - RNA, 13 nt, Staphylococcus aureus subsp. aureus Mu50
uguucauaauaua

SEQ ID NO: 2043363 - RNA, 15 nt, Staphylococcus aureus subsp. aureus Mu50
uguucauaaucauaa

SEQ ID NO: 2043364 - RNA, 16 nt, Staphylococcus aureus subsp. aureus Mu50
uuacuguaguacuaua

SEQ ID NO: 2043365 - RNA, 13 nt, Staphylococcus aureus subsp. aureus Mu50
uuacuucaguuug

SEQ ID NO: 2043366 - RNA, 12 nt, Staphylococcus aureus subsp. aureus Mu50
uuacuugcacac

SEQ ID NO: 2043367 - RNA, 15 nt, Staphylococcus aureus subsp. aureus Mu50
uuauaaguuaaaaau

SEQ ID NO: 2043368 - RNA, 17 nt, Staphylococcus aureus subsp. aureus Mu50
uuauaaugaacaacaaa

SEQ ID NO: 2043369 - RNA, 16 nt, Staphylococcus aureus subsp. aureus Mu50
uuauauauucaauaau

SEQ ID NO: 2043370 - RNA, 13 nt, Staphylococcus aureus subsp. aureus Mu50
uuauaucaucaac

SEQ ID NO: 2043371 - RNA, 22 nt, Staphylococcus aureus subsp. aureus Mu50
uuauaucauucuguguaaauau

SEQ ID NO: 2043372 - RNA, 17 nt, Staphylococcus aureus subsp. aureus Mu50
uuauaugaugaauuguu

SEQ ID NO: 2043373 - RNA, 16 nt, Staphylococcus aureus subsp. aureus Mu50
uuauaugcaacuuaua

SEQ ID NO: 2043374 - RNA, 19 nt, Staphylococcus aureus subsp. aureus Mu50
uuauauauaaagaaauaau

SEQ ID NO: 2043375 - RNA, 17 nt, Staphylococcus aureus subsp. aureus Mu50
uuauauaucacauauua

SEQ ID NO: 2043376 - RNA, 14 nt, Staphylococcus aureus subsp. aureus Mu50
uuauacgaaucaca

SEQ ID NO: 2043377 - RNA, 16 nt, Staphylococcus aureus subsp. aureus Mu50
uuauacucugaaaagc

SEQ ID NO: 2043378 - RNA, 22 nt, Staphylococcus aureus subsp. aureus Mu50
uuauagcagguggcauccauau

SEQ ID NO: 2043379 - RNA, 17 nt, Staphylococcus aureus subsp. aureus Mu50
uuauagugguaaaaagu

SEQ ID NO: 2043380 - RNA, 14 nt, Staphylococcus aureus subsp. aureus Mu50
uuaccguuuauuuc

SEQ ID NO: 2043381 - RNA, 14 nt, Staphylococcus aureus subsp. aureus Mu50
uuaccucugauaaa

SEQ ID NO: 2043382 - RNA, 17 nt, Staphylococcus aureus subsp. aureus Mu50
uuaccucugauaaauga

SEQ ID NO: 2043383 - RNA, 22 nt, Staphylococcus aureus subsp. aureus Mu50
uuaccuuugucuuuuuuaucau

SEQ ID NO: 2043384 - RNA, 15 nt, Staphylococcus aureus subsp. aureus Mu50
uuaccuuuuaaggca

SEQ ID NO: 2043385 - RNA, 13 nt, Staphylococcus aureus subsp. aureus Mu50
uuacuccuuacaa

SEQ ID NO: 2043386 - RNA, 21 nt, Staphylococcus aureus subsp. aureus Mu50
uuacucaaaccaucuuaucuu

SEQ ID NO: 2043387 - RNA, 15 nt, Staphylococcus aureus subsp. aureus Mu50
uuacgaaaguagaau

SEQ ID NO: 2043388 - RNA, 16 nt, Staphylococcus aureus subsp. aureus Mu50
uuacugcaauuauuuu

SEQ ID NO: 2043389 - RNA, 18 nt, Staphylococcus aureus subsp. aureus Mu50
uuaucuaaugaucaucua

SEQ ID NO: 2043390 - RNA, 14 nt, Staphylococcus aureus subsp. aureus Mu50
uuauauucaacuua

SEQ ID NO: 2043391 - RNA, 19 nt, Staphylococcus aureus subsp. aureus Mu50
uuauauugagacaacauug

SEQ ID NO: 2043392 - RNA, 16 nt, Staphylococcus aureus subsp. aureus Mu50
uuaucguaauuguuaa

SEQ ID NO: 2043393 - RNA, 21 nt, Staphylococcus aureus subsp. aureus Mu50
uuaucuugcuuauugauauaa

SEQ ID NO: 2043394 - RNA, 16 nt, Staphylococcus aureus subsp. aureus Mu50
uuaugauaauuaauua

SEQ ID NO: 2043395 - RNA, 23 nt, Staphylococcus aureus subsp. aureus Mu50
uuaugagacccaccguuaaaaua

SEQ ID NO: 2043396 - RNA, 23 nt, Staphylococcus aureus subsp. aureus Mu50
uuaucuuuuaaaaucguugcaga

SEQ ID NO: 2043397 - RNA, 19 nt, Staphylococcus aureus subsp. aureus Mu50
uuaugacaacauaacaaag

SEQ ID NO: 2043398 - RNA, 13 nt, Staphylococcus aureus subsp. aureus Mu50
uuaugcuuuaaau

SEQ ID NO: 2043399 - RNA, 22 nt, Staphylococcus aureus subsp. aureus Mu50
uuaugcaaaauuaaugaacgaa

SEQ ID NO: 2043400 - RNA, 23 nt, Staphylococcus aureus subsp. aureus Mu50
uuaugucuuaggcgcuacaaugu

SEQ ID NO: 2043401 - RNA, 17 nt, Staphylococcus aureus subsp. aureus Mu50
uuauguagcuuugugua

SEQ ID NO: 2043402 - RNA, 15 nt, Staphylococcus aureus subsp. aureus Mu50
uuauguacuacauac

SEQ ID NO: 2043403 - RNA, 22 nt, Staphylococcus aureus subsp. aureus Mu50
uuaugggggauuuuuuuauguu

SEQ ID NO: 2043404 - RNA, 13 nt, Staphylococcus aureus subsp. aureus Mu50
uuauguaaauaac

SEQ ID NO: 2043405 - RNA, 22 nt, Staphylococcus aureus subsp. aureus Mu50
uuauguaaauaacaguuaauua

SEQ ID NO: 2043406 - RNA, 20 nt, Staphylococcus aureus subsp. aureus Mu50
uuauguguuguguaucaguu

SEQ ID NO: 2043407 - RNA, 14 nt, Staphylococcus aureus subsp. aureus Mu50
uuauguuauaaauu

SEQ ID NO: 2043408 - RNA, 21 nt, Staphylococcus aureus subsp. aureus Mu50
uuauuaaaauuaaauaaugau

SEQ ID NO: 2043409 - RNA, 21 nt, Staphylococcus aureus subsp. aureus Mu50
uuauuaagccaucccaacuua

SEQ ID NO: 2043410 - RNA, 18 nt, Staphylococcus aureus subsp. aureus Mu50
uuauuaggauucaauaau

SEQ ID NO: 2043411 - RNA, 11 nt, Staphylococcus aureus subsp. aureus Mu50
uuauuaucauu

SEQ ID NO: 2043412 - RNA, 14 nt, Staphylococcus aureus subsp. aureus Mu50
uuauuauuaaauua

SEQ ID NO: 2043413 - RNA, 18 nt, Staphylococcus aureus subsp. aureus Mu50
uuauugaguaucaugcuu

SEQ ID NO: 2043414 - RNA, 19 nt, Staphylococcus aureus subsp. aureus Mu50
uuauugaguaucaugcuuu

SEQ ID NO: 2043415 - RNA, 14 nt, Staphylococcus aureus subsp. aureus Mu50
uucaccauuuacuu

SEQ ID NO: 2043416 - RNA, 20 nt, Staphylococcus aureus subsp. aureus Mu50
uucaauuaauuuaaaugcuu

SEQ ID NO: 2043417 - RNA, 16 nt, Staphylococcus aureus subsp. aureus Mu50
uucaaucuaaucuuaa

SEQ ID NO: 2043418 - RNA, 14 nt, Staphylococcus aureus subsp. aureus Mu50
uucaaugauuuuau

SEQ ID NO: 2043419 - RNA, 18 nt, Staphylococcus aureus subsp. aureus Mu50
uucaaugauuuuuaaaaa

SEQ ID NO: 2043420 - RNA, 13 nt, Staphylococcus aureus subsp. aureus Mu50
uucaauauuugaa

SEQ ID NO: 2043421 - RNA, 16 nt, Staphylococcus aureus subsp. aureus Mu50
uucaaucgucacauca

SEQ ID NO: 2043422 - RNA, 16 nt, Staphylococcus aureus subsp. aureus Mu50
uuauuucaauaauaau

SEQ ID NO: 2043423 - RNA, 19 nt, Staphylococcus aureus subsp. aureus Mu50
uuauuucauuagaaaaggc

SEQ ID NO: 2043424 - RNA, 16 nt, Staphylococcus aureus subsp. aureus Mu50
uuauuugauaaauaaa

SEQ ID NO: 2043425 - RNA, 14 nt, Staphylococcus aureus subsp. aureus Mu50
uuauuuagaauucu

SEQ ID NO: 2043426 - RNA, 16 nt, Staphylococcus aureus subsp. aureus Mu50
uuauuuagauaaaaau

SEQ ID NO: 2043427 - RNA, 20 nt, Staphylococcus aureus subsp. aureus Mu50
uuauuuauaacuuuaaaaau

SEQ ID NO: 2043428 - RNA, 23 nt, Staphylococcus aureus subsp. aureus Mu50
uuauugggagcaaucaauacaau

SEQ ID NO: 2043429 - RNA, 18 nt, Staphylococcus aureus subsp. aureus Mu50
uuauucuuaauuuaagua

SEQ ID NO: 2043430 - RNA, 14 nt, Staphylococcus aureus subsp. aureus Mu50
uuauugucaucaug

SEQ ID NO: 2043431 - RNA, 16 nt, Staphylococcus aureus subsp. aureus Mu50
uuauuguuuuaaugua

SEQ ID NO: 2043432 - RNA, 12 nt, Staphylococcus aureus subsp. aureus Mu50
uuauuuaaauuu

SEQ ID NO: 2043433 - RNA, 12 nt, Staphylococcus aureus subsp. aureus Mu50
uucaaagcgaua

SEQ ID NO: 2043434 - RNA, 17 nt, Staphylococcus aureus subsp. aureus Mu50
uucaaacgugauuuuau

SEQ ID NO: 2043435 - RNA, 12 nt, Staphylococcus aureus subsp. aureus Mu50
uuauuucuuuuc

SEQ ID NO: 2043436 - RNA, 18 nt, Staphylococcus aureus subsp. aureus Mu50
uucaaaaaauauuuacau

SEQ ID NO: 2043437 - RNA, 16 nt, Staphylococcus aureus subsp. aureus Mu50
uuauuuuaacuuaauu

SEQ ID NO: 2043438 - RNA, 13 nt, Staphylococcus aureus subsp. aureus Mu50
uuauuuugauuaa

SEQ ID NO: 2043439 - RNA, 14 nt, Staphylococcus aureus subsp. aureus Mu50
uucaaaaucuuuau

SEQ ID NO: 2043440 - RNA, 19 nt, Staphylococcus aureus subsp. aureus Mu50
uucaacgucgaauguuucu

SEQ ID NO: 2043441 - RNA, 21 nt, Staphylococcus aureus subsp. aureus Mu50
uucaaccauaugacuuuuuau

SEQ ID NO: 2043442 - RNA, 21 nt, Staphylococcus aureus subsp. aureus Mu50
uucaagcguuucuugaucuaa

SEQ ID NO: 2043443 - RNA, 14 nt, Staphylococcus aureus subsp. aureus Mu50
uucaagaaugugaa

SEQ ID NO: 2043444 - RNA, 14 nt, Staphylococcus aureus subsp. aureus Mu50
uucaacuuuaauca

SEQ ID NO: 2043445 - RNA, 13 nt, Staphylococcus aureus subsp. aureus Mu50
uucaaauuuacca

SEQ ID NO: 2043446 - RNA, 18 nt, Staphylococcus aureus subsp. aureus Mu50
uucaaaguagauauugaa

SEQ ID NO: 2043447 - RNA, 15 nt, Staphylococcus aureus subsp. aureus Mu50
uucaaauguaacauu

SEQ ID NO: 2043448 - RNA, 21 nt, Staphylococcus aureus subsp. aureus Mu50
uucaaauguugacuacucaau

SEQ ID NO: 2043449 - RNA, 21 nt, Staphylococcus aureus subsp. aureus Mu50
uucaaaucuggcacuuaagcu

SEQ ID NO: 2043450 - RNA, 21 nt, Staphylococcus aureus subsp. aureus Mu50
uucaaauaaugugaaaaaucu

SEQ ID NO: 2043451 - RNA, 20 nt, Staphylococcus aureus subsp. aureus Mu50
uucaacauauuauauauauu

SEQ ID NO: 2043452 - RNA, 16 nt, Staphylococcus aureus subsp. aureus Mu50
uucaacauauaaauca

SEQ ID NO: 2043453 - RNA, 20 nt, Staphylococcus aureus subsp. aureus Mu50
uugaauuugaauaagugguu

SEQ ID NO: 2043454 - RNA, 19 nt, Staphylococcus aureus subsp. aureus Mu50
uugaaguuacuauauuuau

SEQ ID NO: 2043455 - RNA, 17 nt, Staphylococcus aureus subsp. aureus Mu50
uugaaucggugucuuua

SEQ ID NO: 2043456 - RNA, 15 nt, Staphylococcus aureus subsp. aureus Mu50
uugaaggaaaauaaa

SEQ ID NO: 2043457 - RNA, 12 nt, Staphylococcus aureus subsp. aureus Mu50
uugaacuuuuau

SEQ ID NO: 2043458 - RNA, 22 nt, Staphylococcus aureus subsp. aureus Mu50
uugaauaacacuagaaaguugu

SEQ ID NO: 2043459 - RNA, 19 nt, Staphylococcus aureus subsp. aureus Mu50
uugaauaauuaauguuucu

SEQ ID NO: 2043460 - RNA, 18 nt, Staphylococcus aureus subsp. aureus Mu50
uugaaguacauuaaaaca

SEQ ID NO: 2043461 - RNA, 18 nt, Staphylococcus aureus subsp. aureus Mu50
uugaagaagguaauaaag

SEQ ID NO: 2043462 - RNA, 20 nt, Staphylococcus aureus subsp. aureus Mu50
uugacgaguagauucguacc

SEQ ID NO: 2043463 - RNA, 14 nt, Staphylococcus aureus subsp. aureus Mu50
uugacgauuuaauu

SEQ ID NO: 2043464 - RNA, 23 nt, Staphylococcus aureus subsp. aureus Mu50
uugaccaccacuuucaguaauug

SEQ ID NO: 2043465 - RNA, 19 nt, Staphylococcus aureus subsp. aureus Mu50
uugauacguaaacacuuua

SEQ ID NO: 2043466 - RNA, 20 nt, Staphylococcus aureus subsp. aureus Mu50
uugauagcaccguaacauau

SEQ ID NO: 2043467 - RNA, 21 nt, Staphylococcus aureus subsp. aureus Mu50
uugauaaaugcgguugauggu

SEQ ID NO: 2043468 - RNA, 23 nt, Staphylococcus aureus subsp. aureus Mu50
uugauaucuacagagaaucaauu

SEQ ID NO: 2043469 - RNA, 19 nt, Staphylococcus aureus subsp. aureus Mu50
uugauauggcguauucacc

SEQ ID NO: 2043470 - RNA, 22 nt, Staphylococcus aureus subsp. aureus Mu50
uugagaauauuaagauguauau

SEQ ID NO: 2043471 - RNA, 18 nt, Staphylococcus aureus subsp. aureus Mu50
uugagcaucacucaacau

SEQ ID NO: 2043472 - RNA, 15 nt, Staphylococcus aureus subsp. aureus Mu50
uugagcguuuaauua

SEQ ID NO: 2043473 - RNA, 19 nt, Staphylococcus aureus subsp. aureus Mu50
uugacucaaagauauacuu

SEQ ID NO: 2043474 - RNA, 22 nt, Staphylococcus aureus subsp. aureus Mu50
uugagaaccacuauaauuucuu

SEQ ID NO: 2043475 - RNA, 14 nt, Staphylococcus aureus subsp. aureus Mu50
uugacuuuaucaau

SEQ ID NO: 2043476 - RNA, 16 nt, Staphylococcus aureus subsp. aureus Mu50
uugacuuuaucaauug

SEQ ID NO: 2043477 - RNA, 13 nt, Staphylococcus aureus subsp. aureus Mu50
uucuagcuuuagu

SEQ ID NO: 2043478 - RNA, 22 nt, Staphylococcus aureus subsp. aureus Mu50
uucguaauuuaugauuguuuau

SEQ ID NO: 2043479 - RNA, 17 nt, Staphylococcus aureus subsp. aureus Mu50
uucuauaauucacuuua

SEQ ID NO: 2043480 - RNA, 17 nt, Staphylococcus aureus subsp. aureus Mu50
uucuaugcucuacaaag

SEQ ID NO: 2043481 - RNA, 21 nt, Staphylococcus aureus subsp. aureus Mu50
uucuagucaggggccccaaca

SEQ ID NO: 2043482 - RNA, 15 nt, Staphylococcus aureus subsp. aureus Mu50
uucuauaauaaaucg

SEQ ID NO: 2043483 - RNA, 13 nt, Staphylococcus aureus subsp. aureus Mu50
uucuauuugauaa

SEQ ID NO: 2043484 - RNA, 20 nt, Staphylococcus aureus subsp. aureus Mu50
uucuauuaaacuuccuuuuu

SEQ ID NO: 2043485 - RNA, 21 nt, Staphylococcus aureus subsp. aureus Mu50
uucuauuaauaauuugguuaa

SEQ ID NO: 2043486 - RNA, 20 nt, Staphylococcus aureus subsp. aureus Mu50
uucucuuaaauaugaauaau

SEQ ID NO: 2043487 - RNA, 14 nt, Staphylococcus aureus subsp. aureus Mu50
uucuuguucuaaaa

SEQ ID NO: 2043488 - RNA, 22 nt, Staphylococcus aureus subsp. aureus Mu50
uucuuggucugcuguaucauca

SEQ ID NO: 2043489 - RNA, 12 nt, Staphylococcus aureus subsp. aureus Mu50
uucuuuaaauua

SEQ ID NO: 2043490 - RNA, 18 nt, Staphylococcus aureus subsp. aureus Mu50
uugaaacgguaucaacau

SEQ ID NO: 2043491 - RNA, 19 nt, Staphylococcus aureus subsp. aureus Mu50
uugaaacaucuugauauuc

SEQ ID NO: 2043492 - RNA, 13 nt, Staphylococcus aureus subsp. aureus Mu50
uugaaauguuuaa

SEQ ID NO: 2043493 - RNA, 13 nt, Staphylococcus aureus subsp. aureus Mu50
uugaaauguuuau

SEQ ID NO: 2043494 - RNA, 12 nt, Staphylococcus aureus subsp. aureus Mu50
uucuuucuuuuu

SEQ ID NO: 2043495 - RNA, 18 nt, Staphylococcus aureus subsp. aureus Mu50
uucuuucuuuuuuauuaa

SEQ ID NO: 2043496 - RNA, 12 nt, Staphylococcus aureus subsp. aureus Mu50
uucuuugauuag

SEQ ID NO: 2043497 - RNA, 16 nt, Staphylococcus aureus subsp. aureus Mu50
uucuuuuguaaauggu

SEQ ID NO: 2043498 - RNA, 14 nt, Staphylococcus aureus subsp. aureus Mu50
uucauaaaauuuaa

SEQ ID NO: 2043499 - RNA, 13 nt, Staphylococcus aureus subsp. aureus Mu50
uucauaaacugaa

SEQ ID NO: 2043500 - RNA, 16 nt, Staphylococcus aureus subsp. aureus Mu50
uucauagucacuuuua

SEQ ID NO: 2043501 - RNA, 17 nt, Staphylococcus aureus subsp. aureus Mu50
uucauagugguguuuau

SEQ ID NO: 2043502 - RNA, 20 nt, Staphylococcus aureus subsp. aureus Mu50
uucauaguuaucgauuuuau

SEQ ID NO: 2043503 - RNA, 14 nt, Staphylococcus aureus subsp. aureus Mu50
uucauaaucauaau

SEQ ID NO: 2043504 - RNA, 14 nt, Staphylococcus aureus subsp. aureus Mu50
uucauaaaguuuau

SEQ ID NO: 2043505 - RNA, 15 nt, Staphylococcus aureus subsp. aureus Mu50
uucgauuguaauaac

SEQ ID NO: 2043506 - RNA, 19 nt, Staphylococcus aureus subsp. aureus Mu50
uucgaguaugguugauuac

SEQ ID NO: 2043507 - RNA, 14 nt, Staphylococcus aureus subsp. aureus Mu50
uucgauaugauuaa

SEQ ID NO: 2043508 - RNA, 21 nt, Staphylococcus aureus subsp. aureus Mu50
uuuaugauucuaacggcguuu

SEQ ID NO: 2043509 - RNA, 22 nt, Staphylococcus aureus subsp. aureus Mu50
uuuaugagcuuaauaaauugua

SEQ ID NO: 2043510 - RNA, 14 nt, Staphylococcus aureus subsp. aureus Mu50
uuuauuaaagaaac

SEQ ID NO: 2043511 - RNA, 14 nt, Staphylococcus aureus subsp. aureus Mu50
uuuauggauuucuu

SEQ ID NO: 2043512 - RNA, 13 nt, Staphylococcus aureus subsp. aureus Mu50
uuuaugucccaau

SEQ ID NO: 2043513 - RNA, 14 nt, Staphylococcus aureus subsp. aureus Mu50
uuuauguuauuguu

SEQ ID NO: 2043514 - RNA, 18 nt, Staphylococcus aureus subsp. aureus Mu50
uuuauguuugauuuuauu

SEQ ID NO: 2043515 - RNA, 18 nt, Staphylococcus aureus subsp. aureus Mu50
uuuaguucacaugaauuu

SEQ ID NO: 2043516 - RNA, 23 nt, Staphylococcus aureus subsp. aureus Mu50
uuuauaaagauagaaugaauaau

SEQ ID NO: 2043517 - RNA, 12 nt, Staphylococcus aureus subsp. aureus Mu50
uuuauaauaauc

SEQ ID NO: 2043518 - RNA, 15 nt, Staphylococcus aureus subsp. aureus Mu50
uuuauacauaaauau

SEQ ID NO: 2043519 - RNA, 12 nt, Staphylococcus aureus subsp. aureus Mu50
uuuauaaauuuc

SEQ ID NO: 2043520 - RNA, 12 nt, Staphylococcus aureus subsp. aureus Mu50
uuuauaaauuuu

SEQ ID NO: 2043521 - RNA, 15 nt, Staphylococcus aureus subsp. aureus Mu50
uuuaucaacauaaaa

SEQ ID NO: 2043522 - RNA, 16 nt, Staphylococcus aureus subsp. aureus Mu50
uuuauagaaaauuaac

SEQ ID NO: 2043523 - RNA, 17 nt, Staphylococcus aureus subsp. aureus Mu50
uuuauaggucaacugua

SEQ ID NO: 2043524 - RNA, 23 nt, Staphylococcus aureus subsp. aureus Mu50
uuuauaucuuaaguacauaaaug

SEQ ID NO: 2043525 - RNA, 16 nt, Staphylococcus aureus subsp. aureus Mu50
uuuaucaauuucuauu

SEQ ID NO: 2043526 - RNA, 17 nt, Staphylococcus aureus subsp. aureus Mu50
uuuaucaauuucucuuu

SEQ ID NO: 2043527 - RNA, 21 nt, Staphylococcus aureus subsp. aureus Mu50
uuuaucagcgaaauuuguaaa

SEQ ID NO: 2043528 - RNA, 12 nt, Staphylococcus aureus subsp. aureus Mu50
uuuaucauuauu

SEQ ID NO: 2043529 - RNA, 13 nt, Staphylococcus aureus subsp. aureus Mu50
uuuaucauuauuc

SEQ ID NO: 2043530 - RNA, 13 nt, Staphylococcus aureus subsp. aureus Mu50
uuucaauucuagu

SEQ ID NO: 2043531 - RNA, 14 nt, Staphylococcus aureus subsp. aureus Mu50
uuucacgauuucuu

SEQ ID NO: 2043532 - RNA, 20 nt, Staphylococcus aureus subsp. aureus Mu50
uuucacgcugaaauuuuuua

SEQ ID NO: 2043533 - RNA, 14 nt, Staphylococcus aureus subsp. aureus Mu50
uuuauucacuuuuu

SEQ ID NO: 2043534 - RNA, 11 nt, Staphylococcus aureus subsp. aureus Mu50
uuuauuauuag

SEQ ID NO: 2043535 - RNA, 13 nt, Staphylococcus aureus subsp. aureus Mu50
uuuauuaaauaac

SEQ ID NO: 2043536 - RNA, 21 nt, Staphylococcus aureus subsp. aureus Mu50
uuuauuuucuuuuucuaaaua

SEQ ID NO: 2043537 - RNA, 18 nt, Staphylococcus aureus subsp. aureus Mu50
uuucaaauaauauaaaac

SEQ ID NO: 2043538 - RNA, 18 nt, Staphylococcus aureus subsp. aureus Mu50
uuuauuuucauauaaaua

SEQ ID NO: 2043539 - RNA, 21 nt, Staphylococcus aureus subsp. aureus Mu50
uuucauaugcaucaacagaua

SEQ ID NO: 2043540 - RNA, 16 nt, Staphylococcus aureus subsp. aureus Mu50
uuucauguucauaaua

SEQ ID NO: 2043541 - RNA, 15 nt, Staphylococcus aureus subsp. aureus Mu50
uuucaugauuuacua

SEQ ID NO: 2043542 - RNA, 18 nt, Staphylococcus aureus subsp. aureus Mu50
uuucauaaaguuuauuua

SEQ ID NO: 2043543 - RNA, 17 nt, Staphylococcus aureus subsp. aureus Mu50
uuucauaccuugauuau

SEQ ID NO: 2043544 - RNA, 17 nt, Staphylococcus aureus subsp. aureus Mu50
uuucauauaaauagcuu

SEQ ID NO: 2043545 - RNA, 13 nt, Staphylococcus aureus subsp. aureus Mu50
uuucagaaugaac

SEQ ID NO: 2043546 - RNA, 14 nt, Staphylococcus aureus subsp. aureus Mu50
uuucgauucauuua

SEQ ID NO: 2043547 - RNA, 17 nt, Staphylococcus aureus subsp. aureus Mu50
uuucgaacgcuugaaaa

SEQ ID NO: 2043548 - RNA, 18 nt, Staphylococcus aureus subsp. aureus Mu50
uuucgaacgcuugaaaaa

SEQ ID NO: 2043549 - RNA, 20 nt, Staphylococcus aureus subsp. aureus Mu50
uuucgaaaagaaauucuaca

SEQ ID NO: 2043550 - RNA, 22 nt, Staphylococcus aureus subsp. aureus Mu50
uuuacgaaaguagaauuauuua

SEQ ID NO: 2043551 - RNA, 12 nt, Staphylococcus aureus subsp. aureus Mu50
uuuaauauuaua

SEQ ID NO: 2043552 - RNA, 16 nt, Staphylococcus aureus subsp. aureus Mu50
uuuaauguaauuauuu

SEQ ID NO: 2043553 - RNA, 15 nt, Staphylococcus aureus subsp. aureus Mu50
uuuacuaaaugaauu

SEQ ID NO: 2043554 - RNA, 23 nt, Staphylococcus aureus subsp. aureus Mu50
uuuacuagaaagcacaccuaauu

SEQ ID NO: 2043555 - RNA, 18 nt, Staphylococcus aureus subsp. aureus Mu50
uuuacucaaaccaucuua

SEQ ID NO: 2043556 - RNA, 11 nt, Staphylococcus aureus subsp. aureus Mu50
uuuacuuaauc

SEQ ID NO: 2043557 - RNA, 22 nt, Staphylococcus aureus subsp. aureus Mu50
uuuaagcuaucuaaaccuuuuu

SEQ ID NO: 2043558 - RNA, 14 nt, Staphylococcus aureus subsp. aureus Mu50
uuuaagaucaauau

SEQ ID NO: 2043559 - RNA, 18 nt, Staphylococcus aureus subsp. aureus Mu50
uuuaagcuuaucaacgau

SEQ ID NO: 2043560 - RNA, 16 nt, Staphylococcus aureus subsp. aureus Mu50
uuuaaucguaacauau

SEQ ID NO: 2043561 - RNA, 13 nt, Staphylococcus aureus subsp. aureus Mu50
uuuaauaauugua

SEQ ID NO: 2043562 - RNA, 13 nt, Staphylococcus aureus subsp. aureus Mu50
uuuaauaaucaaa

SEQ ID NO: 2043563 - RNA, 14 nt, Staphylococcus aureus subsp. aureus Mu50
uuuaggcaaauaac

SEQ ID NO: 2043564 - RNA, 21 nt, Staphylococcus aureus subsp. aureus Mu50
uuuaguauuucaucauuaguu

SEQ ID NO: 2043565 - RNA, 21 nt, Staphylococcus aureus subsp. aureus Mu50
uuuagguaauacaucaucaag

SEQ ID NO: 2043566 - RNA, 23 nt, Staphylococcus aureus subsp. aureus Mu50
uuuagugaaaaaguuucggaaaa

SEQ ID NO: 2043567 - RNA, 22 nt, Staphylococcus aureus subsp. aureus Mu50
uuuaggaaugaauaaagcuaac

SEQ ID NO: 2043568 - RNA, 17 nt, Staphylococcus aureus subsp. aureus Mu50
uuuacuugaauauagcu

SEQ ID NO: 2043569 - RNA, 19 nt, Staphylococcus aureus subsp. aureus Mu50
uuuacuuucucaucuauuu

SEQ ID NO: 2043570 - RNA, 14 nt, Staphylococcus aureus subsp. aureus Mu50
uuuagaaauagauu

SEQ ID NO: 2043571 - RNA, 13 nt, Staphylococcus aureus subsp. aureus Mu50
uuuagauuuaguu

SEQ ID NO: 2043572 - RNA, 18 nt, Staphylococcus aureus subsp. aureus Mu50
uuuagcaauugaaucaaa

SEQ ID NO: 2043573 - RNA, 19 nt, Staphylococcus aureus subsp. aureus Mu50
uuuagcaauugaaucaaau

SEQ ID NO: 2043574 - RNA, 16 nt, Staphylococcus aureus subsp. aureus Mu50
uuuagaguuuuuauua

SEQ ID NO: 2043575 - RNA, 18 nt, Staphylococcus aureus subsp. aureus Mu50
uuuagaguuuuuauuauu

SEQ ID NO: 2043576 - RNA, 20 nt, Staphylococcus aureus subsp. aureus Mu50
uuuagauagcucuauggcuu

SEQ ID NO: 2043577 - RNA, 14 nt, Staphylococcus aureus subsp. aureus Mu50
uuuagacaauauuu

SEQ ID NO: 2043578 - RNA, 19 nt, Staphylococcus aureus subsp. aureus Mu50
aauccugugacucaaugau

SEQ ID NO: 2043579 - RNA, 20 nt, Staphylococcus aureus subsp. aureus Mu50
aauccuucuccaaaaauaau

SEQ ID NO: 2043580 - RNA, 14 nt, Staphylococcus aureus subsp. aureus Mu50
aauccuucaucaau

SEQ ID NO: 2043581 - RNA, 13 nt, Staphylococcus aureus subsp. aureus Mu50
uuguaugaauaau

SEQ ID NO: 2043582 - RNA, 15 nt, Staphylococcus aureus subsp. aureus Mu50
uuuaacuucuuuugu

SEQ ID NO: 2043583 - RNA, 17 nt, Staphylococcus aureus subsp. aureus Mu50
uuuaacuuuaucuaguu

SEQ ID NO: 2043584 - RNA, 16 nt, Staphylococcus aureus subsp. aureus Mu50
uuuaagaaaucaacaa

SEQ ID NO: 2043585 - RNA, 20 nt, Staphylococcus aureus subsp. aureus Mu50
uuguuucagcugcaauuuua

SEQ ID NO: 2043586 - RNA, 22 nt, Staphylococcus aureus subsp. aureus Mu50
uuuaacgucauuuuuaauaaug

SEQ ID NO: 2043587 - RNA, 16 nt, Staphylococcus aureus subsp. aureus Mu50
uuuaacguuauucauu

SEQ ID NO: 2043588 - RNA, 20 nt, Staphylococcus aureus subsp. aureus Mu50
uuuaacuauguuacuuauau

SEQ ID NO: 2043589 - RNA, 16 nt, Staphylococcus aureus subsp. aureus Mu50
uuguugaauaauuaau

SEQ ID NO: 2043590 - RNA, 22 nt, Staphylococcus aureus subsp. aureus Mu50
uuguuuauuaggauucaauaau

SEQ ID NO: 2043591 - RNA, 14 nt, Staphylococcus aureus subsp. aureus Mu50
uuguucgauaaucg

SEQ ID NO: 2043592 - RNA, 22 nt, Staphylococcus aureus subsp. aureus Mu50
uuguucccauuuuuaaaauuau

SEQ ID NO: 2043593 - RNA, 21 nt, Staphylococcus aureus subsp. aureus Mu50
uuguuacuaguuuguaauaau

SEQ ID NO: 2043594 - RNA, 22 nt, Staphylococcus aureus subsp. aureus Mu50
uuguuacuaguuuguaauaauu

SEQ ID NO: 2043595 - RNA, 21 nt, Staphylococcus aureus subsp. aureus Mu50
uuguucaauaugauccuuuaa

SEQ ID NO: 2043596 - RNA, 22 nt, Staphylococcus aureus subsp. aureus Mu50
uuguuaccaaacaauacauaau

SEQ ID NO: 2043597 - RNA, 18 nt, Staphylococcus aureus subsp. aureus Mu50
uuguuauaaguaaauaau

SEQ ID NO: 2043598 - RNA, 13 nt, Staphylococcus aureus subsp. aureus Mu50
uuggcuugcuuca

SEQ ID NO: 2043599 - RNA, 18 nt, Staphylococcus aureus subsp. aureus Mu50
uuggcucuauaucaaauu

SEQ ID NO: 2043600 - RNA, 17 nt, Staphylococcus aureus subsp. aureus Mu50
uuggcuggcccccaaca

SEQ ID NO: 2043601 - RNA, 17 nt, Staphylococcus aureus subsp. aureus Mu50
uuggcuucgucaucaac

SEQ ID NO: 2043602 - RNA, 17 nt, Staphylococcus aureus subsp. aureus Mu50
uuggcggggccccaaca

SEQ ID NO: 2043603 - RNA, 13 nt, Staphylococcus aureus subsp. aureus Mu50
aauccguuaaaau

SEQ ID NO: 2043604 - RNA, 15 nt, Staphylococcus aureus subsp. aureus Mu50
aauccguuaaaauuu

SEQ ID NO: 2043605 - RNA, 20 nt, Staphylococcus aureus subsp. aureus Mu50
aauccguuaaaauuuuaauu

SEQ ID NO: 2043606 - RNA, 16 nt, Staphylococcus aureus subsp. aureus Mu50
uuguagcuugaauaau

SEQ ID NO: 2043607 - RNA, 18 nt, Staphylococcus aureus subsp. aureus Mu50
uuguagcuugaauaauau

SEQ ID NO: 2043608 - RNA, 19 nt, Staphylococcus aureus subsp. aureus Mu50
uuguacgcuucaauuauuu

SEQ ID NO: 2043609 - RNA, 18 nt, Staphylococcus aureus subsp. aureus Mu50
uuguacaucauuaaauau

SEQ ID NO: 2043610 - RNA, 23 nt, Staphylococcus aureus subsp. aureus Mu50
uugcuuaacuuccuuuuuauuuu

SEQ ID NO: 2043611 - RNA, 16 nt, Staphylococcus aureus subsp. aureus Mu50
uugcuuuaucaauaau

SEQ ID NO: 2043612 - RNA, 16 nt, Staphylococcus aureus subsp. aureus Mu50
uugcuuuuauaauaau

SEQ ID NO: 2043613 - RNA, 23 nt, Staphylococcus aureus subsp. aureus Mu50
uugcuuuuucucugcuguaacca

SEQ ID NO: 2043614 - RNA, 22 nt, Staphylococcus aureus subsp. aureus Mu50
uuggaagaaugccuuuuauuua

SEQ ID NO: 2043615 - RNA, 21 nt, Staphylococcus aureus subsp. aureus Mu50
uuggaaagaugggauuucacu

SEQ ID NO: 2043616 - RNA, 18 nt, Staphylococcus aureus subsp. aureus Mu50
uuggauaauuucuucuuc

SEQ ID NO: 2043617 - RNA, 14 nt, Staphylococcus aureus subsp. aureus Mu50
uuggacuaauaauu

SEQ ID NO: 2043618 - RNA, 14 nt, Staphylococcus aureus subsp. aureus Mu50
uuggauuucuuuuu

SEQ ID NO: 2043619 - RNA, 21 nt, Staphylococcus aureus subsp. aureus Mu50
uugauauagucaaugaauaau

SEQ ID NO: 2043620 - RNA, 23 nt, Staphylococcus aureus subsp. aureus Mu50
uugcgguuggcucuuuuuauuua

SEQ ID NO: 2043621 - RNA, 19 nt, Staphylococcus aureus subsp. aureus Mu50
uugcgguuuuuuugauuga

SEQ ID NO: 2043622 - RNA, 19 nt, Staphylococcus aureus subsp. aureus Mu50
uugcuagugcucuugcaau

SEQ ID NO: 2043623 - RNA, 20 nt, Staphylococcus aureus subsp. aureus Mu50
aauuggaaucaucuuuuuga

SEQ ID NO: 2043624 - RNA, 18 nt, Staphylococcus aureus subsp. aureus Mu50
aauugcuuucacauuguu

SEQ ID NO: 2043625 - RNA, 14 nt, Staphylococcus aureus subsp. aureus Mu50
aauugcuaaaauau

SEQ ID NO: 2043626 - RNA, 17 nt, Staphylococcus aureus subsp. aureus Mu50
aauugcuaaaauaucaa

SEQ ID NO: 2043627 - RNA, 17 nt, Staphylococcus aureus subsp. aureus Mu50
aauugauuauaaugauu

SEQ ID NO: 2043628 - RNA, 20 nt, Staphylococcus aureus subsp. aureus Mu50
aauugcauagcuaaauaaau

SEQ ID NO: 2043629 - RNA, 23 nt, Staphylococcus aureus subsp. aureus Mu50
aauugauucucuguagauaucaa

SEQ ID NO: 2043630 - RNA, 23 nt, Staphylococcus aureus subsp. aureus Mu50
aauugauuuugcugccaaaaagu

SEQ ID NO: 2043631 - RNA, 21 nt, Staphylococcus aureus subsp. aureus Mu50
aauugaugucacauaugacuu

SEQ ID NO: 2043632 - RNA, 21 nt, Staphylococcus aureus subsp. aureus Mu50
aauugaugugccuuucuaaua

SEQ ID NO: 2043633 - RNA, 14 nt, Staphylococcus aureus subsp. aureus Mu50
aauugauuaaauaa

SEQ ID NO: 2043634 - RNA, 17 nt, Staphylococcus aureus subsp. aureus Mu50
aauugauuaaauaaauu

SEQ ID NO: 2043635 - RNA, 16 nt, Staphylococcus aureus subsp. aureus Mu50
aauugauuauaaugau

SEQ ID NO: 2043636 - RNA, 13 nt, Staphylococcus aureus subsp. aureus Mu50
aauucuuuuguaa

SEQ ID NO: 2043637 - RNA, 12 nt, Staphylococcus aureus subsp. aureus Mu50
aauucuuuuuca

SEQ ID NO: 2043638 - RNA, 17 nt, Staphylococcus aureus subsp. aureus Mu50
aauugaaggccauuuuu

SEQ ID NO: 2043639 - RNA, 18 nt, Staphylococcus aureus subsp. aureus Mu50
aauugaaggccauuuuua

SEQ ID NO: 2043640 - RNA, 13 nt, Staphylococcus aureus subsp. aureus Mu50
aauugaauagguc

SEQ ID NO: 2043641 - RNA, 18 nt, Staphylococcus aureus subsp. aureus Mu50
aauucuucaucaauaacu

SEQ ID NO: 2043642 - RNA, 19 nt, Staphylococcus aureus subsp. aureus Mu50
aauucuucaucaauaacua

SEQ ID NO: 2043643 - RNA, 23 nt, Staphylococcus aureus subsp. aureus Mu50
aauucuggauuaaacccuucaga

SEQ ID NO: 2043644 - RNA, 16 nt, Staphylococcus aureus subsp. aureus Mu50
aauucuguuucaaagc

SEQ ID NO: 2043645 - RNA, 20 nt, Staphylococcus aureus subsp. aureus Mu50
aauugaguauuaaauuugaa

SEQ ID NO: 2043646 - RNA, 15 nt, Staphylococcus aureus subsp. aureus Mu50
aauugauauugcaaa

SEQ ID NO: 2043647 - RNA, 20 nt, Staphylococcus aureus subsp. aureus Mu50
aauugaucagcauuuaagcu

SEQ ID NO: 2043648 - RNA, 18 nt, Staphylococcus aureus subsp. aureus Mu50
aauugaaucuuuguuaua

SEQ ID NO: 2043649 - RNA, 13 nt, Staphylococcus aureus subsp. aureus Mu50
aauugaaugaaaa

SEQ ID NO: 2043650 - RNA, 21 nt, Staphylococcus aureus subsp. aureus Mu50
aauugaaugaaaaaguugauc

SEQ ID NO: 2043651 - RNA, 15 nt, Staphylococcus aureus subsp. aureus Mu50
aauugacuuuaauug

SEQ ID NO: 2043652 - RNA, 22 nt, Staphylococcus aureus subsp. aureus Mu50
aauucugaaaucaguuuuugaa

SEQ ID NO: 2043653 - RNA, 19 nt, Staphylococcus aureus subsp. aureus Mu50
aauucuacagguaaugcaa

SEQ ID NO: 2043654 - RNA, 23 nt, Staphylococcus aureus subsp. aureus Mu50
aauucguuuugcuaaccaucaua

SEQ ID NO: 2043655 - RNA, 13 nt, Staphylococcus aureus subsp. aureus Mu50
aauucuaagucuc

SEQ ID NO: 2043656 - RNA, 19 nt, Staphylococcus aureus subsp. aureus Mu50
aauucuacaggcaaugcaa

SEQ ID NO: 2043657 - RNA, 17 nt, Staphylococcus aureus subsp. aureus Mu50
aauucgcuuguaacaag

SEQ ID NO: 2043658 - RNA, 23 nt, Staphylococcus aureus subsp. aureus Mu50
aauucgcuuguaacaagcuuuuu

SEQ ID NO: 2043659 - RNA, 15 nt, Staphylococcus aureus subsp. aureus Mu50
aauuucaguaucaug

SEQ ID NO: 2043660 - RNA, 23 nt, Staphylococcus aureus subsp. aureus Mu50
aauuucauaaaguuuauuuaugu

SEQ ID NO: 2043661 - RNA, 20 nt, Staphylococcus aureus subsp. aureus Mu50
aauuucaucacgugauaaug

SEQ ID NO: 2043662 - RNA, 22 nt, Staphylococcus aureus subsp. aureus Mu50
aauuucaucacgugauaaugac

SEQ ID NO: 2043663 - RNA, 11 nt, Staphylococcus aureus subsp. aureus Mu50
aauuucuaaua

SEQ ID NO: 2043664 - RNA, 18 nt, Staphylococcus aureus subsp. aureus Mu50
aauuucgccucaucuaau

SEQ ID NO: 2043665 - RNA, 16 nt, Staphylococcus aureus subsp. aureus Mu50
aauuucauauaaugaa

SEQ ID NO: 2043666 - RNA, 18 nt, Staphylococcus aureus subsp. aureus Mu50
aauuuagcaucaaaaaua

SEQ ID NO: 2043667 - RNA, 14 nt, Staphylococcus aureus subsp. aureus Mu50
aauuuaugauuguu

SEQ ID NO: 2043668 - RNA, 17 nt, Staphylococcus aureus subsp. aureus Mu50
aauuuauuuuuaauuuc

SEQ ID NO: 2043669 - RNA, 12 nt, Staphylococcus aureus subsp. aureus Mu50
aauuucaaaaua

SEQ ID NO: 2043670 - RNA, 17 nt, Staphylococcus aureus subsp. aureus Mu50
aauuucaacauuacuaa

SEQ ID NO: 2043671 - RNA, 17 nt, Staphylococcus aureus subsp. aureus Mu50
aauuuauuauaaaauag

SEQ ID NO: 2043672 - RNA, 13 nt, Staphylococcus aureus subsp. aureus Mu50
aauuuauucaaaa

SEQ ID NO: 2043673 - RNA, 17 nt, Staphylococcus aureus subsp. aureus Mu50
aauuuagucauuacaaa

SEQ ID NO: 2043674 - RNA, 20 nt, Staphylococcus aureus subsp. aureus Mu50
aauuuaguccuucuuuacua

SEQ ID NO: 2043675 - RNA, 12 nt, Staphylococcus aureus subsp. aureus Mu50
aauuuagugaaa

SEQ ID NO: 2043676 - RNA, 16 nt, Staphylococcus aureus subsp. aureus Mu50
aauuuagugaaacaau

SEQ ID NO: 2043677 - RNA, 20 nt, Staphylococcus aureus subsp. aureus Mu50
aauuuaguuauaauuucugu

SEQ ID NO: 2043678 - RNA, 20 nt, Staphylococcus aureus subsp. aureus Mu50
aauuuaguucaccauuucgu

SEQ ID NO: 2043679 - RNA, 17 nt, Staphylococcus aureus subsp. aureus Mu50
aauuuaggcaugucaaa

SEQ ID NO: 2043680 - RNA, 20 nt, Staphylococcus aureus subsp. aureus Mu50
aauuuagcaaauauuucugg

SEQ ID NO: 2043681 - RNA, 19 nt, Staphylococcus aureus subsp. aureus Mu50
aauuuaccauuuucaauaa

SEQ ID NO: 2043682 - RNA, 23 nt, Staphylococcus aureus subsp. aureus Mu50
aauuguucuucagaaacuuuuga

SEQ ID NO: 2043683 - RNA, 15 nt, Staphylococcus aureus subsp. aureus Mu50
aauuguugcaaaaua

SEQ ID NO: 2043684 - RNA, 22 nt, Staphylococcus aureus subsp. aureus Mu50
aauuguuaaacccucauuuuua

SEQ ID NO: 2043685 - RNA, 13 nt, Staphylococcus aureus subsp. aureus Mu50
aauuguucuaaua

SEQ ID NO: 2043686 - RNA, 11 nt, Staphylococcus aureus subsp. aureus Mu50
aauuuaaauaa

SEQ ID NO: 2043687 - RNA, 14 nt, Staphylococcus aureus subsp. aureus Mu50
aauuuaaauaauaa

SEQ ID NO: 2043688 - RNA, 15 nt, Staphylococcus aureus subsp. aureus Mu50
aauuguuuugagaua

SEQ ID NO: 2043689 - RNA, 19 nt, Staphylococcus aureus subsp. aureus Mu50
aauuuaaaacaaugauuaa

SEQ ID NO: 2043690 - RNA, 14 nt, Staphylococcus aureus subsp. aureus Mu50
aauuuaaaauaaua

SEQ ID NO: 2043691 - RNA, 19 nt, Staphylococcus aureus subsp. aureus Mu50
aauuuaaaugauauugaaa

SEQ ID NO: 2043692 - RNA, 12 nt, Staphylococcus aureus subsp. aureus Mu50
aauuuaaaugcu

SEQ ID NO: 2043693 - RNA, 19 nt, Staphylococcus aureus subsp. aureus Mu50
aauuuaaauugucacaauc

SEQ ID NO: 2043694 - RNA, 16 nt, Staphylococcus aureus subsp. aureus Mu50
aauuuaacguguaaug

SEQ ID NO: 2043695 - RNA, 16 nt, Staphylococcus aureus subsp. aureus Mu50
aauuuacguacuucau

SEQ ID NO: 2043696 - RNA, 17 nt, Staphylococcus aureus subsp. aureus Mu50
aauuuacuccuuacaau

SEQ ID NO: 2043697 - RNA, 18 nt, Staphylococcus aureus subsp. aureus Mu50
aauuuaauaauuaaauau

SEQ ID NO: 2043698 - RNA, 21 nt, Staphylococcus aureus subsp. aureus Mu50
aauuuaauguuuucagccacu

SEQ ID NO: 2043699 - RNA, 15 nt, Staphylococcus aureus subsp. aureus Mu50
aauuguggcuacuaa

SEQ ID NO: 2043700 - RNA, 13 nt, Staphylococcus aureus subsp. aureus Mu50
aauugucuuuaua

SEQ ID NO: 2043701 - RNA, 16 nt, Staphylococcus aureus subsp. aureus Mu50
aauugucuuuauaaaa

SEQ ID NO: 2043702 - RNA, 19 nt, Staphylococcus aureus subsp. aureus Mu50
aauuguuaguuuucuuaaa

SEQ ID NO: 2043703 - RNA, 20 nt, Staphylococcus aureus subsp. aureus Mu50
aauuguuauaaguaaauaau

SEQ ID NO: 2043704 - RNA, 14 nt, Staphylococcus aureus subsp. aureus Mu50
aauuguuaucguuc

SEQ ID NO: 2043705 - RNA, 13 nt, Staphylococcus aureus subsp. aureus Mu50
aauuguuaaaccc

SEQ ID NO: 2043706 - RNA, 16 nt, Staphylococcus aureus subsp. aureus Mu50
aauuguagauccaauu

SEQ ID NO: 2043707 - RNA, 16 nt, Staphylococcus aureus subsp. aureus Mu50
aauuguaugaauaaua

SEQ ID NO: 2043708 - RNA, 18 nt, Staphylococcus aureus subsp. aureus Mu50
aauugguaaaaaucucaa

SEQ ID NO: 2043709 - RNA, 18 nt, Staphylococcus aureus subsp. aureus Mu50
aauugguuuuuagugaaa

SEQ ID NO: 2043710 - RNA, 17 nt, Staphylococcus aureus subsp. aureus Mu50
aauugggaaauauuuga

SEQ ID NO: 2043711 - RNA, 19 nt, Staphylococcus aureus subsp. aureus Mu50
aauugguuuuuagugaaaa

SEQ ID NO: 2043712 - RNA, 19 nt, Staphylococcus aureus subsp. aureus Mu50
aauuaugacuuauuuuuca

SEQ ID NO: 2043713 - RNA, 15 nt, Staphylococcus aureus subsp. aureus Mu50
aauuauggagcggaa

SEQ ID NO: 2043714 - RNA, 17 nt, Staphylococcus aureus subsp. aureus Mu50
aauuauggauaaaauuu

SEQ ID NO: 2043715 - RNA, 12 nt, Staphylococcus aureus subsp. aureus Mu50
aauuauuaacgc

SEQ ID NO: 2043716 - RNA, 22 nt, Staphylococcus aureus subsp. aureus Mu50
aauuauuaacgcaaaaauacuc

SEQ ID NO: 2043717 - RNA, 12 nt, Staphylococcus aureus subsp. aureus Mu50
aauuauauaccc

SEQ ID NO: 2043718 - RNA, 15 nt, Staphylococcus aureus subsp. aureus Mu50
aauuauauguuuuua

SEQ ID NO: 2043719 - RNA, 20 nt, Staphylococcus aureus subsp. aureus Mu50
aauuauauuuauuuguacau

SEQ ID NO: 2043720 - RNA, 17 nt, Staphylococcus aureus subsp. aureus Mu50
aauuauuagaacguaau

SEQ ID NO: 2043721 - RNA, 19 nt, Staphylococcus aureus subsp. aureus Mu50
aauuauuauaguuuagauu

SEQ ID NO: 2043722 - RNA, 18 nt, Staphylococcus aureus subsp. aureus Mu50
aauuaucagaaucaagua

SEQ ID NO: 2043723 - RNA, 20 nt, Staphylococcus aureus subsp. aureus Mu50
aauuaucuguagguaagaaa

SEQ ID NO: 2043724 - RNA, 16 nt, Staphylococcus aureus subsp. aureus Mu50
aauuaucuuaagucau

SEQ ID NO: 2043725 - RNA, 18 nt, Staphylococcus aureus subsp. aureus Mu50
aauuaguucguguuugaa

SEQ ID NO: 2043726 - RNA, 21 nt, Staphylococcus aureus subsp. aureus Mu50
aauuaagauguugaguuguaa

SEQ ID NO: 2043727 - RNA, 21 nt, Staphylococcus aureus subsp. aureus Mu50
aauuagguauaguguuugaca

SEQ ID NO: 2043728 - RNA, 20 nt, Staphylococcus aureus subsp. aureus Mu50
aauuauaaccgcuacaauua

SEQ ID NO: 2043729 - RNA, 23 nt, Staphylococcus aureus subsp. aureus Mu50
aauuauaaccgcuacaauuauaa

SEQ ID NO: 2043730 - RNA, 23 nt, Staphylococcus aureus subsp. aureus Mu50
aauucaauauuaaucauaaugaa

SEQ ID NO: 2043731 - RNA, 16 nt, Staphylococcus aureus subsp. aureus Mu50
aauuaucuucaucauu

SEQ ID NO: 2043732 - RNA, 21 nt, Staphylococcus aureus subsp. aureus Mu50
aauucaggauggaaugauacg

SEQ ID NO: 2043733 - RNA, 13 nt, Staphylococcus aureus subsp. aureus Mu50
aauucaacgucau

SEQ ID NO: 2043734 - RNA, 22 nt, Staphylococcus aureus subsp. aureus Mu50
aauuauuucccuggaaaaugau

SEQ ID NO: 2043735 - RNA, 19 nt, Staphylococcus aureus subsp. aureus Mu50
aauuauuuuaaaaaaugau

SEQ ID NO: 2043736 - RNA, 19 nt, Staphylococcus aureus subsp. aureus Mu50
aauuauuuucucgauacaa

SEQ ID NO: 2043737 - RNA, 15 nt, Staphylococcus aureus subsp. aureus Mu50
aauuauuuuucaaau

SEQ ID NO: 2043738 - RNA, 20 nt, Staphylococcus aureus subsp. aureus Mu50
aauucaacuaugaaauugga

SEQ ID NO: 2043739 - RNA, 12 nt, Staphylococcus aureus subsp. aureus Mu50
aauucaacuuua

SEQ ID NO: 2043740 - RNA, 12 nt, Staphylococcus aureus subsp. aureus Mu50
aauucauauuaa

SEQ ID NO: 2043741 - RNA, 21 nt, Staphylococcus aureus subsp. aureus Mu50
aauucaguucaaacagaaauu

SEQ ID NO: 2043742 - RNA, 21 nt, Staphylococcus aureus subsp. aureus Mu50
aauucaguaucuaaauauuaa

SEQ ID NO: 2043743 - RNA, 19 nt, Staphylococcus aureus subsp. aureus Mu50
aauuccaagagaauuaaua

SEQ ID NO: 2043744 - RNA, 21 nt, Staphylococcus aureus subsp. aureus Mu50
aauuccaugucaauuuuuuca

SEQ ID NO: 2043745 - RNA, 14 nt, Staphylococcus aureus subsp. aureus Mu50
aauucccaaccuuc

SEQ ID NO: 2043746 - RNA, 13 nt, Staphylococcus aureus subsp. aureus Mu50
aauucccauguau

SEQ ID NO: 2043747 - RNA, 19 nt, Staphylococcus aureus subsp. aureus Mu50
aauuccuggugcaauaaua

SEQ ID NO: 2043748 - RNA, 18 nt, Staphylococcus aureus subsp. aureus Mu50
aauuccuucuauagcacc

SEQ ID NO: 2043749 - RNA, 17 nt, Staphylococcus aureus subsp. aureus Mu50
aauucgacucaaacaau

SEQ ID NO: 2043750 - RNA, 18 nt, Staphylococcus aureus subsp. aureus Mu50
aauucgaugacuuuuuaa

SEQ ID NO: 2043751 - RNA, 15 nt, Staphylococcus aureus subsp. aureus Mu50
aauucgccuaaaugg

SEQ ID NO: 2043752 - RNA, 18 nt, Staphylococcus aureus subsp. aureus Mu50
aauuaccguuuauuucgu

SEQ ID NO: 2043753 - RNA, 16 nt, Staphylococcus aureus subsp. aureus Mu50
aauuaauagagacauu

SEQ ID NO: 2043754 - RNA, 14 nt, Staphylococcus aureus subsp. aureus Mu50
aauuaaucccuuca

SEQ ID NO: 2043755 - RNA, 19 nt, Staphylococcus aureus subsp. aureus Mu50
aauuaaugccauuguuauc

SEQ ID NO: 2043756 - RNA, 13 nt, Staphylococcus aureus subsp. aureus Mu50
aauuaauuguaaa

SEQ ID NO: 2043757 - RNA, 18 nt, Staphylococcus aureus subsp. aureus Mu50
aauuacaccugcaauaua

SEQ ID NO: 2043758 - RNA, 21 nt, Staphylococcus aureus subsp. aureus Mu50
aauuacacuacgcugaugaau

SEQ ID NO: 2043759 - RNA, 16 nt, Staphylococcus aureus subsp. aureus Mu50
aauuaauacaucaaua

SEQ ID NO: 2043760 - RNA, 14 nt, Staphylococcus aureus subsp. aureus Mu50
aauuaagaaaaguu

SEQ ID NO: 2043761 - RNA, 20 nt, Staphylococcus aureus subsp. aureus Mu50
aauuaaagcuagaaacaaug

SEQ ID NO: 2043762 - RNA, 16 nt, Staphylococcus aureus subsp. aureus Mu50
aauuaaaacuauaaua

SEQ ID NO: 2043763 - RNA, 15 nt, Staphylococcus aureus subsp. aureus Mu50
aauuaaagauuaaaa

SEQ ID NO: 2043764 - RNA, 18 nt, Staphylococcus aureus subsp. aureus Mu50
aauuacuguaaauaugaa

SEQ ID NO: 2043765 - RNA, 18 nt, Staphylococcus aureus subsp. aureus Mu50
aauuagaaaaauaugauu

SEQ ID NO: 2043766 - RNA, 21 nt, Staphylococcus aureus subsp. aureus Mu50
aauuagaaccaucauucauau

SEQ ID NO: 2043767 - RNA, 14 nt, Staphylococcus aureus subsp. aureus Mu50
aauuagaauauaug

SEQ ID NO: 2043768 - RNA, 14 nt, Staphylococcus aureus subsp. aureus Mu50
aauuacguuuacua

SEQ ID NO: 2043769 - RNA, 17 nt, Staphylococcus aureus subsp. aureus Mu50
aauuagauuuuaugcuu

SEQ ID NO: 2043770 - RNA, 22 nt, Staphylococcus aureus subsp. aureus Mu50
aauuagauuuuaugcuuuacuu

SEQ ID NO: 2043771 - RNA, 20 nt, Staphylococcus aureus subsp. aureus Mu50
aauuagauuuuguuguacuu

SEQ ID NO: 2043772 - RNA, 19 nt, Staphylococcus aureus subsp. aureus Mu50
aauuagccccaguauagaa

SEQ ID NO: 2043773 - RNA, 17 nt, Staphylococcus aureus subsp. aureus Mu50
aaugcucccuucaaagu

SEQ ID NO: 2043774 - RNA, 18 nt, Staphylococcus aureus subsp. aureus Mu50
aaugcucccuucaaaguu

SEQ ID NO: 2043775 - RNA, 16 nt, Staphylococcus aureus subsp. aureus Mu50
aaugccgcuucuaauu

SEQ ID NO: 2043776 - RNA, 16 nt, Staphylococcus aureus subsp. aureus Mu50
aaugccggucauaaca

SEQ ID NO: 2043777 - RNA, 22 nt, Staphylococcus aureus subsp. aureus Mu50
aaugcuuaauuuguuuuaaaua

SEQ ID NO: 2043778 - RNA, 23 nt, Staphylococcus aureus subsp. aureus Mu50
aaugcuuaauuuguuuuaaauac

SEQ ID NO: 2043779 - RNA, 18 nt, Staphylococcus aureus subsp. aureus Mu50
aaugcuuauauaaacaaa

SEQ ID NO: 2043780 - RNA, 18 nt, Staphylococcus aureus subsp. aureus Mu50
aaugcuucaaauguaaca

SEQ ID NO: 2043781 - RNA, 22 nt, Staphylococcus aureus subsp. aureus Mu50
aaugcuucugguucuucaauau

SEQ ID NO: 2043782 - RNA, 14 nt, Staphylococcus aureus subsp. aureus Mu50
aauggaaagacguu

SEQ ID NO: 2043783 - RNA, 11 nt, Staphylococcus aureus subsp. aureus Mu50
uuuuuuauguu

SEQ ID NO: 2043784 - RNA, 14 nt, Staphylococcus aureus subsp. aureus Mu50
aaucuauugcaaua

SEQ ID NO: 2043785 - RNA, 15 nt, Staphylococcus aureus subsp. aureus Mu50
aaucuauugcaauau

SEQ ID NO: 2043786 - RNA, 13 nt, Staphylococcus aureus subsp. aureus Mu50
aaucucaaaauuu

SEQ ID NO: 2043787 - RNA, 15 nt, Staphylococcus aureus subsp. aureus Mu50
aaucucuuuagauga

SEQ ID NO: 2043788 - RNA, 18 nt, Staphylococcus aureus subsp. aureus Mu50
aaucucuuuuugauuaua

SEQ ID NO: 2043789 - RNA, 19 nt, Staphylococcus aureus subsp. aureus Mu50
aaucucgguacauuuaaug

SEQ ID NO: 2043790 - RNA, 18 nt, Staphylococcus aureus subsp. aureus Mu50
uuuuguaucucugaaaaa

SEQ ID NO: 2043791 - RNA, 15 nt, Staphylococcus aureus subsp. aureus Mu50
uuuugugaauuuauu

SEQ ID NO: 2043792 - RNA, 14 nt, Staphylococcus aureus subsp. aureus Mu50
uuuugcuuuauuuu

SEQ ID NO: 2043793 - RNA, 22 nt, Staphylococcus aureus subsp. aureus Mu50
uuuuguugcucagugcauuuuu

SEQ ID NO: 2043794 - RNA, 21 nt, Staphylococcus aureus subsp. aureus Mu50
uuuuucgagaugauauuacau

SEQ ID NO: 2043795 - RNA, 17 nt, Staphylococcus aureus subsp. aureus Mu50
uuuuucguuuuaauaau

SEQ ID NO: 2043796 - RNA, 14 nt, Staphylococcus aureus subsp. aureus Mu50
uuuuucuaaauaaa

SEQ ID NO: 2043797 - RNA, 20 nt, Staphylococcus aureus subsp. aureus Mu50
aaugccaagaagacauugga

SEQ ID NO: 2043798 - RNA, 22 nt, Staphylococcus aureus subsp. aureus Mu50
aaugcauggaaaagugcgauua

SEQ ID NO: 2043799 - RNA, 16 nt, Staphylococcus aureus subsp. aureus Mu50
aaugccaaauauagua

SEQ ID NO: 2043800 - RNA, 13 nt, Staphylococcus aureus subsp. aureus Mu50
aaugcacugcuaa

SEQ ID NO: 2043801 - RNA, 15 nt, Staphylococcus aureus subsp. aureus Mu50
aaugcaccuauaaua

SEQ ID NO: 2043802 - RNA, 14 nt, Staphylococcus aureus subsp. aureus Mu50
aaucuguucauaau

SEQ ID NO: 2043803 - RNA, 14 nt, Staphylococcus aureus subsp. aureus Mu50
aaucuguuuaaauu

SEQ ID NO: 2043804 - RNA, 21 nt, Staphylococcus aureus subsp. aureus Mu50
aaucuuaaagauuuuucagcu

SEQ ID NO: 2043805 - RNA, 14 nt, Staphylococcus aureus subsp. aureus Mu50
aaucugcuuuauuu

SEQ ID NO: 2043806 - RNA, 21 nt, Staphylococcus aureus subsp. aureus Mu50
aaucuggcacuuaagcuuuaa

SEQ ID NO: 2043807 - RNA, 13 nt, Staphylococcus aureus subsp. aureus Mu50
aaucuuggugaua

SEQ ID NO: 2043808 - RNA, 18 nt, Staphylococcus aureus subsp. aureus Mu50
aaucuuggugauagucuu

SEQ ID NO: 2043809 - RNA, 13 nt, Staphylococcus aureus subsp. aureus Mu50
aaucuuguuuuca

SEQ ID NO: 2043810 - RNA, 20 nt, Staphylococcus aureus subsp. aureus Mu50
aaucuuguuuucauuuaaaa

SEQ ID NO: 2043811 - RNA, 21 nt, Staphylococcus aureus subsp. aureus Mu50
aaucuuaaucgcucuaaauag

SEQ ID NO: 2043812 - RNA, 13 nt, Staphylococcus aureus subsp. aureus Mu50
aaucuuauuuugu

SEQ ID NO: 2043813 - RNA, 22 nt, Staphylococcus aureus subsp. aureus Mu50
aaugauuuuuauuauugucauc

SEQ ID NO: 2043814 - RNA, 22 nt, Staphylococcus aureus subsp. aureus Mu50
aaugauuuuucaucaauaucaa

SEQ ID NO: 2043815 - RNA, 19 nt, Staphylococcus aureus subsp. aureus Mu50
aaugcaaaucaaauacauc

SEQ ID NO: 2043816 - RNA, 21 nt, Staphylococcus aureus subsp. aureus Mu50
aaugauuacuuuaagauuauu

SEQ ID NO: 2043817 - RNA, 19 nt, Staphylococcus aureus subsp. aureus Mu50
aaugauugacgauuuaauu

SEQ ID NO: 2043818 - RNA, 17 nt, Staphylococcus aureus subsp. aureus Mu50
aaugauuguaauaucua

SEQ ID NO: 2043819 - RNA, 13 nt, Staphylococcus aureus subsp. aureus Mu50
aaugauuguuuua

SEQ ID NO: 2043820 - RNA, 14 nt, Staphylococcus aureus subsp. aureus Mu50
aaugauuuaauaaa

SEQ ID NO: 2043821 - RNA, 17 nt, Staphylococcus aureus subsp. aureus Mu50
aaucuucuaguaauucu

SEQ ID NO: 2043822 - RNA, 18 nt, Staphylococcus aureus subsp. aureus Mu50
aaucuuuacuuguaauua

SEQ ID NO: 2043823 - RNA, 16 nt, Staphylococcus aureus subsp. aureus Mu50
uuuucauuguaauaau

SEQ ID NO: 2043824 - RNA, 21 nt, Staphylococcus aureus subsp. aureus Mu50
uuuucauuuaacauguauuua

SEQ ID NO: 2043825 - RNA, 15 nt, Staphylococcus aureus subsp. aureus Mu50
uuuucauuuuaguua

SEQ ID NO: 2043826 - RNA, 13 nt, Staphylococcus aureus subsp. aureus Mu50
uuuuccauaaaua

SEQ ID NO: 2043827 - RNA, 22 nt, Staphylococcus aureus subsp. aureus Mu50
uuuuauuacaaacauuccucua

SEQ ID NO: 2043828 - RNA, 13 nt, Staphylococcus aureus subsp. aureus Mu50
uuuucauaauuaa

SEQ ID NO: 2043829 - RNA, 14 nt, Staphylococcus aureus subsp. aureus Mu50
uuuucauaauuaau

SEQ ID NO: 2043830 - RNA, 13 nt, Staphylococcus aureus subsp. aureus Mu50
uuuucaucauuua

SEQ ID NO: 2043831 - RNA, 19 nt, Staphylococcus aureus subsp. aureus Mu50
uuuucaucguucauauauu

SEQ ID NO: 2043832 - RNA, 18 nt, Staphylococcus aureus subsp. aureus Mu50
uuuucaugaaaaguugau

SEQ ID NO: 2043833 - RNA, 15 nt, Staphylococcus aureus subsp. aureus Mu50
uuuucacuaauauuu

SEQ ID NO: 2043834 - RNA, 17 nt, Staphylococcus aureus subsp. aureus Mu50
uuuugacauauuuuuua

SEQ ID NO: 2043835 - RNA, 17 nt, Staphylococcus aureus subsp. aureus Mu50
uuuugagagauuauuua

SEQ ID NO: 2043836 - RNA, 24 nt, Staphylococcus aureus subsp. aureus Mu50
uuuugaagaauaaaaaaguugauu

SEQ ID NO: 2043837 - RNA, 12 nt, Staphylococcus aureus subsp. aureus Mu50
uuuugaauauuu

SEQ ID NO: 2043838 - RNA, 20 nt, Staphylococcus aureus subsp. aureus Mu50
uuuugauuaguaaauauagu

SEQ ID NO: 2043839 - RNA, 13 nt, Staphylococcus aureus subsp. aureus Mu50
uuuugauuauauu

SEQ ID NO: 2043840 - RNA, 15 nt, Staphylococcus aureus subsp. aureus Mu50
uuuugauuuaauaau

SEQ ID NO: 2043841 - RNA, 13 nt, Staphylococcus aureus subsp. aureus Mu50
uuuugauuuauua

SEQ ID NO: 2043842 - RNA, 20 nt, Staphylococcus aureus subsp. aureus Mu50
uuuugcaacauuaaauuauu

SEQ ID NO: 2043843 - RNA, 18 nt, Staphylococcus aureus subsp. aureus Mu50
uuuugcgaaaauaucauu

SEQ ID NO: 2043844 - RNA, 16 nt, Staphylococcus aureus subsp. aureus Mu50
uuuugcguuaauaauu

SEQ ID NO: 2043845 - RNA, 22 nt, Staphylococcus aureus subsp. aureus Mu50
uuuugcuaaccaucauaaaugu

SEQ ID NO: 2043846 - RNA, 15 nt, Staphylococcus aureus subsp. aureus Mu50
uuuugcucuaaacuu

SEQ ID NO: 2043847 - RNA, 16 nt, Staphylococcus aureus subsp. aureus Mu50
uuuucuuauuuauuca

SEQ ID NO: 2043848 - RNA, 13 nt, Staphylococcus aureus subsp. aureus Mu50
uuuugaaauggua

SEQ ID NO: 2043849 - RNA, 13 nt, Staphylococcus aureus subsp. aureus Mu50
uuuucuuuuuuua

SEQ ID NO: 2043850 - RNA, 14 nt, Staphylococcus aureus subsp. aureus Mu50
uuuucuauggcaca

SEQ ID NO: 2043851 - RNA, 13 nt, Staphylococcus aureus subsp. aureus Mu50
uuucucauaguca

SEQ ID NO: 2043852 - RNA, 17 nt, Staphylococcus aureus subsp. aureus Mu50
uuuguucaguuaaaucu

SEQ ID NO: 2043853 - RNA, 15 nt, Staphylococcus aureus subsp. aureus Mu50
uuucuauuaauauag

SEQ ID NO: 2043854 - RNA, 17 nt, Staphylococcus aureus subsp. aureus Mu50
uuucucggcgauaaaau

SEQ ID NO: 2043855 - RNA, 22 nt, Staphylococcus aureus subsp. aureus Mu50
uuucguguuccaauuuuauuga

SEQ ID NO: 2043856 - RNA, 14 nt, Staphylococcus aureus subsp. aureus Mu50
uuucuauaucuauu

SEQ ID NO: 2043857 - RNA, 16 nt, Staphylococcus aureus subsp. aureus Mu50
uuucuaauuaaacgcu

SEQ ID NO: 2043858 - RNA, 16 nt, Staphylococcus aureus subsp. aureus Mu50
uuuuauguauuuauua

SEQ ID NO: 2043859 - RNA, 17 nt, Staphylococcus aureus subsp. aureus Mu50
uuuuauguauuuauuuu

SEQ ID NO: 2043860 - RNA, 23 nt, Staphylococcus aureus subsp. aureus Mu50
uuuuauguccagccauuaaaccu

SEQ ID NO: 2043861 - RNA, 13 nt, Staphylococcus aureus subsp. aureus Mu50
uuuucaaauauau

SEQ ID NO: 2043862 - RNA, 23 nt, Staphylococcus aureus subsp. aureus Mu50
uuuuauucgauaauauaacugca

SEQ ID NO: 2043863 - RNA, 20 nt, Staphylococcus aureus subsp. aureus Mu50
uuuuauuauugucaucaugu

SEQ ID NO: 2043864 - RNA, 22 nt, Staphylococcus aureus subsp. aureus Mu50
uuuuaagugguuaucacgugcu

SEQ ID NO: 2043865 - RNA, 13 nt, Staphylococcus aureus subsp. aureus Mu50
uuuuaaguuaauu

SEQ ID NO: 2043866 - RNA, 21 nt, Staphylococcus aureus subsp. aureus Mu50
uuuuaacauagcuuaauaauu

SEQ ID NO: 2043867 - RNA, 19 nt, Staphylococcus aureus subsp. aureus Mu50
uuuuaagguucuuuuuuua

SEQ ID NO: 2043868 - RNA, 14 nt, Staphylococcus aureus subsp. aureus Mu50
uuuuauaauaaauu

SEQ ID NO: 2043869 - RNA, 17 nt, Staphylococcus aureus subsp. aureus Mu50
uuuuaaagguuaaauau

SEQ ID NO: 2043870 - RNA, 18 nt, Staphylococcus aureus subsp. aureus Mu50
uuuuaaagguuaaauauu

SEQ ID NO: 2043871 - RNA, 12 nt, Staphylococcus aureus subsp. aureus Mu50
uuuuaaaguaac

SEQ ID NO: 2043872 - RNA, 22 nt, Staphylococcus aureus subsp. aureus Mu50
uuuuaaaugauuuaauaaaaac

SEQ ID NO: 2043873 - RNA, 13 nt, Staphylococcus aureus subsp. aureus Mu50
uuuuaaauguauu

SEQ ID NO: 2043874 - RNA, 20 nt, Staphylococcus aureus subsp. aureus Mu50
uuuuaaauuaugacuuauuu

SEQ ID NO: 2043875 - RNA, 16 nt, Staphylococcus aureus subsp. aureus Mu50
uuuuaaaauuaaaccu

SEQ ID NO: 2043876 - RNA, 15 nt, Staphylococcus aureus subsp. aureus Mu50
uuuguuuuaccauca

SEQ ID NO: 2043877 - RNA, 22 nt, Staphylococcus aureus subsp. aureus Mu50
uuuuaaaaaacauaccugcaua

SEQ ID NO: 2043878 - RNA, 19 nt, Staphylococcus aureus subsp. aureus Mu50
ugcucaaaaaugcuuauau

SEQ ID NO: 2043879 - RNA, 17 nt, Staphylococcus aureus subsp. aureus Mu50
ugcugaauaaaauauau

SEQ ID NO: 2043880 - RNA, 19 nt, Staphylococcus aureus subsp. aureus Mu50
ugcucuaauccaaaauaau

SEQ ID NO: 2043881 - RNA, 14 nt, Staphylococcus aureus subsp. aureus Mu50
aauaucauauuuga

SEQ ID NO: 2043882 - RNA, 11 nt, Staphylococcus aureus subsp. aureus Mu50
aauaucaauuu

SEQ ID NO: 2043883 - RNA, 16 nt, Staphylococcus aureus subsp. aureus Mu50
aauaucaauuuuuacu

SEQ ID NO: 2043884 - RNA, 20 nt, Staphylococcus aureus subsp. aureus Mu50
aauaucacgaucuuuaaagu

SEQ ID NO: 2043885 - RNA, 16 nt, Staphylococcus aureus subsp. aureus Mu50
aauaucacuaucagcu

SEQ ID NO: 2043886 - RNA, 14 nt, Staphylococcus aureus subsp. aureus Mu50
ugcguuuaauuuac

SEQ ID NO: 2043887 - RNA, 16 nt, Staphylococcus aureus subsp. aureus Mu50
ugcguuuuuaaauaau

SEQ ID NO: 2043888 - RNA, 23 nt, Staphylococcus aureus subsp. aureus Mu50
ugcuaaacgcuaaaauuuccuca

SEQ ID NO: 2043889 - RNA, 17 nt, Staphylococcus aureus subsp. aureus Mu50
ugcuaaaaguauaaacc

SEQ ID NO: 2043890 - RNA, 20 nt, Staphylococcus aureus subsp. aureus Mu50
ugcuaauacuaaucaaagaa

SEQ ID NO: 2043891 - RNA, 16 nt, Staphylococcus aureus subsp. aureus Mu50
ugcuaauuuaacugcg

SEQ ID NO: 2043892 - RNA, 17 nt, Staphylococcus aureus subsp. aureus Mu50
ugcuacuauuaaauaau

SEQ ID NO: 2043893 - RNA, 15 nt, Staphylococcus aureus subsp. aureus Mu50
ugcuacaauuuccua

SEQ ID NO: 2043894 - RNA, 14 nt, Staphylococcus aureus subsp. aureus Mu50
ugcuaauucaagaa

SEQ ID NO: 2043895 - RNA, 16 nt, Staphylococcus aureus subsp. aureus Mu50
ugcuaauuuuuucauc

SEQ ID NO: 2043896 - RNA, 18 nt, Staphylococcus aureus subsp. aureus Mu50
ugcuaauuuuuucaucau

SEQ ID NO: 2043897 - RNA, 13 nt, Staphylococcus aureus subsp. aureus Mu50
ugcuacaauuucc

SEQ ID NO: 2043898 - RNA, 19 nt, Staphylococcus aureus subsp. aureus Mu50
ugcgugcuuaauuacaaua

SEQ ID NO: 2043899 - RNA, 19 nt, Staphylococcus aureus subsp. aureus Mu50
uggauaauuucuucuucug

SEQ ID NO: 2043900 - RNA, 13 nt, Staphylococcus aureus subsp. aureus Mu50
uggauaauugcau

SEQ ID NO: 2043901 - RNA, 22 nt, Staphylococcus aureus subsp. aureus Mu50
uggagaucuaacaauauauaau

SEQ ID NO: 2043902 - RNA, 18 nt, Staphylococcus aureus subsp. aureus Mu50
uggagaaccuuuaaaagu

SEQ ID NO: 2043903 - RNA, 20 nt, Staphylococcus aureus subsp. aureus Mu50
uggacuaauuuauuaauuuu

SEQ ID NO: 2043904 - RNA, 22 nt, Staphylococcus aureus subsp. aureus Mu50
uggauuuucucccauacugauu

SEQ ID NO: 2043905 - RNA, 14 nt, Staphylococcus aureus subsp. aureus Mu50
uggcaaaacaauau

SEQ ID NO: 2043906 - RNA, 21 nt, Staphylococcus aureus subsp. aureus Mu50
uggauuaucgaauuagauuua

SEQ ID NO: 2043907 - RNA, 14 nt, Staphylococcus aureus subsp. aureus Mu50
uggcacaaaugaau

SEQ ID NO: 2043908 - RNA, 15 nt, Staphylococcus aureus subsp. aureus Mu50
uggcaacguucuacu

SEQ ID NO: 2043909 - RNA, 18 nt, Staphylococcus aureus subsp. aureus Mu50
uggcaacggcacauucau

SEQ ID NO: 2043910 - RNA, 20 nt, Staphylococcus aureus subsp. aureus Mu50
ugccugcccuuuagucaugu

SEQ ID NO: 2043911 - RNA, 15 nt, Staphylococcus aureus subsp. aureus Mu50
aauaguaaagugaaa

SEQ ID NO: 2043912 - RNA, 20 nt, Staphylococcus aureus subsp. aureus Mu50
aauaguuuuucauauucaca

SEQ ID NO: 2043913 - RNA, 12 nt, Staphylococcus aureus subsp. aureus Mu50
aauaguucaaau

SEQ ID NO: 2043914 - RNA, 20 nt, Staphylococcus aureus subsp. aureus Mu50
aauagugucaucaccuuguu

SEQ ID NO: 2043915 - RNA, 19 nt, Staphylococcus aureus subsp. aureus Mu50
aauaguuaaaguagaaccu

SEQ ID NO: 2043916 - RNA, 14 nt, Staphylococcus aureus subsp. aureus Mu50
ugccuaaccuguuu

SEQ ID NO: 2043917 - RNA, 23 nt, Staphylococcus aureus subsp. aureus Mu50
aauagagacauuuuaucugaaaa

SEQ ID NO: 2043918 - RNA, 15 nt, Staphylococcus aureus subsp. aureus Mu50
aauagauaauauaua

SEQ ID NO: 2043919 - RNA, 13 nt, Staphylococcus aureus subsp. aureus Mu50
aauagaugagaaa

SEQ ID NO: 2043920 - RNA, 22 nt, Staphylococcus aureus subsp. aureus Mu50
aauagacugucucguuuuuuga

SEQ ID NO: 2043921 - RNA, 18 nt, Staphylococcus aureus subsp. aureus Mu50
uguccaacugcuuuuuau

SEQ ID NO: 2043922 - RNA, 12 nt, Staphylococcus aureus subsp. aureus Mu50
ugucauucuagu

SEQ ID NO: 2043923 - RNA, 15 nt, Staphylococcus aureus subsp. aureus Mu50
ugucaguuuuuuuau

SEQ ID NO: 2043924 - RNA, 14 nt, Staphylococcus aureus subsp. aureus Mu50
ugucauaccaaaua

SEQ ID NO: 2043925 - RNA, 14 nt, Staphylococcus aureus subsp. aureus Mu50
ugucauaccuuuua

SEQ ID NO: 2043926 - RNA, 21 nt, Staphylococcus aureus subsp. aureus Mu50
ugucauagccuauuuaaaaga

SEQ ID NO: 2043927 - RNA, 19 nt, Staphylococcus aureus subsp. aureus Mu50
uguauuagcaauuugguca

SEQ ID NO: 2043928 - RNA, 21 nt, Staphylococcus aureus subsp. aureus Mu50
uguauguuuuaucaauauuag

SEQ ID NO: 2043929 - RNA, 12 nt, Staphylococcus aureus subsp. aureus Mu50
uguauuaaacau

SEQ ID NO: 2043930 - RNA, 15 nt, Staphylococcus aureus subsp. aureus Mu50
uguauuuggcgcuuu

SEQ ID NO: 2043931 - RNA, 20 nt, Staphylococcus aureus subsp. aureus Mu50
uguauucagucaguaaaaau

SEQ ID NO: 2043932 - RNA, 17 nt, Staphylococcus aureus subsp. aureus Mu50
uguauuuaauaaaccag

SEQ ID NO: 2043933 - RNA, 12 nt, Staphylococcus aureus subsp. aureus Mu50
uguauaaauaac

SEQ ID NO: 2043934 - RNA, 22 nt, Staphylococcus aureus subsp. aureus Mu50
uguauaagcugaaaaucaucau

SEQ ID NO: 2043935 - RNA, 22 nt, Staphylococcus aureus subsp. aureus Mu50
uguauauauauguaaaugaaau

SEQ ID NO: 2043936 - RNA, 22 nt, Staphylococcus aureus subsp. aureus Mu50
uguaucaacauuaauaaauaau

SEQ ID NO: 2043937 - RNA, 21 nt, Staphylococcus aureus subsp. aureus Mu50
uguaucgauucgauuauuuag

SEQ ID NO: 2043938 - RNA, 16 nt, Staphylococcus aureus subsp. aureus Mu50
uguaucugauguugau

SEQ ID NO: 2043939 - RNA, 14 nt, Staphylococcus aureus subsp. aureus Mu50
uguaucuucaccau

SEQ ID NO: 2043940 - RNA, 23 nt, Staphylococcus aureus subsp. aureus Mu50
uguaagaacgaaacuuuaauuaa

SEQ ID NO: 2043941 - RNA, 11 nt, Staphylococcus aureus subsp. aureus Mu50
uguaacuguuu

SEQ ID NO: 2043942 - RNA, 18 nt, Staphylococcus aureus subsp. aureus Mu50
uguaacuuuaucacugua

SEQ ID NO: 2043943 - RNA, 14 nt, Staphylococcus aureus subsp. aureus Mu50
uguaacguacaauu

SEQ ID NO: 2043944 - RNA, 14 nt, Staphylococcus aureus subsp. aureus Mu50
uguaaccuaaaaac

SEQ ID NO: 2043945 - RNA, 16 nt, Staphylococcus aureus subsp. aureus Mu50
uguaaccuaaaaacaa

SEQ ID NO: 2043946 - RNA, 23 nt, Staphylococcus aureus subsp. aureus Mu50
aaucaauguucuaugcucuacaa

SEQ ID NO: 2043947 - RNA, 15 nt, Staphylococcus aureus subsp. aureus Mu50
uguaacauaaacaau

SEQ ID NO: 2043948 - RNA, 14 nt, Staphylococcus aureus subsp. aureus Mu50
uguaaccaaaagaa

SEQ ID NO: 2043949 - RNA, 23 nt, Staphylococcus aureus subsp. aureus Mu50
uguaacacacuuauaaucuauaa

SEQ ID NO: 2043950 - RNA, 18 nt, Staphylococcus aureus subsp. aureus Mu50
uguaacaagcuuuucauu

SEQ ID NO: 2043951 - RNA, 22 nt, Staphylococcus aureus subsp. aureus Mu50
uguaaagcuuuaguuaaauagu

SEQ ID NO: 2043952 - RNA, 23 nt, Staphylococcus aureus subsp. aureus Mu50
uguaaauaaaaauuauauaaauu

SEQ ID NO: 2043953 - RNA, 18 nt, Staphylococcus aureus subsp. aureus Mu50
uguaaaaccauagauaau

SEQ ID NO: 2043954 - RNA, 15 nt, Staphylococcus aureus subsp. aureus Mu50
uguaaaaccauagau

SEQ ID NO: 2043955 - RNA, 15 nt, Staphylococcus aureus subsp. aureus Mu50
ugguucaaaaaucau

SEQ ID NO: 2043956 - RNA, 15 nt, Staphylococcus aureus subsp. aureus Mu50
ugguuauuaaaauua

SEQ ID NO: 2043957 - RNA, 20 nt, Staphylococcus aureus subsp. aureus Mu50
uguccaucuuuuauuaaaga

SEQ ID NO: 2043958 - RNA, 14 nt, Staphylococcus aureus subsp. aureus Mu50
ugucccaaugcuga

SEQ ID NO: 2043959 - RNA, 16 nt, Staphylococcus aureus subsp. aureus Mu50
uguccgauuuuuuuac

SEQ ID NO: 2043960 - RNA, 22 nt, Staphylococcus aureus subsp. aureus Mu50
aaucaaagaaaaagugauaauu

SEQ ID NO: 2043961 - RNA, 18 nt, Staphylococcus aureus subsp. aureus Mu50
aauauuuuuuaaaaugau

SEQ ID NO: 2043962 - RNA, 13 nt, Staphylococcus aureus subsp. aureus Mu50
aaucaauaccaac

SEQ ID NO: 2043963 - RNA, 22 nt, Staphylococcus aureus subsp. aureus Mu50
ugguuaucacuuauuauuuugu

SEQ ID NO: 2043964 - RNA, 17 nt, Staphylococcus aureus subsp. aureus Mu50
uggucguacuuucaaau

SEQ ID NO: 2043965 - RNA, 15 nt, Staphylococcus aureus subsp. aureus Mu50
uggguauauaauuua

SEQ ID NO: 2043966 - RNA, 15 nt, Staphylococcus aureus subsp. aureus Mu50
ugguaacguuaauag

SEQ ID NO: 2043967 - RNA, 17 nt, Staphylococcus aureus subsp. aureus Mu50
ugguacaccuacaaaua

SEQ ID NO: 2043968 - RNA, 21 nt, Staphylococcus aureus subsp. aureus Mu50
ugggacgacgaaauaaauuuu

SEQ ID NO: 2043969 - RNA, 14 nt, Staphylococcus aureus subsp. aureus Mu50
ugggacgacgaaau

SEQ ID NO: 2043970 - RNA, 16 nt, Staphylococcus aureus subsp. aureus Mu50
uggcuugcuucauuau

SEQ ID NO: 2043971 - RNA, 16 nt, Staphylococcus aureus subsp. aureus Mu50
uggcguaaugauauua

SEQ ID NO: 2043972 - RNA, 19 nt, Staphylococcus aureus subsp. aureus Mu50
uggcuagucuuuaacuuua

SEQ ID NO: 2043973 - RNA, 17 nt, Staphylococcus aureus subsp. aureus Mu50
uggcucaaaacuuuuac

SEQ ID NO: 2043974 - RNA, 14 nt, Staphylococcus aureus subsp. aureus Mu50
uggcguucaacauu

SEQ ID NO: 2043975 - RNA, 17 nt, Staphylococcus aureus subsp. aureus Mu50
gugcauuguaauaccaa

SEQ ID NO: 2043976 - RNA, 22 nt, Staphylococcus aureus subsp. aureus Mu50
gugcauuuagaugauucuuauc

SEQ ID NO: 2043977 - RNA, 14 nt, Staphylococcus aureus subsp. aureus Mu50
guucacuugguaca

SEQ ID NO: 2043978 - RNA, 13 nt, Staphylococcus aureus subsp. aureus Mu50
guguuuucuuuuc

SEQ ID NO: 2043979 - RNA, 12 nt, Staphylococcus aureus subsp. aureus Mu50
guguuucuuuua

SEQ ID NO: 2043980 - RNA, 16 nt, Staphylococcus aureus subsp. aureus Mu50
guuacuuauauauuca

SEQ ID NO: 2043981 - RNA, 22 nt, Staphylococcus aureus subsp. aureus Mu50
guuacuuauauauucaauaauu

SEQ ID NO: 2043982 - RNA, 14 nt, Staphylococcus aureus subsp. aureus Mu50
guguuuaacuaaac

SEQ ID NO: 2043983 - RNA, 21 nt, Staphylococcus aureus subsp. aureus Mu50
guguguuuucuuuucaaaaua

SEQ ID NO: 2043984 - RNA, 22 nt, Staphylococcus aureus subsp. aureus Mu50
guuccccugaaaagaauaaguu

SEQ ID NO: 2043985 - RNA, 22 nt, Staphylococcus aureus subsp. aureus Mu50
guuccugcuacaacuucuucuc

SEQ ID NO: 2043986 - RNA, 14 nt, Staphylococcus aureus subsp. aureus Mu50
guucaucaacauga

SEQ ID NO: 2043987 - RNA, 13 nt, Staphylococcus aureus subsp. aureus Mu50
guucauaaugauc

SEQ ID NO: 2043988 - RNA, 17 nt, Staphylococcus aureus subsp. aureus Mu50
guucauuggcaauauac

SEQ ID NO: 2043989 - RNA, 17 nt, Staphylococcus aureus subsp. aureus Mu50
guuucuaaauucuuuuu

SEQ ID NO: 2043990 - RNA, 15 nt, Staphylococcus aureus subsp. aureus Mu50
guuguaaaacuaagu

SEQ ID NO: 2043991 - RNA, 22 nt, Staphylococcus aureus subsp. aureus Mu50
guugguuuaaaaauugauauug

SEQ ID NO: 2043992 - RNA, 13 nt, Staphylococcus aureus subsp. aureus Mu50
guugguuuaucag

SEQ ID NO: 2043993 - RNA, 24 nt, Staphylococcus aureus subsp. aureus Mu50
guuguaauuuaaaauaguucuuua

SEQ ID NO: 2043994 - RNA, 14 nt, Staphylococcus aureus subsp. aureus Mu50
guuuuaaucuuauu

SEQ ID NO: 2043995 - RNA, 13 nt, Staphylococcus aureus subsp. aureus Mu50
guuugcuuuuugu

SEQ ID NO: 2043996 - RNA, 19 nt, Staphylococcus aureus subsp. aureus Mu50
guuucuggcucuucuuauc

SEQ ID NO: 2043997 - RNA, 17 nt, Staphylococcus aureus subsp. aureus Mu50
guuucuuuacuucuuuc

SEQ ID NO: 2043998 - RNA, 15 nt, Staphylococcus aureus subsp. aureus Mu50
guuugaaaauuaacu

SEQ ID NO: 2043999 - RNA, 15 nt, Staphylococcus aureus subsp. aureus Mu50
guuugauucuaaaua

SEQ ID NO: 2044000 - RNA, 16 nt, Staphylococcus aureus subsp. aureus Mu50
guuugaguaaauuaau

SEQ ID NO: 2044001 - RNA, 18 nt, Staphylococcus aureus subsp. aureus Mu50
guuuugguuguucuuuuu

SEQ ID NO: 2044002 - RNA, 12 nt, Staphylococcus aureus subsp. aureus Mu50
guuuuuauuaug

SEQ ID NO: 2044003 - RNA, 17 nt, Staphylococcus aureus subsp. aureus Mu50
guuuuaccauaaauuga

SEQ ID NO: 2044004 - RNA, 20 nt, Staphylococcus aureus subsp. aureus Mu50
guuuuaccauaaauugaagu

SEQ ID NO: 2044005 - RNA, 14 nt, Staphylococcus aureus subsp. aureus Mu50
guuuuaccaucacg

SEQ ID NO: 2044006 - RNA, 22 nt, Staphylococcus aureus subsp. aureus Mu50
guuuuaccccuguugaauauac

SEQ ID NO: 2044007 - RNA, 20 nt, Staphylococcus aureus subsp. aureus Mu50
guuuuaaagacugaaccgua

SEQ ID NO: 2044008 - RNA, 18 nt, Staphylococcus aureus subsp. aureus Mu50
guuuuacuuucaccauuu

SEQ ID NO: 2044009 - RNA, 15 nt, Staphylococcus aureus subsp. aureus Mu50
guuuuauuaucuuug

SEQ ID NO: 2044010 - RNA, 21 nt, Staphylococcus aureus subsp. aureus Mu50
guuuguuucuaaauucuuuuu

SEQ ID NO: 2044011 - RNA, 23 nt, Staphylococcus aureus subsp. aureus Mu50
uaaaacacccugcuuaucauuac

SEQ ID NO: 2044012 - RNA, 21 nt, Staphylococcus aureus subsp. aureus Mu50
uaaaacauguugauaaaaagg

SEQ ID NO: 2044013 - RNA, 15 nt, Staphylococcus aureus subsp. aureus Mu50
uaaaauaguucuuua

SEQ ID NO: 2044014 - RNA, 18 nt, Staphylococcus aureus subsp. aureus Mu50
uaaaauagaaaaauuuca

SEQ ID NO: 2044015 - RNA, 17 nt, Staphylococcus aureus subsp. aureus Mu50
uaaaauaauuaaauaaa

SEQ ID NO: 2044016 - RNA, 18 nt, Staphylococcus aureus subsp. aureus Mu50
uaaaauaagauauauaau

SEQ ID NO: 2044017 - RNA, 17 nt, Staphylococcus aureus subsp. aureus Mu50
uaaaaucgcgucugauu

SEQ ID NO: 2044018 - RNA, 23 nt, Staphylococcus aureus subsp. aureus Mu50
uaaacauuuauauagauugccau

SEQ ID NO: 2044019 - RNA, 21 nt, Staphylococcus aureus subsp. aureus Mu50
uaaaaugaguugaagcuaauu

SEQ ID NO: 2044020 - RNA, 13 nt, Staphylococcus aureus subsp. aureus Mu50
uaaaaugcauagc

SEQ ID NO: 2044021 - RNA, 20 nt, Staphylococcus aureus subsp. aureus Mu50
uaaaaugcucccuucaaagu

SEQ ID NO: 2044022 - RNA, 16 nt, Staphylococcus aureus subsp. aureus Mu50
uaaaaucaucguauuu

SEQ ID NO: 2044023 - RNA, 14 nt, Staphylococcus aureus subsp. aureus Mu50
uaaaaucaucuuaa

SEQ ID NO: 2044024 - RNA, 14 nt, Staphylococcus aureus subsp. aureus Mu50
uaaaauauuauuuu

SEQ ID NO: 2044025 - RNA, 16 nt, Staphylococcus aureus subsp. aureus Mu50
uaaaauaguucuuuaa

SEQ ID NO: 2044026 - RNA, 21 nt, Staphylococcus aureus subsp. aureus Mu50
uaaaauaguucuuuaaauuau

SEQ ID NO: 2044027 - RNA, 23 nt, Staphylococcus aureus subsp. aureus Mu50
uaaaauauaucuuaugauacuuu

SEQ ID NO: 2044028 - RNA, 21 nt, Staphylococcus aureus subsp. aureus Mu50
uaaaaauacauaauaaaaagg

SEQ ID NO: 2044029 - RNA, 16 nt, Staphylococcus aureus subsp. aureus Mu50
uaaaaauacauuuugc

SEQ ID NO: 2044030 - RNA, 15 nt, Staphylococcus aureus subsp. aureus Mu50
uaaaaauauauuuca

SEQ ID NO: 2044031 - RNA, 14 nt, Staphylococcus aureus subsp. aureus Mu50
uaaaacaauaauuu

SEQ ID NO: 2044032 - RNA, 22 nt, Staphylococcus aureus subsp. aureus Mu50
uaaaacaaauucauauuaacug

SEQ ID NO: 2044033 - RNA, 18 nt, Staphylococcus aureus subsp. aureus Mu50
uaaaacaagacuacgaau

SEQ ID NO: 2044034 - RNA, 19 nt, Staphylococcus aureus subsp. aureus Mu50
uaaaaaucaaagaggcaca

SEQ ID NO: 2044035 - RNA, 15 nt, Staphylococcus aureus subsp. aureus Mu50
uaaaaagguacuaau

SEQ ID NO: 2044036 - RNA, 19 nt, Staphylococcus aureus subsp. aureus Mu50
uaaaaagaagaucccucaa

SEQ ID NO: 2044037 - RNA, 18 nt, Staphylococcus aureus subsp. aureus Mu50
uaaaaagagguuuucauu

SEQ ID NO: 2044038 - RNA, 13 nt, Staphylococcus aureus subsp. aureus Mu50
uaaaaaacauacc

SEQ ID NO: 2044039 - RNA, 13 nt, Staphylococcus aureus subsp. aureus Mu50
uaaaaaauaacuc

SEQ ID NO: 2044040 - RNA, 19 nt, Staphylococcus aureus subsp. aureus Mu50
uaaaaaauacucccuucaa

SEQ ID NO: 2044041 - RNA, 22 nt, Staphylococcus aureus subsp. aureus Mu50
uaaaaacgucucuauagcaaca

SEQ ID NO: 2044042 - RNA, 20 nt, Staphylococcus aureus subsp. aureus Mu50
uaaaaaccuauucccaaaau

SEQ ID NO: 2044043 - RNA, 14 nt, Staphylococcus aureus subsp. aureus Mu50
uaaaaacgauucau

SEQ ID NO: 2044044 - RNA, 15 nt, Staphylococcus aureus subsp. aureus Mu50
uaaaaaccaauauuu

SEQ ID NO: 2044045 - RNA, 17 nt, Staphylococcus aureus subsp. aureus Mu50
guugaccuuguucuuuc

SEQ ID NO: 2044046 - RNA, 18 nt, Staphylococcus aureus subsp. aureus Mu50
guugauaguuguaucauu

SEQ ID NO: 2044047 - RNA, 14 nt, Staphylococcus aureus subsp. aureus Mu50
guugauaaauaaac

SEQ ID NO: 2044048 - RNA, 15 nt, Staphylococcus aureus subsp. aureus Mu50
guugauaaauggaaa

SEQ ID NO: 2044049 - RNA, 19 nt, Staphylococcus aureus subsp. aureus Mu50
guugauaauagccauucga

SEQ ID NO: 2044050 - RNA, 14 nt, Staphylococcus aureus subsp. aureus Mu50
guugcaguuucaau

SEQ ID NO: 2044051 - RNA, 17 nt, Staphylococcus aureus subsp. aureus Mu50
guugcacaaauugcaau

SEQ ID NO: 2044052 - RNA, 15 nt, Staphylococcus aureus subsp. aureus Mu50
uacaugaaucaacaa

SEQ ID NO: 2044053 - RNA, 20 nt, Staphylococcus aureus subsp. aureus Mu50
uacaugaaucaacaauuuaa

SEQ ID NO: 2044054 - RNA, 19 nt, Staphylococcus aureus subsp. aureus Mu50
uacaugacauucauuuagu

SEQ ID NO: 2044055 - RNA, 20 nt, Staphylococcus aureus subsp. aureus Mu50
uacaugaacaaauaauuuac

SEQ ID NO: 2044056 - RNA, 13 nt, Staphylococcus aureus subsp. aureus Mu50
uacauuucaaaaa

SEQ ID NO: 2044057 - RNA, 17 nt, Staphylococcus aureus subsp. aureus Mu50
uacauugauaaaauaau

SEQ ID NO: 2044058 - RNA, 21 nt, Staphylococcus aureus subsp. aureus Mu50
uacauugauaaaauaaucggu

SEQ ID NO: 2044059 - RNA, 16 nt, Staphylococcus aureus subsp. aureus Mu50
uacaugugggauaucu

SEQ ID NO: 2044060 - RNA, 21 nt, Staphylococcus aureus subsp. aureus Mu50
uacauuaaaacaauaauuuaa

SEQ ID NO: 2044061 - RNA, 19 nt, Staphylococcus aureus subsp. aureus Mu50
uacauuaauauaaauauca

SEQ ID NO: 2044062 - RNA, 23 nt, Staphylococcus aureus subsp. aureus Mu50
uacauuacgcucaucaccuuuua

SEQ ID NO: 2044063 - RNA, 17 nt, Staphylococcus aureus subsp. aureus Mu50
uacauuauuaaauagau

SEQ ID NO: 2044064 - RNA, 13 nt, Staphylococcus aureus subsp. aureus Mu50
uacaucaauuucu

SEQ ID NO: 2044065 - RNA, 15 nt, Staphylococcus aureus subsp. aureus Mu50
uacaucauuaaauau

SEQ ID NO: 2044066 - RNA, 23 nt, Staphylococcus aureus subsp. aureus Mu50
uacauagguucaucuuuaugcaa

SEQ ID NO: 2044067 - RNA, 14 nt, Staphylococcus aureus subsp. aureus Mu50
uacauauaagaauu

SEQ ID NO: 2044068 - RNA, 18 nt, Staphylococcus aureus subsp. aureus Mu50
uaccaaccaaaaccaaau

SEQ ID NO: 2044069 - RNA, 18 nt, Staphylococcus aureus subsp. aureus Mu50
uacaugcaccuuuacaac

SEQ ID NO: 2044070 - RNA, 18 nt, Staphylococcus aureus subsp. aureus Mu50
uaccaauacguuuccaau

SEQ ID NO: 2044071 - RNA, 13 nt, Staphylococcus aureus subsp. aureus Mu50
uaccaauugauuu

SEQ ID NO: 2044072 - RNA, 15 nt, Staphylococcus aureus subsp. aureus Mu50
uaccaauuagcauga

SEQ ID NO: 2044073 - RNA, 16 nt, Staphylococcus aureus subsp. aureus Mu50
uacagauaauuauuuc

SEQ ID NO: 2044074 - RNA, 22 nt, Staphylococcus aureus subsp. aureus Mu50
uacagauuuuaaaaauucauaa

SEQ ID NO: 2044075 - RNA, 21 nt, Staphylococcus aureus subsp. aureus Mu50
uacagaugaugcuucgcauca

SEQ ID NO: 2044076 - RNA, 14 nt, Staphylococcus aureus subsp. aureus Mu50
uacacuaucguuuu

SEQ ID NO: 2044077 - RNA, 22 nt, Staphylococcus aureus subsp. aureus Mu50
uacacuaaaaccuauuccuaau

SEQ ID NO: 2044078 - RNA, 13 nt, Staphylococcus aureus subsp. aureus Mu50
uacacuugauuau

SEQ ID NO: 2044079 - RNA, 21 nt, Staphylococcus aureus subsp. aureus Mu50
uacacuugauuaucauuguuc

SEQ ID NO: 2044080 - RNA, 20 nt, Staphylococcus aureus subsp. aureus Mu50
uacacuuuuugacauauuuu

SEQ ID NO: 2044081 - RNA, 19 nt, Staphylococcus aureus subsp. aureus Mu50
uacagaaccaacaauaaau

SEQ ID NO: 2044082 - RNA, 22 nt, Staphylococcus aureus subsp. aureus Mu50
uacagcacgagacaauaaugca

SEQ ID NO: 2044083 - RNA, 20 nt, Staphylococcus aureus subsp. aureus Mu50
uacauaauuuaucaauuucu

SEQ ID NO: 2044084 - RNA, 17 nt, Staphylococcus aureus subsp. aureus Mu50
uacauaacccuaaaaug

SEQ ID NO: 2044085 - RNA, 19 nt, Staphylococcus aureus subsp. aureus Mu50
uacauaacccuaaaaugaa

SEQ ID NO: 2044086 - RNA, 16 nt, Staphylococcus aureus subsp. aureus Mu50
uacaccauaaauguaa

SEQ ID NO: 2044087 - RNA, 21 nt, Staphylococcus aureus subsp. aureus Mu50
uacacaucgaucuaaauauau

SEQ ID NO: 2044088 - RNA, 17 nt, Staphylococcus aureus subsp. aureus Mu50
uacaauuuuccuuccaa

SEQ ID NO: 2044089 - RNA, 16 nt, Staphylococcus aureus subsp. aureus Mu50
uacaccuacaaauauu

SEQ ID NO: 2044090 - RNA, 23 nt, Staphylococcus aureus subsp. aureus Mu50
uacaccuuuggcaccaguacuuu

SEQ ID NO: 2044091 - RNA, 16 nt, Staphylococcus aureus subsp. aureus Mu50
uacaauauucaauaau

SEQ ID NO: 2044092 - RNA, 17 nt, Staphylococcus aureus subsp. aureus Mu50
uacaauauucaauaauu

SEQ ID NO: 2044093 - RNA, 18 nt, Staphylococcus aureus subsp. aureus Mu50
uacaaguuuauaaucuuu

SEQ ID NO: 2044094 - RNA, 21 nt, Staphylococcus aureus subsp. aureus Mu50
uacaaguugaucaaaaauguu

SEQ ID NO: 2044095 - RNA, 15 nt, Staphylococcus aureus subsp. aureus Mu50
uacaauaaugugcaa

SEQ ID NO: 2044096 - RNA, 17 nt, Staphylococcus aureus subsp. aureus Mu50
uacaagucuuauuuguu

SEQ ID NO: 2044097 - RNA, 20 nt, Staphylococcus aureus subsp. aureus Mu50
uacaagucuuuacucuacac

SEQ ID NO: 2044098 - RNA, 18 nt, Staphylococcus aureus subsp. aureus Mu50
uacaaauguauaaauaau

SEQ ID NO: 2044099 - RNA, 15 nt, Staphylococcus aureus subsp. aureus Mu50
uacaaauuauaaauu

SEQ ID NO: 2044100 - RNA, 13 nt, Staphylococcus aureus subsp. aureus Mu50
uacaaauugauuu

SEQ ID NO: 2044101 - RNA, 17 nt, Staphylococcus aureus subsp. aureus Mu50
uacaacauagaauaacg

SEQ ID NO: 2044102 - RNA, 14 nt, Staphylococcus aureus subsp. aureus Mu50
uacaacauguguau

SEQ ID NO: 2044103 - RNA, 20 nt, Staphylococcus aureus subsp. aureus Mu50
uacaacuguuggaauaccuu

SEQ ID NO: 2044104 - RNA, 19 nt, Staphylococcus aureus subsp. aureus Mu50
uacaacuguuggaauaccu

SEQ ID NO: 2044105 - RNA, 14 nt, Staphylococcus aureus subsp. aureus Mu50
uaaugguuucauaa

SEQ ID NO: 2044106 - RNA, 23 nt, Staphylococcus aureus subsp. aureus Mu50
uaaugucuucauaaucguauuca

SEQ ID NO: 2044107 - RNA, 13 nt, Staphylococcus aureus subsp. aureus Mu50
uaaugugaaaaau

SEQ ID NO: 2044108 - RNA, 22 nt, Staphylococcus aureus subsp. aureus Mu50
uaaugugcgucacucacuucaa

SEQ ID NO: 2044109 - RNA, 19 nt, Staphylococcus aureus subsp. aureus Mu50
uaauguaaaguugauaaug

SEQ ID NO: 2044110 - RNA, 13 nt, Staphylococcus aureus subsp. aureus Mu50
uaauguaaucauu

SEQ ID NO: 2044111 - RNA, 16 nt, Staphylococcus aureus subsp. aureus Mu50
uaauguacauguauaa

SEQ ID NO: 2044112 - RNA, 13 nt, Staphylococcus aureus subsp. aureus Mu50
uaauguacuucaa

SEQ ID NO: 2044113 - RNA, 13 nt, Staphylococcus aureus subsp. aureus Mu50
uaauguaucauuu

SEQ ID NO: 2044114 - RNA, 14 nt, Staphylococcus aureus subsp. aureus Mu50
uaauguauuaauug

SEQ ID NO: 2044115 - RNA, 22 nt, Staphylococcus aureus subsp. aureus Mu50
uaaucaagaauauaagugauuu

SEQ ID NO: 2044116 - RNA, 14 nt, Staphylococcus aureus subsp. aureus Mu50
uaaugguucauagu

SEQ ID NO: 2044117 - RNA, 21 nt, Staphylococcus aureus subsp. aureus Mu50
uaaucagugaaauaucaagau

SEQ ID NO: 2044118 - RNA, 19 nt, Staphylococcus aureus subsp. aureus Mu50
uaaucagugaaauaucaag

SEQ ID NO: 2044119 - RNA, 15 nt, Staphylococcus aureus subsp. aureus Mu50
uaaucauaaugaaua

SEQ ID NO: 2044120 - RNA, 15 nt, Staphylococcus aureus subsp. aureus Mu50
uaaucauagcauuaa

SEQ ID NO: 2044121 - RNA, 22 nt, Staphylococcus aureus subsp. aureus Mu50
uaauuuaguaucuauacaauua

SEQ ID NO: 2044122 - RNA, 19 nt, Staphylococcus aureus subsp. aureus Mu50
uaauuuagucauuacaaau

SEQ ID NO: 2044123 - RNA, 14 nt, Staphylococcus aureus subsp. aureus Mu50
uaauuucaccagua

SEQ ID NO: 2044124 - RNA, 17 nt, Staphylococcus aureus subsp. aureus Mu50
uaauuucuaugaaaaaa

SEQ ID NO: 2044125 - RNA, 19 nt, Staphylococcus aureus subsp. aureus Mu50
uacaaaguuaaccauacau

SEQ ID NO: 2044126 - RNA, 17 nt, Staphylococcus aureus subsp. aureus Mu50
uaauuucauguucauaa

SEQ ID NO: 2044127 - RNA, 18 nt, Staphylococcus aureus subsp. aureus Mu50
uaauuuccuaaaaacugu

SEQ ID NO: 2044128 - RNA, 16 nt, Staphylococcus aureus subsp. aureus Mu50
uacaaaguuuauacuu

SEQ ID NO: 2044129 - RNA, 13 nt, Staphylococcus aureus subsp. aureus Mu50
uacaaauauacuu

SEQ ID NO: 2044130 - RNA, 23 nt, Staphylococcus aureus subsp. aureus Mu50
uacaaauauuucuaaaccauuuu

SEQ ID NO: 2044131 - RNA, 21 nt, Staphylococcus aureus subsp. aureus Mu50
uaauugguucuucuuucauag

SEQ ID NO: 2044132 - RNA, 14 nt, Staphylococcus aureus subsp. aureus Mu50
uaauuguuaaauca

SEQ ID NO: 2044133 - RNA, 15 nt, Staphylococcus aureus subsp. aureus Mu50
uaauuuaucuuaauc

SEQ ID NO: 2044134 - RNA, 16 nt, Staphylococcus aureus subsp. aureus Mu50
uaauuguuuugagaua

SEQ ID NO: 2044135 - RNA, 23 nt, Staphylococcus aureus subsp. aureus Mu50
uaauuuaaaagauuagaugauau

SEQ ID NO: 2044136 - RNA, 21 nt, Staphylococcus aureus subsp. aureus Mu50
uaauuuaaaauaguucuuuaa

SEQ ID NO: 2044137 - RNA, 17 nt, Staphylococcus aureus subsp. aureus Mu50
uaauuuacucaaaccau

SEQ ID NO: 2044138 - RNA, 19 nt, Staphylococcus aureus subsp. aureus Mu50
uaauuaauaaaaaaaucac

SEQ ID NO: 2044139 - RNA, 20 nt, Staphylococcus aureus subsp. aureus Mu50
uaauucguuuuacuacuguc

SEQ ID NO: 2044140 - RNA, 14 nt, Staphylococcus aureus subsp. aureus Mu50
uaauucuucaucaa

SEQ ID NO: 2044141 - RNA, 13 nt, Staphylococcus aureus subsp. aureus Mu50
uaauucugaaauc

SEQ ID NO: 2044142 - RNA, 12 nt, Staphylococcus aureus subsp. aureus Mu50
uaauuaaauaaa

SEQ ID NO: 2044143 - RNA, 14 nt, Staphylococcus aureus subsp. aureus Mu50
uaauuaaauaacuu

SEQ ID NO: 2044144 - RNA, 22 nt, Staphylococcus aureus subsp. aureus Mu50
uaauuaaauauaaagacgauuu

SEQ ID NO: 2044145 - RNA, 20 nt, Staphylococcus aureus subsp. aureus Mu50
uaauuaaaacaugacaacuu

SEQ ID NO: 2044146 - RNA, 19 nt, Staphylococcus aureus subsp. aureus Mu50
uaauguuuuagugacaaac

SEQ ID NO: 2044147 - RNA, 14 nt, Staphylococcus aureus subsp. aureus Mu50
uaauugaucagcau

SEQ ID NO: 2044148 - RNA, 23 nt, Staphylococcus aureus subsp. aureus Mu50
uaauugauauggaucauaaucau

SEQ ID NO: 2044149 - RNA, 17 nt, Staphylococcus aureus subsp. aureus Mu50
uaauacuuuucucgauu

SEQ ID NO: 2044150 - RNA, 18 nt, Staphylococcus aureus subsp. aureus Mu50
uaauagccauucgaugcu

SEQ ID NO: 2044151 - RNA, 17 nt, Staphylococcus aureus subsp. aureus Mu50
uaauaguguuauauugu

SEQ ID NO: 2044152 - RNA, 18 nt, Staphylococcus aureus subsp. aureus Mu50
uaauaucacgaucuuuaa

SEQ ID NO: 2044153 - RNA, 16 nt, Staphylococcus aureus subsp. aureus Mu50
uaauaucaauuuuuac

SEQ ID NO: 2044154 - RNA, 14 nt, Staphylococcus aureus subsp. aureus Mu50
uaauauauaaaagu

SEQ ID NO: 2044155 - RNA, 22 nt, Staphylococcus aureus subsp. aureus Mu50
uaauaucaugcacaauauucgu

SEQ ID NO: 2044156 - RNA, 22 nt, Staphylococcus aureus subsp. aureus Mu50
uaauaucuuacuacuuaauuaa

SEQ ID NO: 2044157 - RNA, 23 nt, Staphylococcus aureus subsp. aureus Mu50
uaauaucuuacuacuuaauuaau

SEQ ID NO: 2044158 - RNA, 23 nt, Staphylococcus aureus subsp. aureus Mu50
uaauaugaauuuagaugcauaaa

SEQ ID NO: 2044159 - RNA, 18 nt, Staphylococcus aureus subsp. aureus Mu50
uaauauuagauaucuuaa

SEQ ID NO: 2044160 - RNA, 13 nt, Staphylococcus aureus subsp. aureus Mu50
uaauauuauaagu

SEQ ID NO: 2044161 - RNA, 22 nt, Staphylococcus aureus subsp. aureus Mu50
uaauauugaugaauaaauagau

SEQ ID NO: 2044162 - RNA, 23 nt, Staphylococcus aureus subsp. aureus Mu50
uaauauucuuucguuuucaucaa

SEQ ID NO: 2044163 - RNA, 12 nt, Staphylococcus aureus subsp. aureus Mu50
uaauauuguuaa

SEQ ID NO: 2044164 - RNA, 19 nt, Staphylococcus aureus subsp. aureus Mu50
uaauauuuagauacugaau

SEQ ID NO: 2044165 - RNA, 22 nt, Staphylococcus aureus subsp. aureus Mu50
uaauauuuuaaacguaucauuu

SEQ ID NO: 2044166 - RNA, 15 nt, Staphylococcus aureus subsp. aureus Mu50
uaaguaaauaauagu

SEQ ID NO: 2044167 - RNA, 22 nt, Staphylococcus aureus subsp. aureus Mu50
uaaguaaccaagucuaacaguu

SEQ ID NO: 2044168 - RNA, 21 nt, Staphylococcus aureus subsp. aureus Mu50
uaaguaguuguuauauucuag

SEQ ID NO: 2044169 - RNA, 15 nt, Staphylococcus aureus subsp. aureus Mu50
uaaguacuuuuacaa

SEQ ID NO: 2044170 - RNA, 16 nt, Staphylococcus aureus subsp. aureus Mu50
uaaguagaugauuagu

SEQ ID NO: 2044171 - RNA, 18 nt, Staphylococcus aureus subsp. aureus Mu50
uaaguacagcauauaaug

SEQ ID NO: 2044172 - RNA, 14 nt, Staphylococcus aureus subsp. aureus Mu50
uaaguacauaaaug

SEQ ID NO: 2044173 - RNA, 18 nt, Staphylococcus aureus subsp. aureus Mu50
uaaguaauucauuugcuu

SEQ ID NO: 2044174 - RNA, 15 nt, Staphylococcus aureus subsp. aureus Mu50
uaaguaauaauuuau

SEQ ID NO: 2044175 - RNA, 19 nt, Staphylococcus aureus subsp. aureus Mu50
uaaguaauagcaaccauau

SEQ ID NO: 2044176 - RNA, 18 nt, Staphylococcus aureus subsp. aureus Mu50
uaaguaaucauaauaauc

SEQ ID NO: 2044177 - RNA, 19 nt, Staphylococcus aureus subsp. aureus Mu50
uaaguaucgccaucauuca

SEQ ID NO: 2044178 - RNA, 21 nt, Staphylococcus aureus subsp. aureus Mu50
uaaguaucggugauuuaauug

SEQ ID NO: 2044179 - RNA, 19 nt, Staphylococcus aureus subsp. aureus Mu50
uaagucuaauguuggaaaa

SEQ ID NO: 2044180 - RNA, 13 nt, Staphylococcus aureus subsp. aureus Mu50
uaaguauaauuaa

SEQ ID NO: 2044181 - RNA, 22 nt, Staphylococcus aureus subsp. aureus Mu50
uaagugauuucuucauuaucaa

SEQ ID NO: 2044182 - RNA, 19 nt, Staphylococcus aureus subsp. aureus Mu50
uaagugauaaauaaugcau

SEQ ID NO: 2044183 - RNA, 24 nt, Staphylococcus aureus subsp. aureus Mu50
uaaguguuuuauagauucauguaa

SEQ ID NO: 2044184 - RNA, 15 nt, Staphylococcus aureus subsp. aureus Mu50
uaaguuaaugugcau

SEQ ID NO: 2044185 - RNA, 13 nt, Staphylococcus aureus subsp. aureus Mu50
uaaguuaauuuau

SEQ ID NO: 2044186 - RNA, 19 nt, Staphylococcus aureus subsp. aureus Mu50
uaacuuacuauuuguuaug

SEQ ID NO: 2044187 - RNA, 21 nt, Staphylococcus aureus subsp. aureus Mu50
uaacuuauauacguugauuaa

SEQ ID NO: 2044188 - RNA, 15 nt, Staphylococcus aureus subsp. aureus Mu50
uaacuuacuuuugua

SEQ ID NO: 2044189 - RNA, 19 nt, Staphylococcus aureus subsp. aureus Mu50
uaacuuccuaaaauuuaca

SEQ ID NO: 2044190 - RNA, 19 nt, Staphylococcus aureus subsp. aureus Mu50
uaacuacacuuaauauauu

SEQ ID NO: 2044191 - RNA, 14 nt, Staphylococcus aureus subsp. aureus Mu50
uaacuauaaauaga

SEQ ID NO: 2044192 - RNA, 14 nt, Staphylococcus aureus subsp. aureus Mu50
uaacuauggucauc

SEQ ID NO: 2044193 - RNA, 24 nt, Staphylococcus aureus subsp. aureus Mu50
uaacugaauuaaagcaucgaacaa

SEQ ID NO: 2044194 - RNA, 17 nt, Staphylococcus aureus subsp. aureus Mu50
uaacuauguuacuuaua

SEQ ID NO: 2044195 - RNA, 15 nt, Staphylococcus aureus subsp. aureus Mu50
uaacuguaaaacauu

SEQ ID NO: 2044196 - RNA, 18 nt, Staphylococcus aureus subsp. aureus Mu50
uaacccacauuaaauauu

SEQ ID NO: 2044197 - RNA, 15 nt, Staphylococcus aureus subsp. aureus Mu50
uaacguacaauguau

SEQ ID NO: 2044198 - RNA, 22 nt, Staphylococcus aureus subsp. aureus Mu50
uaacguauagaugcuaauguaa

SEQ ID NO: 2044199 - RNA, 15 nt, Staphylococcus aureus subsp. aureus Mu50
uaacguucacuuggu

SEQ ID NO: 2044200 - RNA, 15 nt, Staphylococcus aureus subsp. aureus Mu50
uaacuacacuuaaua

SEQ ID NO: 2044201 - RNA, 15 nt, Staphylococcus aureus subsp. aureus Mu50
uaacguuucuuugua

SEQ ID NO: 2044202 - RNA, 14 nt, Staphylococcus aureus subsp. aureus Mu50
uaaccauaaugaac

SEQ ID NO: 2044203 - RNA, 20 nt, Staphylococcus aureus subsp. aureus Mu50
uaaccagugcaacuacgaua

SEQ ID NO: 2044204 - RNA, 23 nt, Staphylococcus aureus subsp. aureus Mu50
uaaccauuucaucauaauugaug

SEQ ID NO: 2044205 - RNA, 13 nt, Staphylococcus aureus subsp. aureus Mu50
uaacauaaaauga

SEQ ID NO: 2044206 - RNA, 13 nt, Staphylococcus aureus subsp. aureus Mu50
uaacauaaacaau

SEQ ID NO: 2044207 - RNA, 20 nt, Staphylococcus aureus subsp. aureus Mu50
uaacauacuauaaaaauuua

SEQ ID NO: 2044208 - RNA, 13 nt, Staphylococcus aureus subsp. aureus Mu50
uaacauaauuuuu

SEQ ID NO: 2044209 - RNA, 20 nt, Staphylococcus aureus subsp. aureus Mu50
uaacaguuguaaucauuggu

SEQ ID NO: 2044210 - RNA, 10 nt, Staphylococcus aureus subsp. aureus Mu50
uaacauguuu

SEQ ID NO: 2044211 - RNA, 21 nt, Staphylococcus aureus subsp. aureus Mu50
uaacauccugcuuauuaauug

SEQ ID NO: 2044212 - RNA, 16 nt, Staphylococcus aureus subsp. aureus Mu50
uaaacgcuaaaauuuc

SEQ ID NO: 2044213 - RNA, 19 nt, Staphylococcus aureus subsp. aureus Mu50
uaacagcuuaauuuuauua

SEQ ID NO: 2044214 - RNA, 17 nt, Staphylococcus aureus subsp. aureus Mu50
uaaaccagcuaaaccau

SEQ ID NO: 2044215 - RNA, 15 nt, Staphylococcus aureus subsp. aureus Mu50
uccaaguuaaugcac

SEQ ID NO: 2044216 - RNA, 20 nt, Staphylococcus aureus subsp. aureus Mu50
uccaauaaauuguggagauc

SEQ ID NO: 2044217 - RNA, 17 nt, Staphylococcus aureus subsp. aureus Mu50
ucauuuuuucaaugucu

SEQ ID NO: 2044218 - RNA, 12 nt, Staphylococcus aureus subsp. aureus Mu50
uccaaaaagguu

SEQ ID NO: 2044219 - RNA, 20 nt, Staphylococcus aureus subsp. aureus Mu50
ucauuuuucguuguucauaa

SEQ ID NO: 2044220 - RNA, 13 nt, Staphylococcus aureus subsp. aureus Mu50
ucauuuugauuaa

SEQ ID NO: 2044221 - RNA, 21 nt, Staphylococcus aureus subsp. aureus Mu50
ucauuuuuaucccacuccuua

SEQ ID NO: 2044222 - RNA, 15 nt, Staphylococcus aureus subsp. aureus Mu50
ucauuuuauaaauca

SEQ ID NO: 2044223 - RNA, 13 nt, Staphylococcus aureus subsp. aureus Mu50
ucauuguaauaau

SEQ ID NO: 2044224 - RNA, 23 nt, Staphylococcus aureus subsp. aureus Mu50
ucauuguuucagcugcaauuuua

SEQ ID NO: 2044225 - RNA, 15 nt, Staphylococcus aureus subsp. aureus Mu50
ucauuuaaaaaucaa

SEQ ID NO: 2044226 - RNA, 18 nt, Staphylococcus aureus subsp. aureus Mu50
ucauuguguauuguuuua

SEQ ID NO: 2044227 - RNA, 13 nt, Staphylococcus aureus subsp. aureus Mu50
ucauugaucgauu

SEQ ID NO: 2044228 - RNA, 13 nt, Staphylococcus aureus subsp. aureus Mu50
ucauugaugaugu

SEQ ID NO: 2044229 - RNA, 19 nt, Staphylococcus aureus subsp. aureus Mu50
ucauuugacauaucaugaa

SEQ ID NO: 2044230 - RNA, 17 nt, Staphylococcus aureus subsp. aureus Mu50
ucauuucccuuaaauca

SEQ ID NO: 2044231 - RNA, 18 nt, Staphylococcus aureus subsp. aureus Mu50
ucauuugauuuaaaaagu

SEQ ID NO: 2044232 - RNA, 17 nt, Staphylococcus aureus subsp. aureus Mu50
ucauuuguauuaauuug

SEQ ID NO: 2044233 - RNA, 15 nt, Staphylococcus aureus subsp. aureus Mu50
ucauuuguguaaaug

SEQ ID NO: 2044234 - RNA, 18 nt, Staphylococcus aureus subsp. aureus Mu50
ucauuuguguuuuuaaug

SEQ ID NO: 2044235 - RNA, 22 nt, Staphylococcus aureus subsp. aureus Mu50
ucauuucaauauuaaaauacgg

SEQ ID NO: 2044236 - RNA, 20 nt, Staphylococcus aureus subsp. aureus Mu50
ucauuuaaaauauuuuuucu

SEQ ID NO: 2044237 - RNA, 12 nt, Staphylococcus aureus subsp. aureus Mu50
ucauuuaaauau

SEQ ID NO: 2044238 - RNA, 20 nt, Staphylococcus aureus subsp. aureus Mu50
ucauuucugucccacuccca

SEQ ID NO: 2044239 - RNA, 20 nt, Staphylococcus aureus subsp. aureus Mu50
ucauuucugucccacucccu

SEQ ID NO: 2044240 - RNA, 12 nt, Staphylococcus aureus subsp. aureus Mu50
ucauucaccuug

SEQ ID NO: 2044241 - RNA, 18 nt, Staphylococcus aureus subsp. aureus Mu50
ucauuauuuagaauucua

SEQ ID NO: 2044242 - RNA, 19 nt, Staphylococcus aureus subsp. aureus Mu50
ucauuauuugauaaauaaa

SEQ ID NO: 2044243 - RNA, 17 nt, Staphylococcus aureus subsp. aureus Mu50
ucauucaaacuccuuuc

SEQ ID NO: 2044244 - RNA, 20 nt, Staphylococcus aureus subsp. aureus Mu50
ucauucaauuuaguucacca

SEQ ID NO: 2044245 - RNA, 16 nt, Staphylococcus aureus subsp. aureus Mu50
ucauucacaaugauug

SEQ ID NO: 2044246 - RNA, 19 nt, Staphylococcus aureus subsp. aureus Mu50
ucauuauaucgucguaacu

SEQ ID NO: 2044247 - RNA, 15 nt, Staphylococcus aureus subsp. aureus Mu50
ucauuaaguacuuuu

SEQ ID NO: 2044248 - RNA, 16 nt, Staphylococcus aureus subsp. aureus Mu50
ucauuacaaagucugu

SEQ ID NO: 2044249 - RNA, 19 nt, Staphylococcus aureus subsp. aureus Mu50
ucauuaauaggauuauuau

SEQ ID NO: 2044250 - RNA, 19 nt, Staphylococcus aureus subsp. aureus Mu50
ucauguuccccauuaauua

SEQ ID NO: 2044251 - RNA, 12 nt, Staphylococcus aureus subsp. aureus Mu50
ucauguuugauu

SEQ ID NO: 2044252 - RNA, 17 nt, Staphylococcus aureus subsp. aureus Mu50
ucauguucuaaugauau

SEQ ID NO: 2044253 - RNA, 19 nt, Staphylococcus aureus subsp. aureus Mu50
ucaucuucaaacagacuua

SEQ ID NO: 2044254 - RNA, 22 nt, Staphylococcus aureus subsp. aureus Mu50
ucauguauauggcaucaucacc

SEQ ID NO: 2044255 - RNA, 14 nt, Staphylococcus aureus subsp. aureus Mu50
ucauguauugucca

SEQ ID NO: 2044256 - RNA, 17 nt, Staphylococcus aureus subsp. aureus Mu50
ucaugugucauaaucca

SEQ ID NO: 2044257 - RNA, 23 nt, Staphylococcus aureus subsp. aureus Mu50
ucaugucuagauuuuaaaucaau

SEQ ID NO: 2044258 - RNA, 17 nt, Staphylococcus aureus subsp. aureus Mu50
ucaucuucuaaaucaau

SEQ ID NO: 2044259 - RNA, 20 nt, Staphylococcus aureus subsp. aureus Mu50
ucaucuuagacgcuguuuua

SEQ ID NO: 2044260 - RNA, 15 nt, Staphylococcus aureus subsp. aureus Mu50
ucaugggcaguaauu

SEQ ID NO: 2044261 - RNA, 23 nt, Staphylococcus aureus subsp. aureus Mu50
ucaucuuuaugcaaaauuaauga

SEQ ID NO: 2044262 - RNA, 14 nt, Staphylococcus aureus subsp. aureus Mu50
ucaucuugagauuu

SEQ ID NO: 2044263 - RNA, 13 nt, Staphylococcus aureus subsp. aureus Mu50
ucaucauuuucaa

SEQ ID NO: 2044264 - RNA, 16 nt, Staphylococcus aureus subsp. aureus Mu50
ucaucaugacuauuuc

SEQ ID NO: 2044265 - RNA, 16 nt, Staphylococcus aureus subsp. aureus Mu50
ucaucauuaaaucuga

SEQ ID NO: 2044266 - RNA, 17 nt, Staphylococcus aureus subsp. aureus Mu50
ucaucgaacaugaauga

SEQ ID NO: 2044267 - RNA, 22 nt, Staphylococcus aureus subsp. aureus Mu50
ucaucgaacaugaaugauauug

SEQ ID NO: 2044268 - RNA, 16 nt, Staphylococcus aureus subsp. aureus Mu50
ucaucgaguuuguuuc

SEQ ID NO: 2044269 - RNA, 17 nt, Staphylococcus aureus subsp. aureus Mu50
ucaucgucucacuuaau

SEQ ID NO: 2044270 - RNA, 18 nt, Staphylococcus aureus subsp. aureus Mu50
ucaucuauucaacugauu

SEQ ID NO: 2044271 - RNA, 20 nt, Staphylococcus aureus subsp. aureus Mu50
ucauagaugacgaucuauaa

SEQ ID NO: 2044272 - RNA, 21 nt, Staphylococcus aureus subsp. aureus Mu50
ucauauauugacucgaccuuu

SEQ ID NO: 2044273 - RNA, 15 nt, Staphylococcus aureus subsp. aureus Mu50
ucauaguuaucgauu

SEQ ID NO: 2044274 - RNA, 17 nt, Staphylococcus aureus subsp. aureus Mu50
ucauauaugucucucuu

SEQ ID NO: 2044275 - RNA, 13 nt, Staphylococcus aureus subsp. aureus Mu50
ucauaccuuuuaa

SEQ ID NO: 2044276 - RNA, 18 nt, Staphylococcus aureus subsp. aureus Mu50
ucauacgagaaauuagaa

SEQ ID NO: 2044277 - RNA, 14 nt, Staphylococcus aureus subsp. aureus Mu50
ucauaaugaauaau

SEQ ID NO: 2044278 - RNA, 18 nt, Staphylococcus aureus subsp. aureus Mu50
ucauaccaaauaaauaag

SEQ ID NO: 2044279 - RNA, 14 nt, Staphylococcus aureus subsp. aureus Mu50
ucauaauagauaau

SEQ ID NO: 2044280 - RNA, 15 nt, Staphylococcus aureus subsp. aureus Mu50
ucauaauauugauga

SEQ ID NO: 2044281 - RNA, 18 nt, Staphylococcus aureus subsp. aureus Mu50
ucauaaugaacgauauuc

SEQ ID NO: 2044282 - RNA, 23 nt, Staphylococcus aureus subsp. aureus Mu50
ucauaauuaucauauaaaucaaa

SEQ ID NO: 2044283 - RNA, 15 nt, Staphylococcus aureus subsp. aureus Mu50
ucauaauuuaaaaga

SEQ ID NO: 2044284 - RNA, 18 nt, Staphylococcus aureus subsp. aureus Mu50
ucauaaaauuuaaaacaa

SEQ ID NO: 2044285 - RNA, 15 nt, Staphylococcus aureus subsp. aureus Mu50
ucauaaauauaaaau

SEQ ID NO: 2044286 - RNA, 16 nt, Staphylococcus aureus subsp. aureus Mu50
ucauaaaugacgucuc

SEQ ID NO: 2044287 - RNA, 13 nt, Staphylococcus aureus subsp. aureus Mu50
ucauaaauguuau

SEQ ID NO: 2044288 - RNA, 18 nt, Staphylococcus aureus subsp. aureus Mu50
ucauaaacugaaucgauu

SEQ ID NO: 2044289 - RNA, 20 nt, Staphylococcus aureus subsp. aureus Mu50
ucauaaagauaagaugguuu

SEQ ID NO: 2044290 - RNA, 15 nt, Staphylococcus aureus subsp. aureus Mu50
ucauaaagugcguuu

SEQ ID NO: 2044291 - RNA, 19 nt, Staphylococcus aureus subsp. aureus Mu50
ucauaaccgcuucuuuuaa

SEQ ID NO: 2044292 - RNA, 18 nt, Staphylococcus aureus subsp. aureus Mu50
uccauaguggaauacuug

SEQ ID NO: 2044293 - RNA, 22 nt, Staphylococcus aureus subsp. aureus Mu50
uccaugaguuuacuaaacuuuu

SEQ ID NO: 2044294 - RNA, 22 nt, Staphylococcus aureus subsp. aureus Mu50
uccauuagaacuaagaugugca

SEQ ID NO: 2044295 - RNA, 16 nt, Staphylococcus aureus subsp. aureus Mu50
uccauuuaauuuguua

SEQ ID NO: 2044296 - RNA, 23 nt, Staphylococcus aureus subsp. aureus Mu50
uccaguccuuuuuuuauguuuaa

SEQ ID NO: 2044297 - RNA, 21 nt, Staphylococcus aureus subsp. aureus Mu50
uccaguuuuugguagcauuuu

SEQ ID NO: 2044298 - RNA, 20 nt, Staphylococcus aureus subsp. aureus Mu50
uccaaugaaucguucgaagu

SEQ ID NO: 2044299 - RNA, 15 nt, Staphylococcus aureus subsp. aureus Mu50
uccaauuaaauauuu

SEQ ID NO: 2044300 - RNA, 12 nt, Staphylococcus aureus subsp. aureus Mu50
uccaauuccaau

SEQ ID NO: 2044301 - RNA, 15 nt, Staphylococcus aureus subsp. aureus Mu50
uccaauuccaauaaa

SEQ ID NO: 2044302 - RNA, 17 nt, Staphylococcus aureus subsp. aureus Mu50
uccaauuuaaaaugauu

SEQ ID NO: 2044303 - RNA, 17 nt, Staphylococcus aureus subsp. aureus Mu50
uccagaguuaaagucau

SEQ ID NO: 2044304 - RNA, 16 nt, Staphylococcus aureus subsp. aureus Mu50
aauaauuccaguauua

SEQ ID NO: 2044305 - RNA, 23 nt, Staphylococcus aureus subsp. aureus Mu50
aauaauuagauuuaaaaugucau

SEQ ID NO: 2044306 - RNA, 18 nt, Staphylococcus aureus subsp. aureus Mu50
ucagaugauuuaauucug

SEQ ID NO: 2044307 - RNA, 20 nt, Staphylococcus aureus subsp. aureus Mu50
aauaauuaaauaaaaauauu

SEQ ID NO: 2044308 - RNA, 18 nt, Staphylococcus aureus subsp. aureus Mu50
aauaaugugaaaaaucuu

SEQ ID NO: 2044309 - RNA, 22 nt, Staphylococcus aureus subsp. aureus Mu50
aauaaugccaccguggaauuua

SEQ ID NO: 2044310 - RNA, 14 nt, Staphylococcus aureus subsp. aureus Mu50
aauaauggcaauua

SEQ ID NO: 2044311 - RNA, 15 nt, Staphylococcus aureus subsp. aureus Mu50
aauaaugacaaauua

SEQ ID NO: 2044312 - RNA, 15 nt, Staphylococcus aureus subsp. aureus Mu50
aauaaugauauauua

SEQ ID NO: 2044313 - RNA, 16 nt, Staphylococcus aureus subsp. aureus Mu50
ucaggaauagauguca

SEQ ID NO: 2044314 - RNA, 16 nt, Staphylococcus aureus subsp. aureus Mu50
ucagcuuuuucauuca

SEQ ID NO: 2044315 - RNA, 21 nt, Staphylococcus aureus subsp. aureus Mu50
ucagcuuuggcgacauaaaua

SEQ ID NO: 2044316 - RNA, 13 nt, Staphylococcus aureus subsp. aureus Mu50
ucaccuuguaaau

SEQ ID NO: 2044317 - RNA, 12 nt, Staphylococcus aureus subsp. aureus Mu50
ucacgauuaaua

SEQ ID NO: 2044318 - RNA, 20 nt, Staphylococcus aureus subsp. aureus Mu50
ucacaaguuuacagguugaa

SEQ ID NO: 2044319 - RNA, 22 nt, Staphylococcus aureus subsp. aureus Mu50
ucacaaugaccauugucaugcc

SEQ ID NO: 2044320 - RNA, 19 nt, Staphylococcus aureus subsp. aureus Mu50
ucacaauauaacaucaaau

SEQ ID NO: 2044321 - RNA, 20 nt, Staphylococcus aureus subsp. aureus Mu50
ucacaaucauagauauaaga

SEQ ID NO: 2044322 - RNA, 23 nt, Staphylococcus aureus subsp. aureus Mu50
ucacaaauuugaauauacuuaau

SEQ ID NO: 2044323 - RNA, 19 nt, Staphylococcus aureus subsp. aureus Mu50
aauaacacgauuugguuga

SEQ ID NO: 2044324 - RNA, 13 nt, Staphylococcus aureus subsp. aureus Mu50
aauaacaucuaaa

SEQ ID NO: 2044325 - RNA, 13 nt, Staphylococcus aureus subsp. aureus Mu50
aauaacauugaac

SEQ ID NO: 2044326 - RNA, 23 nt, Staphylococcus aureus subsp. aureus Mu50
aauaaccacuuugaauugguuga

SEQ ID NO: 2044327 - RNA, 15 nt, Staphylococcus aureus subsp. aureus Mu50
aauaacuguuuauca

SEQ ID NO: 2044328 - RNA, 18 nt, Staphylococcus aureus subsp. aureus Mu50
aauaacuguuuaucauga

SEQ ID NO: 2044329 - RNA, 14 nt, Staphylococcus aureus subsp. aureus Mu50
aauaacugcuaauu

SEQ ID NO: 2044330 - RNA, 22 nt, Staphylococcus aureus subsp. aureus Mu50
aauaacguacauuuaugauugu

SEQ ID NO: 2044331 - RNA, 20 nt, Staphylococcus aureus subsp. aureus Mu50
aauaacuagaacaagaauua

SEQ ID NO: 2044332 - RNA, 20 nt, Staphylococcus aureus subsp. aureus Mu50
aauaaccuuuaaaacaucau

SEQ ID NO: 2044333 - RNA, 20 nt, Staphylococcus aureus subsp. aureus Mu50
aauaagaugaaauauucuuu

SEQ ID NO: 2044334 - RNA, 12 nt, Staphylococcus aureus subsp. aureus Mu50
aauaagauuauu

SEQ ID NO: 2044335 - RNA, 12 nt, Staphylococcus aureus subsp. aureus Mu50
ucacguuaucau

SEQ ID NO: 2044336 - RNA, 14 nt, Staphylococcus aureus subsp. aureus Mu50
aauaagauuuuuua

SEQ ID NO: 2044337 - RNA, 13 nt, Staphylococcus aureus subsp. aureus Mu50
aauaagcuacuaa

SEQ ID NO: 2044338 - RNA, 15 nt, Staphylococcus aureus subsp. aureus Mu50
aauaagcuacuaagc

SEQ ID NO: 2044339 - RNA, 17 nt, Staphylococcus aureus subsp. aureus Mu50
aauaaucaaaccaccaa

SEQ ID NO: 2044340 - RNA, 17 nt, Staphylococcus aureus subsp. aureus Mu50
aauaaucgcccaucucu

SEQ ID NO: 2044341 - RNA, 14 nt, Staphylococcus aureus subsp. aureus Mu50
aauaaguuaaugug

SEQ ID NO: 2044342 - RNA, 21 nt, Staphylococcus aureus subsp. aureus Mu50
aauaaguuaaugugcauuuau

SEQ ID NO: 2044343 - RNA, 15 nt, Staphylococcus aureus subsp. aureus Mu50
aauaaguugaauaua

SEQ ID NO: 2044344 - RNA, 16 nt, Staphylococcus aureus subsp. aureus Mu50
aauaauaauugcuuua

SEQ ID NO: 2044345 - RNA, 15 nt, Staphylococcus aureus subsp. aureus Mu50
ucacuucaaacaaag

SEQ ID NO: 2044346 - RNA, 23 nt, Staphylococcus aureus subsp. aureus Mu50
ucacuucuuacugaucguaacau

SEQ ID NO: 2044347 - RNA, 21 nt, Staphylococcus aureus subsp. aureus Mu50
ucacuucuaaaacuaaaggua

SEQ ID NO: 2044348 - RNA, 13 nt, Staphylococcus aureus subsp. aureus Mu50
ucacuauauuuca

SEQ ID NO: 2044349 - RNA, 18 nt, Staphylococcus aureus subsp. aureus Mu50
ucacuaggauguucauca

SEQ ID NO: 2044350 - RNA, 14 nt, Staphylococcus aureus subsp. aureus Mu50
ucacuaauauuucu

SEQ ID NO: 2044351 - RNA, 18 nt, Staphylococcus aureus subsp. aureus Mu50
ucacuaaucucgguacau

SEQ ID NO: 2044352 - RNA, 15 nt, Staphylococcus aureus subsp. aureus Mu50
ucacuacuuuuucaa

SEQ ID NO: 2044353 - RNA, 16 nt, Staphylococcus aureus subsp. aureus Mu50
uaugacuuaccuaaua

SEQ ID NO: 2044354 - RNA, 18 nt, Staphylococcus aureus subsp. aureus Mu50
uaugacuuuuuauuagua

SEQ ID NO: 2044355 - RNA, 18 nt, Staphylococcus aureus subsp. aureus Mu50
uaugagcuuaauaaauug

SEQ ID NO: 2044356 - RNA, 21 nt, Staphylococcus aureus subsp. aureus Mu50
uaugaguccuuuuuaguaguu

SEQ ID NO: 2044357 - RNA, 22 nt, Staphylococcus aureus subsp. aureus Mu50
uaugaguccuuuuuaguaguuu

SEQ ID NO: 2044358 - RNA, 19 nt, Staphylococcus aureus subsp. aureus Mu50
uaugauaauuaauuaaaau

SEQ ID NO: 2044359 - RNA, 22 nt, Staphylococcus aureus subsp. aureus Mu50
uaugauacgcuuuuuaaaaaau

SEQ ID NO: 2044360 - RNA, 23 nt, Staphylococcus aureus subsp. aureus Mu50
uaugauacgcuuuuuaaaaaauu

SEQ ID NO: 2044361 - RNA, 20 nt, Staphylococcus aureus subsp. aureus Mu50
uaugaauuuagcaucaaaaa

SEQ ID NO: 2044362 - RNA, 21 nt, Staphylococcus aureus subsp. aureus Mu50
uaugaauuuguuuuaguaaug

SEQ ID NO: 2044363 - RNA, 20 nt, Staphylococcus aureus subsp. aureus Mu50
uaugaauuuuauaaauuaaa

SEQ ID NO: 2044364 - RNA, 19 nt, Staphylococcus aureus subsp. aureus Mu50
uaugaagugaaaucauuua

SEQ ID NO: 2044365 - RNA, 12 nt, Staphylococcus aureus subsp. aureus Mu50
uaugaauaaguc

SEQ ID NO: 2044366 - RNA, 19 nt, Staphylococcus aureus subsp. aureus Mu50
uaugaauaauguuuucauu

SEQ ID NO: 2044367 - RNA, 17 nt, Staphylococcus aureus subsp. aureus Mu50
uaugaaucgauauaaug

SEQ ID NO: 2044368 - RNA, 17 nt, Staphylococcus aureus subsp. aureus Mu50
uaugaaauauuuaucuu

SEQ ID NO: 2044369 - RNA, 14 nt, Staphylococcus aureus subsp. aureus Mu50
uaugaaauuucagu

SEQ ID NO: 2044370 - RNA, 20 nt, Staphylococcus aureus subsp. aureus Mu50
uaugaaauuucaguaucaug

SEQ ID NO: 2044371 - RNA, 13 nt, Staphylococcus aureus subsp. aureus Mu50
uaugaaaaguaaa

SEQ ID NO: 2044372 - RNA, 23 nt, Staphylococcus aureus subsp. aureus Mu50
uaugaaaacauuauuaagugagu

SEQ ID NO: 2044373 - RNA, 18 nt, Staphylococcus aureus subsp. aureus Mu50
uaugaaaagagaaacaaa

SEQ ID NO: 2044374 - RNA, 16 nt, Staphylococcus aureus subsp. aureus Mu50
uaucuucacacuuuua

SEQ ID NO: 2044375 - RNA, 12 nt, Staphylococcus aureus subsp. aureus Mu50
uaucuguuguua

SEQ ID NO: 2044376 - RNA, 14 nt, Staphylococcus aureus subsp. aureus Mu50
uaucuauaaaaaga

SEQ ID NO: 2044377 - RNA, 13 nt, Staphylococcus aureus subsp. aureus Mu50
uaucuauaugcau

SEQ ID NO: 2044378 - RNA, 23 nt, Staphylococcus aureus subsp. aureus Mu50
uaucucuaccauuucaaccuuuu

SEQ ID NO: 2044379 - RNA, 20 nt, Staphylococcus aureus subsp. aureus Mu50
uaucucugaaaaacuucuua

SEQ ID NO: 2044380 - RNA, 18 nt, Staphylococcus aureus subsp. aureus Mu50
uaucugacauuguugcua

SEQ ID NO: 2044381 - RNA, 14 nt, Staphylococcus aureus subsp. aureus Mu50
uaucugcuuuucua

SEQ ID NO: 2044382 - RNA, 21 nt, Staphylococcus aureus subsp. aureus Mu50
uaucugacauuucaucaauaa

SEQ ID NO: 2044383 - RNA, 22 nt, Staphylococcus aureus subsp. aureus Mu50
uaucugacauuucaucaauaau

SEQ ID NO: 2044384 - RNA, 15 nt, Staphylococcus aureus subsp. aureus Mu50
uaucguuuauugaua

SEQ ID NO: 2044385 - RNA, 18 nt, Staphylococcus aureus subsp. aureus Mu50
uaucguuguaccacccca

SEQ ID NO: 2044386 - RNA, 20 nt, Staphylococcus aureus subsp. aureus Mu50
uaucguuguaccaccccaac

SEQ ID NO: 2044387 - RNA, 17 nt, Staphylococcus aureus subsp. aureus Mu50
uaucuacagagaaucaa

SEQ ID NO: 2044388 - RNA, 18 nt, Staphylococcus aureus subsp. aureus Mu50
uaucuacagagaaucaau

SEQ ID NO: 2044389 - RNA, 15 nt, Staphylococcus aureus subsp. aureus Mu50
uaucgucgcuaauaa

SEQ ID NO: 2044390 - RNA, 12 nt, Staphylococcus aureus subsp. aureus Mu50
uaugcauuauag

SEQ ID NO: 2044391 - RNA, 23 nt, Staphylococcus aureus subsp. aureus Mu50
uauguguuguguaucaguuauuu

SEQ ID NO: 2044392 - RNA, 16 nt, Staphylococcus aureus subsp. aureus Mu50
uauguuuuaugauuuu

SEQ ID NO: 2044393 - RNA, 22 nt, Staphylococcus aureus subsp. aureus Mu50
uauguuuuaugauuuucuuuaa

SEQ ID NO: 2044394 - RNA, 16 nt, Staphylococcus aureus subsp. aureus Mu50
uauguuuaaacauuuu

SEQ ID NO: 2044395 - RNA, 20 nt, Staphylococcus aureus subsp. aureus Mu50
uauuaaaaauuucaauaaug

SEQ ID NO: 2044396 - RNA, 16 nt, Staphylococcus aureus subsp. aureus Mu50
uauuaaaauuaaaacu

SEQ ID NO: 2044397 - RNA, 17 nt, Staphylococcus aureus subsp. aureus Mu50
uauuaaaggaaaucaau

SEQ ID NO: 2044398 - RNA, 23 nt, Staphylococcus aureus subsp. aureus Mu50
uauuaaaguaaaauauacuugaa

SEQ ID NO: 2044399 - RNA, 23 nt, Staphylococcus aureus subsp. aureus Mu50
uaugauccuuuaaugcuuuagca

SEQ ID NO: 2044400 - RNA, 18 nt, Staphylococcus aureus subsp. aureus Mu50
uaugauuguuuaagaaug

SEQ ID NO: 2044401 - RNA, 12 nt, Staphylococcus aureus subsp. aureus Mu50
uaugauguucaa

SEQ ID NO: 2044402 - RNA, 21 nt, Staphylococcus aureus subsp. aureus Mu50
uaugauuuucuuuaauaacua

SEQ ID NO: 2044403 - RNA, 19 nt, Staphylococcus aureus subsp. aureus Mu50
uaugcaucaguuaauaauu

SEQ ID NO: 2044404 - RNA, 13 nt, Staphylococcus aureus subsp. aureus Mu50
uauuaaacccaau

SEQ ID NO: 2044405 - RNA, 20 nt, Staphylococcus aureus subsp. aureus Mu50
uauuaaauuuguguucaaau

SEQ ID NO: 2044406 - RNA, 18 nt, Staphylococcus aureus subsp. aureus Mu50
uauguuuaauuugauuaa

SEQ ID NO: 2044407 - RNA, 22 nt, Staphylococcus aureus subsp. aureus Mu50
uauuaacaccagauaucauaau

SEQ ID NO: 2044408 - RNA, 23 nt, Staphylococcus aureus subsp. aureus Mu50
uauuaacaccagauaucauaaua

SEQ ID NO: 2044409 - RNA, 21 nt, Staphylococcus aureus subsp. aureus Mu50
uauuaaggucauuuuuaauug

SEQ ID NO: 2044410 - RNA, 20 nt, Staphylococcus aureus subsp. aureus Mu50
uauuaagacugauuaauuau

SEQ ID NO: 2044411 - RNA, 19 nt, Staphylococcus aureus subsp. aureus Mu50
uauuacugauuguuaacga

SEQ ID NO: 2044412 - RNA, 19 nt, Staphylococcus aureus subsp. aureus Mu50
uauuacuuuggaaauuuau

SEQ ID NO: 2044413 - RNA, 22 nt, Staphylococcus aureus subsp. aureus Mu50
uauuacuuuggaaauuuauuau

SEQ ID NO: 2044414 - RNA, 23 nt, Staphylococcus aureus subsp. aureus Mu50
uauuacuuuggaaauuuauuaua

SEQ ID NO: 2044415 - RNA, 21 nt, Staphylococcus aureus subsp. aureus Mu50
uauuacaaacauuccucuauu

SEQ ID NO: 2044416 - RNA, 13 nt, Staphylococcus aureus subsp. aureus Mu50
uauuacaaugaaa

SEQ ID NO: 2044417 - RNA, 17 nt, Staphylococcus aureus subsp. aureus Mu50
uauuaauauaaaauaaa

SEQ ID NO: 2044418 - RNA, 22 nt, Staphylococcus aureus subsp. aureus Mu50
uauuaaugcucuauauauccau

SEQ ID NO: 2044419 - RNA, 16 nt, Staphylococcus aureus subsp. aureus Mu50
uauuaauuaaaaaauu

SEQ ID NO: 2044420 - RNA, 18 nt, Staphylococcus aureus subsp. aureus Mu50
uauuauccucaaauauau

SEQ ID NO: 2044421 - RNA, 21 nt, Staphylococcus aureus subsp. aureus Mu50
uauuaucgaagaaacauuaua

SEQ ID NO: 2044422 - RNA, 18 nt, Staphylococcus aureus subsp. aureus Mu50
uauuaugauugcuuauuu

SEQ ID NO: 2044423 - RNA, 18 nt, Staphylococcus aureus subsp. aureus Mu50
uauuaugccauucauuaa

SEQ ID NO: 2044424 - RNA, 21 nt, Staphylococcus aureus subsp. aureus Mu50
uauuaaucauaaugaauaauu

SEQ ID NO: 2044425 - RNA, 12 nt, Staphylococcus aureus subsp. aureus Mu50
uauuaucauuaa

SEQ ID NO: 2044426 - RNA, 14 nt, Staphylococcus aureus subsp. aureus Mu50
uauuauucauaaua

SEQ ID NO: 2044427 - RNA, 14 nt, Staphylococcus aureus subsp. aureus Mu50
uauuauucuuuaua

SEQ ID NO: 2044428 - RNA, 15 nt, Staphylococcus aureus subsp. aureus Mu50
uauuauuuaaauuuu

SEQ ID NO: 2044429 - RNA, 15 nt, Staphylococcus aureus subsp. aureus Mu50
uauuauuuaaucuau

SEQ ID NO: 2044430 - RNA, 14 nt, Staphylococcus aureus subsp. aureus Mu50
uauuauuucauuag

SEQ ID NO: 2044431 - RNA, 20 nt, Staphylococcus aureus subsp. aureus Mu50
uauuagauaucuuaaucuaa

SEQ ID NO: 2044432 - RNA, 17 nt, Staphylococcus aureus subsp. aureus Mu50
uauuagccaauaaaaug

SEQ ID NO: 2044433 - RNA, 18 nt, Staphylococcus aureus subsp. aureus Mu50
uauuagccaauaaaaugu

SEQ ID NO: 2044434 - RNA, 20 nt, Staphylococcus aureus subsp. aureus Mu50
uauuaggcuuaaauauaaug

SEQ ID NO: 2044435 - RNA, 15 nt, Staphylococcus aureus subsp. aureus Mu50
uauuauaauuguuca

SEQ ID NO: 2044436 - RNA, 18 nt, Staphylococcus aureus subsp. aureus Mu50
uauuauagggcuguuuuu

SEQ ID NO: 2044437 - RNA, 21 nt, Staphylococcus aureus subsp. aureus Mu50
uauaccucuuagcacuuggau

SEQ ID NO: 2044438 - RNA, 17 nt, Staphylococcus aureus subsp. aureus Mu50
uauagaaccuauuuuuu

SEQ ID NO: 2044439 - RNA, 22 nt, Staphylococcus aureus subsp. aureus Mu50
uauaauugcauagcuaaauaaa

SEQ ID NO: 2044440 - RNA, 22 nt, Staphylococcus aureus subsp. aureus Mu50
uauacauaacccuaaaaugaau

SEQ ID NO: 2044441 - RNA, 23 nt, Staphylococcus aureus subsp. aureus Mu50
uauacauaacccuaaaaugaaua

SEQ ID NO: 2044442 - RNA, 19 nt, Staphylococcus aureus subsp. aureus Mu50
uauauagucuaugaauaau

SEQ ID NO: 2044443 - RNA, 17 nt, Staphylococcus aureus subsp. aureus Mu50
uauauaucacaacacau

SEQ ID NO: 2044444 - RNA, 14 nt, Staphylococcus aureus subsp. aureus Mu50
uauauauuaaaaca

SEQ ID NO: 2044445 - RNA, 16 nt, Staphylococcus aureus subsp. aureus Mu50
uauauauuaaaguaaa

SEQ ID NO: 2044446 - RNA, 20 nt, Staphylococcus aureus subsp. aureus Mu50
uauaucacaacacauaaauu

SEQ ID NO: 2044447 - RNA, 15 nt, Staphylococcus aureus subsp. aureus Mu50
uauaucaucucuaug

SEQ ID NO: 2044448 - RNA, 16 nt, Staphylococcus aureus subsp. aureus Mu50
uauauccgcaucuuuu

SEQ ID NO: 2044449 - RNA, 17 nt, Staphylococcus aureus subsp. aureus Mu50
uauaucgacaccauuua

SEQ ID NO: 2044450 - RNA, 19 nt, Staphylococcus aureus subsp. aureus Mu50
uauauggcaucaucaccau

SEQ ID NO: 2044451 - RNA, 13 nt, Staphylococcus aureus subsp. aureus Mu50
uauauucaacuua

SEQ ID NO: 2044452 - RNA, 13 nt, Staphylococcus aureus subsp. aureus Mu50
uauauguaacaua

SEQ ID NO: 2044453 - RNA, 19 nt, Staphylococcus aureus subsp. aureus Mu50
uauauguauaacauuauua

SEQ ID NO: 2044454 - RNA, 18 nt, Staphylococcus aureus subsp. aureus Mu50
uauauguuuuaugauuuu

SEQ ID NO: 2044455 - RNA, 13 nt, Staphylococcus aureus subsp. aureus Mu50
uauauuaaauacu

SEQ ID NO: 2044456 - RNA, 16 nt, Staphylococcus aureus subsp. aureus Mu50
uauauuaacaacuuua

SEQ ID NO: 2044457 - RNA, 17 nt, Staphylococcus aureus subsp. aureus Mu50
uauauuaaucguuaaug

SEQ ID NO: 2044458 - RNA, 19 nt, Staphylococcus aureus subsp. aureus Mu50
uauaauuucaguaggacau

SEQ ID NO: 2044459 - RNA, 18 nt, Staphylococcus aureus subsp. aureus Mu50
uauaauuuuaauuauuuu

SEQ ID NO: 2044460 - RNA, 16 nt, Staphylococcus aureus subsp. aureus Mu50
uauacacuuacaaaua

SEQ ID NO: 2044461 - RNA, 19 nt, Staphylococcus aureus subsp. aureus Mu50
uagguaucuuaaagcauau

SEQ ID NO: 2044462 - RNA, 12 nt, Staphylococcus aureus subsp. aureus Mu50
uauaauuaaacu

SEQ ID NO: 2044463 - RNA, 15 nt, Staphylococcus aureus subsp. aureus Mu50
uauaauuaaacuaau

SEQ ID NO: 2044464 - RNA, 12 nt, Staphylococcus aureus subsp. aureus Mu50
uauaauugauug

SEQ ID NO: 2044465 - RNA, 15 nt, Staphylococcus aureus subsp. aureus Mu50
uagguaacuaaaaug

SEQ ID NO: 2044466 - RNA, 18 nt, Staphylococcus aureus subsp. aureus Mu50
uagguaacuaaaaugucu

SEQ ID NO: 2044467 - RNA, 19 nt, Staphylococcus aureus subsp. aureus Mu50
uagguauaguguuugacaa

SEQ ID NO: 2044468 - RNA, 14 nt, Staphylococcus aureus subsp. aureus Mu50
uauccauaacugua

SEQ ID NO: 2044469 - RNA, 15 nt, Staphylococcus aureus subsp. aureus Mu50
uaucacuaucagcuu

SEQ ID NO: 2044470 - RNA, 16 nt, Staphylococcus aureus subsp. aureus Mu50
uauauucaacuuauua

SEQ ID NO: 2044471 - RNA, 17 nt, Staphylococcus aureus subsp. aureus Mu50
uauauugcaaaaauaau

SEQ ID NO: 2044472 - RNA, 16 nt, Staphylococcus aureus subsp. aureus Mu50
uauauuuaacaucaau

SEQ ID NO: 2044473 - RNA, 17 nt, Staphylococcus aureus subsp. aureus Mu50
uauauuuguauaugcaa

SEQ ID NO: 2044474 - RNA, 16 nt, Staphylococcus aureus subsp. aureus Mu50
uauauuuuaguucaca

SEQ ID NO: 2044475 - RNA, 17 nt, Staphylococcus aureus subsp. aureus Mu50
uaucagcuuuaauaaua

SEQ ID NO: 2044476 - RNA, 23 nt, Staphylococcus aureus subsp. aureus Mu50
uaucaguccgcuuuuucauagaa

SEQ ID NO: 2044477 - RNA, 17 nt, Staphylococcus aureus subsp. aureus Mu50
uaucauauaaaucaaau

SEQ ID NO: 2044478 - RNA, 15 nt, Staphylococcus aureus subsp. aureus Mu50
uaucauauucaaaau

SEQ ID NO: 2044479 - RNA, 18 nt, Staphylococcus aureus subsp. aureus Mu50
uaucauaccaaaaaguau

SEQ ID NO: 2044480 - RNA, 22 nt, Staphylococcus aureus subsp. aureus Mu50
uaucauaccgacaccuauacau

SEQ ID NO: 2044481 - RNA, 22 nt, Staphylococcus aureus subsp. aureus Mu50
ucaaugacugagaaaaauauuu

SEQ ID NO: 2044482 - RNA, 18 nt, Staphylococcus aureus subsp. aureus Mu50
ucaaucgcauuuuguuuc

SEQ ID NO: 2044483 - RNA, 23 nt, Staphylococcus aureus subsp. aureus Mu50
ucaaucccuuuuagcauaauuag

SEQ ID NO: 2044484 - RNA, 16 nt, Staphylococcus aureus subsp. aureus Mu50
ucaauauuuaaauuuu

SEQ ID NO: 2044485 - RNA, 21 nt, Staphylococcus aureus subsp. aureus Mu50
ucaauauuuauauuaaauacu

SEQ ID NO: 2044486 - RNA, 23 nt, Staphylococcus aureus subsp. aureus Mu50
ucaauaugauccuuuaaugcuuu

SEQ ID NO: 2044487 - RNA, 17 nt, Staphylococcus aureus subsp. aureus Mu50
ucaaucacuauauuuca

SEQ ID NO: 2044488 - RNA, 23 nt, Staphylococcus aureus subsp. aureus Mu50
ucaauauuugaacgagcaccuuu

SEQ ID NO: 2044489 - RNA, 22 nt, Staphylococcus aureus subsp. aureus Mu50
ucaaucaacgagucauaaauau

SEQ ID NO: 2044490 - RNA, 21 nt, Staphylococcus aureus subsp. aureus Mu50
ucaauauuaaucauaaugaau

SEQ ID NO: 2044491 - RNA, 15 nt, Staphylococcus aureus subsp. aureus Mu50
ucaauagaugaaaau

SEQ ID NO: 2044492 - RNA, 19 nt, Staphylococcus aureus subsp. aureus Mu50
ucaauagcgguuuaaaaau

SEQ ID NO: 2044493 - RNA, 21 nt, Staphylococcus aureus subsp. aureus Mu50
ucaauaucuguagcgauaccu

SEQ ID NO: 2044494 - RNA, 18 nt, Staphylococcus aureus subsp. aureus Mu50
ucaauaucuucuucuaac

SEQ ID NO: 2044495 - RNA, 21 nt, Staphylococcus aureus subsp. aureus Mu50
ucaauauaaccgugaugaugu

SEQ ID NO: 2044496 - RNA, 18 nt, Staphylococcus aureus subsp. aureus Mu50
ucaaugauuuuuaaaaau

SEQ ID NO: 2044497 - RNA, 19 nt, Staphylococcus aureus subsp. aureus Mu50
ucaaugauuuuuaaaaaua

SEQ ID NO: 2044498 - RNA, 22 nt, Staphylococcus aureus subsp. aureus Mu50
ucaauguaauuuucacuuucaa

SEQ ID NO: 2044499 - RNA, 13 nt, Staphylococcus aureus subsp. aureus Mu50
ucaauguaucaag

SEQ ID NO: 2044500 - RNA, 24 nt, Staphylococcus aureus subsp. aureus Mu50
ucaauuaaucggaucauuauuuag

SEQ ID NO: 2044501 - RNA, 19 nt, Staphylococcus aureus subsp. aureus Mu50
ucaauuauugaaaacaaaa

SEQ ID NO: 2044502 - RNA, 19 nt, Staphylococcus aureus subsp. aureus Mu50
ucaauuuuuacuaaaucau

SEQ ID NO: 2044503 - RNA, 17 nt, Staphylococcus aureus subsp. aureus Mu50
ucaauuucuguaauaau

SEQ ID NO: 2044504 - RNA, 17 nt, Staphylococcus aureus subsp. aureus Mu50
ucaauugacauuaauga

SEQ ID NO: 2044505 - RNA, 19 nt, Staphylococcus aureus subsp. aureus Mu50
ucaauuuaguauaaauaaa

SEQ ID NO: 2044506 - RNA, 17 nt, Staphylococcus aureus subsp. aureus Mu50
ucaauugucucaauaau

SEQ ID NO: 2044507 - RNA, 15 nt, Staphylococcus aureus subsp. aureus Mu50
ucaauugugcuuggu

SEQ ID NO: 2044508 - RNA, 18 nt, Staphylococcus aureus subsp. aureus Mu50
ucaauuguuacuuuaacu

SEQ ID NO: 2044509 - RNA, 12 nt, Staphylococcus aureus subsp. aureus Mu50
ucaagacgcauu

SEQ ID NO: 2044510 - RNA, 17 nt, Staphylococcus aureus subsp. aureus Mu50
ucaagcuuugcugcuuu

SEQ ID NO: 2044511 - RNA, 18 nt, Staphylococcus aureus subsp. aureus Mu50
ucaagcuuaauaagcuga

SEQ ID NO: 2044512 - RNA, 21 nt, Staphylococcus aureus subsp. aureus Mu50
ucaauacccuacuauauauca

SEQ ID NO: 2044513 - RNA, 14 nt, Staphylococcus aureus subsp. aureus Mu50
ucaauaauucauca

SEQ ID NO: 2044514 - RNA, 23 nt, Staphylococcus aureus subsp. aureus Mu50
ucaauaaugcguuggcgguauuu

SEQ ID NO: 2044515 - RNA, 18 nt, Staphylococcus aureus subsp. aureus Mu50
ucaauaacaccuuucauu

SEQ ID NO: 2044516 - RNA, 16 nt, Staphylococcus aureus subsp. aureus Mu50
ucaauaaauuuuauau

SEQ ID NO: 2044517 - RNA, 14 nt, Staphylococcus aureus subsp. aureus Mu50
ucaauaacaccuuu

SEQ ID NO: 2044518 - RNA, 12 nt, Staphylococcus aureus subsp. aureus Mu50
ucaauaaauaaa

SEQ ID NO: 2044519 - RNA, 13 nt, Staphylococcus aureus subsp. aureus Mu50
ucaaguuuugguc

SEQ ID NO: 2044520 - RNA, 20 nt, Staphylococcus aureus subsp. aureus Mu50
ucaaguucaccguaaucuuu

SEQ ID NO: 2044521 - RNA, 19 nt, Staphylococcus aureus subsp. aureus Mu50
ucaagugcuugguuaaagu

SEQ ID NO: 2044522 - RNA, 12 nt, Staphylococcus aureus subsp. aureus Mu50
ucaaguaacuca

SEQ ID NO: 2044523 - RNA, 21 nt, Staphylococcus aureus subsp. aureus Mu50
uauugaucugauuucacuucu

SEQ ID NO: 2044524 - RNA, 13 nt, Staphylococcus aureus subsp. aureus Mu50
uauugaugaauaa

SEQ ID NO: 2044525 - RNA, 16 nt, Staphylococcus aureus subsp. aureus Mu50
uauugaugaauaaaua

SEQ ID NO: 2044526 - RNA, 14 nt, Staphylococcus aureus subsp. aureus Mu50
uauugcaauaaaau

SEQ ID NO: 2044527 - RNA, 15 nt, Staphylococcus aureus subsp. aureus Mu50
uauugcaauauaguu

SEQ ID NO: 2044528 - RNA, 17 nt, Staphylococcus aureus subsp. aureus Mu50
uauucaauaauuauuaa

SEQ ID NO: 2044529 - RNA, 19 nt, Staphylococcus aureus subsp. aureus Mu50
uauucaauaauuauuaauu

SEQ ID NO: 2044530 - RNA, 23 nt, Staphylococcus aureus subsp. aureus Mu50
uauugauauucuaaaaaauuaaa

SEQ ID NO: 2044531 - RNA, 14 nt, Staphylococcus aureus subsp. aureus Mu50
uauuauuuuuuucu

SEQ ID NO: 2044532 - RNA, 15 nt, Staphylococcus aureus subsp. aureus Mu50
uauucaaaaagguau

SEQ ID NO: 2044533 - RNA, 21 nt, Staphylococcus aureus subsp. aureus Mu50
uauucaaacaguccuuauuau

SEQ ID NO: 2044534 - RNA, 22 nt, Staphylococcus aureus subsp. aureus Mu50
uauucaaacaguccuuauuaua

SEQ ID NO: 2044535 - RNA, 21 nt, Staphylococcus aureus subsp. aureus Mu50
uauugccgguuaaauuauuua

SEQ ID NO: 2044536 - RNA, 13 nt, Staphylococcus aureus subsp. aureus Mu50
ucaaaauguuuaa

SEQ ID NO: 2044537 - RNA, 20 nt, Staphylococcus aureus subsp. aureus Mu50
ucaaaauguuuaacaauaau

SEQ ID NO: 2044538 - RNA, 20 nt, Staphylococcus aureus subsp. aureus Mu50
ucaaaauuaugacuaacauu

SEQ ID NO: 2044539 - RNA, 18 nt, Staphylococcus aureus subsp. aureus Mu50
ucaaaauucaauauuaau

SEQ ID NO: 2044540 - RNA, 20 nt, Staphylococcus aureus subsp. aureus Mu50
uauugguaaauuuaucauuu

SEQ ID NO: 2044541 - RNA, 19 nt, Staphylococcus aureus subsp. aureus Mu50
uauuguagggaguauuguu

SEQ ID NO: 2044542 - RNA, 16 nt, Staphylococcus aureus subsp. aureus Mu50
uauuguauuuuauuua

SEQ ID NO: 2044543 - RNA, 15 nt, Staphylococcus aureus subsp. aureus Mu50
uauugucaucauguu

SEQ ID NO: 2044544 - RNA, 13 nt, Staphylococcus aureus subsp. aureus Mu50
ucaaacauauuca

SEQ ID NO: 2044545 - RNA, 18 nt, Staphylococcus aureus subsp. aureus Mu50
uauugggagcaaucaaua

SEQ ID NO: 2044546 - RNA, 13 nt, Staphylococcus aureus subsp. aureus Mu50
ucaaaauuuugac

SEQ ID NO: 2044547 - RNA, 21 nt, Staphylococcus aureus subsp. aureus Mu50
ucaaagccugucggaauuggu

SEQ ID NO: 2044548 - RNA, 18 nt, Staphylococcus aureus subsp. aureus Mu50
ucaaagcgauaaaguaug

SEQ ID NO: 2044549 - RNA, 15 nt, Staphylococcus aureus subsp. aureus Mu50
ucaaaguauauugcu

SEQ ID NO: 2044550 - RNA, 17 nt, Staphylococcus aureus subsp. aureus Mu50
ucaaauccaaaaucuuu

SEQ ID NO: 2044551 - RNA, 15 nt, Staphylococcus aureus subsp. aureus Mu50
ucaaauauaaauaaa

SEQ ID NO: 2044552 - RNA, 18 nt, Staphylococcus aureus subsp. aureus Mu50
ucaaauaauauaaaacga

SEQ ID NO: 2044553 - RNA, 16 nt, Staphylococcus aureus subsp. aureus Mu50
ucaaaguuuaauugcu

SEQ ID NO: 2044554 - RNA, 15 nt, Staphylococcus aureus subsp. aureus Mu50
ucaaauaaacacauc

SEQ ID NO: 2044555 - RNA, 18 nt, Staphylococcus aureus subsp. aureus Mu50
ucaaauaaaucaaacuuu

SEQ ID NO: 2044556 - RNA, 22 nt, Staphylococcus aureus subsp. aureus Mu50
ucaaagguuuacuauuaaagga

SEQ ID NO: 2044557 - RNA, 20 nt, Staphylococcus aureus subsp. aureus Mu50
ucaaauauaucuaauacuuu

SEQ ID NO: 2044558 - RNA, 15 nt, Staphylococcus aureus subsp. aureus Mu50
ucaaccucuuguaau

SEQ ID NO: 2044559 - RNA, 11 nt, Staphylococcus aureus subsp. aureus Mu50
ucaacuuuuga

SEQ ID NO: 2044560 - RNA, 22 nt, Staphylococcus aureus subsp. aureus Mu50
ucaacuuuuuaauaauacuucu

SEQ ID NO: 2044561 - RNA, 18 nt, Staphylococcus aureus subsp. aureus Mu50
ucaagaccaaauauuuua

SEQ ID NO: 2044562 - RNA, 12 nt, Staphylococcus aureus subsp. aureus Mu50
ucaagaacaauc

SEQ ID NO: 2044563 - RNA, 15 nt, Staphylococcus aureus subsp. aureus Mu50
ucaacuuguuuccua

SEQ ID NO: 2044564 - RNA, 15 nt, Staphylococcus aureus subsp. aureus Mu50
ucaacuguaccauuu

SEQ ID NO: 2044565 - RNA, 17 nt, Staphylococcus aureus subsp. aureus Mu50
uacgauuauuuggauaa

SEQ ID NO: 2044566 - RNA, 17 nt, Staphylococcus aureus subsp. aureus Mu50
uacgaguuauaucuuuu

SEQ ID NO: 2044567 - RNA, 14 nt, Staphylococcus aureus subsp. aureus Mu50
uacgauacaucauu

SEQ ID NO: 2044568 - RNA, 17 nt, Staphylococcus aureus subsp. aureus Mu50
uaccacuguauuuacua

SEQ ID NO: 2044569 - RNA, 23 nt, Staphylococcus aureus subsp. aureus Mu50
uaccacuugaauacuuuuuaacu

SEQ ID NO: 2044570 - RNA, 13 nt, Staphylococcus aureus subsp. aureus Mu50
uacgaaaauauca

SEQ ID NO: 2044571 - RNA, 19 nt, Staphylococcus aureus subsp. aureus Mu50
uacgaacaucuaauacauu

SEQ ID NO: 2044572 - RNA, 18 nt, Staphylococcus aureus subsp. aureus Mu50
uacugaaacuaaauuaaa

SEQ ID NO: 2044573 - RNA, 19 nt, Staphylococcus aureus subsp. aureus Mu50
uacuaucuacaauaaccau

SEQ ID NO: 2044574 - RNA, 13 nt, Staphylococcus aureus subsp. aureus Mu50
uacuacauuauua

SEQ ID NO: 2044575 - RNA, 17 nt, Staphylococcus aureus subsp. aureus Mu50
uacguuuuaaauaaaug

SEQ ID NO: 2044576 - RNA, 16 nt, Staphylococcus aureus subsp. aureus Mu50
uacuaauauauuaauu

SEQ ID NO: 2044577 - RNA, 18 nt, Staphylococcus aureus subsp. aureus Mu50
uacuaaccuauuaaaaaa

SEQ ID NO: 2044578 - RNA, 21 nt, Staphylococcus aureus subsp. aureus Mu50
uacuaacguaaaggugauauu

SEQ ID NO: 2044579 - RNA, 14 nt, Staphylococcus aureus subsp. aureus Mu50
uacucugggcauuu

SEQ ID NO: 2044580 - RNA, 15 nt, Staphylococcus aureus subsp. aureus Mu50
uacuagaauuaacua

SEQ ID NO: 2044581 - RNA, 22 nt, Staphylococcus aureus subsp. aureus Mu50
uacuagcauuagcaaauauuau

SEQ ID NO: 2044582 - RNA, 20 nt, Staphylococcus aureus subsp. aureus Mu50
uacuaguuuguaauaauuaa

SEQ ID NO: 2044583 - RNA, 16 nt, Staphylococcus aureus subsp. aureus Mu50
uacguuauuucaauaa

SEQ ID NO: 2044584 - RNA, 14 nt, Staphylococcus aureus subsp. aureus Mu50
uacguuuaauaaug

SEQ ID NO: 2044585 - RNA, 17 nt, Staphylococcus aureus subsp. aureus Mu50
uacguuuaauaaugguu

SEQ ID NO: 2044586 - RNA, 18 nt, Staphylococcus aureus subsp. aureus Mu50
uacuaaaaguguuaugaa

SEQ ID NO: 2044587 - RNA, 22 nt, Staphylococcus aureus subsp. aureus Mu50
uacguccaaaaugaacaauacc

SEQ ID NO: 2044588 - RNA, 14 nt, Staphylococcus aureus subsp. aureus Mu50
uagcaaaaauacuu

SEQ ID NO: 2044589 - RNA, 14 nt, Staphylococcus aureus subsp. aureus Mu50
uagauuuucacuaa

SEQ ID NO: 2044590 - RNA, 15 nt, Staphylococcus aureus subsp. aureus Mu50
uacuuuggacuuuaa

SEQ ID NO: 2044591 - RNA, 15 nt, Staphylococcus aureus subsp. aureus Mu50
uacuuuuucaacugu

SEQ ID NO: 2044592 - RNA, 14 nt, Staphylococcus aureus subsp. aureus Mu50
uagaaaacaucuua

SEQ ID NO: 2044593 - RNA, 21 nt, Staphylococcus aureus subsp. aureus Mu50
uagaaaauaugacgaucuuca

SEQ ID NO: 2044594 - RNA, 20 nt, Staphylococcus aureus subsp. aureus Mu50
uacuuucaaacaaaucuuuu

SEQ ID NO: 2044595 - RNA, 14 nt, Staphylococcus aureus subsp. aureus Mu50
uacuuucaccauuu

SEQ ID NO: 2044596 - RNA, 16 nt, Staphylococcus aureus subsp. aureus Mu50
uacuuucaccauuuac

SEQ ID NO: 2044597 - RNA, 20 nt, Staphylococcus aureus subsp. aureus Mu50
uacuuggcucaaaacuuuua

SEQ ID NO: 2044598 - RNA, 15 nt, Staphylococcus aureus subsp. aureus Mu50
uacuuguaauuaaua

SEQ ID NO: 2044599 - RNA, 16 nt, Staphylococcus aureus subsp. aureus Mu50
uacuuggaaauguaua

SEQ ID NO: 2044600 - RNA, 17 nt, Staphylococcus aureus subsp. aureus Mu50
uacuugaauaccuuuua

SEQ ID NO: 2044601 - RNA, 15 nt, Staphylococcus aureus subsp. aureus Mu50
uagccuuuucuagcu

SEQ ID NO: 2044602 - RNA, 22 nt, Staphylococcus aureus subsp. aureus Mu50
uagcaauuuucgauauuuguuu

SEQ ID NO: 2044603 - RNA, 19 nt, Staphylococcus aureus subsp. aureus Mu50
uagcaccggcaucuugaac

SEQ ID NO: 2044604 - RNA, 12 nt, Staphylococcus aureus subsp. aureus Mu50
uagcaaugaauu

SEQ ID NO: 2044605 - RNA, 21 nt, Staphylococcus aureus subsp. aureus Mu50
uagccgaaaaacaucauuucu

SEQ ID NO: 2044606 - RNA, 20 nt, Staphylococcus aureus subsp. aureus Mu50
aaguugcacuugguucauaa

SEQ ID NO: 2044607 - RNA, 15 nt, Staphylococcus aureus subsp. aureus Mu50
aaguugucaucuaau

SEQ ID NO: 2044608 - RNA, 19 nt, Staphylococcus aureus subsp. aureus Mu50
aaguugucaucuaauuaca

SEQ ID NO: 2044609 - RNA, 19 nt, Staphylococcus aureus subsp. aureus Mu50
aaguuguugaaauuucugu

SEQ ID NO: 2044610 - RNA, 19 nt, Staphylococcus aureus subsp. aureus Mu50
aaguuguaauuuaaaauag

SEQ ID NO: 2044611 - RNA, 13 nt, Staphylococcus aureus subsp. aureus Mu50
aaguuuaaaauac

SEQ ID NO: 2044612 - RNA, 16 nt, Staphylococcus aureus subsp. aureus Mu50
aaguuuaaaugugcaa

SEQ ID NO: 2044613 - RNA, 21 nt, Staphylococcus aureus subsp. aureus Mu50
uagcuacaauuaaagugaaua

SEQ ID NO: 2044614 - RNA, 21 nt, Staphylococcus aureus subsp. aureus Mu50
uagcuaaagcuugcuguucaa

SEQ ID NO: 2044615 - RNA, 22 nt, Staphylococcus aureus subsp. aureus Mu50
uagcguucaauagcauaugaua

SEQ ID NO: 2044616 - RNA, 15 nt, Staphylococcus aureus subsp. aureus Mu50
uagcggauuuauuuu

SEQ ID NO: 2044617 - RNA, 16 nt, Staphylococcus aureus subsp. aureus Mu50
uaggcuauguaaaucg

SEQ ID NO: 2044618 - RNA, 19 nt, Staphylococcus aureus subsp. aureus Mu50
aauaaaaacucuaaaaguu

SEQ ID NO: 2044619 - RNA, 19 nt, Staphylococcus aureus subsp. aureus Mu50
aauaaaacuuauaacugau

SEQ ID NO: 2044620 - RNA, 15 nt, Staphylococcus aureus subsp. aureus Mu50
aauaaaauauaucuu

SEQ ID NO: 2044621 - RNA, 23 nt, Staphylococcus aureus subsp. aureus Mu50
aauaaaauuacuugaauauuauu

SEQ ID NO: 2044622 - RNA, 21 nt, Staphylococcus aureus subsp. aureus Mu50
aauaaaaaccaauauuucugg

SEQ ID NO: 2044623 - RNA, 14 nt, Staphylococcus aureus subsp. aureus Mu50
aauaaaaaaaugau

SEQ ID NO: 2044624 - RNA, 19 nt, Staphylococcus aureus subsp. aureus Mu50
aauaaaaccgguacuuuca

SEQ ID NO: 2044625 - RNA, 21 nt, Staphylococcus aureus subsp. aureus Mu50
aauaaaaauauugcguuuaau

SEQ ID NO: 2044626 - RNA, 21 nt, Staphylococcus aureus subsp. aureus Mu50
aauaaaaaugccgagauuauu

SEQ ID NO: 2044627 - RNA, 13 nt, Staphylococcus aureus subsp. aureus Mu50
aauaacaaacauu

SEQ ID NO: 2044628 - RNA, 20 nt, Staphylococcus aureus subsp. aureus Mu50
aauaaauguuaaagauuauu

SEQ ID NO: 2044629 - RNA, 16 nt, Staphylococcus aureus subsp. aureus Mu50
aauaaauaaacaacug

SEQ ID NO: 2044630 - RNA, 18 nt, Staphylococcus aureus subsp. aureus Mu50
aauaaauaagcaaucaua

SEQ ID NO: 2044631 - RNA, 21 nt, Staphylococcus aureus subsp. aureus Mu50
aauaaaucacgccauaaucuu

SEQ ID NO: 2044632 - RNA, 18 nt, Staphylococcus aureus subsp. aureus Mu50
aauaaaucacgccauaau

SEQ ID NO: 2044633 - RNA, 21 nt, Staphylococcus aureus subsp. aureus Mu50
aauaaagauuauaucuuuaua

SEQ ID NO: 2044634 - RNA, 18 nt, Staphylococcus aureus subsp. aureus Mu50
aauaaaccuacaauauag

SEQ ID NO: 2044635 - RNA, 20 nt, Staphylococcus aureus subsp. aureus Mu50
aauaaacgauugauuaucau

SEQ ID NO: 2044636 - RNA, 16 nt, Staphylococcus aureus subsp. aureus Mu50
uaggauguucaucaac

SEQ ID NO: 2044637 - RNA, 12 nt, Staphylococcus aureus subsp. aureus Mu50
uaggauuuacac

SEQ ID NO: 2044638 - RNA, 22 nt, Staphylococcus aureus subsp. aureus Mu50
aauaacaauagugacuuuuaua

SEQ ID NO: 2044639 - RNA, 16 nt, Staphylococcus aureus subsp. aureus Mu50
uaggaccucuuauuua

SEQ ID NO: 2044640 - RNA, 22 nt, Staphylococcus aureus subsp. aureus Mu50
ucggacagaugaguauacugaa

SEQ ID NO: 2044641 - RNA, 22 nt, Staphylococcus aureus subsp. aureus Mu50
ucggaagcauauuucuaaauua

SEQ ID NO: 2044642 - RNA, 21 nt, Staphylococcus aureus subsp. aureus Mu50
ucgccaucuuuuuuagcugaa

SEQ ID NO: 2044643 - RNA, 14 nt, Staphylococcus aureus subsp. aureus Mu50
ucgcccuugccugu

SEQ ID NO: 2044644 - RNA, 20 nt, Staphylococcus aureus subsp. aureus Mu50
ucgacaaauuaaaaaacaau

SEQ ID NO: 2044645 - RNA, 16 nt, Staphylococcus aureus subsp. aureus Mu50
ucgaauugguaaaaau

SEQ ID NO: 2044646 - RNA, 21 nt, Staphylococcus aureus subsp. aureus Mu50
ucgaacgauauuuuaaaaagu

SEQ ID NO: 2044647 - RNA, 20 nt, Staphylococcus aureus subsp. aureus Mu50
ucgaacaaucggaagcauau

SEQ ID NO: 2044648 - RNA, 20 nt, Staphylococcus aureus subsp. aureus Mu50
uccuucgcuaugaccaugau

SEQ ID NO: 2044649 - RNA, 17 nt, Staphylococcus aureus subsp. aureus Mu50
ucgaaaauuauacaaau

SEQ ID NO: 2044650 - RNA, 23 nt, Staphylococcus aureus subsp. aureus Mu50
ucgaaaauagcuauuaaaauaga

SEQ ID NO: 2044651 - RNA, 16 nt, Staphylococcus aureus subsp. aureus Mu50
ucgaaagccaauuaau

SEQ ID NO: 2044652 - RNA, 19 nt, Staphylococcus aureus subsp. aureus Mu50
ucgaaagaugauauauuca

SEQ ID NO: 2044653 - RNA, 22 nt, Staphylococcus aureus subsp. aureus Mu50
ucgauuuagaagaacaauaauu

SEQ ID NO: 2044654 - RNA, 19 nt, Staphylococcus aureus subsp. aureus Mu50
ucgauuauucuuaauuuaa

SEQ ID NO: 2044655 - RNA, 15 nt, Staphylococcus aureus subsp. aureus Mu50
ucgauucgauuauuu

SEQ ID NO: 2044656 - RNA, 17 nt, Staphylococcus aureus subsp. aureus Mu50
ucgauucauaaaauuua

SEQ ID NO: 2044657 - RNA, 22 nt, Staphylococcus aureus subsp. aureus Mu50
ucgaugcuaaaaauauugaaua

SEQ ID NO: 2044658 - RNA, 22 nt, Staphylococcus aureus subsp. aureus Mu50
ucgauggcuugguuauuuucaa

SEQ ID NO: 2044659 - RNA, 18 nt, Staphylococcus aureus subsp. aureus Mu50
ucgauaguucuauauaau

SEQ ID NO: 2044660 - RNA, 17 nt, Staphylococcus aureus subsp. aureus Mu50
ucgauauuuguuucgua

SEQ ID NO: 2044661 - RNA, 20 nt, Staphylococcus aureus subsp. aureus Mu50
ucgauauuucuaguugcaau

SEQ ID NO: 2044662 - RNA, 13 nt, Staphylococcus aureus subsp. aureus Mu50
uccguuaauuuaa

SEQ ID NO: 2044663 - RNA, 20 nt, Staphylococcus aureus subsp. aureus Mu50
uccguuaaaauuuuaauuaa

SEQ ID NO: 2044664 - RNA, 17 nt, Staphylococcus aureus subsp. aureus Mu50
uccuauuacuacauaau

SEQ ID NO: 2044665 - RNA, 21 nt, Staphylococcus aureus subsp. aureus Mu50
uccuaccccgugaaucuuauu

SEQ ID NO: 2044666 - RNA, 18 nt, Staphylococcus aureus subsp. aureus Mu50
uccuaccgcuaaaauucu

SEQ ID NO: 2044667 - RNA, 22 nt, Staphylococcus aureus subsp. aureus Mu50
uccuacacuguuuuauaaauga

SEQ ID NO: 2044668 - RNA, 18 nt, Staphylococcus aureus subsp. aureus Mu50
uccuaauuauauuaauga

SEQ ID NO: 2044669 - RNA, 19 nt, Staphylococcus aureus subsp. aureus Mu50
uccuaagcaucguaaaaaa

SEQ ID NO: 2044670 - RNA, 21 nt, Staphylococcus aureus subsp. aureus Mu50
uccuauuguuuuagcaauuug

SEQ ID NO: 2044671 - RNA, 15 nt, Staphylococcus aureus subsp. aureus Mu50
uccgauaucuuuuaa

SEQ ID NO: 2044672 - RNA, 15 nt, Staphylococcus aureus subsp. aureus Mu50
uccgccaauuaaaau

SEQ ID NO: 2044673 - RNA, 20 nt, Staphylococcus aureus subsp. aureus Mu50
ugauuccacuacaaucauac

SEQ ID NO: 2044674 - RNA, 18 nt, Staphylococcus aureus subsp. aureus Mu50
ugauucauuacaaccauu

SEQ ID NO: 2044675 - RNA, 20 nt, Staphylococcus aureus subsp. aureus Mu50
ugauucaccagguuuuuuau

SEQ ID NO: 2044676 - RNA, 17 nt, Staphylococcus aureus subsp. aureus Mu50
ugauugaacaauaauau

SEQ ID NO: 2044677 - RNA, 21 nt, Staphylococcus aureus subsp. aureus Mu50
ugauucuacagcacugaaauc

SEQ ID NO: 2044678 - RNA, 14 nt, Staphylococcus aureus subsp. aureus Mu50
ugauucuaaauaau

SEQ ID NO: 2044679 - RNA, 20 nt, Staphylococcus aureus subsp. aureus Mu50
ugauuggcagugaucuuuuu

SEQ ID NO: 2044680 - RNA, 17 nt, Staphylococcus aureus subsp. aureus Mu50
ugauuguuaacgaauaa

SEQ ID NO: 2044681 - RNA, 18 nt, Staphylococcus aureus subsp. aureus Mu50
ugauuuagcauacauuaa

SEQ ID NO: 2044682 - RNA, 22 nt, Staphylococcus aureus subsp. aureus Mu50
ugauuuaagauuuaauaaagug

SEQ ID NO: 2044683 - RNA, 19 nt, Staphylococcus aureus subsp. aureus Mu50
ugauuuaaaaaauuuaaug

SEQ ID NO: 2044684 - RNA, 15 nt, Staphylococcus aureus subsp. aureus Mu50
ugauuuaauuuuuaa

SEQ ID NO: 2044685 - RNA, 21 nt, Staphylococcus aureus subsp. aureus Mu50
ugauuuaauuuuuaauguauu

SEQ ID NO: 2044686 - RNA, 19 nt, Staphylococcus aureus subsp. aureus Mu50
ugauuuaccuuugucuuuu

SEQ ID NO: 2044687 - RNA, 22 nt, Staphylococcus aureus subsp. aureus Mu50
ugauuuaccuuugucuuuuuua

SEQ ID NO: 2044688 - RNA, 14 nt, Staphylococcus aureus subsp. aureus Mu50
ugauuaaaaaucaa

SEQ ID NO: 2044689 - RNA, 11 nt, Staphylococcus aureus subsp. aureus Mu50
ugaugugaugu

SEQ ID NO: 2044690 - RNA, 19 nt, Staphylococcus aureus subsp. aureus Mu50
ugauguguuguuuuaauug

SEQ ID NO: 2044691 - RNA, 14 nt, Staphylococcus aureus subsp. aureus Mu50
ugauguuaaaaaau

SEQ ID NO: 2044692 - RNA, 17 nt, Staphylococcus aureus subsp. aureus Mu50
ugaugugaauguuuugu

SEQ ID NO: 2044693 - RNA, 21 nt, Staphylococcus aureus subsp. aureus Mu50
ugauuaacuuucuaauuguuu

SEQ ID NO: 2044694 - RNA, 11 nt, Staphylococcus aureus subsp. aureus Mu50
ugauuaauuuc

SEQ ID NO: 2044695 - RNA, 16 nt, Staphylococcus aureus subsp. aureus Mu50
ugauuacaacuuauuc

SEQ ID NO: 2044696 - RNA, 21 nt, Staphylococcus aureus subsp. aureus Mu50
ugauuacguugguuuaaaaau

SEQ ID NO: 2044697 - RNA, 21 nt, Staphylococcus aureus subsp. aureus Mu50
ugauuacuuuaagauuauuug

SEQ ID NO: 2044698 - RNA, 14 nt, Staphylococcus aureus subsp. aureus Mu50
ugauuaguaaauau

SEQ ID NO: 2044699 - RNA, 22 nt, Staphylococcus aureus subsp. aureus Mu50
ugauuaguaauuuuuaaaucua

SEQ ID NO: 2044700 - RNA, 14 nt, Staphylococcus aureus subsp. aureus Mu50
ugauucaauauagu

SEQ ID NO: 2044701 - RNA, 21 nt, Staphylococcus aureus subsp. aureus Mu50
ugaugauaaaaauaaaaccga

SEQ ID NO: 2044702 - RNA, 21 nt, Staphylococcus aureus subsp. aureus Mu50
ugcaauacauuaauauaaaua

SEQ ID NO: 2044703 - RNA, 22 nt, Staphylococcus aureus subsp. aureus Mu50
ugcaauacauuaauauaaauau

SEQ ID NO: 2044704 - RNA, 16 nt, Staphylococcus aureus subsp. aureus Mu50
ugcaaguccaaauaau

SEQ ID NO: 2044705 - RNA, 23 nt, Staphylococcus aureus subsp. aureus Mu50
ugcaauaccuccccaacuuaaua

SEQ ID NO: 2044706 - RNA, 23 nt, Staphylococcus aureus subsp. aureus Mu50
ugcaccuaaacgaucaacugcuu

SEQ ID NO: 2044707 - RNA, 14 nt, Staphylococcus aureus subsp. aureus Mu50
ugcacauaaaaaau

SEQ ID NO: 2044708 - RNA, 17 nt, Staphylococcus aureus subsp. aureus Mu50
ugcaacuuuaagacuuu

SEQ ID NO: 2044709 - RNA, 19 nt, Staphylococcus aureus subsp. aureus Mu50
ugcaaguaauuuaauuggu

SEQ ID NO: 2044710 - RNA, 21 nt, Staphylococcus aureus subsp. aureus Mu50
ugcaacagaaccgaaaauaau

SEQ ID NO: 2044711 - RNA, 12 nt, Staphylococcus aureus subsp. aureus Mu50
ugcaacauuaaa

SEQ ID NO: 2044712 - RNA, 19 nt, Staphylococcus aureus subsp. aureus Mu50
ugcaacauuaaauuauuag

SEQ ID NO: 2044713 - RNA, 15 nt, Staphylococcus aureus subsp. aureus Mu50
ugcaaaauuaaugaa

SEQ ID NO: 2044714 - RNA, 14 nt, Staphylococcus aureus subsp. aureus Mu50
ugauuuuuaaaaau

SEQ ID NO: 2044715 - RNA, 13 nt, Staphylococcus aureus subsp. aureus Mu50
ugauuuuguuuca

SEQ ID NO: 2044716 - RNA, 16 nt, Staphylococcus aureus subsp. aureus Mu50
ugauuucacuucauaa

SEQ ID NO: 2044717 - RNA, 16 nt, Staphylococcus aureus subsp. aureus Mu50
ugauuugauucauuac

SEQ ID NO: 2044718 - RNA, 14 nt, Staphylococcus aureus subsp. aureus Mu50
ugauuuguuugauu

SEQ ID NO: 2044719 - RNA, 19 nt, Staphylococcus aureus subsp. aureus Mu50
ugauuuggguaauguuuuu

SEQ ID NO: 2044720 - RNA, 20 nt, Staphylococcus aureus subsp. aureus Mu50
ugauuuggguaauguuuuua

SEQ ID NO: 2044721 - RNA, 22 nt, Staphylococcus aureus subsp. aureus Mu50
ugcaaauuaucauuaaauugcu

SEQ ID NO: 2044722 - RNA, 13 nt, Staphylococcus aureus subsp. aureus Mu50
ugcaaauaaaaaa

SEQ ID NO: 2044723 - RNA, 19 nt, Staphylococcus aureus subsp. aureus Mu50
ugagcucugaaggagacau

SEQ ID NO: 2044724 - RNA, 18 nt, Staphylococcus aureus subsp. aureus Mu50
ugauaucacuauacaauc

SEQ ID NO: 2044725 - RNA, 16 nt, Staphylococcus aureus subsp. aureus Mu50
ugauauaaaccaugau

SEQ ID NO: 2044726 - RNA, 19 nt, Staphylococcus aureus subsp. aureus Mu50
ugauauaaaccaugauuag

SEQ ID NO: 2044727 - RNA, 22 nt, Staphylococcus aureus subsp. aureus Mu50
ugauauaaauuaucagaaucaa

SEQ ID NO: 2044728 - RNA, 17 nt, Staphylococcus aureus subsp. aureus Mu50
ugauauaagauucauau

SEQ ID NO: 2044729 - RNA, 21 nt, Staphylococcus aureus subsp. aureus Mu50
ugauagcgugauuuuucauau

SEQ ID NO: 2044730 - RNA, 14 nt, Staphylococcus aureus subsp. aureus Mu50
ugauagugaauaau

SEQ ID NO: 2044731 - RNA, 17 nt, Staphylococcus aureus subsp. aureus Mu50
ugauaguguauguuuuu

SEQ ID NO: 2044732 - RNA, 13 nt, Staphylococcus aureus subsp. aureus Mu50
ugauacuugauuu

SEQ ID NO: 2044733 - RNA, 18 nt, Staphylococcus aureus subsp. aureus Mu50
ugauacguaaacacuuua

SEQ ID NO: 2044734 - RNA, 15 nt, Staphylococcus aureus subsp. aureus Mu50
ugauacgcuuuuuaa

SEQ ID NO: 2044735 - RNA, 20 nt, Staphylococcus aureus subsp. aureus Mu50
ugauacgcuuuuuaaaaaau

SEQ ID NO: 2044736 - RNA, 20 nt, Staphylococcus aureus subsp. aureus Mu50
ugagugcuuauuuguuuauu

SEQ ID NO: 2044737 - RNA, 21 nt, Staphylococcus aureus subsp. aureus Mu50
ugagugcuuauuuguuuauua

SEQ ID NO: 2044738 - RNA, 16 nt, Staphylococcus aureus subsp. aureus Mu50
ugaguaaauuaauaga

SEQ ID NO: 2044739 - RNA, 13 nt, Staphylococcus aureus subsp. aureus Mu50
ugaguacaacaua

SEQ ID NO: 2044740 - RNA, 17 nt, Staphylococcus aureus subsp. aureus Mu50
ugacugagaaaaauauu

SEQ ID NO: 2044741 - RNA, 21 nt, Staphylococcus aureus subsp. aureus Mu50
ugacugauuuuuuuuaugcac

SEQ ID NO: 2044742 - RNA, 16 nt, Staphylococcus aureus subsp. aureus Mu50
ugagauggucuuuuaa

SEQ ID NO: 2044743 - RNA, 19 nt, Staphylococcus aureus subsp. aureus Mu50
ugagcaucacucaacauau

SEQ ID NO: 2044744 - RNA, 14 nt, Staphylococcus aureus subsp. aureus Mu50
ugagaauauuaaga

SEQ ID NO: 2044745 - RNA, 17 nt, Staphylococcus aureus subsp. aureus Mu50
ugacuuugucuuuaaug

SEQ ID NO: 2044746 - RNA, 13 nt, Staphylococcus aureus subsp. aureus Mu50
ugagauaaaauca

SEQ ID NO: 2044747 - RNA, 14 nt, Staphylococcus aureus subsp. aureus Mu50
ugacuuuauuucua

SEQ ID NO: 2044748 - RNA, 20 nt, Staphylococcus aureus subsp. aureus Mu50
ugacuuuaaaucuuguucua

SEQ ID NO: 2044749 - RNA, 14 nt, Staphylococcus aureus subsp. aureus Mu50
ugacuuacauuuua

SEQ ID NO: 2044750 - RNA, 15 nt, Staphylococcus aureus subsp. aureus Mu50
ugccacauucgagcu

SEQ ID NO: 2044751 - RNA, 18 nt, Staphylococcus aureus subsp. aureus Mu50
ugccaccguggaauuuac

SEQ ID NO: 2044752 - RNA, 14 nt, Staphylococcus aureus subsp. aureus Mu50
ugcauuuaauuuaa

SEQ ID NO: 2044753 - RNA, 15 nt, Staphylococcus aureus subsp. aureus Mu50
ugcauuuaauuuaau

SEQ ID NO: 2044754 - RNA, 19 nt, Staphylococcus aureus subsp. aureus Mu50
ugcauuuagaugauucuua

SEQ ID NO: 2044755 - RNA, 23 nt, Staphylococcus aureus subsp. aureus Mu50
ugcauuguaauaccaauuuuuag

SEQ ID NO: 2044756 - RNA, 14 nt, Staphylococcus aureus subsp. aureus Mu50
ugcauuaauuucau

SEQ ID NO: 2044757 - RNA, 20 nt, Staphylococcus aureus subsp. aureus Mu50
ugcauuacuaucuucaucau

SEQ ID NO: 2044758 - RNA, 12 nt, Staphylococcus aureus subsp. aureus Mu50
ugcauuaagugc

SEQ ID NO: 2044759 - RNA, 22 nt, Staphylococcus aureus subsp. aureus Mu50
ucuccaguggaaaugauaauuu

SEQ ID NO: 2044760 - RNA, 15 nt, Staphylococcus aureus subsp. aureus Mu50
ucuauuuauaacacu

SEQ ID NO: 2044761 - RNA, 19 nt, Staphylococcus aureus subsp. aureus Mu50
ucuauuuaucauacuucaa

SEQ ID NO: 2044762 - RNA, 13 nt, Staphylococcus aureus subsp. aureus Mu50
ucuauuaauaauu

SEQ ID NO: 2044763 - RNA, 13 nt, Staphylococcus aureus subsp. aureus Mu50
ucuauuaauuuac

SEQ ID NO: 2044764 - RNA, 20 nt, Staphylococcus aureus subsp. aureus Mu50
ucuauggcuucgcuaauaau

SEQ ID NO: 2044765 - RNA, 14 nt, Staphylococcus aureus subsp. aureus Mu50
ucuauauaauuuau

SEQ ID NO: 2044766 - RNA, 22 nt, Staphylococcus aureus subsp. aureus Mu50
ucuaucuauaaacgucacuuua

SEQ ID NO: 2044767 - RNA, 22 nt, Staphylococcus aureus subsp. aureus Mu50
ucuagugcuuugucuuggaugu

SEQ ID NO: 2044768 - RNA, 22 nt, Staphylococcus aureus subsp. aureus Mu50
ucuaguguucucauuauaauga

SEQ ID NO: 2044769 - RNA, 14 nt, Staphylococcus aureus subsp. aureus Mu50
ucuauagguuuaua

SEQ ID NO: 2044770 - RNA, 18 nt, Staphylococcus aureus subsp. aureus Mu50
ucuauaaauaucaauaau

SEQ ID NO: 2044771 - RNA, 21 nt, Staphylococcus aureus subsp. aureus Mu50
ucuauagaaaaaguauuacuu

SEQ ID NO: 2044772 - RNA, 22 nt, Staphylococcus aureus subsp. aureus Mu50
ucuauauaaaaacuguucauac

SEQ ID NO: 2044773 - RNA, 16 nt, Staphylococcus aureus subsp. aureus Mu50
ucuacaggcaaugcaa

SEQ ID NO: 2044774 - RNA, 16 nt, Staphylococcus aureus subsp. aureus Mu50
ucuacagguaaugcaa

SEQ ID NO: 2044775 - RNA, 15 nt, Staphylococcus aureus subsp. aureus Mu50
ucuacauaauuugaa

SEQ ID NO: 2044776 - RNA, 18 nt, Staphylococcus aureus subsp. aureus Mu50
ucuaacuuaccaugauga

SEQ ID NO: 2044777 - RNA, 15 nt, Staphylococcus aureus subsp. aureus Mu50
ucuacaauaaccauu

SEQ ID NO: 2044778 - RNA, 18 nt, Staphylococcus aureus subsp. aureus Mu50
ucuacaauaaccauuuca

SEQ ID NO: 2044779 - RNA, 21 nt, Staphylococcus aureus subsp. aureus Mu50
ucuacaauaaccauuucauca

SEQ ID NO: 2044780 - RNA, 19 nt, Staphylococcus aureus subsp. aureus Mu50
ucuacaauauuaaaauuaa

SEQ ID NO: 2044781 - RNA, 22 nt, Staphylococcus aureus subsp. aureus Mu50
ucuaauuucuuagauuuuauau

SEQ ID NO: 2044782 - RNA, 23 nt, Staphylococcus aureus subsp. aureus Mu50
ucuaauuaaacgcucaacuauau

SEQ ID NO: 2044783 - RNA, 17 nt, Staphylococcus aureus subsp. aureus Mu50
ucuaauucaaugauuuu

SEQ ID NO: 2044784 - RNA, 16 nt, Staphylococcus aureus subsp. aureus Mu50
ucuaauccaaaauaau

SEQ ID NO: 2044785 - RNA, 23 nt, Staphylococcus aureus subsp. aureus Mu50
ucuaaugauauuugaucguugaa

SEQ ID NO: 2044786 - RNA, 19 nt, Staphylococcus aureus subsp. aureus Mu50
ucuaaugaucaucuauauu

SEQ ID NO: 2044787 - RNA, 22 nt, Staphylococcus aureus subsp. aureus Mu50
ucuaaugcaacuugaucauuau

SEQ ID NO: 2044788 - RNA, 23 nt, Staphylococcus aureus subsp. aureus Mu50
ucuaaugcaacuugaucauuaua

SEQ ID NO: 2044789 - RNA, 12 nt, Staphylococcus aureus subsp. aureus Mu50
ucuacuacuaau

SEQ ID NO: 2044790 - RNA, 13 nt, Staphylococcus aureus subsp. aureus Mu50
ucuagauuauuua

SEQ ID NO: 2044791 - RNA, 18 nt, Staphylococcus aureus subsp. aureus Mu50
ucuagauuauuuaaaaau

SEQ ID NO: 2044792 - RNA, 18 nt, Staphylococcus aureus subsp. aureus Mu50
ucuagauuuuaaaucaau

SEQ ID NO: 2044793 - RNA, 18 nt, Staphylococcus aureus subsp. aureus Mu50
ucuagguuagaauuauuu

SEQ ID NO: 2044794 - RNA, 19 nt, Staphylococcus aureus subsp. aureus Mu50
ucuacuaaagagaaucgaa

SEQ ID NO: 2044795 - RNA, 21 nt, Staphylococcus aureus subsp. aureus Mu50
ucuaaccacuucuucaccugc

SEQ ID NO: 2044796 - RNA, 17 nt, Staphylococcus aureus subsp. aureus Mu50
ucuaacguuaacaauau

SEQ ID NO: 2044797 - RNA, 14 nt, Staphylococcus aureus subsp. aureus Mu50
ucuaagauacguug

SEQ ID NO: 2044798 - RNA, 23 nt, Staphylococcus aureus subsp. aureus Mu50
ucuaaguuaaaaccuuuucaaau

SEQ ID NO: 2044799 - RNA, 15 nt, Staphylococcus aureus subsp. aureus Mu50
ucuaagauguguuga

SEQ ID NO: 2044800 - RNA, 16 nt, Staphylococcus aureus subsp. aureus Mu50
ucuaagauguguugaa

SEQ ID NO: 2044801 - RNA, 16 nt, Staphylococcus aureus subsp. aureus Mu50
ucuaauacaaaccuau

SEQ ID NO: 2044802 - RNA, 11 nt, Staphylococcus aureus subsp. aureus Mu50
ucuaaaaaugu

SEQ ID NO: 2044803 - RNA, 17 nt, Staphylococcus aureus subsp. aureus Mu50
ucuaaaaacauaaaaau

SEQ ID NO: 2044804 - RNA, 17 nt, Staphylococcus aureus subsp. aureus Mu50
ucguuuugcuaaccauc

SEQ ID NO: 2044805 - RNA, 20 nt, Staphylococcus aureus subsp. aureus Mu50
ucuaaacuucuauuaauaau

SEQ ID NO: 2044806 - RNA, 18 nt, Staphylococcus aureus subsp. aureus Mu50
ucuaaagaaaucucuauc

SEQ ID NO: 2044807 - RNA, 13 nt, Staphylococcus aureus subsp. aureus Mu50
ucuaaaaguugaa

SEQ ID NO: 2044808 - RNA, 19 nt, Staphylococcus aureus subsp. aureus Mu50
ucuaaagguaccacuguau

SEQ ID NO: 2044809 - RNA, 17 nt, Staphylococcus aureus subsp. aureus Mu50
ucuaaagcgauuuccau

SEQ ID NO: 2044810 - RNA, 17 nt, Staphylococcus aureus subsp. aureus Mu50
ucuaaagcuauaaaaaa

SEQ ID NO: 2044811 - RNA, 18 nt, Staphylococcus aureus subsp. aureus Mu50
ucuaaagcuauaaaaaau

SEQ ID NO: 2044812 - RNA, 23 nt, Staphylococcus aureus subsp. aureus Mu50
ucguucucguguaaaaugcaaua

SEQ ID NO: 2044813 - RNA, 14 nt, Staphylococcus aureus subsp. aureus Mu50
ucguuaccuuuuaa

SEQ ID NO: 2044814 - RNA, 16 nt, Staphylococcus aureus subsp. aureus Mu50
ucguuaauuuuauuuu

SEQ ID NO: 2044815 - RNA, 21 nt, Staphylococcus aureus subsp. aureus Mu50
ucguuaacaaucaguaauaau

SEQ ID NO: 2044816 - RNA, 12 nt, Staphylococcus aureus subsp. aureus Mu50
ucguguuaauaa

SEQ ID NO: 2044817 - RNA, 16 nt, Staphylococcus aureus subsp. aureus Mu50
ucguaauguguuaaua

SEQ ID NO: 2044818 - RNA, 19 nt, Staphylococcus aureus subsp. aureus Mu50
ucguaaagaucauuuucaa

SEQ ID NO: 2044819 - RNA, 12 nt, Staphylococcus aureus subsp. aureus Mu50
ucguacuuucaa

SEQ ID NO: 2044820 - RNA, 13 nt, Staphylococcus aureus subsp. aureus Mu50
ucugcuaauuuau

SEQ ID NO: 2044821 - RNA, 21 nt, Staphylococcus aureus subsp. aureus Mu50
aauacuuucacuuuuuauauc

SEQ ID NO: 2044822 - RNA, 17 nt, Staphylococcus aureus subsp. aureus Mu50
aauacuuuuuaacuggu

SEQ ID NO: 2044823 - RNA, 23 nt, Staphylococcus aureus subsp. aureus Mu50
aauagaaucuaaggccauuugua

SEQ ID NO: 2044824 - RNA, 16 nt, Staphylococcus aureus subsp. aureus Mu50
aauacuuucaaacaaa

SEQ ID NO: 2044825 - RNA, 16 nt, Staphylococcus aureus subsp. aureus Mu50
aauacuuucacuuuuu

SEQ ID NO: 2044826 - RNA, 13 nt, Staphylococcus aureus subsp. aureus Mu50
aauacuugaaaga

SEQ ID NO: 2044827 - RNA, 23 nt, Staphylococcus aureus subsp. aureus Mu50
aauacuguuuaaauaaaauuguu

SEQ ID NO: 2044828 - RNA, 23 nt, Staphylococcus aureus subsp. aureus Mu50
ucugugaauaugcuuuuaauagu

SEQ ID NO: 2044829 - RNA, 15 nt, Staphylococcus aureus subsp. aureus Mu50
aauacuaaaaguguu

SEQ ID NO: 2044830 - RNA, 19 nt, Staphylococcus aureus subsp. aureus Mu50
aauacuaagauuagcuaug

SEQ ID NO: 2044831 - RNA, 21 nt, Staphylococcus aureus subsp. aureus Mu50
aauacuguauuuuaacgucau

SEQ ID NO: 2044832 - RNA, 17 nt, Staphylococcus aureus subsp. aureus Mu50
aauacucuucaaucuac

SEQ ID NO: 2044833 - RNA, 22 nt, Staphylococcus aureus subsp. aureus Mu50
aauacucaguuuauugaggaua

SEQ ID NO: 2044834 - RNA, 21 nt, Staphylococcus aureus subsp. aureus Mu50
aauacuaagauuagcuaugaa

SEQ ID NO: 2044835 - RNA, 20 nt, Staphylococcus aureus subsp. aureus Mu50
aauacuacauauaaugccaa

SEQ ID NO: 2044836 - RNA, 21 nt, Staphylococcus aureus subsp. aureus Mu50
aauacuacuguugacauuuga

SEQ ID NO: 2044837 - RNA, 23 nt, Staphylococcus aureus subsp. aureus Mu50
ucuguaugcgguuauaucauucu

SEQ ID NO: 2044838 - RNA, 13 nt, Staphylococcus aureus subsp. aureus Mu50
ucuguauuauuau

SEQ ID NO: 2044839 - RNA, 16 nt, Staphylococcus aureus subsp. aureus Mu50
ucuguauauggcgaua

SEQ ID NO: 2044840 - RNA, 15 nt, Staphylococcus aureus subsp. aureus Mu50
ucuguaauuaaucca

SEQ ID NO: 2044841 - RNA, 19 nt, Staphylococcus aureus subsp. aureus Mu50
ucuguacguuuuaaauaaa

SEQ ID NO: 2044842 - RNA, 18 nt, Staphylococcus aureus subsp. aureus Mu50
ucuucugaauuuaauagg

SEQ ID NO: 2044843 - RNA, 22 nt, Staphylococcus aureus subsp. aureus Mu50
ucuucuuucauaguuauuaaau

SEQ ID NO: 2044844 - RNA, 14 nt, Staphylococcus aureus subsp. aureus Mu50
ucuucuuuuuuuaa

SEQ ID NO: 2044845 - RNA, 15 nt, Staphylococcus aureus subsp. aureus Mu50
ucuugaauaaauuuu

SEQ ID NO: 2044846 - RNA, 22 nt, Staphylococcus aureus subsp. aureus Mu50
ucuugagcaucacucaacauau

SEQ ID NO: 2044847 - RNA, 23 nt, Staphylococcus aureus subsp. aureus Mu50
ucuugagcaucacucaacauauu

SEQ ID NO: 2044848 - RNA, 20 nt, Staphylococcus aureus subsp. aureus Mu50
ucuugcauacgaauuaaaau

SEQ ID NO: 2044849 - RNA, 21 nt, Staphylococcus aureus subsp. aureus Mu50
ucuugauuauauuuuucuuca

SEQ ID NO: 2044850 - RNA, 19 nt, Staphylococcus aureus subsp. aureus Mu50
ucuugcaagccaucaauau

SEQ ID NO: 2044851 - RNA, 20 nt, Staphylococcus aureus subsp. aureus Mu50
ucuugucauuucaaucauuu

SEQ ID NO: 2044852 - RNA, 13 nt, Staphylococcus aureus subsp. aureus Mu50
ucuugguuuuuua

SEQ ID NO: 2044853 - RNA, 19 nt, Staphylococcus aureus subsp. aureus Mu50
ucuuguaaacuucuuuucu

SEQ ID NO: 2044854 - RNA, 12 nt, Staphylococcus aureus subsp. aureus Mu50
ucuuguaauguu

SEQ ID NO: 2044855 - RNA, 20 nt, Staphylococcus aureus subsp. aureus Mu50
ucuguuuaugagcuuaauaa

SEQ ID NO: 2044856 - RNA, 17 nt, Staphylococcus aureus subsp. aureus Mu50
ucuguugucaucauguu

SEQ ID NO: 2044857 - RNA, 16 nt, Staphylococcus aureus subsp. aureus Mu50
ucuguuguuucgaugg

SEQ ID NO: 2044858 - RNA, 19 nt, Staphylococcus aureus subsp. aureus Mu50
ugaaaagaacacgauauuc

SEQ ID NO: 2044859 - RNA, 18 nt, Staphylococcus aureus subsp. aureus Mu50
ugaaaauaauacuacaua

SEQ ID NO: 2044860 - RNA, 22 nt, Staphylococcus aureus subsp. aureus Mu50
ugaaaauagaaagaaauuguuc

SEQ ID NO: 2044861 - RNA, 20 nt, Staphylococcus aureus subsp. aureus Mu50
ugaaaaguugauugccauau

SEQ ID NO: 2044862 - RNA, 17 nt, Staphylococcus aureus subsp. aureus Mu50
ugaaaaguuuggcuuuu

SEQ ID NO: 2044863 - RNA, 17 nt, Staphylococcus aureus subsp. aureus Mu50
ucuuuuuuuaccuaauu

SEQ ID NO: 2044864 - RNA, 20 nt, Staphylococcus aureus subsp. aureus Mu50
ugaaaaccucuuuuuguugu

SEQ ID NO: 2044865 - RNA, 12 nt, Staphylococcus aureus subsp. aureus Mu50
ugaaaaaguaaa

SEQ ID NO: 2044866 - RNA, 16 nt, Staphylococcus aureus subsp. aureus Mu50
ucuuuuagguaauaau

SEQ ID NO: 2044867 - RNA, 12 nt, Staphylococcus aureus subsp. aureus Mu50
ucuuuuguuuua

SEQ ID NO: 2044868 - RNA, 14 nt, Staphylococcus aureus subsp. aureus Mu50
ucuuuuuguuuauc

SEQ ID NO: 2044869 - RNA, 17 nt, Staphylococcus aureus subsp. aureus Mu50
ucuuuuuuaauucuauu

SEQ ID NO: 2044870 - RNA, 16 nt, Staphylococcus aureus subsp. aureus Mu50
ucuuuuucuauacaau

SEQ ID NO: 2044871 - RNA, 16 nt, Staphylococcus aureus subsp. aureus Mu50
ucuuuuuguuguuuua

SEQ ID NO: 2044872 - RNA, 12 nt, Staphylococcus aureus subsp. aureus Mu50
ucuuuucuuuga

SEQ ID NO: 2044873 - RNA, 14 nt, Staphylococcus aureus subsp. aureus Mu50
ucuuuuauuuucau

SEQ ID NO: 2044874 - RNA, 17 nt, Staphylococcus aureus subsp. aureus Mu50
ucuuuuacuaaaugaau

SEQ ID NO: 2044875 - RNA, 16 nt, Staphylococcus aureus subsp. aureus Mu50
ucuuuuagcuuuugua

SEQ ID NO: 2044876 - RNA, 21 nt, Staphylococcus aureus subsp. aureus Mu50
ucuuuguuggggcccacaccc

SEQ ID NO: 2044877 - RNA, 24 nt, Staphylococcus aureus subsp. aureus Mu50
ucuuuuaacccacauuaaauauua

SEQ ID NO: 2044878 - RNA, 20 nt, Staphylococcus aureus subsp. aureus Mu50
ucuuuuaauagaucuuugua

SEQ ID NO: 2044879 - RNA, 17 nt, Staphylococcus aureus subsp. aureus Mu50
ucuuuaugauaauuaau

SEQ ID NO: 2044880 - RNA, 23 nt, Staphylococcus aureus subsp. aureus Mu50
ucuuuauuagaaugaaaccguau

SEQ ID NO: 2044881 - RNA, 21 nt, Staphylococcus aureus subsp. aureus Mu50
ucuuuaucaacauaaaauuua

SEQ ID NO: 2044882 - RNA, 16 nt, Staphylococcus aureus subsp. aureus Mu50
ucuuuagaugagauuu

SEQ ID NO: 2044883 - RNA, 15 nt, Staphylococcus aureus subsp. aureus Mu50
ucuuuagguaaaaga

SEQ ID NO: 2044884 - RNA, 20 nt, Staphylococcus aureus subsp. aureus Mu50
ucuuuagcuauguaaaauua

SEQ ID NO: 2044885 - RNA, 22 nt, Staphylococcus aureus subsp. aureus Mu50
ucuuuagcuauguaaaauuauu

SEQ ID NO: 2044886 - RNA, 23 nt, Staphylococcus aureus subsp. aureus Mu50
ucuuuaacccaaauugaugacuu

SEQ ID NO: 2044887 - RNA, 17 nt, Staphylococcus aureus subsp. aureus Mu50
ucuuuaauauaaauuuu

SEQ ID NO: 2044888 - RNA, 12 nt, Staphylococcus aureus subsp. aureus Mu50
ucuuguucuaaa

SEQ ID NO: 2044889 - RNA, 14 nt, Staphylococcus aureus subsp. aureus Mu50
ucuuguucuaaaau

SEQ ID NO: 2044890 - RNA, 20 nt, Staphylococcus aureus subsp. aureus Mu50
ucuugugcgguaaccauuuu

SEQ ID NO: 2044891 - RNA, 14 nt, Staphylococcus aureus subsp. aureus Mu50
ugaauaaauaacuu

SEQ ID NO: 2044892 - RNA, 16 nt, Staphylococcus aureus subsp. aureus Mu50
ugaauaauguuuccau

SEQ ID NO: 2044893 - RNA, 15 nt, Staphylococcus aureus subsp. aureus Mu50
ugaaucaacaauuua

SEQ ID NO: 2044894 - RNA, 14 nt, Staphylococcus aureus subsp. aureus Mu50
ugaaucaacaguuu

SEQ ID NO: 2044895 - RNA, 22 nt, Staphylococcus aureus subsp. aureus Mu50
ugaauagugagcguauuauuau

SEQ ID NO: 2044896 - RNA, 20 nt, Staphylococcus aureus subsp. aureus Mu50
ugaauaguagugauaucgcu

SEQ ID NO: 2044897 - RNA, 14 nt, Staphylococcus aureus subsp. aureus Mu50
ugaauauaaguaau

SEQ ID NO: 2044898 - RNA, 18 nt, Staphylococcus aureus subsp. aureus Mu50
ugaauauacuuaauuuaa

SEQ ID NO: 2044899 - RNA, 14 nt, Staphylococcus aureus subsp. aureus Mu50
ugaauaugauauua

SEQ ID NO: 2044900 - RNA, 22 nt, Staphylococcus aureus subsp. aureus Mu50
ugaagcguuuuuauuacaaaca

SEQ ID NO: 2044901 - RNA, 14 nt, Staphylococcus aureus subsp. aureus Mu50
ugaagguaauuuaa

SEQ ID NO: 2044902 - RNA, 15 nt, Staphylococcus aureus subsp. aureus Mu50
ugaaguaagucauau

SEQ ID NO: 2044903 - RNA, 18 nt, Staphylococcus aureus subsp. aureus Mu50
ugaaguacauuaaaacaa

SEQ ID NO: 2044904 - RNA, 15 nt, Staphylococcus aureus subsp. aureus Mu50
ugaagaaauuugaug

SEQ ID NO: 2044905 - RNA, 14 nt, Staphylococcus aureus subsp. aureus Mu50
ugaacuucuuuuuu

SEQ ID NO: 2044906 - RNA, 20 nt, Staphylococcus aureus subsp. aureus Mu50
ugaagaacgaucuguccauu

SEQ ID NO: 2044907 - RNA, 16 nt, Staphylococcus aureus subsp. aureus Mu50
ugaacgguuguauuuc

SEQ ID NO: 2044908 - RNA, 14 nt, Staphylococcus aureus subsp. aureus Mu50
ugaacgguagaaua

SEQ ID NO: 2044909 - RNA, 18 nt, Staphylococcus aureus subsp. aureus Mu50
ugaaacaucuugauauuc

SEQ ID NO: 2044910 - RNA, 16 nt, Staphylococcus aureus subsp. aureus Mu50
ugacauaucgauauuc

SEQ ID NO: 2044911 - RNA, 15 nt, Staphylococcus aureus subsp. aureus Mu50
ugacauaggcgcuuu

SEQ ID NO: 2044912 - RNA, 20 nt, Staphylococcus aureus subsp. aureus Mu50
ugacaguuuccauaaauaaa

SEQ ID NO: 2044913 - RNA, 14 nt, Staphylococcus aureus subsp. aureus Mu50
ugacauaaaaaaua

SEQ ID NO: 2044914 - RNA, 22 nt, Staphylococcus aureus subsp. aureus Mu50
ugacauaaaacuuacauuacau

SEQ ID NO: 2044915 - RNA, 19 nt, Staphylococcus aureus subsp. aureus Mu50
ugacacucauucaauuuag

SEQ ID NO: 2044916 - RNA, 19 nt, Staphylococcus aureus subsp. aureus Mu50
ugacauggcacgauaauug

SEQ ID NO: 2044917 - RNA, 18 nt, Staphylococcus aureus subsp. aureus Mu50
ugacauuucaucaauaau

SEQ ID NO: 2044918 - RNA, 21 nt, Staphylococcus aureus subsp. aureus Mu50
ugacauuucaucaauaauuuc

SEQ ID NO: 2044919 - RNA, 17 nt, Staphylococcus aureus subsp. aureus Mu50
ugacauuuucaaguuua

SEQ ID NO: 2044920 - RNA, 22 nt, Staphylococcus aureus subsp. aureus Mu50
ugaaugaaaggcgucuuaaauu

SEQ ID NO: 2044921 - RNA, 20 nt, Staphylococcus aureus subsp. aureus Mu50
ugaaucuuauuuuguuuuaa

SEQ ID NO: 2044922 - RNA, 20 nt, Staphylococcus aureus subsp. aureus Mu50
ugaaucuaaacuauaauaau

SEQ ID NO: 2044923 - RNA, 21 nt, Staphylococcus aureus subsp. aureus Mu50
ugaaucuaaacuauaauaauu

SEQ ID NO: 2044924 - RNA, 18 nt, Staphylococcus aureus subsp. aureus Mu50
ugaaucccauaacaauca

SEQ ID NO: 2044925 - RNA, 22 nt, Staphylococcus aureus subsp. aureus Mu50
ugaauuaacaauauuaaauuuc

SEQ ID NO: 2044926 - RNA, 22 nt, Staphylococcus aureus subsp. aureus Mu50
ugaauuucaaaauaguaaagug

SEQ ID NO: 2044927 - RNA, 21 nt, Staphylococcus aureus subsp. aureus Mu50
ugacacauuauugaaauuuuu

SEQ ID NO: 2044928 - RNA, 17 nt, Staphylococcus aureus subsp. aureus Mu50
ugacaauguacauaaau

SEQ ID NO: 2044929 - RNA, 12 nt, Staphylococcus aureus subsp. aureus Mu50
ugacaccuaaua

SEQ ID NO: 2044930 - RNA, 23 nt, Staphylococcus aureus subsp. aureus Mu50
ugaauuuuauuagguaauacuuu

SEQ ID NO: 2044931 - RNA, 13 nt, Staphylococcus aureus subsp. aureus Mu50
ugacaacauuauu

SEQ ID NO: 2044932 - RNA, 23 nt, Staphylococcus aureus subsp. aureus Mu50
ugaauuuuaacuaagauuaguag

SEQ ID NO: 2044933 - RNA, 19 nt, Staphylococcus aureus subsp. aureus Mu50
ugacaacuuaauagaaaga

SEQ ID NO: 2044934 - RNA, 14 nt, Staphylococcus aureus subsp. aureus Mu50
agcucauagcaaau

SEQ ID NO: 2044935 - RNA, 16 nt, Staphylococcus aureus subsp. aureus Mu50
agcuagcauguuuuga

SEQ ID NO: 2044936 - RNA, 18 nt, Staphylococcus aureus subsp. aureus Mu50
agcuagaaacaaugcgaa

SEQ ID NO: 2044937 - RNA, 16 nt, Staphylococcus aureus subsp. aureus Mu50
agcuacaaauaaugag

SEQ ID NO: 2044938 - RNA, 14 nt, Staphylococcus aureus subsp. aureus Mu50
agcuaaacgacauu

SEQ ID NO: 2044939 - RNA, 13 nt, Staphylococcus aureus subsp. aureus Mu50
agcuaaaaguuuc

SEQ ID NO: 2044940 - RNA, 18 nt, Staphylococcus aureus subsp. aureus Mu50
agcuaaacgcaauacgaa

SEQ ID NO: 2044941 - RNA, 16 nt, Staphylococcus aureus subsp. aureus Mu50
agcguaauuauuauaa

SEQ ID NO: 2044942 - RNA, 17 nt, Staphylococcus aureus subsp. aureus Mu50
agcguaauuauuauaau

SEQ ID NO: 2044943 - RNA, 18 nt, Staphylococcus aureus subsp. aureus Mu50
agcguaauuauuauaaua

SEQ ID NO: 2044944 - RNA, 15 nt, Staphylococcus aureus subsp. aureus Mu50
agcguacgauauagu

SEQ ID NO: 2044945 - RNA, 18 nt, Staphylococcus aureus subsp. aureus Mu50
agcuuacugcuuuuuuau

SEQ ID NO: 2044946 - RNA, 13 nt, Staphylococcus aureus subsp. aureus Mu50
agcuuaucaacga

SEQ ID NO: 2044947 - RNA, 18 nt, Staphylococcus aureus subsp. aureus Mu50
agcuugcuuacaauaauc

SEQ ID NO: 2044948 - RNA, 15 nt, Staphylococcus aureus subsp. aureus Mu50
agcuugauuuaacaa

SEQ ID NO: 2044949 - RNA, 19 nt, Staphylococcus aureus subsp. aureus Mu50
agcuugggacagaaaacaa

SEQ ID NO: 2044950 - RNA, 15 nt, Staphylococcus aureus subsp. aureus Mu50
agcuucuaaguaaua

SEQ ID NO: 2044951 - RNA, 14 nt, Staphylococcus aureus subsp. aureus Mu50
agcuucuuuaaaua

SEQ ID NO: 2044952 - RNA, 22 nt, Staphylococcus aureus subsp. aureus Mu50
agcuucuuaaaucaacaucauc

SEQ ID NO: 2044953 - RNA, 16 nt, Staphylococcus aureus subsp. aureus Mu50
aggaccacucaauucu

SEQ ID NO: 2044954 - RNA, 16 nt, Staphylococcus aureus subsp. aureus Mu50
aggaagucaccauauu

SEQ ID NO: 2044955 - RNA, 17 nt, Staphylococcus aureus subsp. aureus Mu50
aggaagucaccauauuu

SEQ ID NO: 2044956 - RNA, 21 nt, Staphylococcus aureus subsp. aureus Mu50
aggaacguguucuaaaaguug

SEQ ID NO: 2044957 - RNA, 21 nt, Staphylococcus aureus subsp. aureus Mu50
agcuuuuacgccuucuuuaua

SEQ ID NO: 2044958 - RNA, 18 nt, Staphylococcus aureus subsp. aureus Mu50
agcuuucuuuuucaucuu

SEQ ID NO: 2044959 - RNA, 20 nt, Staphylococcus aureus subsp. aureus Mu50
agcuuucuuuuucaucuuuc

SEQ ID NO: 2044960 - RNA, 17 nt, Staphylococcus aureus subsp. aureus Mu50
aggaaauggcuccauuu

SEQ ID NO: 2044961 - RNA, 17 nt, Staphylococcus aureus subsp. aureus Mu50
aaacguacauuuuuaug

SEQ ID NO: 2044962 - RNA, 15 nt, Staphylococcus aureus subsp. aureus Mu50
aaacgugacauuuuc

SEQ ID NO: 2044963 - RNA, 22 nt, Staphylococcus aureus subsp. aureus Mu50
aaacgucgugucugaauacacg

SEQ ID NO: 2044964 - RNA, 14 nt, Staphylococcus aureus subsp. aureus Mu50
aaacguucaaucgu

SEQ ID NO: 2044965 - RNA, 12 nt, Staphylococcus aureus subsp. aureus Mu50
aaacguuuaauu

SEQ ID NO: 2044966 - RNA, 13 nt, Staphylococcus aureus subsp. aureus Mu50
aaacuaaucaaau

SEQ ID NO: 2044967 - RNA, 15 nt, Staphylococcus aureus subsp. aureus Mu50
aggauaauuucaauu

SEQ ID NO: 2044968 - RNA, 15 nt, Staphylococcus aureus subsp. aureus Mu50
aggauacauaaaucu

SEQ ID NO: 2044969 - RNA, 15 nt, Staphylococcus aureus subsp. aureus Mu50
aggauaugcuaaaca

SEQ ID NO: 2044970 - RNA, 22 nt, Staphylococcus aureus subsp. aureus Mu50
aggauaugcuguguaucaucau

SEQ ID NO: 2044971 - RNA, 18 nt, Staphylococcus aureus subsp. aureus Mu50
aggaucaagugcagaugu

SEQ ID NO: 2044972 - RNA, 14 nt, Staphylococcus aureus subsp. aureus Mu50
aggauauuuuuuaa

SEQ ID NO: 2044973 - RNA, 20 nt, Staphylococcus aureus subsp. aureus Mu50
aggauuugcaccuauaccuc

SEQ ID NO: 2044974 - RNA, 13 nt, Staphylococcus aureus subsp. aureus Mu50
aggauuuuuuuag

SEQ ID NO: 2044975 - RNA, 15 nt, Staphylococcus aureus subsp. aureus Mu50
aggauguuauaaaau

SEQ ID NO: 2044976 - RNA, 20 nt, Staphylococcus aureus subsp. aureus Mu50
aggauguucaucaacaugau

SEQ ID NO: 2044977 - RNA, 22 nt, Staphylococcus aureus subsp. aureus Mu50
aggcaauguaaugguuaauaac

SEQ ID NO: 2044978 - RNA, 14 nt, Staphylococcus aureus subsp. aureus Mu50
agauuauuuuuuua

SEQ ID NO: 2044979 - RNA, 18 nt, Staphylococcus aureus subsp. aureus Mu50
agauucacuguauaaaua

SEQ ID NO: 2044980 - RNA, 19 nt, Staphylococcus aureus subsp. aureus Mu50
agauucggaaaauaugaua

SEQ ID NO: 2044981 - RNA, 22 nt, Staphylococcus aureus subsp. aureus Mu50
agauucggaaaauaugauaacu

SEQ ID NO: 2044982 - RNA, 19 nt, Staphylococcus aureus subsp. aureus Mu50
agauuaugacaacauaaca

SEQ ID NO: 2044983 - RNA, 18 nt, Staphylococcus aureus subsp. aureus Mu50
agauuaguagucaaaauu

SEQ ID NO: 2044984 - RNA, 15 nt, Staphylococcus aureus subsp. aureus Mu50
agauuauauuaucau

SEQ ID NO: 2044985 - RNA, 22 nt, Staphylococcus aureus subsp. aureus Mu50
agauuuaccucuugauaaaaua

SEQ ID NO: 2044986 - RNA, 16 nt, Staphylococcus aureus subsp. aureus Mu50
agauuuaguuuuuuua

SEQ ID NO: 2044987 - RNA, 18 nt, Staphylococcus aureus subsp. aureus Mu50
agauuggcugugcuauaa

SEQ ID NO: 2044988 - RNA, 19 nt, Staphylococcus aureus subsp. aureus Mu50
agauucuucaccaacuuuu

SEQ ID NO: 2044989 - RNA, 15 nt, Staphylococcus aureus subsp. aureus Mu50
agauuuucaacacac

SEQ ID NO: 2044990 - RNA, 20 nt, Staphylococcus aureus subsp. aureus Mu50
agauuuuaaaaauucauaau

SEQ ID NO: 2044991 - RNA, 18 nt, Staphylococcus aureus subsp. aureus Mu50
agauuuugaauuuuauaa

SEQ ID NO: 2044992 - RNA, 17 nt, Staphylococcus aureus subsp. aureus Mu50
agauuuguagcuugaau

SEQ ID NO: 2044993 - RNA, 16 nt, Staphylococcus aureus subsp. aureus Mu50
agcaguugacuguaaa

SEQ ID NO: 2044994 - RNA, 20 nt, Staphylococcus aureus subsp. aureus Mu50
agcaguugacuguaaaacaa

SEQ ID NO: 2044995 - RNA, 12 nt, Staphylococcus aureus subsp. aureus Mu50
agccauaacuga

SEQ ID NO: 2044996 - RNA, 14 nt, Staphylococcus aureus subsp. aureus Mu50
agcauuuuuauauc

SEQ ID NO: 2044997 - RNA, 19 nt, Staphylococcus aureus subsp. aureus Mu50
agcauuuuuauguuaaauc

SEQ ID NO: 2044998 - RNA, 14 nt, Staphylococcus aureus subsp. aureus Mu50
agcauuuucaaugu

SEQ ID NO: 2044999 - RNA, 14 nt, Staphylococcus aureus subsp. aureus Mu50
agccaauaaaaugu

SEQ ID NO: 2045000 - RNA, 22 nt, Staphylococcus aureus subsp. aureus Mu50
agcaugacacucauucaauuua

SEQ ID NO: 2045001 - RNA, 20 nt, Staphylococcus aureus subsp. aureus Mu50
agcauaugguaaaucgucau

SEQ ID NO: 2045002 - RNA, 22 nt, Staphylococcus aureus subsp. aureus Mu50
agcccuaagcucguuaauuuua

SEQ ID NO: 2045003 - RNA, 21 nt, Staphylococcus aureus subsp. aureus Mu50
agcgaaaguaucuaugaaauu

SEQ ID NO: 2045004 - RNA, 23 nt, Staphylococcus aureus subsp. aureus Mu50
agccugauguaccacucauaauc

SEQ ID NO: 2045005 - RNA, 20 nt, Staphylococcus aureus subsp. aureus Mu50
agccucuaaugauuaaaaau

SEQ ID NO: 2045006 - RNA, 18 nt, Staphylococcus aureus subsp. aureus Mu50
agcgauaccuuuaauauc

SEQ ID NO: 2045007 - RNA, 17 nt, Staphylococcus aureus subsp. aureus Mu50
agcgauuuccaucauuu

SEQ ID NO: 2045008 - RNA, 23 nt, Staphylococcus aureus subsp. aureus Mu50
auccccgaagcacagaaaauuau

SEQ ID NO: 2045009 - RNA, 22 nt, Staphylococcus aureus subsp. aureus Mu50
auccauugcacuaugcauaaua

SEQ ID NO: 2045010 - RNA, 21 nt, Staphylococcus aureus subsp. aureus Mu50
aucccaaguuacaauaucaua

SEQ ID NO: 2045011 - RNA, 14 nt, Staphylococcus aureus subsp. aureus Mu50
auccaucaauacca

SEQ ID NO: 2045012 - RNA, 19 nt, Staphylococcus aureus subsp. aureus Mu50
auccaucaauaccauaauu

SEQ ID NO: 2045013 - RNA, 15 nt, Staphylococcus aureus subsp. aureus Mu50
aucccucuaucaaau

SEQ ID NO: 2045014 - RNA, 20 nt, Staphylococcus aureus subsp. aureus Mu50
aucccuuuuagcauaauuag

SEQ ID NO: 2045015 - RNA, 18 nt, Staphylococcus aureus subsp. aureus Mu50
aucauuuuuaauuuugac

SEQ ID NO: 2045016 - RNA, 15 nt, Staphylococcus aureus subsp. aureus Mu50
auccaaaacauuuug

SEQ ID NO: 2045017 - RNA, 22 nt, Staphylococcus aureus subsp. aureus Mu50
auccaaaaucuuuacuuguaau

SEQ ID NO: 2045018 - RNA, 18 nt, Staphylococcus aureus subsp. aureus Mu50
auccaaaccaauuuuaac

SEQ ID NO: 2045019 - RNA, 16 nt, Staphylococcus aureus subsp. aureus Mu50
aucauuuaauugaugu

SEQ ID NO: 2045020 - RNA, 22 nt, Staphylococcus aureus subsp. aureus Mu50
aucauuauuuagaauucuaaaa

SEQ ID NO: 2045021 - RNA, 15 nt, Staphylococcus aureus subsp. aureus Mu50
aucauuguaaaacaa

SEQ ID NO: 2045022 - RNA, 19 nt, Staphylococcus aureus subsp. aureus Mu50
aucauuucugucccacucc

SEQ ID NO: 2045023 - RNA, 15 nt, Staphylococcus aureus subsp. aureus Mu50
aucauuugaugcuuu

SEQ ID NO: 2045024 - RNA, 21 nt, Staphylococcus aureus subsp. aureus Mu50
aucauuuguguauaaauguca

SEQ ID NO: 2045025 - RNA, 16 nt, Staphylococcus aureus subsp. aureus Mu50
aucauuuguguuuuua

SEQ ID NO: 2045026 - RNA, 17 nt, Staphylococcus aureus subsp. aureus Mu50
aucauuuguguuuuuaa

SEQ ID NO: 2045027 - RNA, 22 nt, Staphylococcus aureus subsp. aureus Mu50
aucauuuguguuuuuaauguuu

SEQ ID NO: 2045028 - RNA, 24 nt, Staphylococcus aureus subsp. aureus Mu50
aucauugaauguuggaucggcauu

SEQ ID NO: 2045029 - RNA, 22 nt, Staphylococcus aureus subsp. aureus Mu50
aucauucuguguaaauauaaau

SEQ ID NO: 2045030 - RNA, 18 nt, Staphylococcus aureus subsp. aureus Mu50
aucauugaauguuggauc

SEQ ID NO: 2045031 - RNA, 20 nt, Staphylococcus aureus subsp. aureus Mu50
aucaugugcuuuguuuauca

SEQ ID NO: 2045032 - RNA, 20 nt, Staphylococcus aureus subsp. aureus Mu50
aucauuaguguagaaaauag

SEQ ID NO: 2045033 - RNA, 16 nt, Staphylococcus aureus subsp. aureus Mu50
aucauuauaaaauggu

SEQ ID NO: 2045034 - RNA, 16 nt, Staphylococcus aureus subsp. aureus Mu50
aucauuauacgugcuu

SEQ ID NO: 2045035 - RNA, 22 nt, Staphylococcus aureus subsp. aureus Mu50
aucauggcuuauacacuuacaa

SEQ ID NO: 2045036 - RNA, 22 nt, Staphylococcus aureus subsp. aureus Mu50
aucauguaaugcuuaaaaacaa

SEQ ID NO: 2045037 - RNA, 15 nt, Staphylococcus aureus subsp. aureus Mu50
aucaugugacauaac

SEQ ID NO: 2045038 - RNA, 14 nt, Staphylococcus aureus subsp. aureus Mu50
auccuuuaaugcuu

SEQ ID NO: 2045039 - RNA, 18 nt, Staphylococcus aureus subsp. aureus Mu50
auccuuuauauucuaaua

SEQ ID NO: 2045040 - RNA, 22 nt, Staphylococcus aureus subsp. aureus Mu50
auccuuugauguuuucuauaau

SEQ ID NO: 2045041 - RNA, 14 nt, Staphylococcus aureus subsp. aureus Mu50
auccuguguaaaau

SEQ ID NO: 2045042 - RNA, 17 nt, Staphylococcus aureus subsp. aureus Mu50
auccuuaauugcucuuc

SEQ ID NO: 2045043 - RNA, 16 nt, Staphylococcus aureus subsp. aureus Mu50
auccuucucaucauuu

SEQ ID NO: 2045044 - RNA, 15 nt, Staphylococcus aureus subsp. aureus Mu50
auccugccaauauau

SEQ ID NO: 2045045 - RNA, 17 nt, Staphylococcus aureus subsp. aureus Mu50
auccuggaauauuaaca

SEQ ID NO: 2045046 - RNA, 20 nt, Staphylococcus aureus subsp. aureus Mu50
auccuggaauauuaacacca

SEQ ID NO: 2045047 - RNA, 15 nt, Staphylococcus aureus subsp. aureus Mu50
auccuaagcauaauu

SEQ ID NO: 2045048 - RNA, 15 nt, Staphylococcus aureus subsp. aureus Mu50
aucagcuaaauauuu

SEQ ID NO: 2045049 - RNA, 11 nt, Staphylococcus aureus subsp. aureus Mu50
aucagcuuuaa

SEQ ID NO: 2045050 - RNA, 17 nt, Staphylococcus aureus subsp. aureus Mu50
aucagcuuuaauaauau

SEQ ID NO: 2045051 - RNA, 23 nt, Staphylococcus aureus subsp. aureus Mu50
aucagcuuuggcgacauaaauac

SEQ ID NO: 2045052 - RNA, 18 nt, Staphylococcus aureus subsp. aureus Mu50
aucaguaguuuuaaaagu

SEQ ID NO: 2045053 - RNA, 14 nt, Staphylococcus aureus subsp. aureus Mu50
aucaguauuuacuu

SEQ ID NO: 2045054 - RNA, 21 nt, Staphylococcus aureus subsp. aureus Mu50
aucaguaauaauguaguaguu

SEQ ID NO: 2045055 - RNA, 22 nt, Staphylococcus aureus subsp. aureus Mu50
aucaguuucaucaaguauaaau

SEQ ID NO: 2045056 - RNA, 14 nt, Staphylococcus aureus subsp. aureus Mu50
aucauaaauaacac

SEQ ID NO: 2045057 - RNA, 23 nt, Staphylococcus aureus subsp. aureus Mu50
aucauaaauguuauuaaccauca

SEQ ID NO: 2045058 - RNA, 14 nt, Staphylococcus aureus subsp. aureus Mu50
aucagucucuaaaa

SEQ ID NO: 2045059 - RNA, 23 nt, Staphylococcus aureus subsp. aureus Mu50
aucagucucuaaaacuuuuucaa

SEQ ID NO: 2045060 - RNA, 14 nt, Staphylococcus aureus subsp. aureus Mu50
aucaguuaauaauu

SEQ ID NO: 2045061 - RNA, 18 nt, Staphylococcus aureus subsp. aureus Mu50
aucaucaccauacuaaaa

SEQ ID NO: 2045062 - RNA, 12 nt, Staphylococcus aureus subsp. aureus Mu50
aucaucauacuu

SEQ ID NO: 2045063 - RNA, 21 nt, Staphylococcus aureus subsp. aureus Mu50
aucaucacuguagauucaaau

SEQ ID NO: 2045064 - RNA, 20 nt, Staphylococcus aureus subsp. aureus Mu50
aucaucaacaaucuuuuuca

SEQ ID NO: 2045065 - RNA, 21 nt, Staphylococcus aureus subsp. aureus Mu50
aucauauuugaauacuuuauu

SEQ ID NO: 2045066 - RNA, 22 nt, Staphylococcus aureus subsp. aureus Mu50
aucauagacaauguucuuuuca

SEQ ID NO: 2045067 - RNA, 16 nt, Staphylococcus aureus subsp. aureus Mu50
aucauaccaauccgaa

SEQ ID NO: 2045068 - RNA, 19 nt, Staphylococcus aureus subsp. aureus Mu50
aucauaccagcaaguguau

SEQ ID NO: 2045069 - RNA, 15 nt, Staphylococcus aureus subsp. aureus Mu50
aucauccauaaaaau

SEQ ID NO: 2045070 - RNA, 16 nt, Staphylococcus aureus subsp. aureus Mu50
aucauccauaaaaaua

SEQ ID NO: 2045071 - RNA, 24 nt, Staphylococcus aureus subsp. aureus Mu50
aucaucgccaugacguauacaaau

SEQ ID NO: 2045072 - RNA, 13 nt, Staphylococcus aureus subsp. aureus Mu50
aucaugcauaauc

SEQ ID NO: 2045073 - RNA, 16 nt, Staphylococcus aureus subsp. aureus Mu50
aucaugcaaaacuaau

SEQ ID NO: 2045074 - RNA, 13 nt, Staphylococcus aureus subsp. aureus Mu50
aucaugcaaaaua

SEQ ID NO: 2045075 - RNA, 16 nt, Staphylococcus aureus subsp. aureus Mu50
aucaugccuucaugaa

SEQ ID NO: 2045076 - RNA, 17 nt, Staphylococcus aureus subsp. aureus Mu50
aucacuuggaauaauac

SEQ ID NO: 2045077 - RNA, 21 nt, Staphylococcus aureus subsp. aureus Mu50
aucacuugguaaaacaucgua

SEQ ID NO: 2045078 - RNA, 16 nt, Staphylococcus aureus subsp. aureus Mu50
aucaagcugagcuuua

SEQ ID NO: 2045079 - RNA, 16 nt, Staphylococcus aureus subsp. aureus Mu50
aucaaguauaaauguu

SEQ ID NO: 2045080 - RNA, 20 nt, Staphylococcus aureus subsp. aureus Mu50
aucaaguuuacgaucauaaa

SEQ ID NO: 2045081 - RNA, 16 nt, Staphylococcus aureus subsp. aureus Mu50
aucaauacaauuuuac

SEQ ID NO: 2045082 - RNA, 15 nt, Staphylococcus aureus subsp. aureus Mu50
aucaauaccauaauu

SEQ ID NO: 2045083 - RNA, 22 nt, Staphylococcus aureus subsp. aureus Mu50
aucaauaucuucuaauuccauc

SEQ ID NO: 2045084 - RNA, 16 nt, Staphylococcus aureus subsp. aureus Mu50
aucaauauaauuuggu

SEQ ID NO: 2045085 - RNA, 15 nt, Staphylococcus aureus subsp. aureus Mu50
aucaauagaugaaaa

SEQ ID NO: 2045086 - RNA, 18 nt, Staphylococcus aureus subsp. aureus Mu50
aucaaugacauccauaca

SEQ ID NO: 2045087 - RNA, 17 nt, Staphylococcus aureus subsp. aureus Mu50
auauuuauuguuuuuaa

SEQ ID NO: 2045088 - RNA, 22 nt, Staphylococcus aureus subsp. aureus Mu50
auauuucggacgauaacagcua

SEQ ID NO: 2045089 - RNA, 12 nt, Staphylococcus aureus subsp. aureus Mu50
auauuucuaaac

SEQ ID NO: 2045090 - RNA, 16 nt, Staphylococcus aureus subsp. aureus Mu50
auauuucuaaaccauu

SEQ ID NO: 2045091 - RNA, 21 nt, Staphylococcus aureus subsp. aureus Mu50
auauuuaggacgugccuuaac

SEQ ID NO: 2045092 - RNA, 16 nt, Staphylococcus aureus subsp. aureus Mu50
auauuuagauuuauaa

SEQ ID NO: 2045093 - RNA, 22 nt, Staphylococcus aureus subsp. aureus Mu50
auauuuauuaguugugguuguu

SEQ ID NO: 2045094 - RNA, 20 nt, Staphylococcus aureus subsp. aureus Mu50
auauuuagaauaagaaauaa

SEQ ID NO: 2045095 - RNA, 18 nt, Staphylococcus aureus subsp. aureus Mu50
auauuuagaaugaugagu

SEQ ID NO: 2045096 - RNA, 19 nt, Staphylococcus aureus subsp. aureus Mu50
auauuuagaaugaugagua

SEQ ID NO: 2045097 - RNA, 20 nt, Staphylococcus aureus subsp. aureus Mu50
auauuuagauuggucaaacu

SEQ ID NO: 2045098 - RNA, 14 nt, Staphylococcus aureus subsp. aureus Mu50
auauuuaacauuuu

SEQ ID NO: 2045099 - RNA, 12 nt, Staphylococcus aureus subsp. aureus Mu50
auauuuaaaaua

SEQ ID NO: 2045100 - RNA, 15 nt, Staphylococcus aureus subsp. aureus Mu50
auauuuaaaauauua

SEQ ID NO: 2045101 - RNA, 20 nt, Staphylococcus aureus subsp. aureus Mu50
auauugugccgcuucuacaa

SEQ ID NO: 2045102 - RNA, 14 nt, Staphylococcus aureus subsp. aureus Mu50
auauuguuaaaauu

SEQ ID NO: 2045103 - RNA, 16 nt, Staphylococcus aureus subsp. aureus Mu50
auauuggcuugcuuca

SEQ ID NO: 2045104 - RNA, 22 nt, Staphylococcus aureus subsp. aureus Mu50
auauuuucugcgauauagcuuu

SEQ ID NO: 2045105 - RNA, 23 nt, Staphylococcus aureus subsp. aureus Mu50
auauuuucugcgauauagcuuug

SEQ ID NO: 2045106 - RNA, 14 nt, Staphylococcus aureus subsp. aureus Mu50
auauuuuaaaaagu

SEQ ID NO: 2045107 - RNA, 14 nt, Staphylococcus aureus subsp. aureus Mu50
auauuuuacaaaau

SEQ ID NO: 2045108 - RNA, 22 nt, Staphylococcus aureus subsp. aureus Mu50
auauuucuaguugcaaucguau

SEQ ID NO: 2045109 - RNA, 15 nt, Staphylococcus aureus subsp. aureus Mu50
auauuuuguuaauaa

SEQ ID NO: 2045110 - RNA, 22 nt, Staphylococcus aureus subsp. aureus Mu50
auauuuuguuaauaagcgcauc

SEQ ID NO: 2045111 - RNA, 13 nt, Staphylococcus aureus subsp. aureus Mu50
auauuuuuauuaa

SEQ ID NO: 2045112 - RNA, 23 nt, Staphylococcus aureus subsp. aureus Mu50
auauuuuuguauuuauguuuucu

SEQ ID NO: 2045113 - RNA, 12 nt, Staphylococcus aureus subsp. aureus Mu50
aucaaaaguuug

SEQ ID NO: 2045114 - RNA, 16 nt, Staphylococcus aureus subsp. aureus Mu50
aucaacauaaaauuua

SEQ ID NO: 2045115 - RNA, 19 nt, Staphylococcus aureus subsp. aureus Mu50
aucaacaucaucuuuaauu

SEQ ID NO: 2045116 - RNA, 17 nt, Staphylococcus aureus subsp. aureus Mu50
aucaacauuaauaaaua

SEQ ID NO: 2045117 - RNA, 21 nt, Staphylococcus aureus subsp. aureus Mu50
aucaacauuaauaaauaauaa

SEQ ID NO: 2045118 - RNA, 22 nt, Staphylococcus aureus subsp. aureus Mu50
auauuuugcaauaauucaucuu

SEQ ID NO: 2045119 - RNA, 12 nt, Staphylococcus aureus subsp. aureus Mu50
aucaaaaauguu

SEQ ID NO: 2045120 - RNA, 15 nt, Staphylococcus aureus subsp. aureus Mu50
aucaaaauuaugacu

SEQ ID NO: 2045121 - RNA, 15 nt, Staphylococcus aureus subsp. aureus Mu50
aucaaaauuuucuac

SEQ ID NO: 2045122 - RNA, 15 nt, Staphylococcus aureus subsp. aureus Mu50
aucaaaccaccaaaa

SEQ ID NO: 2045123 - RNA, 19 nt, Staphylococcus aureus subsp. aureus Mu50
aucaacgccauauuuauuu

SEQ ID NO: 2045124 - RNA, 18 nt, Staphylococcus aureus subsp. aureus Mu50
aucaacgauuuugucuuu

SEQ ID NO: 2045125 - RNA, 12 nt, Staphylococcus aureus subsp. aureus Mu50
auauucaaugau

SEQ ID NO: 2045126 - RNA, 18 nt, Staphylococcus aureus subsp. aureus Mu50
auauucacgauauaacau

SEQ ID NO: 2045127 - RNA, 20 nt, Staphylococcus aureus subsp. aureus Mu50
auauucacgauauaacauua

SEQ ID NO: 2045128 - RNA, 22 nt, Staphylococcus aureus subsp. aureus Mu50
auauucauuccuaagaauguaa

SEQ ID NO: 2045129 - RNA, 16 nt, Staphylococcus aureus subsp. aureus Mu50
auauucauucuagcau

SEQ ID NO: 2045130 - RNA, 22 nt, Staphylococcus aureus subsp. aureus Mu50
auauucgauacauaaaacauca

SEQ ID NO: 2045131 - RNA, 23 nt, Staphylococcus aureus subsp. aureus Mu50
auauucgcgaacguuauuuucaa

SEQ ID NO: 2045132 - RNA, 19 nt, Staphylococcus aureus subsp. aureus Mu50
auauucguaaauccuuuau

SEQ ID NO: 2045133 - RNA, 14 nt, Staphylococcus aureus subsp. aureus Mu50
auauucguuacaaa

SEQ ID NO: 2045134 - RNA, 16 nt, Staphylococcus aureus subsp. aureus Mu50
auauucguuacaaaug

SEQ ID NO: 2045135 - RNA, 14 nt, Staphylococcus aureus subsp. aureus Mu50
auauucuaaaaaau

SEQ ID NO: 2045136 - RNA, 15 nt, Staphylococcus aureus subsp. aureus Mu50
auauucuauuguugu

SEQ ID NO: 2045137 - RNA, 17 nt, Staphylococcus aureus subsp. aureus Mu50
auauucuuuuuaacuau

SEQ ID NO: 2045138 - RNA, 16 nt, Staphylococcus aureus subsp. aureus Mu50
auauugaagaugcuuu

SEQ ID NO: 2045139 - RNA, 18 nt, Staphylococcus aureus subsp. aureus Mu50
auauugaauugaaaaauu

SEQ ID NO: 2045140 - RNA, 19 nt, Staphylococcus aureus subsp. aureus Mu50
auauugaauugaaaaauua

SEQ ID NO: 2045141 - RNA, 13 nt, Staphylococcus aureus subsp. aureus Mu50
auauugcaaaaau

SEQ ID NO: 2045142 - RNA, 14 nt, Staphylococcus aureus subsp. aureus Mu50
auauugcaaaacuu

SEQ ID NO: 2045143 - RNA, 14 nt, Staphylococcus aureus subsp. aureus Mu50
auaucuuuaucauu

SEQ ID NO: 2045144 - RNA, 17 nt, Staphylococcus aureus subsp. aureus Mu50
auaucuuuauuuuuuau

SEQ ID NO: 2045145 - RNA, 16 nt, Staphylococcus aureus subsp. aureus Mu50
auaucuuucaaauuaa

SEQ ID NO: 2045146 - RNA, 14 nt, Staphylococcus aureus subsp. aureus Mu50
auaucuuucaauua

SEQ ID NO: 2045147 - RNA, 21 nt, Staphylococcus aureus subsp. aureus Mu50
auaucuuacugcuguuuuuua

SEQ ID NO: 2045148 - RNA, 18 nt, Staphylococcus aureus subsp. aureus Mu50
auaucuucauuuaaaagu

SEQ ID NO: 2045149 - RNA, 12 nt, Staphylococcus aureus subsp. aureus Mu50
auaucuucugau

SEQ ID NO: 2045150 - RNA, 19 nt, Staphylococcus aureus subsp. aureus Mu50
auaucuucuuuauuuacac

SEQ ID NO: 2045151 - RNA, 14 nt, Staphylococcus aureus subsp. aureus Mu50
auaucuucuuuuaa

SEQ ID NO: 2045152 - RNA, 15 nt, Staphylococcus aureus subsp. aureus Mu50
auaugauaaccaaac

SEQ ID NO: 2045153 - RNA, 16 nt, Staphylococcus aureus subsp. aureus Mu50
auaugauuaaagcgau

SEQ ID NO: 2045154 - RNA, 23 nt, Staphylococcus aureus subsp. aureus Mu50
auaugaagcguuuuuauuacaaa

SEQ ID NO: 2045155 - RNA, 20 nt, Staphylococcus aureus subsp. aureus Mu50
auaucuuuuauacauguaca

SEQ ID NO: 2045156 - RNA, 17 nt, Staphylococcus aureus subsp. aureus Mu50
auaugaauugaguauua

SEQ ID NO: 2045157 - RNA, 20 nt, Staphylococcus aureus subsp. aureus Mu50
auaugaauuuagaugcauaa

SEQ ID NO: 2045158 - RNA, 20 nt, Staphylococcus aureus subsp. aureus Mu50
auaucaguaauaauacgcuu

SEQ ID NO: 2045159 - RNA, 15 nt, Staphylococcus aureus subsp. aureus Mu50
auaucauacgcaacu

SEQ ID NO: 2045160 - RNA, 23 nt, Staphylococcus aureus subsp. aureus Mu50
auaucauauucaaaauaacuuau

SEQ ID NO: 2045161 - RNA, 18 nt, Staphylococcus aureus subsp. aureus Mu50
auaucaucaacaaucuuu

SEQ ID NO: 2045162 - RNA, 13 nt, Staphylococcus aureus subsp. aureus Mu50
auaucagcuuuuu

SEQ ID NO: 2045163 - RNA, 23 nt, Staphylococcus aureus subsp. aureus Mu50
auauauugacucgaccuuuauau

SEQ ID NO: 2045164 - RNA, 19 nt, Staphylococcus aureus subsp. aureus Mu50
auaucacugaaugcuaaua

SEQ ID NO: 2045165 - RNA, 17 nt, Staphylococcus aureus subsp. aureus Mu50
auaucacaacacauaaa

SEQ ID NO: 2045166 - RNA, 14 nt, Staphylococcus aureus subsp. aureus Mu50
auaucaaauacauu

SEQ ID NO: 2045167 - RNA, 23 nt, Staphylococcus aureus subsp. aureus Mu50
auaucaaauuggacugaugcauu

SEQ ID NO: 2045168 - RNA, 22 nt, Staphylococcus aureus subsp. aureus Mu50
auaucaacauguuccgcuacaa

SEQ ID NO: 2045169 - RNA, 14 nt, Staphylococcus aureus subsp. aureus Mu50
auaucaagauguuu

SEQ ID NO: 2045170 - RNA, 16 nt, Staphylococcus aureus subsp. aureus Mu50
auauaucaaauacauu

SEQ ID NO: 2045171 - RNA, 21 nt, Staphylococcus aureus subsp. aureus Mu50
auauaucacaacacauaaauu

SEQ ID NO: 2045172 - RNA, 14 nt, Staphylococcus aureus subsp. aureus Mu50
auauagcugugauu

SEQ ID NO: 2045173 - RNA, 19 nt, Staphylococcus aureus subsp. aureus Mu50
auagugagcguauuauuau

SEQ ID NO: 2045174 - RNA, 19 nt, Staphylococcus aureus subsp. aureus Mu50
auauauaaagaaauaauuu

SEQ ID NO: 2045175 - RNA, 14 nt, Staphylococcus aureus subsp. aureus Mu50
auauaguuauaugu

SEQ ID NO: 2045176 - RNA, 22 nt, Staphylococcus aureus subsp. aureus Mu50
auauaucuagccugaaauagaa

SEQ ID NO: 2045177 - RNA, 13 nt, Staphylococcus aureus subsp. aureus Mu50
auauaugaaauau

SEQ ID NO: 2045178 - RNA, 19 nt, Staphylococcus aureus subsp. aureus Mu50
auauauagauuaaaccgca

SEQ ID NO: 2045179 - RNA, 20 nt, Staphylococcus aureus subsp. aureus Mu50
auaguccgcguguacuuuac

SEQ ID NO: 2045180 - RNA, 14 nt, Staphylococcus aureus subsp. aureus Mu50
auagucauucauaa

SEQ ID NO: 2045181 - RNA, 17 nt, Staphylococcus aureus subsp. aureus Mu50
auagucauucauaauuu

SEQ ID NO: 2045182 - RNA, 19 nt, Staphylococcus aureus subsp. aureus Mu50
auaguacuuaauuuaaauu

SEQ ID NO: 2045183 - RNA, 19 nt, Staphylococcus aureus subsp. aureus Mu50
auaguaauaaaaugaugau

SEQ ID NO: 2045184 - RNA, 19 nt, Staphylococcus aureus subsp. aureus Mu50
auaguacauuuauuuucaa

SEQ ID NO: 2045185 - RNA, 19 nt, Staphylococcus aureus subsp. aureus Mu50
auaguaccaagcuucauua

SEQ ID NO: 2045186 - RNA, 17 nt, Staphylococcus aureus subsp. aureus Mu50
auaccauugugaugaua

SEQ ID NO: 2045187 - RNA, 20 nt, Staphylococcus aureus subsp. aureus Mu50
auacaggaaauugaagcguu

SEQ ID NO: 2045188 - RNA, 21 nt, Staphylococcus aureus subsp. aureus Mu50
auacagaucucaauccaauua

SEQ ID NO: 2045189 - RNA, 19 nt, Staphylococcus aureus subsp. aureus Mu50
auagguucaucuuuaugca

SEQ ID NO: 2045190 - RNA, 15 nt, Staphylococcus aureus subsp. aureus Mu50
auagcuguuugauau

SEQ ID NO: 2045191 - RNA, 17 nt, Staphylococcus aureus subsp. aureus Mu50
auagcuaaugcauuauu

SEQ ID NO: 2045192 - RNA, 13 nt, Staphylococcus aureus subsp. aureus Mu50
auagcgugauuuu

SEQ ID NO: 2045193 - RNA, 15 nt, Staphylococcus aureus subsp. aureus Mu50
auagcuaaagcuugc

SEQ ID NO: 2045194 - RNA, 16 nt, Staphylococcus aureus subsp. aureus Mu50
auagcguaauuauuau

SEQ ID NO: 2045195 - RNA, 21 nt, Staphylococcus aureus subsp. aureus Mu50
auagcggugugaauugauuuu

SEQ ID NO: 2045196 - RNA, 18 nt, Staphylococcus aureus subsp. aureus Mu50
auacaagcaauacgauug

SEQ ID NO: 2045197 - RNA, 23 nt, Staphylococcus aureus subsp. aureus Mu50
auacacaaauuuuuuguaaacau

SEQ ID NO: 2045198 - RNA, 18 nt, Staphylococcus aureus subsp. aureus Mu50
auacaaugauuacuuuaa

SEQ ID NO: 2045199 - RNA, 22 nt, Staphylococcus aureus subsp. aureus Mu50
auacacugcacaucauaauaaa

SEQ ID NO: 2045200 - RNA, 16 nt, Staphylococcus aureus subsp. aureus Mu50
auacacuuacaaauau

SEQ ID NO: 2045201 - RNA, 12 nt, Staphylococcus aureus subsp. aureus Mu50
auaauugaaaau

SEQ ID NO: 2045202 - RNA, 16 nt, Staphylococcus aureus subsp. aureus Mu50
auaauugaaaaucuaa

SEQ ID NO: 2045203 - RNA, 16 nt, Staphylococcus aureus subsp. aureus Mu50
auaauuagauuuaaaa

SEQ ID NO: 2045204 - RNA, 17 nt, Staphylococcus aureus subsp. aureus Mu50
auaauuauuaaacuuug

SEQ ID NO: 2045205 - RNA, 15 nt, Staphylococcus aureus subsp. aureus Mu50
auaauucaaugcuau

SEQ ID NO: 2045206 - RNA, 15 nt, Staphylococcus aureus subsp. aureus Mu50
auaauucagaugaau

SEQ ID NO: 2045207 - RNA, 22 nt, Staphylococcus aureus subsp. aureus Mu50
auaauguucccuuaccauuucu

SEQ ID NO: 2045208 - RNA, 13 nt, Staphylococcus aureus subsp. aureus Mu50
auaauuaaacuaa

SEQ ID NO: 2045209 - RNA, 12 nt, Staphylococcus aureus subsp. aureus Mu50
auaauuaaacua

SEQ ID NO: 2045210 - RNA, 17 nt, Staphylococcus aureus subsp. aureus Mu50
auaauuaacuuacuuuu

SEQ ID NO: 2045211 - RNA, 21 nt, Staphylococcus aureus subsp. aureus Mu50
auaauuaacuuacuuuuguaa

SEQ ID NO: 2045212 - RNA, 14 nt, Staphylococcus aureus subsp. aureus Mu50
auaaugugucaaau

SEQ ID NO: 2045213 - RNA, 14 nt, Staphylococcus aureus subsp. aureus Mu50
auaauguucccuua

SEQ ID NO: 2045214 - RNA, 16 nt, Staphylococcus aureus subsp. aureus Mu50
auaaugucuuacuuuu

SEQ ID NO: 2045215 - RNA, 20 nt, Staphylococcus aureus subsp. aureus Mu50
auaaugucuuacuuuuaaau

SEQ ID NO: 2045216 - RNA, 20 nt, Staphylococcus aureus subsp. aureus Mu50
auaaugguucucugucaaau

SEQ ID NO: 2045217 - RNA, 18 nt, Staphylococcus aureus subsp. aureus Mu50
auaaugguugaauaacac

SEQ ID NO: 2045218 - RNA, 15 nt, Staphylococcus aureus subsp. aureus Mu50
auaauguaauuguuu

SEQ ID NO: 2045219 - RNA, 13 nt, Staphylococcus aureus subsp. aureus Mu50
auaauguaucauu

SEQ ID NO: 2045220 - RNA, 18 nt, Staphylococcus aureus subsp. aureus Mu50
auaaugcagauucuucac

SEQ ID NO: 2045221 - RNA, 14 nt, Staphylococcus aureus subsp. aureus Mu50
auaauggacgguau

SEQ ID NO: 2045222 - RNA, 17 nt, Staphylococcus aureus subsp. aureus Mu50
auaaugaacaacaaauu

SEQ ID NO: 2045223 - RNA, 23 nt, Staphylococcus aureus subsp. aureus Mu50
auaaugaacaagggccauccauu

SEQ ID NO: 2045224 - RNA, 15 nt, Staphylococcus aureus subsp. aureus Mu50
auaaugaacgauauu

SEQ ID NO: 2045225 - RNA, 21 nt, Staphylococcus aureus subsp. aureus Mu50
auaaugaacgauauucuacau

SEQ ID NO: 2045226 - RNA, 16 nt, Staphylococcus aureus subsp. aureus Mu50
auaaugaauucauuca

SEQ ID NO: 2045227 - RNA, 23 nt, Staphylococcus aureus subsp. aureus Mu50
auaaugaauucauucaauacgaa

SEQ ID NO: 2045228 - RNA, 19 nt, Staphylococcus aureus subsp. aureus Mu50
auaaugacaaauuaucacu

SEQ ID NO: 2045229 - RNA, 19 nt, Staphylococcus aureus subsp. aureus Mu50
auaaucuucauuaauuaca

SEQ ID NO: 2045230 - RNA, 14 nt, Staphylococcus aureus subsp. aureus Mu50
auaaucuuuaacau

SEQ ID NO: 2045231 - RNA, 14 nt, Staphylococcus aureus subsp. aureus Mu50
auaaucuuuauuaa

SEQ ID NO: 2045232 - RNA, 17 nt, Staphylococcus aureus subsp. aureus Mu50
auaaucucauucuuuaa

SEQ ID NO: 2045233 - RNA, 22 nt, Staphylococcus aureus subsp. aureus Mu50
auaaucguuaaaacacccugcu

SEQ ID NO: 2045234 - RNA, 15 nt, Staphylococcus aureus subsp. aureus Mu50
auaaucauuaguuau

SEQ ID NO: 2045235 - RNA, 21 nt, Staphylococcus aureus subsp. aureus Mu50
auaauccgagucauacucauc

SEQ ID NO: 2045236 - RNA, 22 nt, Staphylococcus aureus subsp. aureus Mu50
auaaucacuuggcgacauuugu

SEQ ID NO: 2045237 - RNA, 14 nt, Staphylococcus aureus subsp. aureus Mu50
auaagguugaagaa

SEQ ID NO: 2045238 - RNA, 18 nt, Staphylococcus aureus subsp. aureus Mu50
auaaguaauaauauaaau

SEQ ID NO: 2045239 - RNA, 19 nt, Staphylococcus aureus subsp. aureus Mu50
auaaguaauaauauaaaua

SEQ ID NO: 2045240 - RNA, 14 nt, Staphylococcus aureus subsp. aureus Mu50
auaaguaauaauuu

SEQ ID NO: 2045241 - RNA, 20 nt, Staphylococcus aureus subsp. aureus Mu50
auaauaugccauaguaauaa

SEQ ID NO: 2045242 - RNA, 17 nt, Staphylococcus aureus subsp. aureus Mu50
auaauauuuaaccacuu

SEQ ID NO: 2045243 - RNA, 21 nt, Staphylococcus aureus subsp. aureus Mu50
auaaggcauauccgaaaauug

SEQ ID NO: 2045244 - RNA, 16 nt, Staphylococcus aureus subsp. aureus Mu50
auaaggacucuguuua

SEQ ID NO: 2045245 - RNA, 20 nt, Staphylococcus aureus subsp. aureus Mu50
auaagcugaaaaucaucauu

SEQ ID NO: 2045246 - RNA, 18 nt, Staphylococcus aureus subsp. aureus Mu50
auaagcgcaauuaaaagu

SEQ ID NO: 2045247 - RNA, 17 nt, Staphylococcus aureus subsp. aureus Mu50
auaaauuuuuaguuaaa

SEQ ID NO: 2045248 - RNA, 12 nt, Staphylococcus aureus subsp. aureus Mu50
auaacacaaguu

SEQ ID NO: 2045249 - RNA, 15 nt, Staphylococcus aureus subsp. aureus Mu50
auaacaccaauuaaa

SEQ ID NO: 2045250 - RNA, 15 nt, Staphylococcus aureus subsp. aureus Mu50
auaaauugaaguaca

SEQ ID NO: 2045251 - RNA, 16 nt, Staphylococcus aureus subsp. aureus Mu50
auaaauuucaagguau

SEQ ID NO: 2045252 - RNA, 16 nt, Staphylococcus aureus subsp. aureus Mu50
auaaauucccauguau

SEQ ID NO: 2045253 - RNA, 17 nt, Staphylococcus aureus subsp. aureus Mu50
auaacaaaaauugcuau

SEQ ID NO: 2045254 - RNA, 19 nt, Staphylococcus aureus subsp. aureus Mu50
auaaauuuugaauuacaga

SEQ ID NO: 2045255 - RNA, 22 nt, Staphylococcus aureus subsp. aureus Mu50
auaaaugcagcuguauaaccau

SEQ ID NO: 2045256 - RNA, 20 nt, Staphylococcus aureus subsp. aureus Mu50
auaaaugcuaaaaguauaaa

SEQ ID NO: 2045257 - RNA, 22 nt, Staphylococcus aureus subsp. aureus Mu50
auaaauguuaaagauuauuauu

SEQ ID NO: 2045258 - RNA, 22 nt, Staphylococcus aureus subsp. aureus Mu50
auaaauguuauuaaccaucaug

SEQ ID NO: 2045259 - RNA, 14 nt, Staphylococcus aureus subsp. aureus Mu50
auaaauuaauauga

SEQ ID NO: 2045260 - RNA, 16 nt, Staphylococcus aureus subsp. aureus Mu50
auaaauuacccacauc

SEQ ID NO: 2045261 - RNA, 15 nt, Staphylococcus aureus subsp. aureus Mu50
auaaauuagaugaaa

SEQ ID NO: 2045262 - RNA, 15 nt, Staphylococcus aureus subsp. aureus Mu50
aguucacuaaauuca

SEQ ID NO: 2045263 - RNA, 20 nt, Staphylococcus aureus subsp. aureus Mu50
aguucacuaaauucaauaau

SEQ ID NO: 2045264 - RNA, 20 nt, Staphylococcus aureus subsp. aureus Mu50
aguucaccguaaucuuuuaa

SEQ ID NO: 2045265 - RNA, 18 nt, Staphylococcus aureus subsp. aureus Mu50
aguucacaacaaagugua

SEQ ID NO: 2045266 - RNA, 17 nt, Staphylococcus aureus subsp. aureus Mu50
aguuaucggcuaaaguu

SEQ ID NO: 2045267 - RNA, 20 nt, Staphylococcus aureus subsp. aureus Mu50
aguuaucggcuaaaguuaua

SEQ ID NO: 2045268 - RNA, 20 nt, Staphylococcus aureus subsp. aureus Mu50
aguuaugacuaacgaaaaag

SEQ ID NO: 2045269 - RNA, 15 nt, Staphylococcus aureus subsp. aureus Mu50
aguuauuuuaauaac

SEQ ID NO: 2045270 - RNA, 12 nt, Staphylococcus aureus subsp. aureus Mu50
aguuauaucauc

SEQ ID NO: 2045271 - RNA, 16 nt, Staphylococcus aureus subsp. aureus Mu50
auaaaaccuucaauca

SEQ ID NO: 2045272 - RNA, 19 nt, Staphylococcus aureus subsp. aureus Mu50
auaaaaacucuaaaaguug

SEQ ID NO: 2045273 - RNA, 15 nt, Staphylococcus aureus subsp. aureus Mu50
auaaaacuuauaacu

SEQ ID NO: 2045274 - RNA, 19 nt, Staphylococcus aureus subsp. aureus Mu50
auaaaaaucuuaugauguc

SEQ ID NO: 2045275 - RNA, 19 nt, Staphylococcus aureus subsp. aureus Mu50
auaaaaagaauaugauauu

SEQ ID NO: 2045276 - RNA, 21 nt, Staphylococcus aureus subsp. aureus Mu50
auaaaagauauaaacauuuau

SEQ ID NO: 2045277 - RNA, 13 nt, Staphylococcus aureus subsp. aureus Mu50
aguuguacuucuu

SEQ ID NO: 2045278 - RNA, 20 nt, Staphylococcus aureus subsp. aureus Mu50
aguugugguuguuaauguau

SEQ ID NO: 2045279 - RNA, 18 nt, Staphylococcus aureus subsp. aureus Mu50
aguuguccauuuuaugca

SEQ ID NO: 2045280 - RNA, 14 nt, Staphylococcus aureus subsp. aureus Mu50
auaaauaagugaua

SEQ ID NO: 2045281 - RNA, 12 nt, Staphylococcus aureus subsp. aureus Mu50
auaaauaaguua

SEQ ID NO: 2045282 - RNA, 14 nt, Staphylococcus aureus subsp. aureus Mu50
auaaauaauaaguu

SEQ ID NO: 2045283 - RNA, 21 nt, Staphylococcus aureus subsp. aureus Mu50
auaaagucauaugguuaucuu

SEQ ID NO: 2045284 - RNA, 20 nt, Staphylococcus aureus subsp. aureus Mu50
auaaauaaaaauacauaauu

SEQ ID NO: 2045285 - RNA, 21 nt, Staphylococcus aureus subsp. aureus Mu50
auaaaggaauagcuacaauua

SEQ ID NO: 2045286 - RNA, 15 nt, Staphylococcus aureus subsp. aureus Mu50
auaaagaaauaauuu

SEQ ID NO: 2045287 - RNA, 13 nt, Staphylococcus aureus subsp. aureus Mu50
auaaauacaaaua

SEQ ID NO: 2045288 - RNA, 14 nt, Staphylococcus aureus subsp. aureus Mu50
auaaauaaaaugcu

SEQ ID NO: 2045289 - RNA, 14 nt, Staphylococcus aureus subsp. aureus Mu50
auaaauaaaauuuu

SEQ ID NO: 2045290 - RNA, 17 nt, Staphylococcus aureus subsp. aureus Mu50
auaaauauugaacaauu

SEQ ID NO: 2045291 - RNA, 19 nt, Staphylococcus aureus subsp. aureus Mu50
auaaauauugaacaauuuu

SEQ ID NO: 2045292 - RNA, 15 nt, Staphylococcus aureus subsp. aureus Mu50
auaaauauuuuuaau

SEQ ID NO: 2045293 - RNA, 19 nt, Staphylococcus aureus subsp. aureus Mu50
auaaaugaauuauuuaaaa

SEQ ID NO: 2045294 - RNA, 20 nt, Staphylococcus aureus subsp. aureus Mu50
auaaauccuaagucuuuuaa

SEQ ID NO: 2045295 - RNA, 22 nt, Staphylococcus aureus subsp. aureus Mu50
auaaauccuaagucuuuuaaau

SEQ ID NO: 2045296 - RNA, 14 nt, Staphylococcus aureus subsp. aureus Mu50
auaaaucaguaguu

SEQ ID NO: 2045297 - RNA, 14 nt, Staphylococcus aureus subsp. aureus Mu50
auaaaucaucauuc

SEQ ID NO: 2045298 - RNA, 16 nt, Staphylococcus aureus subsp. aureus Mu50
auaaaucacgccauaa

SEQ ID NO: 2045299 - RNA, 22 nt, Staphylococcus aureus subsp. aureus Mu50
auaaaucauuaguuguaucagu

SEQ ID NO: 2045300 - RNA, 19 nt, Staphylococcus aureus subsp. aureus Mu50
auaaacgauugauuaucau

SEQ ID NO: 2045301 - RNA, 23 nt, Staphylococcus aureus subsp. aureus Mu50
auaaaccaugcuuccauaauuug

SEQ ID NO: 2045302 - RNA, 11 nt, Staphylococcus aureus subsp. aureus Mu50
auaaacaauaa

SEQ ID NO: 2045303 - RNA, 21 nt, Staphylococcus aureus subsp. aureus Mu50
auaaaaguacuuuaaaauugu

SEQ ID NO: 2045304 - RNA, 13 nt, Staphylococcus aureus subsp. aureus Mu50
auaaaaugcuaca

SEQ ID NO: 2045305 - RNA, 13 nt, Staphylococcus aureus subsp. aureus Mu50
auaaaaucauaac

SEQ ID NO: 2045306 - RNA, 16 nt, Staphylococcus aureus subsp. aureus Mu50
auaaaaucaucuuaac

SEQ ID NO: 2045307 - RNA, 17 nt, Staphylococcus aureus subsp. aureus Mu50
agugaucuuuuuuauau

SEQ ID NO: 2045308 - RNA, 17 nt, Staphylococcus aureus subsp. aureus Mu50
agucuacaguaaauuga

SEQ ID NO: 2045309 - RNA, 19 nt, Staphylococcus aureus subsp. aureus Mu50
agucuacaguaaauugauu

SEQ ID NO: 2045310 - RNA, 17 nt, Staphylococcus aureus subsp. aureus Mu50
agucuaugaauaauguu

SEQ ID NO: 2045311 - RNA, 15 nt, Staphylococcus aureus subsp. aureus Mu50
agugauuuuuuacau

SEQ ID NO: 2045312 - RNA, 19 nt, Staphylococcus aureus subsp. aureus Mu50
agugcaaguccaaauaaua

SEQ ID NO: 2045313 - RNA, 14 nt, Staphylococcus aureus subsp. aureus Mu50
agugcaauuauuuc

SEQ ID NO: 2045314 - RNA, 21 nt, Staphylococcus aureus subsp. aureus Mu50
aguuacaaugcgguauugcau

SEQ ID NO: 2045315 - RNA, 15 nt, Staphylococcus aureus subsp. aureus Mu50
aguuacaugcucuuu

SEQ ID NO: 2045316 - RNA, 22 nt, Staphylococcus aureus subsp. aureus Mu50
aguuaagucgccuaacuuuuau

SEQ ID NO: 2045317 - RNA, 21 nt, Staphylococcus aureus subsp. aureus Mu50
aguuaauaaacgcuucauagu

SEQ ID NO: 2045318 - RNA, 23 nt, Staphylococcus aureus subsp. aureus Mu50
aguuaaaucuuuaacuucugauu

SEQ ID NO: 2045319 - RNA, 17 nt, Staphylococcus aureus subsp. aureus Mu50
aguguuuaugaaagucu

SEQ ID NO: 2045320 - RNA, 19 nt, Staphylococcus aureus subsp. aureus Mu50
aguguucucauuauaauga

SEQ ID NO: 2045321 - RNA, 17 nt, Staphylococcus aureus subsp. aureus Mu50
aguguuuuauagauuca

SEQ ID NO: 2045322 - RNA, 19 nt, Staphylococcus aureus subsp. aureus Mu50
aguguuuuauucgauaaua

SEQ ID NO: 2045323 - RNA, 14 nt, Staphylococcus aureus subsp. aureus Mu50
agugugucauaaug

SEQ ID NO: 2045324 - RNA, 22 nt, Staphylococcus aureus subsp. aureus Mu50
agugguagccaauaucauauuu

SEQ ID NO: 2045325 - RNA, 23 nt, Staphylococcus aureus subsp. aureus Mu50
agugccguccauuuccaugaaua

SEQ ID NO: 2045326 - RNA, 20 nt, Staphylococcus aureus subsp. aureus Mu50
aguccuucuuugaaaucaau

SEQ ID NO: 2045327 - RNA, 15 nt, Staphylococcus aureus subsp. aureus Mu50
agucgacaugauucu

SEQ ID NO: 2045328 - RNA, 14 nt, Staphylococcus aureus subsp. aureus Mu50
agucaugucccaua

SEQ ID NO: 2045329 - RNA, 12 nt, Staphylococcus aureus subsp. aureus Mu50
agucauaugcau

SEQ ID NO: 2045330 - RNA, 17 nt, Staphylococcus aureus subsp. aureus Mu50
agucauaacgauuguug

SEQ ID NO: 2045331 - RNA, 17 nt, Staphylococcus aureus subsp. aureus Mu50
agucauaauuuaaaaga

SEQ ID NO: 2045332 - RNA, 23 nt, Staphylococcus aureus subsp. aureus Mu50
aguaggaauuguuaauuucaaca

SEQ ID NO: 2045333 - RNA, 16 nt, Staphylococcus aureus subsp. aureus Mu50
aguaauguuccauaua

SEQ ID NO: 2045334 - RNA, 21 nt, Staphylococcus aureus subsp. aureus Mu50
aguaaugcuguacuauauuca

SEQ ID NO: 2045335 - RNA, 22 nt, Staphylococcus aureus subsp. aureus Mu50
aguacgauuauuuggauaauuu

SEQ ID NO: 2045336 - RNA, 16 nt, Staphylococcus aureus subsp. aureus Mu50
aguaccaucucuauuu

SEQ ID NO: 2045337 - RNA, 21 nt, Staphylococcus aureus subsp. aureus Mu50
aguacauuuauuuucaauaaa

SEQ ID NO: 2045338 - RNA, 21 nt, Staphylococcus aureus subsp. aureus Mu50
agguuaacauuugucauaaua

SEQ ID NO: 2045339 - RNA, 15 nt, Staphylococcus aureus subsp. aureus Mu50
agguuauuauaaaau

SEQ ID NO: 2045340 - RNA, 16 nt, Staphylococcus aureus subsp. aureus Mu50
agguuauuauaaaaua

SEQ ID NO: 2045341 - RNA, 19 nt, Staphylococcus aureus subsp. aureus Mu50
agguuauuugauaaugaua

SEQ ID NO: 2045342 - RNA, 22 nt, Staphylococcus aureus subsp. aureus Mu50
agguaaauuuaaaauaauagau

SEQ ID NO: 2045343 - RNA, 18 nt, Staphylococcus aureus subsp. aureus Mu50
agguaauuuaacauuuuu

SEQ ID NO: 2045344 - RNA, 17 nt, Staphylococcus aureus subsp. aureus Mu50
agguacuagaauuaacu

SEQ ID NO: 2045345 - RNA, 14 nt, Staphylococcus aureus subsp. aureus Mu50
agguauaaucauuu

SEQ ID NO: 2045346 - RNA, 14 nt, Staphylococcus aureus subsp. aureus Mu50
aggugcuuuaaugc

SEQ ID NO: 2045347 - RNA, 23 nt, Staphylococcus aureus subsp. aureus Mu50
agggguauguuuguuaugugauu

SEQ ID NO: 2045348 - RNA, 13 nt, Staphylococcus aureus subsp. aureus Mu50
agguaauaaagcu

SEQ ID NO: 2045349 - RNA, 17 nt, Staphylococcus aureus subsp. aureus Mu50
agguaauaaagcugauu

SEQ ID NO: 2045350 - RNA, 15 nt, Staphylococcus aureus subsp. aureus Mu50
auuaauauccaaaau

SEQ ID NO: 2045351 - RNA, 21 nt, Staphylococcus aureus subsp. aureus Mu50
auuaauauccaaaauccugaa

SEQ ID NO: 2045352 - RNA, 13 nt, Staphylococcus aureus subsp. aureus Mu50
auuaaucaauuua

SEQ ID NO: 2045353 - RNA, 16 nt, Staphylococcus aureus subsp. aureus Mu50
auuaauccaucuacac

SEQ ID NO: 2045354 - RNA, 17 nt, Staphylococcus aureus subsp. aureus Mu50
auuaauaggauuauuau

SEQ ID NO: 2045355 - RNA, 16 nt, Staphylococcus aureus subsp. aureus Mu50
auuacccuuuaaacuc

SEQ ID NO: 2045356 - RNA, 21 nt, Staphylococcus aureus subsp. aureus Mu50
auuaccaacaagguucuaaau

SEQ ID NO: 2045357 - RNA, 14 nt, Staphylococcus aureus subsp. aureus Mu50
auuaccaaugaaua

SEQ ID NO: 2045358 - RNA, 19 nt, Staphylococcus aureus subsp. aureus Mu50
auuacauauacgacauuuu

SEQ ID NO: 2045359 - RNA, 19 nt, Staphylococcus aureus subsp. aureus Mu50
auuacaucuauauuuguuu

SEQ ID NO: 2045360 - RNA, 20 nt, Staphylococcus aureus subsp. aureus Mu50
auuaauuuuaucuuauuauu

SEQ ID NO: 2045361 - RNA, 15 nt, Staphylococcus aureus subsp. aureus Mu50
auuacaacuuauucu

SEQ ID NO: 2045362 - RNA, 16 nt, Staphylococcus aureus subsp. aureus Mu50
auuacagaugaugcuu

SEQ ID NO: 2045363 - RNA, 15 nt, Staphylococcus aureus subsp. aureus Mu50
auuacaaaucaugac

SEQ ID NO: 2045364 - RNA, 15 nt, Staphylococcus aureus subsp. aureus Mu50
auuacaauauaauuu

SEQ ID NO: 2045365 - RNA, 12 nt, Staphylococcus aureus subsp. aureus Mu50
auuacaaugaaa

SEQ ID NO: 2045366 - RNA, 17 nt, Staphylococcus aureus subsp. aureus Mu50
auuaaucguuaauguau

SEQ ID NO: 2045367 - RNA, 14 nt, Staphylococcus aureus subsp. aureus Mu50
auuaauguaaugau

SEQ ID NO: 2045368 - RNA, 21 nt, Staphylococcus aureus subsp. aureus Mu50
auuaauguucaaaaaaugaau

SEQ ID NO: 2045369 - RNA, 15 nt, Staphylococcus aureus subsp. aureus Mu50
auuaauguucaauuu

SEQ ID NO: 2045370 - RNA, 21 nt, Staphylococcus aureus subsp. aureus Mu50
auuaauucgccuaaaugguuu

SEQ ID NO: 2045371 - RNA, 15 nt, Staphylococcus aureus subsp. aureus Mu50
auuaauuuaaaugcu

SEQ ID NO: 2045372 - RNA, 23 nt, Staphylococcus aureus subsp. aureus Mu50
auuaauuacagcgugauucaucu

SEQ ID NO: 2045373 - RNA, 16 nt, Staphylococcus aureus subsp. aureus Mu50
auuaauuacuuucauu

SEQ ID NO: 2045374 - RNA, 15 nt, Staphylococcus aureus subsp. aureus Mu50
auuaauuaucauaaa

SEQ ID NO: 2045375 - RNA, 20 nt, Staphylococcus aureus subsp. aureus Mu50
auuaauuuacucaaaccauc

SEQ ID NO: 2045376 - RNA, 18 nt, Staphylococcus aureus subsp. aureus Mu50
auuaauuuagucauuaca

SEQ ID NO: 2045377 - RNA, 18 nt, Staphylococcus aureus subsp. aureus Mu50
auuaauuucauuguaacu

SEQ ID NO: 2045378 - RNA, 21 nt, Staphylococcus aureus subsp. aureus Mu50
auuaauuucauuguaacucaa

SEQ ID NO: 2045379 - RNA, 23 nt, Staphylococcus aureus subsp. aureus Mu50
auuaucuuuaguauuucaucauu

SEQ ID NO: 2045380 - RNA, 13 nt, Staphylococcus aureus subsp. aureus Mu50
auuaucuuucaau

SEQ ID NO: 2045381 - RNA, 21 nt, Staphylococcus aureus subsp. aureus Mu50
auuaucuuuguaaauuuuuaa

SEQ ID NO: 2045382 - RNA, 14 nt, Staphylococcus aureus subsp. aureus Mu50
auuaugauuauauu

SEQ ID NO: 2045383 - RNA, 16 nt, Staphylococcus aureus subsp. aureus Mu50
auuaugguaauuaguu

SEQ ID NO: 2045384 - RNA, 14 nt, Staphylococcus aureus subsp. aureus Mu50
auuauguagcuuug

SEQ ID NO: 2045385 - RNA, 21 nt, Staphylococcus aureus subsp. aureus Mu50
auuauuaacuuuaauauaagu

SEQ ID NO: 2045386 - RNA, 17 nt, Staphylococcus aureus subsp. aureus Mu50
auuauuaauuuaaucca

SEQ ID NO: 2045387 - RNA, 15 nt, Staphylococcus aureus subsp. aureus Mu50
auuauuacaaugaaa

SEQ ID NO: 2045388 - RNA, 17 nt, Staphylococcus aureus subsp. aureus Mu50
auuauugaaacuaauaa

SEQ ID NO: 2045389 - RNA, 20 nt, Staphylococcus aureus subsp. aureus Mu50
auuauugaaaucgauacuaa

SEQ ID NO: 2045390 - RNA, 14 nt, Staphylococcus aureus subsp. aureus Mu50
auuauugaaacuaa

SEQ ID NO: 2045391 - RNA, 16 nt, Staphylococcus aureus subsp. aureus Mu50
auuauugaaacuaaua

SEQ ID NO: 2045392 - RNA, 14 nt, Staphylococcus aureus subsp. aureus Mu50
auuauuauuuaaau

SEQ ID NO: 2045393 - RNA, 14 nt, Staphylococcus aureus subsp. aureus Mu50
auuauuaucaaaga

SEQ ID NO: 2045394 - RNA, 21 nt, Staphylococcus aureus subsp. aureus Mu50
auuauuaucaaagaaauguau

SEQ ID NO: 2045395 - RNA, 24 nt, Staphylococcus aureus subsp. aureus Mu50
auuauguagugguucuuauacauu

SEQ ID NO: 2045396 - RNA, 22 nt, Staphylococcus aureus subsp. aureus Mu50
auuauuaggcggccaguccauu

SEQ ID NO: 2045397 - RNA, 14 nt, Staphylococcus aureus subsp. aureus Mu50
auucacgauauaac

SEQ ID NO: 2045398 - RNA, 18 nt, Staphylococcus aureus subsp. aureus Mu50
auucaccuaucaacgauu

SEQ ID NO: 2045399 - RNA, 15 nt, Staphylococcus aureus subsp. aureus Mu50
auucacgaacauuac

SEQ ID NO: 2045400 - RNA, 18 nt, Staphylococcus aureus subsp. aureus Mu50
auucacgacuugauagca

SEQ ID NO: 2045401 - RNA, 17 nt, Staphylococcus aureus subsp. aureus Mu50
auuacguugguuuaaaa

SEQ ID NO: 2045402 - RNA, 23 nt, Staphylococcus aureus subsp. aureus Mu50
auuacuacauaauuuaucaauuu

SEQ ID NO: 2045403 - RNA, 13 nt, Staphylococcus aureus subsp. aureus Mu50
auuacuauaaaaa

SEQ ID NO: 2045404 - RNA, 16 nt, Staphylococcus aureus subsp. aureus Mu50
auuacuauauuuaaau

SEQ ID NO: 2045405 - RNA, 21 nt, Staphylococcus aureus subsp. aureus Mu50
auuacgccaccaguuucaagu

SEQ ID NO: 2045406 - RNA, 14 nt, Staphylococcus aureus subsp. aureus Mu50
auuaccguuuauuu

SEQ ID NO: 2045407 - RNA, 23 nt, Staphylococcus aureus subsp. aureus Mu50
auuaccccaagaugguauugcuu

SEQ ID NO: 2045408 - RNA, 20 nt, Staphylococcus aureus subsp. aureus Mu50
auuacugucuuuccauaaua

SEQ ID NO: 2045409 - RNA, 23 nt, Staphylococcus aureus subsp. aureus Mu50
auuacugucuuuccauaauaaug

SEQ ID NO: 2045410 - RNA, 20 nt, Staphylococcus aureus subsp. aureus Mu50
auuacuuauuucuuuucauu

SEQ ID NO: 2045411 - RNA, 18 nt, Staphylococcus aureus subsp. aureus Mu50
auuacuuuagaaagugau

SEQ ID NO: 2045412 - RNA, 17 nt, Staphylococcus aureus subsp. aureus Mu50
auuacuuuaucguugua

SEQ ID NO: 2045413 - RNA, 22 nt, Staphylococcus aureus subsp. aureus Mu50
auuacucuuuuucuuucauaau

SEQ ID NO: 2045414 - RNA, 23 nt, Staphylococcus aureus subsp. aureus Mu50
auuagaaaaggcucauuuguuaa

SEQ ID NO: 2045415 - RNA, 15 nt, Staphylococcus aureus subsp. aureus Mu50
auuagauuuuaugcu

SEQ ID NO: 2045416 - RNA, 15 nt, Staphylococcus aureus subsp. aureus Mu50
auuagauuuuguugu

SEQ ID NO: 2045417 - RNA, 15 nt, Staphylococcus aureus subsp. aureus Mu50
auuagcauuauuauu

SEQ ID NO: 2045418 - RNA, 21 nt, Staphylococcus aureus subsp. aureus Mu50
auuaucguaaaaaaacgucua

SEQ ID NO: 2045419 - RNA, 17 nt, Staphylococcus aureus subsp. aureus Mu50
auuaucguaauuguuaa

SEQ ID NO: 2045420 - RNA, 15 nt, Staphylococcus aureus subsp. aureus Mu50
auucccaaagcgaau

SEQ ID NO: 2045421 - RNA, 18 nt, Staphylococcus aureus subsp. aureus Mu50
auucauuuguauuaauuu

SEQ ID NO: 2045422 - RNA, 19 nt, Staphylococcus aureus subsp. aureus Mu50
auucauuuuaaauucaacu

SEQ ID NO: 2045423 - RNA, 22 nt, Staphylococcus aureus subsp. aureus Mu50
auuccaagagaauuaauaauuu

SEQ ID NO: 2045424 - RNA, 14 nt, Staphylococcus aureus subsp. aureus Mu50
auuccaaaaauugu

SEQ ID NO: 2045425 - RNA, 22 nt, Staphylococcus aureus subsp. aureus Mu50
auuccaaagaaagcuaauauca

SEQ ID NO: 2045426 - RNA, 16 nt, Staphylococcus aureus subsp. aureus Mu50
auucacgcguucaaau

SEQ ID NO: 2045427 - RNA, 20 nt, Staphylococcus aureus subsp. aureus Mu50
auucauuuaaaaaucaaaga

SEQ ID NO: 2045428 - RNA, 14 nt, Staphylococcus aureus subsp. aureus Mu50
aaacugaaucgauu

SEQ ID NO: 2045429 - RNA, 14 nt, Staphylococcus aureus subsp. aureus Mu50
aaacucuguuuguc

SEQ ID NO: 2045430 - RNA, 15 nt, Staphylococcus aureus subsp. aureus Mu50
aaacucuuacaagua

SEQ ID NO: 2045431 - RNA, 14 nt, Staphylococcus aureus subsp. aureus Mu50
aaacucuaaaaguu

SEQ ID NO: 2045432 - RNA, 15 nt, Staphylococcus aureus subsp. aureus Mu50
aaacucauacaaauu

SEQ ID NO: 2045433 - RNA, 16 nt, Staphylococcus aureus subsp. aureus Mu50
auucgccaucuuuuuu

SEQ ID NO: 2045434 - RNA, 19 nt, Staphylococcus aureus subsp. aureus Mu50
auucgacucaaacaauaaa

SEQ ID NO: 2045435 - RNA, 12 nt, Staphylococcus aureus subsp. aureus Mu50
auuucgcuuuuu

SEQ ID NO: 2045436 - RNA, 15 nt, Staphylococcus aureus subsp. aureus Mu50
auuucgcuuuuuuua

SEQ ID NO: 2045437 - RNA, 21 nt, Staphylococcus aureus subsp. aureus Mu50
auuucgaaaagaaauucuaca

SEQ ID NO: 2045438 - RNA, 19 nt, Staphylococcus aureus subsp. aureus Mu50
auuucgccucaucuaauuu

SEQ ID NO: 2045439 - RNA, 20 nt, Staphylococcus aureus subsp. aureus Mu50
auuucgacaucuagaugaaa

SEQ ID NO: 2045440 - RNA, 19 nt, Staphylococcus aureus subsp. aureus Mu50
auuucgauaccuaaaauac

SEQ ID NO: 2045441 - RNA, 13 nt, Staphylococcus aureus subsp. aureus Mu50
auuucuaucaaau

SEQ ID NO: 2045442 - RNA, 17 nt, Staphylococcus aureus subsp. aureus Mu50
auuucgguauuuuaaau

SEQ ID NO: 2045443 - RNA, 15 nt, Staphylococcus aureus subsp. aureus Mu50
auuucccuaugaaau

SEQ ID NO: 2045444 - RNA, 13 nt, Staphylococcus aureus subsp. aureus Mu50
auuuccaucauuu

SEQ ID NO: 2045445 - RNA, 14 nt, Staphylococcus aureus subsp. aureus Mu50
auuucauuugaaau

SEQ ID NO: 2045446 - RNA, 15 nt, Staphylococcus aureus subsp. aureus Mu50
auuucagcauuugcu

SEQ ID NO: 2045447 - RNA, 15 nt, Staphylococcus aureus subsp. aureus Mu50
auuucaugugucaca

SEQ ID NO: 2045448 - RNA, 17 nt, Staphylococcus aureus subsp. aureus Mu50
auuucauuuaugcgauu

SEQ ID NO: 2045449 - RNA, 13 nt, Staphylococcus aureus subsp. aureus Mu50
auuucaugauguu

SEQ ID NO: 2045450 - RNA, 15 nt, Staphylococcus aureus subsp. aureus Mu50
auuucauguucauaa

SEQ ID NO: 2045451 - RNA, 17 nt, Staphylococcus aureus subsp. aureus Mu50
auuucauguucauaaua

SEQ ID NO: 2045452 - RNA, 16 nt, Staphylococcus aureus subsp. aureus Mu50
auuuacauuaauuugu

SEQ ID NO: 2045453 - RNA, 17 nt, Staphylococcus aureus subsp. aureus Mu50
auuuacauugccacuuu

SEQ ID NO: 2045454 - RNA, 17 nt, Staphylococcus aureus subsp. aureus Mu50
auuuacaauguuaucuu

SEQ ID NO: 2045455 - RNA, 19 nt, Staphylococcus aureus subsp. aureus Mu50
auuuacacacaugauaauu

SEQ ID NO: 2045456 - RNA, 17 nt, Staphylococcus aureus subsp. aureus Mu50
auuuacacagaaugaua

SEQ ID NO: 2045457 - RNA, 17 nt, Staphylococcus aureus subsp. aureus Mu50
auuuacaccuauaccuc

SEQ ID NO: 2045458 - RNA, 16 nt, Staphylococcus aureus subsp. aureus Mu50
auuuauacuaaauuga

SEQ ID NO: 2045459 - RNA, 20 nt, Staphylococcus aureus subsp. aureus Mu50
auuuaauucugguuuaauga

SEQ ID NO: 2045460 - RNA, 16 nt, Staphylococcus aureus subsp. aureus Mu50
auuuaauuuaauuuua

SEQ ID NO: 2045461 - RNA, 14 nt, Staphylococcus aureus subsp. aureus Mu50
auuuauaacauuua

SEQ ID NO: 2045462 - RNA, 15 nt, Staphylococcus aureus subsp. aureus Mu50
auuuauaacauuuaa

SEQ ID NO: 2045463 - RNA, 21 nt, Staphylococcus aureus subsp. aureus Mu50
auuuauaacgacguaauccuu

SEQ ID NO: 2045464 - RNA, 20 nt, Staphylococcus aureus subsp. aureus Mu50
auuuacaaauguauaaauaa

SEQ ID NO: 2045465 - RNA, 14 nt, Staphylococcus aureus subsp. aureus Mu50
auuuaauuuuucua

SEQ ID NO: 2045466 - RNA, 19 nt, Staphylococcus aureus subsp. aureus Mu50
auuuaauuuuucuaaauga

SEQ ID NO: 2045467 - RNA, 20 nt, Staphylococcus aureus subsp. aureus Mu50
auuuaauuuuucuaaaugau

SEQ ID NO: 2045468 - RNA, 13 nt, Staphylococcus aureus subsp. aureus Mu50
auuuaaugcguug

SEQ ID NO: 2045469 - RNA, 12 nt, Staphylococcus aureus subsp. aureus Mu50
auuuaaucuauu

SEQ ID NO: 2045470 - RNA, 12 nt, Staphylococcus aureus subsp. aureus Mu50
auuguguugaau

SEQ ID NO: 2045471 - RNA, 12 nt, Staphylococcus aureus subsp. aureus Mu50
auuguuaaauga

SEQ ID NO: 2045472 - RNA, 19 nt, Staphylococcus aureus subsp. aureus Mu50
auuuaaagucuucaucuuu

SEQ ID NO: 2045473 - RNA, 19 nt, Staphylococcus aureus subsp. aureus Mu50
auuuaaaucuguacuucua

SEQ ID NO: 2045474 - RNA, 13 nt, Staphylococcus aureus subsp. aureus Mu50
auuuaaccuuuaa

SEQ ID NO: 2045475 - RNA, 14 nt, Staphylococcus aureus subsp. aureus Mu50
auuuaacaucaauu

SEQ ID NO: 2045476 - RNA, 17 nt, Staphylococcus aureus subsp. aureus Mu50
auuuaaguuuauaauca

SEQ ID NO: 2045477 - RNA, 15 nt, Staphylococcus aureus subsp. aureus Mu50
auuuauuauaaaaua

SEQ ID NO: 2045478 - RNA, 18 nt, Staphylococcus aureus subsp. aureus Mu50
auuuaucugcaaaaugca

SEQ ID NO: 2045479 - RNA, 20 nt, Staphylococcus aureus subsp. aureus Mu50
auuuaucugcaaaaugcauu

SEQ ID NO: 2045480 - RNA, 16 nt, Staphylococcus aureus subsp. aureus Mu50
auuuaucauacuucaa

SEQ ID NO: 2045481 - RNA, 14 nt, Staphylococcus aureus subsp. aureus Mu50
auuuauaugauguu

SEQ ID NO: 2045482 - RNA, 16 nt, Staphylococcus aureus subsp. aureus Mu50
auuucaauauuaaaau

SEQ ID NO: 2045483 - RNA, 15 nt, Staphylococcus aureus subsp. aureus Mu50
auuucaaaaaaagcu

SEQ ID NO: 2045484 - RNA, 17 nt, Staphylococcus aureus subsp. aureus Mu50
auuuauuuauaaaauaa

SEQ ID NO: 2045485 - RNA, 16 nt, Staphylococcus aureus subsp. aureus Mu50
auuuauuuucaauaaa

SEQ ID NO: 2045486 - RNA, 19 nt, Staphylococcus aureus subsp. aureus Mu50
auuucagaaauacauccau

SEQ ID NO: 2045487 - RNA, 22 nt, Staphylococcus aureus subsp. aureus Mu50
auuucaccaguagucacuguuu

SEQ ID NO: 2045488 - RNA, 14 nt, Staphylococcus aureus subsp. aureus Mu50
auucucuaacgauu

SEQ ID NO: 2045489 - RNA, 12 nt, Staphylococcus aureus subsp. aureus Mu50
auugcacuuuuu

SEQ ID NO: 2045490 - RNA, 18 nt, Staphylococcus aureus subsp. aureus Mu50
auucuacagcaucaccua

SEQ ID NO: 2045491 - RNA, 14 nt, Staphylococcus aureus subsp. aureus Mu50
auucuaucuauaaa

SEQ ID NO: 2045492 - RNA, 22 nt, Staphylococcus aureus subsp. aureus Mu50
auucuaaaacggaaauaaccac

SEQ ID NO: 2045493 - RNA, 13 nt, Staphylococcus aureus subsp. aureus Mu50
auucguauucaaa

SEQ ID NO: 2045494 - RNA, 17 nt, Staphylococcus aureus subsp. aureus Mu50
auucgucuguuucauau

SEQ ID NO: 2045495 - RNA, 22 nt, Staphylococcus aureus subsp. aureus Mu50
auucgcgaacguuauuuucaau

SEQ ID NO: 2045496 - RNA, 14 nt, Staphylococcus aureus subsp. aureus Mu50
auugucgacuuuua

SEQ ID NO: 2045497 - RNA, 15 nt, Staphylococcus aureus subsp. aureus Mu50
auugugaaaucuauu

SEQ ID NO: 2045498 - RNA, 12 nt, Staphylococcus aureus subsp. aureus Mu50
auugucaucaug

SEQ ID NO: 2045499 - RNA, 19 nt, Staphylococcus aureus subsp. aureus Mu50
auugucaucauguucuaau

SEQ ID NO: 2045500 - RNA, 22 nt, Staphylococcus aureus subsp. aureus Mu50
auuguauuguuuucaucaugca

SEQ ID NO: 2045501 - RNA, 12 nt, Staphylococcus aureus subsp. aureus Mu50
auuggcagauag

SEQ ID NO: 2045502 - RNA, 20 nt, Staphylococcus aureus subsp. aureus Mu50
auugcuaaaaaaauuaaaau

SEQ ID NO: 2045503 - RNA, 19 nt, Staphylococcus aureus subsp. aureus Mu50
auugcuaaaauaucaaaau

SEQ ID NO: 2045504 - RNA, 19 nt, Staphylococcus aureus subsp. aureus Mu50
auugcuaaacgcuaaaauu

SEQ ID NO: 2045505 - RNA, 21 nt, Staphylococcus aureus subsp. aureus Mu50
auuuuaccuugagcagcauca

SEQ ID NO: 2045506 - RNA, 16 nt, Staphylococcus aureus subsp. aureus Mu50
auuuuaccauguuuua

SEQ ID NO: 2045507 - RNA, 14 nt, Staphylococcus aureus subsp. aureus Mu50
auuuuaauuuucag

SEQ ID NO: 2045508 - RNA, 16 nt, Staphylococcus aureus subsp. aureus Mu50
auuuuacaaucaacuu

SEQ ID NO: 2045509 - RNA, 14 nt, Staphylococcus aureus subsp. aureus Mu50
auuuuaacgucauu

SEQ ID NO: 2045510 - RNA, 19 nt, Staphylococcus aureus subsp. aureus Mu50
auuuuaacgucauuuuuaa

SEQ ID NO: 2045511 - RNA, 13 nt, Staphylococcus aureus subsp. aureus Mu50
auuuuaagugguu

SEQ ID NO: 2045512 - RNA, 13 nt, Staphylococcus aureus subsp. aureus Mu50
auuuuaauaaaau

SEQ ID NO: 2045513 - RNA, 16 nt, Staphylococcus aureus subsp. aureus Mu50
auuuuaaauuacaacu

SEQ ID NO: 2045514 - RNA, 19 nt, Staphylococcus aureus subsp. aureus Mu50
auuuuagcaaaagcuuuua

SEQ ID NO: 2045515 - RNA, 17 nt, Staphylococcus aureus subsp. aureus Mu50
auuuuagccaaauuacu

SEQ ID NO: 2045516 - RNA, 22 nt, Staphylococcus aureus subsp. aureus Mu50
auuuucaaagacguacaugcuu

SEQ ID NO: 2045517 - RNA, 18 nt, Staphylococcus aureus subsp. aureus Mu50
auuuuagugccgagcuuu

SEQ ID NO: 2045518 - RNA, 14 nt, Staphylococcus aureus subsp. aureus Mu50
auuuuauucacuuu

SEQ ID NO: 2045519 - RNA, 20 nt, Staphylococcus aureus subsp. aureus Mu50
auuuuauugaguaucaugcu

SEQ ID NO: 2045520 - RNA, 16 nt, Staphylococcus aureus subsp. aureus Mu50
auuuuaucuaaacauu

SEQ ID NO: 2045521 - RNA, 22 nt, Staphylococcus aureus subsp. aureus Mu50
auuuuaucuaaagcuauaaaaa

SEQ ID NO: 2045522 - RNA, 18 nt, Staphylococcus aureus subsp. aureus Mu50
auuuuauccaaaccaauu

SEQ ID NO: 2045523 - RNA, 22 nt, Staphylococcus aureus subsp. aureus Mu50
auuuuauccaaaccaauuuuaa

SEQ ID NO: 2045524 - RNA, 16 nt, Staphylococcus aureus subsp. aureus Mu50
auuuuaugauuugauu

SEQ ID NO: 2045525 - RNA, 15 nt, Staphylococcus aureus subsp. aureus Mu50
auuuuauaaaucaaa

SEQ ID NO: 2045526 - RNA, 17 nt, Staphylococcus aureus subsp. aureus Mu50
auuuuauaaaucaaaga

SEQ ID NO: 2045527 - RNA, 21 nt, Staphylococcus aureus subsp. aureus Mu50
auuuuagucgucgaaaugccu

SEQ ID NO: 2045528 - RNA, 16 nt, Staphylococcus aureus subsp. aureus Mu50
auuuuauuuauuuuga

SEQ ID NO: 2045529 - RNA, 22 nt, Staphylococcus aureus subsp. aureus Mu50
auuuucaauuagaaaacaucuu

SEQ ID NO: 2045530 - RNA, 15 nt, Staphylococcus aureus subsp. aureus Mu50
auuuucaauaaauuu

SEQ ID NO: 2045531 - RNA, 15 nt, Staphylococcus aureus subsp. aureus Mu50
auuuucacuaauauu

SEQ ID NO: 2045532 - RNA, 15 nt, Staphylococcus aureus subsp. aureus Mu50
auuuucacuuucaau

SEQ ID NO: 2045533 - RNA, 13 nt, Staphylococcus aureus subsp. aureus Mu50
auuuucucccaua

SEQ ID NO: 2045534 - RNA, 21 nt, Staphylococcus aureus subsp. aureus Mu50
auuuucuguuuaauuaaaaua

SEQ ID NO: 2045535 - RNA, 21 nt, Staphylococcus aureus subsp. aureus Mu50
auuuucuuagaaaaucaaguu

SEQ ID NO: 2045536 - RNA, 17 nt, Staphylococcus aureus subsp. aureus Mu50
auuuucuugccaucaau

SEQ ID NO: 2045537 - RNA, 19 nt, Staphylococcus aureus subsp. aureus Mu50
auuuucuugccaucaauuu

SEQ ID NO: 2045538 - RNA, 23 nt, Staphylococcus aureus subsp. aureus Mu50
auuuucuugccaucaauuucugu

SEQ ID NO: 2045539 - RNA, 17 nt, Staphylococcus aureus subsp. aureus Mu50
auuuugacauaaaaaau

SEQ ID NO: 2045540 - RNA, 17 nt, Staphylococcus aureus subsp. aureus Mu50
auuuugaauaugauauu

SEQ ID NO: 2045541 - RNA, 16 nt, Staphylococcus aureus subsp. aureus Mu50
auuuugaaucauacga

SEQ ID NO: 2045542 - RNA, 13 nt, Staphylococcus aureus subsp. aureus Mu50
auuugucauaaua

SEQ ID NO: 2045543 - RNA, 19 nt, Staphylococcus aureus subsp. aureus Mu50
auuuguaaagacaccauca

SEQ ID NO: 2045544 - RNA, 14 nt, Staphylococcus aureus subsp. aureus Mu50
auuuguauuaauuu

SEQ ID NO: 2045545 - RNA, 21 nt, Staphylococcus aureus subsp. aureus Mu50
auuuguauuuugcgcuucuag

SEQ ID NO: 2045546 - RNA, 20 nt, Staphylococcus aureus subsp. aureus Mu50
auuuguagagaugugaugcu

SEQ ID NO: 2045547 - RNA, 18 nt, Staphylococcus aureus subsp. aureus Mu50
auuugugguaaucaugua

SEQ ID NO: 2045548 - RNA, 14 nt, Staphylococcus aureus subsp. aureus Mu50
auuuguguauaaau

SEQ ID NO: 2045549 - RNA, 23 nt, Staphylococcus aureus subsp. aureus Mu50
auuuguguauaaaugucauagua

SEQ ID NO: 2045550 - RNA, 14 nt, Staphylococcus aureus subsp. aureus Mu50
auuuuaaauaaaau

SEQ ID NO: 2045551 - RNA, 17 nt, Staphylococcus aureus subsp. aureus Mu50
auuuuaaauaaaaugca

SEQ ID NO: 2045552 - RNA, 19 nt, Staphylococcus aureus subsp. aureus Mu50
auuuuaaacaugaacaauc

SEQ ID NO: 2045553 - RNA, 21 nt, Staphylococcus aureus subsp. aureus Mu50
auuugguggagaaccaaaaau

SEQ ID NO: 2045554 - RNA, 22 nt, Staphylococcus aureus subsp. aureus Mu50
auuugguggagaaccaaaaauu

SEQ ID NO: 2045555 - RNA, 23 nt, Staphylococcus aureus subsp. aureus Mu50
auuuggguaauguuuuuacaaau

SEQ ID NO: 2045556 - RNA, 19 nt, Staphylococcus aureus subsp. aureus Mu50
auuuggcguugcaccaagc

SEQ ID NO: 2045557 - RNA, 16 nt, Staphylococcus aureus subsp. aureus Mu50
auuuggcgcuuuauga

SEQ ID NO: 2045558 - RNA, 17 nt, Staphylococcus aureus subsp. aureus Mu50
auuuggauaauuuuuaa

SEQ ID NO: 2045559 - RNA, 17 nt, Staphylococcus aureus subsp. aureus Mu50
auuuggaggugaugaga

SEQ ID NO: 2045560 - RNA, 19 nt, Staphylococcus aureus subsp. aureus Mu50
auuugaauauggaaaaugu

SEQ ID NO: 2045561 - RNA, 17 nt, Staphylococcus aureus subsp. aureus Mu50
auuucuuuucauuauca

SEQ ID NO: 2045562 - RNA, 15 nt, Staphylococcus aureus subsp. aureus Mu50
auuucuuuucgaaau

SEQ ID NO: 2045563 - RNA, 14 nt, Staphylococcus aureus subsp. aureus Mu50
auuugcaacaauau

SEQ ID NO: 2045564 - RNA, 23 nt, Staphylococcus aureus subsp. aureus Mu50
auuugauuaguaauuuuuaaauc

SEQ ID NO: 2045565 - RNA, 16 nt, Staphylococcus aureus subsp. aureus Mu50
auuugauuauucuuca

SEQ ID NO: 2045566 - RNA, 13 nt, Staphylococcus aureus subsp. aureus Mu50
auuugauucuuca

SEQ ID NO: 2045567 - RNA, 13 nt, Staphylococcus aureus subsp. aureus Mu50
auuugauuuagca

SEQ ID NO: 2045568 - RNA, 13 nt, Staphylococcus aureus subsp. aureus Mu50
auuucuugcuuca

SEQ ID NO: 2045569 - RNA, 17 nt, Staphylococcus aureus subsp. aureus Mu50
auuucuucauuuucauu

SEQ ID NO: 2045570 - RNA, 19 nt, Staphylococcus aureus subsp. aureus Mu50
auuucugucccacucccau

SEQ ID NO: 2045571 - RNA, 17 nt, Staphylococcus aureus subsp. aureus Mu50
auuucugcuucuuuuaa

SEQ ID NO: 2045572 - RNA, 14 nt, Staphylococcus aureus subsp. aureus Mu50
auuucugaugcuag

SEQ ID NO: 2045573 - RNA, 13 nt, Staphylococcus aureus subsp. aureus Mu50
caaaacuuguaau

SEQ ID NO: 2045574 - RNA, 23 nt, Staphylococcus aureus subsp. aureus Mu50
caaaacguuugaagaauguuuca

SEQ ID NO: 2045575 - RNA, 22 nt, Staphylococcus aureus subsp. aureus Mu50
caaaaccgcuauaaaauuuuga

SEQ ID NO: 2045576 - RNA, 15 nt, Staphylococcus aureus subsp. aureus Mu50
caaaacgcauuucau

SEQ ID NO: 2045577 - RNA, 17 nt, Staphylococcus aureus subsp. aureus Mu50
caaaacgcauuucaugu

SEQ ID NO: 2045578 - RNA, 21 nt, Staphylococcus aureus subsp. aureus Mu50
caaaacauuuugugacuuugu

SEQ ID NO: 2045579 - RNA, 14 nt, Staphylococcus aureus subsp. aureus Mu50
caaaaccaaaugaa

SEQ ID NO: 2045580 - RNA, 13 nt, Staphylococcus aureus subsp. aureus Mu50
caaaaauaaaaau

SEQ ID NO: 2045581 - RNA, 19 nt, Staphylococcus aureus subsp. aureus Mu50
caaaaaugaagaauacaaa

SEQ ID NO: 2045582 - RNA, 18 nt, Staphylococcus aureus subsp. aureus Mu50
caaaaaacgccuuuccau

SEQ ID NO: 2045583 - RNA, 12 nt, Staphylococcus aureus subsp. aureus Mu50
caaaaaauugua

SEQ ID NO: 2045584 - RNA, 17 nt, Staphylococcus aureus subsp. aureus Mu50
caaaaaauacguuuaau

SEQ ID NO: 2045585 - RNA, 13 nt, Staphylococcus aureus subsp. aureus Mu50
caaaaaauaucuu

SEQ ID NO: 2045586 - RNA, 17 nt, Staphylococcus aureus subsp. aureus Mu50
auuuuggauaauaugag

SEQ ID NO: 2045587 - RNA, 12 nt, Staphylococcus aureus subsp. aureus Mu50
auuuuuaaaaau

SEQ ID NO: 2045588 - RNA, 13 nt, Staphylococcus aureus subsp. aureus Mu50
auuuuuaaaucua

SEQ ID NO: 2045589 - RNA, 23 nt, Staphylococcus aureus subsp. aureus Mu50
auuuuguuguacuuccuuccauu

SEQ ID NO: 2045590 - RNA, 14 nt, Staphylococcus aureus subsp. aureus Mu50
auuuuguuucaaac

SEQ ID NO: 2045591 - RNA, 14 nt, Staphylococcus aureus subsp. aureus Mu50
auuuuguuucaaca

SEQ ID NO: 2045592 - RNA, 16 nt, Staphylococcus aureus subsp. aureus Mu50
auuuuuaauaauuuga

SEQ ID NO: 2045593 - RNA, 22 nt, Staphylococcus aureus subsp. aureus Mu50
auuuuguaauggcuauucgauu

SEQ ID NO: 2045594 - RNA, 16 nt, Staphylococcus aureus subsp. aureus Mu50
auuuuuacaaagugau

SEQ ID NO: 2045595 - RNA, 17 nt, Staphylococcus aureus subsp. aureus Mu50
auuuuuacuaaaucauu

SEQ ID NO: 2045596 - RNA, 12 nt, Staphylococcus aureus subsp. aureus Mu50
auuuuuaucauc

SEQ ID NO: 2045597 - RNA, 15 nt, Staphylococcus aureus subsp. aureus Mu50
auuuuuaucaucaug

SEQ ID NO: 2045598 - RNA, 13 nt, Staphylococcus aureus subsp. aureus Mu50
auuuuuaucaucu

SEQ ID NO: 2045599 - RNA, 21 nt, Staphylococcus aureus subsp. aureus Mu50
auuuugcugccaaaaaguauu

SEQ ID NO: 2045600 - RNA, 19 nt, Staphylococcus aureus subsp. aureus Mu50
auuuugcucuaaacuucua

SEQ ID NO: 2045601 - RNA, 20 nt, Staphylococcus aureus subsp. aureus Mu50
auuuugcgaaaauaucauuu

SEQ ID NO: 2045602 - RNA, 15 nt, Staphylococcus aureus subsp. aureus Mu50
auuuugauauaaaaa

SEQ ID NO: 2045603 - RNA, 23 nt, Staphylococcus aureus subsp. aureus Mu50
auuuuucuucaguuaaaucuuua

SEQ ID NO: 2045604 - RNA, 12 nt, Staphylococcus aureus subsp. aureus Mu50
auuuuuggcuua

SEQ ID NO: 2045605 - RNA, 18 nt, Staphylococcus aureus subsp. aureus Mu50
auuuuuguaauacaucua

SEQ ID NO: 2045606 - RNA, 19 nt, Staphylococcus aureus subsp. aureus Mu50
auuuuuguaauugaugauu

SEQ ID NO: 2045607 - RNA, 21 nt, Staphylococcus aureus subsp. aureus Mu50
auuuuucaaauauaucaacgu

SEQ ID NO: 2045608 - RNA, 17 nt, Staphylococcus aureus subsp. aureus Mu50
auuuuucauuaauacaa

SEQ ID NO: 2045609 - RNA, 18 nt, Staphylococcus aureus subsp. aureus Mu50
auuuuugcuauuucaaca

SEQ ID NO: 2045610 - RNA, 18 nt, Staphylococcus aureus subsp. aureus Mu50
auuuuuuagacaaauguu

SEQ ID NO: 2045611 - RNA, 21 nt, Staphylococcus aureus subsp. aureus Mu50
auuuuuuaguaauaacaucua

SEQ ID NO: 2045612 - RNA, 15 nt, Staphylococcus aureus subsp. aureus Mu50
auuuuuuauaaagau

SEQ ID NO: 2045613 - RNA, 23 nt, Staphylococcus aureus subsp. aureus Mu50
auuuuuuuuauuaauuaaaaaau

SEQ ID NO: 2045614 - RNA, 19 nt, Staphylococcus aureus subsp. aureus Mu50
auuuuuuuacguaaucuaa

SEQ ID NO: 2045615 - RNA, 13 nt, Staphylococcus aureus subsp. aureus Mu50
auuuuuuuaugcu

SEQ ID NO: 2045616 - RNA, 23 nt, Staphylococcus aureus subsp. aureus Mu50
auuuuuuuaaaucuauauaaagu

SEQ ID NO: 2045617 - RNA, 21 nt, Staphylococcus aureus subsp. aureus Mu50
caaauuacugucuuuccauaa

SEQ ID NO: 2045618 - RNA, 13 nt, Staphylococcus aureus subsp. aureus Mu50
caaauguugaaug

SEQ ID NO: 2045619 - RNA, 18 nt, Staphylococcus aureus subsp. aureus Mu50
caaauguugaauguggaa

SEQ ID NO: 2045620 - RNA, 15 nt, Staphylococcus aureus subsp. aureus Mu50
caaauucaacuuuaa

SEQ ID NO: 2045621 - RNA, 16 nt, Staphylococcus aureus subsp. aureus Mu50
caaauuaguuugauau

SEQ ID NO: 2045622 - RNA, 16 nt, Staphylococcus aureus subsp. aureus Mu50
caaauuaucauuaaau

SEQ ID NO: 2045623 - RNA, 15 nt, Staphylococcus aureus subsp. aureus Mu50
caaauuauuaacgca

SEQ ID NO: 2045624 - RNA, 12 nt, Staphylococcus aureus subsp. aureus Mu50
caacaauugcua

SEQ ID NO: 2045625 - RNA, 13 nt, Staphylococcus aureus subsp. aureus Mu50
caacaauugcuaa

SEQ ID NO: 2045626 - RNA, 17 nt, Staphylococcus aureus subsp. aureus Mu50
caacaauugcuaaucca

SEQ ID NO: 2045627 - RNA, 20 nt, Staphylococcus aureus subsp. aureus Mu50
caaauuugaauauacuuaau

SEQ ID NO: 2045628 - RNA, 18 nt, Staphylococcus aureus subsp. aureus Mu50
caaauugaacuuauaagu

SEQ ID NO: 2045629 - RNA, 19 nt, Staphylococcus aureus subsp. aureus Mu50
caaauugccuuucauuuua

SEQ ID NO: 2045630 - RNA, 18 nt, Staphylococcus aureus subsp. aureus Mu50
caaauuggauaauuucuu

SEQ ID NO: 2045631 - RNA, 14 nt, Staphylococcus aureus subsp. aureus Mu50
caaauugugauuua

SEQ ID NO: 2045632 - RNA, 17 nt, Staphylococcus aureus subsp. aureus Mu50
caaauuuaggcauguca

SEQ ID NO: 2045633 - RNA, 20 nt, Staphylococcus aureus subsp. aureus Mu50
caaagaaccacgcaucaugu

SEQ ID NO: 2045634 - RNA, 15 nt, Staphylococcus aureus subsp. aureus Mu50
caaacuugauucaau

SEQ ID NO: 2045635 - RNA, 23 nt, Staphylococcus aureus subsp. aureus Mu50
caaauauuguagccuccgccacc

SEQ ID NO: 2045636 - RNA, 14 nt, Staphylococcus aureus subsp. aureus Mu50
caaauauuucuaaa

SEQ ID NO: 2045637 - RNA, 16 nt, Staphylococcus aureus subsp. aureus Mu50
caaauauuuuaucugu

SEQ ID NO: 2045638 - RNA, 15 nt, Staphylococcus aureus subsp. aureus Mu50
caaauauaaauaaaa

SEQ ID NO: 2045639 - RNA, 18 nt, Staphylococcus aureus subsp. aureus Mu50
caaaucgauauugagaau

SEQ ID NO: 2045640 - RNA, 19 nt, Staphylococcus aureus subsp. aureus Mu50
caaaguaauaugagugaaa

SEQ ID NO: 2045641 - RNA, 13 nt, Staphylococcus aureus subsp. aureus Mu50
caaaguagacauu

SEQ ID NO: 2045642 - RNA, 17 nt, Staphylococcus aureus subsp. aureus Mu50
caaaguagacauugaaa

SEQ ID NO: 2045643 - RNA, 18 nt, Staphylococcus aureus subsp. aureus Mu50
caaaguagauauugaaug

SEQ ID NO: 2045644 - RNA, 14 nt, Staphylococcus aureus subsp. aureus Mu50
caaauaucuaaaca

SEQ ID NO: 2045645 - RNA, 12 nt, Staphylococcus aureus subsp. aureus Mu50
caaauauuaaau

SEQ ID NO: 2045646 - RNA, 15 nt, Staphylococcus aureus subsp. aureus Mu50
caaauauuaaauuau

SEQ ID NO: 2045647 - RNA, 15 nt, Staphylococcus aureus subsp. aureus Mu50
caaauauuauuaaau

SEQ ID NO: 2045648 - RNA, 14 nt, Staphylococcus aureus subsp. aureus Mu50
caaacuauuaaugg

SEQ ID NO: 2045649 - RNA, 19 nt, Staphylococcus aureus subsp. aureus Mu50
caaacggcccaacuggauc

SEQ ID NO: 2045650 - RNA, 23 nt, Staphylococcus aureus subsp. aureus Mu50
caaaccuaucaucaaucguuaau

SEQ ID NO: 2045651 - RNA, 17 nt, Staphylococcus aureus subsp. aureus Mu50
caaacgcacuaucaaug

SEQ ID NO: 2045652 - RNA, 23 nt, Staphylococcus aureus subsp. aureus Mu50
caaacgacuaaccacauuauaau

SEQ ID NO: 2045653 - RNA, 16 nt, Staphylococcus aureus subsp. aureus Mu50
caaacccuuuaaacau

SEQ ID NO: 2045654 - RNA, 13 nt, Staphylococcus aureus subsp. aureus Mu50
caaaauauaaaau

SEQ ID NO: 2045655 - RNA, 16 nt, Staphylococcus aureus subsp. aureus Mu50
caaaauauacuaaauu

SEQ ID NO: 2045656 - RNA, 23 nt, Staphylococcus aureus subsp. aureus Mu50
caaaauauggaauuucauauaau

SEQ ID NO: 2045657 - RNA, 22 nt, Staphylococcus aureus subsp. aureus Mu50
caaaaugauugccaccguuaua

SEQ ID NO: 2045658 - RNA, 17 nt, Staphylococcus aureus subsp. aureus Mu50
caaaauguuuaacaaua

SEQ ID NO: 2045659 - RNA, 17 nt, Staphylococcus aureus subsp. aureus Mu50
caaaauuauguaaaaaa

SEQ ID NO: 2045660 - RNA, 17 nt, Staphylococcus aureus subsp. aureus Mu50
caaaauucaauauuaau

SEQ ID NO: 2045661 - RNA, 13 nt, Staphylococcus aureus subsp. aureus Mu50
caaaauuugaaau

SEQ ID NO: 2045662 - RNA, 14 nt, Staphylococcus aureus subsp. aureus Mu50
caaaauuuucuaca

SEQ ID NO: 2045663 - RNA, 13 nt, Staphylococcus aureus subsp. aureus Mu50
caaacauuccucu

SEQ ID NO: 2045664 - RNA, 21 nt, Staphylococcus aureus subsp. aureus Mu50
caaacaguccuuauuauaggg

SEQ ID NO: 2045665 - RNA, 21 nt, Staphylococcus aureus subsp. aureus Mu50
caaacauaauuaccuuuccau

SEQ ID NO: 2045666 - RNA, 15 nt, Staphylococcus aureus subsp. aureus Mu50
augacauuuaauacu

SEQ ID NO: 2045667 - RNA, 20 nt, Staphylococcus aureus subsp. aureus Mu50
augacauuuaauacuuuucu

SEQ ID NO: 2045668 - RNA, 19 nt, Staphylococcus aureus subsp. aureus Mu50
augacagcaucaucaauuu

SEQ ID NO: 2045669 - RNA, 15 nt, Staphylococcus aureus subsp. aureus Mu50
augacaucaauaucu

SEQ ID NO: 2045670 - RNA, 20 nt, Staphylococcus aureus subsp. aureus Mu50
augaauaauguuuccauuua

SEQ ID NO: 2045671 - RNA, 14 nt, Staphylococcus aureus subsp. aureus Mu50
augaauuuuuauuu

SEQ ID NO: 2045672 - RNA, 18 nt, Staphylococcus aureus subsp. aureus Mu50
augaauaaauagauaaua

SEQ ID NO: 2045673 - RNA, 21 nt, Staphylococcus aureus subsp. aureus Mu50
augaauaaauagauaauauau

SEQ ID NO: 2045674 - RNA, 13 nt, Staphylococcus aureus subsp. aureus Mu50
augaaggcuuuga

SEQ ID NO: 2045675 - RNA, 20 nt, Staphylococcus aureus subsp. aureus Mu50
augaacaaaauaacauguuu

SEQ ID NO: 2045676 - RNA, 15 nt, Staphylococcus aureus subsp. aureus Mu50
augaaaaguaaauug

SEQ ID NO: 2045677 - RNA, 15 nt, Staphylococcus aureus subsp. aureus Mu50
augaaauaacaauag

SEQ ID NO: 2045678 - RNA, 18 nt, Staphylococcus aureus subsp. aureus Mu50
augaaaguaccuaaaaua

SEQ ID NO: 2045679 - RNA, 16 nt, Staphylococcus aureus subsp. aureus Mu50
augaaagcaucuugca

SEQ ID NO: 2045680 - RNA, 18 nt, Staphylococcus aureus subsp. aureus Mu50
augaaaauaccucuacau

SEQ ID NO: 2045681 - RNA, 14 nt, Staphylococcus aureus subsp. aureus Mu50
aucuuuaaauguau

SEQ ID NO: 2045682 - RNA, 20 nt, Staphylococcus aureus subsp. aureus Mu50
aucuuuaauaaccuuuaaaa

SEQ ID NO: 2045683 - RNA, 14 nt, Staphylococcus aureus subsp. aureus Mu50
aucuuuaauacgaa

SEQ ID NO: 2045684 - RNA, 24 nt, Staphylococcus aureus subsp. aureus Mu50
aucuuuaaucaaaggaucauguuc

SEQ ID NO: 2045685 - RNA, 17 nt, Staphylococcus aureus subsp. aureus Mu50
aucuugauuuuauaaau

SEQ ID NO: 2045686 - RNA, 19 nt, Staphylococcus aureus subsp. aureus Mu50
aucuugcaagccaucaaua

SEQ ID NO: 2045687 - RNA, 13 nt, Staphylococcus aureus subsp. aureus Mu50
augcacaauauuc

SEQ ID NO: 2045688 - RNA, 15 nt, Staphylococcus aureus subsp. aureus Mu50
augcaccaacaauag

SEQ ID NO: 2045689 - RNA, 18 nt, Staphylococcus aureus subsp. aureus Mu50
augcaauacauuaauaua

SEQ ID NO: 2045690 - RNA, 17 nt, Staphylococcus aureus subsp. aureus Mu50
augcacuuuaacauaac

SEQ ID NO: 2045691 - RNA, 19 nt, Staphylococcus aureus subsp. aureus Mu50
augcaccuuuacaacauac

SEQ ID NO: 2045692 - RNA, 20 nt, Staphylococcus aureus subsp. aureus Mu50
augcacuaaauuagcaacga

SEQ ID NO: 2045693 - RNA, 14 nt, Staphylococcus aureus subsp. aureus Mu50
augcauauauugag

SEQ ID NO: 2045694 - RNA, 17 nt, Staphylococcus aureus subsp. aureus Mu50
augcauauguaauacaa

SEQ ID NO: 2045695 - RNA, 21 nt, Staphylococcus aureus subsp. aureus Mu50
augcaucaacagauacuucag

SEQ ID NO: 2045696 - RNA, 12 nt, Staphylococcus aureus subsp. aureus Mu50
augcauaauuag

SEQ ID NO: 2045697 - RNA, 20 nt, Staphylococcus aureus subsp. aureus Mu50
augauuugccccgccauuca

SEQ ID NO: 2045698 - RNA, 14 nt, Staphylococcus aureus subsp. aureus Mu50
augauuuucuuuaa

SEQ ID NO: 2045699 - RNA, 17 nt, Staphylococcus aureus subsp. aureus Mu50
augauuuugcuuuauuu

SEQ ID NO: 2045700 - RNA, 13 nt, Staphylococcus aureus subsp. aureus Mu50
augauuguuuuaa

SEQ ID NO: 2045701 - RNA, 14 nt, Staphylococcus aureus subsp. aureus Mu50
augauuuauaaaaa

SEQ ID NO: 2045702 - RNA, 14 nt, Staphylococcus aureus subsp. aureus Mu50
augauugcuuauuu

SEQ ID NO: 2045703 - RNA, 22 nt, Staphylococcus aureus subsp. aureus Mu50
augauuggcagugaucuuuuuu

SEQ ID NO: 2045704 - RNA, 16 nt, Staphylococcus aureus subsp. aureus Mu50
augcaacuugaucauu

SEQ ID NO: 2045705 - RNA, 17 nt, Staphylococcus aureus subsp. aureus Mu50
augagguucaguagaau

SEQ ID NO: 2045706 - RNA, 16 nt, Staphylococcus aureus subsp. aureus Mu50
augauuauauuuucuc

SEQ ID NO: 2045707 - RNA, 23 nt, Staphylococcus aureus subsp. aureus Mu50
augauuacguugguuuaaaaauu

SEQ ID NO: 2045708 - RNA, 20 nt, Staphylococcus aureus subsp. aureus Mu50
augauuagcgcaccaauuau

SEQ ID NO: 2045709 - RNA, 16 nt, Staphylococcus aureus subsp. aureus Mu50
augauuaacuuucuaa

SEQ ID NO: 2045710 - RNA, 18 nt, Staphylococcus aureus subsp. aureus Mu50
augauuaaaaaucaaaga

SEQ ID NO: 2045711 - RNA, 18 nt, Staphylococcus aureus subsp. aureus Mu50
augauuaaagcgauaaua

SEQ ID NO: 2045712 - RNA, 22 nt, Staphylococcus aureus subsp. aureus Mu50
aucguaaaaaaacgucuauacu

SEQ ID NO: 2045713 - RNA, 16 nt, Staphylococcus aureus subsp. aureus Mu50
aucguauguaacaauu

SEQ ID NO: 2045714 - RNA, 14 nt, Staphylococcus aureus subsp. aureus Mu50
aucgucgcuaauaa

SEQ ID NO: 2045715 - RNA, 18 nt, Staphylococcus aureus subsp. aureus Mu50
aucucgucacauauaaau

SEQ ID NO: 2045716 - RNA, 20 nt, Staphylococcus aureus subsp. aureus Mu50
aucguuaauuuccaauaucu

SEQ ID NO: 2045717 - RNA, 13 nt, Staphylococcus aureus subsp. aureus Mu50
aucguucaauguu

SEQ ID NO: 2045718 - RNA, 18 nt, Staphylococcus aureus subsp. aureus Mu50
aucguuaauguauaaaaa

SEQ ID NO: 2045719 - RNA, 14 nt, Staphylococcus aureus subsp. aureus Mu50
aucucauaauaauu

SEQ ID NO: 2045720 - RNA, 14 nt, Staphylococcus aureus subsp. aureus Mu50
aucuccaucaaagu

SEQ ID NO: 2045721 - RNA, 15 nt, Staphylococcus aureus subsp. aureus Mu50
aucuccaucaaaguu

SEQ ID NO: 2045722 - RNA, 23 nt, Staphylococcus aureus subsp. aureus Mu50
aucugacauuucaucaauaauuu

SEQ ID NO: 2045723 - RNA, 12 nt, Staphylococcus aureus subsp. aureus Mu50
aucugaaucugc

SEQ ID NO: 2045724 - RNA, 22 nt, Staphylococcus aureus subsp. aureus Mu50
aucucugcuuuaauauaauuau

SEQ ID NO: 2045725 - RNA, 17 nt, Staphylococcus aureus subsp. aureus Mu50
aucuggcaaauugccuu

SEQ ID NO: 2045726 - RNA, 19 nt, Staphylococcus aureus subsp. aureus Mu50
aucuggaauaccuaaccau

SEQ ID NO: 2045727 - RNA, 20 nt, Staphylococcus aureus subsp. aureus Mu50
auggccaaauguugauaaua

SEQ ID NO: 2045728 - RNA, 19 nt, Staphylococcus aureus subsp. aureus Mu50
auggcaucuggcaaauugc

SEQ ID NO: 2045729 - RNA, 18 nt, Staphylococcus aureus subsp. aureus Mu50
auggauauucaaugaauu

SEQ ID NO: 2045730 - RNA, 20 nt, Staphylococcus aureus subsp. aureus Mu50
auggauuauuaugccuuuga

SEQ ID NO: 2045731 - RNA, 14 nt, Staphylococcus aureus subsp. aureus Mu50
augcucuacaaagu

SEQ ID NO: 2045732 - RNA, 15 nt, Staphylococcus aureus subsp. aureus Mu50
augcucuacaaaguu

SEQ ID NO: 2045733 - RNA, 20 nt, Staphylococcus aureus subsp. aureus Mu50
augcugcaagucucauaucu

SEQ ID NO: 2045734 - RNA, 18 nt, Staphylococcus aureus subsp. aureus Mu50
augucacuguuaaagaug

SEQ ID NO: 2045735 - RNA, 20 nt, Staphylococcus aureus subsp. aureus Mu50
augucauagacuacgcgauu

SEQ ID NO: 2045736 - RNA, 19 nt, Staphylococcus aureus subsp. aureus Mu50
augucauauacuauauguc

SEQ ID NO: 2045737 - RNA, 13 nt, Staphylococcus aureus subsp. aureus Mu50
augucauaugcac

SEQ ID NO: 2045738 - RNA, 15 nt, Staphylococcus aureus subsp. aureus Mu50
augucaugucuagau

SEQ ID NO: 2045739 - RNA, 15 nt, Staphylococcus aureus subsp. aureus Mu50
auguaaaguugauaa

SEQ ID NO: 2045740 - RNA, 19 nt, Staphylococcus aureus subsp. aureus Mu50
auguaaauaaaaauuauau

SEQ ID NO: 2045741 - RNA, 23 nt, Staphylococcus aureus subsp. aureus Mu50
auguaaaucgugcuguuaucaug

SEQ ID NO: 2045742 - RNA, 22 nt, Staphylococcus aureus subsp. aureus Mu50
augguuuuguuuugcucuuuaa

SEQ ID NO: 2045743 - RNA, 18 nt, Staphylococcus aureus subsp. aureus Mu50
auguaaaaaauaucuugu

SEQ ID NO: 2045744 - RNA, 15 nt, Staphylococcus aureus subsp. aureus Mu50
auguaagaacgaaac

SEQ ID NO: 2045745 - RNA, 19 nt, Staphylococcus aureus subsp. aureus Mu50
auguaagcaacauaugauu

SEQ ID NO: 2045746 - RNA, 18 nt, Staphylococcus aureus subsp. aureus Mu50
auguaacguuucuuugua

SEQ ID NO: 2045747 - RNA, 13 nt, Staphylococcus aureus subsp. aureus Mu50
auguaugcuugua

SEQ ID NO: 2045748 - RNA, 20 nt, Staphylococcus aureus subsp. aureus Mu50
auguauaacauuauuaaaca

SEQ ID NO: 2045749 - RNA, 19 nt, Staphylococcus aureus subsp. aureus Mu50
auguauaucgacaccauuu

SEQ ID NO: 2045750 - RNA, 23 nt, Staphylococcus aureus subsp. aureus Mu50
auguaugaaaggaguauuuuugc

SEQ ID NO: 2045751 - RNA, 20 nt, Staphylococcus aureus subsp. aureus Mu50
auguauguuuuaucaauauu

SEQ ID NO: 2045752 - RNA, 22 nt, Staphylococcus aureus subsp. aureus Mu50
auguauugcuauaagaacuaau

SEQ ID NO: 2045753 - RNA, 20 nt, Staphylococcus aureus subsp. aureus Mu50
auguauuuuuacuuuuauaa

SEQ ID NO: 2045754 - RNA, 15 nt, Staphylococcus aureus subsp. aureus Mu50
auguauuuuucuuaa

SEQ ID NO: 2045755 - RNA, 20 nt, Staphylococcus aureus subsp. aureus Mu50
auguauuuuucuuaauuauc

SEQ ID NO: 2045756 - RNA, 14 nt, Staphylococcus aureus subsp. aureus Mu50
auggucaacuuuuu

SEQ ID NO: 2045757 - RNA, 20 nt, Staphylococcus aureus subsp. aureus Mu50
augguauugcuuuacuaauu

SEQ ID NO: 2045758 - RNA, 23 nt, Staphylococcus aureus subsp. aureus Mu50
augguuaauaacccauuuucaaa

SEQ ID NO: 2045759 - RNA, 21 nt, Staphylococcus aureus subsp. aureus Mu50
augguuaucacuuauuauuuu

SEQ ID NO: 2045760 - RNA, 16 nt, Staphylococcus aureus subsp. aureus Mu50
augguuccaaguauuu

SEQ ID NO: 2045761 - RNA, 13 nt, Staphylococcus aureus subsp. aureus Mu50
augguuaucacuu

SEQ ID NO: 2045762 - RNA, 14 nt, Staphylococcus aureus subsp. aureus Mu50
augguuucauaaac

SEQ ID NO: 2045763 - RNA, 20 nt, Staphylococcus aureus subsp. aureus Mu50
auggcgggcccccaacacaa

SEQ ID NO: 2045764 - RNA, 19 nt, Staphylococcus aureus subsp. aureus Mu50
augguaucaauagccauuu

SEQ ID NO: 2045765 - RNA, 17 nt, Staphylococcus aureus subsp. aureus Mu50
augguaucuuuaauuuc

SEQ ID NO: 2045766 - RNA, 23 nt, Staphylococcus aureus subsp. aureus Mu50
augguaaaacccaguaucgauuu

SEQ ID NO: 2045767 - RNA, 15 nt, Staphylococcus aureus subsp. aureus Mu50
auggguaguuaauau

SEQ ID NO: 2045768 - RNA, 19 nt, Staphylococcus aureus subsp. aureus Mu50
augcccaaccacgauaucu

SEQ ID NO: 2045769 - RNA, 17 nt, Staphylococcus aureus subsp. aureus Mu50
augcauuuaauuuaauu

SEQ ID NO: 2045770 - RNA, 21 nt, Staphylococcus aureus subsp. aureus Mu50
augcauuacuacuuuauaaau

SEQ ID NO: 2045771 - RNA, 17 nt, Staphylococcus aureus subsp. aureus Mu50
augcauuauuauaauag

SEQ ID NO: 2045772 - RNA, 13 nt, Staphylococcus aureus subsp. aureus Mu50
augccaacuauac

SEQ ID NO: 2045773 - RNA, 21 nt, Staphylococcus aureus subsp. aureus Mu50
augccaccguggaauuuacca

SEQ ID NO: 2045774 - RNA, 21 nt, Staphylococcus aureus subsp. aureus Mu50
augccaauggaaguuuuuuag

SEQ ID NO: 2045775 - RNA, 16 nt, Staphylococcus aureus subsp. aureus Mu50
augcucccuucaaagu

SEQ ID NO: 2045776 - RNA, 18 nt, Staphylococcus aureus subsp. aureus Mu50
augcuaucucuaccauuu

SEQ ID NO: 2045777 - RNA, 19 nt, Staphylococcus aureus subsp. aureus Mu50
augcuagcuuucuuuuuca

SEQ ID NO: 2045778 - RNA, 20 nt, Staphylococcus aureus subsp. aureus Mu50
augcuaauacuaaucaaaga

SEQ ID NO: 2045779 - RNA, 12 nt, Staphylococcus aureus subsp. aureus Mu50
augcuaauguaa

SEQ ID NO: 2045780 - RNA, 20 nt, Staphylococcus aureus subsp. aureus Mu50
caagugucaaauacguauca

SEQ ID NO: 2045781 - RNA, 22 nt, Staphylococcus aureus subsp. aureus Mu50
caauaaaacuauguguauaugu

SEQ ID NO: 2045782 - RNA, 20 nt, Staphylococcus aureus subsp. aureus Mu50
caauaaaaaugguauucgca

SEQ ID NO: 2045783 - RNA, 13 nt, Staphylococcus aureus subsp. aureus Mu50
caaguugaucaaa

SEQ ID NO: 2045784 - RNA, 16 nt, Staphylococcus aureus subsp. aureus Mu50
caaguuuauaaucuuu

SEQ ID NO: 2045785 - RNA, 14 nt, Staphylococcus aureus subsp. aureus Mu50
caagugacaacauu

SEQ ID NO: 2045786 - RNA, 20 nt, Staphylococcus aureus subsp. aureus Mu50
caagugccauuuuuaaauua

SEQ ID NO: 2045787 - RNA, 17 nt, Staphylococcus aureus subsp. aureus Mu50
caagugcuugauuaaca

SEQ ID NO: 2045788 - RNA, 15 nt, Staphylococcus aureus subsp. aureus Mu50
caaguuacaauauca

SEQ ID NO: 2045789 - RNA, 19 nt, Staphylococcus aureus subsp. aureus Mu50
caaguuaugcugucaaaca

SEQ ID NO: 2045790 - RNA, 21 nt, Staphylococcus aureus subsp. aureus Mu50
caauaauaaauaggaugaaaa

SEQ ID NO: 2045791 - RNA, 16 nt, Staphylococcus aureus subsp. aureus Mu50
caauaacuauaaucau

SEQ ID NO: 2045792 - RNA, 14 nt, Staphylococcus aureus subsp. aureus Mu50
caauaaaauuacuu

SEQ ID NO: 2045793 - RNA, 16 nt, Staphylococcus aureus subsp. aureus Mu50
caauaacaggugcuua

SEQ ID NO: 2045794 - RNA, 15 nt, Staphylococcus aureus subsp. aureus Mu50
caauaaccauuucau

SEQ ID NO: 2045795 - RNA, 23 nt, Staphylococcus aureus subsp. aureus Mu50
caauaaccccugucacuaaugga

SEQ ID NO: 2045796 - RNA, 19 nt, Staphylococcus aureus subsp. aureus Mu50
caagguaugaaauaacaau

SEQ ID NO: 2045797 - RNA, 17 nt, Staphylococcus aureus subsp. aureus Mu50
caacuuaaauggaugau

SEQ ID NO: 2045798 - RNA, 17 nt, Staphylococcus aureus subsp. aureus Mu50
caacuuagaauuuacaa

SEQ ID NO: 2045799 - RNA, 14 nt, Staphylococcus aureus subsp. aureus Mu50
caacuuauucuuca

SEQ ID NO: 2045800 - RNA, 15 nt, Staphylococcus aureus subsp. aureus Mu50
caacuucgauaugau

SEQ ID NO: 2045801 - RNA, 16 nt, Staphylococcus aureus subsp. aureus Mu50
caagaauggcuuaaca

SEQ ID NO: 2045802 - RNA, 16 nt, Staphylococcus aureus subsp. aureus Mu50
caagcaauacgauugc

SEQ ID NO: 2045803 - RNA, 18 nt, Staphylococcus aureus subsp. aureus Mu50
caagauuaugacaacaua

SEQ ID NO: 2045804 - RNA, 21 nt, Staphylococcus aureus subsp. aureus Mu50
caagauuggcugugcuauaau

SEQ ID NO: 2045805 - RNA, 24 nt, Staphylococcus aureus subsp. aureus Mu50
caacuuuuuaauaauacuucuaau

SEQ ID NO: 2045806 - RNA, 15 nt, Staphylococcus aureus subsp. aureus Mu50
caacuuuaaucaaaa

SEQ ID NO: 2045807 - RNA, 17 nt, Staphylococcus aureus subsp. aureus Mu50
caacuugcauugucugu

SEQ ID NO: 2045808 - RNA, 19 nt, Staphylococcus aureus subsp. aureus Mu50
caagccaucaauauugaua

SEQ ID NO: 2045809 - RNA, 20 nt, Staphylococcus aureus subsp. aureus Mu50
cacacagguaaauuuaaaau

SEQ ID NO: 2045810 - RNA, 16 nt, Staphylococcus aureus subsp. aureus Mu50
cacaauacgaaaucaa

SEQ ID NO: 2045811 - RNA, 22 nt, Staphylococcus aureus subsp. aureus Mu50
cacaaguuuacagguugaauaa

SEQ ID NO: 2045812 - RNA, 16 nt, Staphylococcus aureus subsp. aureus Mu50
caaugugagauauaaa

SEQ ID NO: 2045813 - RNA, 19 nt, Staphylococcus aureus subsp. aureus Mu50
caauguaaugguuaauaac

SEQ ID NO: 2045814 - RNA, 22 nt, Staphylococcus aureus subsp. aureus Mu50
caauguaauuuucacuuucaau

SEQ ID NO: 2045815 - RNA, 22 nt, Staphylococcus aureus subsp. aureus Mu50
caauguacuaggaccuacaauu

SEQ ID NO: 2045816 - RNA, 21 nt, Staphylococcus aureus subsp. aureus Mu50
caauuucgauugcguuuucua

SEQ ID NO: 2045817 - RNA, 22 nt, Staphylococcus aureus subsp. aureus Mu50
cacaaaugaauggagcaugauu

SEQ ID NO: 2045818 - RNA, 20 nt, Staphylococcus aureus subsp. aureus Mu50
caauuuaauuaagaaaauca

SEQ ID NO: 2045819 - RNA, 19 nt, Staphylococcus aureus subsp. aureus Mu50
caauuucauuuuugauaac

SEQ ID NO: 2045820 - RNA, 20 nt, Staphylococcus aureus subsp. aureus Mu50
caauuguugcaaaauacgau

SEQ ID NO: 2045821 - RNA, 14 nt, Staphylococcus aureus subsp. aureus Mu50
cacaaauuugaaua

SEQ ID NO: 2045822 - RNA, 13 nt, Staphylococcus aureus subsp. aureus Mu50
caaucgcauuuug

SEQ ID NO: 2045823 - RNA, 14 nt, Staphylococcus aureus subsp. aureus Mu50
caaucgcauuuugu

SEQ ID NO: 2045824 - RNA, 23 nt, Staphylococcus aureus subsp. aureus Mu50
caaucauuguaaaugaucaucgu

SEQ ID NO: 2045825 - RNA, 15 nt, Staphylococcus aureus subsp. aureus Mu50
caaucaucauuaaau

SEQ ID NO: 2045826 - RNA, 12 nt, Staphylococcus aureus subsp. aureus Mu50
caauacauuaau

SEQ ID NO: 2045827 - RNA, 18 nt, Staphylococcus aureus subsp. aureus Mu50
caauacaccuauuacacu

SEQ ID NO: 2045828 - RNA, 20 nt, Staphylococcus aureus subsp. aureus Mu50
caauacagaacuuuaauaau

SEQ ID NO: 2045829 - RNA, 19 nt, Staphylococcus aureus subsp. aureus Mu50
caauaauuacuaaccuaaa

SEQ ID NO: 2045830 - RNA, 23 nt, Staphylococcus aureus subsp. aureus Mu50
caauaauucaucaaguugauaau

SEQ ID NO: 2045831 - RNA, 19 nt, Staphylococcus aureus subsp. aureus Mu50
caauaauugaugaaagacu

SEQ ID NO: 2045832 - RNA, 14 nt, Staphylococcus aureus subsp. aureus Mu50
caauaccauaauua

SEQ ID NO: 2045833 - RNA, 15 nt, Staphylococcus aureus subsp. aureus Mu50
caauacgaauaucug

SEQ ID NO: 2045834 - RNA, 19 nt, Staphylococcus aureus subsp. aureus Mu50
caauacgaaguuucauguu

SEQ ID NO: 2045835 - RNA, 20 nt, Staphylococcus aureus subsp. aureus Mu50
caauaccuaauuuacguacu

SEQ ID NO: 2045836 - RNA, 22 nt, Staphylococcus aureus subsp. aureus Mu50
caaucggaagcauauuucuaaa

SEQ ID NO: 2045837 - RNA, 16 nt, Staphylococcus aureus subsp. aureus Mu50
caaugaauuguuaguu

SEQ ID NO: 2045838 - RNA, 15 nt, Staphylococcus aureus subsp. aureus Mu50
caaugaauuucuaau

SEQ ID NO: 2045839 - RNA, 15 nt, Staphylococcus aureus subsp. aureus Mu50
caaugaauaaauuga

SEQ ID NO: 2045840 - RNA, 17 nt, Staphylococcus aureus subsp. aureus Mu50
caaugaauaaauugaua

SEQ ID NO: 2045841 - RNA, 19 nt, Staphylococcus aureus subsp. aureus Mu50
caaugaauaaugacaaauu

SEQ ID NO: 2045842 - RNA, 18 nt, Staphylococcus aureus subsp. aureus Mu50
caccacuuaggauaaacu

SEQ ID NO: 2045843 - RNA, 17 nt, Staphylococcus aureus subsp. aureus Mu50
caccacuuucaguaauu

SEQ ID NO: 2045844 - RNA, 21 nt, Staphylococcus aureus subsp. aureus Mu50
cacaccuaauucauauauacu

SEQ ID NO: 2045845 - RNA, 23 nt, Staphylococcus aureus subsp. aureus Mu50
caccaaguucacuaaauucaaua

SEQ ID NO: 2045846 - RNA, 18 nt, Staphylococcus aureus subsp. aureus Mu50
caccaaugauagugaaua

SEQ ID NO: 2045847 - RNA, 13 nt, Staphylococcus aureus subsp. aureus Mu50
caccaauugaaua

SEQ ID NO: 2045848 - RNA, 21 nt, Staphylococcus aureus subsp. aureus Mu50
caccaauuaaaucgauuaaga

SEQ ID NO: 2045849 - RNA, 15 nt, Staphylococcus aureus subsp. aureus Mu50
caccuuuacaacaua

SEQ ID NO: 2045850 - RNA, 14 nt, Staphylococcus aureus subsp. aureus Mu50
caccuuguuaaaau

SEQ ID NO: 2045851 - RNA, 18 nt, Staphylococcus aureus subsp. aureus Mu50
caccuuguaaauugaauu

SEQ ID NO: 2045852 - RNA, 22 nt, Staphylococcus aureus subsp. aureus Mu50
cacgauuucuuuaugauaauaa

SEQ ID NO: 2045853 - RNA, 13 nt, Staphylococcus aureus subsp. aureus Mu50
cacgaucuuuaaa

SEQ ID NO: 2045854 - RNA, 14 nt, Staphylococcus aureus subsp. aureus Mu50
caccucgauauuau

SEQ ID NO: 2045855 - RNA, 20 nt, Staphylococcus aureus subsp. aureus Mu50
caccguggaauuuaccauuu

SEQ ID NO: 2045856 - RNA, 22 nt, Staphylococcus aureus subsp. aureus Mu50
caccccaacucgcauugccugu

SEQ ID NO: 2045857 - RNA, 20 nt, Staphylococcus aureus subsp. aureus Mu50
cagaaucuuacauugauaaa

SEQ ID NO: 2045858 - RNA, 15 nt, Staphylococcus aureus subsp. aureus Mu50
aaagacaccuucaau

SEQ ID NO: 2045859 - RNA, 21 nt, Staphylococcus aureus subsp. aureus Mu50
aaagacugaaccguauaaugc

SEQ ID NO: 2045860 - RNA, 16 nt, Staphylococcus aureus subsp. aureus Mu50
aaagauaaacaagcca

SEQ ID NO: 2045861 - RNA, 19 nt, Staphylococcus aureus subsp. aureus Mu50
aaagauagaaugaauaauu

SEQ ID NO: 2045862 - RNA, 12 nt, Staphylococcus aureus subsp. aureus Mu50
aaagaugucgaa

SEQ ID NO: 2045863 - RNA, 18 nt, Staphylococcus aureus subsp. aureus Mu50
cacuccuuaaacaaauaa

SEQ ID NO: 2045864 - RNA, 17 nt, Staphylococcus aureus subsp. aureus Mu50
cacucauucaauuuagu

SEQ ID NO: 2045865 - RNA, 21 nt, Staphylococcus aureus subsp. aureus Mu50
cacucauaaucaagucugcau

SEQ ID NO: 2045866 - RNA, 17 nt, Staphylococcus aureus subsp. aureus Mu50
cacuaucguuuuuauua

SEQ ID NO: 2045867 - RNA, 20 nt, Staphylococcus aureus subsp. aureus Mu50
cacuaucuguuguuauauaa

SEQ ID NO: 2045868 - RNA, 15 nt, Staphylococcus aureus subsp. aureus Mu50
cacuauaauuucuua

SEQ ID NO: 2045869 - RNA, 19 nt, Staphylococcus aureus subsp. aureus Mu50
cacuaucauuaucaaauaa

SEQ ID NO: 2045870 - RNA, 14 nt, Staphylococcus aureus subsp. aureus Mu50
cacuuggauuuuaa

SEQ ID NO: 2045871 - RNA, 21 nt, Staphylococcus aureus subsp. aureus Mu50
cacuuggauuuuaauuauuug

SEQ ID NO: 2045872 - RNA, 12 nt, Staphylococcus aureus subsp. aureus Mu50
cacuucguauug

SEQ ID NO: 2045873 - RNA, 11 nt, Staphylococcus aureus subsp. aureus Mu50
cacuucauaaa

SEQ ID NO: 2045874 - RNA, 17 nt, Staphylococcus aureus subsp. aureus Mu50
cagaacaauucaaugua

SEQ ID NO: 2045875 - RNA, 21 nt, Staphylococcus aureus subsp. aureus Mu50
cagaaauuuaauauuguuaau

SEQ ID NO: 2045876 - RNA, 19 nt, Staphylococcus aureus subsp. aureus Mu50
cagcauugggacauaaaau

SEQ ID NO: 2045877 - RNA, 16 nt, Staphylococcus aureus subsp. aureus Mu50
cagcauuuucaaugua

SEQ ID NO: 2045878 - RNA, 22 nt, Staphylococcus aureus subsp. aureus Mu50
cagcauuaccagcaauuucgau

SEQ ID NO: 2045879 - RNA, 15 nt, Staphylococcus aureus subsp. aureus Mu50
cagauuuguauuuug

SEQ ID NO: 2045880 - RNA, 21 nt, Staphylococcus aureus subsp. aureus Mu50
cagauuuuaaaaauucauaau

SEQ ID NO: 2045881 - RNA, 23 nt, Staphylococcus aureus subsp. aureus Mu50
cagauuuuaaaaauucauaaucg

SEQ ID NO: 2045882 - RNA, 20 nt, Staphylococcus aureus subsp. aureus Mu50
cagauucauaucuuucaauu

SEQ ID NO: 2045883 - RNA, 16 nt, Staphylococcus aureus subsp. aureus Mu50
cagcaaugacacuaau

SEQ ID NO: 2045884 - RNA, 19 nt, Staphylococcus aureus subsp. aureus Mu50
caucguauucuuuuaauag

SEQ ID NO: 2045885 - RNA, 16 nt, Staphylococcus aureus subsp. aureus Mu50
caucuaaauaguuuuu

SEQ ID NO: 2045886 - RNA, 18 nt, Staphylococcus aureus subsp. aureus Mu50
caucuaaauaguuuuuca

SEQ ID NO: 2045887 - RNA, 17 nt, Staphylococcus aureus subsp. aureus Mu50
caucucugcuuuaauau

SEQ ID NO: 2045888 - RNA, 19 nt, Staphylococcus aureus subsp. aureus Mu50
caucugaaaaaauuaauaa

SEQ ID NO: 2045889 - RNA, 15 nt, Staphylococcus aureus subsp. aureus Mu50
caucuauuauuaugu

SEQ ID NO: 2045890 - RNA, 17 nt, Staphylococcus aureus subsp. aureus Mu50
caucucagcaauacuaa

SEQ ID NO: 2045891 - RNA, 16 nt, Staphylococcus aureus subsp. aureus Mu50
caucuauuauuauguu

SEQ ID NO: 2045892 - RNA, 22 nt, Staphylococcus aureus subsp. aureus Mu50
caucuauuuaauaauguaucau

SEQ ID NO: 2045893 - RNA, 18 nt, Staphylococcus aureus subsp. aureus Mu50
caucuccuugguuauuaa

SEQ ID NO: 2045894 - RNA, 17 nt, Staphylococcus aureus subsp. aureus Mu50
caucguaaagaucauuu

SEQ ID NO: 2045895 - RNA, 16 nt, Staphylococcus aureus subsp. aureus Mu50
caugauacucaauaaa

SEQ ID NO: 2045896 - RNA, 20 nt, Staphylococcus aureus subsp. aureus Mu50
caugauacucaauaaaauug

SEQ ID NO: 2045897 - RNA, 21 nt, Staphylococcus aureus subsp. aureus Mu50
caucuuucaaaugcuuaauaa

SEQ ID NO: 2045898 - RNA, 21 nt, Staphylococcus aureus subsp. aureus Mu50
caucuugucuaguucgauuuu

SEQ ID NO: 2045899 - RNA, 12 nt, Staphylococcus aureus subsp. aureus Mu50
caucuuuaaaga

SEQ ID NO: 2045900 - RNA, 19 nt, Staphylococcus aureus subsp. aureus Mu50
caucuugagauuuucaaca

SEQ ID NO: 2045901 - RNA, 22 nt, Staphylococcus aureus subsp. aureus Mu50
caucuuaucaagaauauaacga

SEQ ID NO: 2045902 - RNA, 13 nt, Staphylococcus aureus subsp. aureus Mu50
caucuguugauaa

SEQ ID NO: 2045903 - RNA, 17 nt, Staphylococcus aureus subsp. aureus Mu50
caugaccuaauauauua

SEQ ID NO: 2045904 - RNA, 20 nt, Staphylococcus aureus subsp. aureus Mu50
caugauaaaguauguuguca

SEQ ID NO: 2045905 - RNA, 15 nt, Staphylococcus aureus subsp. aureus Mu50
caugacauucauuua

SEQ ID NO: 2045906 - RNA, 18 nt, Staphylococcus aureus subsp. aureus Mu50
caugacagcaucaucaau

SEQ ID NO: 2045907 - RNA, 21 nt, Staphylococcus aureus subsp. aureus Mu50
caugacagcaucaucaauuua

SEQ ID NO: 2045908 - RNA, 20 nt, Staphylococcus aureus subsp. aureus Mu50
caugacacucauucaauuua

SEQ ID NO: 2045909 - RNA, 16 nt, Staphylococcus aureus subsp. aureus Mu50
caugacagcaucauca

SEQ ID NO: 2045910 - RNA, 17 nt, Staphylococcus aureus subsp. aureus Mu50
cauaacuagcaauuuga

SEQ ID NO: 2045911 - RNA, 24 nt, Staphylococcus aureus subsp. aureus Mu50
cauaaugaacaagggccauccauu

SEQ ID NO: 2045912 - RNA, 19 nt, Staphylococcus aureus subsp. aureus Mu50
cauaaugaauucauucaau

SEQ ID NO: 2045913 - RNA, 21 nt, Staphylococcus aureus subsp. aureus Mu50
cauaauuaacuuucuuuuguu

SEQ ID NO: 2045914 - RNA, 13 nt, Staphylococcus aureus subsp. aureus Mu50
cauaauuaauaac

SEQ ID NO: 2045915 - RNA, 17 nt, Staphylococcus aureus subsp. aureus Mu50
cauaauuaucauauaaa

SEQ ID NO: 2045916 - RNA, 16 nt, Staphylococcus aureus subsp. aureus Mu50
cauaacaccauuuacu

SEQ ID NO: 2045917 - RNA, 16 nt, Staphylococcus aureus subsp. aureus Mu50
caguuaaaucuuuaac

SEQ ID NO: 2045918 - RNA, 18 nt, Staphylococcus aureus subsp. aureus Mu50
cauacguuccuaaagucg

SEQ ID NO: 2045919 - RNA, 13 nt, Staphylococcus aureus subsp. aureus Mu50
cauacuaaauaag

SEQ ID NO: 2045920 - RNA, 13 nt, Staphylococcus aureus subsp. aureus Mu50
cauacguaucaaa

SEQ ID NO: 2045921 - RNA, 15 nt, Staphylococcus aureus subsp. aureus Mu50
cauacuucguuguca

SEQ ID NO: 2045922 - RNA, 20 nt, Staphylococcus aureus subsp. aureus Mu50
cauacuucguugucacuauu

SEQ ID NO: 2045923 - RNA, 22 nt, Staphylococcus aureus subsp. aureus Mu50
cauacuugucguauucuucaau

SEQ ID NO: 2045924 - RNA, 19 nt, Staphylococcus aureus subsp. aureus Mu50
cauaccuauaaacauaucu

SEQ ID NO: 2045925 - RNA, 22 nt, Staphylococcus aureus subsp. aureus Mu50
cauacgcaaugauuauaaauac

SEQ ID NO: 2045926 - RNA, 14 nt, Staphylococcus aureus subsp. aureus Mu50
cauaauuuaucaau

SEQ ID NO: 2045927 - RNA, 18 nt, Staphylococcus aureus subsp. aureus Mu50
cauacaccuucagaugcu

SEQ ID NO: 2045928 - RNA, 23 nt, Staphylococcus aureus subsp. aureus Mu50
cauacacugcacaucauaauaaa

SEQ ID NO: 2045929 - RNA, 18 nt, Staphylococcus aureus subsp. aureus Mu50
cauacacuugauuaucau

SEQ ID NO: 2045930 - RNA, 19 nt, Staphylococcus aureus subsp. aureus Mu50
cauacacuugauuaucauu

SEQ ID NO: 2045931 - RNA, 18 nt, Staphylococcus aureus subsp. aureus Mu50
caucagauuauugguuga

SEQ ID NO: 2045932 - RNA, 22 nt, Staphylococcus aureus subsp. aureus Mu50
caucagauuauugguugaaauu

SEQ ID NO: 2045933 - RNA, 18 nt, Staphylococcus aureus subsp. aureus Mu50
caucacuaaaguaaauaa

SEQ ID NO: 2045934 - RNA, 18 nt, Staphylococcus aureus subsp. aureus Mu50
caucacgugauaaugacu

SEQ ID NO: 2045935 - RNA, 11 nt, Staphylococcus aureus subsp. aureus Mu50
caucacuugcu

SEQ ID NO: 2045936 - RNA, 22 nt, Staphylococcus aureus subsp. aureus Mu50
caucacuugcuguugcaauaaa

SEQ ID NO: 2045937 - RNA, 16 nt, Staphylococcus aureus subsp. aureus Mu50
cauagccuauuuaaaa

SEQ ID NO: 2045938 - RNA, 21 nt, Staphylococcus aureus subsp. aureus Mu50
cauaugcuuguugugaauaaa

SEQ ID NO: 2045939 - RNA, 15 nt, Staphylococcus aureus subsp. aureus Mu50
cauauguaauacaaa

SEQ ID NO: 2045940 - RNA, 15 nt, Staphylococcus aureus subsp. aureus Mu50
cauauucacgauaua

SEQ ID NO: 2045941 - RNA, 17 nt, Staphylococcus aureus subsp. aureus Mu50
cauauguuguuucuaau

SEQ ID NO: 2045942 - RNA, 17 nt, Staphylococcus aureus subsp. aureus Mu50
cauauguacuauuaucu

SEQ ID NO: 2045943 - RNA, 14 nt, Staphylococcus aureus subsp. aureus Mu50
cauagaccuaugaa

SEQ ID NO: 2045944 - RNA, 18 nt, Staphylococcus aureus subsp. aureus Mu50
cauagauaauugcuauaa

SEQ ID NO: 2045945 - RNA, 15 nt, Staphylococcus aureus subsp. aureus Mu50
cauauuuuaacuaug

SEQ ID NO: 2045946 - RNA, 16 nt, Staphylococcus aureus subsp. aureus Mu50
cauauucauauuacuu

SEQ ID NO: 2045947 - RNA, 20 nt, Staphylococcus aureus subsp. aureus Mu50
cauauuuaucucuuucuuca

SEQ ID NO: 2045948 - RNA, 17 nt, Staphylococcus aureus subsp. aureus Mu50
cauauucuauuguuguu

SEQ ID NO: 2045949 - RNA, 18 nt, Staphylococcus aureus subsp. aureus Mu50
caucaauuucuguaauaa

SEQ ID NO: 2045950 - RNA, 15 nt, Staphylococcus aureus subsp. aureus Mu50
caucacauaacuaug

SEQ ID NO: 2045951 - RNA, 22 nt, Staphylococcus aureus subsp. aureus Mu50
caucaauaucuucuucuaacca

SEQ ID NO: 2045952 - RNA, 17 nt, Staphylococcus aureus subsp. aureus Mu50
caucaaucguaacuaac

SEQ ID NO: 2045953 - RNA, 21 nt, Staphylococcus aureus subsp. aureus Mu50
caucaaucguaacuaacaugu

SEQ ID NO: 2045954 - RNA, 16 nt, Staphylococcus aureus subsp. aureus Mu50
caucccaacuuaauaa

SEQ ID NO: 2045955 - RNA, 12 nt, Staphylococcus aureus subsp. aureus Mu50
cauccauaaaaa

SEQ ID NO: 2045956 - RNA, 15 nt, Staphylococcus aureus subsp. aureus Mu50
cauccucauuaauaa

SEQ ID NO: 2045957 - RNA, 18 nt, Staphylococcus aureus subsp. aureus Mu50
cauccucauuaauaaauu

SEQ ID NO: 2045958 - RNA, 17 nt, Staphylococcus aureus subsp. aureus Mu50
aaagauuuacccauuac

SEQ ID NO: 2045959 - RNA, 22 nt, Staphylococcus aureus subsp. aureus Mu50
caggaucacguuuuucuuuaaa

SEQ ID NO: 2045960 - RNA, 14 nt, Staphylococcus aureus subsp. aureus Mu50
caguaggaauuguu

SEQ ID NO: 2045961 - RNA, 20 nt, Staphylococcus aureus subsp. aureus Mu50
caguaucuaaauauuaaauu

SEQ ID NO: 2045962 - RNA, 18 nt, Staphylococcus aureus subsp. aureus Mu50
caguaucauguucuuaua

SEQ ID NO: 2045963 - RNA, 20 nt, Staphylococcus aureus subsp. aureus Mu50
caguaguugacugaacgaaa

SEQ ID NO: 2045964 - RNA, 17 nt, Staphylococcus aureus subsp. aureus Mu50
caguaguuaauugaaug

SEQ ID NO: 2045965 - RNA, 19 nt, Staphylococcus aureus subsp. aureus Mu50
caguaguuaauugaaugaa

SEQ ID NO: 2045966 - RNA, 22 nt, Staphylococcus aureus subsp. aureus Mu50
caguacgauuauuuggauaauu

SEQ ID NO: 2045967 - RNA, 13 nt, Staphylococcus aureus subsp. aureus Mu50
cagguuuaauaaa

SEQ ID NO: 2045968 - RNA, 15 nt, Staphylococcus aureus subsp. aureus Mu50
caggugcuuacuuuu

SEQ ID NO: 2045969 - RNA, 17 nt, Staphylococcus aureus subsp. aureus Mu50
cagugcuauguauuuuu

SEQ ID NO: 2045970 - RNA, 17 nt, Staphylococcus aureus subsp. aureus Mu50
caguauguggauacaaa

SEQ ID NO: 2045971 - RNA, 22 nt, Staphylococcus aureus subsp. aureus Mu50
cagucaacugcugcuaaaauaa

SEQ ID NO: 2045972 - RNA, 15 nt, Staphylococcus aureus subsp. aureus Mu50
cccugcuuaucauua

SEQ ID NO: 2045973 - RNA, 16 nt, Staphylococcus aureus subsp. aureus Mu50
cccuugugauucaaau

SEQ ID NO: 2045974 - RNA, 13 nt, Staphylococcus aureus subsp. aureus Mu50
aaaucuccucaaa

SEQ ID NO: 2045975 - RNA, 20 nt, Staphylococcus aureus subsp. aureus Mu50
aaaucugcuugugugucauu

SEQ ID NO: 2045976 - RNA, 12 nt, Staphylococcus aureus subsp. aureus Mu50
aaaucugcuuua

SEQ ID NO: 2045977 - RNA, 17 nt, Staphylococcus aureus subsp. aureus Mu50
aaaucuucaagugccau

SEQ ID NO: 2045978 - RNA, 17 nt, Staphylococcus aureus subsp. aureus Mu50
aaaucuucuauuuucau

SEQ ID NO: 2045979 - RNA, 16 nt, Staphylococcus aureus subsp. aureus Mu50
aaaucuucuccaauca

SEQ ID NO: 2045980 - RNA, 14 nt, Staphylococcus aureus subsp. aureus Mu50
aaaucguuauaagu

SEQ ID NO: 2045981 - RNA, 12 nt, Staphylococcus aureus subsp. aureus Mu50
aaaucuacaaua

SEQ ID NO: 2045982 - RNA, 19 nt, Staphylococcus aureus subsp. aureus Mu50
aaaucuauaacgauaguuu

SEQ ID NO: 2045983 - RNA, 15 nt, Staphylococcus aureus subsp. aureus Mu50
aaaucuauauaaagu

SEQ ID NO: 2045984 - RNA, 22 nt, Staphylococcus aureus subsp. aureus Mu50
aaaucuaucuacucaaauauaa

SEQ ID NO: 2045985 - RNA, 23 nt, Staphylococcus aureus subsp. aureus Mu50
aaaugaauguuaagacauaugca

SEQ ID NO: 2045986 - RNA, 15 nt, Staphylococcus aureus subsp. aureus Mu50
aaaucuuuaucaguu

SEQ ID NO: 2045987 - RNA, 13 nt, Staphylococcus aureus subsp. aureus Mu50
aaaucuuuaaaug

SEQ ID NO: 2045988 - RNA, 21 nt, Staphylococcus aureus subsp. aureus Mu50
aaaucuuuuacuaaaugaauu

SEQ ID NO: 2045989 - RNA, 16 nt, Staphylococcus aureus subsp. aureus Mu50
aaaucuuuuagcuuuu

SEQ ID NO: 2045990 - RNA, 17 nt, Staphylococcus aureus subsp. aureus Mu50
cccguuuuuugguucua

SEQ ID NO: 2045991 - RNA, 20 nt, Staphylococcus aureus subsp. aureus Mu50
ccgaauucuccguuaauuua

SEQ ID NO: 2045992 - RNA, 14 nt, Staphylococcus aureus subsp. aureus Mu50
ccgacuuguugaua

SEQ ID NO: 2045993 - RNA, 20 nt, Staphylococcus aureus subsp. aureus Mu50
ccauuuuauuuuaacuuaau

SEQ ID NO: 2045994 - RNA, 19 nt, Staphylococcus aureus subsp. aureus Mu50
ccauuuacuucauaaguca

SEQ ID NO: 2045995 - RNA, 14 nt, Staphylococcus aureus subsp. aureus Mu50
ccauugcacuaugc

SEQ ID NO: 2045996 - RNA, 18 nt, Staphylococcus aureus subsp. aureus Mu50
ccauugaucuuuuauaau

SEQ ID NO: 2045997 - RNA, 14 nt, Staphylococcus aureus subsp. aureus Mu50
ccauugauguaugu

SEQ ID NO: 2045998 - RNA, 17 nt, Staphylococcus aureus subsp. aureus Mu50
ccauucuuuuucucaau

SEQ ID NO: 2045999 - RNA, 16 nt, Staphylococcus aureus subsp. aureus Mu50
aaaucggaauaaaaua

SEQ ID NO: 2046000 - RNA, 16 nt, Staphylococcus aureus subsp. aureus Mu50
aaaucggcuauacauu

SEQ ID NO: 2046001 - RNA, 19 nt, Staphylococcus aureus subsp. aureus Mu50
aaaucgcagcaaugacacu

SEQ ID NO: 2046002 - RNA, 11 nt, Staphylococcus aureus subsp. aureus Mu50
aaaucgauaaa

SEQ ID NO: 2046003 - RNA, 15 nt, Staphylococcus aureus subsp. aureus Mu50
aaaucgauacuaaua

SEQ ID NO: 2046004 - RNA, 22 nt, Staphylococcus aureus subsp. aureus Mu50
aaaucgauacuaauaucuucuu

SEQ ID NO: 2046005 - RNA, 16 nt, Staphylococcus aureus subsp. aureus Mu50
ccauucaauguuuaau

SEQ ID NO: 2046006 - RNA, 12 nt, Staphylococcus aureus subsp. aureus Mu50
aaauccuuuaua

SEQ ID NO: 2046007 - RNA, 15 nt, Staphylococcus aureus subsp. aureus Mu50
aaauccuuaaaugga

SEQ ID NO: 2046008 - RNA, 15 nt, Staphylococcus aureus subsp. aureus Mu50
aaauccucaguuaua

SEQ ID NO: 2046009 - RNA, 15 nt, Staphylococcus aureus subsp. aureus Mu50
ccagcuuacugcuuu

SEQ ID NO: 2046010 - RNA, 18 nt, Staphylococcus aureus subsp. aureus Mu50
aaaucccaaguuacaaua

SEQ ID NO: 2046011 - RNA, 16 nt, Staphylococcus aureus subsp. aureus Mu50
aaaucauucauuugca

SEQ ID NO: 2046012 - RNA, 20 nt, Staphylococcus aureus subsp. aureus Mu50
aaauccaagcgcuucaggca

SEQ ID NO: 2046013 - RNA, 17 nt, Staphylococcus aureus subsp. aureus Mu50
aaaucauuuaaauuagu

SEQ ID NO: 2046014 - RNA, 20 nt, Staphylococcus aureus subsp. aureus Mu50
aaaucauuuaaauuaguuau

SEQ ID NO: 2046015 - RNA, 22 nt, Staphylococcus aureus subsp. aureus Mu50
aaaucacuugguaaaacaucgu

SEQ ID NO: 2046016 - RNA, 13 nt, Staphylococcus aureus subsp. aureus Mu50
aaaucaucauaac

SEQ ID NO: 2046017 - RNA, 16 nt, Staphylococcus aureus subsp. aureus Mu50
aaaucaugacauaaaa

SEQ ID NO: 2046018 - RNA, 12 nt, Staphylococcus aureus subsp. aureus Mu50
aaaguuuaaagu

SEQ ID NO: 2046019 - RNA, 16 nt, Staphylococcus aureus subsp. aureus Mu50
aaaguuuauacuuaau

SEQ ID NO: 2046020 - RNA, 21 nt, Staphylococcus aureus subsp. aureus Mu50
aaaguucguaauugucuuuau

SEQ ID NO: 2046021 - RNA, 16 nt, Staphylococcus aureus subsp. aureus Mu50
aaaguugauuaaaagu

SEQ ID NO: 2046022 - RNA, 14 nt, Staphylococcus aureus subsp. aureus Mu50
aaaguuauauaaau

SEQ ID NO: 2046023 - RNA, 14 nt, Staphylococcus aureus subsp. aureus Mu50
ccacggcauuuaag

SEQ ID NO: 2046024 - RNA, 14 nt, Staphylococcus aureus subsp. aureus Mu50
aaagugauaauuaa

SEQ ID NO: 2046025 - RNA, 15 nt, Staphylococcus aureus subsp. aureus Mu50
aaaguaaauuacagu

SEQ ID NO: 2046026 - RNA, 20 nt, Staphylococcus aureus subsp. aureus Mu50
ccaccuuguuuaaguuuuuc

SEQ ID NO: 2046027 - RNA, 15 nt, Staphylococcus aureus subsp. aureus Mu50
aaaggucccauuaaa

SEQ ID NO: 2046028 - RNA, 21 nt, Staphylococcus aureus subsp. aureus Mu50
aaaggucuauguacaauaauu

SEQ ID NO: 2046029 - RNA, 16 nt, Staphylococcus aureus subsp. aureus Mu50
aaaggucaaaaaauua

SEQ ID NO: 2046030 - RNA, 15 nt, Staphylococcus aureus subsp. aureus Mu50
aaagggaauggauua

SEQ ID NO: 2046031 - RNA, 15 nt, Staphylococcus aureus subsp. aureus Mu50
aaaggugugggcuuu

SEQ ID NO: 2046032 - RNA, 17 nt, Staphylococcus aureus subsp. aureus Mu50
ccacuggccuuuaauga

SEQ ID NO: 2046033 - RNA, 23 nt, Staphylococcus aureus subsp. aureus Mu50
aaauaacguuaauauaauuaauu

SEQ ID NO: 2046034 - RNA, 17 nt, Staphylococcus aureus subsp. aureus Mu50
aaauaacuucguuuuaa

SEQ ID NO: 2046035 - RNA, 17 nt, Staphylococcus aureus subsp. aureus Mu50
aaauaagauauauaaua

SEQ ID NO: 2046036 - RNA, 13 nt, Staphylococcus aureus subsp. aureus Mu50
aaauaagaugaaa

SEQ ID NO: 2046037 - RNA, 20 nt, Staphylococcus aureus subsp. aureus Mu50
aaauaagaugaaauauucuu

SEQ ID NO: 2046038 - RNA, 18 nt, Staphylococcus aureus subsp. aureus Mu50
aaauaagcaucacauaug

SEQ ID NO: 2046039 - RNA, 16 nt, Staphylococcus aureus subsp. aureus Mu50
aaaggaaaucaaucca

SEQ ID NO: 2046040 - RNA, 20 nt, Staphylococcus aureus subsp. aureus Mu50
aaagcuguaguuucaacuuu

SEQ ID NO: 2046041 - RNA, 20 nt, Staphylococcus aureus subsp. aureus Mu50
ccaaagaaagcuaauaucaa

SEQ ID NO: 2046042 - RNA, 17 nt, Staphylococcus aureus subsp. aureus Mu50
ccaaaucggaauaaaau

SEQ ID NO: 2046043 - RNA, 20 nt, Staphylococcus aureus subsp. aureus Mu50
ccaaauccaucuaauucaau

SEQ ID NO: 2046044 - RNA, 20 nt, Staphylococcus aureus subsp. aureus Mu50
ccaaauauauuuuuauuaau

SEQ ID NO: 2046045 - RNA, 12 nt, Staphylococcus aureus subsp. aureus Mu50
ccaaauaucagu

SEQ ID NO: 2046046 - RNA, 22 nt, Staphylococcus aureus subsp. aureus Mu50
ccaacuugcauugucuguagaa

SEQ ID NO: 2046047 - RNA, 13 nt, Staphylococcus aureus subsp. aureus Mu50
ccaacuuaauaac

SEQ ID NO: 2046048 - RNA, 17 nt, Staphylococcus aureus subsp. aureus Mu50
ccaaucauucguuuaau

SEQ ID NO: 2046049 - RNA, 13 nt, Staphylococcus aureus subsp. aureus Mu50
cgauucaaucuaa

SEQ ID NO: 2046050 - RNA, 14 nt, Staphylococcus aureus subsp. aureus Mu50
cgauucaaucuaau

SEQ ID NO: 2046051 - RNA, 14 nt, Staphylococcus aureus subsp. aureus Mu50
cgauuaaaugaugc

SEQ ID NO: 2046052 - RNA, 19 nt, Staphylococcus aureus subsp. aureus Mu50
cgauuaauaguacagucau

SEQ ID NO: 2046053 - RNA, 22 nt, Staphylococcus aureus subsp. aureus Mu50
cgauuaaaugaugcaguaaaac

SEQ ID NO: 2046054 - RNA, 14 nt, Staphylococcus aureus subsp. aureus Mu50
cgauuaauugaaug

SEQ ID NO: 2046055 - RNA, 14 nt, Staphylococcus aureus subsp. aureus Mu50
cgauuaauuuucuu

SEQ ID NO: 2046056 - RNA, 21 nt, Staphylococcus aureus subsp. aureus Mu50
cgauuaauuuucuuuuuuaau

SEQ ID NO: 2046057 - RNA, 15 nt, Staphylococcus aureus subsp. aureus Mu50
cgauucucauuuacu

SEQ ID NO: 2046058 - RNA, 22 nt, Staphylococcus aureus subsp. aureus Mu50
cgcaacaggaccacucaauucu

SEQ ID NO: 2046059 - RNA, 18 nt, Staphylococcus aureus subsp. aureus Mu50
cgccaauuaaaauuuguu

SEQ ID NO: 2046060 - RNA, 23 nt, Staphylococcus aureus subsp. aureus Mu50
cgccaugacguauacaaauugau

SEQ ID NO: 2046061 - RNA, 17 nt, Staphylococcus aureus subsp. aureus Mu50
cgaauccuaaaaagcuc

SEQ ID NO: 2046062 - RNA, 19 nt, Staphylococcus aureus subsp. aureus Mu50
cgacaaucacagcaauaau

SEQ ID NO: 2046063 - RNA, 15 nt, Staphylococcus aureus subsp. aureus Mu50
aacaacuaagauaua

SEQ ID NO: 2046064 - RNA, 13 nt, Staphylococcus aureus subsp. aureus Mu50
aacaaaucuauaa

SEQ ID NO: 2046065 - RNA, 15 nt, Staphylococcus aureus subsp. aureus Mu50
aacaaauucauauua

SEQ ID NO: 2046066 - RNA, 20 nt, Staphylococcus aureus subsp. aureus Mu50
aacaaauucauauuaacugu

SEQ ID NO: 2046067 - RNA, 21 nt, Staphylococcus aureus subsp. aureus Mu50
aacaagcauuuuucaauuaua

SEQ ID NO: 2046068 - RNA, 16 nt, Staphylococcus aureus subsp. aureus Mu50
cgauaucuaagucgau

SEQ ID NO: 2046069 - RNA, 21 nt, Staphylococcus aureus subsp. aureus Mu50
cgauaucuuuuaauucuuaau

SEQ ID NO: 2046070 - RNA, 16 nt, Staphylococcus aureus subsp. aureus Mu50
cgauauagugcuuguu

SEQ ID NO: 2046071 - RNA, 19 nt, Staphylococcus aureus subsp. aureus Mu50
cgauauagaccguugaaau

SEQ ID NO: 2046072 - RNA, 23 nt, Staphylococcus aureus subsp. aureus Mu50
cgauaaauaacuuuaccaccauu

SEQ ID NO: 2046073 - RNA, 16 nt, Staphylococcus aureus subsp. aureus Mu50
cgauaccuuuaauaau

SEQ ID NO: 2046074 - RNA, 15 nt, Staphylococcus aureus subsp. aureus Mu50
cgauaccuuuaauau

SEQ ID NO: 2046075 - RNA, 22 nt, Staphylococcus aureus subsp. aureus Mu50
cgauaaaaguuguauucugaaa

SEQ ID NO: 2046076 - RNA, 12 nt, Staphylococcus aureus subsp. aureus Mu50
cgauaaaauguu

SEQ ID NO: 2046077 - RNA, 22 nt, Staphylococcus aureus subsp. aureus Mu50
cgagcuggugagaaauugaauu

SEQ ID NO: 2046078 - RNA, 20 nt, Staphylococcus aureus subsp. aureus Mu50
cgagcguugguaacguuaau

SEQ ID NO: 2046079 - RNA, 19 nt, Staphylococcus aureus subsp. aureus Mu50
aacaagguacacuagucuu

SEQ ID NO: 2046080 - RNA, 16 nt, Staphylococcus aureus subsp. aureus Mu50
aacacaguacaaauaa

SEQ ID NO: 2046081 - RNA, 23 nt, Staphylococcus aureus subsp. aureus Mu50
aacacaguacaaauaacaaacau

SEQ ID NO: 2046082 - RNA, 16 nt, Staphylococcus aureus subsp. aureus Mu50
aacacauaaauuaagc

SEQ ID NO: 2046083 - RNA, 12 nt, Staphylococcus aureus subsp. aureus Mu50
aacacaugcacu

SEQ ID NO: 2046084 - RNA, 20 nt, Staphylococcus aureus subsp. aureus Mu50
aacaccaauugaaauuaacu

SEQ ID NO: 2046085 - RNA, 15 nt, Staphylococcus aureus subsp. aureus Mu50
aacaccacacagcau

SEQ ID NO: 2046086 - RNA, 20 nt, Staphylococcus aureus subsp. aureus Mu50
cgagccauuauuauuuuuuu

SEQ ID NO: 2046087 - RNA, 14 nt, Staphylococcus aureus subsp. aureus Mu50
aaauuguguuucuu

SEQ ID NO: 2046088 - RNA, 23 nt, Staphylococcus aureus subsp. aureus Mu50
aaauuguuccuucgauaguuuau

SEQ ID NO: 2046089 - RNA, 12 nt, Staphylococcus aureus subsp. aureus Mu50
aaauuuaaaaua

SEQ ID NO: 2046090 - RNA, 16 nt, Staphylococcus aureus subsp. aureus Mu50
aaauuuguaccaaaua

SEQ ID NO: 2046091 - RNA, 13 nt, Staphylococcus aureus subsp. aureus Mu50
aaauuuacaaaug

SEQ ID NO: 2046092 - RNA, 13 nt, Staphylococcus aureus subsp. aureus Mu50
aaauuuaccaguu

SEQ ID NO: 2046093 - RNA, 20 nt, Staphylococcus aureus subsp. aureus Mu50
aaauuuccaaaguaauauga

SEQ ID NO: 2046094 - RNA, 20 nt, Staphylococcus aureus subsp. aureus Mu50
aaauuuauuauaaaauagaa

SEQ ID NO: 2046095 - RNA, 21 nt, Staphylococcus aureus subsp. aureus Mu50
aaauuuauucaaaucauaagu

SEQ ID NO: 2046096 - RNA, 22 nt, Staphylococcus aureus subsp. aureus Mu50
aaauuucauaaaguuuauuuau

SEQ ID NO: 2046097 - RNA, 15 nt, Staphylococcus aureus subsp. aureus Mu50
aaauuugguacauaa

SEQ ID NO: 2046098 - RNA, 21 nt, Staphylococcus aureus subsp. aureus Mu50
aaauuugguacauaauagacu

SEQ ID NO: 2046099 - RNA, 18 nt, Staphylococcus aureus subsp. aureus Mu50
aaauuucgauuaauugaa

SEQ ID NO: 2046100 - RNA, 23 nt, Staphylococcus aureus subsp. aureus Mu50
aaauuucgccucaucuaauuuau

SEQ ID NO: 2046101 - RNA, 13 nt, Staphylococcus aureus subsp. aureus Mu50
aaauuuaaaauaa

SEQ ID NO: 2046102 - RNA, 16 nt, Staphylococcus aureus subsp. aureus Mu50
ccgucaaacuuaaaac

SEQ ID NO: 2046103 - RNA, 18 nt, Staphylococcus aureus subsp. aureus Mu50
ccguauuuuaauauugaa

SEQ ID NO: 2046104 - RNA, 16 nt, Staphylococcus aureus subsp. aureus Mu50
ccucauuuuuauaaau

SEQ ID NO: 2046105 - RNA, 21 nt, Staphylococcus aureus subsp. aureus Mu50
ccucuguuuuguugguguuua

SEQ ID NO: 2046106 - RNA, 23 nt, Staphylococcus aureus subsp. aureus Mu50
ccucuaaugauuaaaaaucaaag

SEQ ID NO: 2046107 - RNA, 17 nt, Staphylococcus aureus subsp. aureus Mu50
ccucuuuuguuuaguau

SEQ ID NO: 2046108 - RNA, 10 nt, Staphylococcus aureus subsp. aureus Mu50
ccucuuuaaa

SEQ ID NO: 2046109 - RNA, 19 nt, Staphylococcus aureus subsp. aureus Mu50
ccugaagcgcuuggauuuu

SEQ ID NO: 2046110 - RNA, 21 nt, Staphylococcus aureus subsp. aureus Mu50
ccugauacaaugauuacuuua

SEQ ID NO: 2046111 - RNA, 19 nt, Staphylococcus aureus subsp. aureus Mu50
ccuggaaucgaaaauauca

SEQ ID NO: 2046112 - RNA, 22 nt, Staphylococcus aureus subsp. aureus Mu50
aaaugccgcuucuaauuuuuca

SEQ ID NO: 2046113 - RNA, 13 nt, Staphylococcus aureus subsp. aureus Mu50
aaaugauuaaagu

SEQ ID NO: 2046114 - RNA, 18 nt, Staphylococcus aureus subsp. aureus Mu50
aaaugcauuacuacuuua

SEQ ID NO: 2046115 - RNA, 19 nt, Staphylococcus aureus subsp. aureus Mu50
ccgccuugauuuuuugaaa

SEQ ID NO: 2046116 - RNA, 13 nt, Staphylococcus aureus subsp. aureus Mu50
aaaugcuaaaagu

SEQ ID NO: 2046117 - RNA, 13 nt, Staphylococcus aureus subsp. aureus Mu50
aacaguuaauaug

SEQ ID NO: 2046118 - RNA, 15 nt, Staphylococcus aureus subsp. aureus Mu50
aacaguuaauaugaa

SEQ ID NO: 2046119 - RNA, 21 nt, Staphylococcus aureus subsp. aureus Mu50
aacauauuuucacaaucauag

SEQ ID NO: 2046120 - RNA, 14 nt, Staphylococcus aureus subsp. aureus Mu50
aacauauaaaucau

SEQ ID NO: 2046121 - RNA, 15 nt, Staphylococcus aureus subsp. aureus Mu50
aacauauuauauaua

SEQ ID NO: 2046122 - RNA, 15 nt, Staphylococcus aureus subsp. aureus Mu50
aacauauaaaucauu

SEQ ID NO: 2046123 - RNA, 13 nt, Staphylococcus aureus subsp. aureus Mu50
aacauaaaaugag

SEQ ID NO: 2046124 - RNA, 11 nt, Staphylococcus aureus subsp. aureus Mu50
aacauaaauaa

SEQ ID NO: 2046125 - RNA, 17 nt, Staphylococcus aureus subsp. aureus Mu50
aacauagcuuaauaauu

SEQ ID NO: 2046126 - RNA, 18 nt, Staphylococcus aureus subsp. aureus Mu50
aacauacuauaaaaauuu

SEQ ID NO: 2046127 - RNA, 15 nt, Staphylococcus aureus subsp. aureus Mu50
aacauaauauuuuga

SEQ ID NO: 2046128 - RNA, 11 nt, Staphylococcus aureus subsp. aureus Mu50
aacaucuaaau

SEQ ID NO: 2046129 - RNA, 20 nt, Staphylococcus aureus subsp. aureus Mu50
aacaucuaaauaguuuuuca

SEQ ID NO: 2046130 - RNA, 17 nt, Staphylococcus aureus subsp. aureus Mu50
aacauccccaaaaauag

SEQ ID NO: 2046131 - RNA, 12 nt, Staphylococcus aureus subsp. aureus Mu50
aacaucaucguc

SEQ ID NO: 2046132 - RNA, 17 nt, Staphylococcus aureus subsp. aureus Mu50
cgguaauuacuuguaau

SEQ ID NO: 2046133 - RNA, 16 nt, Staphylococcus aureus subsp. aureus Mu50
aaccauacauaugcua

SEQ ID NO: 2046134 - RNA, 21 nt, Staphylococcus aureus subsp. aureus Mu50
aaccauacucuaacuuaccau

SEQ ID NO: 2046135 - RNA, 14 nt, Staphylococcus aureus subsp. aureus Mu50
aaccauaaugaaca

SEQ ID NO: 2046136 - RNA, 16 nt, Staphylococcus aureus subsp. aureus Mu50
aaccaucauaaauguu

SEQ ID NO: 2046137 - RNA, 13 nt, Staphylococcus aureus subsp. aureus Mu50
aacccaauuaacc

SEQ ID NO: 2046138 - RNA, 15 nt, Staphylococcus aureus subsp. aureus Mu50
aacccacauuaaaua

SEQ ID NO: 2046139 - RNA, 18 nt, Staphylococcus aureus subsp. aureus Mu50
aacccacauuaaauauua

SEQ ID NO: 2046140 - RNA, 16 nt, Staphylococcus aureus subsp. aureus Mu50
aaccauguaaaauuag

SEQ ID NO: 2046141 - RNA, 15 nt, Staphylococcus aureus subsp. aureus Mu50
aaccauuucaucaua

SEQ ID NO: 2046142 - RNA, 18 nt, Staphylococcus aureus subsp. aureus Mu50
aaccauuuuauuuuaacu

SEQ ID NO: 2046143 - RNA, 17 nt, Staphylococcus aureus subsp. aureus Mu50
aaccaauccaauauaca

SEQ ID NO: 2046144 - RNA, 16 nt, Staphylococcus aureus subsp. aureus Mu50
aaccacgcaucaugua

SEQ ID NO: 2046145 - RNA, 22 nt, Staphylococcus aureus subsp. aureus Mu50
aaccacuuuuuuguucaaucac

SEQ ID NO: 2046146 - RNA, 24 nt, Staphylococcus aureus subsp. aureus Mu50
aaccaccuacgcccaucaucacug

SEQ ID NO: 2046147 - RNA, 20 nt, Staphylococcus aureus subsp. aureus Mu50
aaccacgcaucauguauaug

SEQ ID NO: 2046148 - RNA, 19 nt, Staphylococcus aureus subsp. aureus Mu50
aaccaacuuucucaaguaa

SEQ ID NO: 2046149 - RNA, 20 nt, Staphylococcus aureus subsp. aureus Mu50
aaccaauaauccgagucaua

SEQ ID NO: 2046150 - RNA, 13 nt, Staphylococcus aureus subsp. aureus Mu50
aaccaaaauuaua

SEQ ID NO: 2046151 - RNA, 13 nt, Staphylococcus aureus subsp. aureus Mu50
aacauuucagcau

SEQ ID NO: 2046152 - RNA, 20 nt, Staphylococcus aureus subsp. aureus Mu50
aacauuuaaaaaaugcgcuu

SEQ ID NO: 2046153 - RNA, 19 nt, Staphylococcus aureus subsp. aureus Mu50
aaccagcuaaaccaucugu

SEQ ID NO: 2046154 - RNA, 19 nt, Staphylococcus aureus subsp. aureus Mu50
aaccaguucgaaaauuaua

SEQ ID NO: 2046155 - RNA, 16 nt, Staphylococcus aureus subsp. aureus Mu50
cgcuugggcugacauu

SEQ ID NO: 2046156 - RNA, 15 nt, Staphylococcus aureus subsp. aureus Mu50
cgcuuggauuuuuug

SEQ ID NO: 2046157 - RNA, 20 nt, Staphylococcus aureus subsp. aureus Mu50
cgcuuuuuaaaaaauuuaaa

SEQ ID NO: 2046158 - RNA, 16 nt, Staphylococcus aureus subsp. aureus Mu50
cggaauucaaccaauu

SEQ ID NO: 2046159 - RNA, 15 nt, Staphylococcus aureus subsp. aureus Mu50
cgcuuaaaaugauug

SEQ ID NO: 2046160 - RNA, 14 nt, Staphylococcus aureus subsp. aureus Mu50
cgcuucuaacucac

SEQ ID NO: 2046161 - RNA, 15 nt, Staphylococcus aureus subsp. aureus Mu50
cgcuuccaauuuaaa

SEQ ID NO: 2046162 - RNA, 18 nt, Staphylococcus aureus subsp. aureus Mu50
cgcuacaauuauaaauga

SEQ ID NO: 2046163 - RNA, 22 nt, Staphylococcus aureus subsp. aureus Mu50
aacagcaguaagauuauuuuca

SEQ ID NO: 2046164 - RNA, 17 nt, Staphylococcus aureus subsp. aureus Mu50
aacacgaugagcgcaua

SEQ ID NO: 2046165 - RNA, 18 nt, Staphylococcus aureus subsp. aureus Mu50
gugacucggggaauuuuu

SEQ ID NO: 2046166 - RNA, 14 nt, Staphylococcus aureus subsp. aureus Mu50
gugaaauaucaaga

SEQ ID NO: 2046167 - RNA, 23 nt, Staphylococcus aureus subsp. aureus Mu50
gugaaggagauuaagcaauguaa

SEQ ID NO: 2046168 - RNA, 20 nt, Staphylococcus aureus subsp. aureus Mu50
gucuuguaucaacauuaaua

SEQ ID NO: 2046169 - RNA, 17 nt, Staphylococcus aureus subsp. aureus Mu50
gucuuuuaauuaaaagu

SEQ ID NO: 2046170 - RNA, 13 nt, Staphylococcus aureus subsp. aureus Mu50
gucuuugaaaaac

SEQ ID NO: 2046171 - RNA, 18 nt, Staphylococcus aureus subsp. aureus Mu50
gucuaugucaaauugaac

SEQ ID NO: 2046172 - RNA, 14 nt, Staphylococcus aureus subsp. aureus Mu50
gucucguugcacaa

SEQ ID NO: 2046173 - RNA, 13 nt, Staphylococcus aureus subsp. aureus Mu50
gucccguaggagu

SEQ ID NO: 2046174 - RNA, 20 nt, Staphylococcus aureus subsp. aureus Mu50
guaucgaauuaagaaaaguu

SEQ ID NO: 2046175 - RNA, 15 nt, Staphylococcus aureus subsp. aureus Mu50
gucauaaaauaccag

SEQ ID NO: 2046176 - RNA, 15 nt, Staphylococcus aureus subsp. aureus Mu50
gucauuugaauccaa

SEQ ID NO: 2046177 - RNA, 14 nt, Staphylococcus aureus subsp. aureus Mu50
gucauucacauaca

SEQ ID NO: 2046178 - RNA, 17 nt, Staphylococcus aureus subsp. aureus Mu50
gucaugucuagauuuua

SEQ ID NO: 2046179 - RNA, 19 nt, Staphylococcus aureus subsp. aureus Mu50
gucauuaugugacauacca

SEQ ID NO: 2046180 - RNA, 20 nt, Staphylococcus aureus subsp. aureus Mu50
gguacagauaagaauauuua

SEQ ID NO: 2046181 - RNA, 13 nt, Staphylococcus aureus subsp. aureus Mu50
gguacauaauaga

SEQ ID NO: 2046182 - RNA, 22 nt, Staphylococcus aureus subsp. aureus Mu50
ggguaaggugauugaacaauaa

SEQ ID NO: 2046183 - RNA, 19 nt, Staphylococcus aureus subsp. aureus Mu50
ggggugggacgacgaaaua

SEQ ID NO: 2046184 - RNA, 19 nt, Staphylococcus aureus subsp. aureus Mu50
ggucguacuuucaaauaau

SEQ ID NO: 2046185 - RNA, 18 nt, Staphylococcus aureus subsp. aureus Mu50
guacuaagcuuucauuaa

SEQ ID NO: 2046186 - RNA, 14 nt, Staphylococcus aureus subsp. aureus Mu50
guacguuugcauau

SEQ ID NO: 2046187 - RNA, 20 nt, Staphylococcus aureus subsp. aureus Mu50
guaaacaugguuuucuuuuu

SEQ ID NO: 2046188 - RNA, 23 nt, Staphylococcus aureus subsp. aureus Mu50
guaaaccgaggugucaauaaauu

SEQ ID NO: 2046189 - RNA, 22 nt, Staphylococcus aureus subsp. aureus Mu50
guaaaauuuucguguuaauaac

SEQ ID NO: 2046190 - RNA, 17 nt, Staphylococcus aureus subsp. aureus Mu50
guaaauuuaucauuuua

SEQ ID NO: 2046191 - RNA, 13 nt, Staphylococcus aureus subsp. aureus Mu50
guaaugaugugaa

SEQ ID NO: 2046192 - RNA, 17 nt, Staphylococcus aureus subsp. aureus Mu50
guaauguuccauauaac

SEQ ID NO: 2046193 - RNA, 17 nt, Staphylococcus aureus subsp. aureus Mu50
guaaugucauaucuuua

SEQ ID NO: 2046194 - RNA, 22 nt, Staphylococcus aureus subsp. aureus Mu50
guaauucuucaucuucuucaaa

SEQ ID NO: 2046195 - RNA, 22 nt, Staphylococcus aureus subsp. aureus Mu50
guacagauaggaaacuuaaaua

SEQ ID NO: 2046196 - RNA, 15 nt, Staphylococcus aureus subsp. aureus Mu50
guaacuaaaaugucu

SEQ ID NO: 2046197 - RNA, 23 nt, Staphylococcus aureus subsp. aureus Mu50
guaacuaacauguuauugcuuau

SEQ ID NO: 2046198 - RNA, 19 nt, Staphylococcus aureus subsp. aureus Mu50
aagucuuaacaaauuaaaa

SEQ ID NO: 2046199 - RNA, 20 nt, Staphylococcus aureus subsp. aureus Mu50
aagucguuguugaaauuaaa

SEQ ID NO: 2046200 - RNA, 18 nt, Staphylococcus aureus subsp. aureus Mu50
aagucucuugucauuuca

SEQ ID NO: 2046201 - RNA, 18 nt, Staphylococcus aureus subsp. aureus Mu50
aagucugcugguaacucu

SEQ ID NO: 2046202 - RNA, 20 nt, Staphylococcus aureus subsp. aureus Mu50
guauaauuaaacuaauagca

SEQ ID NO: 2046203 - RNA, 12 nt, Staphylococcus aureus subsp. aureus Mu50
guauaaauaaaa

SEQ ID NO: 2046204 - RNA, 20 nt, Staphylococcus aureus subsp. aureus Mu50
guauaaccauguauaucuaa

SEQ ID NO: 2046205 - RNA, 23 nt, Staphylococcus aureus subsp. aureus Mu50
guagggaguauuguuuuauauuu

SEQ ID NO: 2046206 - RNA, 13 nt, Staphylococcus aureus subsp. aureus Mu50
guagguaagaaaa

SEQ ID NO: 2046207 - RNA, 20 nt, Staphylococcus aureus subsp. aureus Mu50
guacuuucauuguuaaacau

SEQ ID NO: 2046208 - RNA, 19 nt, Staphylococcus aureus subsp. aureus Mu50
guacuuuuuugagcauuuu

SEQ ID NO: 2046209 - RNA, 15 nt, Staphylococcus aureus subsp. aureus Mu50
ggugugaauugauuu

SEQ ID NO: 2046210 - RNA, 20 nt, Staphylococcus aureus subsp. aureus Mu50
ggugggacgacgaaauaaau

SEQ ID NO: 2046211 - RNA, 22 nt, Staphylococcus aureus subsp. aureus Mu50
gguuuaaugagcuuuucuaaug

SEQ ID NO: 2046212 - RNA, 14 nt, Staphylococcus aureus subsp. aureus Mu50
gguucuauaauuca

SEQ ID NO: 2046213 - RNA, 14 nt, Staphylococcus aureus subsp. aureus Mu50
gguguuuagucuuu

SEQ ID NO: 2046214 - RNA, 18 nt, Staphylococcus aureus subsp. aureus Mu50
gguuaucacuuauuauuu

SEQ ID NO: 2046215 - RNA, 18 nt, Staphylococcus aureus subsp. aureus Mu50
gguuauuauaaaauaaau

SEQ ID NO: 2046216 - RNA, 18 nt, Staphylococcus aureus subsp. aureus Mu50
ggcuauacauugauaaau

SEQ ID NO: 2046217 - RNA, 20 nt, Staphylococcus aureus subsp. aureus Mu50
ggauguucaucaacaugaua

SEQ ID NO: 2046218 - RNA, 23 nt, Staphylococcus aureus subsp. aureus Mu50
ggaugggccccaacacagagaau

SEQ ID NO: 2046219 - RNA, 16 nt, Staphylococcus aureus subsp. aureus Mu50
ggaugugacaaauacu

SEQ ID NO: 2046220 - RNA, 18 nt, Staphylococcus aureus subsp. aureus Mu50
ggaugcacuccuauuguu

SEQ ID NO: 2046221 - RNA, 13 nt, Staphylococcus aureus subsp. aureus Mu50
ggaucggcauugu

SEQ ID NO: 2046222 - RNA, 16 nt, Staphylococcus aureus subsp. aureus Mu50
ggauuuuagauuuagu

SEQ ID NO: 2046223 - RNA, 23 nt, Staphylococcus aureus subsp. aureus Mu50
ggcaagauuggcugugcuauaau

SEQ ID NO: 2046224 - RNA, 18 nt, Staphylococcus aureus subsp. aureus Mu50
ggcaauuaaaacuauaau

SEQ ID NO: 2046225 - RNA, 13 nt, Staphylococcus aureus subsp. aureus Mu50
ggcauuguaaaau

SEQ ID NO: 2046226 - RNA, 18 nt, Staphylococcus aureus subsp. aureus Mu50
gcuuaugggggauuuuuu

SEQ ID NO: 2046227 - RNA, 15 nt, Staphylococcus aureus subsp. aureus Mu50
gcuuaaauauaauga

SEQ ID NO: 2046228 - RNA, 22 nt, Staphylococcus aureus subsp. aureus Mu50
gcuuaaucucuuuuugauuaua

SEQ ID NO: 2046229 - RNA, 13 nt, Staphylococcus aureus subsp. aureus Mu50
gcuguguaucauc

SEQ ID NO: 2046230 - RNA, 16 nt, Staphylococcus aureus subsp. aureus Mu50
gcuguguaucaucaua

SEQ ID NO: 2046231 - RNA, 22 nt, Staphylococcus aureus subsp. aureus Mu50
gcuguaccuucugauacuucau

SEQ ID NO: 2046232 - RNA, 19 nt, Staphylococcus aureus subsp. aureus Mu50
gcuguccaucgucaucacu

SEQ ID NO: 2046233 - RNA, 23 nt, Staphylococcus aureus subsp. aureus Mu50
gcuguauauauauguaaaugaaa

SEQ ID NO: 2046234 - RNA, 14 nt, Staphylococcus aureus subsp. aureus Mu50
gcuggguaauaaau

SEQ ID NO: 2046235 - RNA, 13 nt, Staphylococcus aureus subsp. aureus Mu50
gcuucgucuuuau

SEQ ID NO: 2046236 - RNA, 19 nt, Staphylococcus aureus subsp. aureus Mu50
gcuucaggcauaacuguau

SEQ ID NO: 2046237 - RNA, 22 nt, Staphylococcus aureus subsp. aureus Mu50
gcuucuaacugaauuaaagcau

SEQ ID NO: 2046238 - RNA, 21 nt, Staphylococcus aureus subsp. aureus Mu50
gcuucucacaacugcauauaa

SEQ ID NO: 2046239 - RNA, 17 nt, Staphylococcus aureus subsp. aureus Mu50
gcuucuuggcauuuuuu

SEQ ID NO: 2046240 - RNA, 16 nt, Staphylococcus aureus subsp. aureus Mu50
gcuugaauaauauauu

SEQ ID NO: 2046241 - RNA, 23 nt, Staphylococcus aureus subsp. aureus Mu50
gcuuguacgauaacuacacuuaa

SEQ ID NO: 2046242 - RNA, 17 nt, Staphylococcus aureus subsp. aureus Mu50
gcuuguaacaagcauuu

SEQ ID NO: 2046243 - RNA, 15 nt, Staphylococcus aureus subsp. aureus Mu50
gcuuuauuuuaucau

SEQ ID NO: 2046244 - RNA, 12 nt, Staphylococcus aureus subsp. aureus Mu50
gcuuuaauuuga

SEQ ID NO: 2046245 - RNA, 18 nt, Staphylococcus aureus subsp. aureus Mu50
gcuuuuaaucaaauuauc

SEQ ID NO: 2046246 - RNA, 14 nt, Staphylococcus aureus subsp. aureus Mu50
gcuuuuaugcaugc

SEQ ID NO: 2046247 - RNA, 17 nt, Staphylococcus aureus subsp. aureus Mu50
gcuuuuuuuauggugug

SEQ ID NO: 2046248 - RNA, 14 nt, Staphylococcus aureus subsp. aureus Mu50
gcugcaccaagaaa

SEQ ID NO: 2046249 - RNA, 22 nt, Staphylococcus aureus subsp. aureus Mu50
gcugcaagucucauaucuauuu

SEQ ID NO: 2046250 - RNA, 22 nt, Staphylococcus aureus subsp. aureus Mu50
gcugaguugaagaaauuugaug

SEQ ID NO: 2046251 - RNA, 22 nt, Staphylococcus aureus subsp. aureus Mu50
gcugauaauuuuucuucuuuuu

SEQ ID NO: 2046252 - RNA, 11 nt, Staphylococcus aureus subsp. aureus Mu50
gcugaauuuua

SEQ ID NO: 2046253 - RNA, 22 nt, Staphylococcus aureus subsp. aureus Mu50
gcugaaucgaguuugaaauaau

SEQ ID NO: 2046254 - RNA, 21 nt, Staphylococcus aureus subsp. aureus Mu50
gcugaaguuugaacaacaucu

SEQ ID NO: 2046255 - RNA, 12 nt, Staphylococcus aureus subsp. aureus Mu50
gcucuuuauaua

SEQ ID NO: 2046256 - RNA, 20 nt, Staphylococcus aureus subsp. aureus Mu50
gcucauuuuuuuaauuauuu

SEQ ID NO: 2046257 - RNA, 20 nt, Staphylococcus aureus subsp. aureus Mu50
gcucauuaaugguauugauu

SEQ ID NO: 2046258 - RNA, 16 nt, Staphylococcus aureus subsp. aureus Mu50
gcuccauuuaauuugu

SEQ ID NO: 2046259 - RNA, 19 nt, Staphylococcus aureus subsp. aureus Mu50
aagcguuucuugaucuaau

SEQ ID NO: 2046260 - RNA, 18 nt, Staphylococcus aureus subsp. aureus Mu50
aagcuaauaucaauaaug

SEQ ID NO: 2046261 - RNA, 21 nt, Staphylococcus aureus subsp. aureus Mu50
aagcgaauacaauaguacuaa

SEQ ID NO: 2046262 - RNA, 20 nt, Staphylococcus aureus subsp. aureus Mu50
gccuuuuuaggaugcauaua

SEQ ID NO: 2046263 - RNA, 12 nt, Staphylococcus aureus subsp. aureus Mu50
gccuuucuaaua

SEQ ID NO: 2046264 - RNA, 20 nt, Staphylococcus aureus subsp. aureus Mu50
gcgaacaugguaucuuuaau

SEQ ID NO: 2046265 - RNA, 22 nt, Staphylococcus aureus subsp. aureus Mu50
aagcccuauuguuuuuuauaag

SEQ ID NO: 2046266 - RNA, 15 nt, Staphylococcus aureus subsp. aureus Mu50
gccuauuugacacau

SEQ ID NO: 2046267 - RNA, 21 nt, Staphylococcus aureus subsp. aureus Mu50
gccuaugugaugguaaaucau

SEQ ID NO: 2046268 - RNA, 19 nt, Staphylococcus aureus subsp. aureus Mu50
gccuaauaauaaaauagcu

SEQ ID NO: 2046269 - RNA, 15 nt, Staphylococcus aureus subsp. aureus Mu50
gaaauuuauuauaau

SEQ ID NO: 2046270 - RNA, 14 nt, Staphylococcus aureus subsp. aureus Mu50
gaaauugaagcguu

SEQ ID NO: 2046271 - RNA, 16 nt, Staphylococcus aureus subsp. aureus Mu50
gaaauuauuauuuaaa

SEQ ID NO: 2046272 - RNA, 15 nt, Staphylococcus aureus subsp. aureus Mu50
gaacaaaaaauaaaa

SEQ ID NO: 2046273 - RNA, 17 nt, Staphylococcus aureus subsp. aureus Mu50
gaaauuuuuuagugaaa

SEQ ID NO: 2046274 - RNA, 20 nt, Staphylococcus aureus subsp. aureus Mu50
gaaauuuuuuagugaaaaag

SEQ ID NO: 2046275 - RNA, 15 nt, Staphylococcus aureus subsp. aureus Mu50
gaaauauaccaacca

SEQ ID NO: 2046276 - RNA, 15 nt, Staphylococcus aureus subsp. aureus Mu50
gaaauauuugaaaau

SEQ ID NO: 2046277 - RNA, 13 nt, Staphylococcus aureus subsp. aureus Mu50
gaaaucauuuggu

SEQ ID NO: 2046278 - RNA, 21 nt, Staphylococcus aureus subsp. aureus Mu50
gaaauacuugaauuuaauaag

SEQ ID NO: 2046279 - RNA, 23 nt, Staphylococcus aureus subsp. aureus Mu50
gaaauacgaugucagacgaauca

SEQ ID NO: 2046280 - RNA, 20 nt, Staphylococcus aureus subsp. aureus Mu50
gaaaguuugaaggugauaau

SEQ ID NO: 2046281 - RNA, 22 nt, Staphylococcus aureus subsp. aureus Mu50
gaaauaaaacaagacuacgaau

SEQ ID NO: 2046282 - RNA, 15 nt, Staphylococcus aureus subsp. aureus Mu50
gaaacaucuugauau

SEQ ID NO: 2046283 - RNA, 13 nt, Staphylococcus aureus subsp. aureus Mu50
gaaaaucaucauu

SEQ ID NO: 2046284 - RNA, 15 nt, Staphylococcus aureus subsp. aureus Mu50
aaccugucuuaauuc

SEQ ID NO: 2046285 - RNA, 13 nt, Staphylococcus aureus subsp. aureus Mu50
aaccuguaauuga

SEQ ID NO: 2046286 - RNA, 22 nt, Staphylococcus aureus subsp. aureus Mu50
gaaaaguuacuuacgccaauca

SEQ ID NO: 2046287 - RNA, 16 nt, Staphylococcus aureus subsp. aureus Mu50
gaaaaguaauuaaaua

SEQ ID NO: 2046288 - RNA, 19 nt, Staphylococcus aureus subsp. aureus Mu50
gaaaauaaaacaaauuauu

SEQ ID NO: 2046289 - RNA, 19 nt, Staphylococcus aureus subsp. aureus Mu50
gaaaauaagcaucacauau

SEQ ID NO: 2046290 - RNA, 20 nt, Staphylococcus aureus subsp. aureus Mu50
aaccucuguuuuguuggugu

SEQ ID NO: 2046291 - RNA, 19 nt, Staphylococcus aureus subsp. aureus Mu50
aaccuauuccuaauaaaua

SEQ ID NO: 2046292 - RNA, 23 nt, Staphylococcus aureus subsp. aureus Mu50
aaccuauuccuaauaaauaucuu

SEQ ID NO: 2046293 - RNA, 16 nt, Staphylococcus aureus subsp. aureus Mu50
aaccuacuaauauauu

SEQ ID NO: 2046294 - RNA, 13 nt, Staphylococcus aureus subsp. aureus Mu50
aaccguuuuauug

SEQ ID NO: 2046295 - RNA, 21 nt, Staphylococcus aureus subsp. aureus Mu50
gaacuaucaauauaauuuggu

SEQ ID NO: 2046296 - RNA, 13 nt, Staphylococcus aureus subsp. aureus Mu50
gaacuaauguaaa

SEQ ID NO: 2046297 - RNA, 13 nt, Staphylococcus aureus subsp. aureus Mu50
gaacuacuacauu

SEQ ID NO: 2046298 - RNA, 15 nt, Staphylococcus aureus subsp. aureus Mu50
cuuuuuguuaauuuu

SEQ ID NO: 2046299 - RNA, 19 nt, Staphylococcus aureus subsp. aureus Mu50
cuuuuuguuauaucuaauu

SEQ ID NO: 2046300 - RNA, 17 nt, Staphylococcus aureus subsp. aureus Mu50
cuuuuuguuuugaaugu

SEQ ID NO: 2046301 - RNA, 19 nt, Staphylococcus aureus subsp. aureus Mu50
cuuuuugcguuuuuaaaua

SEQ ID NO: 2046302 - RNA, 21 nt, Staphylococcus aureus subsp. aureus Mu50
cuuuuuuuguuuauuuagaau

SEQ ID NO: 2046303 - RNA, 20 nt, Staphylococcus aureus subsp. aureus Mu50
gaaaaaauggcgaaaaagcu

SEQ ID NO: 2046304 - RNA, 12 nt, Staphylococcus aureus subsp. aureus Mu50
gaaaaaccaaua

SEQ ID NO: 2046305 - RNA, 23 nt, Staphylococcus aureus subsp. aureus Mu50
gaaaaacuucuuaacuugaaaug

SEQ ID NO: 2046306 - RNA, 14 nt, Staphylococcus aureus subsp. aureus Mu50
gaaaacccugaaga

SEQ ID NO: 2046307 - RNA, 23 nt, Staphylococcus aureus subsp. aureus Mu50
cuuuuaugcaugcgcaaaagcgc

SEQ ID NO: 2046308 - RNA, 19 nt, Staphylococcus aureus subsp. aureus Mu50
cuuuuauuuuuuauaaaga

SEQ ID NO: 2046309 - RNA, 22 nt, Staphylococcus aureus subsp. aureus Mu50
cuuuucaaacauauucauucua

SEQ ID NO: 2046310 - RNA, 13 nt, Staphylococcus aureus subsp. aureus Mu50
cuuuuaugcaugc

SEQ ID NO: 2046311 - RNA, 16 nt, Staphylococcus aureus subsp. aureus Mu50
cuuuuaugcaugcgca

SEQ ID NO: 2046312 - RNA, 17 nt, Staphylococcus aureus subsp. aureus Mu50
cuuuguguuugcuuuuu

SEQ ID NO: 2046313 - RNA, 20 nt, Staphylococcus aureus subsp. aureus Mu50
cuuuguuggggcccacaccc

SEQ ID NO: 2046314 - RNA, 15 nt, Staphylococcus aureus subsp. aureus Mu50
cuuuguuuaucaauu

SEQ ID NO: 2046315 - RNA, 16 nt, Staphylococcus aureus subsp. aureus Mu50
cuuuguuuucaguaac

SEQ ID NO: 2046316 - RNA, 20 nt, Staphylococcus aureus subsp. aureus Mu50
cuuuuaccucugauaaauga

SEQ ID NO: 2046317 - RNA, 20 nt, Staphylococcus aureus subsp. aureus Mu50
cuuuuaauagaucuuuguau

SEQ ID NO: 2046318 - RNA, 14 nt, Staphylococcus aureus subsp. aureus Mu50
cuuuuacuaaauga

SEQ ID NO: 2046319 - RNA, 17 nt, Staphylococcus aureus subsp. aureus Mu50
cuuuuacgccuucuuua

SEQ ID NO: 2046320 - RNA, 23 nt, Staphylococcus aureus subsp. aureus Mu50
cuuuuauacauguacauuaucac

SEQ ID NO: 2046321 - RNA, 15 nt, Staphylococcus aureus subsp. aureus Mu50
cuuuuuaggaaugau

SEQ ID NO: 2046322 - RNA, 22 nt, Staphylococcus aureus subsp. aureus Mu50
cuuuuucaaauaauauaaaacg

SEQ ID NO: 2046323 - RNA, 19 nt, Staphylococcus aureus subsp. aureus Mu50
cuuuuuaucaugauuaauu

SEQ ID NO: 2046324 - RNA, 23 nt, Staphylococcus aureus subsp. aureus Mu50
cuuuuguaaagcuuuaguuaaau

SEQ ID NO: 2046325 - RNA, 13 nt, Staphylococcus aureus subsp. aureus Mu50
cuuuuguaaaugg

SEQ ID NO: 2046326 - RNA, 15 nt, Staphylococcus aureus subsp. aureus Mu50
cuuuuguaauugaaa

SEQ ID NO: 2046327 - RNA, 17 nt, Staphylococcus aureus subsp. aureus Mu50
cuuuuguuuuuauauua

SEQ ID NO: 2046328 - RNA, 14 nt, Staphylococcus aureus subsp. aureus Mu50
cuuuuuaaaaucgu

SEQ ID NO: 2046329 - RNA, 23 nt, Staphylococcus aureus subsp. aureus Mu50
cuuucuucagaaccuugaaugau

SEQ ID NO: 2046330 - RNA, 24 nt, Staphylococcus aureus subsp. aureus Mu50
cuuucuucagaaccuugaaugaua

SEQ ID NO: 2046331 - RNA, 18 nt, Staphylococcus aureus subsp. aureus Mu50
cuuugaagggagcauuuc

SEQ ID NO: 2046332 - RNA, 22 nt, Staphylococcus aureus subsp. aureus Mu50
cuuugaagggguuuuuucuuau

SEQ ID NO: 2046333 - RNA, 15 nt, Staphylococcus aureus subsp. aureus Mu50
cuuugacauguguua

SEQ ID NO: 2046334 - RNA, 21 nt, Staphylococcus aureus subsp. aureus Mu50
cuuuggugaaaguacuuggaa

SEQ ID NO: 2046335 - RNA, 21 nt, Staphylococcus aureus subsp. aureus Mu50
cuuugcucaccuuuagacaau

SEQ ID NO: 2046336 - RNA, 14 nt, Staphylococcus aureus subsp. aureus Mu50
cuuucauuaauuuu

SEQ ID NO: 2046337 - RNA, 15 nt, Staphylococcus aureus subsp. aureus Mu50
cuuucauuaauuuuu

SEQ ID NO: 2046338 - RNA, 15 nt, Staphylococcus aureus subsp. aureus Mu50
cuuucgaaaaacugu

SEQ ID NO: 2046339 - RNA, 14 nt, Staphylococcus aureus subsp. aureus Mu50
cuucguuuuaauaa

SEQ ID NO: 2046340 - RNA, 20 nt, Staphylococcus aureus subsp. aureus Mu50
cuucguacaucguugccauu

SEQ ID NO: 2046341 - RNA, 19 nt, Staphylococcus aureus subsp. aureus Mu50
cuugcucuaauucaaugau

SEQ ID NO: 2046342 - RNA, 20 nt, Staphylococcus aureus subsp. aureus Mu50
cuugcuggacagcuacaauu

SEQ ID NO: 2046343 - RNA, 18 nt, Staphylococcus aureus subsp. aureus Mu50
cuugcuguucaacaucuu

SEQ ID NO: 2046344 - RNA, 17 nt, Staphylococcus aureus subsp. aureus Mu50
cuuggaaauguauauga

SEQ ID NO: 2046345 - RNA, 15 nt, Staphylococcus aureus subsp. aureus Mu50
cuuggauaauugcau

SEQ ID NO: 2046346 - RNA, 21 nt, Staphylococcus aureus subsp. aureus Mu50
cuuggaaguaucugugaauau

SEQ ID NO: 2046347 - RNA, 17 nt, Staphylococcus aureus subsp. aureus Mu50
cuuuaugauaauuaauu

SEQ ID NO: 2046348 - RNA, 21 nt, Staphylococcus aureus subsp. aureus Mu50
cuuuaugcaaaauuaaugaac

SEQ ID NO: 2046349 - RNA, 18 nt, Staphylococcus aureus subsp. aureus Mu50
cuuuauauauaaaaucau

SEQ ID NO: 2046350 - RNA, 14 nt, Staphylococcus aureus subsp. aureus Mu50
cuuuauuagaauga

SEQ ID NO: 2046351 - RNA, 13 nt, Staphylococcus aureus subsp. aureus Mu50
cuuuauuaucauu

SEQ ID NO: 2046352 - RNA, 22 nt, Staphylococcus aureus subsp. aureus Mu50
cuuuauugggagcaaucaauac

SEQ ID NO: 2046353 - RNA, 13 nt, Staphylococcus aureus subsp. aureus Mu50
cuuucaagaccuu

SEQ ID NO: 2046354 - RNA, 19 nt, Staphylococcus aureus subsp. aureus Mu50
cuuucagcuaauucgucua

SEQ ID NO: 2046355 - RNA, 16 nt, Staphylococcus aureus subsp. aureus Mu50
aaccguuauauauuau

SEQ ID NO: 2046356 - RNA, 13 nt, Staphylococcus aureus subsp. aureus Mu50
cuuuaaucaaaaa

SEQ ID NO: 2046357 - RNA, 22 nt, Staphylococcus aureus subsp. aureus Mu50
cuuuaauaaccuuuaaaacauc

SEQ ID NO: 2046358 - RNA, 14 nt, Staphylococcus aureus subsp. aureus Mu50
cuuuaauauaauua

SEQ ID NO: 2046359 - RNA, 17 nt, Staphylococcus aureus subsp. aureus Mu50
cuuuaauauagauuuga

SEQ ID NO: 2046360 - RNA, 20 nt, Staphylococcus aureus subsp. aureus Mu50
cuuuaacuucugauucuuca

SEQ ID NO: 2046361 - RNA, 23 nt, Staphylococcus aureus subsp. aureus Mu50
cuuuaaccacuccuuaaacaaau

SEQ ID NO: 2046362 - RNA, 12 nt, Staphylococcus aureus subsp. aureus Mu50
cuuuaauugcuc

SEQ ID NO: 2046363 - RNA, 23 nt, Staphylococcus aureus subsp. aureus Mu50
cuuuacuaaaccucaacauuaaa

SEQ ID NO: 2046364 - RNA, 22 nt, Staphylococcus aureus subsp. aureus Mu50
cuuuagcaauugaaucaaauac

SEQ ID NO: 2046365 - RNA, 19 nt, Staphylococcus aureus subsp. aureus Mu50
cuuuaguaguguauucauu

SEQ ID NO: 2046366 - RNA, 20 nt, Staphylococcus aureus subsp. aureus Mu50
cuuuagcuauguaaaauuau

SEQ ID NO: 2046367 - RNA, 15 nt, Staphylococcus aureus subsp. aureus Mu50
cuuuaacaauugauu

SEQ ID NO: 2046368 - RNA, 19 nt, Staphylococcus aureus subsp. aureus Mu50
cuuuaaaguuaaaguuuug

SEQ ID NO: 2046369 - RNA, 23 nt, Staphylococcus aureus subsp. aureus Mu50
cuuuaaaguuaaaguuuuguuca

SEQ ID NO: 2046370 - RNA, 19 nt, Staphylococcus aureus subsp. aureus Mu50
cuuguccguuuuauauuua

SEQ ID NO: 2046371 - RNA, 17 nt, Staphylococcus aureus subsp. aureus Mu50
cuuguccuaacgcuaau

SEQ ID NO: 2046372 - RNA, 20 nt, Staphylococcus aureus subsp. aureus Mu50
cuggggaagaccauuuuaua

SEQ ID NO: 2046373 - RNA, 20 nt, Staphylococcus aureus subsp. aureus Mu50
cuggguuaccaaguaaugau

SEQ ID NO: 2046374 - RNA, 23 nt, Staphylococcus aureus subsp. aureus Mu50
cugguauuuuaugacguaauuaa

SEQ ID NO: 2046375 - RNA, 21 nt, Staphylococcus aureus subsp. aureus Mu50
cuuaaguaagauuuaaacauc

SEQ ID NO: 2046376 - RNA, 15 nt, Staphylococcus aureus subsp. aureus Mu50
cuuaauaagucagcu

SEQ ID NO: 2046377 - RNA, 22 nt, Staphylococcus aureus subsp. aureus Mu50
cuuaauaucaugggcaguaauu

SEQ ID NO: 2046378 - RNA, 15 nt, Staphylococcus aureus subsp. aureus Mu50
cuuaaucaagcuagc

SEQ ID NO: 2046379 - RNA, 13 nt, Staphylococcus aureus subsp. aureus Mu50
cuuaaauacaauu

SEQ ID NO: 2046380 - RNA, 19 nt, Staphylococcus aureus subsp. aureus Mu50
cuuaaaaauaggaauacau

SEQ ID NO: 2046381 - RNA, 18 nt, Staphylococcus aureus subsp. aureus Mu50
cuuaaaaugauuguuuua

SEQ ID NO: 2046382 - RNA, 16 nt, Staphylococcus aureus subsp. aureus Mu50
cuuaaauagugcuuuu

SEQ ID NO: 2046383 - RNA, 16 nt, Staphylococcus aureus subsp. aureus Mu50
cuuaacaaauuaaaaa

SEQ ID NO: 2046384 - RNA, 23 nt, Staphylococcus aureus subsp. aureus Mu50
cuuaucgccuggugcaggcauca

SEQ ID NO: 2046385 - RNA, 22 nt, Staphylococcus aureus subsp. aureus Mu50
cuuaaucaagcuagcaucaugu

SEQ ID NO: 2046386 - RNA, 14 nt, Staphylococcus aureus subsp. aureus Mu50
cuguguacguuuca

SEQ ID NO: 2046387 - RNA, 20 nt, Staphylococcus aureus subsp. aureus Mu50
cuguuauugcaauaaaauua

SEQ ID NO: 2046388 - RNA, 19 nt, Staphylococcus aureus subsp. aureus Mu50
cuguacuuuuauguuguua

SEQ ID NO: 2046389 - RNA, 22 nt, Staphylococcus aureus subsp. aureus Mu50
cuguagacaauuguaguaauga

SEQ ID NO: 2046390 - RNA, 22 nt, Staphylococcus aureus subsp. aureus Mu50
cuguaugccgccuaauaauaaa

SEQ ID NO: 2046391 - RNA, 13 nt, Staphylococcus aureus subsp. aureus Mu50
cuguauuuaauaa

SEQ ID NO: 2046392 - RNA, 16 nt, Staphylococcus aureus subsp. aureus Mu50
cuguauuuaauaaacc

SEQ ID NO: 2046393 - RNA, 20 nt, Staphylococcus aureus subsp. aureus Mu50
cuguauauauauguaaauga

SEQ ID NO: 2046394 - RNA, 22 nt, Staphylococcus aureus subsp. aureus Mu50
cuguaucaaaaucgguuugauu

SEQ ID NO: 2046395 - RNA, 17 nt, Staphylococcus aureus subsp. aureus Mu50
cuguauagcgguguuuu

SEQ ID NO: 2046396 - RNA, 19 nt, Staphylococcus aureus subsp. aureus Mu50
cuguauagcuggcuuuuua

SEQ ID NO: 2046397 - RNA, 13 nt, Staphylococcus aureus subsp. aureus Mu50
cuguauaaauaac

SEQ ID NO: 2046398 - RNA, 18 nt, Staphylococcus aureus subsp. aureus Mu50
cuucaauuucauuuuuga

SEQ ID NO: 2046399 - RNA, 16 nt, Staphylococcus aureus subsp. aureus Mu50
cuucaauccaagcaau

SEQ ID NO: 2046400 - RNA, 14 nt, Staphylococcus aureus subsp. aureus Mu50
cuucaauauuuaaa

SEQ ID NO: 2046401 - RNA, 23 nt, Staphylococcus aureus subsp. aureus Mu50
cuucaggaauaucuuucaaauua

SEQ ID NO: 2046402 - RNA, 17 nt, Staphylococcus aureus subsp. aureus Mu50
cuuauuauuaauuccuu

SEQ ID NO: 2046403 - RNA, 14 nt, Staphylococcus aureus subsp. aureus Mu50
cuuauuauuuaucg

SEQ ID NO: 2046404 - RNA, 17 nt, Staphylococcus aureus subsp. aureus Mu50
cuuauucuucacuuuca

SEQ ID NO: 2046405 - RNA, 24 nt, Staphylococcus aureus subsp. aureus Mu50
cuuauuuggaugguaaguauaauu

SEQ ID NO: 2046406 - RNA, 16 nt, Staphylococcus aureus subsp. aureus Mu50
cuuauuuguuuaauua

SEQ ID NO: 2046407 - RNA, 20 nt, Staphylococcus aureus subsp. aureus Mu50
cuuauuuguuuaauuaucuu

SEQ ID NO: 2046408 - RNA, 19 nt, Staphylococcus aureus subsp. aureus Mu50
cuucaaaaaauaauagcaa

SEQ ID NO: 2046409 - RNA, 21 nt, Staphylococcus aureus subsp. aureus Mu50
cuuauuaaaaaagaacauaaa

SEQ ID NO: 2046410 - RNA, 18 nt, Staphylococcus aureus subsp. aureus Mu50
cuuauggguucaauaucg

SEQ ID NO: 2046411 - RNA, 21 nt, Staphylococcus aureus subsp. aureus Mu50
cuuauggguucaauaucgauu

SEQ ID NO: 2046412 - RNA, 15 nt, Staphylococcus aureus subsp. aureus Mu50
cuucaacuaaugucg

SEQ ID NO: 2046413 - RNA, 14 nt, Staphylococcus aureus subsp. aureus Mu50
cuucaagugccauu

SEQ ID NO: 2046414 - RNA, 14 nt, Staphylococcus aureus subsp. aureus Mu50
cuucaaacuuucac

SEQ ID NO: 2046415 - RNA, 21 nt, Staphylococcus aureus subsp. aureus Mu50
cuucaaacagacuuaacuguc

SEQ ID NO: 2046416 - RNA, 14 nt, Staphylococcus aureus subsp. aureus Mu50
cuucaguuaaauca

SEQ ID NO: 2046417 - RNA, 14 nt, Staphylococcus aureus subsp. aureus Mu50
cuuccaaucaacuu

SEQ ID NO: 2046418 - RNA, 20 nt, Staphylococcus aureus subsp. aureus Mu50
cuuccaauuuaaaaugauuc

SEQ ID NO: 2046419 - RNA, 22 nt, Staphylococcus aureus subsp. aureus Mu50
cuucauuaucaauagaugaaaa

SEQ ID NO: 2046420 - RNA, 16 nt, Staphylococcus aureus subsp. aureus Mu50
cuucaucuguaucaau

SEQ ID NO: 2046421 - RNA, 16 nt, Staphylococcus aureus subsp. aureus Mu50
cuucgauucauaaaau

SEQ ID NO: 2046422 - RNA, 19 nt, Staphylococcus aureus subsp. aureus Mu50
aacgucgugucugaauaca

SEQ ID NO: 2046423 - RNA, 18 nt, Staphylococcus aureus subsp. aureus Mu50
aacgucaucaaaacguuu

SEQ ID NO: 2046424 - RNA, 14 nt, Staphylococcus aureus subsp. aureus Mu50
aacgucaacagcau

SEQ ID NO: 2046425 - RNA, 13 nt, Staphylococcus aureus subsp. aureus Mu50
gacgaucuauaau

SEQ ID NO: 2046426 - RNA, 16 nt, Staphylococcus aureus subsp. aureus Mu50
gacgauacguauauag

SEQ ID NO: 2046427 - RNA, 20 nt, Staphylococcus aureus subsp. aureus Mu50
gacagcuucucauugaaauc

SEQ ID NO: 2046428 - RNA, 15 nt, Staphylococcus aureus subsp. aureus Mu50
gacauaaauauggau

SEQ ID NO: 2046429 - RNA, 21 nt, Staphylococcus aureus subsp. aureus Mu50
gacacuauaccauuuuuauag

SEQ ID NO: 2046430 - RNA, 20 nt, Staphylococcus aureus subsp. aureus Mu50
gacacgcccgacaucauaaa

SEQ ID NO: 2046431 - RNA, 17 nt, Staphylococcus aureus subsp. aureus Mu50
gacaauguacauaaauu

SEQ ID NO: 2046432 - RNA, 12 nt, Staphylococcus aureus subsp. aureus Mu50
gaaucacauuaa

SEQ ID NO: 2046433 - RNA, 14 nt, Staphylococcus aureus subsp. aureus Mu50
gaauccuaaaaagc

SEQ ID NO: 2046434 - RNA, 18 nt, Staphylococcus aureus subsp. aureus Mu50
gaaucgaaaauaucaauu

SEQ ID NO: 2046435 - RNA, 21 nt, Staphylococcus aureus subsp. aureus Mu50
gaauaauuggcugaugaacuu

SEQ ID NO: 2046436 - RNA, 22 nt, Staphylococcus aureus subsp. aureus Mu50
gaauacaauaguacuaagcuuu

SEQ ID NO: 2046437 - RNA, 19 nt, Staphylococcus aureus subsp. aureus Mu50
gaaucaacaauuuaaacgc

SEQ ID NO: 2046438 - RNA, 16 nt, Staphylococcus aureus subsp. aureus Mu50
gaauauuauucauaau

SEQ ID NO: 2046439 - RNA, 23 nt, Staphylococcus aureus subsp. aureus Mu50
gaauaaagcguccucuugugaaa

SEQ ID NO: 2046440 - RNA, 18 nt, Staphylococcus aureus subsp. aureus Mu50
gaauaacaagaaaaaccu

SEQ ID NO: 2046441 - RNA, 13 nt, Staphylococcus aureus subsp. aureus Mu50
gaauaacacuaga

SEQ ID NO: 2046442 - RNA, 14 nt, Staphylococcus aureus subsp. aureus Mu50
gaaguuaacuauaa

SEQ ID NO: 2046443 - RNA, 18 nt, Staphylococcus aureus subsp. aureus Mu50
gaagugcgggggauuauu

SEQ ID NO: 2046444 - RNA, 13 nt, Staphylococcus aureus subsp. aureus Mu50
gacaacauaacaa

SEQ ID NO: 2046445 - RNA, 18 nt, Staphylococcus aureus subsp. aureus Mu50
gacaacuaauaacaaaua

SEQ ID NO: 2046446 - RNA, 23 nt, Staphylococcus aureus subsp. aureus Mu50
gacaacuaauaacaaauaguuca

SEQ ID NO: 2046447 - RNA, 14 nt, Staphylococcus aureus subsp. aureus Mu50
gacaaguaugucau

SEQ ID NO: 2046448 - RNA, 22 nt, Staphylococcus aureus subsp. aureus Mu50
gaauuuaggaaugaauaaagcu

SEQ ID NO: 2046449 - RNA, 18 nt, Staphylococcus aureus subsp. aureus Mu50
gaauuucuaauuuaguau

SEQ ID NO: 2046450 - RNA, 13 nt, Staphylococcus aureus subsp. aureus Mu50
gaauuucaucaaa

SEQ ID NO: 2046451 - RNA, 23 nt, Staphylococcus aureus subsp. aureus Mu50
gaauggauuacagcguaacuaaa

SEQ ID NO: 2046452 - RNA, 19 nt, Staphylococcus aureus subsp. aureus Mu50
aacgauagacauugagaua

SEQ ID NO: 2046453 - RNA, 20 nt, Staphylococcus aureus subsp. aureus Mu50
aacgauaguaguacacgaau

SEQ ID NO: 2046454 - RNA, 18 nt, Staphylococcus aureus subsp. aureus Mu50
aacgauuguugcaaugau

SEQ ID NO: 2046455 - RNA, 18 nt, Staphylococcus aureus subsp. aureus Mu50
aacgauuucuaguuuauc

SEQ ID NO: 2046456 - RNA, 19 nt, Staphylococcus aureus subsp. aureus Mu50
aacgcuuugcagauugaua

SEQ ID NO: 2046457 - RNA, 18 nt, Staphylococcus aureus subsp. aureus Mu50
cuccuaagcuaguguuuu

SEQ ID NO: 2046458 - RNA, 20 nt, Staphylococcus aureus subsp. aureus Mu50
cuccuuaaacaaauaaaugu

SEQ ID NO: 2046459 - RNA, 15 nt, Staphylococcus aureus subsp. aureus Mu50
cuccuuacaauaaag

SEQ ID NO: 2046460 - RNA, 14 nt, Staphylococcus aureus subsp. aureus Mu50
cuauauuuaauuuu

SEQ ID NO: 2046461 - RNA, 16 nt, Staphylococcus aureus subsp. aureus Mu50
cuauauuuagaaugau

SEQ ID NO: 2046462 - RNA, 15 nt, Staphylococcus aureus subsp. aureus Mu50
cuauauuuguuuguu

SEQ ID NO: 2046463 - RNA, 21 nt, Staphylococcus aureus subsp. aureus Mu50
cuauaucaaauuggacugaug

SEQ ID NO: 2046464 - RNA, 19 nt, Staphylococcus aureus subsp. aureus Mu50
cuauagcaccauuauuaaa

SEQ ID NO: 2046465 - RNA, 13 nt, Staphylococcus aureus subsp. aureus Mu50
cuauauaguaaaa

SEQ ID NO: 2046466 - RNA, 13 nt, Staphylococcus aureus subsp. aureus Mu50
cuauauaaaguug

SEQ ID NO: 2046467 - RNA, 21 nt, Staphylococcus aureus subsp. aureus Mu50
cuauauaaaguugacaauaca

SEQ ID NO: 2046468 - RNA, 22 nt, Staphylococcus aureus subsp. aureus Mu50
cuauauaaaguugacaauacaa

SEQ ID NO: 2046469 - RNA, 17 nt, Staphylococcus aureus subsp. aureus Mu50
cuauacauugauaaauu

SEQ ID NO: 2046470 - RNA, 14 nt, Staphylococcus aureus subsp. aureus Mu50
cuauaauucacuuu

SEQ ID NO: 2046471 - RNA, 16 nt, Staphylococcus aureus subsp. aureus Mu50
cuauaauuuuaauuau

SEQ ID NO: 2046472 - RNA, 17 nt, Staphylococcus aureus subsp. aureus Mu50
cuauaauuuuaauuauu

SEQ ID NO: 2046473 - RNA, 21 nt, Staphylococcus aureus subsp. aureus Mu50
cuauaauaccuaauugcuuaa

SEQ ID NO: 2046474 - RNA, 14 nt, Staphylococcus aureus subsp. aureus Mu50
cuauaaucuaucuu

SEQ ID NO: 2046475 - RNA, 16 nt, Staphylococcus aureus subsp. aureus Mu50
cuauaaucuaucuugu

SEQ ID NO: 2046476 - RNA, 23 nt, Staphylococcus aureus subsp. aureus Mu50
cuagauucauauuuauauuuaca

SEQ ID NO: 2046477 - RNA, 21 nt, Staphylococcus aureus subsp. aureus Mu50
cuagauuuuaaaucaauacca

SEQ ID NO: 2046478 - RNA, 15 nt, Staphylococcus aureus subsp. aureus Mu50
cuauaaauaucaaua

SEQ ID NO: 2046479 - RNA, 17 nt, Staphylococcus aureus subsp. aureus Mu50
cuauaaauaucaauaau

SEQ ID NO: 2046480 - RNA, 22 nt, Staphylococcus aureus subsp. aureus Mu50
cuauaaacgucacuuuauuaaa

SEQ ID NO: 2046481 - RNA, 17 nt, Staphylococcus aureus subsp. aureus Mu50
cuauaaauacgucaucu

SEQ ID NO: 2046482 - RNA, 15 nt, Staphylococcus aureus subsp. aureus Mu50
cuaguuuguaauaau

SEQ ID NO: 2046483 - RNA, 21 nt, Staphylococcus aureus subsp. aureus Mu50
cuaguucgauucaugaauaau

SEQ ID NO: 2046484 - RNA, 15 nt, Staphylococcus aureus subsp. aureus Mu50
cuaguucagcuucua

SEQ ID NO: 2046485 - RNA, 21 nt, Staphylococcus aureus subsp. aureus Mu50
cuacuauaaauacgucaucuu

SEQ ID NO: 2046486 - RNA, 16 nt, Staphylococcus aureus subsp. aureus Mu50
cuacuaagcguuuaau

SEQ ID NO: 2046487 - RNA, 17 nt, Staphylococcus aureus subsp. aureus Mu50
cuacuaauauauuaauu

SEQ ID NO: 2046488 - RNA, 21 nt, Staphylococcus aureus subsp. aureus Mu50
cuacuaaucuuuuuuuaauua

SEQ ID NO: 2046489 - RNA, 24 nt, Staphylococcus aureus subsp. aureus Mu50
cuacguguguaguagcaccgauuu

SEQ ID NO: 2046490 - RNA, 23 nt, Staphylococcus aureus subsp. aureus Mu50
cuacucccgcaaauauuaaauua

SEQ ID NO: 2046491 - RNA, 21 nt, Staphylococcus aureus subsp. aureus Mu50
cuaugauauauguaacauaaa

SEQ ID NO: 2046492 - RNA, 18 nt, Staphylococcus aureus subsp. aureus Mu50
cuaucuacucaaauauaa

SEQ ID NO: 2046493 - RNA, 21 nt, Staphylococcus aureus subsp. aureus Mu50
cuaucuauaaacgucacuuua

SEQ ID NO: 2046494 - RNA, 15 nt, Staphylococcus aureus subsp. aureus Mu50
cuaucguaaacaaca

SEQ ID NO: 2046495 - RNA, 16 nt, Staphylococcus aureus subsp. aureus Mu50
cuaucguaaacaacau

SEQ ID NO: 2046496 - RNA, 19 nt, Staphylococcus aureus subsp. aureus Mu50
cuauccuaagcauaauuca

SEQ ID NO: 2046497 - RNA, 14 nt, Staphylococcus aureus subsp. aureus Mu50
cuaugccaaauaac

SEQ ID NO: 2046498 - RNA, 22 nt, Staphylococcus aureus subsp. aureus Mu50
cuaugcuuuuuuuacaauauga

SEQ ID NO: 2046499 - RNA, 17 nt, Staphylococcus aureus subsp. aureus Mu50
cuauuaaacauuuuuga

SEQ ID NO: 2046500 - RNA, 11 nt, Staphylococcus aureus subsp. aureus Mu50
cuauuaauuug

SEQ ID NO: 2046501 - RNA, 17 nt, Staphylococcus aureus subsp. aureus Mu50
cuauuaagaaauacuca

SEQ ID NO: 2046502 - RNA, 19 nt, Staphylococcus aureus subsp. aureus Mu50
cuauuaucgaagaaacauu

SEQ ID NO: 2046503 - RNA, 14 nt, Staphylococcus aureus subsp. aureus Mu50
cuauuccuaauaaa

SEQ ID NO: 2046504 - RNA, 18 nt, Staphylococcus aureus subsp. aureus Mu50
cucaaguaacucaaguga

SEQ ID NO: 2046505 - RNA, 17 nt, Staphylococcus aureus subsp. aureus Mu50
cucaagugaaucuaacu

SEQ ID NO: 2046506 - RNA, 15 nt, Staphylococcus aureus subsp. aureus Mu50
cuauucacgaacauu

SEQ ID NO: 2046507 - RNA, 12 nt, Staphylococcus aureus subsp. aureus Mu50
cuauuuaauaau

SEQ ID NO: 2046508 - RNA, 13 nt, Staphylococcus aureus subsp. aureus Mu50
cuauuuuaaauua

SEQ ID NO: 2046509 - RNA, 17 nt, Staphylococcus aureus subsp. aureus Mu50
cuauuuaaaagacaauc

SEQ ID NO: 2046510 - RNA, 13 nt, Staphylococcus aureus subsp. aureus Mu50
cuauuuuauacau

SEQ ID NO: 2046511 - RNA, 21 nt, Staphylococcus aureus subsp. aureus Mu50
cuccaauuaccaaugaauaaa

SEQ ID NO: 2046512 - RNA, 16 nt, Staphylococcus aureus subsp. aureus Mu50
cucauuugacauauca

SEQ ID NO: 2046513 - RNA, 14 nt, Staphylococcus aureus subsp. aureus Mu50
cucauuauaaugau

SEQ ID NO: 2046514 - RNA, 15 nt, Staphylococcus aureus subsp. aureus Mu50
cucaauuaauuuagu

SEQ ID NO: 2046515 - RNA, 16 nt, Staphylococcus aureus subsp. aureus Mu50
cucaaugcauuuaauu

SEQ ID NO: 2046516 - RNA, 18 nt, Staphylococcus aureus subsp. aureus Mu50
cucaaugcauuuaauuua

SEQ ID NO: 2046517 - RNA, 19 nt, Staphylococcus aureus subsp. aureus Mu50
cucaauuuaguauaaauaa

SEQ ID NO: 2046518 - RNA, 12 nt, Staphylococcus aureus subsp. aureus Mu50
cucacaugugaa

SEQ ID NO: 2046519 - RNA, 15 nt, Staphylococcus aureus subsp. aureus Mu50
cucacgauuaauaaa

SEQ ID NO: 2046520 - RNA, 15 nt, Staphylococcus aureus subsp. aureus Mu50
cugaguuuuaaugaa

SEQ ID NO: 2046521 - RNA, 18 nt, Staphylococcus aureus subsp. aureus Mu50
cugauauugaucugauuu

SEQ ID NO: 2046522 - RNA, 15 nt, Staphylococcus aureus subsp. aureus Mu50
cugacucuuaauuuu

SEQ ID NO: 2046523 - RNA, 23 nt, Staphylococcus aureus subsp. aureus Mu50
cugaauuaaagcaucgaacaauc

SEQ ID NO: 2046524 - RNA, 18 nt, Staphylococcus aureus subsp. aureus Mu50
cugaaucugcuaauuuau

SEQ ID NO: 2046525 - RNA, 13 nt, Staphylococcus aureus subsp. aureus Mu50
cugaauaaauaac

SEQ ID NO: 2046526 - RNA, 23 nt, Staphylococcus aureus subsp. aureus Mu50
cugaagaacgaucuguccauuua

SEQ ID NO: 2046527 - RNA, 20 nt, Staphylococcus aureus subsp. aureus Mu50
cucuauggcuucgcuaauaa

SEQ ID NO: 2046528 - RNA, 19 nt, Staphylococcus aureus subsp. aureus Mu50
cucuaagcauucaguuaau

SEQ ID NO: 2046529 - RNA, 12 nt, Staphylococcus aureus subsp. aureus Mu50
cucuuuaaacuc

SEQ ID NO: 2046530 - RNA, 14 nt, Staphylococcus aureus subsp. aureus Mu50
cucuuuaguuaauu

SEQ ID NO: 2046531 - RNA, 13 nt, Staphylococcus aureus subsp. aureus Mu50
cugaaaauaucac

SEQ ID NO: 2046532 - RNA, 23 nt, Staphylococcus aureus subsp. aureus Mu50
cugaaaaacuucuuaacuugaaa

SEQ ID NO: 2046533 - RNA, 17 nt, Staphylococcus aureus subsp. aureus Mu50
cugaaaagaauaaguug

SEQ ID NO: 2046534 - RNA, 24 nt, Staphylococcus aureus subsp. aureus Mu50
cugccauucuuuuucucaauguga

SEQ ID NO: 2046535 - RNA, 12 nt, Staphylococcus aureus subsp. aureus Mu50
cugcagucgcuu

SEQ ID NO: 2046536 - RNA, 13 nt, Staphylococcus aureus subsp. aureus Mu50
cugcauuaauuuc

SEQ ID NO: 2046537 - RNA, 18 nt, Staphylococcus aureus subsp. aureus Mu50
cugccaauaaaaugcaau

SEQ ID NO: 2046538 - RNA, 21 nt, Staphylococcus aureus subsp. aureus Mu50
cugaugaggcaauauuaaaau

SEQ ID NO: 2046539 - RNA, 17 nt, Staphylococcus aureus subsp. aureus Mu50
cugauguuugcauaccu

SEQ ID NO: 2046540 - RNA, 13 nt, Staphylococcus aureus subsp. aureus Mu50
cugauuucacuuc

SEQ ID NO: 2046541 - RNA, 20 nt, Staphylococcus aureus subsp. aureus Mu50
cugauugcugcuguacaauu

SEQ ID NO: 2046542 - RNA, 15 nt, Staphylococcus aureus subsp. aureus Mu50
cugcaccgauaucau

SEQ ID NO: 2046543 - RNA, 19 nt, Staphylococcus aureus subsp. aureus Mu50
cugcaauuuguaauacaag

SEQ ID NO: 2046544 - RNA, 15 nt, Staphylococcus aureus subsp. aureus Mu50
cgugaauuaaaaaau

SEQ ID NO: 2046545 - RNA, 15 nt, Staphylococcus aureus subsp. aureus Mu50
aacccuaaaaugaau

SEQ ID NO: 2046546 - RNA, 14 nt, Staphylococcus aureus subsp. aureus Mu50
aaccgauuaauaua

SEQ ID NO: 2046547 - RNA, 15 nt, Staphylococcus aureus subsp. aureus Mu50
aaccgauauuucuga

SEQ ID NO: 2046548 - RNA, 16 nt, Staphylococcus aureus subsp. aureus Mu50
aaccgacuuguugaua

SEQ ID NO: 2046549 - RNA, 10 nt, Staphylococcus aureus subsp. aureus Mu50
cguuaauaau

SEQ ID NO: 2046550 - RNA, 16 nt, Staphylococcus aureus subsp. aureus Mu50
cguucaaauguugaau

SEQ ID NO: 2046551 - RNA, 22 nt, Staphylococcus aureus subsp. aureus Mu50
cguuauuuuuuuguccaauaaa

SEQ ID NO: 2046552 - RNA, 18 nt, Staphylococcus aureus subsp. aureus Mu50
cguucaagaacaaucaau

SEQ ID NO: 2046553 - RNA, 21 nt, Staphylococcus aureus subsp. aureus Mu50
cguuauuuucaauauuugaua

SEQ ID NO: 2046554 - RNA, 12 nt, Staphylococcus aureus subsp. aureus Mu50
cguucaauuuuu

SEQ ID NO: 2046555 - RNA, 20 nt, Staphylococcus aureus subsp. aureus Mu50
cguuaacaaucaguaauaau

SEQ ID NO: 2046556 - RNA, 21 nt, Staphylococcus aureus subsp. aureus Mu50
cguguuugaauguuuuugaua

SEQ ID NO: 2046557 - RNA, 14 nt, Staphylococcus aureus subsp. aureus Mu50
cguauuuuaaugau

SEQ ID NO: 2046558 - RNA, 13 nt, Staphylococcus aureus subsp. aureus Mu50
cguaucauuuaaa

SEQ ID NO: 2046559 - RNA, 20 nt, Staphylococcus aureus subsp. aureus Mu50
cguaucaagaaaaaguuuuu

SEQ ID NO: 2046560 - RNA, 15 nt, Staphylococcus aureus subsp. aureus Mu50
aacccaucauguaca

SEQ ID NO: 2046561 - RNA, 20 nt, Staphylococcus aureus subsp. aureus Mu50
aacccaguaucgauuuaaca

SEQ ID NO: 2046562 - RNA, 18 nt, Staphylococcus aureus subsp. aureus Mu50
cguaaauuuuaucuaaac

SEQ ID NO: 2046563 - RNA, 22 nt, Staphylococcus aureus subsp. aureus Mu50
cguaacauauguacuauuaucu

SEQ ID NO: 2046564 - RNA, 17 nt, Staphylococcus aureus subsp. aureus Mu50
cguaauuuaugauuguu

SEQ ID NO: 2046565 - RNA, 16 nt, Staphylococcus aureus subsp. aureus Mu50
cguacuuucaaauaau

SEQ ID NO: 2046566 - RNA, 20 nt, Staphylococcus aureus subsp. aureus Mu50
cguacuguguaauaccaauu

SEQ ID NO: 2046567 - RNA, 17 nt, Staphylococcus aureus subsp. aureus Mu50
cgguuugaaaaauggug

SEQ ID NO: 2046568 - RNA, 17 nt, Staphylococcus aureus subsp. aureus Mu50
cgucgaauauaauuuuu

SEQ ID NO: 2046569 - RNA, 14 nt, Staphylococcus aureus subsp. aureus Mu50
cguccaaaaugaac

SEQ ID NO: 2046570 - RNA, 23 nt, Staphylococcus aureus subsp. aureus Mu50
gaugaguauacuuacugaaacua

SEQ ID NO: 2046571 - RNA, 17 nt, Staphylococcus aureus subsp. aureus Mu50
gaugauuuauaaaaacu

SEQ ID NO: 2046572 - RNA, 14 nt, Staphylococcus aureus subsp. aureus Mu50
gaugcauaaaaacc

SEQ ID NO: 2046573 - RNA, 23 nt, Staphylococcus aureus subsp. aureus Mu50
gaugcauauauauauagauuaaa

SEQ ID NO: 2046574 - RNA, 14 nt, Staphylococcus aureus subsp. aureus Mu50
aacuuacauuacau

SEQ ID NO: 2046575 - RNA, 12 nt, Staphylococcus aureus subsp. aureus Mu50
aacuuaauuaaa

SEQ ID NO: 2046576 - RNA, 21 nt, Staphylococcus aureus subsp. aureus Mu50
aacuuaauacgauaauaacua

SEQ ID NO: 2046577 - RNA, 18 nt, Staphylococcus aureus subsp. aureus Mu50
aacuguuucuguaaaagu

SEQ ID NO: 2046578 - RNA, 20 nt, Staphylococcus aureus subsp. aureus Mu50
gaucuguccauuuaucuuua

SEQ ID NO: 2046579 - RNA, 22 nt, Staphylococcus aureus subsp. aureus Mu50
gaucuuggccaauuaacuugau

SEQ ID NO: 2046580 - RNA, 22 nt, Staphylococcus aureus subsp. aureus Mu50
gaugaaucccauaacaaucauu

SEQ ID NO: 2046581 - RNA, 16 nt, Staphylococcus aureus subsp. aureus Mu50
gaugaacaaaauaaca

SEQ ID NO: 2046582 - RNA, 17 nt, Staphylococcus aureus subsp. aureus Mu50
aacugcuuuuuauuaug

SEQ ID NO: 2046583 - RNA, 13 nt, Staphylococcus aureus subsp. aureus Mu50
gaugacauggcac

SEQ ID NO: 2046584 - RNA, 20 nt, Staphylococcus aureus subsp. aureus Mu50
gauucauaucuuucaauuaa

SEQ ID NO: 2046585 - RNA, 21 nt, Staphylococcus aureus subsp. aureus Mu50
gauucauaaaauuuaaaacaa

SEQ ID NO: 2046586 - RNA, 14 nt, Staphylococcus aureus subsp. aureus Mu50
gauuaaauucaucu

SEQ ID NO: 2046587 - RNA, 18 nt, Staphylococcus aureus subsp. aureus Mu50
gauuaaagcgauaauaga

SEQ ID NO: 2046588 - RNA, 18 nt, Staphylococcus aureus subsp. aureus Mu50
gauuaaauacgccaaaua

SEQ ID NO: 2046589 - RNA, 13 nt, Staphylococcus aureus subsp. aureus Mu50
gauguucaucaac

SEQ ID NO: 2046590 - RNA, 16 nt, Staphylococcus aureus subsp. aureus Mu50
gauguuugcaacauau

SEQ ID NO: 2046591 - RNA, 11 nt, Staphylococcus aureus subsp. aureus Mu50
gauuuaauaaa

SEQ ID NO: 2046592 - RNA, 19 nt, Staphylococcus aureus subsp. aureus Mu50
gauuuaauaaagugucuaa

SEQ ID NO: 2046593 - RNA, 18 nt, Staphylococcus aureus subsp. aureus Mu50
gauugcgagacuguuuuu

SEQ ID NO: 2046594 - RNA, 18 nt, Staphylococcus aureus subsp. aureus Mu50
gauuccaaucuauuuuaa

SEQ ID NO: 2046595 - RNA, 21 nt, Staphylococcus aureus subsp. aureus Mu50
gauuuuauauaaaaagaagau

SEQ ID NO: 2046596 - RNA, 17 nt, Staphylococcus aureus subsp. aureus Mu50
gauuuccucgguuuuau

SEQ ID NO: 2046597 - RNA, 20 nt, Staphylococcus aureus subsp. aureus Mu50
gauuuauuauuaccauaacu

SEQ ID NO: 2046598 - RNA, 21 nt, Staphylococcus aureus subsp. aureus Mu50
gauuuaauugaaauagaaacu

SEQ ID NO: 2046599 - RNA, 23 nt, Staphylococcus aureus subsp. aureus Mu50
gcaaacgcacuaucaaugacauc

SEQ ID NO: 2046600 - RNA, 13 nt, Staphylococcus aureus subsp. aureus Mu50
gauuuuuaauaau

SEQ ID NO: 2046601 - RNA, 17 nt, Staphylococcus aureus subsp. aureus Mu50
gauuuuuacaaagugau

SEQ ID NO: 2046602 - RNA, 19 nt, Staphylococcus aureus subsp. aureus Mu50
gcaaaugaaauucuuuugu

SEQ ID NO: 2046603 - RNA, 14 nt, Staphylococcus aureus subsp. aureus Mu50
aacuucuaacaccu

SEQ ID NO: 2046604 - RNA, 16 nt, Staphylococcus aureus subsp. aureus Mu50
aacuucuuuuguuuua

SEQ ID NO: 2046605 - RNA, 15 nt, Staphylococcus aureus subsp. aureus Mu50
aacuucuuuuuugua

SEQ ID NO: 2046606 - RNA, 16 nt, Staphylococcus aureus subsp. aureus Mu50
aacuucauaauauauc

SEQ ID NO: 2046607 - RNA, 17 nt, Staphylococcus aureus subsp. aureus Mu50
aacuucgauaugauuaa

SEQ ID NO: 2046608 - RNA, 22 nt, Staphylococcus aureus subsp. aureus Mu50
gaugggaaaucaguaauaucaa

SEQ ID NO: 2046609 - RNA, 17 nt, Staphylococcus aureus subsp. aureus Mu50
gaucaucuauauuuaau

SEQ ID NO: 2046610 - RNA, 15 nt, Staphylococcus aureus subsp. aureus Mu50
gaucauaaucauaaa

SEQ ID NO: 2046611 - RNA, 15 nt, Staphylococcus aureus subsp. aureus Mu50
gauaacaaaacgauu

SEQ ID NO: 2046612 - RNA, 21 nt, Staphylococcus aureus subsp. aureus Mu50
gauaaauuaacuuagguuauu

SEQ ID NO: 2046613 - RNA, 19 nt, Staphylococcus aureus subsp. aureus Mu50
gaguaaauuaauagagaaa

SEQ ID NO: 2046614 - RNA, 23 nt, Staphylococcus aureus subsp. aureus Mu50
gauaccaaacugccuaauacacu

SEQ ID NO: 2046615 - RNA, 15 nt, Staphylococcus aureus subsp. aureus Mu50
gauaccaaauauauu

SEQ ID NO: 2046616 - RNA, 14 nt, Staphylococcus aureus subsp. aureus Mu50
gauacugauauuua

SEQ ID NO: 2046617 - RNA, 23 nt, Staphylococcus aureus subsp. aureus Mu50
gauacuggguuuuaccauaaauu

SEQ ID NO: 2046618 - RNA, 16 nt, Staphylococcus aureus subsp. aureus Mu50
gauacguuauuucaau

SEQ ID NO: 2046619 - RNA, 16 nt, Staphylococcus aureus subsp. aureus Mu50
gauaucaauguauugu

SEQ ID NO: 2046620 - RNA, 16 nt, Staphylococcus aureus subsp. aureus Mu50
gauauaaaaagugaaa

SEQ ID NO: 2046621 - RNA, 22 nt, Staphylococcus aureus subsp. aureus Mu50
gauauuucaacuuuuuaauaau

SEQ ID NO: 2046622 - RNA, 11 nt, Staphylococcus aureus subsp. aureus Mu50
gauauugauug

SEQ ID NO: 2046623 - RNA, 15 nt, Staphylococcus aureus subsp. aureus Mu50
gaucaaaaucaugcu

SEQ ID NO: 2046624 - RNA, 16 nt, Staphylococcus aureus subsp. aureus Mu50
gauauuuuuuaauaau

SEQ ID NO: 2046625 - RNA, 15 nt, Staphylococcus aureus subsp. aureus Mu50
aacucuaaaaguugu

SEQ ID NO: 2046626 - RNA, 19 nt, Staphylococcus aureus subsp. aureus Mu50
aacucuaaaaguuguaauu

SEQ ID NO: 2046627 - RNA, 14 nt, Staphylococcus aureus subsp. aureus Mu50
aacucuaaauauaa

SEQ ID NO: 2046628 - RNA, 12 nt, Staphylococcus aureus subsp. aureus Mu50
aacugauaauug

SEQ ID NO: 2046629 - RNA, 19 nt, Staphylococcus aureus subsp. aureus Mu50
aacugcaauaauuacuaac

SEQ ID NO: 2046630 - RNA, 12 nt, Staphylococcus aureus subsp. aureus Mu50
aacugccuaaua

SEQ ID NO: 2046631 - RNA, 20 nt, Staphylococcus aureus subsp. aureus Mu50
gagcuugggacagaaaacaa

SEQ ID NO: 2046632 - RNA, 13 nt, Staphylococcus aureus subsp. aureus Mu50
gagguauauacaa

SEQ ID NO: 2046633 - RNA, 13 nt, Staphylococcus aureus subsp. aureus Mu50
gagguaaaucuau

SEQ ID NO: 2046634 - RNA, 16 nt, Staphylococcus aureus subsp. aureus Mu50
gagguacuagaauuaa

SEQ ID NO: 2046635 - RNA, 18 nt, Staphylococcus aureus subsp. aureus Mu50
aagaaacggaaaugacuu

SEQ ID NO: 2046636 - RNA, 19 nt, Staphylococcus aureus subsp. aureus Mu50
aagaagugccguauucuuu

SEQ ID NO: 2046637 - RNA, 15 nt, Staphylococcus aureus subsp. aureus Mu50
aagaauaaaaaaguu

SEQ ID NO: 2046638 - RNA, 17 nt, Staphylococcus aureus subsp. aureus Mu50
aagaacuaacauaauuu

SEQ ID NO: 2046639 - RNA, 21 nt, Staphylococcus aureus subsp. aureus Mu50
aagaacuaaugguuucauaaa

SEQ ID NO: 2046640 - RNA, 18 nt, Staphylococcus aureus subsp. aureus Mu50
aagaacgaaacuuuaauu

SEQ ID NO: 2046641 - RNA, 17 nt, Staphylococcus aureus subsp. aureus Mu50
aagaacaugauacugaa

SEQ ID NO: 2046642 - RNA, 18 nt, Staphylococcus aureus subsp. aureus Mu50
aagaaaucaccagauuuu

SEQ ID NO: 2046643 - RNA, 21 nt, Staphylococcus aureus subsp. aureus Mu50
aagaaauucgcuugauuaauu

SEQ ID NO: 2046644 - RNA, 14 nt, Staphylococcus aureus subsp. aureus Mu50
gcagcgaucuuuuu

SEQ ID NO: 2046645 - RNA, 13 nt, Staphylococcus aureus subsp. aureus Mu50
gcaggaaugauau

SEQ ID NO: 2046646 - RNA, 19 nt, Staphylococcus aureus subsp. aureus Mu50
gcacuagccguuauuuuuu

SEQ ID NO: 2046647 - RNA, 12 nt, Staphylococcus aureus subsp. aureus Mu50
gcacuaucuuuu

SEQ ID NO: 2046648 - RNA, 17 nt, Staphylococcus aureus subsp. aureus Mu50
aacuuuuauugccauaa

SEQ ID NO: 2046649 - RNA, 13 nt, Staphylococcus aureus subsp. aureus Mu50
aacuuuucaaaca

SEQ ID NO: 2046650 - RNA, 21 nt, Staphylococcus aureus subsp. aureus Mu50
aacuuuucaaacaauacaguu

SEQ ID NO: 2046651 - RNA, 19 nt, Staphylococcus aureus subsp. aureus Mu50
aacuuuucuaucucuugug

SEQ ID NO: 2046652 - RNA, 19 nt, Staphylococcus aureus subsp. aureus Mu50
aacuuuaccaccauuuuua

SEQ ID NO: 2046653 - RNA, 19 nt, Staphylococcus aureus subsp. aureus Mu50
aacuuuaguauauucaaca

SEQ ID NO: 2046654 - RNA, 13 nt, Staphylococcus aureus subsp. aureus Mu50
aacuuuuacuuuc

SEQ ID NO: 2046655 - RNA, 16 nt, Staphylococcus aureus subsp. aureus Mu50
aacuuguaauauaaca

SEQ ID NO: 2046656 - RNA, 18 nt, Staphylococcus aureus subsp. aureus Mu50
aacuuggcaaugaaauua

SEQ ID NO: 2046657 - RNA, 21 nt, Staphylococcus aureus subsp. aureus Mu50
aacuuggcaaugaaauuacca

SEQ ID NO: 2046658 - RNA, 16 nt, Staphylococcus aureus subsp. aureus Mu50
aacuuggcuuaaucuc

SEQ ID NO: 2046659 - RNA, 23 nt, Staphylococcus aureus subsp. aureus Mu50
aacuuggcuuaaucucuuuuuga

SEQ ID NO: 2046660 - RNA, 20 nt, Staphylococcus aureus subsp. aureus Mu50
aacuuguguuauguaugaaa

SEQ ID NO: 2046661 - RNA, 16 nt, Staphylococcus aureus subsp. aureus Mu50
aacuuuaauauaagua

SEQ ID NO: 2046662 - RNA, 20 nt, Staphylococcus aureus subsp. aureus Mu50
gcaacauauuuucacaauca

SEQ ID NO: 2046663 - RNA, 22 nt, Staphylococcus aureus subsp. aureus Mu50
gcaacauauuuucacaaucaua

SEQ ID NO: 2046664 - RNA, 14 nt, Staphylococcus aureus subsp. aureus Mu50
gcaauuuuagccaa

SEQ ID NO: 2046665 - RNA, 14 nt, Staphylococcus aureus subsp. aureus Mu50
aagaugcuuuaauu

SEQ ID NO: 2046666 - RNA, 23 nt, Staphylococcus aureus subsp. aureus Mu50
aagaugguuugaguaaauuaaua

SEQ ID NO: 2046667 - RNA, 15 nt, Staphylococcus aureus subsp. aureus Mu50
aagauguauaugaau

SEQ ID NO: 2046668 - RNA, 16 nt, Staphylococcus aureus subsp. aureus Mu50
aagauguguugaaacu

SEQ ID NO: 2046669 - RNA, 22 nt, Staphylococcus aureus subsp. aureus Mu50
aagauuaugaaaacauuauuaa

SEQ ID NO: 2046670 - RNA, 14 nt, Staphylococcus aureus subsp. aureus Mu50
aagauuauuauuac

SEQ ID NO: 2046671 - RNA, 15 nt, Staphylococcus aureus subsp. aureus Mu50
aagauucaacuuguu

SEQ ID NO: 2046672 - RNA, 19 nt, Staphylococcus aureus subsp. aureus Mu50
aagauuauuugcgauauca

SEQ ID NO: 2046673 - RNA, 21 nt, Staphylococcus aureus subsp. aureus Mu50
aagauuauuugcgauaucagc

SEQ ID NO: 2046674 - RNA, 15 nt, Staphylococcus aureus subsp. aureus Mu50
aagcacgauaaaaau

SEQ ID NO: 2046675 - RNA, 20 nt, Staphylococcus aureus subsp. aureus Mu50
aagauuuuuuauguuuaauu

SEQ ID NO: 2046676 - RNA, 15 nt, Staphylococcus aureus subsp. aureus Mu50
aagcaaugcaugcuu

SEQ ID NO: 2046677 - RNA, 13 nt, Staphylococcus aureus subsp. aureus Mu50
aagauuuuaacuu

SEQ ID NO: 2046678 - RNA, 15 nt, Staphylococcus aureus subsp. aureus Mu50
aagauuuuuaacauu

SEQ ID NO: 2046679 - RNA, 16 nt, Staphylococcus aureus subsp. aureus Mu50
aagauaauuuucaauu

SEQ ID NO: 2046680 - RNA, 17 nt, Staphylococcus aureus subsp. aureus Mu50
aagauaacgagugaaaa

SEQ ID NO: 2046681 - RNA, 18 nt, Staphylococcus aureus subsp. aureus Mu50
gcccauacuaaauaagua

SEQ ID NO: 2046682 - RNA, 18 nt, Staphylococcus aureus subsp. aureus Mu50
gccauuguuauccaaaac

SEQ ID NO: 2046683 - RNA, 19 nt, Staphylococcus aureus subsp. aureus Mu50
gccauguuggcaauuguuu

SEQ ID NO: 2046684 - RNA, 14 nt, Staphylococcus aureus subsp. aureus Mu50
aagacauuuaaaua

SEQ ID NO: 2046685 - RNA, 18 nt, Staphylococcus aureus subsp. aureus Mu50
gcccacaccccaacuugc

SEQ ID NO: 2046686 - RNA, 17 nt, Staphylococcus aureus subsp. aureus Mu50
gccaaugcuuccaucac

SEQ ID NO: 2046687 - RNA, 14 nt, Staphylococcus aureus subsp. aureus Mu50
gccaagaagacauu

SEQ ID NO: 2046688 - RNA, 17 nt, Staphylococcus aureus subsp. aureus Mu50
acuguuucuguaaaagu

SEQ ID NO: 2046689 - RNA, 17 nt, Staphylococcus aureus subsp. aureus Mu50
acuguuuuauaaaugaa

SEQ ID NO: 2046690 - RNA, 22 nt, Staphylococcus aureus subsp. aureus Mu50
acuuaaaauuuaaauauugaag

SEQ ID NO: 2046691 - RNA, 14 nt, Staphylococcus aureus subsp. aureus Mu50
acuuaauauaguua

SEQ ID NO: 2046692 - RNA, 20 nt, Staphylococcus aureus subsp. aureus Mu50
acuuaauauaguuaauguaa

SEQ ID NO: 2046693 - RNA, 20 nt, Staphylococcus aureus subsp. aureus Mu50
acuuaaucguucccauucuu

SEQ ID NO: 2046694 - RNA, 16 nt, Staphylococcus aureus subsp. aureus Mu50
acuuaauaaauaauuu

SEQ ID NO: 2046695 - RNA, 13 nt, Staphylococcus aureus subsp. aureus Mu50
acuuaauaaccau

SEQ ID NO: 2046696 - RNA, 20 nt, Staphylococcus aureus subsp. aureus Mu50
acuuacauuuuaauaaaauc

SEQ ID NO: 2046697 - RNA, 16 nt, Staphylococcus aureus subsp. aureus Mu50
acuuaaugcuucaaau

SEQ ID NO: 2046698 - RNA, 16 nt, Staphylococcus aureus subsp. aureus Mu50
acuuauaauauuaaau

SEQ ID NO: 2046699 - RNA, 21 nt, Staphylococcus aureus subsp. aureus Mu50
acuuagggugacucaaugaau

SEQ ID NO: 2046700 - RNA, 23 nt, Staphylococcus aureus subsp. aureus Mu50
acuuauauauucaauaauuauua

SEQ ID NO: 2046701 - RNA, 15 nt, Staphylococcus aureus subsp. aureus Mu50
acuguguaauaccaa

SEQ ID NO: 2046702 - RNA, 15 nt, Staphylococcus aureus subsp. aureus Mu50
acuguugacauuuga

SEQ ID NO: 2046703 - RNA, 23 nt, Staphylococcus aureus subsp. aureus Mu50
acugucucaucuucuaaaucaau

SEQ ID NO: 2046704 - RNA, 22 nt, Staphylococcus aureus subsp. aureus Mu50
acugugacucggggaauuuuua

SEQ ID NO: 2046705 - RNA, 22 nt, Staphylococcus aureus subsp. aureus Mu50
acugugauauuaauugaaaaac

SEQ ID NO: 2046706 - RNA, 16 nt, Staphylococcus aureus subsp. aureus Mu50
acugaauuaauaucca

SEQ ID NO: 2046707 - RNA, 22 nt, Staphylococcus aureus subsp. aureus Mu50
acugacuagccuucaauauuuc

SEQ ID NO: 2046708 - RNA, 20 nt, Staphylococcus aureus subsp. aureus Mu50
acucuuuuucuuucauaauu

SEQ ID NO: 2046709 - RNA, 16 nt, Staphylococcus aureus subsp. aureus Mu50
acuaugaauagaugau

SEQ ID NO: 2046710 - RNA, 21 nt, Staphylococcus aureus subsp. aureus Mu50
acugaagacaccuuaucacuu

SEQ ID NO: 2046711 - RNA, 13 nt, Staphylococcus aureus subsp. aureus Mu50
acuaucaauauaa

SEQ ID NO: 2046712 - RNA, 15 nt, Staphylococcus aureus subsp. aureus Mu50
acuaucuguuguuau

SEQ ID NO: 2046713 - RNA, 23 nt, Staphylococcus aureus subsp. aureus Mu50
acuaucuguuguuauauaaauag

SEQ ID NO: 2046714 - RNA, 15 nt, Staphylococcus aureus subsp. aureus Mu50
acuaucuucaucaua

SEQ ID NO: 2046715 - RNA, 13 nt, Staphylococcus aureus subsp. aureus Mu50
acuauauccuuuu

SEQ ID NO: 2046716 - RNA, 16 nt, Staphylococcus aureus subsp. aureus Mu50
acuauauccuuuuuga

SEQ ID NO: 2046717 - RNA, 13 nt, Staphylococcus aureus subsp. aureus Mu50
acuauaccauuuu

SEQ ID NO: 2046718 - RNA, 16 nt, Staphylococcus aureus subsp. aureus Mu50
acuauaccauuuuuau

SEQ ID NO: 2046719 - RNA, 14 nt, Staphylococcus aureus subsp. aureus Mu50
acuauaaauccuaa

SEQ ID NO: 2046720 - RNA, 22 nt, Staphylococcus aureus subsp. aureus Mu50
acuagcauuagcaaauauuauu

SEQ ID NO: 2046721 - RNA, 15 nt, Staphylococcus aureus subsp. aureus Mu50
acuauaauaauugga

SEQ ID NO: 2046722 - RNA, 17 nt, Staphylococcus aureus subsp. aureus Mu50
acuaguuuguaauaauu

SEQ ID NO: 2046723 - RNA, 15 nt, Staphylococcus aureus subsp. aureus Mu50
acugauuuuuuuuau

SEQ ID NO: 2046724 - RNA, 19 nt, Staphylococcus aureus subsp. aureus Mu50
acugcacaucauaauaaau

SEQ ID NO: 2046725 - RNA, 19 nt, Staphylococcus aureus subsp. aureus Mu50
acugcaccuccaaccgcuu

SEQ ID NO: 2046726 - RNA, 18 nt, Staphylococcus aureus subsp. aureus Mu50
acugcacggauaccuacu

SEQ ID NO: 2046727 - RNA, 21 nt, Staphylococcus aureus subsp. aureus Mu50
acugccaauaaaaugcaauuu

SEQ ID NO: 2046728 - RNA, 23 nt, Staphylococcus aureus subsp. aureus Mu50
agaaugccguaacccauggauuc

SEQ ID NO: 2046729 - RNA, 19 nt, Staphylococcus aureus subsp. aureus Mu50
agaauuucgaaaagaaauu

SEQ ID NO: 2046730 - RNA, 18 nt, Staphylococcus aureus subsp. aureus Mu50
agaauuucgaaaagaaau

SEQ ID NO: 2046731 - RNA, 20 nt, Staphylococcus aureus subsp. aureus Mu50
agaaucgaaccaaauuuuau

SEQ ID NO: 2046732 - RNA, 12 nt, Staphylococcus aureus subsp. aureus Mu50
agaaugauauaa

SEQ ID NO: 2046733 - RNA, 22 nt, Staphylococcus aureus subsp. aureus Mu50
agaaucuuacauugauaaaaua

SEQ ID NO: 2046734 - RNA, 15 nt, Staphylococcus aureus subsp. aureus Mu50
agaauauaagugauu

SEQ ID NO: 2046735 - RNA, 15 nt, Staphylococcus aureus subsp. aureus Mu50
agaauauuuaaguuu

SEQ ID NO: 2046736 - RNA, 21 nt, Staphylococcus aureus subsp. aureus Mu50
agaaccauuucuaguuuucau

SEQ ID NO: 2046737 - RNA, 13 nt, Staphylococcus aureus subsp. aureus Mu50
agaacgcuuuauu

SEQ ID NO: 2046738 - RNA, 15 nt, Staphylococcus aureus subsp. aureus Mu50
agaacuuuucaaaca

SEQ ID NO: 2046739 - RNA, 15 nt, Staphylococcus aureus subsp. aureus Mu50
agaacuuuaauaaug

SEQ ID NO: 2046740 - RNA, 15 nt, Staphylococcus aureus subsp. aureus Mu50
agaacuauuuuaaau

SEQ ID NO: 2046741 - RNA, 19 nt, Staphylococcus aureus subsp. aureus Mu50
agaacuauuuuaaauuaca

SEQ ID NO: 2046742 - RNA, 16 nt, Staphylococcus aureus subsp. aureus Mu50
agaacagcacauuuuu

SEQ ID NO: 2046743 - RNA, 19 nt, Staphylococcus aureus subsp. aureus Mu50
agaaauuagaaccaucauu

SEQ ID NO: 2046744 - RNA, 19 nt, Staphylococcus aureus subsp. aureus Mu50
agaaauugugcuuuuccau

SEQ ID NO: 2046745 - RNA, 21 nt, Staphylococcus aureus subsp. aureus Mu50
agaaauuguguuucuuuuauu

SEQ ID NO: 2046746 - RNA, 12 nt, Staphylococcus aureus subsp. aureus Mu50
agaaauucuaca

SEQ ID NO: 2046747 - RNA, 18 nt, Staphylococcus aureus subsp. aureus Mu50
agaaauucuacaaacaau

SEQ ID NO: 2046748 - RNA, 16 nt, Staphylococcus aureus subsp. aureus Mu50
agaaauucuacaggua

SEQ ID NO: 2046749 - RNA, 21 nt, Staphylococcus aureus subsp. aureus Mu50
agaaauucgaaaagaaauucu

SEQ ID NO: 2046750 - RNA, 13 nt, Staphylococcus aureus subsp. aureus Mu50
agaaaucuauaac

SEQ ID NO: 2046751 - RNA, 22 nt, Staphylococcus aureus subsp. aureus Mu50
agaaauguuaacgauagacauu

SEQ ID NO: 2046752 - RNA, 17 nt, Staphylococcus aureus subsp. aureus Mu50
agaaagcuaauaucaau

SEQ ID NO: 2046753 - RNA, 16 nt, Staphylococcus aureus subsp. aureus Mu50
agaaaaucauucauuu

SEQ ID NO: 2046754 - RNA, 18 nt, Staphylococcus aureus subsp. aureus Mu50
acuuccugcuuuuuuuau

SEQ ID NO: 2046755 - RNA, 14 nt, Staphylococcus aureus subsp. aureus Mu50
acuuccuuagucaa

SEQ ID NO: 2046756 - RNA, 14 nt, Staphylococcus aureus subsp. aureus Mu50
acuuccuuccauuc

SEQ ID NO: 2046757 - RNA, 19 nt, Staphylococcus aureus subsp. aureus Mu50
acuucgccaagccaucuuu

SEQ ID NO: 2046758 - RNA, 15 nt, Staphylococcus aureus subsp. aureus Mu50
acuuugucauuuuga

SEQ ID NO: 2046759 - RNA, 14 nt, Staphylococcus aureus subsp. aureus Mu50
acuuugucuguauu

SEQ ID NO: 2046760 - RNA, 22 nt, Staphylococcus aureus subsp. aureus Mu50
acuuuguuuucaguaacugauu

SEQ ID NO: 2046761 - RNA, 22 nt, Staphylococcus aureus subsp. aureus Mu50
acuuuuagaguuuuuauuauua

SEQ ID NO: 2046762 - RNA, 23 nt, Staphylococcus aureus subsp. aureus Mu50
acuuuuggucuguugaagucaau

SEQ ID NO: 2046763 - RNA, 19 nt, Staphylococcus aureus subsp. aureus Mu50
acuuuuguaaaaaaagaca

SEQ ID NO: 2046764 - RNA, 16 nt, Staphylococcus aureus subsp. aureus Mu50
acuuuuguuaaaaaau

SEQ ID NO: 2046765 - RNA, 14 nt, Staphylococcus aureus subsp. aureus Mu50
acuuuuuaauaauu

SEQ ID NO: 2046766 - RNA, 23 nt, Staphylococcus aureus subsp. aureus Mu50
acuuuuuacuaggaauauaaaac

SEQ ID NO: 2046767 - RNA, 17 nt, Staphylococcus aureus subsp. aureus Mu50
acuuuuuauaucaaaau

SEQ ID NO: 2046768 - RNA, 21 nt, Staphylococcus aureus subsp. aureus Mu50
acuuuuuauuaguauucaaaa

SEQ ID NO: 2046769 - RNA, 16 nt, Staphylococcus aureus subsp. aureus Mu50
acuuuuuuuaauuuga

SEQ ID NO: 2046770 - RNA, 18 nt, Staphylococcus aureus subsp. aureus Mu50
agaaaacauaaauacaaa

SEQ ID NO: 2046771 - RNA, 17 nt, Staphylococcus aureus subsp. aureus Mu50
agauauuuucuucucaa

SEQ ID NO: 2046772 - RNA, 13 nt, Staphylococcus aureus subsp. aureus Mu50
agauaucauaaua

SEQ ID NO: 2046773 - RNA, 22 nt, Staphylococcus aureus subsp. aureus Mu50
agauaggauuugcaccuauacc

SEQ ID NO: 2046774 - RNA, 14 nt, Staphylococcus aureus subsp. aureus Mu50
agauagcuauauuu

SEQ ID NO: 2046775 - RNA, 17 nt, Staphylococcus aureus subsp. aureus Mu50
agauagcggauuuauuu

SEQ ID NO: 2046776 - RNA, 13 nt, Staphylococcus aureus subsp. aureus Mu50
agauacguuauuu

SEQ ID NO: 2046777 - RNA, 21 nt, Staphylococcus aureus subsp. aureus Mu50
agauccauaaggauuuuuaau

SEQ ID NO: 2046778 - RNA, 18 nt, Staphylococcus aureus subsp. aureus Mu50
agaucauuaaaaacgauu

SEQ ID NO: 2046779 - RNA, 15 nt, Staphylococcus aureus subsp. aureus Mu50
agaggcuuuaaaauu

SEQ ID NO: 2046780 - RNA, 21 nt, Staphylococcus aureus subsp. aureus Mu50
agagguaaaucuguuuaaauu

SEQ ID NO: 2046781 - RNA, 18 nt, Staphylococcus aureus subsp. aureus Mu50
agauaaguaauaauauaa

SEQ ID NO: 2046782 - RNA, 16 nt, Staphylococcus aureus subsp. aureus Mu50
agaguuuuuauuauua

SEQ ID NO: 2046783 - RNA, 15 nt, Staphylococcus aureus subsp. aureus Mu50
agaguuaaagucaua

SEQ ID NO: 2046784 - RNA, 21 nt, Staphylococcus aureus subsp. aureus Mu50
agaucuuuguaugcaucaguu

SEQ ID NO: 2046785 - RNA, 20 nt, Staphylococcus aureus subsp. aureus Mu50
agauguugguucaucaaaca

SEQ ID NO: 2046786 - RNA, 12 nt, Staphylococcus aureus subsp. aureus Mu50
agaugcauaaaa

SEQ ID NO: 2046787 - RNA, 23 nt, Staphylococcus aureus subsp. aureus Mu50
agaugacuguagaaaacaugcuu

SEQ ID NO: 2046788 - RNA, 15 nt, Staphylococcus aureus subsp. aureus Mu50
agaugaauaauguuu

SEQ ID NO: 2046789 - RNA, 16 nt, Staphylococcus aureus subsp. aureus Mu50
agacuucguugcacuu

SEQ ID NO: 2046790 - RNA, 23 nt, Staphylococcus aureus subsp. aureus Mu50
agacuugguuacuuaguaaggaa

SEQ ID NO: 2046791 - RNA, 17 nt, Staphylococcus aureus subsp. aureus Mu50
agacuuauucaacguau

SEQ ID NO: 2046792 - RNA, 15 nt, Staphylococcus aureus subsp. aureus Mu50
agacugccaauaaaa

SEQ ID NO: 2046793 - RNA, 19 nt, Staphylococcus aureus subsp. aureus Mu50
agacugccaauaaaaugca

SEQ ID NO: 2046794 - RNA, 14 nt, Staphylococcus aureus subsp. aureus Mu50
agacguuuuuuuau

SEQ ID NO: 2046795 - RNA, 13 nt, Staphylococcus aureus subsp. aureus Mu50
agacuaaaaugaa

SEQ ID NO: 2046796 - RNA, 19 nt, Staphylococcus aureus subsp. aureus Mu50
agacuagccauaccuuauu

SEQ ID NO: 2046797 - RNA, 14 nt, Staphylococcus aureus subsp. aureus Mu50
agacuauaggucuu

SEQ ID NO: 2046798 - RNA, 16 nt, Staphylococcus aureus subsp. aureus Mu50
agacauuuuaucugaa

SEQ ID NO: 2046799 - RNA, 13 nt, Staphylococcus aureus subsp. aureus Mu50
agacaacauuguu

SEQ ID NO: 2046800 - RNA, 17 nt, Staphylococcus aureus subsp. aureus Mu50
agacaauauuuuuacau

SEQ ID NO: 2046801 - RNA, 16 nt, Staphylococcus aureus subsp. aureus Mu50
agaauuuuaauuaauu

SEQ ID NO: 2046802 - RNA, 21 nt, Staphylococcus aureus subsp. aureus Mu50
agaauuuuaauuaauuaucau

SEQ ID NO: 2046803 - RNA, 15 nt, Staphylococcus aureus subsp. aureus Mu50
acgcuguuuuaaauu

SEQ ID NO: 2046804 - RNA, 16 nt, Staphylococcus aureus subsp. aureus Mu50
acgcugauuuaauagc

SEQ ID NO: 2046805 - RNA, 20 nt, Staphylococcus aureus subsp. aureus Mu50
acgcuucauauaaagucgua

SEQ ID NO: 2046806 - RNA, 23 nt, Staphylococcus aureus subsp. aureus Mu50
acgcuuuuuaaaaaauuuaaaua

SEQ ID NO: 2046807 - RNA, 12 nt, Staphylococcus aureus subsp. aureus Mu50
aaacacuauaaa

SEQ ID NO: 2046808 - RNA, 15 nt, Staphylococcus aureus subsp. aureus Mu50
aaacacucaaaaugu

SEQ ID NO: 2046809 - RNA, 16 nt, Staphylococcus aureus subsp. aureus Mu50
aaacacaguacaaaua

SEQ ID NO: 2046810 - RNA, 19 nt, Staphylococcus aureus subsp. aureus Mu50
aaacacccugcuuaucauu

SEQ ID NO: 2046811 - RNA, 22 nt, Staphylococcus aureus subsp. aureus Mu50
aaacauaauuaccuuuccauuc

SEQ ID NO: 2046812 - RNA, 22 nt, Staphylococcus aureus subsp. aureus Mu50
aaacauaguuucuucuauuaua

SEQ ID NO: 2046813 - RNA, 14 nt, Staphylococcus aureus subsp. aureus Mu50
aaacagcaaauaaa

SEQ ID NO: 2046814 - RNA, 20 nt, Staphylococcus aureus subsp. aureus Mu50
acgugcuuuuaaauguauuu

SEQ ID NO: 2046815 - RNA, 14 nt, Staphylococcus aureus subsp. aureus Mu50
acgugcaaauaaaa

SEQ ID NO: 2046816 - RNA, 21 nt, Staphylococcus aureus subsp. aureus Mu50
acguaucaucaaaguuuaauu

SEQ ID NO: 2046817 - RNA, 15 nt, Staphylococcus aureus subsp. aureus Mu50
acguaucaaaauuuu

SEQ ID NO: 2046818 - RNA, 20 nt, Staphylococcus aureus subsp. aureus Mu50
acguauacuuucgaucuucu

SEQ ID NO: 2046819 - RNA, 19 nt, Staphylococcus aureus subsp. aureus Mu50
acguauauaaguuaaaauu

SEQ ID NO: 2046820 - RNA, 20 nt, Staphylococcus aureus subsp. aureus Mu50
acguauauaaguuaaaauug

SEQ ID NO: 2046821 - RNA, 15 nt, Staphylococcus aureus subsp. aureus Mu50
acguauauacgauug

SEQ ID NO: 2046822 - RNA, 23 nt, Staphylococcus aureus subsp. aureus Mu50
acguauauacgauugaguugaaa

SEQ ID NO: 2046823 - RNA, 20 nt, Staphylococcus aureus subsp. aureus Mu50
acguuuuaaagguuaaauau

SEQ ID NO: 2046824 - RNA, 12 nt, Staphylococcus aureus subsp. aureus Mu50
acguuuuaaaua

SEQ ID NO: 2046825 - RNA, 13 nt, Staphylococcus aureus subsp. aureus Mu50
acguuuuaaauaa

SEQ ID NO: 2046826 - RNA, 21 nt, Staphylococcus aureus subsp. aureus Mu50
acguuuucuagguaauacgaa

SEQ ID NO: 2046827 - RNA, 14 nt, Staphylococcus aureus subsp. aureus Mu50
acuaaaaguguuau

SEQ ID NO: 2046828 - RNA, 19 nt, Staphylococcus aureus subsp. aureus Mu50
acuaaaaguguuaugaauu

SEQ ID NO: 2046829 - RNA, 21 nt, Staphylococcus aureus subsp. aureus Mu50
acguuuuucuuuaaacgcauc

SEQ ID NO: 2046830 - RNA, 19 nt, Staphylococcus aureus subsp. aureus Mu50
acguuucaauguaucaaga

SEQ ID NO: 2046831 - RNA, 17 nt, Staphylococcus aureus subsp. aureus Mu50
acguuucguugcugaua

SEQ ID NO: 2046832 - RNA, 14 nt, Staphylococcus aureus subsp. aureus Mu50
acguucauggauuc

SEQ ID NO: 2046833 - RNA, 13 nt, Staphylococcus aureus subsp. aureus Mu50
acguuauuuuuug

SEQ ID NO: 2046834 - RNA, 19 nt, Staphylococcus aureus subsp. aureus Mu50
acuacaagucauuauccaa

SEQ ID NO: 2046835 - RNA, 18 nt, Staphylococcus aureus subsp. aureus Mu50
acuaauuuagacaucauu

SEQ ID NO: 2046836 - RNA, 13 nt, Staphylococcus aureus subsp. aureus Mu50
acuaauuuaaagc

SEQ ID NO: 2046837 - RNA, 15 nt, Staphylococcus aureus subsp. aureus Mu50
acuaauuuaaagcau

SEQ ID NO: 2046838 - RNA, 20 nt, Staphylococcus aureus subsp. aureus Mu50
acuaauugaucagcauuuaa

SEQ ID NO: 2046839 - RNA, 19 nt, Staphylococcus aureus subsp. aureus Mu50
acuaagauuagcuaugaag

SEQ ID NO: 2046840 - RNA, 17 nt, Staphylococcus aureus subsp. aureus Mu50
acuaaucuuuuuuuaau

SEQ ID NO: 2046841 - RNA, 23 nt, Staphylococcus aureus subsp. aureus Mu50
acuaagcuuucauuaauuuuuca

SEQ ID NO: 2046842 - RNA, 21 nt, Staphylococcus aureus subsp. aureus Mu50
acuaagucguucaauuguuga

SEQ ID NO: 2046843 - RNA, 22 nt, Staphylococcus aureus subsp. aureus Mu50
acuaagucguucaauuguugau

SEQ ID NO: 2046844 - RNA, 13 nt, Staphylococcus aureus subsp. aureus Mu50
acuaaguuuguuu

SEQ ID NO: 2046845 - RNA, 21 nt, Staphylococcus aureus subsp. aureus Mu50
acuaauaugauugguuuguga

SEQ ID NO: 2046846 - RNA, 22 nt, Staphylococcus aureus subsp. aureus Mu50
acuaauaugauugguuugugau

SEQ ID NO: 2046847 - RNA, 18 nt, Staphylococcus aureus subsp. aureus Mu50
acuaaucguuguggcuuu

SEQ ID NO: 2046848 - RNA, 17 nt, Staphylococcus aureus subsp. aureus Mu50
acuaacauaauuuuuau

SEQ ID NO: 2046849 - RNA, 13 nt, Staphylococcus aureus subsp. aureus Mu50
acuaacauguuau

SEQ ID NO: 2046850 - RNA, 14 nt, Staphylococcus aureus subsp. aureus Mu50
acuaaauaugcuuu

SEQ ID NO: 2046851 - RNA, 21 nt, Staphylococcus aureus subsp. aureus Mu50
acuaaauguucuggaauaccu

SEQ ID NO: 2046852 - RNA, 22 nt, Staphylococcus aureus subsp. aureus Mu50
acuaaauguucuggaauaccua

SEQ ID NO: 2046853 - RNA, 13 nt, Staphylococcus aureus subsp. aureus Mu50
acuaaaucauuuu

SEQ ID NO: 2046854 - RNA, 16 nt, Staphylococcus aureus subsp. aureus Mu50
acuaccuguuggcuuu

SEQ ID NO: 2046855 - RNA, 18 nt, Staphylococcus aureus subsp. aureus Mu50
acuacgcauuuuaaauaa

SEQ ID NO: 2046856 - RNA, 15 nt, Staphylococcus aureus subsp. aureus Mu50
acuaccuauuaauau

SEQ ID NO: 2046857 - RNA, 15 nt, Staphylococcus aureus subsp. aureus Mu50
acuacaguguaugau

SEQ ID NO: 2046858 - RNA, 22 nt, Staphylococcus aureus subsp. aureus Mu50
acuacuuaaauuaagaauaauc

SEQ ID NO: 2046859 - RNA, 14 nt, Staphylococcus aureus subsp. aureus Mu50
acuacuuuauaaau

SEQ ID NO: 2046860 - RNA, 11 nt, Staphylococcus aureus subsp. aureus Mu50
acuagauaguu

SEQ ID NO: 2046861 - RNA, 17 nt, Staphylococcus aureus subsp. aureus Mu50
acgggaacaucauaauc

SEQ ID NO: 2046862 - RNA, 22 nt, Staphylococcus aureus subsp. aureus Mu50
acggugaaaguucauuacaaac

SEQ ID NO: 2046863 - RNA, 22 nt, Staphylococcus aureus subsp. aureus Mu50
acgguaucaucugcauuuaauu

SEQ ID NO: 2046864 - RNA, 14 nt, Staphylococcus aureus subsp. aureus Mu50
acgguaacuuuuua

SEQ ID NO: 2046865 - RNA, 18 nt, Staphylococcus aureus subsp. aureus Mu50
acgguaacuuuuuacauu

SEQ ID NO: 2046866 - RNA, 13 nt, Staphylococcus aureus subsp. aureus Mu50
aaaauuaauaauu

SEQ ID NO: 2046867 - RNA, 17 nt, Staphylococcus aureus subsp. aureus Mu50
aaaauuguucaauauuu

SEQ ID NO: 2046868 - RNA, 15 nt, Staphylococcus aureus subsp. aureus Mu50
aaaauugguuuggau

SEQ ID NO: 2046869 - RNA, 21 nt, Staphylococcus aureus subsp. aureus Mu50
acccaucauguacaguuacuu

SEQ ID NO: 2046870 - RNA, 21 nt, Staphylococcus aureus subsp. aureus Mu50
accauuugcuggcgcaaugau

SEQ ID NO: 2046871 - RNA, 11 nt, Staphylococcus aureus subsp. aureus Mu50
accauuuacuu

SEQ ID NO: 2046872 - RNA, 16 nt, Staphylococcus aureus subsp. aureus Mu50
accauaucaaguuuua

SEQ ID NO: 2046873 - RNA, 23 nt, Staphylococcus aureus subsp. aureus Mu50
aaaaugaagaauacaaauauuaa

SEQ ID NO: 2046874 - RNA, 20 nt, Staphylococcus aureus subsp. aureus Mu50
aaaauacuuuuugaugauuu

SEQ ID NO: 2046875 - RNA, 16 nt, Staphylococcus aureus subsp. aureus Mu50
aaaauagaaaaauuuc

SEQ ID NO: 2046876 - RNA, 16 nt, Staphylococcus aureus subsp. aureus Mu50
accaguucgaaaauua

SEQ ID NO: 2046877 - RNA, 15 nt, Staphylococcus aureus subsp. aureus Mu50
aaaaucauuaauaau

SEQ ID NO: 2046878 - RNA, 19 nt, Staphylococcus aureus subsp. aureus Mu50
aaaauauguguuaacugau

SEQ ID NO: 2046879 - RNA, 22 nt, Staphylococcus aureus subsp. aureus Mu50
aaaauauuacuaacaaccguuu

SEQ ID NO: 2046880 - RNA, 16 nt, Staphylococcus aureus subsp. aureus Mu50
accaugccagcuucua

SEQ ID NO: 2046881 - RNA, 17 nt, Staphylococcus aureus subsp. aureus Mu50
accaguauaaccaugua

SEQ ID NO: 2046882 - RNA, 14 nt, Staphylococcus aureus subsp. aureus Mu50
accaguauaauuuu

SEQ ID NO: 2046883 - RNA, 12 nt, Staphylococcus aureus subsp. aureus Mu50
acauaaaauuua

SEQ ID NO: 2046884 - RNA, 21 nt, Staphylococcus aureus subsp. aureus Mu50
acaguuaugccugaagcgcuu

SEQ ID NO: 2046885 - RNA, 14 nt, Staphylococcus aureus subsp. aureus Mu50
acaguuuuuauauu

SEQ ID NO: 2046886 - RNA, 14 nt, Staphylococcus aureus subsp. aureus Mu50
acaguuacuucagu

SEQ ID NO: 2046887 - RNA, 13 nt, Staphylococcus aureus subsp. aureus Mu50
acaguaaguaaua

SEQ ID NO: 2046888 - RNA, 19 nt, Staphylococcus aureus subsp. aureus Mu50
acaguguugaauuucaaaa

SEQ ID NO: 2046889 - RNA, 12 nt, Staphylococcus aureus subsp. aureus Mu50
acauaauucaau

SEQ ID NO: 2046890 - RNA, 17 nt, Staphylococcus aureus subsp. aureus Mu50
acauaaccgaugugauu

SEQ ID NO: 2046891 - RNA, 15 nt, Staphylococcus aureus subsp. aureus Mu50
accgcacuucuauau

SEQ ID NO: 2046892 - RNA, 20 nt, Staphylococcus aureus subsp. aureus Mu50
accucuaggauuaaaagcau

SEQ ID NO: 2046893 - RNA, 19 nt, Staphylococcus aureus subsp. aureus Mu50
accucuuuuguuuaguaug

SEQ ID NO: 2046894 - RNA, 19 nt, Staphylococcus aureus subsp. aureus Mu50
accuacguguguaguagca

SEQ ID NO: 2046895 - RNA, 19 nt, Staphylococcus aureus subsp. aureus Mu50
accuacuaauauauuaauu

SEQ ID NO: 2046896 - RNA, 19 nt, Staphylococcus aureus subsp. aureus Mu50
accuacuuuuucaauaugu

SEQ ID NO: 2046897 - RNA, 20 nt, Staphylococcus aureus subsp. aureus Mu50
accuaaagauaauauuaaau

SEQ ID NO: 2046898 - RNA, 13 nt, Staphylococcus aureus subsp. aureus Mu50
accuacaacacca

SEQ ID NO: 2046899 - RNA, 18 nt, Staphylococcus aureus subsp. aureus Mu50
accuaauucgccaucuuu

SEQ ID NO: 2046900 - RNA, 18 nt, Staphylococcus aureus subsp. aureus Mu50
accuaauugcuuaauauc

SEQ ID NO: 2046901 - RNA, 16 nt, Staphylococcus aureus subsp. aureus Mu50
accuaaucugcaacga

SEQ ID NO: 2046902 - RNA, 14 nt, Staphylococcus aureus subsp. aureus Mu50
accuaaaauaccca

SEQ ID NO: 2046903 - RNA, 20 nt, Staphylococcus aureus subsp. aureus Mu50
accuaaaucuccugcugcua

SEQ ID NO: 2046904 - RNA, 18 nt, Staphylococcus aureus subsp. aureus Mu50
accuaaaugauuaauaac

SEQ ID NO: 2046905 - RNA, 21 nt, Staphylococcus aureus subsp. aureus Mu50
accguuaguacggcugcuuua

SEQ ID NO: 2046906 - RNA, 17 nt, Staphylococcus aureus subsp. aureus Mu50
accgugguucaaaaauc

SEQ ID NO: 2046907 - RNA, 16 nt, Staphylococcus aureus subsp. aureus Mu50
accuuguucuuuacuc

SEQ ID NO: 2046908 - RNA, 15 nt, Staphylococcus aureus subsp. aureus Mu50
accuuguuaaaauaa

SEQ ID NO: 2046909 - RNA, 21 nt, Staphylococcus aureus subsp. aureus Mu50
acgaaaaaugccaacuauacc

SEQ ID NO: 2046910 - RNA, 21 nt, Staphylococcus aureus subsp. aureus Mu50
accuuuuuguuuucaauaauu

SEQ ID NO: 2046911 - RNA, 17 nt, Staphylococcus aureus subsp. aureus Mu50
accuuuaauaauauuga

SEQ ID NO: 2046912 - RNA, 23 nt, Staphylococcus aureus subsp. aureus Mu50
accuuuccauucguauaagaauc

SEQ ID NO: 2046913 - RNA, 12 nt, Staphylococcus aureus subsp. aureus Mu50
accuuugucuuu

SEQ ID NO: 2046914 - RNA, 14 nt, Staphylococcus aureus subsp. aureus Mu50
acgaauuaaaauaa

SEQ ID NO: 2046915 - RNA, 22 nt, Staphylococcus aureus subsp. aureus Mu50
acgaagcgaguuauauuguuaa

SEQ ID NO: 2046916 - RNA, 21 nt, Staphylococcus aureus subsp. aureus Mu50
acgaauaucuuaaagaauuaa

SEQ ID NO: 2046917 - RNA, 14 nt, Staphylococcus aureus subsp. aureus Mu50
acgaaguuuaaaug

SEQ ID NO: 2046918 - RNA, 13 nt, Staphylococcus aureus subsp. aureus Mu50
acgcaauaucaua

SEQ ID NO: 2046919 - RNA, 18 nt, Staphylococcus aureus subsp. aureus Mu50
acgauuuauuaguuuuua

SEQ ID NO: 2046920 - RNA, 14 nt, Staphylococcus aureus subsp. aureus Mu50
acgauuuuuaaaau

SEQ ID NO: 2046921 - RNA, 18 nt, Staphylococcus aureus subsp. aureus Mu50
acgauuaauaaaauucua

SEQ ID NO: 2046922 - RNA, 22 nt, Staphylococcus aureus subsp. aureus Mu50
acgauuaauaaaauucuauaau

SEQ ID NO: 2046923 - RNA, 15 nt, Staphylococcus aureus subsp. aureus Mu50
acgauugaacaucuc

SEQ ID NO: 2046924 - RNA, 18 nt, Staphylococcus aureus subsp. aureus Mu50
acgcacuaucaaugacau

SEQ ID NO: 2046925 - RNA, 15 nt, Staphylococcus aureus subsp. aureus Mu50
acgcacuauuuuuau

SEQ ID NO: 2046926 - RNA, 16 nt, Staphylococcus aureus subsp. aureus Mu50
acgcacaucuaaguga

SEQ ID NO: 2046927 - RNA, 15 nt, Staphylococcus aureus subsp. aureus Mu50
acgcaauuuaauauu

SEQ ID NO: 2046928 - RNA, 20 nt, Staphylococcus aureus subsp. aureus Mu50
acgauaacagcuacaaauaa

SEQ ID NO: 2046929 - RNA, 13 nt, Staphylococcus aureus subsp. aureus Mu50
acgauaauuauac

SEQ ID NO: 2046930 - RNA, 16 nt, Staphylococcus aureus subsp. aureus Mu50
acgauagauuuaucac

SEQ ID NO: 2046931 - RNA, 17 nt, Staphylococcus aureus subsp. aureus Mu50
acgauaauuauacguua

SEQ ID NO: 2046932 - RNA, 23 nt, Staphylococcus aureus subsp. aureus Mu50
acgauauaacauuaaaaugauau

SEQ ID NO: 2046933 - RNA, 14 nt, Staphylococcus aureus subsp. aureus Mu50
acgaguauuaucac

SEQ ID NO: 2046934 - RNA, 20 nt, Staphylococcus aureus subsp. aureus Mu50
acgaggucuuuuuacugacu

SEQ ID NO: 2046935 - RNA, 23 nt, Staphylococcus aureus subsp. aureus Mu50
aaacacacuaaaagcugauguga

SEQ ID NO: 2046936 - RNA, 15 nt, Staphylococcus aureus subsp. aureus Mu50
acgacgguauaaaaa

SEQ ID NO: 2046937 - RNA, 12 nt, Staphylococcus aureus subsp. aureus Mu50
aaacaaaaaggu

SEQ ID NO: 2046938 - RNA, 19 nt, Staphylococcus aureus subsp. aureus Mu50
aaaauuuuaauuaauuauu

SEQ ID NO: 2046939 - RNA, 22 nt, Staphylococcus aureus subsp. aureus Mu50
aaaauuuuaauuaauuauuaua

SEQ ID NO: 2046940 - RNA, 19 nt, Staphylococcus aureus subsp. aureus Mu50
aaacaauaugaauuggaug

SEQ ID NO: 2046941 - RNA, 16 nt, Staphylococcus aureus subsp. aureus Mu50
aaacaauaaaauuacu

SEQ ID NO: 2046942 - RNA, 23 nt, Staphylococcus aureus subsp. aureus Mu50
aaacaauacguuuucggauugaa

SEQ ID NO: 2046943 - RNA, 16 nt, Staphylococcus aureus subsp. aureus Mu50
aaacaaucguugaaga

SEQ ID NO: 2046944 - RNA, 15 nt, Staphylococcus aureus subsp. aureus Mu50
aaacaauuuguaacu

SEQ ID NO: 2046945 - RNA, 12 nt, Staphylococcus aureus subsp. aureus Mu50
aaacaaauuaca

SEQ ID NO: 2046946 - RNA, 15 nt, Staphylococcus aureus subsp. aureus Mu50
aaacaacaaucaaau

SEQ ID NO: 2046947 - RNA, 15 nt, Staphylococcus aureus subsp. aureus Mu50
aaacaacugagucaa

SEQ ID NO: 2046948 - RNA, 21 nt, Staphylococcus aureus subsp. aureus Mu50
aagacagcuucucauugaaau

SEQ ID NO: 2046949 - RNA, 11 nt, Staphylococcus aureus subsp. aureus Mu50
aagacagaaau

SEQ ID NO: 2046950 - RNA, 15 nt, Staphylococcus aureus subsp. aureus Mu50
aagaauuuaaaagag

SEQ ID NO: 2046951 - RNA, 14 nt, Staphylococcus aureus subsp. aureus Mu50
aagaaugauacugu

SEQ ID NO: 2046952 - RNA, 20 nt, Staphylococcus aureus subsp. aureus Mu50
aagaaugccuuuuauuuauc

SEQ ID NO: 2046953 - RNA, 19 nt, Staphylococcus aureus subsp. aureus Mu50
aagaaugcgaagauuuuua

SEQ ID NO: 2046954 - RNA, 19 nt, Staphylococcus aureus subsp. aureus Mu50
aagaauguacaauuuuuua

SEQ ID NO: 2046955 - RNA, 13 nt, Staphylococcus aureus subsp. aureus Mu50
aagaaaucuauaa

SEQ ID NO: 2046956 - RNA, 20 nt, Staphylococcus aureus subsp. aureus Mu50
aagaaauguuaaauuaaauc

SEQ ID NO: 2046957 - RNA, 14 nt, Staphylococcus aureus subsp. aureus Mu50
aagaaauucuacaa

SEQ ID NO: 2046958 - RNA, 15 nt, Staphylococcus aureus subsp. aureus Mu50
aagaacuauuuuaaa

SEQ ID NO: 2046959 - RNA, 14 nt, Staphylococcus aureus subsp. aureus Mu50
aagaaccgauauuu

SEQ ID NO: 2046960 - RNA, 18 nt, Staphylococcus aureus subsp. aureus Mu50
aagaaccgauauuucuga

SEQ ID NO: 2046961 - RNA, 19 nt, Staphylococcus aureus subsp. aureus Mu50
aagaaacaauucauuaaua

SEQ ID NO: 2046962 - RNA, 16 nt, Staphylococcus aureus subsp. aureus Mu50
aacuuuaucacuguau

SEQ ID NO: 2046963 - RNA, 13 nt, Staphylococcus aureus subsp. aureus Mu50
aacuuuuauuauc

SEQ ID NO: 2046964 - RNA, 15 nt, Staphylococcus aureus subsp. aureus Mu50
aacuuuuauuuuuua

SEQ ID NO: 2046965 - RNA, 15 nt, Staphylococcus aureus subsp. aureus Mu50
aacuuuauggggugu

SEQ ID NO: 2046966 - RNA, 16 nt, Staphylococcus aureus subsp. aureus Mu50
aacuuucacucauauu

SEQ ID NO: 2046967 - RNA, 12 nt, Staphylococcus aureus subsp. aureus Mu50
aacuuucagcac

SEQ ID NO: 2046968 - RNA, 13 nt, Staphylococcus aureus subsp. aureus Mu50
aacuuuaauuaaa

SEQ ID NO: 2046969 - RNA, 18 nt, Staphylococcus aureus subsp. aureus Mu50
aacuuuauauaagucaua

SEQ ID NO: 2046970 - RNA, 21 nt, Staphylococcus aureus subsp. aureus Mu50
aacuuuauauauaaagaaaua

SEQ ID NO: 2046971 - RNA, 13 nt, Staphylococcus aureus subsp. aureus Mu50
aacuuaauuaaaa

SEQ ID NO: 2046972 - RNA, 22 nt, Staphylococcus aureus subsp. aureus Mu50
aacugucgcucauccucauuaa

SEQ ID NO: 2046973 - RNA, 19 nt, Staphylococcus aureus subsp. aureus Mu50
aacuuauuugccauauaca

SEQ ID NO: 2046974 - RNA, 19 nt, Staphylococcus aureus subsp. aureus Mu50
aacuucauaauauauccug

SEQ ID NO: 2046975 - RNA, 21 nt, Staphylococcus aureus subsp. aureus Mu50
aacuuagcuuagucaauguau

SEQ ID NO: 2046976 - RNA, 15 nt, Staphylococcus aureus subsp. aureus Mu50
aacuuagaauuuaca

SEQ ID NO: 2046977 - RNA, 18 nt, Staphylococcus aureus subsp. aureus Mu50
aacuuccuaaaauuuaca

SEQ ID NO: 2046978 - RNA, 15 nt, Staphylococcus aureus subsp. aureus Mu50
aacuuccaacauaua

SEQ ID NO: 2046979 - RNA, 22 nt, Staphylococcus aureus subsp. aureus Mu50
aacuugagcuauucauagaccu

SEQ ID NO: 2046980 - RNA, 14 nt, Staphylococcus aureus subsp. aureus Mu50
aacuucuuguuuca

SEQ ID NO: 2046981 - RNA, 20 nt, Staphylococcus aureus subsp. aureus Mu50
aacuuggcaaugaaauuacc

SEQ ID NO: 2046982 - RNA, 20 nt, Staphylococcus aureus subsp. aureus Mu50
aacuuguaaauuuauuuuua

SEQ ID NO: 2046983 - RNA, 16 nt, Staphylococcus aureus subsp. aureus Mu50
aacuuguccguuuuau

SEQ ID NO: 2046984 - RNA, 20 nt, Staphylococcus aureus subsp. aureus Mu50
aacuuguuguuauuuauuug

SEQ ID NO: 2046985 - RNA, 16 nt, Staphylococcus aureus subsp. aureus Mu50
aacugccuaauacacu

SEQ ID NO: 2046986 - RNA, 15 nt, Staphylococcus aureus subsp. aureus Mu50
aacugcauauaaagu

SEQ ID NO: 2046987 - RNA, 21 nt, Staphylococcus aureus subsp. aureus Mu50
aacugcaaacuugauucaaua

SEQ ID NO: 2046988 - RNA, 14 nt, Staphylococcus aureus subsp. aureus Mu50
aacucucuaaaaag

SEQ ID NO: 2046989 - RNA, 17 nt, Staphylococcus aureus subsp. aureus Mu50
aacucuaaaaguuguaa

SEQ ID NO: 2046990 - RNA, 21 nt, Staphylococcus aureus subsp. aureus Mu50
aacucuaaaaguuguaauuua

SEQ ID NO: 2046991 - RNA, 17 nt, Staphylococcus aureus subsp. aureus Mu50
aacucuaaauauaauag

SEQ ID NO: 2046992 - RNA, 22 nt, Staphylococcus aureus subsp. aureus Mu50
aacucuaaauauaauagaaaua

SEQ ID NO: 2046993 - RNA, 19 nt, Staphylococcus aureus subsp. aureus Mu50
aacucaugcauaagaaaua

SEQ ID NO: 2046994 - RNA, 12 nt, Staphylococcus aureus subsp. aureus Mu50
aaccuuaaauau

SEQ ID NO: 2046995 - RNA, 16 nt, Staphylococcus aureus subsp. aureus Mu50
aacgagucauaaauau

SEQ ID NO: 2046996 - RNA, 16 nt, Staphylococcus aureus subsp. aureus Mu50
aaccguaauuuuaaug

SEQ ID NO: 2046997 - RNA, 17 nt, Staphylococcus aureus subsp. aureus Mu50
aaccguguucuuuaaug

SEQ ID NO: 2046998 - RNA, 19 nt, Staphylococcus aureus subsp. aureus Mu50
aaccucuuuuuguuguugu

SEQ ID NO: 2046999 - RNA, 15 nt, Staphylococcus aureus subsp. aureus Mu50
aaccuacaauauaga

SEQ ID NO: 2047000 - RNA, 18 nt, Staphylococcus aureus subsp. aureus Mu50
aaccuaaagauaauauua

SEQ ID NO: 2047001 - RNA, 14 nt, Staphylococcus aureus subsp. aureus Mu50
aaccuaaagauaua

SEQ ID NO: 2047002 - RNA, 14 nt, Staphylococcus aureus subsp. aureus Mu50
aaccuauuaaaucu

SEQ ID NO: 2047003 - RNA, 22 nt, Staphylococcus aureus subsp. aureus Mu50
aaccuauuuuuuauaugaugaa

SEQ ID NO: 2047004 - RNA, 13 nt, Staphylococcus aureus subsp. aureus Mu50
aacacgcucuuuu

SEQ ID NO: 2047005 - RNA, 15 nt, Staphylococcus aureus subsp. aureus Mu50
aacacgcucuuuuca

SEQ ID NO: 2047006 - RNA, 15 nt, Staphylococcus aureus subsp. aureus Mu50
aacacucaaaauguu

SEQ ID NO: 2047007 - RNA, 19 nt, Staphylococcus aureus subsp. aureus Mu50
aauauugaugaauaaauag

SEQ ID NO: 2047008 - RNA, 18 nt, Staphylococcus aureus subsp. aureus Mu50
aauauugaagaugcuuua

SEQ ID NO: 2047009 - RNA, 15 nt, Staphylococcus aureus subsp. aureus Mu50
aauauugauaucgaa

SEQ ID NO: 2047010 - RNA, 14 nt, Staphylococcus aureus subsp. aureus Mu50
aauauuuaaacuag

SEQ ID NO: 2047011 - RNA, 18 nt, Staphylococcus aureus subsp. aureus Mu50
aauauuuaaauuuuaagu

SEQ ID NO: 2047012 - RNA, 16 nt, Staphylococcus aureus subsp. aureus Mu50
aauauuggacuuugcu

SEQ ID NO: 2047013 - RNA, 17 nt, Staphylococcus aureus subsp. aureus Mu50
aauauuauuaaaucaaa

SEQ ID NO: 2047014 - RNA, 20 nt, Staphylococcus aureus subsp. aureus Mu50
aauauuauucauaauauauu

SEQ ID NO: 2047015 - RNA, 21 nt, Staphylococcus aureus subsp. aureus Mu50
aauauucguaaauccuuuaua

SEQ ID NO: 2047016 - RNA, 12 nt, Staphylococcus aureus subsp. aureus Mu50
aauaugauauua

SEQ ID NO: 2047017 - RNA, 22 nt, Staphylococcus aureus subsp. aureus Mu50
aauaucuuuuucuaaguuuguu

SEQ ID NO: 2047018 - RNA, 19 nt, Staphylococcus aureus subsp. aureus Mu50
aauaugaaucuagaauaua

SEQ ID NO: 2047019 - RNA, 16 nt, Staphylococcus aureus subsp. aureus Mu50
aauaugagauuaucug

SEQ ID NO: 2047020 - RNA, 14 nt, Staphylococcus aureus subsp. aureus Mu50
aauaugauauugau

SEQ ID NO: 2047021 - RNA, 15 nt, Staphylococcus aureus subsp. aureus Mu50
aauaugcccccuaau

SEQ ID NO: 2047022 - RNA, 15 nt, Staphylococcus aureus subsp. aureus Mu50
aauauggaaaaugua

SEQ ID NO: 2047023 - RNA, 14 nt, Staphylococcus aureus subsp. aureus Mu50
aauauggauuuuga

SEQ ID NO: 2047024 - RNA, 16 nt, Staphylococcus aureus subsp. aureus Mu50
aauauuaaauuucuga

SEQ ID NO: 2047025 - RNA, 18 nt, Staphylococcus aureus subsp. aureus Mu50
aauauuaauauaaaauaa

SEQ ID NO: 2047026 - RNA, 14 nt, Staphylococcus aureus subsp. aureus Mu50
aaucaacccaucau

SEQ ID NO: 2047027 - RNA, 20 nt, Staphylococcus aureus subsp. aureus Mu50
aaucaacuuagaauuuacaa

SEQ ID NO: 2047028 - RNA, 15 nt, Staphylococcus aureus subsp. aureus Mu50
aaucaacgagucaua

SEQ ID NO: 2047029 - RNA, 17 nt, Staphylococcus aureus subsp. aureus Mu50
aaucaauccaucaauac

SEQ ID NO: 2047030 - RNA, 13 nt, Staphylococcus aureus subsp. aureus Mu50
aauauuuuaucug

SEQ ID NO: 2047031 - RNA, 15 nt, Staphylococcus aureus subsp. aureus Mu50
aauauuugaaaauuu

SEQ ID NO: 2047032 - RNA, 13 nt, Staphylococcus aureus subsp. aureus Mu50
aauauuugauaac

SEQ ID NO: 2047033 - RNA, 20 nt, Staphylococcus aureus subsp. aureus Mu50
aauauuucccuaugaaauaa

SEQ ID NO: 2047034 - RNA, 16 nt, Staphylococcus aureus subsp. aureus Mu50
aauauuuauuguuuuu

SEQ ID NO: 2047035 - RNA, 17 nt, Staphylococcus aureus subsp. aureus Mu50
aauauuuauuguuuuua

SEQ ID NO: 2047036 - RNA, 13 nt, Staphylococcus aureus subsp. aureus Mu50
aaucaaagauuuu

SEQ ID NO: 2047037 - RNA, 18 nt, Staphylococcus aureus subsp. aureus Mu50
aauauuuucauguccauc

SEQ ID NO: 2047038 - RNA, 15 nt, Staphylococcus aureus subsp. aureus Mu50
aauauuuuucaauua

SEQ ID NO: 2047039 - RNA, 16 nt, Staphylococcus aureus subsp. aureus Mu50
aauauuuuuuaaaaug

SEQ ID NO: 2047040 - RNA, 22 nt, Staphylococcus aureus subsp. aureus Mu50
aauaucaauuuauuauuaacug

SEQ ID NO: 2047041 - RNA, 21 nt, Staphylococcus aureus subsp. aureus Mu50
aauaucaccuuuuuuaagauc

SEQ ID NO: 2047042 - RNA, 18 nt, Staphylococcus aureus subsp. aureus Mu50
aauaucaagauguuugca

SEQ ID NO: 2047043 - RNA, 13 nt, Staphylococcus aureus subsp. aureus Mu50
aauaucaauaauu

SEQ ID NO: 2047044 - RNA, 16 nt, Staphylococcus aureus subsp. aureus Mu50
aauaucaguaauaaua

SEQ ID NO: 2047045 - RNA, 13 nt, Staphylococcus aureus subsp. aureus Mu50
aauauauuuggag

SEQ ID NO: 2047046 - RNA, 20 nt, Staphylococcus aureus subsp. aureus Mu50
aauauauguauaacauuauu

SEQ ID NO: 2047047 - RNA, 20 nt, Staphylococcus aureus subsp. aureus Mu50
aauauauuaacaacuuuauu

SEQ ID NO: 2047048 - RNA, 21 nt, Staphylococcus aureus subsp. aureus Mu50
aauauaguaauaaaagucgau

SEQ ID NO: 2047049 - RNA, 18 nt, Staphylococcus aureus subsp. aureus Mu50
aauauaguaauuguuaua

SEQ ID NO: 2047050 - RNA, 21 nt, Staphylococcus aureus subsp. aureus Mu50
aauauaguggugguacuuuuu

SEQ ID NO: 2047051 - RNA, 15 nt, Staphylococcus aureus subsp. aureus Mu50
aauaucuucuucuaa

SEQ ID NO: 2047052 - RNA, 16 nt, Staphylococcus aureus subsp. aureus Mu50
aauaucuguugcauua

SEQ ID NO: 2047053 - RNA, 20 nt, Staphylococcus aureus subsp. aureus Mu50
aauaugacgaucuucaugaa

SEQ ID NO: 2047054 - RNA, 15 nt, Staphylococcus aureus subsp. aureus Mu50
aauaucgacaaauua

SEQ ID NO: 2047055 - RNA, 17 nt, Staphylococcus aureus subsp. aureus Mu50
aauaucgaugacuuugu

SEQ ID NO: 2047056 - RNA, 17 nt, Staphylococcus aureus subsp. aureus Mu50
aauaucaucuuguuguu

SEQ ID NO: 2047057 - RNA, 17 nt, Staphylococcus aureus subsp. aureus Mu50
aauaucaugcaaaacua

SEQ ID NO: 2047058 - RNA, 20 nt, Staphylococcus aureus subsp. aureus Mu50
aauaucaugggcaguaauuu

SEQ ID NO: 2047059 - RNA, 15 nt, Staphylococcus aureus subsp. aureus Mu50
aauacuguuuaaaua

SEQ ID NO: 2047060 - RNA, 16 nt, Staphylococcus aureus subsp. aureus Mu50
aauacuguuuaaauaa

SEQ ID NO: 2047061 - RNA, 17 nt, Staphylococcus aureus subsp. aureus Mu50
aauacuguuuaaauaaa

SEQ ID NO: 2047062 - RNA, 14 nt, Staphylococcus aureus subsp. aureus Mu50
aauacuuuuuaacu

SEQ ID NO: 2047063 - RNA, 22 nt, Staphylococcus aureus subsp. aureus Mu50
aauauacccagaugaauuuuua

SEQ ID NO: 2047064 - RNA, 15 nt, Staphylococcus aureus subsp. aureus Mu50
aauauaauuuuuuga

SEQ ID NO: 2047065 - RNA, 14 nt, Staphylococcus aureus subsp. aureus Mu50
aauauacacaaaaa

SEQ ID NO: 2047066 - RNA, 20 nt, Staphylococcus aureus subsp. aureus Mu50
aauauaauauacacaaaaag

SEQ ID NO: 2047067 - RNA, 19 nt, Staphylococcus aureus subsp. aureus Mu50
aauauacuuaauuuaaauc

SEQ ID NO: 2047068 - RNA, 19 nt, Staphylococcus aureus subsp. aureus Mu50
aauauacuuuuuaaaugau

SEQ ID NO: 2047069 - RNA, 14 nt, Staphylococcus aureus subsp. aureus Mu50
aauauagauuugaa

SEQ ID NO: 2047070 - RNA, 22 nt, Staphylococcus aureus subsp. aureus Mu50
aauauagauuuuguauuagcau

SEQ ID NO: 2047071 - RNA, 17 nt, Staphylococcus aureus subsp. aureus Mu50
aauauagcaauuuucga

SEQ ID NO: 2047072 - RNA, 22 nt, Staphylococcus aureus subsp. aureus Mu50
aauauagcugugauuugaucaa

SEQ ID NO: 2047073 - RNA, 19 nt, Staphylococcus aureus subsp. aureus Mu50
aauaauuggaaucaucuuu

SEQ ID NO: 2047074 - RNA, 17 nt, Staphylococcus aureus subsp. aureus Mu50
aauacguuuugcuaauu

SEQ ID NO: 2047075 - RNA, 14 nt, Staphylococcus aureus subsp. aureus Mu50
aauacuaacaauua

SEQ ID NO: 2047076 - RNA, 15 nt, Staphylococcus aureus subsp. aureus Mu50
aauacguuaccuacg

SEQ ID NO: 2047077 - RNA, 19 nt, Staphylococcus aureus subsp. aureus Mu50
aauacuaaucaaagaaaaa

SEQ ID NO: 2047078 - RNA, 15 nt, Staphylococcus aureus subsp. aureus Mu50
aauacuaauuucuau

SEQ ID NO: 2047079 - RNA, 17 nt, Staphylococcus aureus subsp. aureus Mu50
aauacuaccuuccauuu

SEQ ID NO: 2047080 - RNA, 22 nt, Staphylococcus aureus subsp. aureus Mu50
aauaacaacgauaauuguuaaa

SEQ ID NO: 2047081 - RNA, 21 nt, Staphylococcus aureus subsp. aureus Mu50
aauaaauguuaaagauuauua

SEQ ID NO: 2047082 - RNA, 23 nt, Staphylococcus aureus subsp. aureus Mu50
aauaacacaugcacuuuauuaaa

SEQ ID NO: 2047083 - RNA, 21 nt, Staphylococcus aureus subsp. aureus Mu50
aauaacaccaauugaauauuu

SEQ ID NO: 2047084 - RNA, 13 nt, Staphylococcus aureus subsp. aureus Mu50
aauaaauucucuu

SEQ ID NO: 2047085 - RNA, 19 nt, Staphylococcus aureus subsp. aureus Mu50
aauaaauuguauuucuuaa

SEQ ID NO: 2047086 - RNA, 14 nt, Staphylococcus aureus subsp. aureus Mu50
aauaaauacaauag

SEQ ID NO: 2047087 - RNA, 15 nt, Staphylococcus aureus subsp. aureus Mu50
aaguugauaauguaa

SEQ ID NO: 2047088 - RNA, 16 nt, Staphylococcus aureus subsp. aureus Mu50
aaguuguaauuuaaaa

SEQ ID NO: 2047089 - RNA, 19 nt, Staphylococcus aureus subsp. aureus Mu50
aaguuguggucuaaccauc

SEQ ID NO: 2047090 - RNA, 11 nt, Staphylococcus aureus subsp. aureus Mu50
aaguuuaaaua

SEQ ID NO: 2047091 - RNA, 12 nt, Staphylococcus aureus subsp. aureus Mu50
aaguuuaaauau

SEQ ID NO: 2047092 - RNA, 16 nt, Staphylococcus aureus subsp. aureus Mu50
aaguuuauacuuaaua

SEQ ID NO: 2047093 - RNA, 21 nt, Staphylococcus aureus subsp. aureus Mu50
aaguugacaauacaaaucgau

SEQ ID NO: 2047094 - RNA, 13 nt, Staphylococcus aureus subsp. aureus Mu50
aaguugauuaaaa

SEQ ID NO: 2047095 - RNA, 18 nt, Staphylococcus aureus subsp. aureus Mu50
aaguugauuauucuauau

SEQ ID NO: 2047096 - RNA, 18 nt, Staphylococcus aureus subsp. aureus Mu50
aauaacccgaacacaaaa

SEQ ID NO: 2047097 - RNA, 12 nt, Staphylococcus aureus subsp. aureus Mu50
aauaacauguuu

SEQ ID NO: 2047098 - RNA, 12 nt, Staphylococcus aureus subsp. aureus Mu50
aauaaccacuuu

SEQ ID NO: 2047099 - RNA, 20 nt, Staphylococcus aureus subsp. aureus Mu50
aauaaccaugccagcuucua

SEQ ID NO: 2047100 - RNA, 23 nt, Staphylococcus aureus subsp. aureus Mu50
aauaaccgcacuuucuauuaaua

SEQ ID NO: 2047101 - RNA, 19 nt, Staphylococcus aureus subsp. aureus Mu50
aauaauauaaaaacaaaag

SEQ ID NO: 2047102 - RNA, 14 nt, Staphylococcus aureus subsp. aureus Mu50
aauaauauugaaug

SEQ ID NO: 2047103 - RNA, 23 nt, Staphylococcus aureus subsp. aureus Mu50
aauaauaucaccuuuuuuaagau

SEQ ID NO: 2047104 - RNA, 17 nt, Staphylococcus aureus subsp. aureus Mu50
aauaaucauccauauau

SEQ ID NO: 2047105 - RNA, 19 nt, Staphylococcus aureus subsp. aureus Mu50
aauaaugacugacacuuua

SEQ ID NO: 2047106 - RNA, 18 nt, Staphylococcus aureus subsp. aureus Mu50
aauaauguacacuuuuga

SEQ ID NO: 2047107 - RNA, 14 nt, Staphylococcus aureus subsp. aureus Mu50
aauaauguaucauu

SEQ ID NO: 2047108 - RNA, 13 nt, Staphylococcus aureus subsp. aureus Mu50
aauaaucacauua

SEQ ID NO: 2047109 - RNA, 15 nt, Staphylococcus aureus subsp. aureus Mu50
aauaaucacauuaau

SEQ ID NO: 2047110 - RNA, 13 nt, Staphylococcus aureus subsp. aureus Mu50
aauaaucuuuaac

SEQ ID NO: 2047111 - RNA, 17 nt, Staphylococcus aureus subsp. aureus Mu50
aauaauugcuaaaauau

SEQ ID NO: 2047112 - RNA, 18 nt, Staphylococcus aureus subsp. aureus Mu50
aauaauuggaaucaucuu

SEQ ID NO: 2047113 - RNA, 17 nt, Staphylococcus aureus subsp. aureus Mu50
aauaauuaauguuucuu

SEQ ID NO: 2047114 - RNA, 20 nt, Staphylococcus aureus subsp. aureus Mu50
aauaauguugucacuuggau

SEQ ID NO: 2047115 - RNA, 18 nt, Staphylococcus aureus subsp. aureus Mu50
aauaauguuuccauuuau

SEQ ID NO: 2047116 - RNA, 17 nt, Staphylococcus aureus subsp. aureus Mu50
aauaaugugucaaauag

SEQ ID NO: 2047117 - RNA, 13 nt, Staphylococcus aureus subsp. aureus Mu50
aaguguuauaaau

SEQ ID NO: 2047118 - RNA, 15 nt, Staphylococcus aureus subsp. aureus Mu50
aaguguuauaaauag

SEQ ID NO: 2047119 - RNA, 19 nt, Staphylococcus aureus subsp. aureus Mu50
aaguguugaccauuaucaa

SEQ ID NO: 2047120 - RNA, 21 nt, Staphylococcus aureus subsp. aureus Mu50
aaguuaaugcacugcuaauau

SEQ ID NO: 2047121 - RNA, 19 nt, Staphylococcus aureus subsp. aureus Mu50
aaguuaaaaccuuuucaaa

SEQ ID NO: 2047122 - RNA, 15 nt, Staphylococcus aureus subsp. aureus Mu50
aagugcaauuauuuc

SEQ ID NO: 2047123 - RNA, 20 nt, Staphylococcus aureus subsp. aureus Mu50
aagugcgguuuaaucuauau

SEQ ID NO: 2047124 - RNA, 18 nt, Staphylococcus aureus subsp. aureus Mu50
aagugccauuuuuaaauu

SEQ ID NO: 2047125 - RNA, 20 nt, Staphylococcus aureus subsp. aureus Mu50
aagugguuguucccauuuuu

SEQ ID NO: 2047126 - RNA, 20 nt, Staphylococcus aureus subsp. aureus Mu50
aaggugugggcuuuauuauc

SEQ ID NO: 2047127 - RNA, 21 nt, Staphylococcus aureus subsp. aureus Mu50
aagucguaucauauauugacu

SEQ ID NO: 2047128 - RNA, 22 nt, Staphylococcus aureus subsp. aureus Mu50
aagucguucucuuaaauaugaa

SEQ ID NO: 2047129 - RNA, 18 nt, Staphylococcus aureus subsp. aureus Mu50
aagugaguaacauuugcu

SEQ ID NO: 2047130 - RNA, 19 nt, Staphylococcus aureus subsp. aureus Mu50
aagugcauauuuaauacau

SEQ ID NO: 2047131 - RNA, 15 nt, Staphylococcus aureus subsp. aureus Mu50
aagugauaauuaaaa

SEQ ID NO: 2047132 - RNA, 18 nt, Staphylococcus aureus subsp. aureus Mu50
aagugauaauuaaaauaa

SEQ ID NO: 2047133 - RNA, 23 nt, Staphylococcus aureus subsp. aureus Mu50
aagugaaucuaacugugcaacaa

SEQ ID NO: 2047134 - RNA, 12 nt, Staphylococcus aureus subsp. aureus Mu50
aagugaaaucau

SEQ ID NO: 2047135 - RNA, 14 nt, Staphylococcus aureus subsp. aureus Mu50
aagucuuuaauagc

SEQ ID NO: 2047136 - RNA, 19 nt, Staphylococcus aureus subsp. aureus Mu50
aagucuaacaguuaauaug

SEQ ID NO: 2047137 - RNA, 17 nt, Staphylococcus aureus subsp. aureus Mu50
aagacguuguaaugaca

SEQ ID NO: 2047138 - RNA, 14 nt, Staphylococcus aureus subsp. aureus Mu50
aagaccguauccug

SEQ ID NO: 2047139 - RNA, 20 nt, Staphylococcus aureus subsp. aureus Mu50
aagccaucaauauugauauc

SEQ ID NO: 2047140 - RNA, 21 nt, Staphylococcus aureus subsp. aureus Mu50
aagccaucccaacuuaauaac

SEQ ID NO: 2047141 - RNA, 21 nt, Staphylococcus aureus subsp. aureus Mu50
aagccaagauaaaucaucauu

SEQ ID NO: 2047142 - RNA, 20 nt, Staphylococcus aureus subsp. aureus Mu50
aagacugauuaauuauugag

SEQ ID NO: 2047143 - RNA, 22 nt, Staphylococcus aureus subsp. aureus Mu50
aagacugauuaauuauugagaa

SEQ ID NO: 2047144 - RNA, 20 nt, Staphylococcus aureus subsp. aureus Mu50
aagcccuuccccuacaaagu

SEQ ID NO: 2047145 - RNA, 22 nt, Staphylococcus aureus subsp. aureus Mu50
aaggauuauuaacuuuaauaua

SEQ ID NO: 2047146 - RNA, 14 nt, Staphylococcus aureus subsp. aureus Mu50
aaggauuuuagauu

SEQ ID NO: 2047147 - RNA, 14 nt, Staphylococcus aureus subsp. aureus Mu50
aaggaugaugugaa

SEQ ID NO: 2047148 - RNA, 17 nt, Staphylococcus aureus subsp. aureus Mu50
aaggcgaaacauuaaaa

SEQ ID NO: 2047149 - RNA, 17 nt, Staphylococcus aureus subsp. aureus Mu50
aaggucccauuaaaauu

SEQ ID NO: 2047150 - RNA, 16 nt, Staphylococcus aureus subsp. aureus Mu50
aagguaauuuaacauu

SEQ ID NO: 2047151 - RNA, 19 nt, Staphylococcus aureus subsp. aureus Mu50
aaggcucauuuguuaaauu

SEQ ID NO: 2047152 - RNA, 23 nt, Staphylococcus aureus subsp. aureus Mu50
acagagaauuucgaaaagaaauu

SEQ ID NO: 2047153 - RNA, 18 nt, Staphylococcus aureus subsp. aureus Mu50
acagaucucaauccaauu

SEQ ID NO: 2047154 - RNA, 22 nt, Staphylococcus aureus subsp. aureus Mu50
acagaugcgucguagauugauu

SEQ ID NO: 2047155 - RNA, 21 nt, Staphylococcus aureus subsp. aureus Mu50
acagauaggaaacuuaaauau

SEQ ID NO: 2047156 - RNA, 13 nt, Staphylococcus aureus subsp. aureus Mu50
acagauaauuauu

SEQ ID NO: 2047157 - RNA, 15 nt, Staphylococcus aureus subsp. aureus Mu50
acagcacauuuuuag

SEQ ID NO: 2047158 - RNA, 22 nt, Staphylococcus aureus subsp. aureus Mu50
acacugcacaucauaauaaauc

SEQ ID NO: 2047159 - RNA, 20 nt, Staphylococcus aureus subsp. aureus Mu50
acacuuggcuuaggaugaaa

SEQ ID NO: 2047160 - RNA, 16 nt, Staphylococcus aureus subsp. aureus Mu50
acacuacgcugaugaa

SEQ ID NO: 2047161 - RNA, 18 nt, Staphylococcus aureus subsp. aureus Mu50
acagcaguaggauaauuu

SEQ ID NO: 2047162 - RNA, 22 nt, Staphylococcus aureus subsp. aureus Mu50
acagcggaauacagaugaugcu

SEQ ID NO: 2047163 - RNA, 14 nt, Staphylococcus aureus subsp. aureus Mu50
acagcgguuuguau

SEQ ID NO: 2047164 - RNA, 14 nt, Staphylococcus aureus subsp. aureus Mu50
acaccuuaucacuu

SEQ ID NO: 2047165 - RNA, 13 nt, Staphylococcus aureus subsp. aureus Mu50
aaaauaacauguu

SEQ ID NO: 2047166 - RNA, 13 nt, Staphylococcus aureus subsp. aureus Mu50
aaaauaauaugaa

SEQ ID NO: 2047167 - RNA, 16 nt, Staphylococcus aureus subsp. aureus Mu50
aaaauaauaugaauuu

SEQ ID NO: 2047168 - RNA, 13 nt, Staphylococcus aureus subsp. aureus Mu50
aaaauaaauaagc

SEQ ID NO: 2047169 - RNA, 23 nt, Staphylococcus aureus subsp. aureus Mu50
aaaauaacugcuaauuuuuucau

SEQ ID NO: 2047170 - RNA, 16 nt, Staphylococcus aureus subsp. aureus Mu50
aaaauacuauacugau

SEQ ID NO: 2047171 - RNA, 21 nt, Staphylococcus aureus subsp. aureus Mu50
aaaauacgguacagauaggaa

SEQ ID NO: 2047172 - RNA, 15 nt, Staphylococcus aureus subsp. aureus Mu50
aaaauaauuuuauau

SEQ ID NO: 2047173 - RNA, 18 nt, Staphylococcus aureus subsp. aureus Mu50
aaaaguuauauaaauuug

SEQ ID NO: 2047174 - RNA, 15 nt, Staphylococcus aureus subsp. aureus Mu50
aaaauaaaaucaacu

SEQ ID NO: 2047175 - RNA, 13 nt, Staphylococcus aureus subsp. aureus Mu50
aaaauaaaauggu

SEQ ID NO: 2047176 - RNA, 22 nt, Staphylococcus aureus subsp. aureus Mu50
aaaagucccgcuuaaaaugauu

SEQ ID NO: 2047177 - RNA, 14 nt, Staphylococcus aureus subsp. aureus Mu50
acacccuuuaaauu

SEQ ID NO: 2047178 - RNA, 17 nt, Staphylococcus aureus subsp. aureus Mu50
aauuuaacggaaauaca

SEQ ID NO: 2047179 - RNA, 13 nt, Staphylococcus aureus subsp. aureus Mu50
aauuuaaaugaua

SEQ ID NO: 2047180 - RNA, 12 nt, Staphylococcus aureus subsp. aureus Mu50
aauuuaaauaau

SEQ ID NO: 2047181 - RNA, 17 nt, Staphylococcus aureus subsp. aureus Mu50
aauuuaaaucuguacuu

SEQ ID NO: 2047182 - RNA, 13 nt, Staphylococcus aureus subsp. aureus Mu50
aauuuaaaacaau

SEQ ID NO: 2047183 - RNA, 22 nt, Staphylococcus aureus subsp. aureus Mu50
aauuuaaaacaaugauuaaaau

SEQ ID NO: 2047184 - RNA, 12 nt, Staphylococcus aureus subsp. aureus Mu50
aauuuaaaauaa

SEQ ID NO: 2047185 - RNA, 13 nt, Staphylococcus aureus subsp. aureus Mu50
aauuuaaaauaau

SEQ ID NO: 2047186 - RNA, 21 nt, Staphylococcus aureus subsp. aureus Mu50
aauuucaguucuuagauuuuc

SEQ ID NO: 2047187 - RNA, 15 nt, Staphylococcus aureus subsp. aureus Mu50
aauuucauguucaua

SEQ ID NO: 2047188 - RNA, 17 nt, Staphylococcus aureus subsp. aureus Mu50
aauuucauguucauaau

SEQ ID NO: 2047189 - RNA, 22 nt, Staphylococcus aureus subsp. aureus Mu50
aauuguucauuggcaauauacu

SEQ ID NO: 2047190 - RNA, 18 nt, Staphylococcus aureus subsp. aureus Mu50
aauuuccaaaguaauaug

SEQ ID NO: 2047191 - RNA, 14 nt, Staphylococcus aureus subsp. aureus Mu50
aauuucauuuuuga

SEQ ID NO: 2047192 - RNA, 19 nt, Staphylococcus aureus subsp. aureus Mu50
aauugggaaauauuugaaa

SEQ ID NO: 2047193 - RNA, 20 nt, Staphylococcus aureus subsp. aureus Mu50
aauugggaaauauuugaaaa

SEQ ID NO: 2047194 - RNA, 23 nt, Staphylococcus aureus subsp. aureus Mu50
aauugguaaaaaucucaaaauuu

SEQ ID NO: 2047195 - RNA, 21 nt, Staphylococcus aureus subsp. aureus Mu50
aauugucacaaucuguucaua

SEQ ID NO: 2047196 - RNA, 21 nt, Staphylococcus aureus subsp. aureus Mu50
aauuguuuaauaacaaaauua

SEQ ID NO: 2047197 - RNA, 22 nt, Staphylococcus aureus subsp. aureus Mu50
aauuguuuaauaacaaaauuaa

SEQ ID NO: 2047198 - RNA, 13 nt, Staphylococcus aureus subsp. aureus Mu50
aauuguauuucuu

SEQ ID NO: 2047199 - RNA, 14 nt, Staphylococcus aureus subsp. aureus Mu50
aauugcuuaauauc

SEQ ID NO: 2047200 - RNA, 14 nt, Staphylococcus aureus subsp. aureus Mu50
aauugcucuuuaac

SEQ ID NO: 2047201 - RNA, 19 nt, Staphylococcus aureus subsp. aureus Mu50
aauugcugauauaauagaa

SEQ ID NO: 2047202 - RNA, 16 nt, Staphylococcus aureus subsp. aureus Mu50
aauuggaacacgaaau

SEQ ID NO: 2047203 - RNA, 16 nt, Staphylococcus aureus subsp. aureus Mu50
aauugcauuacuacaa

SEQ ID NO: 2047204 - RNA, 20 nt, Staphylococcus aureus subsp. aureus Mu50
aauugccuuaucagcauuaa

SEQ ID NO: 2047205 - RNA, 21 nt, Staphylococcus aureus subsp. aureus Mu50
aauugccuuucauuuuagcaa

SEQ ID NO: 2047206 - RNA, 15 nt, Staphylococcus aureus subsp. aureus Mu50
aauugcgauugcuag

SEQ ID NO: 2047207 - RNA, 16 nt, Staphylococcus aureus subsp. aureus Mu50
aauugaguauauucaa

SEQ ID NO: 2047208 - RNA, 17 nt, Staphylococcus aureus subsp. aureus Mu50
aauugaguuuuuuaaaa

SEQ ID NO: 2047209 - RNA, 13 nt, Staphylococcus aureus subsp. aureus Mu50
aauugauggaaaa

SEQ ID NO: 2047210 - RNA, 18 nt, Staphylococcus aureus subsp. aureus Mu50
aauugaugugccuuucua

SEQ ID NO: 2047211 - RNA, 17 nt, Staphylococcus aureus subsp. aureus Mu50
aauugcaaaguaacaau

SEQ ID NO: 2047212 - RNA, 22 nt, Staphylococcus aureus subsp. aureus Mu50
aauugcaacgcaucacaaaauu

SEQ ID NO: 2047213 - RNA, 18 nt, Staphylococcus aureus subsp. aureus Mu50
aauucgaacuaucaauau

SEQ ID NO: 2047214 - RNA, 19 nt, Staphylococcus aureus subsp. aureus Mu50
aauucgaacuaucaauaua

SEQ ID NO: 2047215 - RNA, 12 nt, Staphylococcus aureus subsp. aureus Mu50
aauucgcauuaa

SEQ ID NO: 2047216 - RNA, 13 nt, Staphylococcus aureus subsp. aureus Mu50
aauggcuccauuu

SEQ ID NO: 2047217 - RNA, 21 nt, Staphylococcus aureus subsp. aureus Mu50
aauuaaaacuauaauaaagau

SEQ ID NO: 2047218 - RNA, 14 nt, Staphylococcus aureus subsp. aureus Mu50
aauguuuaucaauu

SEQ ID NO: 2047219 - RNA, 12 nt, Staphylococcus aureus subsp. aureus Mu50
aauguuucauau

SEQ ID NO: 2047220 - RNA, 20 nt, Staphylococcus aureus subsp. aureus Mu50
aauuccuggugcaauaauaa

SEQ ID NO: 2047221 - RNA, 14 nt, Staphylococcus aureus subsp. aureus Mu50
aauucauucaauac

SEQ ID NO: 2047222 - RNA, 15 nt, Staphylococcus aureus subsp. aureus Mu50
aauucaguaucuaaa

SEQ ID NO: 2047223 - RNA, 13 nt, Staphylococcus aureus subsp. aureus Mu50
aauuaaauuuugu

SEQ ID NO: 2047224 - RNA, 22 nt, Staphylococcus aureus subsp. aureus Mu50
aauuaauaacauccccaaaaau

SEQ ID NO: 2047225 - RNA, 11 nt, Staphylococcus aureus subsp. aureus Mu50
aauuaauaauu

SEQ ID NO: 2047226 - RNA, 16 nt, Staphylococcus aureus subsp. aureus Mu50
aauuaauccaucuaca

SEQ ID NO: 2047227 - RNA, 18 nt, Staphylococcus aureus subsp. aureus Mu50
aauuaaucccuucaaaau

SEQ ID NO: 2047228 - RNA, 14 nt, Staphylococcus aureus subsp. aureus Mu50
aauuaaacuaauag

SEQ ID NO: 2047229 - RNA, 15 nt, Staphylococcus aureus subsp. aureus Mu50
aauuaaaauucucuu

SEQ ID NO: 2047230 - RNA, 20 nt, Staphylococcus aureus subsp. aureus Mu50
aauuaaacauuuagauuuca

SEQ ID NO: 2047231 - RNA, 21 nt, Staphylococcus aureus subsp. aureus Mu50
aauuaaagucaauuuaaauaa

SEQ ID NO: 2047232 - RNA, 15 nt, Staphylococcus aureus subsp. aureus Mu50
aauuaaaucgauuaa

SEQ ID NO: 2047233 - RNA, 17 nt, Staphylococcus aureus subsp. aureus Mu50
aaugacuauaacaccaa

SEQ ID NO: 2047234 - RNA, 17 nt, Staphylococcus aureus subsp. aureus Mu50
aaugacgugcuuuuaaa

SEQ ID NO: 2047235 - RNA, 18 nt, Staphylococcus aureus subsp. aureus Mu50
aaugacuaaaucgacaua

SEQ ID NO: 2047236 - RNA, 19 nt, Staphylococcus aureus subsp. aureus Mu50
aaugacaucaucuauaaua

SEQ ID NO: 2047237 - RNA, 14 nt, Staphylococcus aureus subsp. aureus Mu50
aaugacaucuacaa

SEQ ID NO: 2047238 - RNA, 17 nt, Staphylococcus aureus subsp. aureus Mu50
aaugacagcagacuucu

SEQ ID NO: 2047239 - RNA, 17 nt, Staphylococcus aureus subsp. aureus Mu50
aaugaagauuuuguuga

SEQ ID NO: 2047240 - RNA, 17 nt, Staphylococcus aureus subsp. aureus Mu50
aaugaagguguugaaaa

SEQ ID NO: 2047241 - RNA, 23 nt, Staphylococcus aureus subsp. aureus Mu50
aaugaauuguuaguuuucuuaaa

SEQ ID NO: 2047242 - RNA, 15 nt, Staphylococcus aureus subsp. aureus Mu50
aaugaauuucuaauu

SEQ ID NO: 2047243 - RNA, 22 nt, Staphylococcus aureus subsp. aureus Mu50
aaugaacgauauucuacaugaa

SEQ ID NO: 2047244 - RNA, 21 nt, Staphylococcus aureus subsp. aureus Mu50
aaugaacaacaaauugugauu

SEQ ID NO: 2047245 - RNA, 20 nt, Staphylococcus aureus subsp. aureus Mu50
aaugaacaagggccauccau

SEQ ID NO: 2047246 - RNA, 24 nt, Staphylococcus aureus subsp. aureus Mu50
aaugaaccagcuaaccaaauaauu

SEQ ID NO: 2047247 - RNA, 13 nt, Staphylococcus aureus subsp. aureus Mu50
aaucuuuuuuuaa

SEQ ID NO: 2047248 - RNA, 15 nt, Staphylococcus aureus subsp. aureus Mu50
aaugaagaauacaaa

SEQ ID NO: 2047249 - RNA, 18 nt, Staphylococcus aureus subsp. aureus Mu50
aaugaagaauacaaauau

SEQ ID NO: 2047250 - RNA, 16 nt, Staphylococcus aureus subsp. aureus Mu50
aaugaauaaauugaua

SEQ ID NO: 2047251 - RNA, 15 nt, Staphylococcus aureus subsp. aureus Mu50
aaugaauaauuaaaa

SEQ ID NO: 2047252 - RNA, 12 nt, Staphylococcus aureus subsp. aureus Mu50
aaugaaucaauu

SEQ ID NO: 2047253 - RNA, 16 nt, Staphylococcus aureus subsp. aureus Mu50
aaugaauuauuuaaaa

SEQ ID NO: 2047254 - RNA, 20 nt, Staphylococcus aureus subsp. aureus Mu50
aaucacuccucuauuuuaug

SEQ ID NO: 2047255 - RNA, 13 nt, Staphylococcus aureus subsp. aureus Mu50
aaucuuuaaaugu

SEQ ID NO: 2047256 - RNA, 21 nt, Staphylococcus aureus subsp. aureus Mu50
aaucuuuacuuguaauuaaua

SEQ ID NO: 2047257 - RNA, 22 nt, Staphylococcus aureus subsp. aureus Mu50
aaucuuuacuuguaauuaauac

SEQ ID NO: 2047258 - RNA, 15 nt, Staphylococcus aureus subsp. aureus Mu50
aaucuuuuagcuuuu

SEQ ID NO: 2047259 - RNA, 13 nt, Staphylococcus aureus subsp. aureus Mu50
aaucuuuuaaauu

SEQ ID NO: 2047260 - RNA, 17 nt, Staphylococcus aureus subsp. aureus Mu50
aaucaccuuuuuuaacu

SEQ ID NO: 2047261 - RNA, 23 nt, Staphylococcus aureus subsp. aureus Mu50
aaucaccaacaacuuuguuuuca

SEQ ID NO: 2047262 - RNA, 16 nt, Staphylococcus aureus subsp. aureus Mu50
aaucacgccauaaucu

SEQ ID NO: 2047263 - RNA, 18 nt, Staphylococcus aureus subsp. aureus Mu50
aaugcacugagcaacaaa

SEQ ID NO: 2047264 - RNA, 13 nt, Staphylococcus aureus subsp. aureus Mu50
aaugcaccaacaa

SEQ ID NO: 2047265 - RNA, 17 nt, Staphylococcus aureus subsp. aureus Mu50
aaugcaauacauuaaua

SEQ ID NO: 2047266 - RNA, 17 nt, Staphylococcus aureus subsp. aureus Mu50
aaugcuuuagcauuauu

SEQ ID NO: 2047267 - RNA, 20 nt, Staphylococcus aureus subsp. aureus Mu50
aaugcgcuuccaauuuaaaa

SEQ ID NO: 2047268 - RNA, 18 nt, Staphylococcus aureus subsp. aureus Mu50
aaugcuacuauuaaauaa

SEQ ID NO: 2047269 - RNA, 15 nt, Staphylococcus aureus subsp. aureus Mu50
acaaugauuacuuua

SEQ ID NO: 2047270 - RNA, 14 nt, Staphylococcus aureus subsp. aureus Mu50
acaaucuuaucaua

SEQ ID NO: 2047271 - RNA, 14 nt, Staphylococcus aureus subsp. aureus Mu50
acaaucgaauguau

SEQ ID NO: 2047272 - RNA, 19 nt, Staphylococcus aureus subsp. aureus Mu50
acaaucguugaagauguau

SEQ ID NO: 2047273 - RNA, 21 nt, Staphylococcus aureus subsp. aureus Mu50
acaaucguugaagauguauuu

SEQ ID NO: 2047274 - RNA, 14 nt, Staphylococcus aureus subsp. aureus Mu50
acaaucguuuuaau

SEQ ID NO: 2047275 - RNA, 22 nt, Staphylococcus aureus subsp. aureus Mu50
acaauugauugcucuaagcauu

SEQ ID NO: 2047276 - RNA, 17 nt, Staphylococcus aureus subsp. aureus Mu50
acaauuuugacuacuaa

SEQ ID NO: 2047277 - RNA, 23 nt, Staphylococcus aureus subsp. aureus Mu50
acaauuuuaccuucgcauacuuu

SEQ ID NO: 2047278 - RNA, 12 nt, Staphylococcus aureus subsp. aureus Mu50
acaauuuuaaau

SEQ ID NO: 2047279 - RNA, 16 nt, Staphylococcus aureus subsp. aureus Mu50
acaauuuuaaaucuuu

SEQ ID NO: 2047280 - RNA, 16 nt, Staphylococcus aureus subsp. aureus Mu50
acacacaugauaauuu

SEQ ID NO: 2047281 - RNA, 13 nt, Staphylococcus aureus subsp. aureus Mu50
acaauauuuuuac

SEQ ID NO: 2047282 - RNA, 14 nt, Staphylococcus aureus subsp. aureus Mu50
acaauauuaaaauu

SEQ ID NO: 2047283 - RNA, 22 nt, Staphylococcus aureus subsp. aureus Mu50
acaauaugauuaauaaaguaau

SEQ ID NO: 2047284 - RNA, 12 nt, Staphylococcus aureus subsp. aureus Mu50
acaauauucaau

SEQ ID NO: 2047285 - RNA, 20 nt, Staphylococcus aureus subsp. aureus Mu50
acaauauucguaaauccuuu

SEQ ID NO: 2047286 - RNA, 21 nt, Staphylococcus aureus subsp. aureus Mu50
acaauaugaauuggauguaau

SEQ ID NO: 2047287 - RNA, 14 nt, Staphylococcus aureus subsp. aureus Mu50
acaauacgaugaug

SEQ ID NO: 2047288 - RNA, 16 nt, Staphylococcus aureus subsp. aureus Mu50
acaauaauuuaauauu

SEQ ID NO: 2047289 - RNA, 22 nt, Staphylococcus aureus subsp. aureus Mu50
acaauaauuucgcaguagcugc

SEQ ID NO: 2047290 - RNA, 15 nt, Staphylococcus aureus subsp. aureus Mu50
acaauaagcgcaauu

SEQ ID NO: 2047291 - RNA, 14 nt, Staphylococcus aureus subsp. aureus Mu50
acaauaaagacaua

SEQ ID NO: 2047292 - RNA, 18 nt, Staphylococcus aureus subsp. aureus Mu50
acaaguuucgcagcuuua

SEQ ID NO: 2047293 - RNA, 21 nt, Staphylococcus aureus subsp. aureus Mu50
acaagucuuauuuguuuaauu

SEQ ID NO: 2047294 - RNA, 22 nt, Staphylococcus aureus subsp. aureus Mu50
acaagucuaguucgaacacaca

SEQ ID NO: 2047295 - RNA, 19 nt, Staphylococcus aureus subsp. aureus Mu50
acaagcuuuucauuuuuau

SEQ ID NO: 2047296 - RNA, 14 nt, Staphylococcus aureus subsp. aureus Mu50
acaagguucuaaau

SEQ ID NO: 2047297 - RNA, 18 nt, Staphylococcus aureus subsp. aureus Mu50
acaagguaugaaauaaca

SEQ ID NO: 2047298 - RNA, 13 nt, Staphylococcus aureus subsp. aureus Mu50
acaacuucacuuc

SEQ ID NO: 2047299 - RNA, 21 nt, Staphylococcus aureus subsp. aureus Mu50
acaagauaacuagcaaaugca

SEQ ID NO: 2047300 - RNA, 16 nt, Staphylococcus aureus subsp. aureus Mu50
acaagccaagauaaau

SEQ ID NO: 2047301 - RNA, 20 nt, Staphylococcus aureus subsp. aureus Mu50
acaacucccuuuuauaagcu

SEQ ID NO: 2047302 - RNA, 19 nt, Staphylococcus aureus subsp. aureus Mu50
acaacugcgacauguccau

SEQ ID NO: 2047303 - RNA, 17 nt, Staphylococcus aureus subsp. aureus Mu50
acaacucguuuuuccau

SEQ ID NO: 2047304 - RNA, 16 nt, Staphylococcus aureus subsp. aureus Mu50
acaacugauuuaauau

SEQ ID NO: 2047305 - RNA, 15 nt, Staphylococcus aureus subsp. aureus Mu50
acaacacgaugacau

SEQ ID NO: 2047306 - RNA, 14 nt, Staphylococcus aureus subsp. aureus Mu50
acaaauuauaaauu

SEQ ID NO: 2047307 - RNA, 16 nt, Staphylococcus aureus subsp. aureus Mu50
acaaauuaucacucau

SEQ ID NO: 2047308 - RNA, 17 nt, Staphylococcus aureus subsp. aureus Mu50
acaacaucuuuuguugu

SEQ ID NO: 2047309 - RNA, 16 nt, Staphylococcus aureus subsp. aureus Mu50
acaaauaauuuacauu

SEQ ID NO: 2047310 - RNA, 17 nt, Staphylococcus aureus subsp. aureus Mu50
acaaauaauuuacauua

SEQ ID NO: 2047311 - RNA, 20 nt, Staphylococcus aureus subsp. aureus Mu50
acaaauauacuugccuucaa

SEQ ID NO: 2047312 - RNA, 16 nt, Staphylococcus aureus subsp. aureus Mu50
acaaauaacaaacauu

SEQ ID NO: 2047313 - RNA, 14 nt, Staphylococcus aureus subsp. aureus Mu50
acaaaguuaaccau

SEQ ID NO: 2047314 - RNA, 21 nt, Staphylococcus aureus subsp. aureus Mu50
acaaaugaagguguugaaaag

SEQ ID NO: 2047315 - RNA, 21 nt, Staphylococcus aureus subsp. aureus Mu50
acaaauguucuauagaaaaag

SEQ ID NO: 2047316 - RNA, 14 nt, Staphylococcus aureus subsp. aureus Mu50
acaaaguacaguua

SEQ ID NO: 2047317 - RNA, 20 nt, Staphylococcus aureus subsp. aureus Mu50
acaaaggauuauuaacuuua

SEQ ID NO: 2047318 - RNA, 14 nt, Staphylococcus aureus subsp. aureus Mu50
acaaagcuauguau

SEQ ID NO: 2047319 - RNA, 12 nt, Staphylococcus aureus subsp. aureus Mu50
acaaaacgauug

SEQ ID NO: 2047320 - RNA, 18 nt, Staphylococcus aureus subsp. aureus Mu50
acaaaaacaucuacauca

SEQ ID NO: 2047321 - RNA, 21 nt, Staphylococcus aureus subsp. aureus Mu50
acaaaaguaugauuuguuuga

SEQ ID NO: 2047322 - RNA, 18 nt, Staphylococcus aureus subsp. aureus Mu50
acaaaagaucgauacuuu

SEQ ID NO: 2047323 - RNA, 12 nt, Staphylococcus aureus subsp. aureus Mu50
aauuucgauuaa

SEQ ID NO: 2047324 - RNA, 13 nt, Staphylococcus aureus subsp. aureus Mu50
aauuuuuaauaua

SEQ ID NO: 2047325 - RNA, 16 nt, Staphylococcus aureus subsp. aureus Mu50
aauuucuuuaaagucu

SEQ ID NO: 2047326 - RNA, 20 nt, Staphylococcus aureus subsp. aureus Mu50
aauuucucacugcuguucuu

SEQ ID NO: 2047327 - RNA, 15 nt, Staphylococcus aureus subsp. aureus Mu50
aauuuuuuuuauuaa

SEQ ID NO: 2047328 - RNA, 14 nt, Staphylococcus aureus subsp. aureus Mu50
aauuuuuuucauaa

SEQ ID NO: 2047329 - RNA, 21 nt, Staphylococcus aureus subsp. aureus Mu50
aauuuuuucaucauucaaacu

SEQ ID NO: 2047330 - RNA, 19 nt, Staphylococcus aureus subsp. aureus Mu50
aauuugaaaguaaauuaca

SEQ ID NO: 2047331 - RNA, 15 nt, Staphylococcus aureus subsp. aureus Mu50
aauuuuuaugcauua

SEQ ID NO: 2047332 - RNA, 15 nt, Staphylococcus aureus subsp. aureus Mu50
aauuuuuauuuacac

SEQ ID NO: 2047333 - RNA, 14 nt, Staphylococcus aureus subsp. aureus Mu50
aauuuuucaaaagc

SEQ ID NO: 2047334 - RNA, 18 nt, Staphylococcus aureus subsp. aureus Mu50
aauuuuucacuucaaaca

SEQ ID NO: 2047335 - RNA, 23 nt, Staphylococcus aureus subsp. aureus Mu50
aaaucaguuuuuaaaucaaagcu

SEQ ID NO: 2047336 - RNA, 13 nt, Staphylococcus aureus subsp. aureus Mu50
aaaucauaacgac

SEQ ID NO: 2047337 - RNA, 13 nt, Staphylococcus aureus subsp. aureus Mu50
aaauaauuuacau

SEQ ID NO: 2047338 - RNA, 21 nt, Staphylococcus aureus subsp. aureus Mu50
aaauaauaauucauaaaugcu

SEQ ID NO: 2047339 - RNA, 17 nt, Staphylococcus aureus subsp. aureus Mu50
aaauaauacuacauaua

SEQ ID NO: 2047340 - RNA, 13 nt, Staphylococcus aureus subsp. aureus Mu50
aaauaauauaaaa

SEQ ID NO: 2047341 - RNA, 12 nt, Staphylococcus aureus subsp. aureus Mu50
aaauaauaucuc

SEQ ID NO: 2047342 - RNA, 20 nt, Staphylococcus aureus subsp. aureus Mu50
aaauaagugauaaauaaugc

SEQ ID NO: 2047343 - RNA, 18 nt, Staphylococcus aureus subsp. aureus Mu50
aaauaaagucauaugguu

SEQ ID NO: 2047344 - RNA, 13 nt, Staphylococcus aureus subsp. aureus Mu50
aaauaauuaugaa

SEQ ID NO: 2047345 - RNA, 20 nt, Staphylococcus aureus subsp. aureus Mu50
aaaguuuuguucaauaugau

SEQ ID NO: 2047346 - RNA, 15 nt, Staphylococcus aureus subsp. aureus Mu50
aaauaaaaugcauag

SEQ ID NO: 2047347 - RNA, 15 nt, Staphylococcus aureus subsp. aureus Mu50
aaauaaaaaaaugau

SEQ ID NO: 2047348 - RNA, 16 nt, Staphylococcus aureus subsp. aureus Mu50
aaauaaguaguucagc

SEQ ID NO: 2047349 - RNA, 21 nt, Staphylococcus aureus subsp. aureus Mu50
aaauaacuucguuuuaauaaa

SEQ ID NO: 2047350 - RNA, 21 nt, Staphylococcus aureus subsp. aureus Mu50
aaaucauuuugccucguccau

SEQ ID NO: 2047351 - RNA, 19 nt, Staphylococcus aureus subsp. aureus Mu50
aaaucauucauuugcaaag

SEQ ID NO: 2047352 - RNA, 15 nt, Staphylococcus aureus subsp. aureus Mu50
aaaacccaguaucga

SEQ ID NO: 2047353 - RNA, 22 nt, Staphylococcus aureus subsp. aureus Mu50
aaaacaauauugacuuuuacag

SEQ ID NO: 2047354 - RNA, 12 nt, Staphylococcus aureus subsp. aureus Mu50
aaaacaaugccc

SEQ ID NO: 2047355 - RNA, 13 nt, Staphylococcus aureus subsp. aureus Mu50
aaaacaaaacuug

SEQ ID NO: 2047356 - RNA, 18 nt, Staphylococcus aureus subsp. aureus Mu50
aaaaauugcuauauuagu

SEQ ID NO: 2047357 - RNA, 13 nt, Staphylococcus aureus subsp. aureus Mu50
aaaacaucauuca

SEQ ID NO: 2047358 - RNA, 18 nt, Staphylococcus aureus subsp. aureus Mu50
aaauccgcauaaauuaga

SEQ ID NO: 2047359 - RNA, 13 nt, Staphylococcus aureus subsp. aureus Mu50
aaauccucuuaua

SEQ ID NO: 2047360 - RNA, 24 nt, Staphylococcus aureus subsp. aureus Mu50
aaauccucaguuauaccauauuua

SEQ ID NO: 2047361 - RNA, 16 nt, Staphylococcus aureus subsp. aureus Mu50
aaaucgaauugaugga

SEQ ID NO: 2047362 - RNA, 19 nt, Staphylococcus aureus subsp. aureus Mu50
aaaucgauacuaauaucuu

SEQ ID NO: 2047363 - RNA, 23 nt, Staphylococcus aureus subsp. aureus Mu50
aaaucgauacuggguuuuaccau

SEQ ID NO: 2047364 - RNA, 15 nt, Staphylococcus aureus subsp. aureus Mu50
aaaugucaguuuuga

SEQ ID NO: 2047365 - RNA, 16 nt, Staphylococcus aureus subsp. aureus Mu50
aaaugucaguuuugaa

SEQ ID NO: 2047366 - RNA, 16 nt, Staphylococcus aureus subsp. aureus Mu50
aaauguguuuucaaca

SEQ ID NO: 2047367 - RNA, 14 nt, Staphylococcus aureus subsp. aureus Mu50
aaauguuaaugcuu

SEQ ID NO: 2047368 - RNA, 18 nt, Staphylococcus aureus subsp. aureus Mu50
aaauguuacacaaauuaa

SEQ ID NO: 2047369 - RNA, 22 nt, Staphylococcus aureus subsp. aureus Mu50
aaauguuauuaaccaucaugac

SEQ ID NO: 2047370 - RNA, 16 nt, Staphylococcus aureus subsp. aureus Mu50
aaaugcaaagacuaaa

SEQ ID NO: 2047371 - RNA, 22 nt, Staphylococcus aureus subsp. aureus Mu50
aaaugauaauuuaauaauguac

SEQ ID NO: 2047372 - RNA, 20 nt, Staphylococcus aureus subsp. aureus Mu50
aaaugcacugagcaacaaaa

SEQ ID NO: 2047373 - RNA, 21 nt, Staphylococcus aureus subsp. aureus Mu50
aaaugcaauacauuaauauaa

SEQ ID NO: 2047374 - RNA, 19 nt, Staphylococcus aureus subsp. aureus Mu50
aaaugcacgagcaacaucu

SEQ ID NO: 2047375 - RNA, 19 nt, Staphylococcus aureus subsp. aureus Mu50
aaaugaauauaauaacaau

SEQ ID NO: 2047376 - RNA, 13 nt, Staphylococcus aureus subsp. aureus Mu50
aaaugaauuuuga

SEQ ID NO: 2047377 - RNA, 20 nt, Staphylococcus aureus subsp. aureus Mu50
aaaugacaucaucuauaaua

SEQ ID NO: 2047378 - RNA, 21 nt, Staphylococcus aureus subsp. aureus Mu50
aaaugacaucaucuauaauac

SEQ ID NO: 2047379 - RNA, 13 nt, Staphylococcus aureus subsp. aureus Mu50
aaaugacgauacg

SEQ ID NO: 2047380 - RNA, 13 nt, Staphylococcus aureus subsp. aureus Mu50
aacaccaauuaaa

SEQ ID NO: 2047381 - RNA, 15 nt, Staphylococcus aureus subsp. aureus Mu50
aacaccaauugaaau

SEQ ID NO: 2047382 - RNA, 17 nt, Staphylococcus aureus subsp. aureus Mu50
aacacacacugauguga

SEQ ID NO: 2047383 - RNA, 17 nt, Staphylococcus aureus subsp. aureus Mu50
aacacauaaauuaagca

SEQ ID NO: 2047384 - RNA, 17 nt, Staphylococcus aureus subsp. aureus Mu50
aacacaaggaauauaca

SEQ ID NO: 2047385 - RNA, 21 nt, Staphylococcus aureus subsp. aureus Mu50
aacaauuuuugggaagaauaa

SEQ ID NO: 2047386 - RNA, 17 nt, Staphylococcus aureus subsp. aureus Mu50
aacacccugcuuaucau

SEQ ID NO: 2047387 - RNA, 21 nt, Staphylococcus aureus subsp. aureus Mu50
aacaauuacgacaagaauuaa

SEQ ID NO: 2047388 - RNA, 22 nt, Staphylococcus aureus subsp. aureus Mu50
aacaauuuuaaaucuuuuagcu

SEQ ID NO: 2047389 - RNA, 13 nt, Staphylococcus aureus subsp. aureus Mu50
aacaaaagauguu

SEQ ID NO: 2047390 - RNA, 13 nt, Staphylococcus aureus subsp. aureus Mu50
aacaaauuuaacu

SEQ ID NO: 2047391 - RNA, 24 nt, Staphylococcus aureus subsp. aureus Mu50
aacaaauauaauguauaaaacaga

SEQ ID NO: 2047392 - RNA, 20 nt, Staphylococcus aureus subsp. aureus Mu50
aaauuguuccuucgauaguu

SEQ ID NO: 2047393 - RNA, 16 nt, Staphylococcus aureus subsp. aureus Mu50
aaauuuaaauauugaa

SEQ ID NO: 2047394 - RNA, 12 nt, Staphylococcus aureus subsp. aureus Mu50
aaauuuaucauu

SEQ ID NO: 2047395 - RNA, 22 nt, Staphylococcus aureus subsp. aureus Mu50
aaauuuaggcaugucaaaucgg

SEQ ID NO: 2047396 - RNA, 20 nt, Staphylococcus aureus subsp. aureus Mu50
aaauuuaacucaacuuaaau

SEQ ID NO: 2047397 - RNA, 12 nt, Staphylococcus aureus subsp. aureus Mu50
aaauuuaaaugu

SEQ ID NO: 2047398 - RNA, 19 nt, Staphylococcus aureus subsp. aureus Mu50
aaaagacaugagauuauuu

SEQ ID NO: 2047399 - RNA, 17 nt, Staphylococcus aureus subsp. aureus Mu50
aaaacuugcgcaugcuu

SEQ ID NO: 2047400 - RNA, 14 nt, Staphylococcus aureus subsp. aureus Mu50
aaauuucauaaagu

SEQ ID NO: 2047401 - RNA, 15 nt, Staphylococcus aureus subsp. aureus Mu50
aaauuucgauuaauu

SEQ ID NO: 2047402 - RNA, 16 nt, Staphylococcus aureus subsp. aureus Mu50
aaauuuauuauaaaau

SEQ ID NO: 2047403 - RNA, 17 nt, Staphylococcus aureus subsp. aureus Mu50
aaauuuauuauaaaaua

SEQ ID NO: 2047404 - RNA, 15 nt, Staphylococcus aureus subsp. aureus Mu50
aaauuuauucaaaau

SEQ ID NO: 2047405 - RNA, 18 nt, Staphylococcus aureus subsp. aureus Mu50
aaauuuauucaaaauuca

SEQ ID NO: 2047406 - RNA, 21 nt, Staphylococcus aureus subsp. aureus Mu50
aaauuuauucaaaauucaaua

SEQ ID NO: 2047407 - RNA, 18 nt, Staphylococcus aureus subsp. aureus Mu50
aaauuuguguucaaauca

SEQ ID NO: 2047408 - RNA, 17 nt, Staphylococcus aureus subsp. aureus Mu50
aaauuuugcgaaaauau

SEQ ID NO: 2047409 - RNA, 12 nt, Staphylococcus aureus subsp. aureus Mu50
aaauuuaauauu

SEQ ID NO: 2047410 - RNA, 14 nt, Staphylococcus aureus subsp. aureus Mu50
aaauuuuucacuuc

SEQ ID NO: 2047411 - RNA, 17 nt, Staphylococcus aureus subsp. aureus Mu50
aaauuuuuaguuaaagu

SEQ ID NO: 2047412 - RNA, 15 nt, Staphylococcus aureus subsp. aureus Mu50
aaauuuugaauuaca

SEQ ID NO: 2047413 - RNA, 19 nt, Staphylococcus aureus subsp. aureus Mu50
aaauuuucguguuaauaac

SEQ ID NO: 2047414 - RNA, 12 nt, Staphylococcus aureus subsp. aureus Mu50
aaaacuauaaua

SEQ ID NO: 2047415 - RNA, 19 nt, Staphylococcus aureus subsp. aureus Mu50
aaauguccgacuugauaaa

SEQ ID NO: 2047416 - RNA, 13 nt, Staphylococcus aureus subsp. aureus Mu50
aaaugucauuuga

SEQ ID NO: 2047417 - RNA, 22 nt, Staphylococcus aureus subsp. aureus Mu50
aaauguuauugcuuauuuuugu

SEQ ID NO: 2047418 - RNA, 16 nt, Staphylococcus aureus subsp. aureus Mu50
aaaugucuuucaaaua

SEQ ID NO: 2047419 - RNA, 18 nt, Staphylococcus aureus subsp. aureus Mu50
aaaugucuuucaaauaca

SEQ ID NO: 2047420 - RNA, 14 nt, Staphylococcus aureus subsp. aureus Mu50
aaauuaaauaugac

SEQ ID NO: 2047421 - RNA, 20 nt, Staphylococcus aureus subsp. aureus Mu50
aaauuaaaaagguacuaaug

SEQ ID NO: 2047422 - RNA, 16 nt, Staphylococcus aureus subsp. aureus Mu50
aaauuaaaaauuucgc

SEQ ID NO: 2047423 - RNA, 19 nt, Staphylococcus aureus subsp. aureus Mu50
aaauuaaaacagcaaauaa

SEQ ID NO: 2047424 - RNA, 22 nt, Staphylococcus aureus subsp. aureus Mu50
aaauuaacuuaaaauuuaaaua

SEQ ID NO: 2047425 - RNA, 17 nt, Staphylococcus aureus subsp. aureus Mu50
aaauuaagaagaaauac

SEQ ID NO: 2047426 - RNA, 21 nt, Staphylococcus aureus subsp. aureus Mu50
aaauuacaauaagcgcaauua

SEQ ID NO: 2047427 - RNA, 15 nt, Staphylococcus aureus subsp. aureus Mu50
aaaccuaaucuacca

SEQ ID NO: 2047428 - RNA, 20 nt, Staphylococcus aureus subsp. aureus Mu50
aaaccuuguuuuacaagguu

SEQ ID NO: 2047429 - RNA, 20 nt, Staphylococcus aureus subsp. aureus Mu50
aaaccuuugguucaaucauu

SEQ ID NO: 2047430 - RNA, 16 nt, Staphylococcus aureus subsp. aureus Mu50
aaaccuaucaucaauc

SEQ ID NO: 2047431 - RNA, 20 nt, Staphylococcus aureus subsp. aureus Mu50
aaaccaccaaaaaucaucca

SEQ ID NO: 2047432 - RNA, 14 nt, Staphylococcus aureus subsp. aureus Mu50
aaacacaguacaaa

SEQ ID NO: 2047433 - RNA, 15 nt, Staphylococcus aureus subsp. aureus Mu50
aaacacaaauaaagg

SEQ ID NO: 2047434 - RNA, 17 nt, Staphylococcus aureus subsp. aureus Mu50
aaacaauuuguaacuau

SEQ ID NO: 2047435 - RNA, 14 nt, Staphylococcus aureus subsp. aureus Mu50
aaacaaugauggga

SEQ ID NO: 2047436 - RNA, 15 nt, Staphylococcus aureus subsp. aureus Mu50
aaacaagccuuaaaa

SEQ ID NO: 2047437 - RNA, 22 nt, Staphylococcus aureus subsp. aureus Mu50
aaaauuguggcuacuaaucuuu

SEQ ID NO: 2047438 - RNA, 22 nt, Staphylococcus aureus subsp. aureus Mu50
aaacaaaagaucgauacuuuuu

SEQ ID NO: 2047439 - RNA, 18 nt, Staphylococcus aureus subsp. aureus Mu50
aaaauuuucguguuaaua

SEQ ID NO: 2047440 - RNA, 22 nt, Staphylococcus aureus subsp. aureus Mu50
aaacaaaucuuuuaaauuuagu

SEQ ID NO: 2047441 - RNA, 15 nt, Staphylococcus aureus subsp. aureus Mu50
aaacaacaucgauuu

SEQ ID NO: 2047442 - RNA, 12 nt, Staphylococcus aureus subsp. aureus Mu50
aaacaacaucac

SEQ ID NO: 2047443 - RNA, 23 nt, Staphylococcus aureus subsp. aureus Mu50
aaaauugguuuggauaaaaugau

SEQ ID NO: 2047444 - RNA, 15 nt, Staphylococcus aureus subsp. aureus Mu50
aaaauugcuauauua

SEQ ID NO: 2047445 - RNA, 15 nt, Staphylococcus aureus subsp. aureus Mu50
aaaauuuacaaaugu

SEQ ID NO: 2047446 - RNA, 16 nt, Staphylococcus aureus subsp. aureus Mu50
aaaauuuauucaaaau

SEQ ID NO: 2047447 - RNA, 15 nt, Staphylococcus aureus subsp. aureus Mu50
aaaauuuauucaaau

SEQ ID NO: 2047448 - RNA, 18 nt, Staphylococcus aureus subsp. aureus Mu50
aaaauuuauucaaaucau

SEQ ID NO: 2047449 - RNA, 20 nt, Staphylococcus aureus subsp. aureus Mu50
aaaauuucaguaccauguuu

SEQ ID NO: 2047450 - RNA, 23 nt, Staphylococcus aureus subsp. aureus Mu50
aaacauuucgguaugauauuucu

SEQ ID NO: 2047451 - RNA, 19 nt, Staphylococcus aureus subsp. aureus Mu50
aaacauucccuuaauaaua

SEQ ID NO: 2047452 - RNA, 12 nt, Staphylococcus aureus subsp. aureus Mu50
aaaccaacaauu

SEQ ID NO: 2047453 - RNA, 19 nt, Staphylococcus aureus subsp. aureus Mu50
aaacauaccugcauauuca

SEQ ID NO: 2047454 - RNA, 13 nt, Staphylococcus aureus subsp. aureus Mu50
aaacaguguagca

SEQ ID NO: 2047455 - RNA, 15 nt, Staphylococcus aureus subsp. aureus Mu50
aaacauuaaaauaau

SEQ ID NO: 2047456 - RNA, 17 nt, Staphylococcus aureus subsp. aureus Mu50
aaacauuaaucuauaua

SEQ ID NO: 2047457 - RNA, 20 nt, Staphylococcus aureus subsp. aureus Mu50
aaaguaauaaguaauaauuu

SEQ ID NO: 2047458 - RNA, 12 nt, Staphylococcus aureus subsp. aureus Mu50
aaaguaaaauau

SEQ ID NO: 2047459 - RNA, 23 nt, Staphylococcus aureus subsp. aureus Mu50
aaaggugauauuugcuagucaua

SEQ ID NO: 2047460 - RNA, 18 nt, Staphylococcus aureus subsp. aureus Mu50
aaaggucuauguacaaua

SEQ ID NO: 2047461 - RNA, 15 nt, Staphylococcus aureus subsp. aureus Mu50
aaaguaucuaugaaa

SEQ ID NO: 2047462 - RNA, 18 nt, Staphylococcus aureus subsp. aureus Mu50
aaaguaucuaugaaauuu

SEQ ID NO: 2047463 - RNA, 22 nt, Staphylococcus aureus subsp. aureus Mu50
aaaguagguacacauguacguu

SEQ ID NO: 2047464 - RNA, 18 nt, Staphylococcus aureus subsp. aureus Mu50
aaagcguucaauuuuugu

SEQ ID NO: 2047465 - RNA, 18 nt, Staphylococcus aureus subsp. aureus Mu50
aaagggcgaaauggauuc

SEQ ID NO: 2047466 - RNA, 15 nt, Staphylococcus aureus subsp. aureus Mu50
aaagaaagcuaauau

SEQ ID NO: 2047467 - RNA, 18 nt, Staphylococcus aureus subsp. aureus Mu50
aaagaagcucccauuaau

SEQ ID NO: 2047468 - RNA, 14 nt, Staphylococcus aureus subsp. aureus Mu50
aaagaacuaacaua

SEQ ID NO: 2047469 - RNA, 19 nt, Staphylococcus aureus subsp. aureus Mu50
aaagacaccaucaacgcca

SEQ ID NO: 2047470 - RNA, 16 nt, Staphylococcus aureus subsp. aureus Mu50
aaagacaugagauuau

SEQ ID NO: 2047471 - RNA, 15 nt, Staphylococcus aureus subsp. aureus Mu50
aaaccuuuucaaauu

SEQ ID NO: 2047472 - RNA, 18 nt, Staphylococcus aureus subsp. aureus Mu50
aaaccuuuucaaauuaua

SEQ ID NO: 2047473 - RNA, 20 nt, Staphylococcus aureus subsp. aureus Mu50
aaacuuguccguuuuauauu

SEQ ID NO: 2047474 - RNA, 16 nt, Staphylococcus aureus subsp. aureus Mu50
aaaaagcucaauccug

SEQ ID NO: 2047475 - RNA, 13 nt, Staphylococcus aureus subsp. aureus Mu50
aaaaagaacauaa

SEQ ID NO: 2047476 - RNA, 18 nt, Staphylococcus aureus subsp. aureus Mu50
aaaaagacaugagauuau

SEQ ID NO: 2047477 - RNA, 22 nt, Staphylococcus aureus subsp. aureus Mu50
aaaaaugcucaaguugauuauu

SEQ ID NO: 2047478 - RNA, 12 nt, Staphylococcus aureus subsp. aureus Mu50
aaaaauggcgaa

SEQ ID NO: 2047479 - RNA, 14 nt, Staphylococcus aureus subsp. aureus Mu50
aaaaaccguaauuu

SEQ ID NO: 2047480 - RNA, 18 nt, Staphylococcus aureus subsp. aureus Mu50
aaaacgugacauuuucaa

SEQ ID NO: 2047481 - RNA, 14 nt, Staphylococcus aureus subsp. aureus Mu50
aaaacuauuuuaaa

SEQ ID NO: 2047482 - RNA, 22 nt, Staphylococcus aureus subsp. aureus Mu50
aaaacgacucauuauaaaugaa

SEQ ID NO: 2047483 - RNA, 16 nt, Staphylococcus aureus subsp. aureus Mu50
aaaagauauaaacauu

SEQ ID NO: 2047484 - RNA, 18 nt, Staphylococcus aureus subsp. aureus Mu50
aaaagaggcgccacaaca

SEQ ID NO: 2047485 - RNA, 20 nt, Staphylococcus aureus subsp. aureus Mu50
aaaagacuuuccaccauaug

SEQ ID NO: 2047486 - RNA, 14 nt, Staphylococcus aureus subsp. aureus Mu50
aaaagagaauuuua

SEQ ID NO: 2047487 - RNA, 23 nt, Staphylococcus aureus subsp. aureus Mu50
aaaagacagcaguaggauaauuu

SEQ ID NO: 2047488 - RNA, 19 nt, Staphylococcus aureus subsp. aureus Mu50
aaaacuuauuugccauaua

SEQ ID NO: 2047489 - RNA, 14 nt, Staphylococcus aureus subsp. aureus Mu50
aaaagaaaaauuuu

SEQ ID NO: 2047490 - RNA, 12 nt, Staphylococcus aureus subsp. aureus Mu50
aaaacuuuucau

SEQ ID NO: 2047491 - RNA, 22 nt, Staphylococcus aureus subsp. aureus Mu50
aaaacuugugauauauaaccau

SEQ ID NO: 2047492 - RNA, 13 nt, Staphylococcus aureus subsp. aureus Mu50
aaaacuucuuaac

SEQ ID NO: 2047493 - RNA, 16 nt, Staphylococcus aureus subsp. aureus Mu50
aaaaaucuuaugaugu

SEQ ID NO: 2047494 - RNA, 19 nt, Staphylococcus aureus subsp. aureus Mu50
aaaaauugcaaugcuauca

SEQ ID NO: 2047495 - RNA, 16 nt, Staphylococcus aureus subsp. aureus Mu50
aaaaauugauauugca

SEQ ID NO: 2047496 - RNA, 13 nt, Staphylococcus aureus subsp. aureus Mu50
aaaacaauaauuu

SEQ ID NO: 2047497 - RNA, 12 nt, Staphylococcus aureus subsp. aureus Mu50
aaaacaucauuc

SEQ ID NO: 2047498 - RNA, 17 nt, Staphylococcus aureus subsp. aureus Mu50
aaaaccguaauuuuaau

SEQ ID NO: 2047499 - RNA, 19 nt, Staphylococcus aureus subsp. aureus Mu50
aaaacgaagucagucaauu

SEQ ID NO: 2047500 - RNA, 13 nt, Staphylococcus aureus subsp. aureus Mu50
aaaaaagauuagu

SEQ ID NO: 2047501 - RNA, 14 nt, Staphylococcus aureus subsp. aureus Mu50
aaaaaaagauuagu

SEQ ID NO: 2047502 - RNA, 12 nt, Staphylococcus aureus subsp. aureus Mu50
aaaaaaugaugc

SEQ ID NO: 2047503 - RNA, 19 nt, Staphylococcus aureus subsp. aureus Mu50
aaaaaccuagggauaauuu

SEQ ID NO: 2047504 - RNA, 14 nt, Staphylococcus aureus subsp. aureus Mu50
aaaaacgguaauuu

SEQ ID NO: 2047505 - RNA, 21 nt, Staphylococcus aureus subsp. aureus Mu50
aaaauuagacguguaaauguu

SEQ ID NO: 2047506 - RNA, 14 nt, Staphylococcus aureus subsp. aureus Mu50
aaaauucaauauua

SEQ ID NO: 2047507 - RNA, 22 nt, Staphylococcus aureus subsp. aureus Mu50
aaaauuauuuggcucuauauca

SEQ ID NO: 2047508 - RNA, 22 nt, Staphylococcus aureus subsp. aureus Mu50
aaaaucugcuuuauuuuaucau

SEQ ID NO: 2047509 - RNA, 13 nt, Staphylococcus aureus subsp. aureus Mu50
aaaaucugcuuua

SEQ ID NO: 2047510 - RNA, 17 nt, Staphylococcus aureus subsp. aureus Mu50
aaaaugaagaauacaaa

SEQ ID NO: 2047511 - RNA, 13 nt, Staphylococcus aureus subsp. aureus Mu50
aaaaugaaaugaa

SEQ ID NO: 2047512 - RNA, 20 nt, Staphylococcus aureus subsp. aureus Mu50
aaaaucguuauaaguacaaa

SEQ ID NO: 2047513 - RNA, 17 nt, Staphylococcus aureus subsp. aureus Mu50
aaaaucucauaauaauu

SEQ ID NO: 2047514 - RNA, 20 nt, Staphylococcus aureus subsp. aureus Mu50
aaaaucucgacacuauacca

SEQ ID NO: 2047515 - RNA, 18 nt, Staphylococcus aureus subsp. aureus Mu50
aaaauggugcgaauaaua

SEQ ID NO: 2047516 - RNA, 19 nt, Staphylococcus aureus subsp. aureus Mu50
aaaauuaauaauuuuccau

SEQ ID NO: 2047517 - RNA, 20 nt, Staphylococcus aureus subsp. aureus Mu50
aaaauguuaauaaugacuga

SEQ ID NO: 2047518 - RNA, 13 nt, Staphylococcus aureus subsp. aureus Mu50
aaaauuaaaaugu

SEQ ID NO: 2047519 - RNA, 19 nt, Staphylococcus aureus subsp. aureus Mu50
aaaaugauagcuaaacauu

SEQ ID NO: 2047520 - RNA, 13 nt, Staphylococcus aureus subsp. aureus Mu50
aaaaugaauaauu

SEQ ID NO: 2047521 - RNA, 13 nt, Staphylococcus aureus subsp. aureus Mu50
aaaaugaauagua

SEQ ID NO: 2047522 - RNA, 12 nt, Staphylococcus aureus subsp. aureus Mu50
aaaaugaaugaa

SEQ ID NO: 2047523 - RNA, 15 nt, Staphylococcus aureus subsp. aureus Mu50
aaaagccaacacauu

SEQ ID NO: 2047524 - RNA, 13 nt, Staphylococcus aureus subsp. aureus Mu50
aaaagccaccuau

SEQ ID NO: 2047525 - RNA, 17 nt, Staphylococcus aureus subsp. aureus Mu50
aaaagaucgauacuuuu

SEQ ID NO: 2047526 - RNA, 19 nt, Staphylococcus aureus subsp. aureus Mu50
aaaagauucggaaaauaug

SEQ ID NO: 2047527 - RNA, 22 nt, Staphylococcus aureus subsp. aureus Mu50
aaaagguuguuuuucaucauua

SEQ ID NO: 2047528 - RNA, 13 nt, Staphylococcus aureus subsp. aureus Mu50
aaaaguacuuuaa

SEQ ID NO: 2047529 - RNA, 16 nt, Staphylococcus aureus subsp. aureus Mu50
aaaauaaaacgacuca

SEQ ID NO: 2047530 - RNA, 16 nt, Staphylococcus aureus subsp. aureus Mu50
aaaaguuguauucuga

SEQ ID NO: 2047531 - RNA, 18 nt, Staphylococcus aureus subsp. aureus Mu50
aaaauaacaacgauaauu

SEQ ID NO: 2047532 - RNA, 18 nt, Staphylococcus aureus subsp. aureus Mu50
aaaaguuuguauauucuu

SEQ ID NO: 2047533 - RNA, 19 nt, Staphylococcus aureus subsp. aureus Mu50
aaaaguguugacuuuauca

SEQ ID NO: 2047534 - RNA, 20 nt, Staphylococcus aureus subsp. aureus Mu50
aaaauccucacaaauuugaa

SEQ ID NO: 2047535 - RNA, 21 nt, Staphylococcus aureus subsp. aureus Mu50
aaaauccucacaaauuugaau

SEQ ID NO: 2047536 - RNA, 11 nt, Staphylococcus aureus subsp. aureus Mu50
aaaauauccug

SEQ ID NO: 2047537 - RNA, 15 nt, Staphylococcus aureus subsp. aureus Mu50
aaaauauugaauaau

SEQ ID NO: 2047538 - RNA, 22 nt, Staphylococcus aureus subsp. aureus Mu50
aaaauauaguggugguacuuuu

SEQ ID NO: 2047539 - RNA, 15 nt, Staphylococcus aureus subsp. aureus Mu50
aaaauaauagauaau

SEQ ID NO: 2047540 - RNA, 11 nt, Staphylococcus aureus subsp. aureus Mu50
uuuuuuuaaag

SEQ ID NO: 2047541 - RNA, 19 nt, Staphylococcus aureus subsp. aureus Mu50
uuuuucauaauuaauaaca

SEQ ID NO: 2047542 - RNA, 16 nt, Staphylococcus aureus subsp. aureus Mu50
uuuuucaucauuaaaa

SEQ ID NO: 2047543 - RNA, 22 nt, Staphylococcus aureus subsp. aureus Mu50
uuuucagcuaauugucguucuu

SEQ ID NO: 2047544 - RNA, 16 nt, Staphylococcus aureus subsp. aureus Mu50
uuuucauauacuuaac

SEQ ID NO: 2047545 - RNA, 20 nt, Staphylococcus aureus subsp. aureus Mu50
uuuucauagaacaaaaugua

SEQ ID NO: 2047546 - RNA, 21 nt, Staphylococcus aureus subsp. aureus Mu50
uuuucauagaacaaaauguag

SEQ ID NO: 2047547 - RNA, 20 nt, Staphylococcus aureus subsp. aureus Mu50
uuuaccuguuucuuuacuuc

SEQ ID NO: 2047548 - RNA, 20 nt, Staphylococcus aureus subsp. aureus Mu50
uuuucaaaaucuuuaucagu

SEQ ID NO: 2047549 - RNA, 11 nt, Staphylococcus aureus subsp. aureus Mu50
uuuucacuuca

SEQ ID NO: 2047550 - RNA, 16 nt, Staphylococcus aureus subsp. aureus Mu50
uuuucacgaauaucuu

SEQ ID NO: 2047551 - RNA, 18 nt, Staphylococcus aureus subsp. aureus Mu50
uuuucaacaguuuuaaag

SEQ ID NO: 2047552 - RNA, 18 nt, Staphylococcus aureus subsp. aureus Mu50
uuuucaacauaauauuuc

SEQ ID NO: 2047553 - RNA, 21 nt, Staphylococcus aureus subsp. aureus Mu50
uuuucaaacauauucauucua

SEQ ID NO: 2047554 - RNA, 15 nt, Staphylococcus aureus subsp. aureus Mu50
uuuugagcaauaaug

SEQ ID NO: 2047555 - RNA, 19 nt, Staphylococcus aureus subsp. aureus Mu50
uuuugagagauuauuuaaa

SEQ ID NO: 2047556 - RNA, 12 nt, Staphylococcus aureus subsp. aureus Mu50
uuuugagauauu

SEQ ID NO: 2047557 - RNA, 13 nt, Staphylococcus aureus subsp. aureus Mu50
uuuugaauuacag

SEQ ID NO: 2047558 - RNA, 18 nt, Staphylococcus aureus subsp. aureus Mu50
uuuugaauguuucuccua

SEQ ID NO: 2047559 - RNA, 21 nt, Staphylococcus aureus subsp. aureus Mu50
uuuugcccaugucaugaauuu

SEQ ID NO: 2047560 - RNA, 14 nt, Staphylococcus aureus subsp. aureus Mu50
uuuugcaaaacgca

SEQ ID NO: 2047561 - RNA, 14 nt, Staphylococcus aureus subsp. aureus Mu50
uuuugcacuaaugg

SEQ ID NO: 2047562 - RNA, 19 nt, Staphylococcus aureus subsp. aureus Mu50
uuuucucgauuaauuuucu

SEQ ID NO: 2047563 - RNA, 17 nt, Staphylococcus aureus subsp. aureus Mu50
uuuucugccauaaacau

SEQ ID NO: 2047564 - RNA, 22 nt, Staphylococcus aureus subsp. aureus Mu50
uuuucuugcauacgaauuaaaa

SEQ ID NO: 2047565 - RNA, 20 nt, Staphylococcus aureus subsp. aureus Mu50
uuuucuuuaucuauaugcau

SEQ ID NO: 2047566 - RNA, 17 nt, Staphylococcus aureus subsp. aureus Mu50
uuuuuauuaguauucaa

SEQ ID NO: 2047567 - RNA, 20 nt, Staphylococcus aureus subsp. aureus Mu50
uuuuuaucuguagaaacacu

SEQ ID NO: 2047568 - RNA, 11 nt, Staphylococcus aureus subsp. aureus Mu50
uuuuuauauug

SEQ ID NO: 2047569 - RNA, 23 nt, Staphylococcus aureus subsp. aureus Mu50
uuuuuaucgaaagguauaucuuc

SEQ ID NO: 2047570 - RNA, 19 nt, Staphylococcus aureus subsp. aureus Mu50
uuuuuagguuauauuuaaa

SEQ ID NO: 2047571 - RNA, 15 nt, Staphylococcus aureus subsp. aureus Mu50
uuuuuaguaauaaca

SEQ ID NO: 2047572 - RNA, 13 nt, Staphylococcus aureus subsp. aureus Mu50
uuuuuaguaguuu

SEQ ID NO: 2047573 - RNA, 18 nt, Staphylococcus aureus subsp. aureus Mu50
uuuuuauaaguauucaua

SEQ ID NO: 2047574 - RNA, 14 nt, Staphylococcus aureus subsp. aureus Mu50
uuuuucaaugucua

SEQ ID NO: 2047575 - RNA, 19 nt, Staphylococcus aureus subsp. aureus Mu50
uuuuucaauuaaauguuua

SEQ ID NO: 2047576 - RNA, 22 nt, Staphylococcus aureus subsp. aureus Mu50
uuuuucagcuguccgauuuuuu

SEQ ID NO: 2047577 - RNA, 17 nt, Staphylococcus aureus subsp. aureus Mu50
uuuuucaaauaauauaa

SEQ ID NO: 2047578 - RNA, 16 nt, Staphylococcus aureus subsp. aureus Mu50
uuuuucaaauauauca

SEQ ID NO: 2047579 - RNA, 13 nt, Staphylococcus aureus subsp. aureus Mu50
uuuuuauuuacuc

SEQ ID NO: 2047580 - RNA, 13 nt, Staphylococcus aureus subsp. aureus Mu50
uuuuuauuauaau

SEQ ID NO: 2047581 - RNA, 15 nt, Staphylococcus aureus subsp. aureus Mu50
uuuuuauuauacacu

SEQ ID NO: 2047582 - RNA, 15 nt, Staphylococcus aureus subsp. aureus Mu50
uuuuuaauuuugaca

SEQ ID NO: 2047583 - RNA, 17 nt, Staphylococcus aureus subsp. aureus Mu50
uuuuuaauuuuaucucc

SEQ ID NO: 2047584 - RNA, 16 nt, Staphylococcus aureus subsp. aureus Mu50
uuuuuaauuauuuccc

SEQ ID NO: 2047585 - RNA, 18 nt, Staphylococcus aureus subsp. aureus Mu50
uuuuuagccccagcaaau

SEQ ID NO: 2047586 - RNA, 20 nt, Staphylococcus aureus subsp. aureus Mu50
uuuuuagacauuaaaaaauc

SEQ ID NO: 2047587 - RNA, 23 nt, Staphylococcus aureus subsp. aureus Mu50
uuuuuaacuuuaacaucugaauc

SEQ ID NO: 2047588 - RNA, 12 nt, Staphylococcus aureus subsp. aureus Mu50
uuuuuaacaaaa

SEQ ID NO: 2047589 - RNA, 12 nt, Staphylococcus aureus subsp. aureus Mu50
uuuuuaauaauu

SEQ ID NO: 2047590 - RNA, 17 nt, Staphylococcus aureus subsp. aureus Mu50
uuuuuaaagcuggggaa

SEQ ID NO: 2047591 - RNA, 14 nt, Staphylococcus aureus subsp. aureus Mu50
uuuuuaaaucuaca

SEQ ID NO: 2047592 - RNA, 15 nt, Staphylococcus aureus subsp. aureus Mu50
uuuugcuaaccauca

SEQ ID NO: 2047593 - RNA, 14 nt, Staphylococcus aureus subsp. aureus Mu50
uuuugcuguauaua

SEQ ID NO: 2047594 - RNA, 16 nt, Staphylococcus aureus subsp. aureus Mu50
uuuugcgaaaauauca

SEQ ID NO: 2047595 - RNA, 18 nt, Staphylococcus aureus subsp. aureus Mu50
uuuuggaacauauucaua

SEQ ID NO: 2047596 - RNA, 22 nt, Staphylococcus aureus subsp. aureus Mu50
uuuuggcuuaucaagcaccuua

SEQ ID NO: 2047597 - RNA, 21 nt, Staphylococcus aureus subsp. aureus Mu50
uuuugguucuauaauucacuu

SEQ ID NO: 2047598 - RNA, 17 nt, Staphylococcus aureus subsp. aureus Mu50
uuuuggucaaguaaaug

SEQ ID NO: 2047599 - RNA, 20 nt, Staphylococcus aureus subsp. aureus Mu50
uuuuggucaaguaaauguuu

SEQ ID NO: 2047600 - RNA, 14 nt, Staphylococcus aureus subsp. aureus Mu50
uuuuuaaaaauaca

SEQ ID NO: 2047601 - RNA, 12 nt, Staphylococcus aureus subsp. aureus Mu50
uuuuguuuugcu

SEQ ID NO: 2047602 - RNA, 14 nt, Staphylococcus aureus subsp. aureus Mu50
uuuuguuaauuuuu

SEQ ID NO: 2047603 - RNA, 15 nt, Staphylococcus aureus subsp. aureus Mu50
uuuuguuaauuuuuu

SEQ ID NO: 2047604 - RNA, 14 nt, Staphylococcus aureus subsp. aureus Mu50
uuuuguuguacuuc

SEQ ID NO: 2047605 - RNA, 15 nt, Staphylococcus aureus subsp. aureus Mu50
uuuuguuguacuucc

SEQ ID NO: 2047606 - RNA, 13 nt, Staphylococcus aureus subsp. aureus Mu50
uuuugugauuuuu

SEQ ID NO: 2047607 - RNA, 17 nt, Staphylococcus aureus subsp. aureus Mu50
uuuuguaucucugaaaa

SEQ ID NO: 2047608 - RNA, 18 nt, Staphylococcus aureus subsp. aureus Mu50
uuuuguaagacuucccaa

SEQ ID NO: 2047609 - RNA, 17 nt, Staphylococcus aureus subsp. aureus Mu50
uucuaaccauucguaau

SEQ ID NO: 2047610 - RNA, 22 nt, Staphylococcus aureus subsp. aureus Mu50
uucuaacggcguuuguuucuua

SEQ ID NO: 2047611 - RNA, 21 nt, Staphylococcus aureus subsp. aureus Mu50
uucuaacgguaaauaaccacu

SEQ ID NO: 2047612 - RNA, 22 nt, Staphylococcus aureus subsp. aureus Mu50
uucuaaauuauuuauucauuau

SEQ ID NO: 2047613 - RNA, 14 nt, Staphylococcus aureus subsp. aureus Mu50
uucguaauaaacau

SEQ ID NO: 2047614 - RNA, 21 nt, Staphylococcus aureus subsp. aureus Mu50
uucguaauugucuuuauaaaa

SEQ ID NO: 2047615 - RNA, 19 nt, Staphylococcus aureus subsp. aureus Mu50
uucguacaucguugccauu

SEQ ID NO: 2047616 - RNA, 22 nt, Staphylococcus aureus subsp. aureus Mu50
uucguaaaucgugucaaaugcc

SEQ ID NO: 2047617 - RNA, 16 nt, Staphylococcus aureus subsp. aureus Mu50
uucguaacauuuaaaa

SEQ ID NO: 2047618 - RNA, 17 nt, Staphylococcus aureus subsp. aureus Mu50
uucguaacauuuaaaaa

SEQ ID NO: 2047619 - RNA, 13 nt, Staphylococcus aureus subsp. aureus Mu50
uucuaagucucuu

SEQ ID NO: 2047620 - RNA, 15 nt, Staphylococcus aureus subsp. aureus Mu50
uucuaaguguuuuau

SEQ ID NO: 2047621 - RNA, 19 nt, Staphylococcus aureus subsp. aureus Mu50
uucuaagucucuugucauu

SEQ ID NO: 2047622 - RNA, 17 nt, Staphylococcus aureus subsp. aureus Mu50
uucuaaguguugaccau

SEQ ID NO: 2047623 - RNA, 16 nt, Staphylococcus aureus subsp. aureus Mu50
uucuaaguguuuuaua

SEQ ID NO: 2047624 - RNA, 18 nt, Staphylococcus aureus subsp. aureus Mu50
uucuacuuaguaauaaga

SEQ ID NO: 2047625 - RNA, 20 nt, Staphylococcus aureus subsp. aureus Mu50
uucuaaugcuaauuuaacug

SEQ ID NO: 2047626 - RNA, 22 nt, Staphylococcus aureus subsp. aureus Mu50
uucuagcaacugaucauuuuca

SEQ ID NO: 2047627 - RNA, 21 nt, Staphylococcus aureus subsp. aureus Mu50
uucuagcaucgauguuaucga

SEQ ID NO: 2047628 - RNA, 21 nt, Staphylococcus aureus subsp. aureus Mu50
uucuccuucaauguucaauuc

SEQ ID NO: 2047629 - RNA, 18 nt, Staphylococcus aureus subsp. aureus Mu50
uucucauacuauaagcaa

SEQ ID NO: 2047630 - RNA, 13 nt, Staphylococcus aureus subsp. aureus Mu50
uucucauuauaau

SEQ ID NO: 2047631 - RNA, 13 nt, Staphylococcus aureus subsp. aureus Mu50
uucuccuaauaau

SEQ ID NO: 2047632 - RNA, 17 nt, Staphylococcus aureus subsp. aureus Mu50
uucucauuaaccuuaca

SEQ ID NO: 2047633 - RNA, 13 nt, Staphylococcus aureus subsp. aureus Mu50
uucuaguuuucau

SEQ ID NO: 2047634 - RNA, 23 nt, Staphylococcus aureus subsp. aureus Mu50
uucuauacaaugaauuucuaauu

SEQ ID NO: 2047635 - RNA, 16 nt, Staphylococcus aureus subsp. aureus Mu50
uucuauacauuccaaa

SEQ ID NO: 2047636 - RNA, 22 nt, Staphylococcus aureus subsp. aureus Mu50
uucuuagauuuuauauaaaaag

SEQ ID NO: 2047637 - RNA, 19 nt, Staphylococcus aureus subsp. aureus Mu50
uucuuagauuuucacuaau

SEQ ID NO: 2047638 - RNA, 22 nt, Staphylococcus aureus subsp. aureus Mu50
uucuuagauuuucacuaauauu

SEQ ID NO: 2047639 - RNA, 16 nt, Staphylococcus aureus subsp. aureus Mu50
uucuguaauaauauca

SEQ ID NO: 2047640 - RNA, 23 nt, Staphylococcus aureus subsp. aureus Mu50
uucuucaccaguuugugguaaug

SEQ ID NO: 2047641 - RNA, 19 nt, Staphylococcus aureus subsp. aureus Mu50
uucuucaaccauuuguucu

SEQ ID NO: 2047642 - RNA, 18 nt, Staphylococcus aureus subsp. aureus Mu50
uucuucaaccauuuguuc

SEQ ID NO: 2047643 - RNA, 22 nt, Staphylococcus aureus subsp. aureus Mu50
uucuucaaaaaauaauagcaaa

SEQ ID NO: 2047644 - RNA, 23 nt, Staphylococcus aureus subsp. aureus Mu50
uucuuauuuauucauaacguguu

SEQ ID NO: 2047645 - RNA, 16 nt, Staphylococcus aureus subsp. aureus Mu50
uucuucaaaaaauaau

SEQ ID NO: 2047646 - RNA, 12 nt, Staphylococcus aureus subsp. aureus Mu50
uucuugaauaaa

SEQ ID NO: 2047647 - RNA, 19 nt, Staphylococcus aureus subsp. aureus Mu50
uucuugagcuguuacacuu

SEQ ID NO: 2047648 - RNA, 22 nt, Staphylococcus aureus subsp. aureus Mu50
uucuuccaacacccauauaauu

SEQ ID NO: 2047649 - RNA, 12 nt, Staphylococcus aureus subsp. aureus Mu50
uucuucaucaug

SEQ ID NO: 2047650 - RNA, 15 nt, Staphylococcus aureus subsp. aureus Mu50
uucuucaucuuuuau

SEQ ID NO: 2047651 - RNA, 17 nt, Staphylococcus aureus subsp. aureus Mu50
uucuucagguguuuuac

SEQ ID NO: 2047652 - RNA, 20 nt, Staphylococcus aureus subsp. aureus Mu50
uucuucacugcuguuuuuau

SEQ ID NO: 2047653 - RNA, 17 nt, Staphylococcus aureus subsp. aureus Mu50
uucuucacuaaaaauau

SEQ ID NO: 2047654 - RNA, 18 nt, Staphylococcus aureus subsp. aureus Mu50
uucuucacuaaaaauaua

SEQ ID NO: 2047655 - RNA, 23 nt, Staphylococcus aureus subsp. aureus Mu50
uucugaaaugauacauuauuaaa

SEQ ID NO: 2047656 - RNA, 21 nt, Staphylococcus aureus subsp. aureus Mu50
uucucgauacaaaggauuauu

SEQ ID NO: 2047657 - RNA, 19 nt, Staphylococcus aureus subsp. aureus Mu50
uucucuaacuuuaccaaua

SEQ ID NO: 2047658 - RNA, 19 nt, Staphylococcus aureus subsp. aureus Mu50
uucuggaauaccuaauuca

SEQ ID NO: 2047659 - RNA, 18 nt, Staphylococcus aureus subsp. aureus Mu50
uugauuuugaauaaaaaa

SEQ ID NO: 2047660 - RNA, 17 nt, Staphylococcus aureus subsp. aureus Mu50
uugauuuuuuuguucuu

SEQ ID NO: 2047661 - RNA, 22 nt, Staphylococcus aureus subsp. aureus Mu50
uugcaauaaaauuagccuaauu

SEQ ID NO: 2047662 - RNA, 13 nt, Staphylococcus aureus subsp. aureus Mu50
uugcaaguauuuu

SEQ ID NO: 2047663 - RNA, 20 nt, Staphylococcus aureus subsp. aureus Mu50
uugcaauugcaaugaauaac

SEQ ID NO: 2047664 - RNA, 18 nt, Staphylococcus aureus subsp. aureus Mu50
uugcaauggcaaccuuuu

SEQ ID NO: 2047665 - RNA, 16 nt, Staphylococcus aureus subsp. aureus Mu50
uugaucugauuucacu

SEQ ID NO: 2047666 - RNA, 13 nt, Staphylococcus aureus subsp. aureus Mu50
uugaucuuuuaua

SEQ ID NO: 2047667 - RNA, 14 nt, Staphylococcus aureus subsp. aureus Mu50
uugauucuuauaug

SEQ ID NO: 2047668 - RNA, 20 nt, Staphylococcus aureus subsp. aureus Mu50
uugauucuucaccaguuugu

SEQ ID NO: 2047669 - RNA, 18 nt, Staphylococcus aureus subsp. aureus Mu50
uugauucuagugaaauac

SEQ ID NO: 2047670 - RNA, 15 nt, Staphylococcus aureus subsp. aureus Mu50
uugauugauaugguu

SEQ ID NO: 2047671 - RNA, 19 nt, Staphylococcus aureus subsp. aureus Mu50
uugagacaaaaauaaacca

SEQ ID NO: 2047672 - RNA, 14 nt, Staphylococcus aureus subsp. aureus Mu50
uugaguauuaaauu

SEQ ID NO: 2047673 - RNA, 15 nt, Staphylococcus aureus subsp. aureus Mu50
uugaguauuaaauuu

SEQ ID NO: 2047674 - RNA, 18 nt, Staphylococcus aureus subsp. aureus Mu50
uugaguugaaaauaaucg

SEQ ID NO: 2047675 - RNA, 15 nt, Staphylococcus aureus subsp. aureus Mu50
uugaucuacuaaaga

SEQ ID NO: 2047676 - RNA, 18 nt, Staphylococcus aureus subsp. aureus Mu50
uugauaugcucucuucaa

SEQ ID NO: 2047677 - RNA, 20 nt, Staphylococcus aureus subsp. aureus Mu50
uugauauguuuccucuuuaa

SEQ ID NO: 2047678 - RNA, 11 nt, Staphylococcus aureus subsp. aureus Mu50
uugaucaaccu

SEQ ID NO: 2047679 - RNA, 16 nt, Staphylococcus aureus subsp. aureus Mu50
uugaucaaaaagacag

SEQ ID NO: 2047680 - RNA, 17 nt, Staphylococcus aureus subsp. aureus Mu50
uugauauuuuucacgua

SEQ ID NO: 2047681 - RNA, 19 nt, Staphylococcus aureus subsp. aureus Mu50
uugauaaaaaaugaauguu

SEQ ID NO: 2047682 - RNA, 21 nt, Staphylococcus aureus subsp. aureus Mu50
uugauaaaaaaugaauguuaa

SEQ ID NO: 2047683 - RNA, 13 nt, Staphylococcus aureus subsp. aureus Mu50
uugauaaaacuaa

SEQ ID NO: 2047684 - RNA, 17 nt, Staphylococcus aureus subsp. aureus Mu50
uugauaaauauugaaca

SEQ ID NO: 2047685 - RNA, 18 nt, Staphylococcus aureus subsp. aureus Mu50
uugauaugguuagagaaa

SEQ ID NO: 2047686 - RNA, 19 nt, Staphylococcus aureus subsp. aureus Mu50
uugauaugguuagagaaaa

SEQ ID NO: 2047687 - RNA, 22 nt, Staphylococcus aureus subsp. aureus Mu50
uugauaugguuagagaaaaauc

SEQ ID NO: 2047688 - RNA, 15 nt, Staphylococcus aureus subsp. aureus Mu50
uucuuugucaucuuu

SEQ ID NO: 2047689 - RNA, 21 nt, Staphylococcus aureus subsp. aureus Mu50
uucuuuguguuugcuuuuauu

SEQ ID NO: 2047690 - RNA, 18 nt, Staphylococcus aureus subsp. aureus Mu50
uucuuuuaaguuaucaaa

SEQ ID NO: 2047691 - RNA, 20 nt, Staphylococcus aureus subsp. aureus Mu50
uucuuuuucagcuaauuguc

SEQ ID NO: 2047692 - RNA, 22 nt, Staphylococcus aureus subsp. aureus Mu50
uucuuuuugcguuuuuaaauaa

SEQ ID NO: 2047693 - RNA, 13 nt, Staphylococcus aureus subsp. aureus Mu50
uucuuuuugcuuu

SEQ ID NO: 2047694 - RNA, 17 nt, Staphylococcus aureus subsp. aureus Mu50
uucuuuuuuuguuacca

SEQ ID NO: 2047695 - RNA, 18 nt, Staphylococcus aureus subsp. aureus Mu50
uucuuuuuguuguuuuaa

SEQ ID NO: 2047696 - RNA, 23 nt, Staphylococcus aureus subsp. aureus Mu50
uugaaaccuuggcuucauguucu

SEQ ID NO: 2047697 - RNA, 13 nt, Staphylococcus aureus subsp. aureus Mu50
uugaaaauuucac

SEQ ID NO: 2047698 - RNA, 13 nt, Staphylococcus aureus subsp. aureus Mu50
uugaaaaagacua

SEQ ID NO: 2047699 - RNA, 20 nt, Staphylococcus aureus subsp. aureus Mu50
uugaaaaaccaaguuuugca

SEQ ID NO: 2047700 - RNA, 23 nt, Staphylococcus aureus subsp. aureus Mu50
uugaacauauuauaaaaguguaa

SEQ ID NO: 2047701 - RNA, 17 nt, Staphylococcus aureus subsp. aureus Mu50
uugaaacgguaucaaca

SEQ ID NO: 2047702 - RNA, 19 nt, Staphylococcus aureus subsp. aureus Mu50
uugaaacuaauaauuugua

SEQ ID NO: 2047703 - RNA, 13 nt, Staphylococcus aureus subsp. aureus Mu50
uugaauuuuauua

SEQ ID NO: 2047704 - RNA, 13 nt, Staphylococcus aureus subsp. aureus Mu50
uugacaauacaaa

SEQ ID NO: 2047705 - RNA, 13 nt, Staphylococcus aureus subsp. aureus Mu50
uugaccuucaguu

SEQ ID NO: 2047706 - RNA, 11 nt, Staphylococcus aureus subsp. aureus Mu50
uugaacuuuua

SEQ ID NO: 2047707 - RNA, 15 nt, Staphylococcus aureus subsp. aureus Mu50
uugaagaauaaaaaa

SEQ ID NO: 2047708 - RNA, 23 nt, Staphylococcus aureus subsp. aureus Mu50
uugaagaaggaugaguuuaaaaa

SEQ ID NO: 2047709 - RNA, 15 nt, Staphylococcus aureus subsp. aureus Mu50
uugaacgauaacaau

SEQ ID NO: 2047710 - RNA, 21 nt, Staphylococcus aureus subsp. aureus Mu50
uugaacgauaacaauuuauua

SEQ ID NO: 2047711 - RNA, 23 nt, Staphylococcus aureus subsp. aureus Mu50
uugaauugacuuacauuuuaaua

SEQ ID NO: 2047712 - RNA, 22 nt, Staphylococcus aureus subsp. aureus Mu50
uugaauuaacaauauuaaauuu

SEQ ID NO: 2047713 - RNA, 22 nt, Staphylococcus aureus subsp. aureus Mu50
uugaagaauguuucauaugcau

SEQ ID NO: 2047714 - RNA, 18 nt, Staphylococcus aureus subsp. aureus Mu50
uugaagaauguuucauau

SEQ ID NO: 2047715 - RNA, 23 nt, Staphylococcus aureus subsp. aureus Mu50
uugaaugauauuaacuguaccau

SEQ ID NO: 2047716 - RNA, 18 nt, Staphylococcus aureus subsp. aureus Mu50
uugaaugguauaauuccu

SEQ ID NO: 2047717 - RNA, 20 nt, Staphylococcus aureus subsp. aureus Mu50
uugaauggcucguuuuuuua

SEQ ID NO: 2047718 - RNA, 19 nt, Staphylococcus aureus subsp. aureus Mu50
uuguugaauaauuaauguu

SEQ ID NO: 2047719 - RNA, 20 nt, Staphylococcus aureus subsp. aureus Mu50
uuguucuuucuuguucuaaa

SEQ ID NO: 2047720 - RNA, 14 nt, Staphylococcus aureus subsp. aureus Mu50
uuguugaaauuucu

SEQ ID NO: 2047721 - RNA, 16 nt, Staphylococcus aureus subsp. aureus Mu50
uuguucaacuaaauuu

SEQ ID NO: 2047722 - RNA, 14 nt, Staphylococcus aureus subsp. aureus Mu50
uuguuucuaaugcu

SEQ ID NO: 2047723 - RNA, 12 nt, Staphylococcus aureus subsp. aureus Mu50
uuguuucaccag

SEQ ID NO: 2047724 - RNA, 18 nt, Staphylococcus aureus subsp. aureus Mu50
uuguuuaucuguaucaaa

SEQ ID NO: 2047725 - RNA, 21 nt, Staphylococcus aureus subsp. aureus Mu50
uugugacgcugguaauauuuu

SEQ ID NO: 2047726 - RNA, 23 nt, Staphylococcus aureus subsp. aureus Mu50
uugugaugauaauuaaugccauu

SEQ ID NO: 2047727 - RNA, 23 nt, Staphylococcus aureus subsp. aureus Mu50
uugugguuguuaauguauuaauu

SEQ ID NO: 2047728 - RNA, 18 nt, Staphylococcus aureus subsp. aureus Mu50
uuguguauuguuuuacuu

SEQ ID NO: 2047729 - RNA, 24 nt, Staphylococcus aureus subsp. aureus Mu50
uuguguauuuuuauuguuuuggcu

SEQ ID NO: 2047730 - RNA, 13 nt, Staphylococcus aureus subsp. aureus Mu50
uuguguuauguau

SEQ ID NO: 2047731 - RNA, 19 nt, Staphylococcus aureus subsp. aureus Mu50
uuguuaucguucaauguua

SEQ ID NO: 2047732 - RNA, 15 nt, Staphylococcus aureus subsp. aureus Mu50
uuguuauaucuaauu

SEQ ID NO: 2047733 - RNA, 18 nt, Staphylococcus aureus subsp. aureus Mu50
uuguuauaaguaaauaau

SEQ ID NO: 2047734 - RNA, 14 nt, Staphylococcus aureus subsp. aureus Mu50
uuguuauaaaggaa

SEQ ID NO: 2047735 - RNA, 15 nt, Staphylococcus aureus subsp. aureus Mu50
uugucuuuuauauuu

SEQ ID NO: 2047736 - RNA, 13 nt, Staphylococcus aureus subsp. aureus Mu50
uugucuuuuauau

SEQ ID NO: 2047737 - RNA, 15 nt, Staphylococcus aureus subsp. aureus Mu50
uuguauuuuucaaau

SEQ ID NO: 2047738 - RNA, 21 nt, Staphylococcus aureus subsp. aureus Mu50
uugucaaaauugaacuuugua

SEQ ID NO: 2047739 - RNA, 18 nt, Staphylococcus aureus subsp. aureus Mu50
uuguauuuaauaaguuaa

SEQ ID NO: 2047740 - RNA, 21 nt, Staphylococcus aureus subsp. aureus Mu50
uuguauuuccuuaauaugcac

SEQ ID NO: 2047741 - RNA, 20 nt, Staphylococcus aureus subsp. aureus Mu50
uuguccuaacgcuaauuuua

SEQ ID NO: 2047742 - RNA, 18 nt, Staphylococcus aureus subsp. aureus Mu50
uuguauuguuuucaucau

SEQ ID NO: 2047743 - RNA, 20 nt, Staphylococcus aureus subsp. aureus Mu50
uuguaacaagcuuuuuucaa

SEQ ID NO: 2047744 - RNA, 18 nt, Staphylococcus aureus subsp. aureus Mu50
uuguaacacacuuauaau

SEQ ID NO: 2047745 - RNA, 18 nt, Staphylococcus aureus subsp. aureus Mu50
uuguaaagcaugaauagc

SEQ ID NO: 2047746 - RNA, 12 nt, Staphylococcus aureus subsp. aureus Mu50
uuguaaauuuaa

SEQ ID NO: 2047747 - RNA, 20 nt, Staphylococcus aureus subsp. aureus Mu50
uuguaaauuuauuuuuaauu

SEQ ID NO: 2047748 - RNA, 21 nt, Staphylococcus aureus subsp. aureus Mu50
uuguaaauauuuuuuaaaaug

SEQ ID NO: 2047749 - RNA, 14 nt, Staphylococcus aureus subsp. aureus Mu50
uuuaccacuuauaa

SEQ ID NO: 2047750 - RNA, 16 nt, Staphylococcus aureus subsp. aureus Mu50
uuuacauuaauuuguc

SEQ ID NO: 2047751 - RNA, 14 nt, Staphylococcus aureus subsp. aureus Mu50
uuuacauucguuua

SEQ ID NO: 2047752 - RNA, 20 nt, Staphylococcus aureus subsp. aureus Mu50
uuuaccauguuuuacaaguu

SEQ ID NO: 2047753 - RNA, 20 nt, Staphylococcus aureus subsp. aureus Mu50
uuuacaagucuuauuuguuu

SEQ ID NO: 2047754 - RNA, 19 nt, Staphylococcus aureus subsp. aureus Mu50
uuuacaaauguauaaauaa

SEQ ID NO: 2047755 - RNA, 22 nt, Staphylococcus aureus subsp. aureus Mu50
uuuacaauuaauuacuguaaau

SEQ ID NO: 2047756 - RNA, 16 nt, Staphylococcus aureus subsp. aureus Mu50
uuuaauguuaaacaau

SEQ ID NO: 2047757 - RNA, 14 nt, Staphylococcus aureus subsp. aureus Mu50
uuuaauguuugcuu

SEQ ID NO: 2047758 - RNA, 21 nt, Staphylococcus aureus subsp. aureus Mu50
uuuaauguacuucaauuuaug

SEQ ID NO: 2047759 - RNA, 20 nt, Staphylococcus aureus subsp. aureus Mu50
uuuaaugauuuuucaucaau

SEQ ID NO: 2047760 - RNA, 21 nt, Staphylococcus aureus subsp. aureus Mu50
uuuaaucguauuagccaauaa

SEQ ID NO: 2047761 - RNA, 23 nt, Staphylococcus aureus subsp. aureus Mu50
uuuaagcugcucgauauaugucu

SEQ ID NO: 2047762 - RNA, 12 nt, Staphylococcus aureus subsp. aureus Mu50
uuuaagcugcuc

SEQ ID NO: 2047763 - RNA, 13 nt, Staphylococcus aureus subsp. aureus Mu50
uuuaagcugcucg

SEQ ID NO: 2047764 - RNA, 12 nt, Staphylococcus aureus subsp. aureus Mu50
uuuaauauauuu

SEQ ID NO: 2047765 - RNA, 23 nt, Staphylococcus aureus subsp. aureus Mu50
uuuaauaguacuuaauuuaaauu

SEQ ID NO: 2047766 - RNA, 20 nt, Staphylococcus aureus subsp. aureus Mu50
uuuaaguaauucauuugcuu

SEQ ID NO: 2047767 - RNA, 23 nt, Staphylococcus aureus subsp. aureus Mu50
uuuaaacaagcaucaugaaauua

SEQ ID NO: 2047768 - RNA, 21 nt, Staphylococcus aureus subsp. aureus Mu50
uuuaaaaaugcuguuuuaugg

SEQ ID NO: 2047769 - RNA, 13 nt, Staphylococcus aureus subsp. aureus Mu50
uuuaaaauuauca

SEQ ID NO: 2047770 - RNA, 21 nt, Staphylococcus aureus subsp. aureus Mu50
uuuaaacguacauuuuuauga

SEQ ID NO: 2047771 - RNA, 15 nt, Staphylococcus aureus subsp. aureus Mu50
uuuaaagaaaaguuu

SEQ ID NO: 2047772 - RNA, 15 nt, Staphylococcus aureus subsp. aureus Mu50
uuuaaagaaaauuuc

SEQ ID NO: 2047773 - RNA, 20 nt, Staphylococcus aureus subsp. aureus Mu50
uuuaaagaacuauuuuaaau

SEQ ID NO: 2047774 - RNA, 16 nt, Staphylococcus aureus subsp. aureus Mu50
uuuaaaaaauuuaaau

SEQ ID NO: 2047775 - RNA, 11 nt, Staphylococcus aureus subsp. aureus Mu50
uuuaaaaugcu

SEQ ID NO: 2047776 - RNA, 16 nt, Staphylococcus aureus subsp. aureus Mu50
uuuaaaaauucauaau

SEQ ID NO: 2047777 - RNA, 13 nt, Staphylococcus aureus subsp. aureus Mu50
uuuaaaaaguuaa

SEQ ID NO: 2047778 - RNA, 15 nt, Staphylococcus aureus subsp. aureus Mu50
uuuaaaaaucaaaga

SEQ ID NO: 2047779 - RNA, 21 nt, Staphylococcus aureus subsp. aureus Mu50
uuuaaagguauugugauuuca

SEQ ID NO: 2047780 - RNA, 16 nt, Staphylococcus aureus subsp. aureus Mu50
uuuaaagcuaaauguu

SEQ ID NO: 2047781 - RNA, 20 nt, Staphylococcus aureus subsp. aureus Mu50
uuuaaaguuguugaaauuuc

SEQ ID NO: 2047782 - RNA, 18 nt, Staphylococcus aureus subsp. aureus Mu50
uuuaaauaaaauuguuga

SEQ ID NO: 2047783 - RNA, 18 nt, Staphylococcus aureus subsp. aureus Mu50
uuuaaaugucuuucaaau

SEQ ID NO: 2047784 - RNA, 20 nt, Staphylococcus aureus subsp. aureus Mu50
uuuaaauguauuuuuacuuu

SEQ ID NO: 2047785 - RNA, 22 nt, Staphylococcus aureus subsp. aureus Mu50
uuuaaauuggaaucccaaugcu

SEQ ID NO: 2047786 - RNA, 23 nt, Staphylococcus aureus subsp. aureus Mu50
uuuaaauuuaacucaacuuaaau

SEQ ID NO: 2047787 - RNA, 14 nt, Staphylococcus aureus subsp. aureus Mu50
uuuaaauuuaagaa

SEQ ID NO: 2047788 - RNA, 14 nt, Staphylococcus aureus subsp. aureus Mu50
uuuaaauuuauaau

SEQ ID NO: 2047789 - RNA, 20 nt, Staphylococcus aureus subsp. aureus Mu50
uuuaaauuuucaucauaauc

SEQ ID NO: 2047790 - RNA, 23 nt, Staphylococcus aureus subsp. aureus Mu50
uuuaaauugacuuuaauugcucu

SEQ ID NO: 2047791 - RNA, 20 nt, Staphylococcus aureus subsp. aureus Mu50
uuuaaauucuuauaaaauaa

SEQ ID NO: 2047792 - RNA, 18 nt, Staphylococcus aureus subsp. aureus Mu50
uuuaagaagucgaauuca

SEQ ID NO: 2047793 - RNA, 15 nt, Staphylococcus aureus subsp. aureus Mu50
uuuaagaucaauauc

SEQ ID NO: 2047794 - RNA, 14 nt, Staphylococcus aureus subsp. aureus Mu50
uuuaacuuccuaaa

SEQ ID NO: 2047795 - RNA, 17 nt, Staphylococcus aureus subsp. aureus Mu50
uuuaacuucuuuuguuu

SEQ ID NO: 2047796 - RNA, 15 nt, Staphylococcus aureus subsp. aureus Mu50
uuuaacaaaauauac

SEQ ID NO: 2047797 - RNA, 18 nt, Staphylococcus aureus subsp. aureus Mu50
uuggucauagaaauuuua

SEQ ID NO: 2047798 - RNA, 20 nt, Staphylococcus aureus subsp. aureus Mu50
uugguaaaaaucucaaaauu

SEQ ID NO: 2047799 - RNA, 19 nt, Staphylococcus aureus subsp. aureus Mu50
uuggugaguguuucauaau

SEQ ID NO: 2047800 - RNA, 17 nt, Staphylococcus aureus subsp. aureus Mu50
uugguuucuuaacauaa

SEQ ID NO: 2047801 - RNA, 17 nt, Staphylococcus aureus subsp. aureus Mu50
uugguuuagacaaccag

SEQ ID NO: 2047802 - RNA, 18 nt, Staphylococcus aureus subsp. aureus Mu50
uugguuuggauaaaauga

SEQ ID NO: 2047803 - RNA, 17 nt, Staphylococcus aureus subsp. aureus Mu50
uuggggaugggccccaa

SEQ ID NO: 2047804 - RNA, 16 nt, Staphylococcus aureus subsp. aureus Mu50
uuggcuugaaguuguu

SEQ ID NO: 2047805 - RNA, 18 nt, Staphylococcus aureus subsp. aureus Mu50
uugcuucauuauauaauu

SEQ ID NO: 2047806 - RNA, 13 nt, Staphylococcus aureus subsp. aureus Mu50
uugcuggauuaca

SEQ ID NO: 2047807 - RNA, 18 nt, Staphylococcus aureus subsp. aureus Mu50
uuggaaauuuauuauaaa

SEQ ID NO: 2047808 - RNA, 18 nt, Staphylococcus aureus subsp. aureus Mu50
uuggaacauauucauaau

SEQ ID NO: 2047809 - RNA, 17 nt, Staphylococcus aureus subsp. aureus Mu50
uugcuuggauaauugca

SEQ ID NO: 2047810 - RNA, 13 nt, Staphylococcus aureus subsp. aureus Mu50
uugcuugaaauua

SEQ ID NO: 2047811 - RNA, 22 nt, Staphylococcus aureus subsp. aureus Mu50
uugcuugaaauuauuauuuaaa

SEQ ID NO: 2047812 - RNA, 17 nt, Staphylococcus aureus subsp. aureus Mu50
uuggauuuuaacaagau

SEQ ID NO: 2047813 - RNA, 20 nt, Staphylococcus aureus subsp. aureus Mu50
uuggauuuuuugguuucuau

SEQ ID NO: 2047814 - RNA, 15 nt, Staphylococcus aureus subsp. aureus Mu50
uuggauuuuaacaag

SEQ ID NO: 2047815 - RNA, 23 nt, Staphylococcus aureus subsp. aureus Mu50
uuggcaauuguuuaucuccuaaa

SEQ ID NO: 2047816 - RNA, 21 nt, Staphylococcus aureus subsp. aureus Mu50
uuggauagguaacuaaaaugu

SEQ ID NO: 2047817 - RNA, 17 nt, Staphylococcus aureus subsp. aureus Mu50
uuggauucaaaugacau

SEQ ID NO: 2047818 - RNA, 19 nt, Staphylococcus aureus subsp. aureus Mu50
uuggauguaauagagaagg

SEQ ID NO: 2047819 - RNA, 23 nt, Staphylococcus aureus subsp. aureus Mu50
uuggaugaacaaaauaacauguu

SEQ ID NO: 2047820 - RNA, 18 nt, Staphylococcus aureus subsp. aureus Mu50
uuggauaauuucuucuuc

SEQ ID NO: 2047821 - RNA, 16 nt, Staphylococcus aureus subsp. aureus Mu50
uuggaaucccaaugcu

SEQ ID NO: 2047822 - RNA, 14 nt, Staphylococcus aureus subsp. aureus Mu50
uuggaaucaucuuu

SEQ ID NO: 2047823 - RNA, 14 nt, Staphylococcus aureus subsp. aureus Mu50
uuggaauagauguu

SEQ ID NO: 2047824 - RNA, 16 nt, Staphylococcus aureus subsp. aureus Mu50
uuggaagcaauuaugg

SEQ ID NO: 2047825 - RNA, 19 nt, Staphylococcus aureus subsp. aureus Mu50
uugcauacgaauuaaaaua

SEQ ID NO: 2047826 - RNA, 21 nt, Staphylococcus aureus subsp. aureus Mu50
uugcauaaucaauuucaccuu

SEQ ID NO: 2047827 - RNA, 19 nt, Staphylococcus aureus subsp. aureus Mu50
uugccauagaaaugugcug

SEQ ID NO: 2047828 - RNA, 19 nt, Staphylococcus aureus subsp. aureus Mu50
uugcucgcgcucuucuuca

SEQ ID NO: 2047829 - RNA, 14 nt, Staphylococcus aureus subsp. aureus Mu50
uugcucuaauccaa

SEQ ID NO: 2047830 - RNA, 20 nt, Staphylococcus aureus subsp. aureus Mu50
uugcucuaauccaaaauaau

SEQ ID NO: 2047831 - RNA, 20 nt, Staphylococcus aureus subsp. aureus Mu50
uugcuagucauaauuuaaaa

SEQ ID NO: 2047832 - RNA, 16 nt, Staphylococcus aureus subsp. aureus Mu50
uugcuauauuaguaua

SEQ ID NO: 2047833 - RNA, 18 nt, Staphylococcus aureus subsp. aureus Mu50
uugcuauauuaguauaau

SEQ ID NO: 2047834 - RNA, 21 nt, Staphylococcus aureus subsp. aureus Mu50
uugccuggcaacguucuacuc

SEQ ID NO: 2047835 - RNA, 20 nt, Staphylococcus aureus subsp. aureus Mu50
uuccuccuaccgcuaaaauu

SEQ ID NO: 2047836 - RNA, 22 nt, Staphylococcus aureus subsp. aureus Mu50
uuccuagcuuuuaugucuaguu

SEQ ID NO: 2047837 - RNA, 18 nt, Staphylococcus aureus subsp. aureus Mu50
uuccuaccccgugaaucu

SEQ ID NO: 2047838 - RNA, 23 nt, Staphylococcus aureus subsp. aureus Mu50
uuccuacacuguuuuauaaauga

SEQ ID NO: 2047839 - RNA, 19 nt, Staphylococcus aureus subsp. aureus Mu50
uuccucaacgggaacauca

SEQ ID NO: 2047840 - RNA, 19 nt, Staphylococcus aureus subsp. aureus Mu50
uuccuaauggucgugcuug

SEQ ID NO: 2047841 - RNA, 18 nt, Staphylococcus aureus subsp. aureus Mu50
uuccguugaauuaacaau

SEQ ID NO: 2047842 - RNA, 21 nt, Staphylococcus aureus subsp. aureus Mu50
uuccugauauuucaacuuuuu

SEQ ID NO: 2047843 - RNA, 15 nt, Staphylococcus aureus subsp. aureus Mu50
uuccugauacaauga

SEQ ID NO: 2047844 - RNA, 17 nt, Staphylococcus aureus subsp. aureus Mu50
uuccugauacaaugauu

SEQ ID NO: 2047845 - RNA, 15 nt, Staphylococcus aureus subsp. aureus Mu50
uucgaaaagaaauuc

SEQ ID NO: 2047846 - RNA, 14 nt, Staphylococcus aureus subsp. aureus Mu50
uucgaaauagguau

SEQ ID NO: 2047847 - RNA, 15 nt, Staphylococcus aureus subsp. aureus Mu50
uuccuuguuggucug

SEQ ID NO: 2047848 - RNA, 23 nt, Staphylococcus aureus subsp. aureus Mu50
uuccuuuagcaaaaauauuuaaa

SEQ ID NO: 2047849 - RNA, 12 nt, Staphylococcus aureus subsp. aureus Mu50
uucgaacuuuug

SEQ ID NO: 2047850 - RNA, 17 nt, Staphylococcus aureus subsp. aureus Mu50
uucgaacuuuuguucua

SEQ ID NO: 2047851 - RNA, 20 nt, Staphylococcus aureus subsp. aureus Mu50
uucgacuacaaguuuauaau

SEQ ID NO: 2047852 - RNA, 19 nt, Staphylococcus aureus subsp. aureus Mu50
uucgauaccuaaaauaccc

SEQ ID NO: 2047853 - RNA, 15 nt, Staphylococcus aureus subsp. aureus Mu50
uucgauaguuuauua

SEQ ID NO: 2047854 - RNA, 14 nt, Staphylococcus aureus subsp. aureus Mu50
uucgauauuuguuu

SEQ ID NO: 2047855 - RNA, 19 nt, Staphylococcus aureus subsp. aureus Mu50
uucgauaauauaacugcau

SEQ ID NO: 2047856 - RNA, 14 nt, Staphylococcus aureus subsp. aureus Mu50
uucgcaaguagucu

SEQ ID NO: 2047857 - RNA, 23 nt, Staphylococcus aureus subsp. aureus Mu50
uucgauucauuuaaaaaucaaag

SEQ ID NO: 2047858 - RNA, 15 nt, Staphylococcus aureus subsp. aureus Mu50
uucgauuauucuuaa

SEQ ID NO: 2047859 - RNA, 19 nt, Staphylococcus aureus subsp. aureus Mu50
uucgauuauuuagauaaaa

SEQ ID NO: 2047860 - RNA, 16 nt, Staphylococcus aureus subsp. aureus Mu50
uucgcagcuuuauaau

SEQ ID NO: 2047861 - RNA, 14 nt, Staphylococcus aureus subsp. aureus Mu50
uucgcauacuuuuu

SEQ ID NO: 2047862 - RNA, 17 nt, Staphylococcus aureus subsp. aureus Mu50
uucgcaucacugcauau

SEQ ID NO: 2047863 - RNA, 23 nt, Staphylococcus aureus subsp. aureus Mu50
uuccgcacugccuuuuuguaauu

SEQ ID NO: 2047864 - RNA, 12 nt, Staphylococcus aureus subsp. aureus Mu50
uucccuacugcu

SEQ ID NO: 2047865 - RNA, 22 nt, Staphylococcus aureus subsp. aureus Mu50
uucccagucaugucccauaaca

SEQ ID NO: 2047866 - RNA, 22 nt, Staphylococcus aureus subsp. aureus Mu50
uucccaucuuuuagguaauaau

SEQ ID NO: 2047867 - RNA, 19 nt, Staphylococcus aureus subsp. aureus Mu50
uucccauuuuuaaaauuau

SEQ ID NO: 2047868 - RNA, 13 nt, Staphylococcus aureus subsp. aureus Mu50
uuccauucauaaa

SEQ ID NO: 2047869 - RNA, 15 nt, Staphylococcus aureus subsp. aureus Mu50
uucccaaauaguuaa

SEQ ID NO: 2047870 - RNA, 13 nt, Staphylococcus aureus subsp. aureus Mu50
uuccaguaugauu

SEQ ID NO: 2047871 - RNA, 14 nt, Staphylococcus aureus subsp. aureus Mu50
uuccauaaauauuu

SEQ ID NO: 2047872 - RNA, 16 nt, Staphylococcus aureus subsp. aureus Mu50
uuccaacacccauaua

SEQ ID NO: 2047873 - RNA, 24 nt, Staphylococcus aureus subsp. aureus Mu50
uuccaaauugaaauuauccuacug

SEQ ID NO: 2047874 - RNA, 17 nt, Staphylococcus aureus subsp. aureus Mu50
uuccaauaauaaaccua

SEQ ID NO: 2047875 - RNA, 19 nt, Staphylococcus aureus subsp. aureus Mu50
uuccaauaauaaaccuaaa

SEQ ID NO: 2047876 - RNA, 23 nt, Staphylococcus aureus subsp. aureus Mu50
uuccaauaauaaaccuaaagaua

SEQ ID NO: 2047877 - RNA, 14 nt, Staphylococcus aureus subsp. aureus Mu50
uuccaauaauaaau

SEQ ID NO: 2047878 - RNA, 16 nt, Staphylococcus aureus subsp. aureus Mu50
uuccaauaauaaauca

SEQ ID NO: 2047879 - RNA, 17 nt, Staphylococcus aureus subsp. aureus Mu50
uuccaaguauuuucucu

SEQ ID NO: 2047880 - RNA, 15 nt, Staphylococcus aureus subsp. aureus Mu50
uuccaagcaucauug

SEQ ID NO: 2047881 - RNA, 18 nt, Staphylococcus aureus subsp. aureus Mu50
uuccaaagaaagcuaaua

SEQ ID NO: 2047882 - RNA, 16 nt, Staphylococcus aureus subsp. aureus Mu50
uuccaaaaauuguaaa

SEQ ID NO: 2047883 - RNA, 21 nt, Staphylococcus aureus subsp. aureus Mu50
uuccaaacacacuguugaaaa

SEQ ID NO: 2047884 - RNA, 20 nt, Staphylococcus aureus subsp. aureus Mu50
uucauuuuuucaaugucuac

SEQ ID NO: 2047885 - RNA, 13 nt, Staphylococcus aureus subsp. aureus Mu50
uuccaaaacaaaa

SEQ ID NO: 2047886 - RNA, 19 nt, Staphylococcus aureus subsp. aureus Mu50
uucauuuuagcaaaagcuu

SEQ ID NO: 2047887 - RNA, 13 nt, Staphylococcus aureus subsp. aureus Mu50
uucauuuuuucaa

SEQ ID NO: 2047888 - RNA, 12 nt, Staphylococcus aureus subsp. aureus Mu50
uuccacuucauc

SEQ ID NO: 2047889 - RNA, 17 nt, Staphylococcus aureus subsp. aureus Mu50
uuccaaucaacuucaua

SEQ ID NO: 2047890 - RNA, 23 nt, Staphylococcus aureus subsp. aureus Mu50
uuccacaacaaucacgauuaaug

SEQ ID NO: 2047891 - RNA, 13 nt, Staphylococcus aureus subsp. aureus Mu50
uuccaauuuguug

SEQ ID NO: 2047892 - RNA, 14 nt, Staphylococcus aureus subsp. aureus Mu50
uucacuucaaacaa

SEQ ID NO: 2047893 - RNA, 23 nt, Staphylococcus aureus subsp. aureus Mu50
uucacuucgccaagccaucuuuc

SEQ ID NO: 2047894 - RNA, 20 nt, Staphylococcus aureus subsp. aureus Mu50
uucacguaauugaguuguug

SEQ ID NO: 2047895 - RNA, 16 nt, Staphylococcus aureus subsp. aureus Mu50
uucacuaaaaauauau

SEQ ID NO: 2047896 - RNA, 17 nt, Staphylococcus aureus subsp. aureus Mu50
uucacuaauauuucuua

SEQ ID NO: 2047897 - RNA, 21 nt, Staphylococcus aureus subsp. aureus Mu50
uucacuaaauucaauaaucuu

SEQ ID NO: 2047898 - RNA, 22 nt, Staphylococcus aureus subsp. aureus Mu50
uucacuaccauagauuauauua

SEQ ID NO: 2047899 - RNA, 13 nt, Staphylococcus aureus subsp. aureus Mu50
uucacuacuuuuu

SEQ ID NO: 2047900 - RNA, 14 nt, Staphylococcus aureus subsp. aureus Mu50
uucaccguaaucuu

SEQ ID NO: 2047901 - RNA, 16 nt, Staphylococcus aureus subsp. aureus Mu50
uucacgcugaaauuuu

SEQ ID NO: 2047902 - RNA, 11 nt, Staphylococcus aureus subsp. aureus Mu50
uucagaaauga

SEQ ID NO: 2047903 - RNA, 13 nt, Staphylococcus aureus subsp. aureus Mu50
uucagaaaugaca

SEQ ID NO: 2047904 - RNA, 13 nt, Staphylococcus aureus subsp. aureus Mu50
uucacuuuaacuu

SEQ ID NO: 2047905 - RNA, 16 nt, Staphylococcus aureus subsp. aureus Mu50
uucacuuuuuauauca

SEQ ID NO: 2047906 - RNA, 19 nt, Staphylococcus aureus subsp. aureus Mu50
uucacuuuuuuuaauuuga

SEQ ID NO: 2047907 - RNA, 15 nt, Staphylococcus aureus subsp. aureus Mu50
uucagcauuugcugu

SEQ ID NO: 2047908 - RNA, 23 nt, Staphylococcus aureus subsp. aureus Mu50
uucagaugaauaauguuuccauu

SEQ ID NO: 2047909 - RNA, 18 nt, Staphylococcus aureus subsp. aureus Mu50
uucacauuuauccuuuaa

SEQ ID NO: 2047910 - RNA, 18 nt, Staphylococcus aureus subsp. aureus Mu50
uucacacagcuucauuaa

SEQ ID NO: 2047911 - RNA, 13 nt, Staphylococcus aureus subsp. aureus Mu50
uucaauuagaaaa

SEQ ID NO: 2047912 - RNA, 16 nt, Staphylococcus aureus subsp. aureus Mu50
uucaauugacauuaau

SEQ ID NO: 2047913 - RNA, 16 nt, Staphylococcus aureus subsp. aureus Mu50
uucaauguucaauuca

SEQ ID NO: 2047914 - RNA, 21 nt, Staphylococcus aureus subsp. aureus Mu50
uucaauguuuaauuuucuaaa

SEQ ID NO: 2047915 - RNA, 22 nt, Staphylococcus aureus subsp. aureus Mu50
uucaauuucauuuuugauaacu

SEQ ID NO: 2047916 - RNA, 15 nt, Staphylococcus aureus subsp. aureus Mu50
uucaauugucucaau

SEQ ID NO: 2047917 - RNA, 19 nt, Staphylococcus aureus subsp. aureus Mu50
uucaauugucucaauaaug

SEQ ID NO: 2047918 - RNA, 13 nt, Staphylococcus aureus subsp. aureus Mu50
uucaauuuauggu

SEQ ID NO: 2047919 - RNA, 18 nt, Staphylococcus aureus subsp. aureus Mu50
uucaauuuaugguaaaac

SEQ ID NO: 2047920 - RNA, 22 nt, Staphylococcus aureus subsp. aureus Mu50
uucaauuuaugguaaaacccag

SEQ ID NO: 2047921 - RNA, 15 nt, Staphylococcus aureus subsp. aureus Mu50
uucaauauuaaaaua

SEQ ID NO: 2047922 - RNA, 14 nt, Staphylococcus aureus subsp. aureus Mu50
uucaauauuaaaau

SEQ ID NO: 2047923 - RNA, 20 nt, Staphylococcus aureus subsp. aureus Mu50
uucaauauucuuaucauuca

SEQ ID NO: 2047924 - RNA, 14 nt, Staphylococcus aureus subsp. aureus Mu50
uucaauccuuuguu

SEQ ID NO: 2047925 - RNA, 16 nt, Staphylococcus aureus subsp. aureus Mu50
uucaaucgcauuuugu

SEQ ID NO: 2047926 - RNA, 22 nt, Staphylococcus aureus subsp. aureus Mu50
uucaaucgcauuuuguuucaac

SEQ ID NO: 2047927 - RNA, 22 nt, Staphylococcus aureus subsp. aureus Mu50
uucaauccaagcaaucuuagua

SEQ ID NO: 2047928 - RNA, 12 nt, Staphylococcus aureus subsp. aureus Mu50
uucaaucauuca

SEQ ID NO: 2047929 - RNA, 19 nt, Staphylococcus aureus subsp. aureus Mu50
uucaaugauuuuuaaaaau

SEQ ID NO: 2047930 - RNA, 19 nt, Staphylococcus aureus subsp. aureus Mu50
uucaauguaauuuucacuu

SEQ ID NO: 2047931 - RNA, 15 nt, Staphylococcus aureus subsp. aureus Mu50
uucaaucguuucuuc

SEQ ID NO: 2047932 - RNA, 16 nt, Staphylococcus aureus subsp. aureus Mu50
uucaaucgucacauca

SEQ ID NO: 2047933 - RNA, 16 nt, Staphylococcus aureus subsp. aureus Mu50
uucaaugaauucauuu

SEQ ID NO: 2047934 - RNA, 18 nt, Staphylococcus aureus subsp. aureus Mu50
uucaaugauuuuauaaua

SEQ ID NO: 2047935 - RNA, 15 nt, Staphylococcus aureus subsp. aureus Mu50
uucaaugauuuuaua

SEQ ID NO: 2047936 - RNA, 16 nt, Staphylococcus aureus subsp. aureus Mu50
uucaauaaauuuuaua

SEQ ID NO: 2047937 - RNA, 16 nt, Staphylococcus aureus subsp. aureus Mu50
uucaauaaucuuaggu

SEQ ID NO: 2047938 - RNA, 17 nt, Staphylococcus aureus subsp. aureus Mu50
uucaauaaucuuaggug

SEQ ID NO: 2047939 - RNA, 12 nt, Staphylococcus aureus subsp. aureus Mu50
uucaauaauuca

SEQ ID NO: 2047940 - RNA, 21 nt, Staphylococcus aureus subsp. aureus Mu50
uucaauacgaaguguuauaaa

SEQ ID NO: 2047941 - RNA, 13 nt, Staphylococcus aureus subsp. aureus Mu50
uucaaguuuaaaa

SEQ ID NO: 2047942 - RNA, 19 nt, Staphylococcus aureus subsp. aureus Mu50
uucaauaaaaaugguauuc

SEQ ID NO: 2047943 - RNA, 20 nt, Staphylococcus aureus subsp. aureus Mu50
uucaaguaauggauugauaa

SEQ ID NO: 2047944 - RNA, 14 nt, Staphylococcus aureus subsp. aureus Mu50
uucaagcuuaauaa

SEQ ID NO: 2047945 - RNA, 21 nt, Staphylococcus aureus subsp. aureus Mu50
uucaugcacuuuaacauaacu

SEQ ID NO: 2047946 - RNA, 15 nt, Staphylococcus aureus subsp. aureus Mu50
uucaugauuuacuaa

SEQ ID NO: 2047947 - RNA, 23 nt, Staphylococcus aureus subsp. aureus Mu50
uucauuacuuggaaauguauaug

SEQ ID NO: 2047948 - RNA, 18 nt, Staphylococcus aureus subsp. aureus Mu50
uucauuagccaaaucuuu

SEQ ID NO: 2047949 - RNA, 12 nt, Staphylococcus aureus subsp. aureus Mu50
uucauuaucauu

SEQ ID NO: 2047950 - RNA, 21 nt, Staphylococcus aureus subsp. aureus Mu50
uucauuauauaauucuucaaa

SEQ ID NO: 2047951 - RNA, 14 nt, Staphylococcus aureus subsp. aureus Mu50
uucauuaucauuaa

SEQ ID NO: 2047952 - RNA, 19 nt, Staphylococcus aureus subsp. aureus Mu50
uucauuaguugcauaauca

SEQ ID NO: 2047953 - RNA, 16 nt, Staphylococcus aureus subsp. aureus Mu50
uucauuauauaauucu

SEQ ID NO: 2047954 - RNA, 22 nt, Staphylococcus aureus subsp. aureus Mu50
uucauguucuaaugauauuuga

SEQ ID NO: 2047955 - RNA, 16 nt, Staphylococcus aureus subsp. aureus Mu50
uucauuauuuaaauaa

SEQ ID NO: 2047956 - RNA, 17 nt, Staphylococcus aureus subsp. aureus Mu50
uucauucguacuuccaa

SEQ ID NO: 2047957 - RNA, 14 nt, Staphylococcus aureus subsp. aureus Mu50
uucauuguaaauuu

SEQ ID NO: 2047958 - RNA, 21 nt, Staphylococcus aureus subsp. aureus Mu50
uucaucauuuacgauacauca

SEQ ID NO: 2047959 - RNA, 14 nt, Staphylococcus aureus subsp. aureus Mu50
uucaucauuaaaau

SEQ ID NO: 2047960 - RNA, 16 nt, Staphylococcus aureus subsp. aureus Mu50
uucaucauuaaaauca

SEQ ID NO: 2047961 - RNA, 14 nt, Staphylococcus aureus subsp. aureus Mu50
uucaucauaauuga

SEQ ID NO: 2047962 - RNA, 12 nt, Staphylococcus aureus subsp. aureus Mu50
uucaucuaaaug

SEQ ID NO: 2047963 - RNA, 15 nt, Staphylococcus aureus subsp. aureus Mu50
uucaucuaaaugaug

SEQ ID NO: 2047964 - RNA, 22 nt, Staphylococcus aureus subsp. aureus Mu50
uucaucugguauuuuaugacgu

SEQ ID NO: 2047965 - RNA, 17 nt, Staphylococcus aureus subsp. aureus Mu50
uucaucugacugauuuu

SEQ ID NO: 2047966 - RNA, 21 nt, Staphylococcus aureus subsp. aureus Mu50
uucaucguucauauauuuugu

SEQ ID NO: 2047967 - RNA, 14 nt, Staphylococcus aureus subsp. aureus Mu50
uucaucuaaaauga

SEQ ID NO: 2047968 - RNA, 15 nt, Staphylococcus aureus subsp. aureus Mu50
uucaucuaaaaugag

SEQ ID NO: 2047969 - RNA, 12 nt, Staphylococcus aureus subsp. aureus Mu50
uucaucuucaac

SEQ ID NO: 2047970 - RNA, 20 nt, Staphylococcus aureus subsp. aureus Mu50
uucaucuucaaacagacuua

SEQ ID NO: 2047971 - RNA, 13 nt, Staphylococcus aureus subsp. aureus Mu50
uucaucuuaucaa

SEQ ID NO: 2047972 - RNA, 21 nt, Staphylococcus aureus subsp. aureus Mu50
uucaucuugcaaguauuuucu

SEQ ID NO: 2047973 - RNA, 12 nt, Staphylococcus aureus subsp. aureus Mu50
uucaugaacagc

SEQ ID NO: 2047974 - RNA, 14 nt, Staphylococcus aureus subsp. aureus Mu50
uucaugaacagcau

SEQ ID NO: 2047975 - RNA, 21 nt, Staphylococcus aureus subsp. aureus Mu50
uucaugaauaaauacaauguu

SEQ ID NO: 2047976 - RNA, 13 nt, Staphylococcus aureus subsp. aureus Mu50
uucaugaauaauu

SEQ ID NO: 2047977 - RNA, 14 nt, Staphylococcus aureus subsp. aureus Mu50
uucaugaauaauua

SEQ ID NO: 2047978 - RNA, 19 nt, Staphylococcus aureus subsp. aureus Mu50
uucauaaaauuuaaaacaa

SEQ ID NO: 2047979 - RNA, 16 nt, Staphylococcus aureus subsp. aureus Mu50
uucauaaaauuuaaaa

SEQ ID NO: 2047980 - RNA, 20 nt, Staphylococcus aureus subsp. aureus Mu50
uucauaaaguuuauuuaugu

SEQ ID NO: 2047981 - RNA, 17 nt, Staphylococcus aureus subsp. aureus Mu50
uucaguuuguuggucuu

SEQ ID NO: 2047982 - RNA, 15 nt, Staphylococcus aureus subsp. aureus Mu50
uucauaaucauaaua

SEQ ID NO: 2047983 - RNA, 20 nt, Staphylococcus aureus subsp. aureus Mu50
uucauaaaugacugaauuaa

SEQ ID NO: 2047984 - RNA, 13 nt, Staphylococcus aureus subsp. aureus Mu50
uucaguuguuuuu

SEQ ID NO: 2047985 - RNA, 14 nt, Staphylococcus aureus subsp. aureus Mu50
uucaguuaaaccuu

SEQ ID NO: 2047986 - RNA, 14 nt, Staphylococcus aureus subsp. aureus Mu50
uucauauuaacugu

SEQ ID NO: 2047987 - RNA, 20 nt, Staphylococcus aureus subsp. aureus Mu50
uucauauauuuuguuaauaa

SEQ ID NO: 2047988 - RNA, 15 nt, Staphylococcus aureus subsp. aureus Mu50
uucaucaaacaacau

SEQ ID NO: 2047989 - RNA, 17 nt, Staphylococcus aureus subsp. aureus Mu50
uucaucaaacaacauca

SEQ ID NO: 2047990 - RNA, 19 nt, Staphylococcus aureus subsp. aureus Mu50
uucaucaaacaacaucacu

SEQ ID NO: 2047991 - RNA, 13 nt, Staphylococcus aureus subsp. aureus Mu50
uucaucaauaauu

SEQ ID NO: 2047992 - RNA, 17 nt, Staphylococcus aureus subsp. aureus Mu50
uucaucaaguugauaau

SEQ ID NO: 2047993 - RNA, 20 nt, Staphylococcus aureus subsp. aureus Mu50
uucaucaaauccaaaaucuu

SEQ ID NO: 2047994 - RNA, 18 nt, Staphylococcus aureus subsp. aureus Mu50
uucauagaugcauaaaaa

SEQ ID NO: 2047995 - RNA, 19 nt, Staphylococcus aureus subsp. aureus Mu50
uucauagaugcauaaaaac

SEQ ID NO: 2047996 - RNA, 23 nt, Staphylococcus aureus subsp. aureus Mu50
uucauagugguguuuauaucuuu

SEQ ID NO: 2047997 - RNA, 14 nt, Staphylococcus aureus subsp. aureus Mu50
uucauaauuuguug

SEQ ID NO: 2047998 - RNA, 19 nt, Staphylococcus aureus subsp. aureus Mu50
uucauacgcucaaucgcau

SEQ ID NO: 2047999 - RNA, 21 nt, Staphylococcus aureus subsp. aureus Mu50
uucagcugcaauuuuagccaa

SEQ ID NO: 2048000 - RNA, 21 nt, Staphylococcus aureus subsp. aureus Mu50
uucaggaauaucuuucaaauu

SEQ ID NO: 2048001 - RNA, 21 nt, Staphylococcus aureus subsp. aureus Mu50
uucaguaacguacuguguaau

SEQ ID NO: 2048002 - RNA, 15 nt, Staphylococcus aureus subsp. aureus Mu50
uucaguauacucauc

SEQ ID NO: 2048003 - RNA, 16 nt, Staphylococcus aureus subsp. aureus Mu50
uucaguaacugauuuu

SEQ ID NO: 2048004 - RNA, 17 nt, Staphylococcus aureus subsp. aureus Mu50
uucaguacgaacaacua

SEQ ID NO: 2048005 - RNA, 21 nt, Staphylococcus aureus subsp. aureus Mu50
uucaguacgguuauuuaauaa

SEQ ID NO: 2048006 - RNA, 17 nt, Staphylococcus aureus subsp. aureus Mu50
ugggaaauauuugaaaa

SEQ ID NO: 2048007 - RNA, 17 nt, Staphylococcus aureus subsp. aureus Mu50
ugggaauuguauuagca

SEQ ID NO: 2048008 - RNA, 17 nt, Staphylococcus aureus subsp. aureus Mu50
ugggagaaauuuuucac

SEQ ID NO: 2048009 - RNA, 18 nt, Staphylococcus aureus subsp. aureus Mu50
uggggaugggccccaaca

SEQ ID NO: 2048010 - RNA, 22 nt, Staphylococcus aureus subsp. aureus Mu50
uggcuagucuuuaacuuuaauu

SEQ ID NO: 2048011 - RNA, 18 nt, Staphylococcus aureus subsp. aureus Mu50
uggcuacuugaauaccuu

SEQ ID NO: 2048012 - RNA, 21 nt, Staphylococcus aureus subsp. aureus Mu50
uggcuacuaaucuuuuuuuaa

SEQ ID NO: 2048013 - RNA, 18 nt, Staphylococcus aureus subsp. aureus Mu50
uggaaaaggucaaaaaau

SEQ ID NO: 2048014 - RNA, 17 nt, Staphylococcus aureus subsp. aureus Mu50
uggcgguuugaaaauga

SEQ ID NO: 2048015 - RNA, 19 nt, Staphylococcus aureus subsp. aureus Mu50
ugguucaucaaacaacauc

SEQ ID NO: 2048016 - RNA, 19 nt, Staphylococcus aureus subsp. aureus Mu50
ugguuagagaaaaaucugu

SEQ ID NO: 2048017 - RNA, 16 nt, Staphylococcus aureus subsp. aureus Mu50
ugguuaaaguuaaugc

SEQ ID NO: 2048018 - RNA, 19 nt, Staphylococcus aureus subsp. aureus Mu50
ugguucugacauuucugac

SEQ ID NO: 2048019 - RNA, 19 nt, Staphylococcus aureus subsp. aureus Mu50
ugguugaacgguuguauuu

SEQ ID NO: 2048020 - RNA, 13 nt, Staphylococcus aureus subsp. aureus Mu50
ugguucuucuuuc

SEQ ID NO: 2048021 - RNA, 15 nt, Staphylococcus aureus subsp. aureus Mu50
ugguugucuccacac

SEQ ID NO: 2048022 - RNA, 19 nt, Staphylococcus aureus subsp. aureus Mu50
ugguuuaucagcuuuaaua

SEQ ID NO: 2048023 - RNA, 20 nt, Staphylococcus aureus subsp. aureus Mu50
ugguuuaaugagcuuuucua

SEQ ID NO: 2048024 - RNA, 14 nt, Staphylococcus aureus subsp. aureus Mu50
ugguuguucuuuuu

SEQ ID NO: 2048025 - RNA, 20 nt, Staphylococcus aureus subsp. aureus Mu50
ugguuucuuaacauaaaaug

SEQ ID NO: 2048026 - RNA, 14 nt, Staphylococcus aureus subsp. aureus Mu50
ugguuucaucauau

SEQ ID NO: 2048027 - RNA, 20 nt, Staphylococcus aureus subsp. aureus Mu50
ugguuugugauuuuuugaua

SEQ ID NO: 2048028 - RNA, 22 nt, Staphylococcus aureus subsp. aureus Mu50
ugguuugcuuuaaaauucucua

SEQ ID NO: 2048029 - RNA, 20 nt, Staphylococcus aureus subsp. aureus Mu50
uguaacaaaauacccugcuu

SEQ ID NO: 2048030 - RNA, 17 nt, Staphylococcus aureus subsp. aureus Mu50
uguaaauuuuuaagaag

SEQ ID NO: 2048031 - RNA, 20 nt, Staphylococcus aureus subsp. aureus Mu50
uguaaauuuauuuuuaauuu

SEQ ID NO: 2048032 - RNA, 13 nt, Staphylococcus aureus subsp. aureus Mu50
uguaacaaagucu

SEQ ID NO: 2048033 - RNA, 22 nt, Staphylococcus aureus subsp. aureus Mu50
uguaacauaaagcuguuuauug

SEQ ID NO: 2048034 - RNA, 18 nt, Staphylococcus aureus subsp. aureus Mu50
uguaacacacuuauaauc

SEQ ID NO: 2048035 - RNA, 22 nt, Staphylococcus aureus subsp. aureus Mu50
uguaagcuaucguaaacaacau

SEQ ID NO: 2048036 - RNA, 19 nt, Staphylococcus aureus subsp. aureus Mu50
uguaaauguuaaauucuaa

SEQ ID NO: 2048037 - RNA, 13 nt, Staphylococcus aureus subsp. aureus Mu50
uguaaaugaaaua

SEQ ID NO: 2048038 - RNA, 16 nt, Staphylococcus aureus subsp. aureus Mu50
uguaaaaacguucaau

SEQ ID NO: 2048039 - RNA, 16 nt, Staphylococcus aureus subsp. aureus Mu50
ugguuuuuagugaaaa

SEQ ID NO: 2048040 - RNA, 16 nt, Staphylococcus aureus subsp. aureus Mu50
uguaaaaaauaucuug

SEQ ID NO: 2048041 - RNA, 22 nt, Staphylococcus aureus subsp. aureus Mu50
uguaaguuauuuggauauuuau

SEQ ID NO: 2048042 - RNA, 21 nt, Staphylococcus aureus subsp. aureus Mu50
uguaagucgaaaguacccaga

SEQ ID NO: 2048043 - RNA, 20 nt, Staphylococcus aureus subsp. aureus Mu50
uguaagucgcucuagacauu

SEQ ID NO: 2048044 - RNA, 18 nt, Staphylococcus aureus subsp. aureus Mu50
uguaaguuugguuucuua

SEQ ID NO: 2048045 - RNA, 22 nt, Staphylococcus aureus subsp. aureus Mu50
uguaaucauugguuucaucaua

SEQ ID NO: 2048046 - RNA, 19 nt, Staphylococcus aureus subsp. aureus Mu50
uguaaucucguuuuuacau

SEQ ID NO: 2048047 - RNA, 16 nt, Staphylococcus aureus subsp. aureus Mu50
uguaauccuugagcuc

SEQ ID NO: 2048048 - RNA, 15 nt, Staphylococcus aureus subsp. aureus Mu50
uguaaugcuuaaaaa

SEQ ID NO: 2048049 - RNA, 18 nt, Staphylococcus aureus subsp. aureus Mu50
uguaaugcuuaaaaacaa

SEQ ID NO: 2048050 - RNA, 21 nt, Staphylococcus aureus subsp. aureus Mu50
uguaaugcuuaaaaacaauau

SEQ ID NO: 2048051 - RNA, 15 nt, Staphylococcus aureus subsp. aureus Mu50
uguaauugaaaugau

SEQ ID NO: 2048052 - RNA, 20 nt, Staphylococcus aureus subsp. aureus Mu50
uguacacauccucauaauua

SEQ ID NO: 2048053 - RNA, 18 nt, Staphylococcus aureus subsp. aureus Mu50
ugggggauuuuuuuaugu

SEQ ID NO: 2048054 - RNA, 20 nt, Staphylococcus aureus subsp. aureus Mu50
ugguaacucuucaguacgaa

SEQ ID NO: 2048055 - RNA, 16 nt, Staphylococcus aureus subsp. aureus Mu50
ugguagcauuuuagau

SEQ ID NO: 2048056 - RNA, 13 nt, Staphylococcus aureus subsp. aureus Mu50
ugguagcauuuua

SEQ ID NO: 2048057 - RNA, 22 nt, Staphylococcus aureus subsp. aureus Mu50
uggucaccuacagauaaagcuu

SEQ ID NO: 2048058 - RNA, 16 nt, Staphylococcus aureus subsp. aureus Mu50
ugguauuuuuuuaugc

SEQ ID NO: 2048059 - RNA, 15 nt, Staphylococcus aureus subsp. aureus Mu50
uggugcccaaguuuc

SEQ ID NO: 2048060 - RNA, 18 nt, Staphylococcus aureus subsp. aureus Mu50
uguucugcuuuuucuuua

SEQ ID NO: 2048061 - RNA, 19 nt, Staphylococcus aureus subsp. aureus Mu50
uguucaguuguuuuuuugu

SEQ ID NO: 2048062 - RNA, 13 nt, Staphylococcus aureus subsp. aureus Mu50
uguucaugguuua

SEQ ID NO: 2048063 - RNA, 18 nt, Staphylococcus aureus subsp. aureus Mu50
uguuccaaucuuuuuaau

SEQ ID NO: 2048064 - RNA, 14 nt, Staphylococcus aureus subsp. aureus Mu50
uguucauaauauaa

SEQ ID NO: 2048065 - RNA, 23 nt, Staphylococcus aureus subsp. aureus Mu50
uguucauaaucauaauaagauuu

SEQ ID NO: 2048066 - RNA, 14 nt, Staphylococcus aureus subsp. aureus Mu50
uguugauaaaaagg

SEQ ID NO: 2048067 - RNA, 21 nt, Staphylococcus aureus subsp. aureus Mu50
uguugaggcguuucagaaguu

SEQ ID NO: 2048068 - RNA, 22 nt, Staphylococcus aureus subsp. aureus Mu50
uguugacauuugaccaaguaug

SEQ ID NO: 2048069 - RNA, 20 nt, Staphylococcus aureus subsp. aureus Mu50
uguugaaauuaaauucaaau

SEQ ID NO: 2048070 - RNA, 13 nt, Staphylococcus aureus subsp. aureus Mu50
uguucuucagaaa

SEQ ID NO: 2048071 - RNA, 16 nt, Staphylococcus aureus subsp. aureus Mu50
uguucaaaaaaugaau

SEQ ID NO: 2048072 - RNA, 16 nt, Staphylococcus aureus subsp. aureus Mu50
uguucaguuaaaucug

SEQ ID NO: 2048073 - RNA, 17 nt, Staphylococcus aureus subsp. aureus Mu50
uguucaaugauuuuaua

SEQ ID NO: 2048074 - RNA, 19 nt, Staphylococcus aureus subsp. aureus Mu50
uguucaaugauuuuauaau

SEQ ID NO: 2048075 - RNA, 24 nt, Staphylococcus aureus subsp. aureus Mu50
uguuacuuauauauucaauaauua

SEQ ID NO: 2048076 - RNA, 23 nt, Staphylococcus aureus subsp. aureus Mu50
uguuaguuuucuuaaaagagcaa

SEQ ID NO: 2048077 - RNA, 23 nt, Staphylococcus aureus subsp. aureus Mu50
uguuauaaauagagaacagcagu

SEQ ID NO: 2048078 - RNA, 18 nt, Staphylococcus aureus subsp. aureus Mu50
uguuagucuuuuuaagua

SEQ ID NO: 2048079 - RNA, 17 nt, Staphylococcus aureus subsp. aureus Mu50
uguuauagcguuuaaga

SEQ ID NO: 2048080 - RNA, 14 nt, Staphylococcus aureus subsp. aureus Mu50
uguuauauaaauau

SEQ ID NO: 2048081 - RNA, 15 nt, Staphylococcus aureus subsp. aureus Mu50
uguuauaucuaauuc

SEQ ID NO: 2048082 - RNA, 23 nt, Staphylococcus aureus subsp. aureus Mu50
uguuauauuggcaguguuugacu

SEQ ID NO: 2048083 - RNA, 20 nt, Staphylococcus aureus subsp. aureus Mu50
uguuauauuguauuuuauuu

SEQ ID NO: 2048084 - RNA, 14 nt, Staphylococcus aureus subsp. aureus Mu50
uguuaaucaaaauu

SEQ ID NO: 2048085 - RNA, 21 nt, Staphylococcus aureus subsp. aureus Mu50
uguguuuaggaggaauaccca

SEQ ID NO: 2048086 - RNA, 22 nt, Staphylococcus aureus subsp. aureus Mu50
uguguuguuucaggauaaugaa

SEQ ID NO: 2048087 - RNA, 20 nt, Staphylococcus aureus subsp. aureus Mu50
uguuaaugcuucguaaucuu

SEQ ID NO: 2048088 - RNA, 16 nt, Staphylococcus aureus subsp. aureus Mu50
uguuaaugucuucaua

SEQ ID NO: 2048089 - RNA, 19 nt, Staphylococcus aureus subsp. aureus Mu50
uguguuggggcccacaccc

SEQ ID NO: 2048090 - RNA, 16 nt, Staphylococcus aureus subsp. aureus Mu50
uguguuggggcccaca

SEQ ID NO: 2048091 - RNA, 20 nt, Staphylococcus aureus subsp. aureus Mu50
uguguugaaacugaguucaa

SEQ ID NO: 2048092 - RNA, 17 nt, Staphylococcus aureus subsp. aureus Mu50
uguuaauuuuuuauuaa

SEQ ID NO: 2048093 - RNA, 16 nt, Staphylococcus aureus subsp. aureus Mu50
uguuaauuuuuuauua

SEQ ID NO: 2048094 - RNA, 16 nt, Staphylococcus aureus subsp. aureus Mu50
uguuaauuuaauaauu

SEQ ID NO: 2048095 - RNA, 13 nt, Staphylococcus aureus subsp. aureus Mu50
uguuaauuucaac

SEQ ID NO: 2048096 - RNA, 22 nt, Staphylococcus aureus subsp. aureus Mu50
uguuacauauugcauuuagacu

SEQ ID NO: 2048097 - RNA, 17 nt, Staphylococcus aureus subsp. aureus Mu50
uguuacacaaauuaaaa

SEQ ID NO: 2048098 - RNA, 21 nt, Staphylococcus aureus subsp. aureus Mu50
uguuacacaucgaucuaaaua

SEQ ID NO: 2048099 - RNA, 23 nt, Staphylococcus aureus subsp. aureus Mu50
uguuacacaucgaucuaaauaua

SEQ ID NO: 2048100 - RNA, 15 nt, Staphylococcus aureus subsp. aureus Mu50
uguuacacuuuucuu

SEQ ID NO: 2048101 - RNA, 16 nt, Staphylococcus aureus subsp. aureus Mu50
uguuacacuuuucuua

SEQ ID NO: 2048102 - RNA, 22 nt, Staphylococcus aureus subsp. aureus Mu50
uguuacgagugcacuuguaaua

SEQ ID NO: 2048103 - RNA, 15 nt, Staphylococcus aureus subsp. aureus Mu50
uguuacuuauauauu

SEQ ID NO: 2048104 - RNA, 23 nt, Staphylococcus aureus subsp. aureus Mu50
uguuacuaguuuguaauaauuaa

SEQ ID NO: 2048105 - RNA, 22 nt, Staphylococcus aureus subsp. aureus Mu50
ugugcuuuguuuaucaauuucu

SEQ ID NO: 2048106 - RNA, 21 nt, Staphylococcus aureus subsp. aureus Mu50
ugugcuuuuccauaaauauuu

SEQ ID NO: 2048107 - RNA, 14 nt, Staphylococcus aureus subsp. aureus Mu50
uguggauacaaacc

SEQ ID NO: 2048108 - RNA, 17 nt, Staphylococcus aureus subsp. aureus Mu50
uguggauuuaauuuuua

SEQ ID NO: 2048109 - RNA, 18 nt, Staphylococcus aureus subsp. aureus Mu50
ugugcuguucuauuccac

SEQ ID NO: 2048110 - RNA, 13 nt, Staphylococcus aureus subsp. aureus Mu50
ugugcuuaagaac

SEQ ID NO: 2048111 - RNA, 19 nt, Staphylococcus aureus subsp. aureus Mu50
ugugauuuguuacuucuaa

SEQ ID NO: 2048112 - RNA, 20 nt, Staphylococcus aureus subsp. aureus Mu50
ugugauaacuuguaauauaa

SEQ ID NO: 2048113 - RNA, 14 nt, Staphylococcus aureus subsp. aureus Mu50
ugugauaauucuuc

SEQ ID NO: 2048114 - RNA, 17 nt, Staphylococcus aureus subsp. aureus Mu50
ugugauaauucuucaac

SEQ ID NO: 2048115 - RNA, 17 nt, Staphylococcus aureus subsp. aureus Mu50
ugugauacuuucuaaga

SEQ ID NO: 2048116 - RNA, 13 nt, Staphylococcus aureus subsp. aureus Mu50
ugugaaaauacca

SEQ ID NO: 2048117 - RNA, 14 nt, Staphylococcus aureus subsp. aureus Mu50
ugugacaaaugccu

SEQ ID NO: 2048118 - RNA, 22 nt, Staphylococcus aureus subsp. aureus Mu50
ugugacaaaugccuuaucuaua

SEQ ID NO: 2048119 - RNA, 18 nt, Staphylococcus aureus subsp. aureus Mu50
ugugaauguuuucuaaau

SEQ ID NO: 2048120 - RNA, 20 nt, Staphylococcus aureus subsp. aureus Mu50
ugucuuuauguuugauuuua

SEQ ID NO: 2048121 - RNA, 14 nt, Staphylococcus aureus subsp. aureus Mu50
ugucuuugaacaua

SEQ ID NO: 2048122 - RNA, 12 nt, Staphylococcus aureus subsp. aureus Mu50
ugucuuuccaua

SEQ ID NO: 2048123 - RNA, 20 nt, Staphylococcus aureus subsp. aureus Mu50
ugucuuuccauaauaaugcc

SEQ ID NO: 2048124 - RNA, 17 nt, Staphylococcus aureus subsp. aureus Mu50
ugucuuuuauuaugaua

SEQ ID NO: 2048125 - RNA, 13 nt, Staphylococcus aureus subsp. aureus Mu50
ugucuucuuuuuu

SEQ ID NO: 2048126 - RNA, 19 nt, Staphylococcus aureus subsp. aureus Mu50
ugucuuccaaucaacuuca

SEQ ID NO: 2048127 - RNA, 15 nt, Staphylococcus aureus subsp. aureus Mu50
ugucuuaauaugcaa

SEQ ID NO: 2048128 - RNA, 13 nt, Staphylococcus aureus subsp. aureus Mu50
ugucuuacuuuua

SEQ ID NO: 2048129 - RNA, 15 nt, Staphylococcus aureus subsp. aureus Mu50
ugucuuacuuuuaaa

SEQ ID NO: 2048130 - RNA, 21 nt, Staphylococcus aureus subsp. aureus Mu50
ugucuuaggcgcuacaauguu

SEQ ID NO: 2048131 - RNA, 14 nt, Staphylococcus aureus subsp. aureus Mu50
ugucuauuguaaaa

SEQ ID NO: 2048132 - RNA, 21 nt, Staphylococcus aureus subsp. aureus Mu50
ugucuaguucgauuuuuuaau

SEQ ID NO: 2048133 - RNA, 17 nt, Staphylococcus aureus subsp. aureus Mu50
ugucuagacuuauuuga

SEQ ID NO: 2048134 - RNA, 16 nt, Staphylococcus aureus subsp. aureus Mu50
ugucuagacuuauuug

SEQ ID NO: 2048135 - RNA, 19 nt, Staphylococcus aureus subsp. aureus Mu50
ugucguuguacaucauuaa

SEQ ID NO: 2048136 - RNA, 18 nt, Staphylococcus aureus subsp. aureus Mu50
ugucuaaaaacauaaaaa

SEQ ID NO: 2048137 - RNA, 14 nt, Staphylococcus aureus subsp. aureus Mu50
ugucuaaaaauguc

SEQ ID NO: 2048138 - RNA, 17 nt, Staphylococcus aureus subsp. aureus Mu50
ugucucucuuucuuauu

SEQ ID NO: 2048139 - RNA, 23 nt, Staphylococcus aureus subsp. aureus Mu50
ugucucaauaauguuacgcugug

SEQ ID NO: 2048140 - RNA, 16 nt, Staphylococcus aureus subsp. aureus Mu50
ugucgcuuucauaccu

SEQ ID NO: 2048141 - RNA, 15 nt, Staphylococcus aureus subsp. aureus Mu50
ugucgguucaucuaa

SEQ ID NO: 2048142 - RNA, 14 nt, Staphylococcus aureus subsp. aureus Mu50
ugucgauauuucua

SEQ ID NO: 2048143 - RNA, 22 nt, Staphylococcus aureus subsp. aureus Mu50
uguccuaacgcuaauuuuacuc

SEQ ID NO: 2048144 - RNA, 17 nt, Staphylococcus aureus subsp. aureus Mu50
uguccuaauaaguuacc

SEQ ID NO: 2048145 - RNA, 13 nt, Staphylococcus aureus subsp. aureus Mu50
uguccucuaaaac

SEQ ID NO: 2048146 - RNA, 13 nt, Staphylococcus aureus subsp. aureus Mu50
uguccauuuaucu

SEQ ID NO: 2048147 - RNA, 19 nt, Staphylococcus aureus subsp. aureus Mu50
uguccaucuuuuauuaaag

SEQ ID NO: 2048148 - RNA, 17 nt, Staphylococcus aureus subsp. aureus Mu50
uguccacuauauccuuu

SEQ ID NO: 2048149 - RNA, 13 nt, Staphylococcus aureus subsp. aureus Mu50
ugucauuucuucu

SEQ ID NO: 2048150 - RNA, 19 nt, Staphylococcus aureus subsp. aureus Mu50
ugucauuucuucuuuuucc

SEQ ID NO: 2048151 - RNA, 15 nt, Staphylococcus aureus subsp. aureus Mu50
ugucauuuugauuaa

SEQ ID NO: 2048152 - RNA, 15 nt, Staphylococcus aureus subsp. aureus Mu50
ugucauuuucugcuu

SEQ ID NO: 2048153 - RNA, 16 nt, Staphylococcus aureus subsp. aureus Mu50
ugucauuuucugcuuu

SEQ ID NO: 2048154 - RNA, 16 nt, Staphylococcus aureus subsp. aureus Mu50
ugucaucgcuuuaauu

SEQ ID NO: 2048155 - RNA, 20 nt, Staphylococcus aureus subsp. aureus Mu50
ugucauaguauacauaauuc

SEQ ID NO: 2048156 - RNA, 15 nt, Staphylococcus aureus subsp. aureus Mu50
ugucaucauguucua

SEQ ID NO: 2048157 - RNA, 18 nt, Staphylococcus aureus subsp. aureus Mu50
ugucaucauguucuaaug

SEQ ID NO: 2048158 - RNA, 17 nt, Staphylococcus aureus subsp. aureus Mu50
uguacaucauuaaauau

SEQ ID NO: 2048159 - RNA, 16 nt, Staphylococcus aureus subsp. aureus Mu50
uguaucugauguugau

SEQ ID NO: 2048160 - RNA, 21 nt, Staphylococcus aureus subsp. aureus Mu50
uguacacuaucguuuuuauua

SEQ ID NO: 2048161 - RNA, 14 nt, Staphylococcus aureus subsp. aureus Mu50
uguacacuuuugau

SEQ ID NO: 2048162 - RNA, 17 nt, Staphylococcus aureus subsp. aureus Mu50
uguauuguauuuuaaug

SEQ ID NO: 2048163 - RNA, 19 nt, Staphylococcus aureus subsp. aureus Mu50
uguauuguuugaaaauuaa

SEQ ID NO: 2048164 - RNA, 17 nt, Staphylococcus aureus subsp. aureus Mu50
uguauuguuuguuuuua

SEQ ID NO: 2048165 - RNA, 18 nt, Staphylococcus aureus subsp. aureus Mu50
uguauucuucuaauucug

SEQ ID NO: 2048166 - RNA, 19 nt, Staphylococcus aureus subsp. aureus Mu50
uguauucuucuaauucuga

SEQ ID NO: 2048167 - RNA, 17 nt, Staphylococcus aureus subsp. aureus Mu50
uguauucugaaacuuua

SEQ ID NO: 2048168 - RNA, 16 nt, Staphylococcus aureus subsp. aureus Mu50
uguauucugaaacuuu

SEQ ID NO: 2048169 - RNA, 17 nt, Staphylococcus aureus subsp. aureus Mu50
uguauucgguuaauauu

SEQ ID NO: 2048170 - RNA, 20 nt, Staphylococcus aureus subsp. aureus Mu50
uguauucgguuaauauucuu

SEQ ID NO: 2048171 - RNA, 16 nt, Staphylococcus aureus subsp. aureus Mu50
uguaugaugaacuuaa

SEQ ID NO: 2048172 - RNA, 21 nt, Staphylococcus aureus subsp. aureus Mu50
uguaugaucaagcugagcuuu

SEQ ID NO: 2048173 - RNA, 17 nt, Staphylococcus aureus subsp. aureus Mu50
ugucauaccuuuuaauu

SEQ ID NO: 2048174 - RNA, 19 nt, Staphylococcus aureus subsp. aureus Mu50
ugucauaguauacauaauu

SEQ ID NO: 2048175 - RNA, 13 nt, Staphylococcus aureus subsp. aureus Mu50
ugucauaauccau

SEQ ID NO: 2048176 - RNA, 22 nt, Staphylococcus aureus subsp. aureus Mu50
ugucaauaaauuguuuacuaua

SEQ ID NO: 2048177 - RNA, 18 nt, Staphylococcus aureus subsp. aureus Mu50
ugucaauagcgguuuaaa

SEQ ID NO: 2048178 - RNA, 24 nt, Staphylococcus aureus subsp. aureus Mu50
ugucaaaucggcuauacauugaua

SEQ ID NO: 2048179 - RNA, 14 nt, Staphylococcus aureus subsp. aureus Mu50
uguauuuaauaagu

SEQ ID NO: 2048180 - RNA, 19 nt, Staphylococcus aureus subsp. aureus Mu50
uguauuguuuguuuuuaua

SEQ ID NO: 2048181 - RNA, 14 nt, Staphylococcus aureus subsp. aureus Mu50
uuauaaaaacuuau

SEQ ID NO: 2048182 - RNA, 20 nt, Staphylococcus aureus subsp. aureus Mu50
uuagagaaaaaucuguuucu

SEQ ID NO: 2048183 - RNA, 16 nt, Staphylococcus aureus subsp. aureus Mu50
uuagagaagaauucuc

SEQ ID NO: 2048184 - RNA, 21 nt, Staphylococcus aureus subsp. aureus Mu50
uuauaaagcugcgaaacuugu

SEQ ID NO: 2048185 - RNA, 17 nt, Staphylococcus aureus subsp. aureus Mu50
uuauaaaaguguaaugu

SEQ ID NO: 2048186 - RNA, 14 nt, Staphylococcus aureus subsp. aureus Mu50
uuauaaguaaauaa

SEQ ID NO: 2048187 - RNA, 19 nt, Staphylococcus aureus subsp. aureus Mu50
uuauaagaauuuaaaagag

SEQ ID NO: 2048188 - RNA, 20 nt, Staphylococcus aureus subsp. aureus Mu50
uuauaaauagagaacagcag

SEQ ID NO: 2048189 - RNA, 15 nt, Staphylococcus aureus subsp. aureus Mu50
uuauaauagagaaac

SEQ ID NO: 2048190 - RNA, 14 nt, Staphylococcus aureus subsp. aureus Mu50
uuauacacuuuuug

SEQ ID NO: 2048191 - RNA, 15 nt, Staphylococcus aureus subsp. aureus Mu50
uuauaaguauauaau

SEQ ID NO: 2048192 - RNA, 19 nt, Staphylococcus aureus subsp. aureus Mu50
uuauaaguuaaaaauguaa

SEQ ID NO: 2048193 - RNA, 13 nt, Staphylococcus aureus subsp. aureus Mu50
uuauaaguauuca

SEQ ID NO: 2048194 - RNA, 22 nt, Staphylococcus aureus subsp. aureus Mu50
uuauaaguuaaaaauguaaaua

SEQ ID NO: 2048195 - RNA, 17 nt, Staphylococcus aureus subsp. aureus Mu50
uuauaauauuaaauugc

SEQ ID NO: 2048196 - RNA, 21 nt, Staphylococcus aureus subsp. aureus Mu50
uuauaauacguguguuuucuu

SEQ ID NO: 2048197 - RNA, 17 nt, Staphylococcus aureus subsp. aureus Mu50
uuauagcauuucuuuau

SEQ ID NO: 2048198 - RNA, 21 nt, Staphylococcus aureus subsp. aureus Mu50
uuauagaugacuguagaaaac

SEQ ID NO: 2048199 - RNA, 13 nt, Staphylococcus aureus subsp. aureus Mu50
uuauaucaaaauc

SEQ ID NO: 2048200 - RNA, 14 nt, Staphylococcus aureus subsp. aureus Mu50
uuauaucaaaaaau

SEQ ID NO: 2048201 - RNA, 21 nt, Staphylococcus aureus subsp. aureus Mu50
uuauaucauucuguguaaaua

SEQ ID NO: 2048202 - RNA, 13 nt, Staphylococcus aureus subsp. aureus Mu50
uuaucaacaacaa

SEQ ID NO: 2048203 - RNA, 17 nt, Staphylococcus aureus subsp. aureus Mu50
uuaucaacauaaaauuu

SEQ ID NO: 2048204 - RNA, 15 nt, Staphylococcus aureus subsp. aureus Mu50
uuaucaacaaauuua

SEQ ID NO: 2048205 - RNA, 18 nt, Staphylococcus aureus subsp. aureus Mu50
uuauauauauuaaaguaa

SEQ ID NO: 2048206 - RNA, 14 nt, Staphylococcus aureus subsp. aureus Mu50
uuauauauauuaaa

SEQ ID NO: 2048207 - RNA, 19 nt, Staphylococcus aureus subsp. aureus Mu50
uuauauacccaccacauuu

SEQ ID NO: 2048208 - RNA, 19 nt, Staphylococcus aureus subsp. aureus Mu50
uuauauacuaguucaacuc

SEQ ID NO: 2048209 - RNA, 13 nt, Staphylococcus aureus subsp. aureus Mu50
uuauauagaaaac

SEQ ID NO: 2048210 - RNA, 17 nt, Staphylococcus aureus subsp. aureus Mu50
uuauauagacaguaguu

SEQ ID NO: 2048211 - RNA, 17 nt, Staphylococcus aureus subsp. aureus Mu50
uuauauaauucuucaaa

SEQ ID NO: 2048212 - RNA, 20 nt, Staphylococcus aureus subsp. aureus Mu50
uuaucaauuucuauuucacu

SEQ ID NO: 2048213 - RNA, 22 nt, Staphylococcus aureus subsp. aureus Mu50
uuaucaauaaaucaguaguuuu

SEQ ID NO: 2048214 - RNA, 20 nt, Staphylococcus aureus subsp. aureus Mu50
uuaucaacgauuuugucuuu

SEQ ID NO: 2048215 - RNA, 13 nt, Staphylococcus aureus subsp. aureus Mu50
uuaucauuauucg

SEQ ID NO: 2048216 - RNA, 15 nt, Staphylococcus aureus subsp. aureus Mu50
uuauccaaaacauuu

SEQ ID NO: 2048217 - RNA, 22 nt, Staphylococcus aureus subsp. aureus Mu50
uuaucauuaaauugcuugaaau

SEQ ID NO: 2048218 - RNA, 16 nt, Staphylococcus aureus subsp. aureus Mu50
uuaucauuacagauaa

SEQ ID NO: 2048219 - RNA, 12 nt, Staphylococcus aureus subsp. aureus Mu50
uuaucauuauuc

SEQ ID NO: 2048220 - RNA, 21 nt, Staphylococcus aureus subsp. aureus Mu50
uuaugcaugcgcaaaagcgca

SEQ ID NO: 2048221 - RNA, 14 nt, Staphylococcus aureus subsp. aureus Mu50
uuaugaugucaugu

SEQ ID NO: 2048222 - RNA, 14 nt, Staphylococcus aureus subsp. aureus Mu50
uuaugauuauauuu

SEQ ID NO: 2048223 - RNA, 15 nt, Staphylococcus aureus subsp. aureus Mu50
uuaugauuauauuuu

SEQ ID NO: 2048224 - RNA, 19 nt, Staphylococcus aureus subsp. aureus Mu50
uuaugauugcuuauuuauu

SEQ ID NO: 2048225 - RNA, 15 nt, Staphylococcus aureus subsp. aureus Mu50
uuaugaaucauuuua

SEQ ID NO: 2048226 - RNA, 19 nt, Staphylococcus aureus subsp. aureus Mu50
uuaugacuuauuuuucauc

SEQ ID NO: 2048227 - RNA, 20 nt, Staphylococcus aureus subsp. aureus Mu50
uuaugauacugauauuuaga

SEQ ID NO: 2048228 - RNA, 17 nt, Staphylococcus aureus subsp. aureus Mu50
uuaugagcuucuuuaaa

SEQ ID NO: 2048229 - RNA, 15 nt, Staphylococcus aureus subsp. aureus Mu50
uuaugaauugaguau

SEQ ID NO: 2048230 - RNA, 20 nt, Staphylococcus aureus subsp. aureus Mu50
uuaugacaaaguucugcaau

SEQ ID NO: 2048231 - RNA, 13 nt, Staphylococcus aureus subsp. aureus Mu50
uuaugaaaaguaa

SEQ ID NO: 2048232 - RNA, 17 nt, Staphylococcus aureus subsp. aureus Mu50
uuauguucgauuauucu

SEQ ID NO: 2048233 - RNA, 13 nt, Staphylococcus aureus subsp. aureus Mu50
uuauguuuaauuu

SEQ ID NO: 2048234 - RNA, 17 nt, Staphylococcus aureus subsp. aureus Mu50
uuauuaaaauuaaauaa

SEQ ID NO: 2048235 - RNA, 19 nt, Staphylococcus aureus subsp. aureus Mu50
uuauguauuuuuauuuaua

SEQ ID NO: 2048236 - RNA, 23 nt, Staphylococcus aureus subsp. aureus Mu50
uuauguauuuuuauuuauacuaa

SEQ ID NO: 2048237 - RNA, 17 nt, Staphylococcus aureus subsp. aureus Mu50
uuaugugauuaauuuca

SEQ ID NO: 2048238 - RNA, 13 nt, Staphylococcus aureus subsp. aureus Mu50
uuaugguauuuau

SEQ ID NO: 2048239 - RNA, 17 nt, Staphylococcus aureus subsp. aureus Mu50
uuaugggguguauuuuu

SEQ ID NO: 2048240 - RNA, 22 nt, Staphylococcus aureus subsp. aureus Mu50
uuauggcgguuugaaaaugacg

SEQ ID NO: 2048241 - RNA, 16 nt, Staphylococcus aureus subsp. aureus Mu50
uuaugcuagaaaguaa

SEQ ID NO: 2048242 - RNA, 13 nt, Staphylococcus aureus subsp. aureus Mu50
uuaugcuauuuug

SEQ ID NO: 2048243 - RNA, 14 nt, Staphylococcus aureus subsp. aureus Mu50
uuaugcuuuaaauc

SEQ ID NO: 2048244 - RNA, 19 nt, Staphylococcus aureus subsp. aureus Mu50
uuaucuguagaaacacuuu

SEQ ID NO: 2048245 - RNA, 17 nt, Staphylococcus aureus subsp. aureus Mu50
uuaucuguaucaaaauc

SEQ ID NO: 2048246 - RNA, 15 nt, Staphylococcus aureus subsp. aureus Mu50
uuaucugcaaaaugc

SEQ ID NO: 2048247 - RNA, 18 nt, Staphylococcus aureus subsp. aureus Mu50
uuaucugacauuguugcu

SEQ ID NO: 2048248 - RNA, 16 nt, Staphylococcus aureus subsp. aureus Mu50
uuaucugaaaauauca

SEQ ID NO: 2048249 - RNA, 17 nt, Staphylococcus aureus subsp. aureus Mu50
uuaucguaaaaaaacgu

SEQ ID NO: 2048250 - RNA, 21 nt, Staphylococcus aureus subsp. aureus Mu50
uuaucuaacaaucguuuuaau

SEQ ID NO: 2048251 - RNA, 15 nt, Staphylococcus aureus subsp. aureus Mu50
uuaucuaaacauuuu

SEQ ID NO: 2048252 - RNA, 15 nt, Staphylococcus aureus subsp. aureus Mu50
uuaucuaaagcuaua

SEQ ID NO: 2048253 - RNA, 17 nt, Staphylococcus aureus subsp. aureus Mu50
uuauccuacugcugucu

SEQ ID NO: 2048254 - RNA, 15 nt, Staphylococcus aureus subsp. aureus Mu50
uuauccuacugcugu

SEQ ID NO: 2048255 - RNA, 22 nt, Staphylococcus aureus subsp. aureus Mu50
uuaucgacuuugucauuuugau

SEQ ID NO: 2048256 - RNA, 17 nt, Staphylococcus aureus subsp. aureus Mu50
uuaucgaucgguauuuu

SEQ ID NO: 2048257 - RNA, 19 nt, Staphylococcus aureus subsp. aureus Mu50
uuaucgaucgguauuuuca

SEQ ID NO: 2048258 - RNA, 17 nt, Staphylococcus aureus subsp. aureus Mu50
uucaagagguuuuauuu

SEQ ID NO: 2048259 - RNA, 16 nt, Staphylococcus aureus subsp. aureus Mu50
uucaagagaaccaccu

SEQ ID NO: 2048260 - RNA, 18 nt, Staphylococcus aureus subsp. aureus Mu50
uucaacuuuaaucaaaaa

SEQ ID NO: 2048261 - RNA, 19 nt, Staphylococcus aureus subsp. aureus Mu50
uucaacuuuaaucaaaaaa

SEQ ID NO: 2048262 - RNA, 14 nt, Staphylococcus aureus subsp. aureus Mu50
uucaagaccaaaua

SEQ ID NO: 2048263 - RNA, 16 nt, Staphylococcus aureus subsp. aureus Mu50
uucaacuuuuuaauaa

SEQ ID NO: 2048264 - RNA, 22 nt, Staphylococcus aureus subsp. aureus Mu50
uucaacgcauauucuauuguug

SEQ ID NO: 2048265 - RNA, 21 nt, Staphylococcus aureus subsp. aureus Mu50
uucaacgucgaauguuucuuc

SEQ ID NO: 2048266 - RNA, 13 nt, Staphylococcus aureus subsp. aureus Mu50
uucaacuacuuca

SEQ ID NO: 2048267 - RNA, 13 nt, Staphylococcus aureus subsp. aureus Mu50
uucaacaucuuua

SEQ ID NO: 2048268 - RNA, 15 nt, Staphylococcus aureus subsp. aureus Mu50
uucaacauuacaugc

SEQ ID NO: 2048269 - RNA, 14 nt, Staphylococcus aureus subsp. aureus Mu50
uucaaccaauuauu

SEQ ID NO: 2048270 - RNA, 18 nt, Staphylococcus aureus subsp. aureus Mu50
uucaacauaacucaaaua

SEQ ID NO: 2048271 - RNA, 18 nt, Staphylococcus aureus subsp. aureus Mu50
uucaacaaacauaaauaa

SEQ ID NO: 2048272 - RNA, 13 nt, Staphylococcus aureus subsp. aureus Mu50
uucaaauaaagau

SEQ ID NO: 2048273 - RNA, 15 nt, Staphylococcus aureus subsp. aureus Mu50
uucaaauaauauaaa

SEQ ID NO: 2048274 - RNA, 15 nt, Staphylococcus aureus subsp. aureus Mu50
uucaaauugguuuuc

SEQ ID NO: 2048275 - RNA, 14 nt, Staphylococcus aureus subsp. aureus Mu50
uucaaauuaauuaa

SEQ ID NO: 2048276 - RNA, 19 nt, Staphylococcus aureus subsp. aureus Mu50
uucaaauguaguuaagaua

SEQ ID NO: 2048277 - RNA, 21 nt, Staphylococcus aureus subsp. aureus Mu50
uucaaaugcuuaauaaaauca

SEQ ID NO: 2048278 - RNA, 19 nt, Staphylococcus aureus subsp. aureus Mu50
uucaaauguaacauuaaaa

SEQ ID NO: 2048279 - RNA, 14 nt, Staphylococcus aureus subsp. aureus Mu50
uucaaaacugccaa

SEQ ID NO: 2048280 - RNA, 14 nt, Staphylococcus aureus subsp. aureus Mu50
uucaaaaucaaauu

SEQ ID NO: 2048281 - RNA, 19 nt, Staphylococcus aureus subsp. aureus Mu50
uucaaaaugccaagaagac

SEQ ID NO: 2048282 - RNA, 15 nt, Staphylococcus aureus subsp. aureus Mu50
uucaaaauuuugacu

SEQ ID NO: 2048283 - RNA, 13 nt, Staphylococcus aureus subsp. aureus Mu50
uucaaacaauaca

SEQ ID NO: 2048284 - RNA, 17 nt, Staphylococcus aureus subsp. aureus Mu50
uucaaagcugucaacuu

SEQ ID NO: 2048285 - RNA, 18 nt, Staphylococcus aureus subsp. aureus Mu50
uucaaagcgauaaaguau

SEQ ID NO: 2048286 - RNA, 16 nt, Staphylococcus aureus subsp. aureus Mu50
uucaaagcgaucauua

SEQ ID NO: 2048287 - RNA, 15 nt, Staphylococcus aureus subsp. aureus Mu50
uucaaaguagacauu

SEQ ID NO: 2048288 - RNA, 15 nt, Staphylococcus aureus subsp. aureus Mu50
uucaaagacguacau

SEQ ID NO: 2048289 - RNA, 14 nt, Staphylococcus aureus subsp. aureus Mu50
uucaaaaaauauuu

SEQ ID NO: 2048290 - RNA, 23 nt, Staphylococcus aureus subsp. aureus Mu50
uucaaaaaauaauagcaaaauua

SEQ ID NO: 2048291 - RNA, 23 nt, Staphylococcus aureus subsp. aureus Mu50
uucaaaagaaauuguguuucuuu

SEQ ID NO: 2048292 - RNA, 22 nt, Staphylococcus aureus subsp. aureus Mu50
uucaaaaagguauucaaauaaa

SEQ ID NO: 2048293 - RNA, 11 nt, Staphylococcus aureus subsp. aureus Mu50
uucaaaaauag

SEQ ID NO: 2048294 - RNA, 17 nt, Staphylococcus aureus subsp. aureus Mu50
uuauuuugauagacuaa

SEQ ID NO: 2048295 - RNA, 11 nt, Staphylococcus aureus subsp. aureus Mu50
uuauuuuuaag

SEQ ID NO: 2048296 - RNA, 21 nt, Staphylococcus aureus subsp. aureus Mu50
uuauuuucuuuggugaaagua

SEQ ID NO: 2048297 - RNA, 16 nt, Staphylococcus aureus subsp. aureus Mu50
uuauuuuuauucaguu

SEQ ID NO: 2048298 - RNA, 13 nt, Staphylococcus aureus subsp. aureus Mu50
uuauuuuuuuaaa

SEQ ID NO: 2048299 - RNA, 21 nt, Staphylococcus aureus subsp. aureus Mu50
uuauuuuuuuaaaucuauaua

SEQ ID NO: 2048300 - RNA, 22 nt, Staphylococcus aureus subsp. aureus Mu50
uuauuauugucaucauguucua

SEQ ID NO: 2048301 - RNA, 16 nt, Staphylococcus aureus subsp. aureus Mu50
uuauuauuuuguauuu

SEQ ID NO: 2048302 - RNA, 22 nt, Staphylococcus aureus subsp. aureus Mu50
uuauucacuuuuuuuaauuuga

SEQ ID NO: 2048303 - RNA, 20 nt, Staphylococcus aureus subsp. aureus Mu50
uuauugaguaucaugcuuuu

SEQ ID NO: 2048304 - RNA, 15 nt, Staphylococcus aureus subsp. aureus Mu50
uuauugagaauauuu

SEQ ID NO: 2048305 - RNA, 22 nt, Staphylococcus aureus subsp. aureus Mu50
uuauugagaauauuuauuguuu

SEQ ID NO: 2048306 - RNA, 23 nt, Staphylococcus aureus subsp. aureus Mu50
uuauugaauuugaauaagugguu

SEQ ID NO: 2048307 - RNA, 21 nt, Staphylococcus aureus subsp. aureus Mu50
uuauugaaauuuuuaauauac

SEQ ID NO: 2048308 - RNA, 12 nt, Staphylococcus aureus subsp. aureus Mu50
uuauucuuucuc

SEQ ID NO: 2048309 - RNA, 13 nt, Staphylococcus aureus subsp. aureus Mu50
uuauucuucccaa

SEQ ID NO: 2048310 - RNA, 14 nt, Staphylococcus aureus subsp. aureus Mu50
uuauucuucacuuu

SEQ ID NO: 2048311 - RNA, 15 nt, Staphylococcus aureus subsp. aureus Mu50
uuauucuaauacaaa

SEQ ID NO: 2048312 - RNA, 14 nt, Staphylococcus aureus subsp. aureus Mu50
uuauucucuuuauu

SEQ ID NO: 2048313 - RNA, 17 nt, Staphylococcus aureus subsp. aureus Mu50
uuauucuaaguuaaaac

SEQ ID NO: 2048314 - RNA, 15 nt, Staphylococcus aureus subsp. aureus Mu50
uuauucguuaacaau

SEQ ID NO: 2048315 - RNA, 12 nt, Staphylococcus aureus subsp. aureus Mu50
uuauuaacuuua

SEQ ID NO: 2048316 - RNA, 22 nt, Staphylococcus aureus subsp. aureus Mu50
uuauuaauuaaaaaauuccuag

SEQ ID NO: 2048317 - RNA, 22 nt, Staphylococcus aureus subsp. aureus Mu50
uuauuaauggcaacuaagauga

SEQ ID NO: 2048318 - RNA, 14 nt, Staphylococcus aureus subsp. aureus Mu50
uuauuauaaaauaa

SEQ ID NO: 2048319 - RNA, 14 nt, Staphylococcus aureus subsp. aureus Mu50
uuauuauaauagcu

SEQ ID NO: 2048320 - RNA, 23 nt, Staphylococcus aureus subsp. aureus Mu50
uuauuaggggagauuagagaaga

SEQ ID NO: 2048321 - RNA, 15 nt, Staphylococcus aureus subsp. aureus Mu50
uuauuaguauucaaa

SEQ ID NO: 2048322 - RNA, 21 nt, Staphylococcus aureus subsp. aureus Mu50
uuauuaguauucaaaaaauau

SEQ ID NO: 2048323 - RNA, 12 nt, Staphylococcus aureus subsp. aureus Mu50
uuauuauaaaau

SEQ ID NO: 2048324 - RNA, 17 nt, Staphylococcus aureus subsp. aureus Mu50
uuauuagaauauucaga

SEQ ID NO: 2048325 - RNA, 17 nt, Staphylococcus aureus subsp. aureus Mu50
uuauuaggauucaauaa

SEQ ID NO: 2048326 - RNA, 16 nt, Staphylococcus aureus subsp. aureus Mu50
uuauuaugaauuauua

SEQ ID NO: 2048327 - RNA, 12 nt, Staphylococcus aureus subsp. aureus Mu50
uuauuauacaua

SEQ ID NO: 2048328 - RNA, 20 nt, Staphylococcus aureus subsp. aureus Mu50
uuauuauguuauaaauucua

SEQ ID NO: 2048329 - RNA, 13 nt, Staphylococcus aureus subsp. aureus Mu50
uuauuauugaaau

SEQ ID NO: 2048330 - RNA, 18 nt, Staphylococcus aureus subsp. aureus Mu50
uuauuuauacuaaauuga

SEQ ID NO: 2048331 - RNA, 20 nt, Staphylococcus aureus subsp. aureus Mu50
uuauuuagaauucuaaaaga

SEQ ID NO: 2048332 - RNA, 12 nt, Staphylococcus aureus subsp. aureus Mu50
uuauuuaguaca

SEQ ID NO: 2048333 - RNA, 22 nt, Staphylococcus aureus subsp. aureus Mu50
uuauuuaaaacuuguaaauuua

SEQ ID NO: 2048334 - RNA, 13 nt, Staphylococcus aureus subsp. aureus Mu50
uuauuuaaaaugc

SEQ ID NO: 2048335 - RNA, 13 nt, Staphylococcus aureus subsp. aureus Mu50
uuauuuaaaacuu

SEQ ID NO: 2048336 - RNA, 13 nt, Staphylococcus aureus subsp. aureus Mu50
uuauuuaacacuu

SEQ ID NO: 2048337 - RNA, 15 nt, Staphylococcus aureus subsp. aureus Mu50
uuauuuaauaacgaa

SEQ ID NO: 2048338 - RNA, 15 nt, Staphylococcus aureus subsp. aureus Mu50
uuauugcaauaaaau

SEQ ID NO: 2048339 - RNA, 18 nt, Staphylococcus aureus subsp. aureus Mu50
uuauugcacuuuuuucau

SEQ ID NO: 2048340 - RNA, 18 nt, Staphylococcus aureus subsp. aureus Mu50
uuauugccgguuaaauua

SEQ ID NO: 2048341 - RNA, 21 nt, Staphylococcus aureus subsp. aureus Mu50
uuauugccgguuaaauuauuu

SEQ ID NO: 2048342 - RNA, 22 nt, Staphylococcus aureus subsp. aureus Mu50
uuauugucaucauguucuaaug

SEQ ID NO: 2048343 - RNA, 20 nt, Staphylococcus aureus subsp. aureus Mu50
uuauugguuacuguaguacu

SEQ ID NO: 2048344 - RNA, 17 nt, Staphylococcus aureus subsp. aureus Mu50
uuauugguugaaauuaa

SEQ ID NO: 2048345 - RNA, 20 nt, Staphylococcus aureus subsp. aureus Mu50
uuauuuucaauaaauaaaca

SEQ ID NO: 2048346 - RNA, 12 nt, Staphylococcus aureus subsp. aureus Mu50
uuauuuucaaua

SEQ ID NO: 2048347 - RNA, 13 nt, Staphylococcus aureus subsp. aureus Mu50
uuauuuucaauaa

SEQ ID NO: 2048348 - RNA, 21 nt, Staphylococcus aureus subsp. aureus Mu50
uuauuuuaucaucuauucaac

SEQ ID NO: 2048349 - RNA, 18 nt, Staphylococcus aureus subsp. aureus Mu50
uuauuuguuuaauuaucu

SEQ ID NO: 2048350 - RNA, 15 nt, Staphylococcus aureus subsp. aureus Mu50
uuauuuguaauuuca

SEQ ID NO: 2048351 - RNA, 20 nt, Staphylococcus aureus subsp. aureus Mu50
uuauuuggcucuauaucaaa

SEQ ID NO: 2048352 - RNA, 20 nt, Staphylococcus aureus subsp. aureus Mu50
uuauuuggguaacauuagca

SEQ ID NO: 2048353 - RNA, 21 nt, Staphylococcus aureus subsp. aureus Mu50
uuauuucuauaucuauuuauc

SEQ ID NO: 2048354 - RNA, 22 nt, Staphylococcus aureus subsp. aureus Mu50
uuauuugaaaugauaagaauca

SEQ ID NO: 2048355 - RNA, 18 nt, Staphylococcus aureus subsp. aureus Mu50
uuauuugauaaugauagu

SEQ ID NO: 2048356 - RNA, 15 nt, Staphylococcus aureus subsp. aureus Mu50
uuauuugauuauucu

SEQ ID NO: 2048357 - RNA, 21 nt, Staphylococcus aureus subsp. aureus Mu50
uuauuuggaugguaaguauaa

SEQ ID NO: 2048358 - RNA, 21 nt, Staphylococcus aureus subsp. aureus Mu50
uuaacaauauucguaaauccu

SEQ ID NO: 2048359 - RNA, 18 nt, Staphylococcus aureus subsp. aureus Mu50
uuaacaauugauugcucu

SEQ ID NO: 2048360 - RNA, 21 nt, Staphylococcus aureus subsp. aureus Mu50
uuaacaauuuuaucugaaucu

SEQ ID NO: 2048361 - RNA, 15 nt, Staphylococcus aureus subsp. aureus Mu50
uuaacaacuuuauua

SEQ ID NO: 2048362 - RNA, 12 nt, Staphylococcus aureus subsp. aureus Mu50
uuaacaacauga

SEQ ID NO: 2048363 - RNA, 19 nt, Staphylococcus aureus subsp. aureus Mu50
uuaaccacuccuuaaacaa

SEQ ID NO: 2048364 - RNA, 14 nt, Staphylococcus aureus subsp. aureus Mu50
uuaacauaaaauga

SEQ ID NO: 2048365 - RNA, 20 nt, Staphylococcus aureus subsp. aureus Mu50
uuaacauccugcuuauuaau

SEQ ID NO: 2048366 - RNA, 14 nt, Staphylococcus aureus subsp. aureus Mu50
uuaacgcaaaaaua

SEQ ID NO: 2048367 - RNA, 17 nt, Staphylococcus aureus subsp. aureus Mu50
uuaacgcaaaaauacuc

SEQ ID NO: 2048368 - RNA, 12 nt, Staphylococcus aureus subsp. aureus Mu50
uuaacuaaacca

SEQ ID NO: 2048369 - RNA, 15 nt, Staphylococcus aureus subsp. aureus Mu50
uuaacuaauagacug

SEQ ID NO: 2048370 - RNA, 16 nt, Staphylococcus aureus subsp. aureus Mu50
uuaacuauaaauagaa

SEQ ID NO: 2048371 - RNA, 13 nt, Staphylococcus aureus subsp. aureus Mu50
uuaacuauaacaa

SEQ ID NO: 2048372 - RNA, 15 nt, Staphylococcus aureus subsp. aureus Mu50
uuaaccauuuaaaaa

SEQ ID NO: 2048373 - RNA, 22 nt, Staphylococcus aureus subsp. aureus Mu50
uuaacgaaaugaccuuaauaua

SEQ ID NO: 2048374 - RNA, 18 nt, Staphylococcus aureus subsp. aureus Mu50
uuaaccuugauuuaauuu

SEQ ID NO: 2048375 - RNA, 15 nt, Staphylococcus aureus subsp. aureus Mu50
uuaagauuuuaacuu

SEQ ID NO: 2048376 - RNA, 12 nt, Staphylococcus aureus subsp. aureus Mu50
uuaacuuaauua

SEQ ID NO: 2048377 - RNA, 14 nt, Staphylococcus aureus subsp. aureus Mu50
uuaacuuauauacg

SEQ ID NO: 2048378 - RNA, 18 nt, Staphylococcus aureus subsp. aureus Mu50
uuaacucaacuuaaauau

SEQ ID NO: 2048379 - RNA, 14 nt, Staphylococcus aureus subsp. aureus Mu50
uuaacuucauaaua

SEQ ID NO: 2048380 - RNA, 19 nt, Staphylococcus aureus subsp. aureus Mu50
uuaacuuaaaauuuaaaua

SEQ ID NO: 2048381 - RNA, 13 nt, Staphylococcus aureus subsp. aureus Mu50
uuaacuuuaauua

SEQ ID NO: 2048382 - RNA, 21 nt, Staphylococcus aureus subsp. aureus Mu50
uuaacuuuuuugugauuauua

SEQ ID NO: 2048383 - RNA, 17 nt, Staphylococcus aureus subsp. aureus Mu50
uuaagaaacgucuuaau

SEQ ID NO: 2048384 - RNA, 22 nt, Staphylococcus aureus subsp. aureus Mu50
uuaauaacauccccaaaaauag

SEQ ID NO: 2048385 - RNA, 20 nt, Staphylococcus aureus subsp. aureus Mu50
uuaauaacccauuuucaaaa

SEQ ID NO: 2048386 - RNA, 13 nt, Staphylococcus aureus subsp. aureus Mu50
uuaauaauaagua

SEQ ID NO: 2048387 - RNA, 22 nt, Staphylococcus aureus subsp. aureus Mu50
uuaauaaauugacucaaagaua

SEQ ID NO: 2048388 - RNA, 12 nt, Staphylococcus aureus subsp. aureus Mu50
uuaauaaaccua

SEQ ID NO: 2048389 - RNA, 19 nt, Staphylococcus aureus subsp. aureus Mu50
uuaauaaacgcuucauagu

SEQ ID NO: 2048390 - RNA, 14 nt, Staphylococcus aureus subsp. aureus Mu50
uuaauaacaaaauu

SEQ ID NO: 2048391 - RNA, 20 nt, Staphylococcus aureus subsp. aureus Mu50
uuaauaaauuguaugaauaa

SEQ ID NO: 2048392 - RNA, 22 nt, Staphylococcus aureus subsp. aureus Mu50
uuaauaaauuguuaucguucaa

SEQ ID NO: 2048393 - RNA, 22 nt, Staphylococcus aureus subsp. aureus Mu50
uuaaguucaucuggugcaauau

SEQ ID NO: 2048394 - RNA, 13 nt, Staphylococcus aureus subsp. aureus Mu50
uuaaguuuuucag

SEQ ID NO: 2048395 - RNA, 22 nt, Staphylococcus aureus subsp. aureus Mu50
uuaagcucauuucaauauuaaa

SEQ ID NO: 2048396 - RNA, 15 nt, Staphylococcus aureus subsp. aureus Mu50
uuaagcuaucuaaac

SEQ ID NO: 2048397 - RNA, 20 nt, Staphylococcus aureus subsp. aureus Mu50
uuaagcuuacgacauacuug

SEQ ID NO: 2048398 - RNA, 14 nt, Staphylococcus aureus subsp. aureus Mu50
uuaaauaucaugca

SEQ ID NO: 2048399 - RNA, 19 nt, Staphylococcus aureus subsp. aureus Mu50
uuaaauacgccaaauauca

SEQ ID NO: 2048400 - RNA, 22 nt, Staphylococcus aureus subsp. aureus Mu50
uuaaauaucgacaaauuaaaaa

SEQ ID NO: 2048401 - RNA, 21 nt, Staphylococcus aureus subsp. aureus Mu50
uuaaauaugacgcgugaauua

SEQ ID NO: 2048402 - RNA, 17 nt, Staphylococcus aureus subsp. aureus Mu50
uuaaauauuuaaccuuu

SEQ ID NO: 2048403 - RNA, 19 nt, Staphylococcus aureus subsp. aureus Mu50
uuaaauauugauauaaaaa

SEQ ID NO: 2048404 - RNA, 14 nt, Staphylococcus aureus subsp. aureus Mu50
uuaaauauuuaauu

SEQ ID NO: 2048405 - RNA, 14 nt, Staphylococcus aureus subsp. aureus Mu50
uuaaaugcaauaca

SEQ ID NO: 2048406 - RNA, 20 nt, Staphylococcus aureus subsp. aureus Mu50
uuaaaugcccaccauguaca

SEQ ID NO: 2048407 - RNA, 13 nt, Staphylococcus aureus subsp. aureus Mu50
uuaaaucacauau

SEQ ID NO: 2048408 - RNA, 19 nt, Staphylococcus aureus subsp. aureus Mu50
uuaaaucaacaucaucuuu

SEQ ID NO: 2048409 - RNA, 14 nt, Staphylococcus aureus subsp. aureus Mu50
uuaaauuaagaaua

SEQ ID NO: 2048410 - RNA, 14 nt, Staphylococcus aureus subsp. aureus Mu50
uuaaauuaaagcaa

SEQ ID NO: 2048411 - RNA, 22 nt, Staphylococcus aureus subsp. aureus Mu50
uuaaauuaaagcaaauuauaua

SEQ ID NO: 2048412 - RNA, 13 nt, Staphylococcus aureus subsp. aureus Mu50
uuaaauucuaaaa

SEQ ID NO: 2048413 - RNA, 18 nt, Staphylococcus aureus subsp. aureus Mu50
uuaaauuggaaucccaau

SEQ ID NO: 2048414 - RNA, 22 nt, Staphylococcus aureus subsp. aureus Mu50
uuaaauuccaugucaauuuuuu

SEQ ID NO: 2048415 - RNA, 14 nt, Staphylococcus aureus subsp. aureus Mu50
uuaaauucaucuug

SEQ ID NO: 2048416 - RNA, 14 nt, Staphylococcus aureus subsp. aureus Mu50
uuaaauuauauacc

SEQ ID NO: 2048417 - RNA, 16 nt, Staphylococcus aureus subsp. aureus Mu50
uuaaauuauauaccca

SEQ ID NO: 2048418 - RNA, 15 nt, Staphylococcus aureus subsp. aureus Mu50
uuaaauuauauguuu

SEQ ID NO: 2048419 - RNA, 16 nt, Staphylococcus aureus subsp. aureus Mu50
uuaaauuauuuaauuu

SEQ ID NO: 2048420 - RNA, 21 nt, Staphylococcus aureus subsp. aureus Mu50
uuaaauuauuuaauuuuucua

SEQ ID NO: 2048421 - RNA, 15 nt, Staphylococcus aureus subsp. aureus Mu50
uuaaauuugaaagua

SEQ ID NO: 2048422 - RNA, 16 nt, Staphylococcus aureus subsp. aureus Mu50
uuaaauuugaaaguaa

SEQ ID NO: 2048423 - RNA, 14 nt, Staphylococcus aureus subsp. aureus Mu50
uuaaauuucugaac

SEQ ID NO: 2048424 - RNA, 15 nt, Staphylococcus aureus subsp. aureus Mu50
uuaaauuuaaaagaa

SEQ ID NO: 2048425 - RNA, 14 nt, Staphylococcus aureus subsp. aureus Mu50
uuaaauuuauaaua

SEQ ID NO: 2048426 - RNA, 15 nt, Staphylococcus aureus subsp. aureus Mu50
uuaacaacaaauaua

SEQ ID NO: 2048427 - RNA, 17 nt, Staphylococcus aureus subsp. aureus Mu50
uuaacaaaauuaagaag

SEQ ID NO: 2048428 - RNA, 20 nt, Staphylococcus aureus subsp. aureus Mu50
uuaacaaaauuaagaagaaa

SEQ ID NO: 2048429 - RNA, 20 nt, Staphylococcus aureus subsp. aureus Mu50
uuaaagaaaauaucugaaaa

SEQ ID NO: 2048430 - RNA, 21 nt, Staphylococcus aureus subsp. aureus Mu50
uuaaagaaaauaucugaaaaa

SEQ ID NO: 2048431 - RNA, 18 nt, Staphylococcus aureus subsp. aureus Mu50
uuaaagaaaauuucagua

SEQ ID NO: 2048432 - RNA, 21 nt, Staphylococcus aureus subsp. aureus Mu50
uuaaagaaaauuucaguacca

SEQ ID NO: 2048433 - RNA, 14 nt, Staphylococcus aureus subsp. aureus Mu50
uuaaagaacuauuu

SEQ ID NO: 2048434 - RNA, 22 nt, Staphylococcus aureus subsp. aureus Mu50
uuaaaguaaaauauacuugaag

SEQ ID NO: 2048435 - RNA, 17 nt, Staphylococcus aureus subsp. aureus Mu50
uuaaauaagaugaaaua

SEQ ID NO: 2048436 - RNA, 19 nt, Staphylococcus aureus subsp. aureus Mu50
uuaaauaagaugaaauauu

SEQ ID NO: 2048437 - RNA, 15 nt, Staphylococcus aureus subsp. aureus Mu50
uuaaauaagcuacua

SEQ ID NO: 2048438 - RNA, 16 nt, Staphylococcus aureus subsp. aureus Mu50
uuaaaggguguuuaga

SEQ ID NO: 2048439 - RNA, 14 nt, Staphylococcus aureus subsp. aureus Mu50
uuaaagguuaaaua

SEQ ID NO: 2048440 - RNA, 24 nt, Staphylococcus aureus subsp. aureus Mu50
uuaaaggaaaucaauccaucaaua

SEQ ID NO: 2048441 - RNA, 17 nt, Staphylococcus aureus subsp. aureus Mu50
uguugcuaaucucagau

SEQ ID NO: 2048442 - RNA, 16 nt, Staphylococcus aureus subsp. aureus Mu50
uuaaaauuuuaauuaa

SEQ ID NO: 2048443 - RNA, 17 nt, Staphylococcus aureus subsp. aureus Mu50
uuaaaauuuuaauuaau

SEQ ID NO: 2048444 - RNA, 17 nt, Staphylococcus aureus subsp. aureus Mu50
uuaaacaaauaaauguc

SEQ ID NO: 2048445 - RNA, 19 nt, Staphylococcus aureus subsp. aureus Mu50
uuaaacaagcaucaugaaa

SEQ ID NO: 2048446 - RNA, 16 nt, Staphylococcus aureus subsp. aureus Mu50
uuaaacaagcaucaug

SEQ ID NO: 2048447 - RNA, 21 nt, Staphylococcus aureus subsp. aureus Mu50
uuaaacacgcgguaaaacgaa

SEQ ID NO: 2048448 - RNA, 16 nt, Staphylococcus aureus subsp. aureus Mu50
uuaaacauuuagauuu

SEQ ID NO: 2048449 - RNA, 19 nt, Staphylococcus aureus subsp. aureus Mu50
uuaaacaugaacaaucaga

SEQ ID NO: 2048450 - RNA, 15 nt, Staphylococcus aureus subsp. aureus Mu50
uuaaacaguuuaauu

SEQ ID NO: 2048451 - RNA, 22 nt, Staphylococcus aureus subsp. aureus Mu50
uuaaacauaacaugaccuaaua

SEQ ID NO: 2048452 - RNA, 18 nt, Staphylococcus aureus subsp. aureus Mu50
uuaaaccguauagucauu

SEQ ID NO: 2048453 - RNA, 23 nt, Staphylococcus aureus subsp. aureus Mu50
uuaaaccgcacuucuauauuaau

SEQ ID NO: 2048454 - RNA, 20 nt, Staphylococcus aureus subsp. aureus Mu50
uuaaaccgccaccaccuaau

SEQ ID NO: 2048455 - RNA, 15 nt, Staphylococcus aureus subsp. aureus Mu50
uuaaacauuuuugaa

SEQ ID NO: 2048456 - RNA, 12 nt, Staphylococcus aureus subsp. aureus Mu50
uuacuaaaacaa

SEQ ID NO: 2048457 - RNA, 15 nt, Staphylococcus aureus subsp. aureus Mu50
uuacgaucauaaaua

SEQ ID NO: 2048458 - RNA, 14 nt, Staphylococcus aureus subsp. aureus Mu50
uuacgauaaacuaa

SEQ ID NO: 2048459 - RNA, 20 nt, Staphylococcus aureus subsp. aureus Mu50
uuacccacaucuuuuuaaaa

SEQ ID NO: 2048460 - RNA, 22 nt, Staphylococcus aureus subsp. aureus Mu50
uuaccaugaugagauaaaauca

SEQ ID NO: 2048461 - RNA, 18 nt, Staphylococcus aureus subsp. aureus Mu50
uuagaauaguuaccaaaa

SEQ ID NO: 2048462 - RNA, 19 nt, Staphylococcus aureus subsp. aureus Mu50
uuagaauuaguacuugaaa

SEQ ID NO: 2048463 - RNA, 23 nt, Staphylococcus aureus subsp. aureus Mu50
uuagaagaugauuauucucuuua

SEQ ID NO: 2048464 - RNA, 22 nt, Staphylococcus aureus subsp. aureus Mu50
uuagaauaagaaauaaaaggaa

SEQ ID NO: 2048465 - RNA, 14 nt, Staphylococcus aureus subsp. aureus Mu50
uuagaaaaauauga

SEQ ID NO: 2048466 - RNA, 15 nt, Staphylococcus aureus subsp. aureus Mu50
uuacuguaaauauga

SEQ ID NO: 2048467 - RNA, 14 nt, Staphylococcus aureus subsp. aureus Mu50
uuacuguaguacua

SEQ ID NO: 2048468 - RNA, 22 nt, Staphylococcus aureus subsp. aureus Mu50
uuacuguuaggauaaagauguc

SEQ ID NO: 2048469 - RNA, 23 nt, Staphylococcus aureus subsp. aureus Mu50
uuacuuaaucuggguuguaaucu

SEQ ID NO: 2048470 - RNA, 15 nt, Staphylococcus aureus subsp. aureus Mu50
uuacuuuuaaaacua

SEQ ID NO: 2048471 - RNA, 12 nt, Staphylococcus aureus subsp. aureus Mu50
uuacuuuaacuu

SEQ ID NO: 2048472 - RNA, 16 nt, Staphylococcus aureus subsp. aureus Mu50
uuacugaugaacauac

SEQ ID NO: 2048473 - RNA, 22 nt, Staphylococcus aureus subsp. aureus Mu50
uuacugaaacuaaauuaaaagu

SEQ ID NO: 2048474 - RNA, 19 nt, Staphylococcus aureus subsp. aureus Mu50
uuacugcaauuauuuuuca

SEQ ID NO: 2048475 - RNA, 21 nt, Staphylococcus aureus subsp. aureus Mu50
uuacugcacggauaccuacug

SEQ ID NO: 2048476 - RNA, 16 nt, Staphylococcus aureus subsp. aureus Mu50
uuacuccuuacaauaa

SEQ ID NO: 2048477 - RNA, 19 nt, Staphylococcus aureus subsp. aureus Mu50
uuacucuacacucaaacaa

SEQ ID NO: 2048478 - RNA, 17 nt, Staphylococcus aureus subsp. aureus Mu50
uuacucaaaccaucuua

SEQ ID NO: 2048479 - RNA, 18 nt, Staphylococcus aureus subsp. aureus Mu50
uuacuauggcauuauugc

SEQ ID NO: 2048480 - RNA, 15 nt, Staphylococcus aureus subsp. aureus Mu50
uuacuaccuauuaau

SEQ ID NO: 2048481 - RNA, 18 nt, Staphylococcus aureus subsp. aureus Mu50
uuacuaggaauauaaaac

SEQ ID NO: 2048482 - RNA, 16 nt, Staphylococcus aureus subsp. aureus Mu50
uuaauacguuuaauaa

SEQ ID NO: 2048483 - RNA, 18 nt, Staphylococcus aureus subsp. aureus Mu50
uuaauacuaccguuuuua

SEQ ID NO: 2048484 - RNA, 15 nt, Staphylococcus aureus subsp. aureus Mu50
uuaauagagaaagaa

SEQ ID NO: 2048485 - RNA, 18 nt, Staphylococcus aureus subsp. aureus Mu50
uuaauagagaaagaauaa

SEQ ID NO: 2048486 - RNA, 22 nt, Staphylococcus aureus subsp. aureus Mu50
uuaauacuaccguuuuuauaua

SEQ ID NO: 2048487 - RNA, 17 nt, Staphylococcus aureus subsp. aureus Mu50
uuaauagaaagagguuu

SEQ ID NO: 2048488 - RNA, 16 nt, Staphylococcus aureus subsp. aureus Mu50
uuaauagaaagugcgg

SEQ ID NO: 2048489 - RNA, 21 nt, Staphylococcus aureus subsp. aureus Mu50
uuaaugauaaguggauuuucu

SEQ ID NO: 2048490 - RNA, 14 nt, Staphylococcus aureus subsp. aureus Mu50
uuaauuaucauaaa

SEQ ID NO: 2048491 - RNA, 21 nt, Staphylococcus aureus subsp. aureus Mu50
uuaauguauucuucuaauucu

SEQ ID NO: 2048492 - RNA, 19 nt, Staphylococcus aureus subsp. aureus Mu50
uuaauuacuguaaauauga

SEQ ID NO: 2048493 - RNA, 22 nt, Staphylococcus aureus subsp. aureus Mu50
uuaauuauugagaauauuuauu

SEQ ID NO: 2048494 - RNA, 20 nt, Staphylococcus aureus subsp. aureus Mu50
uuaauuauguauuuuuauuu

SEQ ID NO: 2048495 - RNA, 15 nt, Staphylococcus aureus subsp. aureus Mu50
uuaauuauuuagauu

SEQ ID NO: 2048496 - RNA, 14 nt, Staphylococcus aureus subsp. aureus Mu50
uuaauuauuucccu

SEQ ID NO: 2048497 - RNA, 16 nt, Staphylococcus aureus subsp. aureus Mu50
uuaauuauuuuaaaaa

SEQ ID NO: 2048498 - RNA, 22 nt, Staphylococcus aureus subsp. aureus Mu50
uuaauggcagcgaucuuuuuua

SEQ ID NO: 2048499 - RNA, 13 nt, Staphylococcus aureus subsp. aureus Mu50
uuaaugcuuuagc

SEQ ID NO: 2048500 - RNA, 22 nt, Staphylococcus aureus subsp. aureus Mu50
uuaaugcuucaaauguaacauu

SEQ ID NO: 2048501 - RNA, 16 nt, Staphylococcus aureus subsp. aureus Mu50
uuaaugcucuauauau

SEQ ID NO: 2048502 - RNA, 22 nt, Staphylococcus aureus subsp. aureus Mu50
uuacacccuuuaaauuuaacuc

SEQ ID NO: 2048503 - RNA, 15 nt, Staphylococcus aureus subsp. aureus Mu50
uuacaccuuuggcac

SEQ ID NO: 2048504 - RNA, 23 nt, Staphylococcus aureus subsp. aureus Mu50
uuacacuaaaaccuauuccuaau

SEQ ID NO: 2048505 - RNA, 12 nt, Staphylococcus aureus subsp. aureus Mu50
uuacaaguuguu

SEQ ID NO: 2048506 - RNA, 17 nt, Staphylococcus aureus subsp. aureus Mu50
uuacaaguuguucaauu

SEQ ID NO: 2048507 - RNA, 21 nt, Staphylococcus aureus subsp. aureus Mu50
uuacaacuuuuagaguuuuua

SEQ ID NO: 2048508 - RNA, 19 nt, Staphylococcus aureus subsp. aureus Mu50
uuacaaccuuugguuguua

SEQ ID NO: 2048509 - RNA, 21 nt, Staphylococcus aureus subsp. aureus Mu50
uuacaaaucaugacauaaaac

SEQ ID NO: 2048510 - RNA, 22 nt, Staphylococcus aureus subsp. aureus Mu50
uuacaaaugaagguguugaaaa

SEQ ID NO: 2048511 - RNA, 17 nt, Staphylococcus aureus subsp. aureus Mu50
uuacaaaguuaaccaua

SEQ ID NO: 2048512 - RNA, 21 nt, Staphylococcus aureus subsp. aureus Mu50
uuacaaaguuaaccauacaua

SEQ ID NO: 2048513 - RNA, 13 nt, Staphylococcus aureus subsp. aureus Mu50
uuacaaauauacu

SEQ ID NO: 2048514 - RNA, 16 nt, Staphylococcus aureus subsp. aureus Mu50
uuaauuucaacauuac

SEQ ID NO: 2048515 - RNA, 16 nt, Staphylococcus aureus subsp. aureus Mu50
uuaauuuacaauuaau

SEQ ID NO: 2048516 - RNA, 18 nt, Staphylococcus aureus subsp. aureus Mu50
uuaauuuacaauuaauua

SEQ ID NO: 2048517 - RNA, 18 nt, Staphylococcus aureus subsp. aureus Mu50
uuaauuuaaaucuguacu

SEQ ID NO: 2048518 - RNA, 17 nt, Staphylococcus aureus subsp. aureus Mu50
uuaauuggguuuaauaa

SEQ ID NO: 2048519 - RNA, 23 nt, Staphylococcus aureus subsp. aureus Mu50
uuacaaagugauuuaaaaaauuu

SEQ ID NO: 2048520 - RNA, 13 nt, Staphylococcus aureus subsp. aureus Mu50
uuaauuucacuuu

SEQ ID NO: 2048521 - RNA, 15 nt, Staphylococcus aureus subsp. aureus Mu50
uuaauuucaacauua

SEQ ID NO: 2048522 - RNA, 17 nt, Staphylococcus aureus subsp. aureus Mu50
uuaauuuagugaaacaa

SEQ ID NO: 2048523 - RNA, 13 nt, Staphylococcus aureus subsp. aureus Mu50
uuacagaugaugc

SEQ ID NO: 2048524 - RNA, 20 nt, Staphylococcus aureus subsp. aureus Mu50
uuacauuuggcguaaugaua

SEQ ID NO: 2048525 - RNA, 18 nt, Staphylococcus aureus subsp. aureus Mu50
uuacauuuuaauaaaauc

SEQ ID NO: 2048526 - RNA, 16 nt, Staphylococcus aureus subsp. aureus Mu50
uuacauuuuaugucca

SEQ ID NO: 2048527 - RNA, 21 nt, Staphylococcus aureus subsp. aureus Mu50
uuacaugcaccuuuacaacau

SEQ ID NO: 2048528 - RNA, 12 nt, Staphylococcus aureus subsp. aureus Mu50
uuacauuacaua

SEQ ID NO: 2048529 - RNA, 21 nt, Staphylococcus aureus subsp. aureus Mu50
uuacauuacgcucaucaccuu

SEQ ID NO: 2048530 - RNA, 14 nt, Staphylococcus aureus subsp. aureus Mu50
ugccgcuucuacaa

SEQ ID NO: 2048531 - RNA, 14 nt, Staphylococcus aureus subsp. aureus Mu50
ugccggucauaaca

SEQ ID NO: 2048532 - RNA, 20 nt, Staphylococcus aureus subsp. aureus Mu50
ugccauguuggcaauuguuu

SEQ ID NO: 2048533 - RNA, 16 nt, Staphylococcus aureus subsp. aureus Mu50
ugcccugcuguuuuau

SEQ ID NO: 2048534 - RNA, 20 nt, Staphylococcus aureus subsp. aureus Mu50
ugccgccuaauaauaaaaua

SEQ ID NO: 2048535 - RNA, 15 nt, Staphylococcus aureus subsp. aureus Mu50
ugccaaauuucucuu

SEQ ID NO: 2048536 - RNA, 17 nt, Staphylococcus aureus subsp. aureus Mu50
ugccaauggaaguuuuu

SEQ ID NO: 2048537 - RNA, 21 nt, Staphylococcus aureus subsp. aureus Mu50
ugcauuuagaugauucuuauc

SEQ ID NO: 2048538 - RNA, 17 nt, Staphylococcus aureus subsp. aureus Mu50
ugccaaauauaguaauu

SEQ ID NO: 2048539 - RNA, 18 nt, Staphylococcus aureus subsp. aureus Mu50
ugccaaaaugguuaaaau

SEQ ID NO: 2048540 - RNA, 16 nt, Staphylococcus aureus subsp. aureus Mu50
ugccaaaaaguauuca

SEQ ID NO: 2048541 - RNA, 23 nt, Staphylococcus aureus subsp. aureus Mu50
ugcauauugugccgcuucuacaa

SEQ ID NO: 2048542 - RNA, 14 nt, Staphylococcus aureus subsp. aureus Mu50
ugcauauauauaua

SEQ ID NO: 2048543 - RNA, 15 nt, Staphylococcus aureus subsp. aureus Mu50
ugcauauauauauag

SEQ ID NO: 2048544 - RNA, 16 nt, Staphylococcus aureus subsp. aureus Mu50
ugcauauaaagucaua

SEQ ID NO: 2048545 - RNA, 17 nt, Staphylococcus aureus subsp. aureus Mu50
ugcauagcuaaauaaau

SEQ ID NO: 2048546 - RNA, 15 nt, Staphylococcus aureus subsp. aureus Mu50
ugcauagcuaaauaa

SEQ ID NO: 2048547 - RNA, 23 nt, Staphylococcus aureus subsp. aureus Mu50
ugcauagcgcucuggauuuuucu

SEQ ID NO: 2048548 - RNA, 17 nt, Staphylococcus aureus subsp. aureus Mu50
ugcauacgaauuaaaau

SEQ ID NO: 2048549 - RNA, 22 nt, Staphylococcus aureus subsp. aureus Mu50
ugcauaauuaggauuaacauaa

SEQ ID NO: 2048550 - RNA, 13 nt, Staphylococcus aureus subsp. aureus Mu50
ugcauaaaaaaag

SEQ ID NO: 2048551 - RNA, 22 nt, Staphylococcus aureus subsp. aureus Mu50
ugcaguuucaaucgcauuuugu

SEQ ID NO: 2048552 - RNA, 16 nt, Staphylococcus aureus subsp. aureus Mu50
ugcacugagcaacaaa

SEQ ID NO: 2048553 - RNA, 18 nt, Staphylococcus aureus subsp. aureus Mu50
ugcacugcuaauauuaga

SEQ ID NO: 2048554 - RNA, 15 nt, Staphylococcus aureus subsp. aureus Mu50
ugcaguuaaauuaaa

SEQ ID NO: 2048555 - RNA, 19 nt, Staphylococcus aureus subsp. aureus Mu50
ugcaugcgcaaaagcgcag

SEQ ID NO: 2048556 - RNA, 20 nt, Staphylococcus aureus subsp. aureus Mu50
ugcaugacagcaaauuuucu

SEQ ID NO: 2048557 - RNA, 19 nt, Staphylococcus aureus subsp. aureus Mu50
ugcaugacucacuaaucuc

SEQ ID NO: 2048558 - RNA, 19 nt, Staphylococcus aureus subsp. aureus Mu50
ugcaugagacuuauucaac

SEQ ID NO: 2048559 - RNA, 16 nt, Staphylococcus aureus subsp. aureus Mu50
ugcaugacgauaauga

SEQ ID NO: 2048560 - RNA, 13 nt, Staphylococcus aureus subsp. aureus Mu50
ugcaugacagcaa

SEQ ID NO: 2048561 - RNA, 24 nt, Staphylococcus aureus subsp. aureus Mu50
ugcauguccugaauguucgaagau

SEQ ID NO: 2048562 - RNA, 15 nt, Staphylococcus aureus subsp. aureus Mu50
ugcauguacaucuuu

SEQ ID NO: 2048563 - RNA, 15 nt, Staphylococcus aureus subsp. aureus Mu50
ugcauguuuaaauau

SEQ ID NO: 2048564 - RNA, 20 nt, Staphylococcus aureus subsp. aureus Mu50
ugcauuauuauaauagcuuu

SEQ ID NO: 2048565 - RNA, 20 nt, Staphylococcus aureus subsp. aureus Mu50
ugcauuacuaucuucaucau

SEQ ID NO: 2048566 - RNA, 17 nt, Staphylococcus aureus subsp. aureus Mu50
ugcauuaagugcaauaa

SEQ ID NO: 2048567 - RNA, 17 nt, Staphylococcus aureus subsp. aureus Mu50
ugcauuacuaucuucau

SEQ ID NO: 2048568 - RNA, 12 nt, Staphylococcus aureus subsp. aureus Mu50
ugcauuaauuuc

SEQ ID NO: 2048569 - RNA, 18 nt, Staphylococcus aureus subsp. aureus Mu50
ugcauuacuacuuuauaa

SEQ ID NO: 2048570 - RNA, 23 nt, Staphylococcus aureus subsp. aureus Mu50
ugcauuacuacuuuauaaauauc

SEQ ID NO: 2048571 - RNA, 22 nt, Staphylococcus aureus subsp. aureus Mu50
ugcaucccgaaaguuagacuaa

SEQ ID NO: 2048572 - RNA, 17 nt, Staphylococcus aureus subsp. aureus Mu50
ugcgguuuaaucuauau

SEQ ID NO: 2048573 - RNA, 14 nt, Staphylococcus aureus subsp. aureus Mu50
ugcgccuucuuuuu

SEQ ID NO: 2048574 - RNA, 22 nt, Staphylococcus aureus subsp. aureus Mu50
ugcuuuagagauuguaagaauu

SEQ ID NO: 2048575 - RNA, 15 nt, Staphylococcus aureus subsp. aureus Mu50
ugcuuuauuuuauca

SEQ ID NO: 2048576 - RNA, 12 nt, Staphylococcus aureus subsp. aureus Mu50
ugcuuuaauaaa

SEQ ID NO: 2048577 - RNA, 14 nt, Staphylococcus aureus subsp. aureus Mu50
ugcuuuaauaaauc

SEQ ID NO: 2048578 - RNA, 20 nt, Staphylococcus aureus subsp. aureus Mu50
ugcuuucacauuguuuacaa

SEQ ID NO: 2048579 - RNA, 20 nt, Staphylococcus aureus subsp. aureus Mu50
ugcuuuuaaauguauuuuua

SEQ ID NO: 2048580 - RNA, 22 nt, Staphylococcus aureus subsp. aureus Mu50
ugcuuuuaaauguauuuuuacu

SEQ ID NO: 2048581 - RNA, 15 nt, Staphylococcus aureus subsp. aureus Mu50
ugcuuuguuuaucaa

SEQ ID NO: 2048582 - RNA, 13 nt, Staphylococcus aureus subsp. aureus Mu50
ugcuuuuaaaugu

SEQ ID NO: 2048583 - RNA, 14 nt, Staphylococcus aureus subsp. aureus Mu50
ugcuuuuaaaugua

SEQ ID NO: 2048584 - RNA, 18 nt, Staphylococcus aureus subsp. aureus Mu50
ugcuuuuaauauuauaaa

SEQ ID NO: 2048585 - RNA, 20 nt, Staphylococcus aureus subsp. aureus Mu50
ugcuuuuaauauuauaaacc

SEQ ID NO: 2048586 - RNA, 17 nt, Staphylococcus aureus subsp. aureus Mu50
ugcuuuuccauaaauau

SEQ ID NO: 2048587 - RNA, 22 nt, Staphylococcus aureus subsp. aureus Mu50
ugcuuuuccauaaauauuuaaa

SEQ ID NO: 2048588 - RNA, 19 nt, Staphylococcus aureus subsp. aureus Mu50
ugcuuauuuuuguauucuu

SEQ ID NO: 2048589 - RNA, 14 nt, Staphylococcus aureus subsp. aureus Mu50
ugcuuaguacacgu

SEQ ID NO: 2048590 - RNA, 18 nt, Staphylococcus aureus subsp. aureus Mu50
ugcuuaguacacguguau

SEQ ID NO: 2048591 - RNA, 19 nt, Staphylococcus aureus subsp. aureus Mu50
ugcuuaguacacguguauu

SEQ ID NO: 2048592 - RNA, 18 nt, Staphylococcus aureus subsp. aureus Mu50
ugcuucaaauguaacauu

SEQ ID NO: 2048593 - RNA, 13 nt, Staphylococcus aureus subsp. aureus Mu50
ugcuucaaagccu

SEQ ID NO: 2048594 - RNA, 12 nt, Staphylococcus aureus subsp. aureus Mu50
ugcuucaacuac

SEQ ID NO: 2048595 - RNA, 21 nt, Staphylococcus aureus subsp. aureus Mu50
ugcuugaaauuauuauuuaaa

SEQ ID NO: 2048596 - RNA, 16 nt, Staphylococcus aureus subsp. aureus Mu50
ugcuucacuguuuuau

SEQ ID NO: 2048597 - RNA, 15 nt, Staphylococcus aureus subsp. aureus Mu50
ugcuuacuuuuaaaa

SEQ ID NO: 2048598 - RNA, 22 nt, Staphylococcus aureus subsp. aureus Mu50
ugcuguugaagaagguaauaaa

SEQ ID NO: 2048599 - RNA, 19 nt, Staphylococcus aureus subsp. aureus Mu50
ugcuguucucuauuuauaa

SEQ ID NO: 2048600 - RNA, 12 nt, Staphylococcus aureus subsp. aureus Mu50
ugcuguaucuuc

SEQ ID NO: 2048601 - RNA, 23 nt, Staphylococcus aureus subsp. aureus Mu50
ugcuguacguuuaauaccuauga

SEQ ID NO: 2048602 - RNA, 18 nt, Staphylococcus aureus subsp. aureus Mu50
ugcuguacuauauucaau

SEQ ID NO: 2048603 - RNA, 18 nt, Staphylococcus aureus subsp. aureus Mu50
ugcugguugcuucuuauc

SEQ ID NO: 2048604 - RNA, 23 nt, Staphylococcus aureus subsp. aureus Mu50
ugcugccggugcagauaauugaa

SEQ ID NO: 2048605 - RNA, 18 nt, Staphylococcus aureus subsp. aureus Mu50
ugcucgauauaugucuca

SEQ ID NO: 2048606 - RNA, 16 nt, Staphylococcus aureus subsp. aureus Mu50
ugcguugguauucauc

SEQ ID NO: 2048607 - RNA, 23 nt, Staphylococcus aureus subsp. aureus Mu50
ugcugauaauuuuucuucuuuuu

SEQ ID NO: 2048608 - RNA, 21 nt, Staphylococcus aureus subsp. aureus Mu50
ugaauaguaaucagcuuuuuc

SEQ ID NO: 2048609 - RNA, 15 nt, Staphylococcus aureus subsp. aureus Mu50
ugaauauuuuucaau

SEQ ID NO: 2048610 - RNA, 21 nt, Staphylococcus aureus subsp. aureus Mu50
ugaauaaauuuuauucuucag

SEQ ID NO: 2048611 - RNA, 13 nt, Staphylococcus aureus subsp. aureus Mu50
ugaauaaauacaa

SEQ ID NO: 2048612 - RNA, 21 nt, Staphylococcus aureus subsp. aureus Mu50
ugaauaaagcuaacauaccua

SEQ ID NO: 2048613 - RNA, 13 nt, Staphylococcus aureus subsp. aureus Mu50
ugaauaaauaacu

SEQ ID NO: 2048614 - RNA, 14 nt, Staphylococcus aureus subsp. aureus Mu50
ugaauaaauaacuu

SEQ ID NO: 2048615 - RNA, 15 nt, Staphylococcus aureus subsp. aureus Mu50
ugaauaaauaacuuc

SEQ ID NO: 2048616 - RNA, 17 nt, Staphylococcus aureus subsp. aureus Mu50
ugaauacuuuauuugau

SEQ ID NO: 2048617 - RNA, 23 nt, Staphylococcus aureus subsp. aureus Mu50
ugaagucuguuuagaagaaacuu

SEQ ID NO: 2048618 - RNA, 19 nt, Staphylococcus aureus subsp. aureus Mu50
ugaaguauugccaaauuuc

SEQ ID NO: 2048619 - RNA, 20 nt, Staphylococcus aureus subsp. aureus Mu50
ugaaguaugcacaucauuga

SEQ ID NO: 2048620 - RNA, 15 nt, Staphylococcus aureus subsp. aureus Mu50
ugaaguauggaaguu

SEQ ID NO: 2048621 - RNA, 16 nt, Staphylococcus aureus subsp. aureus Mu50
ugaaguuacuauauuu

SEQ ID NO: 2048622 - RNA, 14 nt, Staphylococcus aureus subsp. aureus Mu50
ugaauaaaauauau

SEQ ID NO: 2048623 - RNA, 14 nt, Staphylococcus aureus subsp. aureus Mu50
ugaauaaaauugug

SEQ ID NO: 2048624 - RNA, 20 nt, Staphylococcus aureus subsp. aureus Mu50
ugaaguuugaacaacaucuu

SEQ ID NO: 2048625 - RNA, 13 nt, Staphylococcus aureus subsp. aureus Mu50
ugaaguuguuucu

SEQ ID NO: 2048626 - RNA, 13 nt, Staphylococcus aureus subsp. aureus Mu50
ugaauuaauagcu

SEQ ID NO: 2048627 - RNA, 15 nt, Staphylococcus aureus subsp. aureus Mu50
ugaauuagauuuugu

SEQ ID NO: 2048628 - RNA, 23 nt, Staphylococcus aureus subsp. aureus Mu50
ugaaugguugauuauauuucuca

SEQ ID NO: 2048629 - RNA, 17 nt, Staphylococcus aureus subsp. aureus Mu50
ugaauuaaagcaucgaa

SEQ ID NO: 2048630 - RNA, 16 nt, Staphylococcus aureus subsp. aureus Mu50
ugaauuuuaauauauu

SEQ ID NO: 2048631 - RNA, 23 nt, Staphylococcus aureus subsp. aureus Mu50
ugaauuuuauuagguaauacuuu

SEQ ID NO: 2048632 - RNA, 24 nt, Staphylococcus aureus subsp. aureus Mu50
ugaauuuuauaaguauauaauuga

SEQ ID NO: 2048633 - RNA, 15 nt, Staphylococcus aureus subsp. aureus Mu50
ugaauuuuauaaauu

SEQ ID NO: 2048634 - RNA, 18 nt, Staphylococcus aureus subsp. aureus Mu50
ugacaaucgcuugcuucu

SEQ ID NO: 2048635 - RNA, 24 nt, Staphylococcus aureus subsp. aureus Mu50
ugaaucccauaacaaucauuucug

SEQ ID NO: 2048636 - RNA, 15 nt, Staphylococcus aureus subsp. aureus Mu50
ugaaucauuuuagca

SEQ ID NO: 2048637 - RNA, 18 nt, Staphylococcus aureus subsp. aureus Mu50
ugaaucauuuuagcaccg

SEQ ID NO: 2048638 - RNA, 16 nt, Staphylococcus aureus subsp. aureus Mu50
ugaaucagaugauuua

SEQ ID NO: 2048639 - RNA, 23 nt, Staphylococcus aureus subsp. aureus Mu50
ugaaucaacaguuuuauuaucuu

SEQ ID NO: 2048640 - RNA, 20 nt, Staphylococcus aureus subsp. aureus Mu50
ugaaucgaguuugaaauaau

SEQ ID NO: 2048641 - RNA, 22 nt, Staphylococcus aureus subsp. aureus Mu50
ugaauggcaaucuauauaaaug

SEQ ID NO: 2048642 - RNA, 23 nt, Staphylococcus aureus subsp. aureus Mu50
ugaauggcaaucuauauaaaugu

SEQ ID NO: 2048643 - RNA, 17 nt, Staphylococcus aureus subsp. aureus Mu50
ugaauggagcaugauua

SEQ ID NO: 2048644 - RNA, 20 nt, Staphylococcus aureus subsp. aureus Mu50
ugaagcgcuuggauuuuuug

SEQ ID NO: 2048645 - RNA, 19 nt, Staphylococcus aureus subsp. aureus Mu50
ugaagggagcauuucauua

SEQ ID NO: 2048646 - RNA, 14 nt, Staphylococcus aureus subsp. aureus Mu50
ugaagggagcauuu

SEQ ID NO: 2048647 - RNA, 16 nt, Staphylococcus aureus subsp. aureus Mu50
ugaagggagcauuuca

SEQ ID NO: 2048648 - RNA, 17 nt, Staphylococcus aureus subsp. aureus Mu50
ugaagggagcauuucau

SEQ ID NO: 2048649 - RNA, 18 nt, Staphylococcus aureus subsp. aureus Mu50
ugaagggagcauuucauu

SEQ ID NO: 2048650 - RNA, 22 nt, Staphylococcus aureus subsp. aureus Mu50
ugaagcguucgugauagaaguu

SEQ ID NO: 2048651 - RNA, 14 nt, Staphylococcus aureus subsp. aureus Mu50
ugaagcuaauucau

SEQ ID NO: 2048652 - RNA, 19 nt, Staphylococcus aureus subsp. aureus Mu50
ugaagaaggaugaguuuaa

SEQ ID NO: 2048653 - RNA, 12 nt, Staphylococcus aureus subsp. aureus Mu50
ugaacuucuuuu

SEQ ID NO: 2048654 - RNA, 15 nt, Staphylococcus aureus subsp. aureus Mu50
ugaacuuuguaucuu

SEQ ID NO: 2048655 - RNA, 12 nt, Staphylococcus aureus subsp. aureus Mu50
ugaacguuuauu

SEQ ID NO: 2048656 - RNA, 11 nt, Staphylococcus aureus subsp. aureus Mu50
ugaacuaaaac

SEQ ID NO: 2048657 - RNA, 13 nt, Staphylococcus aureus subsp. aureus Mu50
ugaacuaaaacga

SEQ ID NO: 2048658 - RNA, 20 nt, Staphylococcus aureus subsp. aureus Mu50
ugaacuacucccgcaaauau

SEQ ID NO: 2048659 - RNA, 13 nt, Staphylococcus aureus subsp. aureus Mu50
ugaacuaaauuga

SEQ ID NO: 2048660 - RNA, 17 nt, Staphylococcus aureus subsp. aureus Mu50
ugaccuuaauauaacga

SEQ ID NO: 2048661 - RNA, 21 nt, Staphylococcus aureus subsp. aureus Mu50
ugacgaacgauagauucugau

SEQ ID NO: 2048662 - RNA, 20 nt, Staphylococcus aureus subsp. aureus Mu50
ugaccuuuacgccauucauc

SEQ ID NO: 2048663 - RNA, 15 nt, Staphylococcus aureus subsp. aureus Mu50
ugacauccauacaaa

SEQ ID NO: 2048664 - RNA, 17 nt, Staphylococcus aureus subsp. aureus Mu50
ugacaucaucuauaaua

SEQ ID NO: 2048665 - RNA, 19 nt, Staphylococcus aureus subsp. aureus Mu50
ugacaucaucuauaauacc

SEQ ID NO: 2048666 - RNA, 21 nt, Staphylococcus aureus subsp. aureus Mu50
ugacauauuuuuuaaauuuaa

SEQ ID NO: 2048667 - RNA, 16 nt, Staphylococcus aureus subsp. aureus Mu50
ugacauuuuaaaucua

SEQ ID NO: 2048668 - RNA, 21 nt, Staphylococcus aureus subsp. aureus Mu50
ugacauuuucaaguuuaaaau

SEQ ID NO: 2048669 - RNA, 20 nt, Staphylococcus aureus subsp. aureus Mu50
ugacauuucaucaauaauuu

SEQ ID NO: 2048670 - RNA, 19 nt, Staphylococcus aureus subsp. aureus Mu50
ugacauguguuaaaccaac

SEQ ID NO: 2048671 - RNA, 22 nt, Staphylococcus aureus subsp. aureus Mu50
ugacauucauuuaguuaaauac

SEQ ID NO: 2048672 - RNA, 14 nt, Staphylococcus aureus subsp. aureus Mu50
ugacccuugucagu

SEQ ID NO: 2048673 - RNA, 21 nt, Staphylococcus aureus subsp. aureus Mu50
ugagcaaagcaaauuaguaug

SEQ ID NO: 2048674 - RNA, 23 nt, Staphylococcus aureus subsp. aureus Mu50
ugagauaaaaucauaugucuuaa

SEQ ID NO: 2048675 - RNA, 14 nt, Staphylococcus aureus subsp. aureus Mu50
ugagcaacaaaaga

SEQ ID NO: 2048676 - RNA, 16 nt, Staphylococcus aureus subsp. aureus Mu50
ugagcaaagcuuuuuu

SEQ ID NO: 2048677 - RNA, 22 nt, Staphylococcus aureus subsp. aureus Mu50
ugagcaacaaaagauguugcuc

SEQ ID NO: 2048678 - RNA, 14 nt, Staphylococcus aureus subsp. aureus Mu50
ugagcaagucuucu

SEQ ID NO: 2048679 - RNA, 13 nt, Staphylococcus aureus subsp. aureus Mu50
ugagacgcauugc

SEQ ID NO: 2048680 - RNA, 16 nt, Staphylococcus aureus subsp. aureus Mu50
ugagauaaaaucauau

SEQ ID NO: 2048681 - RNA, 12 nt, Staphylococcus aureus subsp. aureus Mu50
ugagauaaaauc

SEQ ID NO: 2048682 - RNA, 15 nt, Staphylococcus aureus subsp. aureus Mu50
ugagauaaaaucaua

SEQ ID NO: 2048683 - RNA, 13 nt, Staphylococcus aureus subsp. aureus Mu50
ugagaauuucuaa

SEQ ID NO: 2048684 - RNA, 15 nt, Staphylococcus aureus subsp. aureus Mu50
ugagaauuucuaauu

SEQ ID NO: 2048685 - RNA, 23 nt, Staphylococcus aureus subsp. aureus Mu50
ugagacccaccguuaaaauauau

SEQ ID NO: 2048686 - RNA, 16 nt, Staphylococcus aureus subsp. aureus Mu50
ugagaaaucuuaaaga

SEQ ID NO: 2048687 - RNA, 15 nt, Staphylococcus aureus subsp. aureus Mu50
ugacuuccuuaguca

SEQ ID NO: 2048688 - RNA, 14 nt, Staphylococcus aureus subsp. aureus Mu50
ugagaaaguaaaag

SEQ ID NO: 2048689 - RNA, 22 nt, Staphylococcus aureus subsp. aureus Mu50
ugacuacucaauccuaaauuau

SEQ ID NO: 2048690 - RNA, 15 nt, Staphylococcus aureus subsp. aureus Mu50
ugacuaauaaaacuu

SEQ ID NO: 2048691 - RNA, 19 nt, Staphylococcus aureus subsp. aureus Mu50
ugacuagggguuuuuaaua

SEQ ID NO: 2048692 - RNA, 22 nt, Staphylococcus aureus subsp. aureus Mu50
ugacuauuucgcuuuuuuuauu

SEQ ID NO: 2048693 - RNA, 17 nt, Staphylococcus aureus subsp. aureus Mu50
ugacugugaagcugugc

SEQ ID NO: 2048694 - RNA, 21 nt, Staphylococcus aureus subsp. aureus Mu50
ugacugagaaaaauauuucua

SEQ ID NO: 2048695 - RNA, 16 nt, Staphylococcus aureus subsp. aureus Mu50
ugacugaauuaauauc

SEQ ID NO: 2048696 - RNA, 17 nt, Staphylococcus aureus subsp. aureus Mu50
ugacugagaaaaauauu

SEQ ID NO: 2048697 - RNA, 19 nt, Staphylococcus aureus subsp. aureus Mu50
ugacgugcuuuuaaaugua

SEQ ID NO: 2048698 - RNA, 14 nt, Staphylococcus aureus subsp. aureus Mu50
ugacguugugucau

SEQ ID NO: 2048699 - RNA, 18 nt, Staphylococcus aureus subsp. aureus Mu50
ugacguugugucaugcug

SEQ ID NO: 2048700 - RNA, 19 nt, Staphylococcus aureus subsp. aureus Mu50
ugacguucugaucggcuuu

SEQ ID NO: 2048701 - RNA, 18 nt, Staphylococcus aureus subsp. aureus Mu50
ugacguuuugguuguucu

SEQ ID NO: 2048702 - RNA, 15 nt, Staphylococcus aureus subsp. aureus Mu50
ugacguaauuaauag

SEQ ID NO: 2048703 - RNA, 16 nt, Staphylococcus aureus subsp. aureus Mu50
ugcaaauuaucauuaa

SEQ ID NO: 2048704 - RNA, 17 nt, Staphylococcus aureus subsp. aureus Mu50
ugcaacaauauaauaua

SEQ ID NO: 2048705 - RNA, 21 nt, Staphylococcus aureus subsp. aureus Mu50
ugcaacgcaucacaaaauugu

SEQ ID NO: 2048706 - RNA, 20 nt, Staphylococcus aureus subsp. aureus Mu50
ugcaacgaugcuacuuaaag

SEQ ID NO: 2048707 - RNA, 22 nt, Staphylococcus aureus subsp. aureus Mu50
ugcaacauuugauaaccaaugc

SEQ ID NO: 2048708 - RNA, 13 nt, Staphylococcus aureus subsp. aureus Mu50
ugcaauauuauau

SEQ ID NO: 2048709 - RNA, 19 nt, Staphylococcus aureus subsp. aureus Mu50
ugcaauuaauguaaugaua

SEQ ID NO: 2048710 - RNA, 16 nt, Staphylococcus aureus subsp. aureus Mu50
ugcaauagcuauaacu

SEQ ID NO: 2048711 - RNA, 19 nt, Staphylococcus aureus subsp. aureus Mu50
ugcaacuuauaauauuaaa

SEQ ID NO: 2048712 - RNA, 15 nt, Staphylococcus aureus subsp. aureus Mu50
ugcaacuuauaauau

SEQ ID NO: 2048713 - RNA, 20 nt, Staphylococcus aureus subsp. aureus Mu50
ugcacuaauggcacuuaaua

SEQ ID NO: 2048714 - RNA, 23 nt, Staphylococcus aureus subsp. aureus Mu50
ugcacuaauggcacuuaauauaa

SEQ ID NO: 2048715 - RNA, 16 nt, Staphylococcus aureus subsp. aureus Mu50
ugcaccuauaauagcg

SEQ ID NO: 2048716 - RNA, 18 nt, Staphylococcus aureus subsp. aureus Mu50
ugcaccuaaggcuaauga

SEQ ID NO: 2048717 - RNA, 14 nt, Staphylococcus aureus subsp. aureus Mu50
ugcaccuauaccuc

SEQ ID NO: 2048718 - RNA, 22 nt, Staphylococcus aureus subsp. aureus Mu50
ugauuaaaguguuucaacauau

SEQ ID NO: 2048719 - RNA, 20 nt, Staphylococcus aureus subsp. aureus Mu50
ugauuaaaucuucaagugcc

SEQ ID NO: 2048720 - RNA, 14 nt, Staphylococcus aureus subsp. aureus Mu50
ugauuaacaaggaa

SEQ ID NO: 2048721 - RNA, 12 nt, Staphylococcus aureus subsp. aureus Mu50
ugauuaaaagug

SEQ ID NO: 2048722 - RNA, 23 nt, Staphylococcus aureus subsp. aureus Mu50
ugauuaguuucugacuuuuaaaa

SEQ ID NO: 2048723 - RNA, 16 nt, Staphylococcus aureus subsp. aureus Mu50
ugauuaauuaaagauu

SEQ ID NO: 2048724 - RNA, 18 nt, Staphylococcus aureus subsp. aureus Mu50
ugauuaauuaaagauuaa

SEQ ID NO: 2048725 - RNA, 21 nt, Staphylococcus aureus subsp. aureus Mu50
ugauuacaacuuauucuucac

SEQ ID NO: 2048726 - RNA, 13 nt, Staphylococcus aureus subsp. aureus Mu50
ugauuacaacuua

SEQ ID NO: 2048727 - RNA, 14 nt, Staphylococcus aureus subsp. aureus Mu50
ugauuacauauacg

SEQ ID NO: 2048728 - RNA, 11 nt, Staphylococcus aureus subsp. aureus Mu50
ugauucuucac

SEQ ID NO: 2048729 - RNA, 19 nt, Staphylococcus aureus subsp. aureus Mu50
ugauucauucguacuucca

SEQ ID NO: 2048730 - RNA, 17 nt, Staphylococcus aureus subsp. aureus Mu50
ugauuauauuuuucuuc

SEQ ID NO: 2048731 - RNA, 16 nt, Staphylococcus aureus subsp. aureus Mu50
ugauuauauuuuucuu

SEQ ID NO: 2048732 - RNA, 12 nt, Staphylococcus aureus subsp. aureus Mu50
ugauugaacaau

SEQ ID NO: 2048733 - RNA, 20 nt, Staphylococcus aureus subsp. aureus Mu50
ugauugauaugguuagagaa

SEQ ID NO: 2048734 - RNA, 14 nt, Staphylococcus aureus subsp. aureus Mu50
ugauugauaugguu

SEQ ID NO: 2048735 - RNA, 17 nt, Staphylococcus aureus subsp. aureus Mu50
ugauugauaugguuaga

SEQ ID NO: 2048736 - RNA, 17 nt, Staphylococcus aureus subsp. aureus Mu50
ugauugcaaauuaucau

SEQ ID NO: 2048737 - RNA, 18 nt, Staphylococcus aureus subsp. aureus Mu50
ugauugcaaauuaucauu

SEQ ID NO: 2048738 - RNA, 21 nt, Staphylococcus aureus subsp. aureus Mu50
ugauuggcagugaucuuuuuu

SEQ ID NO: 2048739 - RNA, 17 nt, Staphylococcus aureus subsp. aureus Mu50
ugauuuaccuuugucuu

SEQ ID NO: 2048740 - RNA, 14 nt, Staphylococcus aureus subsp. aureus Mu50
ugauugucauauaa

SEQ ID NO: 2048741 - RNA, 17 nt, Staphylococcus aureus subsp. aureus Mu50
ugauuuaauuuuuaaug

SEQ ID NO: 2048742 - RNA, 13 nt, Staphylococcus aureus subsp. aureus Mu50
ugauuuauaaaaa

SEQ ID NO: 2048743 - RNA, 22 nt, Staphylococcus aureus subsp. aureus Mu50
ugauuuauaaaaacuuauuugc

SEQ ID NO: 2048744 - RNA, 12 nt, Staphylococcus aureus subsp. aureus Mu50
ugauuucacuac

SEQ ID NO: 2048745 - RNA, 18 nt, Staphylococcus aureus subsp. aureus Mu50
ugauuuugcugccaaaaa

SEQ ID NO: 2048746 - RNA, 17 nt, Staphylococcus aureus subsp. aureus Mu50
ugauuuugaauaaaaaa

SEQ ID NO: 2048747 - RNA, 12 nt, Staphylococcus aureus subsp. aureus Mu50
ugauuuugcuuu

SEQ ID NO: 2048748 - RNA, 17 nt, Staphylococcus aureus subsp. aureus Mu50
ugauuuuggaacauauu

SEQ ID NO: 2048749 - RNA, 15 nt, Staphylococcus aureus subsp. aureus Mu50
ugauuuuuaaaaaua

SEQ ID NO: 2048750 - RNA, 17 nt, Staphylococcus aureus subsp. aureus Mu50
ugcaaauaaaaaaguua

SEQ ID NO: 2048751 - RNA, 20 nt, Staphylococcus aureus subsp. aureus Mu50
ugcaaauacgaguguuuuaa

SEQ ID NO: 2048752 - RNA, 16 nt, Staphylococcus aureus subsp. aureus Mu50
ugcaaaucaaauacau

SEQ ID NO: 2048753 - RNA, 15 nt, Staphylococcus aureus subsp. aureus Mu50
ugcaaaauguuacac

SEQ ID NO: 2048754 - RNA, 13 nt, Staphylococcus aureus subsp. aureus Mu50
ugcaaaauuaaug

SEQ ID NO: 2048755 - RNA, 15 nt, Staphylococcus aureus subsp. aureus Mu50
ugcaaacacaguaca

SEQ ID NO: 2048756 - RNA, 18 nt, Staphylococcus aureus subsp. aureus Mu50
ugcaaaacgcauuucaug

SEQ ID NO: 2048757 - RNA, 22 nt, Staphylococcus aureus subsp. aureus Mu50
ugauuuuuauuauugucaucau

SEQ ID NO: 2048758 - RNA, 14 nt, Staphylococcus aureus subsp. aureus Mu50
ugauuuuuaauaau

SEQ ID NO: 2048759 - RNA, 16 nt, Staphylococcus aureus subsp. aureus Mu50
ugauuuuuaauaauuu

SEQ ID NO: 2048760 - RNA, 12 nt, Staphylococcus aureus subsp. aureus Mu50
ugcaaaaauaau

SEQ ID NO: 2048761 - RNA, 16 nt, Staphylococcus aureus subsp. aureus Mu50
ugaucauuauaaaaug

SEQ ID NO: 2048762 - RNA, 19 nt, Staphylococcus aureus subsp. aureus Mu50
ugaugauacccgcgauacu

SEQ ID NO: 2048763 - RNA, 14 nt, Staphylococcus aureus subsp. aureus Mu50
ugaugaaagacuga

SEQ ID NO: 2048764 - RNA, 22 nt, Staphylococcus aureus subsp. aureus Mu50
ugaugagaugaggcgauaaaag

SEQ ID NO: 2048765 - RNA, 17 nt, Staphylococcus aureus subsp. aureus Mu50
ugaugaacuuaaugcuu

SEQ ID NO: 2048766 - RNA, 15 nt, Staphylococcus aureus subsp. aureus Mu50
ugauagaugauacau

SEQ ID NO: 2048767 - RNA, 14 nt, Staphylococcus aureus subsp. aureus Mu50
ugauacucaauaaa

SEQ ID NO: 2048768 - RNA, 22 nt, Staphylococcus aureus subsp. aureus Mu50
ugauagugguagccaauaucau

SEQ ID NO: 2048769 - RNA, 20 nt, Staphylococcus aureus subsp. aureus Mu50
ugauaguguaugaauggcaa

SEQ ID NO: 2048770 - RNA, 20 nt, Staphylococcus aureus subsp. aureus Mu50
ugauaguuguaucauuaauu

SEQ ID NO: 2048771 - RNA, 17 nt, Staphylococcus aureus subsp. aureus Mu50
ugauaguuucuaaucuu

SEQ ID NO: 2048772 - RNA, 12 nt, Staphylococcus aureus subsp. aureus Mu50
ugauauaaaaag

SEQ ID NO: 2048773 - RNA, 17 nt, Staphylococcus aureus subsp. aureus Mu50
ugauauaaaaagugaaa

SEQ ID NO: 2048774 - RNA, 23 nt, Staphylococcus aureus subsp. aureus Mu50
ugauauaaaaagugaaaguauua

SEQ ID NO: 2048775 - RNA, 19 nt, Staphylococcus aureus subsp. aureus Mu50
ugauauaaaaagugaaagu

SEQ ID NO: 2048776 - RNA, 14 nt, Staphylococcus aureus subsp. aureus Mu50
ugauagugaauaau

SEQ ID NO: 2048777 - RNA, 15 nt, Staphylococcus aureus subsp. aureus Mu50
ugauagcuaaugcau

SEQ ID NO: 2048778 - RNA, 16 nt, Staphylococcus aureus subsp. aureus Mu50
ugauagcuaaugcauu

SEQ ID NO: 2048779 - RNA, 18 nt, Staphylococcus aureus subsp. aureus Mu50
ugauagcuaaugcauuau

SEQ ID NO: 2048780 - RNA, 16 nt, Staphylococcus aureus subsp. aureus Mu50
ugauauguuuccucuu

SEQ ID NO: 2048781 - RNA, 18 nt, Staphylococcus aureus subsp. aureus Mu50
ugauauguuuccucuuua

SEQ ID NO: 2048782 - RNA, 15 nt, Staphylococcus aureus subsp. aureus Mu50
ugaucaaaaagacag

SEQ ID NO: 2048783 - RNA, 14 nt, Staphylococcus aureus subsp. aureus Mu50
ugaucaaaaauguu

SEQ ID NO: 2048784 - RNA, 19 nt, Staphylococcus aureus subsp. aureus Mu50
ugauauaaccgcauacaga

SEQ ID NO: 2048785 - RNA, 18 nt, Staphylococcus aureus subsp. aureus Mu50
ugauaucugacauuucau

SEQ ID NO: 2048786 - RNA, 14 nt, Staphylococcus aureus subsp. aureus Mu50
ugauaucuugcuug

SEQ ID NO: 2048787 - RNA, 22 nt, Staphylococcus aureus subsp. aureus Mu50
ugaucaaaaauguuaucuagua

SEQ ID NO: 2048788 - RNA, 13 nt, Staphylococcus aureus subsp. aureus Mu50
ugauaaaauaaau

SEQ ID NO: 2048789 - RNA, 24 nt, Staphylococcus aureus subsp. aureus Mu50
ugauaaaagcccaccuaaaaagua

SEQ ID NO: 2048790 - RNA, 14 nt, Staphylococcus aureus subsp. aureus Mu50
ugaguuuuuuaaaa

SEQ ID NO: 2048791 - RNA, 15 nt, Staphylococcus aureus subsp. aureus Mu50
ugauaaagagccacu

SEQ ID NO: 2048792 - RNA, 15 nt, Staphylococcus aureus subsp. aureus Mu50
ugauaaauaaugcau

SEQ ID NO: 2048793 - RNA, 21 nt, Staphylococcus aureus subsp. aureus Mu50
ugauaaaugaauugucuuaau

SEQ ID NO: 2048794 - RNA, 15 nt, Staphylococcus aureus subsp. aureus Mu50
ugaguugaaaauaau

SEQ ID NO: 2048795 - RNA, 21 nt, Staphylococcus aureus subsp. aureus Mu50
ugagucuuagacauuguaaaa

SEQ ID NO: 2048796 - RNA, 22 nt, Staphylococcus aureus subsp. aureus Mu50
ugagucuuagacauuguaaaau

SEQ ID NO: 2048797 - RNA, 23 nt, Staphylococcus aureus subsp. aureus Mu50
ugagucuuagacauuguaaaaug

SEQ ID NO: 2048798 - RNA, 16 nt, Staphylococcus aureus subsp. aureus Mu50
ugagucaauuucuuua

SEQ ID NO: 2048799 - RNA, 21 nt, Staphylococcus aureus subsp. aureus Mu50
ugagcaucuugucuaguucga

SEQ ID NO: 2048800 - RNA, 18 nt, Staphylococcus aureus subsp. aureus Mu50
ugauacgugguuuuauuu

SEQ ID NO: 2048801 - RNA, 17 nt, Staphylococcus aureus subsp. aureus Mu50
ugauacgcacguauaua

SEQ ID NO: 2048802 - RNA, 17 nt, Staphylococcus aureus subsp. aureus Mu50
ugauaccuuuaaaucua

SEQ ID NO: 2048803 - RNA, 15 nt, Staphylococcus aureus subsp. aureus Mu50
ugauacgcuuuuuaa

SEQ ID NO: 2048804 - RNA, 22 nt, Staphylococcus aureus subsp. aureus Mu50
ugauacgccuaaauauuuaccu

SEQ ID NO: 2048805 - RNA, 18 nt, Staphylococcus aureus subsp. aureus Mu50
ugauacauuauuaaauag

SEQ ID NO: 2048806 - RNA, 16 nt, Staphylococcus aureus subsp. aureus Mu50
ugauaauuaauuaaaa

SEQ ID NO: 2048807 - RNA, 16 nt, Staphylococcus aureus subsp. aureus Mu50
ugauaauuaauuaugc

SEQ ID NO: 2048808 - RNA, 13 nt, Staphylococcus aureus subsp. aureus Mu50
ugauaauuuaaua

SEQ ID NO: 2048809 - RNA, 15 nt, Staphylococcus aureus subsp. aureus Mu50
ugauaauuuaauaau

SEQ ID NO: 2048810 - RNA, 19 nt, Staphylococcus aureus subsp. aureus Mu50
ugauaauuaaugccauugu

SEQ ID NO: 2048811 - RNA, 19 nt, Staphylococcus aureus subsp. aureus Mu50
ugauaaugucuuacuuguc

SEQ ID NO: 2048812 - RNA, 14 nt, Staphylococcus aureus subsp. aureus Mu50
ugauaauuuuucuu

SEQ ID NO: 2048813 - RNA, 19 nt, Staphylococcus aureus subsp. aureus Mu50
ugauacagaaccaacaaua

SEQ ID NO: 2048814 - RNA, 20 nt, Staphylococcus aureus subsp. aureus Mu50
ugauacagaaccaacaauaa

SEQ ID NO: 2048815 - RNA, 15 nt, Staphylococcus aureus subsp. aureus Mu50
ugauaauccaccaaa

SEQ ID NO: 2048816 - RNA, 21 nt, Staphylococcus aureus subsp. aureus Mu50
ugauaauccaccaaauacagu

SEQ ID NO: 2048817 - RNA, 16 nt, Staphylococcus aureus subsp. aureus Mu50
ugauaaugacucaagu

SEQ ID NO: 2048818 - RNA, 18 nt, Staphylococcus aureus subsp. aureus Mu50
ugauaauagcuugagcau

SEQ ID NO: 2048819 - RNA, 18 nt, Staphylococcus aureus subsp. aureus Mu50
ugauaagucuugauggug

SEQ ID NO: 2048820 - RNA, 16 nt, Staphylococcus aureus subsp. aureus Mu50
ugauaaguagaaaaua

SEQ ID NO: 2048821 - RNA, 19 nt, Staphylococcus aureus subsp. aureus Mu50
ugauaacaauuuuaaaucu

SEQ ID NO: 2048822 - RNA, 22 nt, Staphylococcus aureus subsp. aureus Mu50
ugauaaccauuaugauuaaucc

SEQ ID NO: 2048823 - RNA, 23 nt, Staphylococcus aureus subsp. aureus Mu50
ugauaaccaaaccauaaguaaaa

SEQ ID NO: 2048824 - RNA, 20 nt, Staphylococcus aureus subsp. aureus Mu50
ugauaacaauuuuaaaucuu

SEQ ID NO: 2048825 - RNA, 14 nt, Staphylococcus aureus subsp. aureus Mu50
ugauaacgagcuaa

SEQ ID NO: 2048826 - RNA, 17 nt, Staphylococcus aureus subsp. aureus Mu50
ucgccaagccaucuuuc

SEQ ID NO: 2048827 - RNA, 16 nt, Staphylococcus aureus subsp. aureus Mu50
ucgcauacuuuuucag

SEQ ID NO: 2048828 - RNA, 14 nt, Staphylococcus aureus subsp. aureus Mu50
ucgcauauuuugau

SEQ ID NO: 2048829 - RNA, 18 nt, Staphylococcus aureus subsp. aureus Mu50
ucgcaucacugcauauaa

SEQ ID NO: 2048830 - RNA, 20 nt, Staphylococcus aureus subsp. aureus Mu50
ucgccuaaaaauaaaaucaa

SEQ ID NO: 2048831 - RNA, 17 nt, Staphylococcus aureus subsp. aureus Mu50
ucgauuuuggcacauaa

SEQ ID NO: 2048832 - RNA, 15 nt, Staphylococcus aureus subsp. aureus Mu50
ucgauuuaucauuau

SEQ ID NO: 2048833 - RNA, 17 nt, Staphylococcus aureus subsp. aureus Mu50
ucgaugacuuugucuuu

SEQ ID NO: 2048834 - RNA, 16 nt, Staphylococcus aureus subsp. aureus Mu50
ucgaugacuuuuuaau

SEQ ID NO: 2048835 - RNA, 16 nt, Staphylococcus aureus subsp. aureus Mu50
ucgauugcguuuucua

SEQ ID NO: 2048836 - RNA, 22 nt, Staphylococcus aureus subsp. aureus Mu50
ucgauuuagaagaacaauaauu

SEQ ID NO: 2048837 - RNA, 21 nt, Staphylococcus aureus subsp. aureus Mu50
ucgaucgguauuuucauuuua

SEQ ID NO: 2048838 - RNA, 21 nt, Staphylococcus aureus subsp. aureus Mu50
ucgcaccgucaaacuuaaaac

SEQ ID NO: 2048839 - RNA, 23 nt, Staphylococcus aureus subsp. aureus Mu50
ucgcaccgucaaacuuaaaacua

SEQ ID NO: 2048840 - RNA, 19 nt, Staphylococcus aureus subsp. aureus Mu50
ucgauaguucuauauaauu

SEQ ID NO: 2048841 - RNA, 23 nt, Staphylococcus aureus subsp. aureus Mu50
ucgauaacguugccauacccaua

SEQ ID NO: 2048842 - RNA, 16 nt, Staphylococcus aureus subsp. aureus Mu50
ucgaucgguauuuuca

SEQ ID NO: 2048843 - RNA, 17 nt, Staphylococcus aureus subsp. aureus Mu50
ucgaucgguauuuucau

SEQ ID NO: 2048844 - RNA, 14 nt, Staphylococcus aureus subsp. aureus Mu50
ucgaguuuguuucu

SEQ ID NO: 2048845 - RNA, 12 nt, Staphylococcus aureus subsp. aureus Mu50
ucgauaaaaugu

SEQ ID NO: 2048846 - RNA, 15 nt, Staphylococcus aureus subsp. aureus Mu50
ucgagguaauuucac

SEQ ID NO: 2048847 - RNA, 17 nt, Staphylococcus aureus subsp. aureus Mu50
uccuuuagcaaaaauau

SEQ ID NO: 2048848 - RNA, 18 nt, Staphylococcus aureus subsp. aureus Mu50
uccuugguuauuaaaauu

SEQ ID NO: 2048849 - RNA, 19 nt, Staphylococcus aureus subsp. aureus Mu50
uccuugguuauuaaaauua

SEQ ID NO: 2048850 - RNA, 13 nt, Staphylococcus aureus subsp. aureus Mu50
ucgaaaagaaauu

SEQ ID NO: 2048851 - RNA, 19 nt, Staphylococcus aureus subsp. aureus Mu50
ucgaaaagaaauucuacag

SEQ ID NO: 2048852 - RNA, 13 nt, Staphylococcus aureus subsp. aureus Mu50
uccuuuuugacuc

SEQ ID NO: 2048853 - RNA, 14 nt, Staphylococcus aureus subsp. aureus Mu50
uccuuuuacuuaau

SEQ ID NO: 2048854 - RNA, 21 nt, Staphylococcus aureus subsp. aureus Mu50
ucgaaaauagcuauuaaaaua

SEQ ID NO: 2048855 - RNA, 23 nt, Staphylococcus aureus subsp. aureus Mu50
ucgaaaauagcuauuaaaauaga

SEQ ID NO: 2048856 - RNA, 18 nt, Staphylococcus aureus subsp. aureus Mu50
ucgaaauauuuauucgcu

SEQ ID NO: 2048857 - RNA, 17 nt, Staphylococcus aureus subsp. aureus Mu50
ucgaaagguauaucuuc

SEQ ID NO: 2048858 - RNA, 15 nt, Staphylococcus aureus subsp. aureus Mu50
ucgaaagccaauuaa

SEQ ID NO: 2048859 - RNA, 20 nt, Staphylococcus aureus subsp. aureus Mu50
ucgaauaacuguuuaucaug

SEQ ID NO: 2048860 - RNA, 16 nt, Staphylococcus aureus subsp. aureus Mu50
ucgaaccaaauuuuau

SEQ ID NO: 2048861 - RNA, 22 nt, Staphylococcus aureus subsp. aureus Mu50
ucgaaauucucuuuguuggggc

SEQ ID NO: 2048862 - RNA, 16 nt, Staphylococcus aureus subsp. aureus Mu50
ucgaaauuguucuaau

SEQ ID NO: 2048863 - RNA, 15 nt, Staphylococcus aureus subsp. aureus Mu50
ucgaacagaaaaucg

SEQ ID NO: 2048864 - RNA, 20 nt, Staphylococcus aureus subsp. aureus Mu50
ucgaaguagcuuguuuagaa

SEQ ID NO: 2048865 - RNA, 15 nt, Staphylococcus aureus subsp. aureus Mu50
ucgaacuaucaauau

SEQ ID NO: 2048866 - RNA, 22 nt, Staphylococcus aureus subsp. aureus Mu50
ucgaacuuuuguucuaaguguu

SEQ ID NO: 2048867 - RNA, 24 nt, Staphylococcus aureus subsp. aureus Mu50
ucagcgauaggcgcgaaaugaccu

SEQ ID NO: 2048868 - RNA, 22 nt, Staphylococcus aureus subsp. aureus Mu50
uccuugcucaugagcacaaacu

SEQ ID NO: 2048869 - RNA, 20 nt, Staphylococcus aureus subsp. aureus Mu50
uccuuggaaacgauauagac

SEQ ID NO: 2048870 - RNA, 15 nt, Staphylococcus aureus subsp. aureus Mu50
uccuugauucuuaua

SEQ ID NO: 2048871 - RNA, 13 nt, Staphylococcus aureus subsp. aureus Mu50
uccuuauuuuucg

SEQ ID NO: 2048872 - RNA, 16 nt, Staphylococcus aureus subsp. aureus Mu50
uccuuaauugcucuuc

SEQ ID NO: 2048873 - RNA, 22 nt, Staphylococcus aureus subsp. aureus Mu50
uccuucgauaguuuauuaauau

SEQ ID NO: 2048874 - RNA, 20 nt, Staphylococcus aureus subsp. aureus Mu50
uccuucaauguucaauucac

SEQ ID NO: 2048875 - RNA, 17 nt, Staphylococcus aureus subsp. aureus Mu50
ucguugucacuauugca

SEQ ID NO: 2048876 - RNA, 22 nt, Staphylococcus aureus subsp. aureus Mu50
ucguuguaaaacuaaguuauuu

SEQ ID NO: 2048877 - RNA, 17 nt, Staphylococcus aureus subsp. aureus Mu50
ucguuguugaaauuaaa

SEQ ID NO: 2048878 - RNA, 15 nt, Staphylococcus aureus subsp. aureus Mu50
ucguuguugaaauua

SEQ ID NO: 2048879 - RNA, 16 nt, Staphylococcus aureus subsp. aureus Mu50
ucguucaauuguugau

SEQ ID NO: 2048880 - RNA, 17 nt, Staphylococcus aureus subsp. aureus Mu50
ucguucauauauuuugu

SEQ ID NO: 2048881 - RNA, 21 nt, Staphylococcus aureus subsp. aureus Mu50
ucguucauauauuuuguuaau

SEQ ID NO: 2048882 - RNA, 16 nt, Staphylococcus aureus subsp. aureus Mu50
ucguucccauucuuug

SEQ ID NO: 2048883 - RNA, 16 nt, Staphylococcus aureus subsp. aureus Mu50
ucguuaaggaaagcuu

SEQ ID NO: 2048884 - RNA, 16 nt, Staphylococcus aureus subsp. aureus Mu50
ucguuaauguauaaaa

SEQ ID NO: 2048885 - RNA, 17 nt, Staphylococcus aureus subsp. aureus Mu50
ucguuaauguauaaaaa

SEQ ID NO: 2048886 - RNA, 19 nt, Staphylococcus aureus subsp. aureus Mu50
ucguuaauguauaaaaagu

SEQ ID NO: 2048887 - RNA, 20 nt, Staphylococcus aureus subsp. aureus Mu50
ucguuaauguauaaaaagug

SEQ ID NO: 2048888 - RNA, 14 nt, Staphylococcus aureus subsp. aureus Mu50
ucguuaauuuccaa

SEQ ID NO: 2048889 - RNA, 15 nt, Staphylococcus aureus subsp. aureus Mu50
ucguucaagaacaau

SEQ ID NO: 2048890 - RNA, 18 nt, Staphylococcus aureus subsp. aureus Mu50
ucguuacuaccuauuaau

SEQ ID NO: 2048891 - RNA, 23 nt, Staphylococcus aureus subsp. aureus Mu50
ucguuaccuuuuaaggcagcuaa

SEQ ID NO: 2048892 - RNA, 17 nt, Staphylococcus aureus subsp. aureus Mu50
ucguuagaugaaugccu

SEQ ID NO: 2048893 - RNA, 14 nt, Staphylococcus aureus subsp. aureus Mu50
ucuacaguuuuaug

SEQ ID NO: 2048894 - RNA, 22 nt, Staphylococcus aureus subsp. aureus Mu50
ucuacagguaaugcaaguuggc

SEQ ID NO: 2048895 - RNA, 18 nt, Staphylococcus aureus subsp. aureus Mu50
ucuacaaacaaugcaagu

SEQ ID NO: 2048896 - RNA, 21 nt, Staphylococcus aureus subsp. aureus Mu50
ucuaauuucuuagauuuuaua

SEQ ID NO: 2048897 - RNA, 14 nt, Staphylococcus aureus subsp. aureus Mu50
ucuaaguaauauaa

SEQ ID NO: 2048898 - RNA, 15 nt, Staphylococcus aureus subsp. aureus Mu50
ucuaauacauacuga

SEQ ID NO: 2048899 - RNA, 16 nt, Staphylococcus aureus subsp. aureus Mu50
ucuaauacauacugau

SEQ ID NO: 2048900 - RNA, 15 nt, Staphylococcus aureus subsp. aureus Mu50
ucuaauuguuguaau

SEQ ID NO: 2048901 - RNA, 21 nt, Staphylococcus aureus subsp. aureus Mu50
ucuaauuguuguaauucuuuu

SEQ ID NO: 2048902 - RNA, 22 nt, Staphylococcus aureus subsp. aureus Mu50
ucuaaguguugaccauuaucaa

SEQ ID NO: 2048903 - RNA, 11 nt, Staphylococcus aureus subsp. aureus Mu50
ucuaaaucuug

SEQ ID NO: 2048904 - RNA, 14 nt, Staphylococcus aureus subsp. aureus Mu50
ucuaaauauuaaau

SEQ ID NO: 2048905 - RNA, 15 nt, Staphylococcus aureus subsp. aureus Mu50
ucuaacgguaaauaa

SEQ ID NO: 2048906 - RNA, 14 nt, Staphylococcus aureus subsp. aureus Mu50
ucuaacugaauuaa

SEQ ID NO: 2048907 - RNA, 17 nt, Staphylococcus aureus subsp. aureus Mu50
ucuaacuuuaccaauau

SEQ ID NO: 2048908 - RNA, 19 nt, Staphylococcus aureus subsp. aureus Mu50
ucuaaauauaauagaaaua

SEQ ID NO: 2048909 - RNA, 19 nt, Staphylococcus aureus subsp. aureus Mu50
ucuaaauaaaauuaaaaca

SEQ ID NO: 2048910 - RNA, 14 nt, Staphylococcus aureus subsp. aureus Mu50
ucuaaauaaaauua

SEQ ID NO: 2048911 - RNA, 18 nt, Staphylococcus aureus subsp. aureus Mu50
ucuaaaaacauaaaaauc

SEQ ID NO: 2048912 - RNA, 13 nt, Staphylococcus aureus subsp. aureus Mu50
ucguuuuuccaug

SEQ ID NO: 2048913 - RNA, 13 nt, Staphylococcus aureus subsp. aureus Mu50
ucuaaaaacauaa

SEQ ID NO: 2048914 - RNA, 13 nt, Staphylococcus aureus subsp. aureus Mu50
ucuaaaaaauuaa

SEQ ID NO: 2048915 - RNA, 18 nt, Staphylococcus aureus subsp. aureus Mu50
ucuaaaaaauuaaaaauu

SEQ ID NO: 2048916 - RNA, 15 nt, Staphylococcus aureus subsp. aureus Mu50
ucgucgcugauacau

SEQ ID NO: 2048917 - RNA, 15 nt, Staphylococcus aureus subsp. aureus Mu50
ucguauucuucaaua

SEQ ID NO: 2048918 - RNA, 22 nt, Staphylococcus aureus subsp. aureus Mu50
ucguaaugaugacaucaauauc

SEQ ID NO: 2048919 - RNA, 19 nt, Staphylococcus aureus subsp. aureus Mu50
ucguacaccauaaauguaa

SEQ ID NO: 2048920 - RNA, 18 nt, Staphylococcus aureus subsp. aureus Mu50
ucguauaauuuuaauauu

SEQ ID NO: 2048921 - RNA, 22 nt, Staphylococcus aureus subsp. aureus Mu50
ucgguacauuuaauggucuaau

SEQ ID NO: 2048922 - RNA, 18 nt, Staphylococcus aureus subsp. aureus Mu50
ucgguauuuuaaauuuau

SEQ ID NO: 2048923 - RNA, 16 nt, Staphylococcus aureus subsp. aureus Mu50
ucgguauuuaauguuu

SEQ ID NO: 2048924 - RNA, 19 nt, Staphylococcus aureus subsp. aureus Mu50
ucgguauucaauucuguga

SEQ ID NO: 2048925 - RNA, 15 nt, Staphylococcus aureus subsp. aureus Mu50
ucgguuuuauuuuua

SEQ ID NO: 2048926 - RNA, 18 nt, Staphylococcus aureus subsp. aureus Mu50
ucguaaacacuauaaaag

SEQ ID NO: 2048927 - RNA, 17 nt, Staphylococcus aureus subsp. aureus Mu50
ucguaacucuuuaauuu

SEQ ID NO: 2048928 - RNA, 22 nt, Staphylococcus aureus subsp. aureus Mu50
ucguaagcuucuguguuggggc

SEQ ID NO: 2048929 - RNA, 15 nt, Staphylococcus aureus subsp. aureus Mu50
ucguaacauuuaaaa

SEQ ID NO: 2048930 - RNA, 18 nt, Staphylococcus aureus subsp. aureus Mu50
ucggggccccaacacaga

SEQ ID NO: 2048931 - RNA, 16 nt, Staphylococcus aureus subsp. aureus Mu50
ucggcuuuguaaaauu

SEQ ID NO: 2048932 - RNA, 13 nt, Staphylococcus aureus subsp. aureus Mu50
ucggcuuucuaag

SEQ ID NO: 2048933 - RNA, 20 nt, Staphylococcus aureus subsp. aureus Mu50
ucggcuuuggauuucuuuuu

SEQ ID NO: 2048934 - RNA, 14 nt, Staphylococcus aureus subsp. aureus Mu50
ucggcuuuguaaaa

SEQ ID NO: 2048935 - RNA, 13 nt, Staphylococcus aureus subsp. aureus Mu50
ucggcucucgcuu

SEQ ID NO: 2048936 - RNA, 23 nt, Staphylococcus aureus subsp. aureus Mu50
ucgcuuuuuuuauuuuucuuuuu

SEQ ID NO: 2048937 - RNA, 18 nt, Staphylococcus aureus subsp. aureus Mu50
ucgcuuuuuuuauuuuuc

SEQ ID NO: 2048938 - RNA, 17 nt, Staphylococcus aureus subsp. aureus Mu50
ucgcuuguaacaagcuu

SEQ ID NO: 2048939 - RNA, 23 nt, Staphylococcus aureus subsp. aureus Mu50
ucgcuugcuucuuuccucuccuu

SEQ ID NO: 2048940 - RNA, 15 nt, Staphylococcus aureus subsp. aureus Mu50
ucgcugcuacaccac

SEQ ID NO: 2048941 - RNA, 17 nt, Staphylococcus aureus subsp. aureus Mu50
ucgcugcuacaccaccu

SEQ ID NO: 2048942 - RNA, 16 nt, Staphylococcus aureus subsp. aureus Mu50
ucggauuaaaaguauc

SEQ ID NO: 2048943 - RNA, 22 nt, Staphylococcus aureus subsp. aureus Mu50
ucggauugaaccggaaauuaaa

SEQ ID NO: 2048944 - RNA, 21 nt, Staphylococcus aureus subsp. aureus Mu50
ucuuuugagacguuuuccaug

SEQ ID NO: 2048945 - RNA, 18 nt, Staphylococcus aureus subsp. aureus Mu50
ucuuuugaaucuuguuga

SEQ ID NO: 2048946 - RNA, 14 nt, Staphylococcus aureus subsp. aureus Mu50
ucuuuugauuuuuu

SEQ ID NO: 2048947 - RNA, 19 nt, Staphylococcus aureus subsp. aureus Mu50
ucuuuuucagcuaauuguc

SEQ ID NO: 2048948 - RNA, 13 nt, Staphylococcus aureus subsp. aureus Mu50
ucuuuuuauuuau

SEQ ID NO: 2048949 - RNA, 18 nt, Staphylococcus aureus subsp. aureus Mu50
ugaaaaaacgagcuggug

SEQ ID NO: 2048950 - RNA, 12 nt, Staphylococcus aureus subsp. aureus Mu50
ucuuuuuuuaau

SEQ ID NO: 2048951 - RNA, 20 nt, Staphylococcus aureus subsp. aureus Mu50
ucuuuuuguuguuuuaauuu

SEQ ID NO: 2048952 - RNA, 19 nt, Staphylococcus aureus subsp. aureus Mu50
ucuuuuugaucaacuauau

SEQ ID NO: 2048953 - RNA, 19 nt, Staphylococcus aureus subsp. aureus Mu50
ucuuuuugauuauauuuau

SEQ ID NO: 2048954 - RNA, 21 nt, Staphylococcus aureus subsp. aureus Mu50
ucuuuuugcguuuuuaaauaa

SEQ ID NO: 2048955 - RNA, 21 nt, Staphylococcus aureus subsp. aureus Mu50
ucuuuuugauaauguucccuu

SEQ ID NO: 2048956 - RNA, 17 nt, Staphylococcus aureus subsp. aureus Mu50
ucuuuuucuuucauaau

SEQ ID NO: 2048957 - RNA, 20 nt, Staphylococcus aureus subsp. aureus Mu50
ucuuuuucaugcuauuuaaa

SEQ ID NO: 2048958 - RNA, 23 nt, Staphylococcus aureus subsp. aureus Mu50
ucuuuuuuuaacuuccuaaaauu

SEQ ID NO: 2048959 - RNA, 15 nt, Staphylococcus aureus subsp. aureus Mu50
ucuuuuuuauuuaau

SEQ ID NO: 2048960 - RNA, 17 nt, Staphylococcus aureus subsp. aureus Mu50
ucuuuuuuauuuaauua

SEQ ID NO: 2048961 - RNA, 19 nt, Staphylococcus aureus subsp. aureus Mu50
ucuuuuuuauuuaauuauu

SEQ ID NO: 2048962 - RNA, 18 nt, Staphylococcus aureus subsp. aureus Mu50
ucuuuucacgaauaucuu

SEQ ID NO: 2048963 - RNA, 15 nt, Staphylococcus aureus subsp. aureus Mu50
ucuuuuauuuucaua

SEQ ID NO: 2048964 - RNA, 17 nt, Staphylococcus aureus subsp. aureus Mu50
ucuuuucaaaaauaguc

SEQ ID NO: 2048965 - RNA, 21 nt, Staphylococcus aureus subsp. aureus Mu50
ucuuuuauuaugauauacgag

SEQ ID NO: 2048966 - RNA, 13 nt, Staphylococcus aureus subsp. aureus Mu50
ucuuuuauauuuu

SEQ ID NO: 2048967 - RNA, 17 nt, Staphylococcus aureus subsp. aureus Mu50
ucuuuuauauuuuuauc

SEQ ID NO: 2048968 - RNA, 21 nt, Staphylococcus aureus subsp. aureus Mu50
ucuuuuauacauguacauuau

SEQ ID NO: 2048969 - RNA, 18 nt, Staphylococcus aureus subsp. aureus Mu50
ucuuuguguuugcuuuuu

SEQ ID NO: 2048970 - RNA, 18 nt, Staphylococcus aureus subsp. aureus Mu50
ucuuuguguuugcuuuua

SEQ ID NO: 2048971 - RNA, 15 nt, Staphylococcus aureus subsp. aureus Mu50
ucuuugucaucuuuu

SEQ ID NO: 2048972 - RNA, 14 nt, Staphylococcus aureus subsp. aureus Mu50
ucuuuguaaauuuu

SEQ ID NO: 2048973 - RNA, 19 nt, Staphylococcus aureus subsp. aureus Mu50
ucuuuguaaccuaaaaaca

SEQ ID NO: 2048974 - RNA, 20 nt, Staphylococcus aureus subsp. aureus Mu50
ucuuuuaaauucuuauaaaa

SEQ ID NO: 2048975 - RNA, 20 nt, Staphylococcus aureus subsp. aureus Mu50
ucuuuguuucgcaaguaguc

SEQ ID NO: 2048976 - RNA, 16 nt, Staphylococcus aureus subsp. aureus Mu50
ucuuuguuuuuaauuu

SEQ ID NO: 2048977 - RNA, 22 nt, Staphylococcus aureus subsp. aureus Mu50
ucuuuguuggggcccacacccc

SEQ ID NO: 2048978 - RNA, 17 nt, Staphylococcus aureus subsp. aureus Mu50
ucuuuggucuaaagcuu

SEQ ID NO: 2048979 - RNA, 15 nt, Staphylococcus aureus subsp. aureus Mu50
ucuuuggugaaagua

SEQ ID NO: 2048980 - RNA, 20 nt, Staphylococcus aureus subsp. aureus Mu50
ucuuucuuuucugaauguau

SEQ ID NO: 2048981 - RNA, 22 nt, Staphylococcus aureus subsp. aureus Mu50
ucuuucuuuguguuugcuuuuu

SEQ ID NO: 2048982 - RNA, 13 nt, Staphylococcus aureus subsp. aureus Mu50
ucuuucuuuucug

SEQ ID NO: 2048983 - RNA, 19 nt, Staphylococcus aureus subsp. aureus Mu50
ucuuucuuguucuaaaaua

SEQ ID NO: 2048984 - RNA, 22 nt, Staphylococcus aureus subsp. aureus Mu50
ucuuugacauguguuaaaccaa

SEQ ID NO: 2048985 - RNA, 20 nt, Staphylococcus aureus subsp. aureus Mu50
ucuuugauaacaauuuuaaa

SEQ ID NO: 2048986 - RNA, 14 nt, Staphylococcus aureus subsp. aureus Mu50
ucuuuauauuuauc

SEQ ID NO: 2048987 - RNA, 13 nt, Staphylococcus aureus subsp. aureus Mu50
ucuuuauauuuau

SEQ ID NO: 2048988 - RNA, 12 nt, Staphylococcus aureus subsp. aureus Mu50
ucuuuaagugac

SEQ ID NO: 2048989 - RNA, 19 nt, Staphylococcus aureus subsp. aureus Mu50
ucuuuaagugacacaccac

SEQ ID NO: 2048990 - RNA, 19 nt, Staphylococcus aureus subsp. aureus Mu50
ucuuucauaguuauuaaau

SEQ ID NO: 2048991 - RNA, 13 nt, Staphylococcus aureus subsp. aureus Mu50
ucuuuauuaauaa

SEQ ID NO: 2048992 - RNA, 15 nt, Staphylococcus aureus subsp. aureus Mu50
ucuuuauuaauaaau

SEQ ID NO: 2048993 - RNA, 14 nt, Staphylococcus aureus subsp. aureus Mu50
ucuuuauguuugau

SEQ ID NO: 2048994 - RNA, 17 nt, Staphylococcus aureus subsp. aureus Mu50
ucuuuaugauaauuaau

SEQ ID NO: 2048995 - RNA, 14 nt, Staphylococcus aureus subsp. aureus Mu50
ucuuuaugauaauu

SEQ ID NO: 2048996 - RNA, 19 nt, Staphylococcus aureus subsp. aureus Mu50
ucuuucagcuaauucgucu

SEQ ID NO: 2048997 - RNA, 19 nt, Staphylococcus aureus subsp. aureus Mu50
ucuuucgagguaauuucac

SEQ ID NO: 2048998 - RNA, 13 nt, Staphylococcus aureus subsp. aureus Mu50
ucuuucugaagaa

SEQ ID NO: 2048999 - RNA, 16 nt, Staphylococcus aureus subsp. aureus Mu50
ucuuucucuauuaauu

SEQ ID NO: 2049000 - RNA, 22 nt, Staphylococcus aureus subsp. aureus Mu50
ucuuucuuagugaaucuucuaa

SEQ ID NO: 2049001 - RNA, 16 nt, Staphylococcus aureus subsp. aureus Mu50
ucuuucuaaguuugaa

SEQ ID NO: 2049002 - RNA, 21 nt, Staphylococcus aureus subsp. aureus Mu50
ucuuucgucuuguaaacuucu

SEQ ID NO: 2049003 - RNA, 21 nt, Staphylococcus aureus subsp. aureus Mu50
ucuuguuuagggaaucccaua

SEQ ID NO: 2049004 - RNA, 17 nt, Staphylococcus aureus subsp. aureus Mu50
ucuuguuuucauuuaaa

SEQ ID NO: 2049005 - RNA, 16 nt, Staphylococcus aureus subsp. aureus Mu50
ugaaauauaccaacca

SEQ ID NO: 2049006 - RNA, 14 nt, Staphylococcus aureus subsp. aureus Mu50
ugaaauagaaacua

SEQ ID NO: 2049007 - RNA, 22 nt, Staphylococcus aureus subsp. aureus Mu50
ugaaauaggcgcuuguaaaauu

SEQ ID NO: 2049008 - RNA, 19 nt, Staphylococcus aureus subsp. aureus Mu50
ugaaauauuuaucuuuaga

SEQ ID NO: 2049009 - RNA, 14 nt, Staphylococcus aureus subsp. aureus Mu50
ugaaauaucaagau

SEQ ID NO: 2049010 - RNA, 14 nt, Staphylococcus aureus subsp. aureus Mu50
ugaaauauucuuua

SEQ ID NO: 2049011 - RNA, 16 nt, Staphylococcus aureus subsp. aureus Mu50
ugaaauauuuaucuuu

SEQ ID NO: 2049012 - RNA, 19 nt, Staphylococcus aureus subsp. aureus Mu50
ugaaauaauauaaaaacaa

SEQ ID NO: 2049013 - RNA, 17 nt, Staphylococcus aureus subsp. aureus Mu50
ugaaaucgauacuaaua

SEQ ID NO: 2049014 - RNA, 17 nt, Staphylococcus aureus subsp. aureus Mu50
ugaaaucauuuaaauua

SEQ ID NO: 2049015 - RNA, 21 nt, Staphylococcus aureus subsp. aureus Mu50
ugaaaucaguuuuugaauauu

SEQ ID NO: 2049016 - RNA, 14 nt, Staphylococcus aureus subsp. aureus Mu50
ugaaaucauuuaaa

SEQ ID NO: 2049017 - RNA, 20 nt, Staphylococcus aureus subsp. aureus Mu50
ugaaaugauacauuauuaaa

SEQ ID NO: 2049018 - RNA, 22 nt, Staphylococcus aureus subsp. aureus Mu50
ugaaaugaaguauggaaguugu

SEQ ID NO: 2049019 - RNA, 15 nt, Staphylococcus aureus subsp. aureus Mu50
ugaaauucuuuugua

SEQ ID NO: 2049020 - RNA, 22 nt, Staphylococcus aureus subsp. aureus Mu50
ugaaauucuuuuguaauugaaa

SEQ ID NO: 2049021 - RNA, 20 nt, Staphylococcus aureus subsp. aureus Mu50
ugaaauugacaguuuccaua

SEQ ID NO: 2049022 - RNA, 19 nt, Staphylococcus aureus subsp. aureus Mu50
ugaaauuagauuuuaugcu

SEQ ID NO: 2049023 - RNA, 20 nt, Staphylococcus aureus subsp. aureus Mu50
ugaaauuauuauuuaaauuu

SEQ ID NO: 2049024 - RNA, 21 nt, Staphylococcus aureus subsp. aureus Mu50
ugaaauuauuauuuaaauuuu

SEQ ID NO: 2049025 - RNA, 12 nt, Staphylococcus aureus subsp. aureus Mu50
ugaaauguuuaa

SEQ ID NO: 2049026 - RNA, 16 nt, Staphylococcus aureus subsp. aureus Mu50
ugaaauuaauuaucuu

SEQ ID NO: 2049027 - RNA, 15 nt, Staphylococcus aureus subsp. aureus Mu50
ugaaauggaaaguaa

SEQ ID NO: 2049028 - RNA, 22 nt, Staphylococcus aureus subsp. aureus Mu50
ugaacaaaaaauaaaaacuucu

SEQ ID NO: 2049029 - RNA, 20 nt, Staphylococcus aureus subsp. aureus Mu50
ugaaauuuuuuagugaaaaa

SEQ ID NO: 2049030 - RNA, 21 nt, Staphylococcus aureus subsp. aureus Mu50
ugaaauuuuuuagugaaaaag

SEQ ID NO: 2049031 - RNA, 15 nt, Staphylococcus aureus subsp. aureus Mu50
ugaaauuuuuaauau

SEQ ID NO: 2049032 - RNA, 20 nt, Staphylococcus aureus subsp. aureus Mu50
ugaaauuuuuaauauacccc

SEQ ID NO: 2049033 - RNA, 14 nt, Staphylococcus aureus subsp. aureus Mu50
ugaaauuuauuaua

SEQ ID NO: 2049034 - RNA, 14 nt, Staphylococcus aureus subsp. aureus Mu50
ugaaauuucauaaa

SEQ ID NO: 2049035 - RNA, 16 nt, Staphylococcus aureus subsp. aureus Mu50
ugaacauauuauaaaa

SEQ ID NO: 2049036 - RNA, 22 nt, Staphylococcus aureus subsp. aureus Mu50
ugaacaucuaguuauuucauag

SEQ ID NO: 2049037 - RNA, 19 nt, Staphylococcus aureus subsp. aureus Mu50
ugaacaauucuucaucaug

SEQ ID NO: 2049038 - RNA, 22 nt, Staphylococcus aureus subsp. aureus Mu50
ugaacaauaauaugccauagua

SEQ ID NO: 2049039 - RNA, 13 nt, Staphylococcus aureus subsp. aureus Mu50
ugaacaauaauau

SEQ ID NO: 2049040 - RNA, 16 nt, Staphylococcus aureus subsp. aureus Mu50
ugaacaaauaauuuac

SEQ ID NO: 2049041 - RNA, 22 nt, Staphylococcus aureus subsp. aureus Mu50
ugaacaacauugagauuaucuu

SEQ ID NO: 2049042 - RNA, 18 nt, Staphylococcus aureus subsp. aureus Mu50
ugaacgauaacaauuuau

SEQ ID NO: 2049043 - RNA, 20 nt, Staphylococcus aureus subsp. aureus Mu50
ugaaccagcuaaccaaauaa

SEQ ID NO: 2049044 - RNA, 17 nt, Staphylococcus aureus subsp. aureus Mu50
ugaaccccauucacuac

SEQ ID NO: 2049045 - RNA, 16 nt, Staphylococcus aureus subsp. aureus Mu50
ugaaaaguaaauugag

SEQ ID NO: 2049046 - RNA, 16 nt, Staphylococcus aureus subsp. aureus Mu50
ugaaaaggaaaaacuu

SEQ ID NO: 2049047 - RNA, 13 nt, Staphylococcus aureus subsp. aureus Mu50
ugaaaagauaaac

SEQ ID NO: 2049048 - RNA, 12 nt, Staphylococcus aureus subsp. aureus Mu50
ugaaaacuucuc

SEQ ID NO: 2049049 - RNA, 17 nt, Staphylococcus aureus subsp. aureus Mu50
ugaaaaagauucggaaa

SEQ ID NO: 2049050 - RNA, 15 nt, Staphylococcus aureus subsp. aureus Mu50
ugaaaaauuaaaaaa

SEQ ID NO: 2049051 - RNA, 14 nt, Staphylococcus aureus subsp. aureus Mu50
ugaaaacauuauua

SEQ ID NO: 2049052 - RNA, 20 nt, Staphylococcus aureus subsp. aureus Mu50
ugaaaaggacuuaguagauu

SEQ ID NO: 2049053 - RNA, 19 nt, Staphylococcus aureus subsp. aureus Mu50
ugaaaauaaucgaacagaa

SEQ ID NO: 2049054 - RNA, 18 nt, Staphylococcus aureus subsp. aureus Mu50
ugaaaauaccaagugcuu

SEQ ID NO: 2049055 - RNA, 22 nt, Staphylococcus aureus subsp. aureus Mu50
ugaaaauaccucuacauuauau

SEQ ID NO: 2049056 - RNA, 22 nt, Staphylococcus aureus subsp. aureus Mu50
ugaaaauuucaccgcuuucaau

SEQ ID NO: 2049057 - RNA, 14 nt, Staphylococcus aureus subsp. aureus Mu50
ugaaaguaccuaaa

SEQ ID NO: 2049058 - RNA, 20 nt, Staphylococcus aureus subsp. aureus Mu50
ugaaagacugacuaauaaaa

SEQ ID NO: 2049059 - RNA, 19 nt, Staphylococcus aureus subsp. aureus Mu50
ugaaaguuuuugucuuaau

SEQ ID NO: 2049060 - RNA, 20 nt, Staphylococcus aureus subsp. aureus Mu50
ugaaaguaccuaaaauagaa

SEQ ID NO: 2049061 - RNA, 22 nt, Staphylococcus aureus subsp. aureus Mu50
ugaaaguaccuaaaauagaaaa

SEQ ID NO: 2049062 - RNA, 22 nt, Staphylococcus aureus subsp. aureus Mu50
ugaaaguacuuggaaaauacua

SEQ ID NO: 2049063 - RNA, 22 nt, Staphylococcus aureus subsp. aureus Mu50
ugaaagucguuguugaaauuaa

SEQ ID NO: 2049064 - RNA, 13 nt, Staphylococcus aureus subsp. aureus Mu50
ugaaaguauuaga

SEQ ID NO: 2049065 - RNA, 20 nt, Staphylococcus aureus subsp. aureus Mu50
ugaaaguauuagauauauuu

SEQ ID NO: 2049066 - RNA, 19 nt, Staphylococcus aureus subsp. aureus Mu50
ugaaacuaaauuaaaagug

SEQ ID NO: 2049067 - RNA, 20 nt, Staphylococcus aureus subsp. aureus Mu50
ucuucaucauuguaaaacaa

SEQ ID NO: 2049068 - RNA, 23 nt, Staphylococcus aureus subsp. aureus Mu50
ucuucaucaugacuauuuuccau

SEQ ID NO: 2049069 - RNA, 13 nt, Staphylococcus aureus subsp. aureus Mu50
ucuucaucauauu

SEQ ID NO: 2049070 - RNA, 17 nt, Staphylococcus aureus subsp. aureus Mu50
ucuucaucuucuucaaa

SEQ ID NO: 2049071 - RNA, 12 nt, Staphylococcus aureus subsp. aureus Mu50
ucuucaucuuuu

SEQ ID NO: 2049072 - RNA, 23 nt, Staphylococcus aureus subsp. aureus Mu50
ucuucaucaauaacuauaaucau

SEQ ID NO: 2049073 - RNA, 13 nt, Staphylococcus aureus subsp. aureus Mu50
ucuucaccaucug

SEQ ID NO: 2049074 - RNA, 19 nt, Staphylococcus aureus subsp. aureus Mu50
ucuuauuuguaauuucagc

SEQ ID NO: 2049075 - RNA, 15 nt, Staphylococcus aureus subsp. aureus Mu50
ucuuauuuauucaua

SEQ ID NO: 2049076 - RNA, 18 nt, Staphylococcus aureus subsp. aureus Mu50
ucuuauuuuguuuuaaaa

SEQ ID NO: 2049077 - RNA, 20 nt, Staphylococcus aureus subsp. aureus Mu50
ucuuauuuuguuuuaaaaaa

SEQ ID NO: 2049078 - RNA, 14 nt, Staphylococcus aureus subsp. aureus Mu50
ucuucaaaaaauaa

SEQ ID NO: 2049079 - RNA, 21 nt, Staphylococcus aureus subsp. aureus Mu50
ucuucaaaguagauauugaau

SEQ ID NO: 2049080 - RNA, 20 nt, Staphylococcus aureus subsp. aureus Mu50
ucuucaacauaacucaaaua

SEQ ID NO: 2049081 - RNA, 18 nt, Staphylococcus aureus subsp. aureus Mu50
ucuucaacuucgauauga

SEQ ID NO: 2049082 - RNA, 14 nt, Staphylococcus aureus subsp. aureus Mu50
ucuucaauuuauuu

SEQ ID NO: 2049083 - RNA, 22 nt, Staphylococcus aureus subsp. aureus Mu50
ucuucaauucuuacaccugcaa

SEQ ID NO: 2049084 - RNA, 22 nt, Staphylococcus aureus subsp. aureus Mu50
ucuuaucgaaagaugauauauu

SEQ ID NO: 2049085 - RNA, 23 nt, Staphylococcus aureus subsp. aureus Mu50
ucuuaucgaaagaugauauauuc

SEQ ID NO: 2049086 - RNA, 16 nt, Staphylococcus aureus subsp. aureus Mu50
ucuuaucuuuaugaua

SEQ ID NO: 2049087 - RNA, 11 nt, Staphylococcus aureus subsp. aureus Mu50
ucuuauuaaaa

SEQ ID NO: 2049088 - RNA, 22 nt, Staphylococcus aureus subsp. aureus Mu50
ucuuauaaagacaccuucaaua

SEQ ID NO: 2049089 - RNA, 13 nt, Staphylococcus aureus subsp. aureus Mu50
ucuuauaaaaauc

SEQ ID NO: 2049090 - RNA, 18 nt, Staphylococcus aureus subsp. aureus Mu50
ucuuagugaaucuucuaa

SEQ ID NO: 2049091 - RNA, 22 nt, Staphylococcus aureus subsp. aureus Mu50
ucuuagauuuucacuaauauuu

SEQ ID NO: 2049092 - RNA, 20 nt, Staphylococcus aureus subsp. aureus Mu50
ucuuagcacuuggauuuuaa

SEQ ID NO: 2049093 - RNA, 13 nt, Staphylococcus aureus subsp. aureus Mu50
ucuuauaacaaaa

SEQ ID NO: 2049094 - RNA, 14 nt, Staphylococcus aureus subsp. aureus Mu50
ucuuauaaguucaa

SEQ ID NO: 2049095 - RNA, 17 nt, Staphylococcus aureus subsp. aureus Mu50
ucuuaucaagaauauaa

SEQ ID NO: 2049096 - RNA, 19 nt, Staphylococcus aureus subsp. aureus Mu50
ucuuacugcugcuuuuaau

SEQ ID NO: 2049097 - RNA, 21 nt, Staphylococcus aureus subsp. aureus Mu50
ucuuacugcugcuuuuaauau

SEQ ID NO: 2049098 - RNA, 14 nt, Staphylococcus aureus subsp. aureus Mu50
ucuuagauauuauu

SEQ ID NO: 2049099 - RNA, 15 nt, Staphylococcus aureus subsp. aureus Mu50
ucuuacuacuuaauu

SEQ ID NO: 2049100 - RNA, 18 nt, Staphylococcus aureus subsp. aureus Mu50
ucuguuaacugaauuucg

SEQ ID NO: 2049101 - RNA, 19 nt, Staphylococcus aureus subsp. aureus Mu50
ucuguuacagguuuuaaaa

SEQ ID NO: 2049102 - RNA, 23 nt, Staphylococcus aureus subsp. aureus Mu50
ucuguuacagguuuuaaaauuaa

SEQ ID NO: 2049103 - RNA, 19 nt, Staphylococcus aureus subsp. aureus Mu50
ucuguuccucaauaggaau

SEQ ID NO: 2049104 - RNA, 17 nt, Staphylococcus aureus subsp. aureus Mu50
ucugcucuuuuuguaug

SEQ ID NO: 2049105 - RNA, 15 nt, Staphylococcus aureus subsp. aureus Mu50
ucuggaacuuuaaua

SEQ ID NO: 2049106 - RNA, 13 nt, Staphylococcus aureus subsp. aureus Mu50
ucugcugcuguug

SEQ ID NO: 2049107 - RNA, 20 nt, Staphylococcus aureus subsp. aureus Mu50
ucuggaauaccuaaccauaa

SEQ ID NO: 2049108 - RNA, 21 nt, Staphylococcus aureus subsp. aureus Mu50
ucuguccgauaucuuuuaauu

SEQ ID NO: 2049109 - RNA, 18 nt, Staphylococcus aureus subsp. aureus Mu50
ucugucuaaaaacauaaa

SEQ ID NO: 2049110 - RNA, 14 nt, Staphylococcus aureus subsp. aureus Mu50
ucuguguaaauaua

SEQ ID NO: 2049111 - RNA, 20 nt, Staphylococcus aureus subsp. aureus Mu50
ucugucuaaaaacauaaaaa

SEQ ID NO: 2049112 - RNA, 15 nt, Staphylococcus aureus subsp. aureus Mu50
ucuguaccguauuuu

SEQ ID NO: 2049113 - RNA, 22 nt, Staphylococcus aureus subsp. aureus Mu50
ucuguaauaugaaggcuuuuug

SEQ ID NO: 2049114 - RNA, 21 nt, Staphylococcus aureus subsp. aureus Mu50
ucuguaaauuaucuaaagaaa

SEQ ID NO: 2049115 - RNA, 20 nt, Staphylococcus aureus subsp. aureus Mu50
ucucaucuauuuaauaaugu

SEQ ID NO: 2049116 - RNA, 13 nt, Staphylococcus aureus subsp. aureus Mu50
ucucaucuucuaa

SEQ ID NO: 2049117 - RNA, 14 nt, Staphylococcus aureus subsp. aureus Mu50
ucucaucuucuaaa

SEQ ID NO: 2049118 - RNA, 18 nt, Staphylococcus aureus subsp. aureus Mu50
ucucaucuucuaaaucaa

SEQ ID NO: 2049119 - RNA, 14 nt, Staphylococcus aureus subsp. aureus Mu50
ucucauuauaauga

SEQ ID NO: 2049120 - RNA, 23 nt, Staphylococcus aureus subsp. aureus Mu50
ucuacaugaaucaacaauuuaaa

SEQ ID NO: 2049121 - RNA, 24 nt, Staphylococcus aureus subsp. aureus Mu50
ucuacauuaaagaaaauaucugaa

SEQ ID NO: 2049122 - RNA, 19 nt, Staphylococcus aureus subsp. aureus Mu50
ucucaucuacuauuuaauc

SEQ ID NO: 2049123 - RNA, 23 nt, Staphylococcus aureus subsp. aureus Mu50
ucuccaguuuucaauuuauuaac

SEQ ID NO: 2049124 - RNA, 15 nt, Staphylococcus aureus subsp. aureus Mu50
ucucgcuuacucauu

SEQ ID NO: 2049125 - RNA, 13 nt, Staphylococcus aureus subsp. aureus Mu50
ucucguaaauugu

SEQ ID NO: 2049126 - RNA, 15 nt, Staphylococcus aureus subsp. aureus Mu50
ucucgugaaaauaau

SEQ ID NO: 2049127 - RNA, 16 nt, Staphylococcus aureus subsp. aureus Mu50
ucucgugaaaauaaua

SEQ ID NO: 2049128 - RNA, 15 nt, Staphylococcus aureus subsp. aureus Mu50
ucucguguauacaac

SEQ ID NO: 2049129 - RNA, 20 nt, Staphylococcus aureus subsp. aureus Mu50
ucucgugaaaauaauacuac

SEQ ID NO: 2049130 - RNA, 13 nt, Staphylococcus aureus subsp. aureus Mu50
ucucuaauuucac

SEQ ID NO: 2049131 - RNA, 19 nt, Staphylococcus aureus subsp. aureus Mu50
ucucuaaaacuuuuucaau

SEQ ID NO: 2049132 - RNA, 22 nt, Staphylococcus aureus subsp. aureus Mu50
ucucuaucaguccgcuuuuuca

SEQ ID NO: 2049133 - RNA, 18 nt, Staphylococcus aureus subsp. aureus Mu50
ucucuagugcuuugucuu

SEQ ID NO: 2049134 - RNA, 18 nt, Staphylococcus aureus subsp. aureus Mu50
ucucuaguaucugauacc

SEQ ID NO: 2049135 - RNA, 19 nt, Staphylococcus aureus subsp. aureus Mu50
ucucuuaaauaugaauaau

SEQ ID NO: 2049136 - RNA, 17 nt, Staphylococcus aureus subsp. aureus Mu50
ucucucgcuaaauuuau

SEQ ID NO: 2049137 - RNA, 18 nt, Staphylococcus aureus subsp. aureus Mu50
ucucucaaugcauuuaau

SEQ ID NO: 2049138 - RNA, 16 nt, Staphylococcus aureus subsp. aureus Mu50
ucucugcugcuuucau

SEQ ID NO: 2049139 - RNA, 19 nt, Staphylococcus aureus subsp. aureus Mu50
ucugaaaaaauuaauaauu

SEQ ID NO: 2049140 - RNA, 17 nt, Staphylococcus aureus subsp. aureus Mu50
ucugaaaaacuucuuaa

SEQ ID NO: 2049141 - RNA, 22 nt, Staphylococcus aureus subsp. aureus Mu50
ucugaaaauaucacugaaugcu

SEQ ID NO: 2049142 - RNA, 21 nt, Staphylococcus aureus subsp. aureus Mu50
ucucuuuguuggggcccacac

SEQ ID NO: 2049143 - RNA, 16 nt, Staphylococcus aureus subsp. aureus Mu50
ucucuuuugauaaauu

SEQ ID NO: 2049144 - RNA, 19 nt, Staphylococcus aureus subsp. aureus Mu50
ucugagaagaaauauauug

SEQ ID NO: 2049145 - RNA, 17 nt, Staphylococcus aureus subsp. aureus Mu50
ucugacuuuuaaaaaac

SEQ ID NO: 2049146 - RNA, 20 nt, Staphylococcus aureus subsp. aureus Mu50
ucugaugaggcaauauuaaa

SEQ ID NO: 2049147 - RNA, 14 nt, Staphylococcus aureus subsp. aureus Mu50
gguggguauauaau

SEQ ID NO: 2049148 - RNA, 15 nt, Staphylococcus aureus subsp. aureus Mu50
gguuaccaucuuuaa

SEQ ID NO: 2049149 - RNA, 20 nt, Staphylococcus aureus subsp. aureus Mu50
gguuaaugacuaugcaaaug

SEQ ID NO: 2049150 - RNA, 17 nt, Staphylococcus aureus subsp. aureus Mu50
gguguugaaaaguaauu

SEQ ID NO: 2049151 - RNA, 14 nt, Staphylococcus aureus subsp. aureus Mu50
gguuauuaaaauua

SEQ ID NO: 2049152 - RNA, 11 nt, Staphylococcus aureus subsp. aureus Mu50
gguuauggugu

SEQ ID NO: 2049153 - RNA, 11 nt, Staphylococcus aureus subsp. aureus Mu50
gguucaaaucc

SEQ ID NO: 2049154 - RNA, 13 nt, Staphylococcus aureus subsp. aureus Mu50
gguucgaaucccu

SEQ ID NO: 2049155 - RNA, 18 nt, Staphylococcus aureus subsp. aureus Mu50
gguucccaauucggauua

SEQ ID NO: 2049156 - RNA, 21 nt, Staphylococcus aureus subsp. aureus Mu50
gguuuaaacaguuuaauucgu

SEQ ID NO: 2049157 - RNA, 15 nt, Staphylococcus aureus subsp. aureus Mu50
gguuguuaggggcuu

SEQ ID NO: 2049158 - RNA, 14 nt, Staphylococcus aureus subsp. aureus Mu50
gguuuaaaaaugcu

SEQ ID NO: 2049159 - RNA, 20 nt, Staphylococcus aureus subsp. aureus Mu50
gguugaacgguuguauuuca

SEQ ID NO: 2049160 - RNA, 17 nt, Staphylococcus aureus subsp. aureus Mu50
gguugauuauauuucuc

SEQ ID NO: 2049161 - RNA, 21 nt, Staphylococcus aureus subsp. aureus Mu50
guaaaaccuuacccaaaaaau

SEQ ID NO: 2049162 - RNA, 21 nt, Staphylococcus aureus subsp. aureus Mu50
gguuuaucagcuuuaauaaua

SEQ ID NO: 2049163 - RNA, 13 nt, Staphylococcus aureus subsp. aureus Mu50
gguuuauuuaaua

SEQ ID NO: 2049164 - RNA, 23 nt, Staphylococcus aureus subsp. aureus Mu50
gguuugaguaaauuaauagagaa

SEQ ID NO: 2049165 - RNA, 21 nt, Staphylococcus aureus subsp. aureus Mu50
ggugagggccccaacacagaa

SEQ ID NO: 2049166 - RNA, 18 nt, Staphylococcus aureus subsp. aureus Mu50
ggucaucaauuggcaacg

SEQ ID NO: 2049167 - RNA, 21 nt, Staphylococcus aureus subsp. aureus Mu50
gguccaaaucgugauaucuug

SEQ ID NO: 2049168 - RNA, 15 nt, Staphylococcus aureus subsp. aureus Mu50
gguauuuaauguuuu

SEQ ID NO: 2049169 - RNA, 17 nt, Staphylococcus aureus subsp. aureus Mu50
ggucaacuguaguggaa

SEQ ID NO: 2049170 - RNA, 18 nt, Staphylococcus aureus subsp. aureus Mu50
ggucacacccauacucug

SEQ ID NO: 2049171 - RNA, 21 nt, Staphylococcus aureus subsp. aureus Mu50
ggucacacccauacucugggc

SEQ ID NO: 2049172 - RNA, 15 nt, Staphylococcus aureus subsp. aureus Mu50
ggggccccaacacag

SEQ ID NO: 2049173 - RNA, 15 nt, Staphylococcus aureus subsp. aureus Mu50
ggggaugggccccaa

SEQ ID NO: 2049174 - RNA, 20 nt, Staphylococcus aureus subsp. aureus Mu50
gggcuagagcguuuugcuuu

SEQ ID NO: 2049175 - RNA, 23 nt, Staphylococcus aureus subsp. aureus Mu50
gggucacacccauacucugggca

SEQ ID NO: 2049176 - RNA, 19 nt, Staphylococcus aureus subsp. aureus Mu50
ggggcuuuuaugcaugcgc

SEQ ID NO: 2049177 - RNA, 16 nt, Staphylococcus aureus subsp. aureus Mu50
ggggugagggccccaa

SEQ ID NO: 2049178 - RNA, 13 nt, Staphylococcus aureus subsp. aureus Mu50
gggcagaucauaa

SEQ ID NO: 2049179 - RNA, 13 nt, Staphylococcus aureus subsp. aureus Mu50
gggcaaaaaagga

SEQ ID NO: 2049180 - RNA, 15 nt, Staphylococcus aureus subsp. aureus Mu50
gggccagccaacuug

SEQ ID NO: 2049181 - RNA, 16 nt, Staphylococcus aureus subsp. aureus Mu50
gggcccacaccccaac

SEQ ID NO: 2049182 - RNA, 14 nt, Staphylococcus aureus subsp. aureus Mu50
gggaagaccauuuu

SEQ ID NO: 2049183 - RNA, 14 nt, Staphylococcus aureus subsp. aureus Mu50
ggcuuuguuuuuca

SEQ ID NO: 2049184 - RNA, 19 nt, Staphylococcus aureus subsp. aureus Mu50
gucuaauguuggaaaaggu

SEQ ID NO: 2049185 - RNA, 18 nt, Staphylococcus aureus subsp. aureus Mu50
gucuagauuuuaaaucaa

SEQ ID NO: 2049186 - RNA, 13 nt, Staphylococcus aureus subsp. aureus Mu50
gucuaacaguuaa

SEQ ID NO: 2049187 - RNA, 12 nt, Staphylococcus aureus subsp. aureus Mu50
gucuaaaaaugu

SEQ ID NO: 2049188 - RNA, 20 nt, Staphylococcus aureus subsp. aureus Mu50
gucucauaucuauuuuucga

SEQ ID NO: 2049189 - RNA, 22 nt, Staphylococcus aureus subsp. aureus Mu50
gucucccauaacaccuacugau

SEQ ID NO: 2049190 - RNA, 14 nt, Staphylococcus aureus subsp. aureus Mu50
gucgguucaucuaa

SEQ ID NO: 2049191 - RNA, 15 nt, Staphylococcus aureus subsp. aureus Mu50
gucguacuuucaaau

SEQ ID NO: 2049192 - RNA, 15 nt, Staphylococcus aureus subsp. aureus Mu50
gucguucaagaacaa

SEQ ID NO: 2049193 - RNA, 16 nt, Staphylococcus aureus subsp. aureus Mu50
gucgaaaauagcuauu

SEQ ID NO: 2049194 - RNA, 19 nt, Staphylococcus aureus subsp. aureus Mu50
gucgaaaauagcuauuaaa

SEQ ID NO: 2049195 - RNA, 20 nt, Staphylococcus aureus subsp. aureus Mu50
gucgaaaauagcuauuaaaa

SEQ ID NO: 2049196 - RNA, 22 nt, Staphylococcus aureus subsp. aureus Mu50
gucgaaaauagcuauuaaaaua

SEQ ID NO: 2049197 - RNA, 19 nt, Staphylococcus aureus subsp. aureus Mu50
gucgaagaagauuaugaaa

SEQ ID NO: 2049198 - RNA, 17 nt, Staphylococcus aureus subsp. aureus Mu50
gucgaauauaauuuuuu

SEQ ID NO: 2049199 - RNA, 14 nt, Staphylococcus aureus subsp. aureus Mu50
guccagcuaauaac

SEQ ID NO: 2049200 - RNA, 23 nt, Staphylococcus aureus subsp. aureus Mu50
guccagcuaauaacgcugcaccu

SEQ ID NO: 2049201 - RNA, 12 nt, Staphylococcus aureus subsp. aureus Mu50
gucauauaaaca

SEQ ID NO: 2049202 - RNA, 18 nt, Staphylococcus aureus subsp. aureus Mu50
gucauauguuuuauaaua

SEQ ID NO: 2049203 - RNA, 14 nt, Staphylococcus aureus subsp. aureus Mu50
gucaucaacacaca

SEQ ID NO: 2049204 - RNA, 11 nt, Staphylococcus aureus subsp. aureus Mu50
gucaucaacac

SEQ ID NO: 2049205 - RNA, 12 nt, Staphylococcus aureus subsp. aureus Mu50
gucaugccuuca

SEQ ID NO: 2049206 - RNA, 14 nt, Staphylococcus aureus subsp. aureus Mu50
guauuuuuaagcug

SEQ ID NO: 2049207 - RNA, 17 nt, Staphylococcus aureus subsp. aureus Mu50
guauuuuaaugauuuuu

SEQ ID NO: 2049208 - RNA, 14 nt, Staphylococcus aureus subsp. aureus Mu50
guauuuuauuuauu

SEQ ID NO: 2049209 - RNA, 18 nt, Staphylococcus aureus subsp. aureus Mu50
guauuugccuuuugaaua

SEQ ID NO: 2049210 - RNA, 18 nt, Staphylococcus aureus subsp. aureus Mu50
guauuguccauagauaca

SEQ ID NO: 2049211 - RNA, 14 nt, Staphylococcus aureus subsp. aureus Mu50
guauuuaauguuuu

SEQ ID NO: 2049212 - RNA, 13 nt, Staphylococcus aureus subsp. aureus Mu50
guauuuacuuuuc

SEQ ID NO: 2049213 - RNA, 15 nt, Staphylococcus aureus subsp. aureus Mu50
guauuuaguaucaug

SEQ ID NO: 2049214 - RNA, 19 nt, Staphylococcus aureus subsp. aureus Mu50
guauugccguuauuuucaa

SEQ ID NO: 2049215 - RNA, 21 nt, Staphylococcus aureus subsp. aureus Mu50
guauucagucaguaaaaauac

SEQ ID NO: 2049216 - RNA, 20 nt, Staphylococcus aureus subsp. aureus Mu50
guauucaaaguuuucauuua

SEQ ID NO: 2049217 - RNA, 16 nt, Staphylococcus aureus subsp. aureus Mu50
guauuacuugaaaaua

SEQ ID NO: 2049218 - RNA, 20 nt, Staphylococcus aureus subsp. aureus Mu50
guauuauuauaauuuuguuu

SEQ ID NO: 2049219 - RNA, 22 nt, Staphylococcus aureus subsp. aureus Mu50
guauuaugauugcuuauuuauu

SEQ ID NO: 2049220 - RNA, 18 nt, Staphylococcus aureus subsp. aureus Mu50
guauugaaugaauucauu

SEQ ID NO: 2049221 - RNA, 23 nt, Staphylococcus aureus subsp. aureus Mu50
guauucuuggcguauuuuuuguu

SEQ ID NO: 2049222 - RNA, 16 nt, Staphylococcus aureus subsp. aureus Mu50
gucacauuuauaacau

SEQ ID NO: 2049223 - RNA, 21 nt, Staphylococcus aureus subsp. aureus Mu50
gucaaucacuccucuauuuua

SEQ ID NO: 2049224 - RNA, 18 nt, Staphylococcus aureus subsp. aureus Mu50
gucaaauuggacuuaugg

SEQ ID NO: 2049225 - RNA, 19 nt, Staphylococcus aureus subsp. aureus Mu50
guaugauagaauacuaaaa

SEQ ID NO: 2049226 - RNA, 16 nt, Staphylococcus aureus subsp. aureus Mu50
guaugagugauagaaa

SEQ ID NO: 2049227 - RNA, 21 nt, Staphylococcus aureus subsp. aureus Mu50
guaugauagaauacuaaaagu

SEQ ID NO: 2049228 - RNA, 20 nt, Staphylococcus aureus subsp. aureus Mu50
guaucgauaguucuauauaa

SEQ ID NO: 2049229 - RNA, 19 nt, Staphylococcus aureus subsp. aureus Mu50
guaucgaauuaagaaaagu

SEQ ID NO: 2049230 - RNA, 16 nt, Staphylococcus aureus subsp. aureus Mu50
guaucuauacaauuau

SEQ ID NO: 2049231 - RNA, 19 nt, Staphylococcus aureus subsp. aureus Mu50
guaucuauacaauuaugga

SEQ ID NO: 2049232 - RNA, 19 nt, Staphylococcus aureus subsp. aureus Mu50
guaucuaugaaauuuuuua

SEQ ID NO: 2049233 - RNA, 14 nt, Staphylococcus aureus subsp. aureus Mu50
guaugcgguuauau

SEQ ID NO: 2049234 - RNA, 13 nt, Staphylococcus aureus subsp. aureus Mu50
guauggaauaaau

SEQ ID NO: 2049235 - RNA, 18 nt, Staphylococcus aureus subsp. aureus Mu50
guauggaauaaaugguuu

SEQ ID NO: 2049236 - RNA, 17 nt, Staphylococcus aureus subsp. aureus Mu50
guauggacuaagauaua

SEQ ID NO: 2049237 - RNA, 22 nt, Staphylococcus aureus subsp. aureus Mu50
guauuacacgcauuacuuuaga

SEQ ID NO: 2049238 - RNA, 21 nt, Staphylococcus aureus subsp. aureus Mu50
guauccuguguaaaauaaauc

SEQ ID NO: 2049239 - RNA, 20 nt, Staphylococcus aureus subsp. aureus Mu50
guauccccauuuauguguug

SEQ ID NO: 2049240 - RNA, 21 nt, Staphylococcus aureus subsp. aureus Mu50
guaucacuaggauguucauca

SEQ ID NO: 2049241 - RNA, 14 nt, Staphylococcus aureus subsp. aureus Mu50
guaucauuucagaa

SEQ ID NO: 2049242 - RNA, 19 nt, Staphylococcus aureus subsp. aureus Mu50
guaucaacauuaauaaaua

SEQ ID NO: 2049243 - RNA, 22 nt, Staphylococcus aureus subsp. aureus Mu50
guaggaugcuuccuuuuuguua

SEQ ID NO: 2049244 - RNA, 20 nt, Staphylococcus aureus subsp. aureus Mu50
guauacuaaacuuuuuucaa

SEQ ID NO: 2049245 - RNA, 18 nt, Staphylococcus aureus subsp. aureus Mu50
guagcuugaauaauauau

SEQ ID NO: 2049246 - RNA, 18 nt, Staphylococcus aureus subsp. aureus Mu50
guagauuacuuugcuaaa

SEQ ID NO: 2049247 - RNA, 19 nt, Staphylococcus aureus subsp. aureus Mu50
guagauuuauuaaauauau

SEQ ID NO: 2049248 - RNA, 22 nt, Staphylococcus aureus subsp. aureus Mu50
guagauugauauccuuaacaug

SEQ ID NO: 2049249 - RNA, 20 nt, Staphylococcus aureus subsp. aureus Mu50
guagaaucuacgauuuucaa

SEQ ID NO: 2049250 - RNA, 18 nt, Staphylococcus aureus subsp. aureus Mu50
guacauccacuuuauaau

SEQ ID NO: 2049251 - RNA, 13 nt, Staphylococcus aureus subsp. aureus Mu50
guaccaccccaac

SEQ ID NO: 2049252 - RNA, 21 nt, Staphylococcus aureus subsp. aureus Mu50
guaccacauacauaucuuuug

SEQ ID NO: 2049253 - RNA, 22 nt, Staphylococcus aureus subsp. aureus Mu50
guacgcaauuuaauauuauaag

SEQ ID NO: 2049254 - RNA, 14 nt, Staphylococcus aureus subsp. aureus Mu50
guacgauucaauuu

SEQ ID NO: 2049255 - RNA, 17 nt, Staphylococcus aureus subsp. aureus Mu50
guacucuucguuuuaau

SEQ ID NO: 2049256 - RNA, 23 nt, Staphylococcus aureus subsp. aureus Mu50
guagaaaauagcuguuugauauu

SEQ ID NO: 2049257 - RNA, 15 nt, Staphylococcus aureus subsp. aureus Mu50
guacuuucaaauaau

SEQ ID NO: 2049258 - RNA, 15 nt, Staphylococcus aureus subsp. aureus Mu50
guacaccuacaaaua

SEQ ID NO: 2049259 - RNA, 15 nt, Staphylococcus aureus subsp. aureus Mu50
guacacgaauaccaa

SEQ ID NO: 2049260 - RNA, 17 nt, Staphylococcus aureus subsp. aureus Mu50
guacacgaauucauuaa

SEQ ID NO: 2049261 - RNA, 14 nt, Staphylococcus aureus subsp. aureus Mu50
guacauauaauaug

SEQ ID NO: 2049262 - RNA, 11 nt, Staphylococcus aureus subsp. aureus Mu50
guacauaauag

SEQ ID NO: 2049263 - RNA, 18 nt, Staphylococcus aureus subsp. aureus Mu50
guacaguuacuuucgcuu

SEQ ID NO: 2049264 - RNA, 15 nt, Staphylococcus aureus subsp. aureus Mu50
guaauuucuccaagu

SEQ ID NO: 2049265 - RNA, 12 nt, Staphylococcus aureus subsp. aureus Mu50
guaauuuuaaug

SEQ ID NO: 2049266 - RNA, 23 nt, Staphylococcus aureus subsp. aureus Mu50
guaauuuuuaaaucuacaauauu

SEQ ID NO: 2049267 - RNA, 14 nt, Staphylococcus aureus subsp. aureus Mu50
guacaaauaauaca

SEQ ID NO: 2049268 - RNA, 19 nt, Staphylococcus aureus subsp. aureus Mu50
guacaauuuuuaaaaaccu

SEQ ID NO: 2049269 - RNA, 23 nt, Staphylococcus aureus subsp. aureus Mu50
guaaucauuauagcagguggcau

SEQ ID NO: 2049270 - RNA, 13 nt, Staphylococcus aureus subsp. aureus Mu50
guaauuaauacau

SEQ ID NO: 2049271 - RNA, 23 nt, Staphylococcus aureus subsp. aureus Mu50
guaaugaucguuagcuaaucguu

SEQ ID NO: 2049272 - RNA, 13 nt, Staphylococcus aureus subsp. aureus Mu50
guaaugauacgca

SEQ ID NO: 2049273 - RNA, 17 nt, Staphylococcus aureus subsp. aureus Mu50
guaaugccauuaauggu

SEQ ID NO: 2049274 - RNA, 16 nt, Staphylococcus aureus subsp. aureus Mu50
guaaugauuuugcuuu

SEQ ID NO: 2049275 - RNA, 18 nt, Staphylococcus aureus subsp. aureus Mu50
guaauugucuuuauaaaa

SEQ ID NO: 2049276 - RNA, 12 nt, Staphylococcus aureus subsp. aureus Mu50
guaauuguuaua

SEQ ID NO: 2049277 - RNA, 21 nt, Staphylococcus aureus subsp. aureus Mu50
guaauuguuauaaguaaauaa

SEQ ID NO: 2049278 - RNA, 22 nt, Staphylococcus aureus subsp. aureus Mu50
guaauuguuauaaguaaauaau

SEQ ID NO: 2049279 - RNA, 14 nt, Staphylococcus aureus subsp. aureus Mu50
guaauuuaaaauag

SEQ ID NO: 2049280 - RNA, 15 nt, Staphylococcus aureus subsp. aureus Mu50
guaauuuaaaauagu

SEQ ID NO: 2049281 - RNA, 16 nt, Staphylococcus aureus subsp. aureus Mu50
guaauuuaaaauaguu

SEQ ID NO: 2049282 - RNA, 18 nt, Staphylococcus aureus subsp. aureus Mu50
guaauugaugauuacucc

SEQ ID NO: 2049283 - RNA, 13 nt, Staphylococcus aureus subsp. aureus Mu50
guaaaacugcaau

SEQ ID NO: 2049284 - RNA, 15 nt, Staphylococcus aureus subsp. aureus Mu50
guaaaacugcaauaa

SEQ ID NO: 2049285 - RNA, 19 nt, Staphylococcus aureus subsp. aureus Mu50
guaauaccuuuacuuucau

SEQ ID NO: 2049286 - RNA, 16 nt, Staphylococcus aureus subsp. aureus Mu50
guaauaauauaaauaa

SEQ ID NO: 2049287 - RNA, 15 nt, Staphylococcus aureus subsp. aureus Mu50
guaauaauaucaccu

SEQ ID NO: 2049288 - RNA, 16 nt, Staphylococcus aureus subsp. aureus Mu50
guaaucauaccagcaa

SEQ ID NO: 2049289 - RNA, 22 nt, Staphylococcus aureus subsp. aureus Mu50
guaaucacuaucuguuguuaua

SEQ ID NO: 2049290 - RNA, 23 nt, Staphylococcus aureus subsp. aureus Mu50
guaaucagcuuuuucacauugcc

SEQ ID NO: 2049291 - RNA, 21 nt, Staphylococcus aureus subsp. aureus Mu50
guggcguaguuugaauuggga

SEQ ID NO: 2049292 - RNA, 15 nt, Staphylococcus aureus subsp. aureus Mu50
gugcuuuguuuauca

SEQ ID NO: 2049293 - RNA, 17 nt, Staphylococcus aureus subsp. aureus Mu50
guggagaaccuuuaaaa

SEQ ID NO: 2049294 - RNA, 17 nt, Staphylococcus aureus subsp. aureus Mu50
guggacguugaucuuug

SEQ ID NO: 2049295 - RNA, 18 nt, Staphylococcus aureus subsp. aureus Mu50
guuaagauaccuuuuucu

SEQ ID NO: 2049296 - RNA, 23 nt, Staphylococcus aureus subsp. aureus Mu50
guuaauccgauuuugauauaaaa

SEQ ID NO: 2049297 - RNA, 14 nt, Staphylococcus aureus subsp. aureus Mu50
guuaauguaaaguu

SEQ ID NO: 2049298 - RNA, 13 nt, Staphylococcus aureus subsp. aureus Mu50
guuaaaucaccaa

SEQ ID NO: 2049299 - RNA, 13 nt, Staphylococcus aureus subsp. aureus Mu50
guuaaccauacau

SEQ ID NO: 2049300 - RNA, 22 nt, Staphylococcus aureus subsp. aureus Mu50
guuaacaauauucguaaauccu

SEQ ID NO: 2049301 - RNA, 14 nt, Staphylococcus aureus subsp. aureus Mu50
guuaacaucuucau

SEQ ID NO: 2049302 - RNA, 23 nt, Staphylococcus aureus subsp. aureus Mu50
guuaaaacacccugcuuaucauu

SEQ ID NO: 2049303 - RNA, 24 nt, Staphylococcus aureus subsp. aureus Mu50
guguucaaauaacgcaaugucuug

SEQ ID NO: 2049304 - RNA, 15 nt, Staphylococcus aureus subsp. aureus Mu50
gugucacaaagaaau

SEQ ID NO: 2049305 - RNA, 17 nt, Staphylococcus aureus subsp. aureus Mu50
guguauucauuuuaaau

SEQ ID NO: 2049306 - RNA, 14 nt, Staphylococcus aureus subsp. aureus Mu50
gugucaugcugaau

SEQ ID NO: 2049307 - RNA, 16 nt, Staphylococcus aureus subsp. aureus Mu50
gugucauaauccauuc

SEQ ID NO: 2049308 - RNA, 14 nt, Staphylococcus aureus subsp. aureus Mu50
guguaugauagaau

SEQ ID NO: 2049309 - RNA, 22 nt, Staphylococcus aureus subsp. aureus Mu50
guguauauuauuuugcuuuaau

SEQ ID NO: 2049310 - RNA, 14 nt, Staphylococcus aureus subsp. aureus Mu50
guguccuaauaagu

SEQ ID NO: 2049311 - RNA, 15 nt, Staphylococcus aureus subsp. aureus Mu50
guucgggaauuuuuu

SEQ ID NO: 2049312 - RNA, 13 nt, Staphylococcus aureus subsp. aureus Mu50
guucuauaauaaa

SEQ ID NO: 2049313 - RNA, 17 nt, Staphylococcus aureus subsp. aureus Mu50
guucucguguaaaaugc

SEQ ID NO: 2049314 - RNA, 19 nt, Staphylococcus aureus subsp. aureus Mu50
guucuccgaucaugccuuc

SEQ ID NO: 2049315 - RNA, 14 nt, Staphylococcus aureus subsp. aureus Mu50
guucuccgaucaug

SEQ ID NO: 2049316 - RNA, 22 nt, Staphylococcus aureus subsp. aureus Mu50
guucucauuauaaugauuuuua

SEQ ID NO: 2049317 - RNA, 15 nt, Staphylococcus aureus subsp. aureus Mu50
guucuauauaauuua

SEQ ID NO: 2049318 - RNA, 18 nt, Staphylococcus aureus subsp. aureus Mu50
guucacaacaaaguguaa

SEQ ID NO: 2049319 - RNA, 22 nt, Staphylococcus aureus subsp. aureus Mu50
guuaggggcuuuuaugcaugcg

SEQ ID NO: 2049320 - RNA, 22 nt, Staphylococcus aureus subsp. aureus Mu50
guuagugauaccuuuaauuguu

SEQ ID NO: 2049321 - RNA, 21 nt, Staphylococcus aureus subsp. aureus Mu50
guuaguauaaacguccaaaca

SEQ ID NO: 2049322 - RNA, 20 nt, Staphylococcus aureus subsp. aureus Mu50
guuaccaucuuuaauacgaa

SEQ ID NO: 2049323 - RNA, 16 nt, Staphylococcus aureus subsp. aureus Mu50
guuacauauugcauuu

SEQ ID NO: 2049324 - RNA, 20 nt, Staphylococcus aureus subsp. aureus Mu50
guuauaucaucaacaaucuu

SEQ ID NO: 2049325 - RNA, 14 nt, Staphylococcus aureus subsp. aureus Mu50
guuauaccauauuu

SEQ ID NO: 2049326 - RNA, 16 nt, Staphylococcus aureus subsp. aureus Mu50
guuauaaguacaaaua

SEQ ID NO: 2049327 - RNA, 23 nt, Staphylococcus aureus subsp. aureus Mu50
guuauaaguacaaauaauacagg

SEQ ID NO: 2049328 - RNA, 21 nt, Staphylococcus aureus subsp. aureus Mu50
guuauaccauauuuauggugu

SEQ ID NO: 2049329 - RNA, 13 nt, Staphylococcus aureus subsp. aureus Mu50
guuauaaaaugaa

SEQ ID NO: 2049330 - RNA, 16 nt, Staphylococcus aureus subsp. aureus Mu50
guuauaaauucuaucu

SEQ ID NO: 2049331 - RNA, 23 nt, Staphylococcus aureus subsp. aureus Mu50
guuauaauggcgggcccccaaca

SEQ ID NO: 2049332 - RNA, 12 nt, Staphylococcus aureus subsp. aureus Mu50
guuauauuuuua

SEQ ID NO: 2049333 - RNA, 23 nt, Staphylococcus aureus subsp. aureus Mu50
guuauauuaaggucauuuuuaau

SEQ ID NO: 2049334 - RNA, 23 nt, Staphylococcus aureus subsp. aureus Mu50
guuauuagauacuucuuuugcaa

SEQ ID NO: 2049335 - RNA, 15 nt, Staphylococcus aureus subsp. aureus Mu50
guuauuauaaaauaa

SEQ ID NO: 2049336 - RNA, 17 nt, Staphylococcus aureus subsp. aureus Mu50
guuaugugcuaaucuau

SEQ ID NO: 2049337 - RNA, 17 nt, Staphylococcus aureus subsp. aureus Mu50
guuauuaaaauuaaaua

SEQ ID NO: 2049338 - RNA, 21 nt, Staphylococcus aureus subsp. aureus Mu50
guuauuaaaucuuuuacuaaa

SEQ ID NO: 2049339 - RNA, 17 nt, Staphylococcus aureus subsp. aureus Mu50
guuauugcuuauuuuug

SEQ ID NO: 2049340 - RNA, 22 nt, Staphylococcus aureus subsp. aureus Mu50
guuaucuugcuuauugauauaa

SEQ ID NO: 2049341 - RNA, 14 nt, Staphylococcus aureus subsp. aureus Mu50
guuauguaugaaag

SEQ ID NO: 2049342 - RNA, 17 nt, Staphylococcus aureus subsp. aureus Mu50
guuaugguguguuggug

SEQ ID NO: 2049343 - RNA, 15 nt, Staphylococcus aureus subsp. aureus Mu50
guuaugguauuuaua

SEQ ID NO: 2049344 - RNA, 13 nt, Staphylococcus aureus subsp. aureus Mu50
guuaugguguguu

SEQ ID NO: 2049345 - RNA, 14 nt, Staphylococcus aureus subsp. aureus Mu50
guuaugguguguug

SEQ ID NO: 2049346 - RNA, 22 nt, Staphylococcus aureus subsp. aureus Mu50
guuauuuuaauaacgauaagca

SEQ ID NO: 2049347 - RNA, 15 nt, Staphylococcus aureus subsp. aureus Mu50
guuauuuuugcuauu

SEQ ID NO: 2049348 - RNA, 18 nt, Staphylococcus aureus subsp. aureus Mu50
guucaacuaaauuuucua

SEQ ID NO: 2049349 - RNA, 23 nt, Staphylococcus aureus subsp. aureus Mu50
guucaauauuuaucaauaaauca

SEQ ID NO: 2049350 - RNA, 19 nt, Staphylococcus aureus subsp. aureus Mu50
guucaaucacuauauuuca

SEQ ID NO: 2049351 - RNA, 19 nt, Staphylococcus aureus subsp. aureus Mu50
gugcacuuguaauauuaua

SEQ ID NO: 2049352 - RNA, 16 nt, Staphylococcus aureus subsp. aureus Mu50
gugauuuuuaauaauu

SEQ ID NO: 2049353 - RNA, 17 nt, Staphylococcus aureus subsp. aureus Mu50
gugcaggauaacguuca

SEQ ID NO: 2049354 - RNA, 14 nt, Staphylococcus aureus subsp. aureus Mu50
gugccauuaaaauu

SEQ ID NO: 2049355 - RNA, 13 nt, Staphylococcus aureus subsp. aureus Mu50
gugacauuuucaa

SEQ ID NO: 2049356 - RNA, 17 nt, Staphylococcus aureus subsp. aureus Mu50
gugacucaguuauauua

SEQ ID NO: 2049357 - RNA, 17 nt, Staphylococcus aureus subsp. aureus Mu50
gugacuuuuauaauucu

SEQ ID NO: 2049358 - RNA, 22 nt, Staphylococcus aureus subsp. aureus Mu50
gugacuuuuauaauucuaaguc

SEQ ID NO: 2049359 - RNA, 20 nt, Staphylococcus aureus subsp. aureus Mu50
gugagauacguuauuucaau

SEQ ID NO: 2049360 - RNA, 20 nt, Staphylococcus aureus subsp. aureus Mu50
gugaguuuccauauuuuuua

SEQ ID NO: 2049361 - RNA, 19 nt, Staphylococcus aureus subsp. aureus Mu50
gugagggccccaacacaga

SEQ ID NO: 2049362 - RNA, 17 nt, Staphylococcus aureus subsp. aureus Mu50
gugauaauguacaugua

SEQ ID NO: 2049363 - RNA, 21 nt, Staphylococcus aureus subsp. aureus Mu50
gugauagaaguuuuuugauua

SEQ ID NO: 2049364 - RNA, 19 nt, Staphylococcus aureus subsp. aureus Mu50
gugauauaugaaauauuua

SEQ ID NO: 2049365 - RNA, 19 nt, Staphylococcus aureus subsp. aureus Mu50
gugauaucuugcuuggaua

SEQ ID NO: 2049366 - RNA, 14 nt, Staphylococcus aureus subsp. aureus Mu50
gugaggcaccaaug

SEQ ID NO: 2049367 - RNA, 15 nt, Staphylococcus aureus subsp. aureus Mu50
gugagggccccaaca

SEQ ID NO: 2049368 - RNA, 18 nt, Staphylococcus aureus subsp. aureus Mu50
gugagggacgucaucaug

SEQ ID NO: 2049369 - RNA, 17 nt, Staphylococcus aureus subsp. aureus Mu50
gugaaugguugauuaua

SEQ ID NO: 2049370 - RNA, 20 nt, Staphylococcus aureus subsp. aureus Mu50
gugaaugguugauuauauuu

SEQ ID NO: 2049371 - RNA, 16 nt, Staphylococcus aureus subsp. aureus Mu50
gugaaucuaaacuaua

SEQ ID NO: 2049372 - RNA, 22 nt, Staphylococcus aureus subsp. aureus Mu50
gugaauguuuucuaaaucuaac

SEQ ID NO: 2049373 - RNA, 13 nt, Staphylococcus aureus subsp. aureus Mu50
gugacaaacauuu

SEQ ID NO: 2049374 - RNA, 21 nt, Staphylococcus aureus subsp. aureus Mu50
gugaaauuagaaaaauaugau

SEQ ID NO: 2049375 - RNA, 22 nt, Staphylococcus aureus subsp. aureus Mu50
gugaaauuagaaaaauaugauu

SEQ ID NO: 2049376 - RNA, 20 nt, Staphylococcus aureus subsp. aureus Mu50
gugaaauucgaacuaucaau

SEQ ID NO: 2049377 - RNA, 21 nt, Staphylococcus aureus subsp. aureus Mu50
gugaaaguauuagauauauuu

SEQ ID NO: 2049378 - RNA, 17 nt, Staphylococcus aureus subsp. aureus Mu50
gugaagagaugaaagau

SEQ ID NO: 2049379 - RNA, 11 nt, Staphylococcus aureus subsp. aureus Mu50
gugaaaagugu

SEQ ID NO: 2049380 - RNA, 12 nt, Staphylococcus aureus subsp. aureus Mu50
gugaaaaguguu

SEQ ID NO: 2049381 - RNA, 11 nt, Staphylococcus aureus subsp. aureus Mu50
gucuuaaacau

SEQ ID NO: 2049382 - RNA, 19 nt, Staphylococcus aureus subsp. aureus Mu50
gucuuccaaucaacuucau

SEQ ID NO: 2049383 - RNA, 13 nt, Staphylococcus aureus subsp. aureus Mu50
gucuggaauaaau

SEQ ID NO: 2049384 - RNA, 18 nt, Staphylococcus aureus subsp. aureus Mu50
gucucuaaaacuuuuuca

SEQ ID NO: 2049385 - RNA, 20 nt, Staphylococcus aureus subsp. aureus Mu50
gucugaugucgaaaauagcu

SEQ ID NO: 2049386 - RNA, 18 nt, Staphylococcus aureus subsp. aureus Mu50
gucugcauuaauuucaug

SEQ ID NO: 2049387 - RNA, 16 nt, Staphylococcus aureus subsp. aureus Mu50
uaaaucuguuuaaauu

SEQ ID NO: 2049388 - RNA, 19 nt, Staphylococcus aureus subsp. aureus Mu50
uaaaucuguuuaaauuuaa

SEQ ID NO: 2049389 - RNA, 20 nt, Staphylococcus aureus subsp. aureus Mu50
uaaaucuguacuucuaauuu

SEQ ID NO: 2049390 - RNA, 23 nt, Staphylococcus aureus subsp. aureus Mu50
uaaaucacgccauaaucuucauu

SEQ ID NO: 2049391 - RNA, 20 nt, Staphylococcus aureus subsp. aureus Mu50
uaaaucuuguuggauuuuaa

SEQ ID NO: 2049392 - RNA, 22 nt, Staphylococcus aureus subsp. aureus Mu50
uaaaucacugcuuucaaguaau

SEQ ID NO: 2049393 - RNA, 20 nt, Staphylococcus aureus subsp. aureus Mu50
uaaaucacgauuuucaagua

SEQ ID NO: 2049394 - RNA, 21 nt, Staphylococcus aureus subsp. aureus Mu50
uaaaucacauaugauaauuaa

SEQ ID NO: 2049395 - RNA, 14 nt, Staphylococcus aureus subsp. aureus Mu50
uaaaucaccaacaa

SEQ ID NO: 2049396 - RNA, 12 nt, Staphylococcus aureus subsp. aureus Mu50
uaaaucaaagag

SEQ ID NO: 2049397 - RNA, 22 nt, Staphylococcus aureus subsp. aureus Mu50
uaaaucaaagggcuucgauuca

SEQ ID NO: 2049398 - RNA, 14 nt, Staphylococcus aureus subsp. aureus Mu50
uaaaucaaagcuau

SEQ ID NO: 2049399 - RNA, 16 nt, Staphylococcus aureus subsp. aureus Mu50
uaaauauuuuuaauua

SEQ ID NO: 2049400 - RNA, 16 nt, Staphylococcus aureus subsp. aureus Mu50
uaaauauuaaauucau

SEQ ID NO: 2049401 - RNA, 19 nt, Staphylococcus aureus subsp. aureus Mu50
uaaauaucgacaaauuaaa

SEQ ID NO: 2049402 - RNA, 20 nt, Staphylococcus aureus subsp. aureus Mu50
uaaauaucuuaguauguuca

SEQ ID NO: 2049403 - RNA, 21 nt, Staphylococcus aureus subsp. aureus Mu50
uaaauaugacgcgugaauuaa

SEQ ID NO: 2049404 - RNA, 13 nt, Staphylococcus aureus subsp. aureus Mu50
uaaauaugaaucu

SEQ ID NO: 2049405 - RNA, 18 nt, Staphylococcus aureus subsp. aureus Mu50
uaaauaugaaucuagaau

SEQ ID NO: 2049406 - RNA, 19 nt, Staphylococcus aureus subsp. aureus Mu50
uaaauaugauguuaaaaaa

SEQ ID NO: 2049407 - RNA, 21 nt, Staphylococcus aureus subsp. aureus Mu50
uaaaugacuucacauuuaucc

SEQ ID NO: 2049408 - RNA, 20 nt, Staphylococcus aureus subsp. aureus Mu50
uaaaugaauugucuuaauau

SEQ ID NO: 2049409 - RNA, 18 nt, Staphylococcus aureus subsp. aureus Mu50
uaaaugaccuuuacgcca

SEQ ID NO: 2049410 - RNA, 15 nt, Staphylococcus aureus subsp. aureus Mu50
uaaaugacauuuaau

SEQ ID NO: 2049411 - RNA, 20 nt, Staphylococcus aureus subsp. aureus Mu50
uaaaucuuuaacuucugauu

SEQ ID NO: 2049412 - RNA, 20 nt, Staphylococcus aureus subsp. aureus Mu50
uaaaucuuuuacuaaaugaa

SEQ ID NO: 2049413 - RNA, 18 nt, Staphylococcus aureus subsp. aureus Mu50
uaaaucuucuauuuucau

SEQ ID NO: 2049414 - RNA, 22 nt, Staphylococcus aureus subsp. aureus Mu50
uaaaugaaaguaccuaaaauag

SEQ ID NO: 2049415 - RNA, 17 nt, Staphylococcus aureus subsp. aureus Mu50
uaaaugaauuauuuaaa

SEQ ID NO: 2049416 - RNA, 16 nt, Staphylococcus aureus subsp. aureus Mu50
uaaaugaauuauuuaa

SEQ ID NO: 2049417 - RNA, 16 nt, Staphylococcus aureus subsp. aureus Mu50
uaaauguuuauaucuu

SEQ ID NO: 2049418 - RNA, 18 nt, Staphylococcus aureus subsp. aureus Mu50
uaaauguuuuauguauuu

SEQ ID NO: 2049419 - RNA, 22 nt, Staphylococcus aureus subsp. aureus Mu50
uaaauguuuuauguauuuauuu

SEQ ID NO: 2049420 - RNA, 21 nt, Staphylococcus aureus subsp. aureus Mu50
uaaaugcuucugguucuucaa

SEQ ID NO: 2049421 - RNA, 23 nt, Staphylococcus aureus subsp. aureus Mu50
uaaauaauguugucacuuggauu

SEQ ID NO: 2049422 - RNA, 20 nt, Staphylococcus aureus subsp. aureus Mu50
uaaauaaugauaaauuaaag

SEQ ID NO: 2049423 - RNA, 18 nt, Staphylococcus aureus subsp. aureus Mu50
uaaauaaugcauggaaaa

SEQ ID NO: 2049424 - RNA, 19 nt, Staphylococcus aureus subsp. aureus Mu50
uaaauaaucgaagauagag

SEQ ID NO: 2049425 - RNA, 16 nt, Staphylococcus aureus subsp. aureus Mu50
uaaauaaauucucuaa

SEQ ID NO: 2049426 - RNA, 13 nt, Staphylococcus aureus subsp. aureus Mu50
uaaauaaaugacu

SEQ ID NO: 2049427 - RNA, 17 nt, Staphylococcus aureus subsp. aureus Mu50
uaaauacaaaaauauag

SEQ ID NO: 2049428 - RNA, 20 nt, Staphylococcus aureus subsp. aureus Mu50
uaaauacaaagccuuaauau

SEQ ID NO: 2049429 - RNA, 17 nt, Staphylococcus aureus subsp. aureus Mu50
uaaauacaauuucuuca

SEQ ID NO: 2049430 - RNA, 22 nt, Staphylococcus aureus subsp. aureus Mu50
uaaauacaaagccuuaauauca

SEQ ID NO: 2049431 - RNA, 11 nt, Staphylococcus aureus subsp. aureus Mu50
uaaauacaaua

SEQ ID NO: 2049432 - RNA, 18 nt, Staphylococcus aureus subsp. aureus Mu50
uaaauagauaauauauag

SEQ ID NO: 2049433 - RNA, 19 nt, Staphylococcus aureus subsp. aureus Mu50
uaaauagcuucuuaaauca

SEQ ID NO: 2049434 - RNA, 15 nt, Staphylococcus aureus subsp. aureus Mu50
uaaauauaguaauaa

SEQ ID NO: 2049435 - RNA, 21 nt, Staphylococcus aureus subsp. aureus Mu50
uaaauagacugccaauaaaau

SEQ ID NO: 2049436 - RNA, 22 nt, Staphylococcus aureus subsp. aureus Mu50
uaaauauauaaggcgcucucuu

SEQ ID NO: 2049437 - RNA, 16 nt, Staphylococcus aureus subsp. aureus Mu50
uaaauaucauaaaugc

SEQ ID NO: 2049438 - RNA, 21 nt, Staphylococcus aureus subsp. aureus Mu50
uaaauaucauaccguacaaag

SEQ ID NO: 2049439 - RNA, 23 nt, Staphylococcus aureus subsp. aureus Mu50
uaaauaaacucaccaaguucacu

SEQ ID NO: 2049440 - RNA, 16 nt, Staphylococcus aureus subsp. aureus Mu50
uaaauaaacucaccaa

SEQ ID NO: 2049441 - RNA, 15 nt, Staphylococcus aureus subsp. aureus Mu50
uaaauaaacaacugc

SEQ ID NO: 2049442 - RNA, 11 nt, Staphylococcus aureus subsp. aureus Mu50
uaaauaaacaa

SEQ ID NO: 2049443 - RNA, 15 nt, Staphylococcus aureus subsp. aureus Mu50
uaaauaaaauuaaaa

SEQ ID NO: 2049444 - RNA, 13 nt, Staphylococcus aureus subsp. aureus Mu50
uaaauaaaaugca

SEQ ID NO: 2049445 - RNA, 14 nt, Staphylococcus aureus subsp. aureus Mu50
uaaauaaaaugcau

SEQ ID NO: 2049446 - RNA, 14 nt, Staphylococcus aureus subsp. aureus Mu50
uaaauaaaauuaaa

SEQ ID NO: 2049447 - RNA, 21 nt, Staphylococcus aureus subsp. aureus Mu50
uaaaguuuugaaccuaaauuc

SEQ ID NO: 2049448 - RNA, 18 nt, Staphylococcus aureus subsp. aureus Mu50
uaaauaaaaggcauucuu

SEQ ID NO: 2049449 - RNA, 23 nt, Staphylococcus aureus subsp. aureus Mu50
uaaauaaaaguuaccuacuacau

SEQ ID NO: 2049450 - RNA, 15 nt, Staphylococcus aureus subsp. aureus Mu50
uaaauaaaaguucaa

SEQ ID NO: 2049451 - RNA, 23 nt, Staphylococcus aureus subsp. aureus Mu50
uaaaguuuauuuauguucgauua

SEQ ID NO: 2049452 - RNA, 15 nt, Staphylococcus aureus subsp. aureus Mu50
uaaaguuuaaauauu

SEQ ID NO: 2049453 - RNA, 13 nt, Staphylococcus aureus subsp. aureus Mu50
uaaagaauuaagu

SEQ ID NO: 2049454 - RNA, 15 nt, Staphylococcus aureus subsp. aureus Mu50
uaaacuuuaugaaau

SEQ ID NO: 2049455 - RNA, 16 nt, Staphylococcus aureus subsp. aureus Mu50
uaaacuucuauuaaua

SEQ ID NO: 2049456 - RNA, 12 nt, Staphylococcus aureus subsp. aureus Mu50
uaaacuucuuuu

SEQ ID NO: 2049457 - RNA, 20 nt, Staphylococcus aureus subsp. aureus Mu50
uaaacuuuucuucaaguugu

SEQ ID NO: 2049458 - RNA, 21 nt, Staphylococcus aureus subsp. aureus Mu50
uaaacuuuucuucaaguuguu

SEQ ID NO: 2049459 - RNA, 21 nt, Staphylococcus aureus subsp. aureus Mu50
uaaagcguucucuaauuucac

SEQ ID NO: 2049460 - RNA, 19 nt, Staphylococcus aureus subsp. aureus Mu50
uaaagccaccuaaaucucc

SEQ ID NO: 2049461 - RNA, 21 nt, Staphylococcus aureus subsp. aureus Mu50
uaaaccaaaucggaauaaaau

SEQ ID NO: 2049462 - RNA, 18 nt, Staphylococcus aureus subsp. aureus Mu50
uaaaccagcuaaaccauc

SEQ ID NO: 2049463 - RNA, 17 nt, Staphylococcus aureus subsp. aureus Mu50
uaaaccggcacuuauuu

SEQ ID NO: 2049464 - RNA, 19 nt, Staphylococcus aureus subsp. aureus Mu50
uaaaccagcugauuccauu

SEQ ID NO: 2049465 - RNA, 17 nt, Staphylococcus aureus subsp. aureus Mu50
uaaaaucucauaauaau

SEQ ID NO: 2049466 - RNA, 20 nt, Staphylococcus aureus subsp. aureus Mu50
uaaaauccaagugcuaagag

SEQ ID NO: 2049467 - RNA, 13 nt, Staphylococcus aureus subsp. aureus Mu50
uaaaaucucauaa

SEQ ID NO: 2049468 - RNA, 17 nt, Staphylococcus aureus subsp. aureus Mu50
uaaaaucugcuuuauuu

SEQ ID NO: 2049469 - RNA, 20 nt, Staphylococcus aureus subsp. aureus Mu50
uaaaaucugcuuuauuuuau

SEQ ID NO: 2049470 - RNA, 15 nt, Staphylococcus aureus subsp. aureus Mu50
uaaaaugaauaguag

SEQ ID NO: 2049471 - RNA, 19 nt, Staphylococcus aureus subsp. aureus Mu50
uaaacauuuuugaauuuaa

SEQ ID NO: 2049472 - RNA, 14 nt, Staphylococcus aureus subsp. aureus Mu50
uaaacauuuagauu

SEQ ID NO: 2049473 - RNA, 20 nt, Staphylococcus aureus subsp. aureus Mu50
uaaaaugauagcuaaacauu

SEQ ID NO: 2049474 - RNA, 15 nt, Staphylococcus aureus subsp. aureus Mu50
uaaaaugauaucuau

SEQ ID NO: 2049475 - RNA, 17 nt, Staphylococcus aureus subsp. aureus Mu50
uaaaaugauuguuuuaa

SEQ ID NO: 2049476 - RNA, 14 nt, Staphylococcus aureus subsp. aureus Mu50
uaaacauugcuuaa

SEQ ID NO: 2049477 - RNA, 14 nt, Staphylococcus aureus subsp. aureus Mu50
uaaaccucaacauu

SEQ ID NO: 2049478 - RNA, 18 nt, Staphylococcus aureus subsp. aureus Mu50
uaaaccucuaaauaaaau

SEQ ID NO: 2049479 - RNA, 22 nt, Staphylococcus aureus subsp. aureus Mu50
uaaaccucuaaauaaaauuaaa

SEQ ID NO: 2049480 - RNA, 21 nt, Staphylococcus aureus subsp. aureus Mu50
uaaacgcaauacgaauaucug

SEQ ID NO: 2049481 - RNA, 23 nt, Staphylococcus aureus subsp. aureus Mu50
uaaauuuugcgaaaauaucauuu

SEQ ID NO: 2049482 - RNA, 20 nt, Staphylococcus aureus subsp. aureus Mu50
uaacaaaauuaagaagaaau

SEQ ID NO: 2049483 - RNA, 21 nt, Staphylococcus aureus subsp. aureus Mu50
uaacaaaauuaagaagaaaua

SEQ ID NO: 2049484 - RNA, 12 nt, Staphylococcus aureus subsp. aureus Mu50
uaaauuuucauc

SEQ ID NO: 2049485 - RNA, 20 nt, Staphylococcus aureus subsp. aureus Mu50
uaaauuuucaucauaaucug

SEQ ID NO: 2049486 - RNA, 17 nt, Staphylococcus aureus subsp. aureus Mu50
uaaauuuugaauuacag

SEQ ID NO: 2049487 - RNA, 20 nt, Staphylococcus aureus subsp. aureus Mu50
uaaauuuucuguuuaauuaa

SEQ ID NO: 2049488 - RNA, 18 nt, Staphylococcus aureus subsp. aureus Mu50
uaaauuuuacgaaaauau

SEQ ID NO: 2049489 - RNA, 20 nt, Staphylococcus aureus subsp. aureus Mu50
uaaauuuuacgaaaauauca

SEQ ID NO: 2049490 - RNA, 18 nt, Staphylococcus aureus subsp. aureus Mu50
uaaauuuuaucuaaacau

SEQ ID NO: 2049491 - RNA, 20 nt, Staphylococcus aureus subsp. aureus Mu50
uaaauuuuaucuaaacauuu

SEQ ID NO: 2049492 - RNA, 16 nt, Staphylococcus aureus subsp. aureus Mu50
uaaauuuauuuuuaau

SEQ ID NO: 2049493 - RNA, 17 nt, Staphylococcus aureus subsp. aureus Mu50
uaaauuuauuuuuaauu

SEQ ID NO: 2049494 - RNA, 19 nt, Staphylococcus aureus subsp. aureus Mu50
uaaauuuagauauuauaaa

SEQ ID NO: 2049495 - RNA, 23 nt, Staphylococcus aureus subsp. aureus Mu50
uaaauuuaacucaacuuaaauau

SEQ ID NO: 2049496 - RNA, 22 nt, Staphylococcus aureus subsp. aureus Mu50
uaaauuucgauuaauugaaugc

SEQ ID NO: 2049497 - RNA, 17 nt, Staphylococcus aureus subsp. aureus Mu50
uaaauuucugaacauaa

SEQ ID NO: 2049498 - RNA, 14 nt, Staphylococcus aureus subsp. aureus Mu50
uaaauuugaaagua

SEQ ID NO: 2049499 - RNA, 14 nt, Staphylococcus aureus subsp. aureus Mu50
uaaauuucuucaua

SEQ ID NO: 2049500 - RNA, 17 nt, Staphylococcus aureus subsp. aureus Mu50
uaacaauuuuaaaucuu

SEQ ID NO: 2049501 - RNA, 17 nt, Staphylococcus aureus subsp. aureus Mu50
uaacaauuuauuaaaac

SEQ ID NO: 2049502 - RNA, 13 nt, Staphylococcus aureus subsp. aureus Mu50
uaacaauuuuaaa

SEQ ID NO: 2049503 - RNA, 19 nt, Staphylococcus aureus subsp. aureus Mu50
uaacaccaauuaaaucgau

SEQ ID NO: 2049504 - RNA, 23 nt, Staphylococcus aureus subsp. aureus Mu50
uaacaaacauuaaucuauauaaa

SEQ ID NO: 2049505 - RNA, 22 nt, Staphylococcus aureus subsp. aureus Mu50
uaaauucccauguauucuuaga

SEQ ID NO: 2049506 - RNA, 20 nt, Staphylococcus aureus subsp. aureus Mu50
uaaauuccaagagaauuaau

SEQ ID NO: 2049507 - RNA, 13 nt, Staphylococcus aureus subsp. aureus Mu50
uaaauucaucuua

SEQ ID NO: 2049508 - RNA, 14 nt, Staphylococcus aureus subsp. aureus Mu50
uaaauucaucuguu

SEQ ID NO: 2049509 - RNA, 16 nt, Staphylococcus aureus subsp. aureus Mu50
uaaauuauuguuuuaa

SEQ ID NO: 2049510 - RNA, 15 nt, Staphylococcus aureus subsp. aureus Mu50
uaaauuauuuauuca

SEQ ID NO: 2049511 - RNA, 16 nt, Staphylococcus aureus subsp. aureus Mu50
uaaauucaauaaucuu

SEQ ID NO: 2049512 - RNA, 18 nt, Staphylococcus aureus subsp. aureus Mu50
uaaauuagaugaaaugga

SEQ ID NO: 2049513 - RNA, 21 nt, Staphylococcus aureus subsp. aureus Mu50
uaaauuacuugcacaccagug

SEQ ID NO: 2049514 - RNA, 14 nt, Staphylococcus aureus subsp. aureus Mu50
uaaauuauauguuu

SEQ ID NO: 2049515 - RNA, 15 nt, Staphylococcus aureus subsp. aureus Mu50
uaaauuauaaauagu

SEQ ID NO: 2049516 - RNA, 19 nt, Staphylococcus aureus subsp. aureus Mu50
uaaauuacaaaaguaugau

SEQ ID NO: 2049517 - RNA, 12 nt, Staphylococcus aureus subsp. aureus Mu50
uaaauuaauaug

SEQ ID NO: 2049518 - RNA, 13 nt, Staphylococcus aureus subsp. aureus Mu50
uaaauuaauauga

SEQ ID NO: 2049519 - RNA, 14 nt, Staphylococcus aureus subsp. aureus Mu50
uaaauuaauagaga

SEQ ID NO: 2049520 - RNA, 19 nt, Staphylococcus aureus subsp. aureus Mu50
uaaauuaauagagaaagaa

SEQ ID NO: 2049521 - RNA, 14 nt, Staphylococcus aureus subsp. aureus Mu50
uaaauuaaaucgau

SEQ ID NO: 2049522 - RNA, 19 nt, Staphylococcus aureus subsp. aureus Mu50
uaaauucuuauaaaauaaa

SEQ ID NO: 2049523 - RNA, 23 nt, Staphylococcus aureus subsp. aureus Mu50
uaaauugacucaaagauauacuu

SEQ ID NO: 2049524 - RNA, 16 nt, Staphylococcus aureus subsp. aureus Mu50
uaaauucuaaaacgga

SEQ ID NO: 2049525 - RNA, 20 nt, Staphylococcus aureus subsp. aureus Mu50
uaaauugcuugaaauuauua

SEQ ID NO: 2049526 - RNA, 19 nt, Staphylococcus aureus subsp. aureus Mu50
uaaauuguuuacuauacuu

SEQ ID NO: 2049527 - RNA, 17 nt, Staphylococcus aureus subsp. aureus Mu50
uaaauuguuuacuauac

SEQ ID NO: 2049528 - RNA, 15 nt, Staphylococcus aureus subsp. aureus Mu50
uaaauuuaaaagaaa

SEQ ID NO: 2049529 - RNA, 14 nt, Staphylococcus aureus subsp. aureus Mu50
uaaauuuaaaauaa

SEQ ID NO: 2049530 - RNA, 13 nt, Staphylococcus aureus subsp. aureus Mu50
uaaauuuaaaugu

SEQ ID NO: 2049531 - RNA, 17 nt, Staphylococcus aureus subsp. aureus Mu50
uaaauuuaaaauaauag

SEQ ID NO: 2049532 - RNA, 15 nt, Staphylococcus aureus subsp. aureus Mu50
uaaccgcauacagau

SEQ ID NO: 2049533 - RNA, 19 nt, Staphylococcus aureus subsp. aureus Mu50
uaaccgcuucuuuuaaguu

SEQ ID NO: 2049534 - RNA, 14 nt, Staphylococcus aureus subsp. aureus Mu50
uaaccuacuuugau

SEQ ID NO: 2049535 - RNA, 16 nt, Staphylococcus aureus subsp. aureus Mu50
uaaccuauuaaaucug

SEQ ID NO: 2049536 - RNA, 21 nt, Staphylococcus aureus subsp. aureus Mu50
uaaccuaauucgccaucuuuu

SEQ ID NO: 2049537 - RNA, 22 nt, Staphylococcus aureus subsp. aureus Mu50
uaacgaaaaagaugguuuuguu

SEQ ID NO: 2049538 - RNA, 17 nt, Staphylococcus aureus subsp. aureus Mu50
uaacgacccaaauuaua

SEQ ID NO: 2049539 - RNA, 22 nt, Staphylococcus aureus subsp. aureus Mu50
uaacgauaagcacgauaaaaau

SEQ ID NO: 2049540 - RNA, 22 nt, Staphylococcus aureus subsp. aureus Mu50
uaacgagugaaaauaagauuau

SEQ ID NO: 2049541 - RNA, 20 nt, Staphylococcus aureus subsp. aureus Mu50
uaacgaugguugcuucacug

SEQ ID NO: 2049542 - RNA, 21 nt, Staphylococcus aureus subsp. aureus Mu50
uaacacauucuuauuugaaau

SEQ ID NO: 2049543 - RNA, 19 nt, Staphylococcus aureus subsp. aureus Mu50
uaacaugugcaaguauaau

SEQ ID NO: 2049544 - RNA, 21 nt, Staphylococcus aureus subsp. aureus Mu50
uaacauguauuuaguaucaug

SEQ ID NO: 2049545 - RNA, 23 nt, Staphylococcus aureus subsp. aureus Mu50
uaacauguauuuaguaucaugau

SEQ ID NO: 2049546 - RNA, 21 nt, Staphylococcus aureus subsp. aureus Mu50
uaacaucuucauguaugaagu

SEQ ID NO: 2049547 - RNA, 19 nt, Staphylococcus aureus subsp. aureus Mu50
uaacaugaccuaauauauu

SEQ ID NO: 2049548 - RNA, 22 nt, Staphylococcus aureus subsp. aureus Mu50
uaacauuucugaugcuagcuuu

SEQ ID NO: 2049549 - RNA, 15 nt, Staphylococcus aureus subsp. aureus Mu50
uaacauuuaaaaaau

SEQ ID NO: 2049550 - RNA, 19 nt, Staphylococcus aureus subsp. aureus Mu50
uaacauuuauucuuucucu

SEQ ID NO: 2049551 - RNA, 13 nt, Staphylococcus aureus subsp. aureus Mu50
uaacauuagcaug

SEQ ID NO: 2049552 - RNA, 13 nt, Staphylococcus aureus subsp. aureus Mu50
uaacauuuaaaaa

SEQ ID NO: 2049553 - RNA, 14 nt, Staphylococcus aureus subsp. aureus Mu50
uaacauuuaaaaaa

SEQ ID NO: 2049554 - RNA, 13 nt, Staphylococcus aureus subsp. aureus Mu50
uaacauuauuaaa

SEQ ID NO: 2049555 - RNA, 12 nt, Staphylococcus aureus subsp. aureus Mu50
uaacauuuugaa

SEQ ID NO: 2049556 - RNA, 20 nt, Staphylococcus aureus subsp. aureus Mu50
uaacauuuguccgauuuauu

SEQ ID NO: 2049557 - RNA, 13 nt, Staphylococcus aureus subsp. aureus Mu50
uaacauuugucau

SEQ ID NO: 2049558 - RNA, 16 nt, Staphylococcus aureus subsp. aureus Mu50
uaaccaucauaaaugu

SEQ ID NO: 2049559 - RNA, 18 nt, Staphylococcus aureus subsp. aureus Mu50
uaaccauaguaauaaaau

SEQ ID NO: 2049560 - RNA, 12 nt, Staphylococcus aureus subsp. aureus Mu50
uaaccauaguaa

SEQ ID NO: 2049561 - RNA, 14 nt, Staphylococcus aureus subsp. aureus Mu50
uaaccauguauauc

SEQ ID NO: 2049562 - RNA, 13 nt, Staphylococcus aureus subsp. aureus Mu50
uaaccauuaugau

SEQ ID NO: 2049563 - RNA, 18 nt, Staphylococcus aureus subsp. aureus Mu50
uaacccuaaaaugaauag

SEQ ID NO: 2049564 - RNA, 12 nt, Staphylococcus aureus subsp. aureus Mu50
guuuuuauuauu

SEQ ID NO: 2049565 - RNA, 21 nt, Staphylococcus aureus subsp. aureus Mu50
guuuuuagguuauauuuaaau

SEQ ID NO: 2049566 - RNA, 12 nt, Staphylococcus aureus subsp. aureus Mu50
guuuuuacuaua

SEQ ID NO: 2049567 - RNA, 14 nt, Staphylococcus aureus subsp. aureus Mu50
guuuuuaaauaauc

SEQ ID NO: 2049568 - RNA, 14 nt, Staphylococcus aureus subsp. aureus Mu50
guuuuucuuuaaac

SEQ ID NO: 2049569 - RNA, 18 nt, Staphylococcus aureus subsp. aureus Mu50
guuuuuguggaaaauuga

SEQ ID NO: 2049570 - RNA, 14 nt, Staphylococcus aureus subsp. aureus Mu50
guuuugaaccuaaa

SEQ ID NO: 2049571 - RNA, 12 nt, Staphylococcus aureus subsp. aureus Mu50
guuuugagagau

SEQ ID NO: 2049572 - RNA, 21 nt, Staphylococcus aureus subsp. aureus Mu50
guuuucuuuauuuuaaacaug

SEQ ID NO: 2049573 - RNA, 12 nt, Staphylococcus aureus subsp. aureus Mu50
guuuucuuuuca

SEQ ID NO: 2049574 - RNA, 17 nt, Staphylococcus aureus subsp. aureus Mu50
guuuuggucaaguaaau

SEQ ID NO: 2049575 - RNA, 14 nt, Staphylococcus aureus subsp. aureus Mu50
guuuuguagauaua

SEQ ID NO: 2049576 - RNA, 20 nt, Staphylococcus aureus subsp. aureus Mu50
guuuuguagauauagcaucu

SEQ ID NO: 2049577 - RNA, 17 nt, Staphylococcus aureus subsp. aureus Mu50
uaaaaaacgauaguagu

SEQ ID NO: 2049578 - RNA, 20 nt, Staphylococcus aureus subsp. aureus Mu50
uaaaaaaccugaaacaaauu

SEQ ID NO: 2049579 - RNA, 17 nt, Staphylococcus aureus subsp. aureus Mu50
uaaaaaacaauaaaauu

SEQ ID NO: 2049580 - RNA, 14 nt, Staphylococcus aureus subsp. aureus Mu50
uaaaaaacaauagg

SEQ ID NO: 2049581 - RNA, 21 nt, Staphylococcus aureus subsp. aureus Mu50
uaaaaaacagcaguaagauau

SEQ ID NO: 2049582 - RNA, 17 nt, Staphylococcus aureus subsp. aureus Mu50
uaaaaaaccaauaaucc

SEQ ID NO: 2049583 - RNA, 15 nt, Staphylococcus aureus subsp. aureus Mu50
uaaaaaaauuaaaau

SEQ ID NO: 2049584 - RNA, 13 nt, Staphylococcus aureus subsp. aureus Mu50
uaaaaaauuaaaa

SEQ ID NO: 2049585 - RNA, 22 nt, Staphylococcus aureus subsp. aureus Mu50
uaaaaaaugcacugagcaacaa

SEQ ID NO: 2049586 - RNA, 13 nt, Staphylococcus aureus subsp. aureus Mu50
uaaaaaaugaaug

SEQ ID NO: 2049587 - RNA, 23 nt, Staphylococcus aureus subsp. aureus Mu50
uaaaaaauccggaacauuaaaag

SEQ ID NO: 2049588 - RNA, 20 nt, Staphylococcus aureus subsp. aureus Mu50
uaaaaaaucaguuuuuaaau

SEQ ID NO: 2049589 - RNA, 19 nt, Staphylococcus aureus subsp. aureus Mu50
uaaaaaaguugauuaaaag

SEQ ID NO: 2049590 - RNA, 14 nt, Staphylococcus aureus subsp. aureus Mu50
uaaaaaaaaccacg

SEQ ID NO: 2049591 - RNA, 20 nt, Staphylococcus aureus subsp. aureus Mu50
uaaaaaaaucccucaauccg

SEQ ID NO: 2049592 - RNA, 21 nt, Staphylococcus aureus subsp. aureus Mu50
guuuuuucauuguaauaauaa

SEQ ID NO: 2049593 - RNA, 22 nt, Staphylococcus aureus subsp. aureus Mu50
guuuuuuuagcuauagaaauga

SEQ ID NO: 2049594 - RNA, 21 nt, Staphylococcus aureus subsp. aureus Mu50
guuuuuugauuaguaaauaua

SEQ ID NO: 2049595 - RNA, 14 nt, Staphylococcus aureus subsp. aureus Mu50
uaaaagcaaaggcg

SEQ ID NO: 2049596 - RNA, 19 nt, Staphylococcus aureus subsp. aureus Mu50
uaaaagcaugauacucaau

SEQ ID NO: 2049597 - RNA, 18 nt, Staphylococcus aureus subsp. aureus Mu50
uaaaagccaacacauaaa

SEQ ID NO: 2049598 - RNA, 23 nt, Staphylococcus aureus subsp. aureus Mu50
uaaaagccucuaaugauuaaaaa

SEQ ID NO: 2049599 - RNA, 17 nt, Staphylococcus aureus subsp. aureus Mu50
uaaaaguacuuuaaaau

SEQ ID NO: 2049600 - RNA, 17 nt, Staphylococcus aureus subsp. aureus Mu50
uaaaaguuguaauuuaa

SEQ ID NO: 2049601 - RNA, 19 nt, Staphylococcus aureus subsp. aureus Mu50
uaaaaguuguaauuuaaaa

SEQ ID NO: 2049602 - RNA, 12 nt, Staphylococcus aureus subsp. aureus Mu50
uaaaauaaaaaa

SEQ ID NO: 2049603 - RNA, 15 nt, Staphylococcus aureus subsp. aureus Mu50
uaaaaguuguauucu

SEQ ID NO: 2049604 - RNA, 18 nt, Staphylococcus aureus subsp. aureus Mu50
uaaaaguuucccaagcau

SEQ ID NO: 2049605 - RNA, 21 nt, Staphylococcus aureus subsp. aureus Mu50
uaaaaucacuugguaaaacau

SEQ ID NO: 2049606 - RNA, 23 nt, Staphylococcus aureus subsp. aureus Mu50
uaaaaucauuaauaauuaaacaa

SEQ ID NO: 2049607 - RNA, 15 nt, Staphylococcus aureus subsp. aureus Mu50
uaaaaucaucguauu

SEQ ID NO: 2049608 - RNA, 15 nt, Staphylococcus aureus subsp. aureus Mu50
uaaaauaguucuuua

SEQ ID NO: 2049609 - RNA, 21 nt, Staphylococcus aureus subsp. aureus Mu50
uaaaauacgguacagauagga

SEQ ID NO: 2049610 - RNA, 13 nt, Staphylococcus aureus subsp. aureus Mu50
uaaaauagaaaaa

SEQ ID NO: 2049611 - RNA, 17 nt, Staphylococcus aureus subsp. aureus Mu50
uaaaauagaaaaauuuc

SEQ ID NO: 2049612 - RNA, 19 nt, Staphylococcus aureus subsp. aureus Mu50
uaaaauagaaaaauuucaa

SEQ ID NO: 2049613 - RNA, 17 nt, Staphylococcus aureus subsp. aureus Mu50
uaaaauagaguagacgu

SEQ ID NO: 2049614 - RNA, 15 nt, Staphylococcus aureus subsp. aureus Mu50
uaaaauagcugcaau

SEQ ID NO: 2049615 - RNA, 20 nt, Staphylococcus aureus subsp. aureus Mu50
uaaaauaaaaugguucucca

SEQ ID NO: 2049616 - RNA, 13 nt, Staphylococcus aureus subsp. aureus Mu50
uaaaauaaaauua

SEQ ID NO: 2049617 - RNA, 14 nt, Staphylococcus aureus subsp. aureus Mu50
uaaaauaaaauuaa

SEQ ID NO: 2049618 - RNA, 14 nt, Staphylococcus aureus subsp. aureus Mu50
uaaaaaucaaagag

SEQ ID NO: 2049619 - RNA, 18 nt, Staphylococcus aureus subsp. aureus Mu50
uaaaaaucaaagaggcac

SEQ ID NO: 2049620 - RNA, 15 nt, Staphylococcus aureus subsp. aureus Mu50
uaaaaauauugaaua

SEQ ID NO: 2049621 - RNA, 14 nt, Staphylococcus aureus subsp. aureus Mu50
uaaaaaucauaaau

SEQ ID NO: 2049622 - RNA, 19 nt, Staphylococcus aureus subsp. aureus Mu50
uaaaaaucauaaauaacac

SEQ ID NO: 2049623 - RNA, 19 nt, Staphylococcus aureus subsp. aureus Mu50
uaaaaauccacacauuaag

SEQ ID NO: 2049624 - RNA, 15 nt, Staphylococcus aureus subsp. aureus Mu50
uaaaacaaugauuaa

SEQ ID NO: 2049625 - RNA, 15 nt, Staphylococcus aureus subsp. aureus Mu50
uaaaaaucucaaaau

SEQ ID NO: 2049626 - RNA, 16 nt, Staphylococcus aureus subsp. aureus Mu50
uaaaaaucucaaaauu

SEQ ID NO: 2049627 - RNA, 20 nt, Staphylococcus aureus subsp. aureus Mu50
uaaaacagaauuucaucaaa

SEQ ID NO: 2049628 - RNA, 18 nt, Staphylococcus aureus subsp. aureus Mu50
uaaaacagcaaauaaaau

SEQ ID NO: 2049629 - RNA, 13 nt, Staphylococcus aureus subsp. aureus Mu50
uaaaaaauuuaau

SEQ ID NO: 2049630 - RNA, 19 nt, Staphylococcus aureus subsp. aureus Mu50
uaaaaacaauauugacuuu

SEQ ID NO: 2049631 - RNA, 15 nt, Staphylococcus aureus subsp. aureus Mu50
uaaaaacaaaagaaa

SEQ ID NO: 2049632 - RNA, 13 nt, Staphylococcus aureus subsp. aureus Mu50
uaaaaaauuuaaa

SEQ ID NO: 2049633 - RNA, 12 nt, Staphylococcus aureus subsp. aureus Mu50
uaaaaaauuauu

SEQ ID NO: 2049634 - RNA, 13 nt, Staphylococcus aureus subsp. aureus Mu50
uaaaaaauuauua

SEQ ID NO: 2049635 - RNA, 19 nt, Staphylococcus aureus subsp. aureus Mu50
uaaaacgaaguuauuuauu

SEQ ID NO: 2049636 - RNA, 16 nt, Staphylococcus aureus subsp. aureus Mu50
uaaaacgauaauaaua

SEQ ID NO: 2049637 - RNA, 13 nt, Staphylococcus aureus subsp. aureus Mu50
uaaaacuuacauu

SEQ ID NO: 2049638 - RNA, 13 nt, Staphylococcus aureus subsp. aureus Mu50
uaaaacuuuuuca

SEQ ID NO: 2049639 - RNA, 21 nt, Staphylococcus aureus subsp. aureus Mu50
uaaaacuuguuguuauuuauu

SEQ ID NO: 2049640 - RNA, 20 nt, Staphylococcus aureus subsp. aureus Mu50
uaaaacuuguuguuauuuau

SEQ ID NO: 2049641 - RNA, 21 nt, Staphylococcus aureus subsp. aureus Mu50
uaaaacauucccuuaauaaua

SEQ ID NO: 2049642 - RNA, 22 nt, Staphylococcus aureus subsp. aureus Mu50
uaaaacauucccuuaauaauaa

SEQ ID NO: 2049643 - RNA, 23 nt, Staphylococcus aureus subsp. aureus Mu50
uaaaaccuuacccaaaaaauugu

SEQ ID NO: 2049644 - RNA, 14 nt, Staphylococcus aureus subsp. aureus Mu50
uaaaaccuucaauc

SEQ ID NO: 2049645 - RNA, 20 nt, Staphylococcus aureus subsp. aureus Mu50
uaaaacgacucauuauaaau

SEQ ID NO: 2049646 - RNA, 22 nt, Staphylococcus aureus subsp. aureus Mu50
uaaaacgacucauuauaaauga

SEQ ID NO: 2049647 - RNA, 23 nt, Staphylococcus aureus subsp. aureus Mu50
guuuuauggcgguuugaaaauga

SEQ ID NO: 2049648 - RNA, 16 nt, Staphylococcus aureus subsp. aureus Mu50
guuuuauguauuuauu

SEQ ID NO: 2049649 - RNA, 12 nt, Staphylococcus aureus subsp. aureus Mu50
guuuuauucaau

SEQ ID NO: 2049650 - RNA, 18 nt, Staphylococcus aureus subsp. aureus Mu50
guuuuauucgauaauaua

SEQ ID NO: 2049651 - RNA, 19 nt, Staphylococcus aureus subsp. aureus Mu50
guuuuauucgauaauauaa

SEQ ID NO: 2049652 - RNA, 19 nt, Staphylococcus aureus subsp. aureus Mu50
guuuuacuauaaugaugua

SEQ ID NO: 2049653 - RNA, 22 nt, Staphylococcus aureus subsp. aureus Mu50
guuuuacuacugucucaucuuc

SEQ ID NO: 2049654 - RNA, 20 nt, Staphylococcus aureus subsp. aureus Mu50
guuuuaccauaaauugaagu

SEQ ID NO: 2049655 - RNA, 17 nt, Staphylococcus aureus subsp. aureus Mu50
guuuuaaagguuaaaua

SEQ ID NO: 2049656 - RNA, 12 nt, Staphylococcus aureus subsp. aureus Mu50
guuuuaaaagua

SEQ ID NO: 2049657 - RNA, 22 nt, Staphylococcus aureus subsp. aureus Mu50
guuuucacuguuuuaucuacag

SEQ ID NO: 2049658 - RNA, 20 nt, Staphylococcus aureus subsp. aureus Mu50
guuuuauuuuuaucaucaug

SEQ ID NO: 2049659 - RNA, 15 nt, Staphylococcus aureus subsp. aureus Mu50
guuuucaguaacuga

SEQ ID NO: 2049660 - RNA, 16 nt, Staphylococcus aureus subsp. aureus Mu50
guuuucauuuuuucaa

SEQ ID NO: 2049661 - RNA, 15 nt, Staphylococcus aureus subsp. aureus Mu50
guuuuccaugaguuu

SEQ ID NO: 2049662 - RNA, 16 nt, Staphylococcus aureus subsp. aureus Mu50
guuuucuaauuguuuu

SEQ ID NO: 2049663 - RNA, 10 nt, Staphylococcus aureus subsp. aureus Mu50
guuuucuagu

SEQ ID NO: 2049664 - RNA, 17 nt, Staphylococcus aureus subsp. aureus Mu50
guuuguuuauugagaau

SEQ ID NO: 2049665 - RNA, 17 nt, Staphylococcus aureus subsp. aureus Mu50
guuuggcauaauaauau

SEQ ID NO: 2049666 - RNA, 15 nt, Staphylococcus aureus subsp. aureus Mu50
guuuggauaaaauga

SEQ ID NO: 2049667 - RNA, 13 nt, Staphylococcus aureus subsp. aureus Mu50
guuugcuuuaaaa

SEQ ID NO: 2049668 - RNA, 20 nt, Staphylococcus aureus subsp. aureus Mu50
guuucuggcucuucuuaucu

SEQ ID NO: 2049669 - RNA, 14 nt, Staphylococcus aureus subsp. aureus Mu50
guuucuuaacauaa

SEQ ID NO: 2049670 - RNA, 17 nt, Staphylococcus aureus subsp. aureus Mu50
guuucuuccgcacugcc

SEQ ID NO: 2049671 - RNA, 21 nt, Staphylococcus aureus subsp. aureus Mu50
guucuucaucuuuuauggugg

SEQ ID NO: 2049672 - RNA, 15 nt, Staphylococcus aureus subsp. aureus Mu50
guuuaaguuuuucag

SEQ ID NO: 2049673 - RNA, 17 nt, Staphylococcus aureus subsp. aureus Mu50
guuuaaucgcauuguua

SEQ ID NO: 2049674 - RNA, 17 nt, Staphylococcus aureus subsp. aureus Mu50
guuuacuauuaaaggaa

SEQ ID NO: 2049675 - RNA, 15 nt, Staphylococcus aureus subsp. aureus Mu50
guuuacuauacuuug

SEQ ID NO: 2049676 - RNA, 17 nt, Staphylococcus aureus subsp. aureus Mu50
guuguucccauuuuuaa

SEQ ID NO: 2049677 - RNA, 19 nt, Staphylococcus aureus subsp. aureus Mu50
guuuauugaggauaauuau

SEQ ID NO: 2049678 - RNA, 23 nt, Staphylococcus aureus subsp. aureus Mu50
guuuagaaaaguaaguaaaauaa

SEQ ID NO: 2049679 - RNA, 14 nt, Staphylococcus aureus subsp. aureus Mu50
guuuagauagcucu

SEQ ID NO: 2049680 - RNA, 20 nt, Staphylococcus aureus subsp. aureus Mu50
guuucaaacgugauuuuauc

SEQ ID NO: 2049681 - RNA, 20 nt, Staphylococcus aureus subsp. aureus Mu50
guuucaaucgcauuuuguuu

SEQ ID NO: 2049682 - RNA, 13 nt, Staphylococcus aureus subsp. aureus Mu50
guuucgucagauu

SEQ ID NO: 2049683 - RNA, 21 nt, Staphylococcus aureus subsp. aureus Mu50
guuucuaaauucuuuuuguuc

SEQ ID NO: 2049684 - RNA, 17 nt, Staphylococcus aureus subsp. aureus Mu50
guuucuaaauucuuuuu

SEQ ID NO: 2049685 - RNA, 19 nt, Staphylococcus aureus subsp. aureus Mu50
guuucauauggugaacugu

SEQ ID NO: 2049686 - RNA, 21 nt, Staphylococcus aureus subsp. aureus Mu50
guuucaugcacuuuaacauaa

SEQ ID NO: 2049687 - RNA, 14 nt, Staphylococcus aureus subsp. aureus Mu50
ucaaaaagacagca

SEQ ID NO: 2049688 - RNA, 22 nt, Staphylococcus aureus subsp. aureus Mu50
ucaaaaauaauuaugaaaagua

SEQ ID NO: 2049689 - RNA, 23 nt, Staphylococcus aureus subsp. aureus Mu50
ucaaaaauagcguaauuauuaua

SEQ ID NO: 2049690 - RNA, 12 nt, Staphylococcus aureus subsp. aureus Mu50
uauuuuuuucuu

SEQ ID NO: 2049691 - RNA, 13 nt, Staphylococcus aureus subsp. aureus Mu50
uauuuuuuuaugc

SEQ ID NO: 2049692 - RNA, 17 nt, Staphylococcus aureus subsp. aureus Mu50
ucaaaagcguucaauuu

SEQ ID NO: 2049693 - RNA, 12 nt, Staphylococcus aureus subsp. aureus Mu50
ucaaaacugcca

SEQ ID NO: 2049694 - RNA, 12 nt, Staphylococcus aureus subsp. aureus Mu50
ucaaaaaucaua

SEQ ID NO: 2049695 - RNA, 18 nt, Staphylococcus aureus subsp. aureus Mu50
ucaaaacguuuaauugca

SEQ ID NO: 2049696 - RNA, 17 nt, Staphylococcus aureus subsp. aureus Mu50
ucaaaaccgcuauaaaa

SEQ ID NO: 2049697 - RNA, 15 nt, Staphylococcus aureus subsp. aureus Mu50
ucaaaacaauuuaaa

SEQ ID NO: 2049698 - RNA, 13 nt, Staphylococcus aureus subsp. aureus Mu50
uauuuuuaucauc

SEQ ID NO: 2049699 - RNA, 15 nt, Staphylococcus aureus subsp. aureus Mu50
uauuuuuaucaucau

SEQ ID NO: 2049700 - RNA, 14 nt, Staphylococcus aureus subsp. aureus Mu50
uauuuuguauuuuu

SEQ ID NO: 2049701 - RNA, 17 nt, Staphylococcus aureus subsp. aureus Mu50
uauuuuuuauguuuuaa

SEQ ID NO: 2049702 - RNA, 19 nt, Staphylococcus aureus subsp. aureus Mu50
uauuuuuugagcacuuaau

SEQ ID NO: 2049703 - RNA, 11 nt, Staphylococcus aureus subsp. aureus Mu50
uauuuuucuuu

SEQ ID NO: 2049704 - RNA, 17 nt, Staphylococcus aureus subsp. aureus Mu50
uauuuuugauuuaauaa

SEQ ID NO: 2049705 - RNA, 14 nt, Staphylococcus aureus subsp. aureus Mu50
uauuuuuuaaaugc

SEQ ID NO: 2049706 - RNA, 13 nt, Staphylococcus aureus subsp. aureus Mu50
uauuuuuuaaaau

SEQ ID NO: 2049707 - RNA, 18 nt, Staphylococcus aureus subsp. aureus Mu50
uauuuucugccauaaaca

SEQ ID NO: 2049708 - RNA, 12 nt, Staphylococcus aureus subsp. aureus Mu50
uauuuucuuaga

SEQ ID NO: 2049709 - RNA, 13 nt, Staphylococcus aureus subsp. aureus Mu50
uauuuucuugugu

SEQ ID NO: 2049710 - RNA, 20 nt, Staphylococcus aureus subsp. aureus Mu50
uauuuucuuuuucuaaauaa

SEQ ID NO: 2049711 - RNA, 21 nt, Staphylococcus aureus subsp. aureus Mu50
uauuuucuuuuucuaaauaaa

SEQ ID NO: 2049712 - RNA, 12 nt, Staphylococcus aureus subsp. aureus Mu50
uauuuuguaguu

SEQ ID NO: 2049713 - RNA, 15 nt, Staphylococcus aureus subsp. aureus Mu50
uauuuugcaauugca

SEQ ID NO: 2049714 - RNA, 20 nt, Staphylococcus aureus subsp. aureus Mu50
uauuuugcaauugcaaugaa

SEQ ID NO: 2049715 - RNA, 17 nt, Staphylococcus aureus subsp. aureus Mu50
uauuuugcgcuucuagu

SEQ ID NO: 2049716 - RNA, 13 nt, Staphylococcus aureus subsp. aureus Mu50
uauuuucucuaua

SEQ ID NO: 2049717 - RNA, 17 nt, Staphylococcus aureus subsp. aureus Mu50
uauuuucucuauaauuu

SEQ ID NO: 2049718 - RNA, 13 nt, Staphylococcus aureus subsp. aureus Mu50
uauuuucauuuua

SEQ ID NO: 2049719 - RNA, 15 nt, Staphylococcus aureus subsp. aureus Mu50
uauuuucauuuuagu

SEQ ID NO: 2049720 - RNA, 21 nt, Staphylococcus aureus subsp. aureus Mu50
uauuuucaauaaauuuuauau

SEQ ID NO: 2049721 - RNA, 16 nt, Staphylococcus aureus subsp. aureus Mu50
uauuuucaauaaauuu

SEQ ID NO: 2049722 - RNA, 19 nt, Staphylococcus aureus subsp. aureus Mu50
uauuuucaauaaauuuuau

SEQ ID NO: 2049723 - RNA, 13 nt, Staphylococcus aureus subsp. aureus Mu50
ucaaaauguuuaa

SEQ ID NO: 2049724 - RNA, 20 nt, Staphylococcus aureus subsp. aureus Mu50
ucaaaauguuuaacaauaau

SEQ ID NO: 2049725 - RNA, 18 nt, Staphylococcus aureus subsp. aureus Mu50
ucaaaauguuuaacaaua

SEQ ID NO: 2049726 - RNA, 22 nt, Staphylococcus aureus subsp. aureus Mu50
ucaaaauucaauauuaaucaua

SEQ ID NO: 2049727 - RNA, 13 nt, Staphylococcus aureus subsp. aureus Mu50
ucaaacaaagggg

SEQ ID NO: 2049728 - RNA, 11 nt, Staphylococcus aureus subsp. aureus Mu50
ucaaacaacau

SEQ ID NO: 2049729 - RNA, 19 nt, Staphylococcus aureus subsp. aureus Mu50
ucaaaccaccaaaaaucau

SEQ ID NO: 2049730 - RNA, 14 nt, Staphylococcus aureus subsp. aureus Mu50
ucaaacauauucau

SEQ ID NO: 2049731 - RNA, 15 nt, Staphylococcus aureus subsp. aureus Mu50
ucaaacggaauuaaa

SEQ ID NO: 2049732 - RNA, 20 nt, Staphylococcus aureus subsp. aureus Mu50
ucaaacuuggcaaugaaauu

SEQ ID NO: 2049733 - RNA, 14 nt, Staphylococcus aureus subsp. aureus Mu50
ucaaacuuaaaacu

SEQ ID NO: 2049734 - RNA, 13 nt, Staphylococcus aureus subsp. aureus Mu50
ucaaacugauuuc

SEQ ID NO: 2049735 - RNA, 21 nt, Staphylococcus aureus subsp. aureus Mu50
ucaaacuuaaaacuauaaccu

SEQ ID NO: 2049736 - RNA, 21 nt, Staphylococcus aureus subsp. aureus Mu50
ucaaauaaaugacauuuaaua

SEQ ID NO: 2049737 - RNA, 22 nt, Staphylococcus aureus subsp. aureus Mu50
ucaaauaaaugacauuuaauac

SEQ ID NO: 2049738 - RNA, 15 nt, Staphylococcus aureus subsp. aureus Mu50
ucaaaguuuucauuu

SEQ ID NO: 2049739 - RNA, 14 nt, Staphylococcus aureus subsp. aureus Mu50
ucaaaguuuucauu

SEQ ID NO: 2049740 - RNA, 13 nt, Staphylococcus aureus subsp. aureus Mu50
ucaaaguuuaauu

SEQ ID NO: 2049741 - RNA, 20 nt, Staphylococcus aureus subsp. aureus Mu50
ucaaauagacaccaaaaaac

SEQ ID NO: 2049742 - RNA, 21 nt, Staphylococcus aureus subsp. aureus Mu50
ucaaauacguaucaagaaaaa

SEQ ID NO: 2049743 - RNA, 17 nt, Staphylococcus aureus subsp. aureus Mu50
ucaaauacauuucaaaa

SEQ ID NO: 2049744 - RNA, 22 nt, Staphylococcus aureus subsp. aureus Mu50
ucaaauaaugugaaaaaucuuc

SEQ ID NO: 2049745 - RNA, 21 nt, Staphylococcus aureus subsp. aureus Mu50
ucaaauacauuucaaaaaaag

SEQ ID NO: 2049746 - RNA, 18 nt, Staphylococcus aureus subsp. aureus Mu50
ucaaauaaugugaaaaau

SEQ ID NO: 2049747 - RNA, 21 nt, Staphylococcus aureus subsp. aureus Mu50
ucaaagcuauauaugaauuga

SEQ ID NO: 2049748 - RNA, 12 nt, Staphylococcus aureus subsp. aureus Mu50
ucaaaguagaca

SEQ ID NO: 2049749 - RNA, 17 nt, Staphylococcus aureus subsp. aureus Mu50
ucaaaguagacauugaa

SEQ ID NO: 2049750 - RNA, 19 nt, Staphylococcus aureus subsp. aureus Mu50
ucaaaguagacauugaaua

SEQ ID NO: 2049751 - RNA, 19 nt, Staphylococcus aureus subsp. aureus Mu50
ucaaagucauuuagauagc

SEQ ID NO: 2049752 - RNA, 21 nt, Staphylococcus aureus subsp. aureus Mu50
ucaaaguauauacuaaucuuc

SEQ ID NO: 2049753 - RNA, 22 nt, Staphylococcus aureus subsp. aureus Mu50
ucaaaguagacauugaauaaau

SEQ ID NO: 2049754 - RNA, 21 nt, Staphylococcus aureus subsp. aureus Mu50
ucaacaucaucuuuaauuuuc

SEQ ID NO: 2049755 - RNA, 20 nt, Staphylococcus aureus subsp. aureus Mu50
ucaacauaacucaaauaucu

SEQ ID NO: 2049756 - RNA, 16 nt, Staphylococcus aureus subsp. aureus Mu50
ucaacaguuuuaaaga

SEQ ID NO: 2049757 - RNA, 20 nt, Staphylococcus aureus subsp. aureus Mu50
ucaacaucguauucuuuuaa

SEQ ID NO: 2049758 - RNA, 16 nt, Staphylococcus aureus subsp. aureus Mu50
ucaacauuaauaaaua

SEQ ID NO: 2049759 - RNA, 18 nt, Staphylococcus aureus subsp. aureus Mu50
ucaacauuaauaaauaau

SEQ ID NO: 2049760 - RNA, 17 nt, Staphylococcus aureus subsp. aureus Mu50
ucaacccaucauguaca

SEQ ID NO: 2049761 - RNA, 20 nt, Staphylococcus aureus subsp. aureus Mu50
ucaaccauuuguucugcaga

SEQ ID NO: 2049762 - RNA, 20 nt, Staphylococcus aureus subsp. aureus Mu50
ucaacacuuucuacucugau

SEQ ID NO: 2049763 - RNA, 22 nt, Staphylococcus aureus subsp. aureus Mu50
ucaacacacacaguuuauaaua

SEQ ID NO: 2049764 - RNA, 17 nt, Staphylococcus aureus subsp. aureus Mu50
ucaacaaucuuuuucau

SEQ ID NO: 2049765 - RNA, 18 nt, Staphylococcus aureus subsp. aureus Mu50
ucaacagggguaaaacuu

SEQ ID NO: 2049766 - RNA, 19 nt, Staphylococcus aureus subsp. aureus Mu50
ucaacagcuucaaaaucaa

SEQ ID NO: 2049767 - RNA, 13 nt, Staphylococcus aureus subsp. aureus Mu50
ucaacaaauuuaa

SEQ ID NO: 2049768 - RNA, 11 nt, Staphylococcus aureus subsp. aureus Mu50
ucaacaaacau

SEQ ID NO: 2049769 - RNA, 13 nt, Staphylococcus aureus subsp. aureus Mu50
ucaaauuuuucga

SEQ ID NO: 2049770 - RNA, 21 nt, Staphylococcus aureus subsp. aureus Mu50
ucaaauuuaccgucauuauau

SEQ ID NO: 2049771 - RNA, 19 nt, Staphylococcus aureus subsp. aureus Mu50
ucaaauuggacuuaugggu

SEQ ID NO: 2049772 - RNA, 17 nt, Staphylococcus aureus subsp. aureus Mu50
ucaaaucauaaguuaaa

SEQ ID NO: 2049773 - RNA, 13 nt, Staphylococcus aureus subsp. aureus Mu50
ucaaauauaucua

SEQ ID NO: 2049774 - RNA, 19 nt, Staphylococcus aureus subsp. aureus Mu50
ucaaauauacuuuuaccau

SEQ ID NO: 2049775 - RNA, 24 nt, Staphylococcus aureus subsp. aureus Mu50
ucaaauauaucaacguuaauauaa

SEQ ID NO: 2049776 - RNA, 21 nt, Staphylococcus aureus subsp. aureus Mu50
ucaaaugcuuaauaaaaucaa

SEQ ID NO: 2049777 - RNA, 22 nt, Staphylococcus aureus subsp. aureus Mu50
ucaaauguugaauguggaacau

SEQ ID NO: 2049778 - RNA, 20 nt, Staphylococcus aureus subsp. aureus Mu50
ucaaauuaauuaaaccaaua

SEQ ID NO: 2049779 - RNA, 17 nt, Staphylococcus aureus subsp. aureus Mu50
ucaaaugacauuuuaaa

SEQ ID NO: 2049780 - RNA, 20 nt, Staphylococcus aureus subsp. aureus Mu50
ucaaaugacauuuuaaaucu

SEQ ID NO: 2049781 - RNA, 20 nt, Staphylococcus aureus subsp. aureus Mu50
ucaaaugccgcuucuaauuu

SEQ ID NO: 2049782 - RNA, 23 nt, Staphylococcus aureus subsp. aureus Mu50
ucaaaugccgcuucuaauuuuuc

SEQ ID NO: 2049783 - RNA, 19 nt, Staphylococcus aureus subsp. aureus Mu50
ucaacugcugcuaaaauaa

SEQ ID NO: 2049784 - RNA, 21 nt, Staphylococcus aureus subsp. aureus Mu50
ucaacugaaauuuuuccgauu

SEQ ID NO: 2049785 - RNA, 13 nt, Staphylococcus aureus subsp. aureus Mu50
ucaacuacuucau

SEQ ID NO: 2049786 - RNA, 22 nt, Staphylococcus aureus subsp. aureus Mu50
ucaacuauauauaguugaucaa

SEQ ID NO: 2049787 - RNA, 21 nt, Staphylococcus aureus subsp. aureus Mu50
ucaacgucaucugcuuguaau

SEQ ID NO: 2049788 - RNA, 21 nt, Staphylococcus aureus subsp. aureus Mu50
ucaacguauauaaguuaaaau

SEQ ID NO: 2049789 - RNA, 15 nt, Staphylococcus aureus subsp. aureus Mu50
ucaacgucaucugcu

SEQ ID NO: 2049790 - RNA, 19 nt, Staphylococcus aureus subsp. aureus Mu50
ucaacuaaucguguauuau

SEQ ID NO: 2049791 - RNA, 14 nt, Staphylococcus aureus subsp. aureus Mu50
ucaacuaauuuaaa

SEQ ID NO: 2049792 - RNA, 23 nt, Staphylococcus aureus subsp. aureus Mu50
ucaaccuguucuuuauuuaaagg

SEQ ID NO: 2049793 - RNA, 14 nt, Staphylococcus aureus subsp. aureus Mu50
ucaacgauugaauu

SEQ ID NO: 2049794 - RNA, 17 nt, Staphylococcus aureus subsp. aureus Mu50
ucaacgccauauuuauu

SEQ ID NO: 2049795 - RNA, 23 nt, Staphylococcus aureus subsp. aureus Mu50
ucaagauguuugcaacauauuuu

SEQ ID NO: 2049796 - RNA, 19 nt, Staphylococcus aureus subsp. aureus Mu50
ucaagaccuucuucucuaa

SEQ ID NO: 2049797 - RNA, 16 nt, Staphylococcus aureus subsp. aureus Mu50
ucaagagguaaaucug

SEQ ID NO: 2049798 - RNA, 19 nt, Staphylococcus aureus subsp. aureus Mu50
ucaagauauccauuaugau

SEQ ID NO: 2049799 - RNA, 17 nt, Staphylococcus aureus subsp. aureus Mu50
ucaacuuauuauuuauc

SEQ ID NO: 2049800 - RNA, 10 nt, Staphylococcus aureus subsp. aureus Mu50
ucaacuuuuc

SEQ ID NO: 2049801 - RNA, 17 nt, Staphylococcus aureus subsp. aureus Mu50
ucaacuuuuuaauaaua

SEQ ID NO: 2049802 - RNA, 14 nt, Staphylococcus aureus subsp. aureus Mu50
ucaagaaaaaguuu

SEQ ID NO: 2049803 - RNA, 19 nt, Staphylococcus aureus subsp. aureus Mu50
ucaagaaaaaguuuuucug

SEQ ID NO: 2049804 - RNA, 14 nt, Staphylococcus aureus subsp. aureus Mu50
ucaacuuuuuuaac

SEQ ID NO: 2049805 - RNA, 16 nt, Staphylococcus aureus subsp. aureus Mu50
ucaacuuuuuuaacuu

SEQ ID NO: 2049806 - RNA, 15 nt, Staphylococcus aureus subsp. aureus Mu50
ucaagaacuuuaaaa

SEQ ID NO: 2049807 - RNA, 20 nt, Staphylococcus aureus subsp. aureus Mu50
ucaagaaauguuaaauuaaa

SEQ ID NO: 2049808 - RNA, 12 nt, Staphylococcus aureus subsp. aureus Mu50
ucaagaauauaa

SEQ ID NO: 2049809 - RNA, 17 nt, Staphylococcus aureus subsp. aureus Mu50
uauugagauagaaauua

SEQ ID NO: 2049810 - RNA, 14 nt, Staphylococcus aureus subsp. aureus Mu50
uauugagacaacau

SEQ ID NO: 2049811 - RNA, 23 nt, Staphylococcus aureus subsp. aureus Mu50
uauugaucugauuucacuucuaa

SEQ ID NO: 2049812 - RNA, 19 nt, Staphylococcus aureus subsp. aureus Mu50
uauugauauucuaaaaaau

SEQ ID NO: 2049813 - RNA, 14 nt, Staphylococcus aureus subsp. aureus Mu50
uauugauuguacca

SEQ ID NO: 2049814 - RNA, 21 nt, Staphylococcus aureus subsp. aureus Mu50
uauugauuguaccaguaacaa

SEQ ID NO: 2049815 - RNA, 23 nt, Staphylococcus aureus subsp. aureus Mu50
uauugauuugauucauuacaugu

SEQ ID NO: 2049816 - RNA, 15 nt, Staphylococcus aureus subsp. aureus Mu50
uauugcaaaaauaau

SEQ ID NO: 2049817 - RNA, 14 nt, Staphylococcus aureus subsp. aureus Mu50
uauugcaaaaauaa

SEQ ID NO: 2049818 - RNA, 21 nt, Staphylococcus aureus subsp. aureus Mu50
uauugauuugauucauuacau

SEQ ID NO: 2049819 - RNA, 16 nt, Staphylococcus aureus subsp. aureus Mu50
uauugcacuuuuuuca

SEQ ID NO: 2049820 - RNA, 23 nt, Staphylococcus aureus subsp. aureus Mu50
uauugcagcaacgcgauugcuaa

SEQ ID NO: 2049821 - RNA, 18 nt, Staphylococcus aureus subsp. aureus Mu50
uauugcauguuuaaauau

SEQ ID NO: 2049822 - RNA, 17 nt, Staphylococcus aureus subsp. aureus Mu50
uauugccaaauuucucu

SEQ ID NO: 2049823 - RNA, 23 nt, Staphylococcus aureus subsp. aureus Mu50
uauugccguuauuuucaauaaau

SEQ ID NO: 2049824 - RNA, 20 nt, Staphylococcus aureus subsp. aureus Mu50
uauugccuaaccuguuugag

SEQ ID NO: 2049825 - RNA, 14 nt, Staphylococcus aureus subsp. aureus Mu50
uauugcuuauuuuu

SEQ ID NO: 2049826 - RNA, 13 nt, Staphylococcus aureus subsp. aureus Mu50
uauugguugaaau

SEQ ID NO: 2049827 - RNA, 18 nt, Staphylococcus aureus subsp. aureus Mu50
uauuggucauuacuaaaa

SEQ ID NO: 2049828 - RNA, 16 nt, Staphylococcus aureus subsp. aureus Mu50
uauuggucauuacuaa

SEQ ID NO: 2049829 - RNA, 15 nt, Staphylococcus aureus subsp. aureus Mu50
uauugguaaauuuau

SEQ ID NO: 2049830 - RNA, 19 nt, Staphylococcus aureus subsp. aureus Mu50
uauugguaaauuuaucauu

SEQ ID NO: 2049831 - RNA, 17 nt, Staphylococcus aureus subsp. aureus Mu50
uauuggaauacucuuca

SEQ ID NO: 2049832 - RNA, 15 nt, Staphylococcus aureus subsp. aureus Mu50
uauuguuuucaucau

SEQ ID NO: 2049833 - RNA, 19 nt, Staphylococcus aureus subsp. aureus Mu50
uauuguuuucaucaugcau

SEQ ID NO: 2049834 - RNA, 19 nt, Staphylococcus aureus subsp. aureus Mu50
uauuuaaaauauuauuuuu

SEQ ID NO: 2049835 - RNA, 23 nt, Staphylococcus aureus subsp. aureus Mu50
uauuuaaaauauuauuuuuaagu

SEQ ID NO: 2049836 - RNA, 14 nt, Staphylococcus aureus subsp. aureus Mu50
uauuguuugaaaau

SEQ ID NO: 2049837 - RNA, 18 nt, Staphylococcus aureus subsp. aureus Mu50
uauuuaaaacuuguaaau

SEQ ID NO: 2049838 - RNA, 13 nt, Staphylococcus aureus subsp. aureus Mu50
uauuuaaaagaca

SEQ ID NO: 2049839 - RNA, 21 nt, Staphylococcus aureus subsp. aureus Mu50
uauuuaaacucucuaaaaagc

SEQ ID NO: 2049840 - RNA, 16 nt, Staphylococcus aureus subsp. aureus Mu50
uauuuaaauuuuaagu

SEQ ID NO: 2049841 - RNA, 22 nt, Staphylococcus aureus subsp. aureus Mu50
uauuguuaaacuagaaaacaua

SEQ ID NO: 2049842 - RNA, 16 nt, Staphylococcus aureus subsp. aureus Mu50
uauugugccgcuucua

SEQ ID NO: 2049843 - RNA, 19 nt, Staphylococcus aureus subsp. aureus Mu50
uauugucgacuuuuagauu

SEQ ID NO: 2049844 - RNA, 18 nt, Staphylococcus aureus subsp. aureus Mu50
uauuguauuuuauuuauu

SEQ ID NO: 2049845 - RNA, 13 nt, Staphylococcus aureus subsp. aureus Mu50
uauugucaucaug

SEQ ID NO: 2049846 - RNA, 15 nt, Staphylococcus aureus subsp. aureus Mu50
uauugucaucauguu

SEQ ID NO: 2049847 - RNA, 14 nt, Staphylococcus aureus subsp. aureus Mu50
uauuguauuuuaau

SEQ ID NO: 2049848 - RNA, 17 nt, Staphylococcus aureus subsp. aureus Mu50
uauuguaagcugacuuu

SEQ ID NO: 2049849 - RNA, 22 nt, Staphylococcus aureus subsp. aureus Mu50
uauuuacauugccacuuuugug

SEQ ID NO: 2049850 - RNA, 22 nt, Staphylococcus aureus subsp. aureus Mu50
uauuuacaauguuaucuugcuu

SEQ ID NO: 2049851 - RNA, 16 nt, Staphylococcus aureus subsp. aureus Mu50
uauuuacacacaugau

SEQ ID NO: 2049852 - RNA, 15 nt, Staphylococcus aureus subsp. aureus Mu50
uauuuaauuuuucua

SEQ ID NO: 2049853 - RNA, 16 nt, Staphylococcus aureus subsp. aureus Mu50
uauuuaauguuuuagu

SEQ ID NO: 2049854 - RNA, 13 nt, Staphylococcus aureus subsp. aureus Mu50
uauuuaauuauuu

SEQ ID NO: 2049855 - RNA, 14 nt, Staphylococcus aureus subsp. aureus Mu50
uauuuaauacauuu

SEQ ID NO: 2049856 - RNA, 14 nt, Staphylococcus aureus subsp. aureus Mu50
uauuuagaauaaac

SEQ ID NO: 2049857 - RNA, 16 nt, Staphylococcus aureus subsp. aureus Mu50
uauuuagaauaaacuu

SEQ ID NO: 2049858 - RNA, 15 nt, Staphylococcus aureus subsp. aureus Mu50
uauuuagauaaaaau

SEQ ID NO: 2049859 - RNA, 14 nt, Staphylococcus aureus subsp. aureus Mu50
uauuuauaaaauaa

SEQ ID NO: 2049860 - RNA, 21 nt, Staphylococcus aureus subsp. aureus Mu50
uauuuagcuugcuuacaauaa

SEQ ID NO: 2049861 - RNA, 22 nt, Staphylococcus aureus subsp. aureus Mu50
uauuuaggacgugccuuaacuu

SEQ ID NO: 2049862 - RNA, 17 nt, Staphylococcus aureus subsp. aureus Mu50
uauuuaggaguauccug

SEQ ID NO: 2049863 - RNA, 23 nt, Staphylococcus aureus subsp. aureus Mu50
uauuuagauacugaauuuuaacu

SEQ ID NO: 2049864 - RNA, 15 nt, Staphylococcus aureus subsp. aureus Mu50
uauuucuuaacaucc

SEQ ID NO: 2049865 - RNA, 22 nt, Staphylococcus aureus subsp. aureus Mu50
uauuucugaaaugauacauuau

SEQ ID NO: 2049866 - RNA, 21 nt, Staphylococcus aureus subsp. aureus Mu50
uauuugacacauuauugaaau

SEQ ID NO: 2049867 - RNA, 22 nt, Staphylococcus aureus subsp. aureus Mu50
uauuugaaugcaaaucaaauac

SEQ ID NO: 2049868 - RNA, 14 nt, Staphylococcus aureus subsp. aureus Mu50
uauuugaauacuuu

SEQ ID NO: 2049869 - RNA, 16 nt, Staphylococcus aureus subsp. aureus Mu50
uauuugaaugcaaauc

SEQ ID NO: 2049870 - RNA, 21 nt, Staphylococcus aureus subsp. aureus Mu50
uauuucuuuuugucauuaauc

SEQ ID NO: 2049871 - RNA, 16 nt, Staphylococcus aureus subsp. aureus Mu50
uauuugaaaauuucac

SEQ ID NO: 2049872 - RNA, 22 nt, Staphylococcus aureus subsp. aureus Mu50
uauuugaaagacauuuaaauau

SEQ ID NO: 2049873 - RNA, 14 nt, Staphylococcus aureus subsp. aureus Mu50
uauuugaaaauauu

SEQ ID NO: 2049874 - RNA, 16 nt, Staphylococcus aureus subsp. aureus Mu50
uauuugauaaauaaaa

SEQ ID NO: 2049875 - RNA, 15 nt, Staphylococcus aureus subsp. aureus Mu50
uauuugauaauauug

SEQ ID NO: 2049876 - RNA, 13 nt, Staphylococcus aureus subsp. aureus Mu50
uauuugauacaac

SEQ ID NO: 2049877 - RNA, 14 nt, Staphylococcus aureus subsp. aureus Mu50
uauuugauucuuca

SEQ ID NO: 2049878 - RNA, 18 nt, Staphylococcus aureus subsp. aureus Mu50
uauuugauuauucuucau

SEQ ID NO: 2049879 - RNA, 19 nt, Staphylococcus aureus subsp. aureus Mu50
uauuugcuagucauaauuu

SEQ ID NO: 2049880 - RNA, 21 nt, Staphylococcus aureus subsp. aureus Mu50
uauuuggaugguaaguauaau

SEQ ID NO: 2049881 - RNA, 14 nt, Staphylococcus aureus subsp. aureus Mu50
uauuugcccgacuu

SEQ ID NO: 2049882 - RNA, 13 nt, Staphylococcus aureus subsp. aureus Mu50
uauuuuaauauuu

SEQ ID NO: 2049883 - RNA, 14 nt, Staphylococcus aureus subsp. aureus Mu50
uauuuuaacuuaau

SEQ ID NO: 2049884 - RNA, 17 nt, Staphylococcus aureus subsp. aureus Mu50
uauuuuaacuuaauuaa

SEQ ID NO: 2049885 - RNA, 19 nt, Staphylococcus aureus subsp. aureus Mu50
uauuuuaacuuaauuaaaa

SEQ ID NO: 2049886 - RNA, 18 nt, Staphylococcus aureus subsp. aureus Mu50
uauuuuaauauugaaaug

SEQ ID NO: 2049887 - RNA, 14 nt, Staphylococcus aureus subsp. aureus Mu50
uauuuuauaauaaa

SEQ ID NO: 2049888 - RNA, 12 nt, Staphylococcus aureus subsp. aureus Mu50
uauuuuaugauu

SEQ ID NO: 2049889 - RNA, 12 nt, Staphylococcus aureus subsp. aureus Mu50
uauuuuaucugu

SEQ ID NO: 2049890 - RNA, 23 nt, Staphylococcus aureus subsp. aureus Mu50
uauuuuaucaagagguaaaucug

SEQ ID NO: 2049891 - RNA, 13 nt, Staphylococcus aureus subsp. aureus Mu50
uauuuuauacaua

SEQ ID NO: 2049892 - RNA, 15 nt, Staphylococcus aureus subsp. aureus Mu50
uauuuguauaugcaa

SEQ ID NO: 2049893 - RNA, 19 nt, Staphylococcus aureus subsp. aureus Mu50
uauuuguggaaauaaaaca

SEQ ID NO: 2049894 - RNA, 16 nt, Staphylococcus aureus subsp. aureus Mu50
uauuuggauauuuauu

SEQ ID NO: 2049895 - RNA, 19 nt, Staphylococcus aureus subsp. aureus Mu50
uauuuguacaugaacaaau

SEQ ID NO: 2049896 - RNA, 15 nt, Staphylococcus aureus subsp. aureus Mu50
uauuuguaauuucag

SEQ ID NO: 2049897 - RNA, 19 nt, Staphylococcus aureus subsp. aureus Mu50
uauuuguuaugguauuuau

SEQ ID NO: 2049898 - RNA, 10 nt, Staphylococcus aureus subsp. aureus Mu50
uauuuuaaac

SEQ ID NO: 2049899 - RNA, 12 nt, Staphylococcus aureus subsp. aureus Mu50
uauuuuaaacau

SEQ ID NO: 2049900 - RNA, 21 nt, Staphylococcus aureus subsp. aureus Mu50
uauuuuaaaccguuauauauu

SEQ ID NO: 2049901 - RNA, 19 nt, Staphylococcus aureus subsp. aureus Mu50
uauuuuaaauuuauaauac

SEQ ID NO: 2049902 - RNA, 14 nt, Staphylococcus aureus subsp. aureus Mu50
uauuuuaaauuaca

SEQ ID NO: 2049903 - RNA, 22 nt, Staphylococcus aureus subsp. aureus Mu50
uauuuuaaacguaucauuuaaa

SEQ ID NO: 2049904 - RNA, 23 nt, Staphylococcus aureus subsp. aureus Mu50
uauuuuaaacguaucauuuaaaa

SEQ ID NO: 2049905 - RNA, 21 nt, Staphylococcus aureus subsp. aureus Mu50
uauuucacucuacaauccuau

SEQ ID NO: 2049906 - RNA, 15 nt, Staphylococcus aureus subsp. aureus Mu50
uauuucauuagaaaa

SEQ ID NO: 2049907 - RNA, 14 nt, Staphylococcus aureus subsp. aureus Mu50
uauuucauauaugu

SEQ ID NO: 2049908 - RNA, 15 nt, Staphylococcus aureus subsp. aureus Mu50
uauuuccaaauugaa

SEQ ID NO: 2049909 - RNA, 16 nt, Staphylococcus aureus subsp. aureus Mu50
uauuucccuaugaaau

SEQ ID NO: 2049910 - RNA, 16 nt, Staphylococcus aureus subsp. aureus Mu50
uauuucuaaauuauuu

SEQ ID NO: 2049911 - RNA, 12 nt, Staphylococcus aureus subsp. aureus Mu50
uauuuauuuaau

SEQ ID NO: 2049912 - RNA, 13 nt, Staphylococcus aureus subsp. aureus Mu50
uauuuauuuugau

SEQ ID NO: 2049913 - RNA, 20 nt, Staphylococcus aureus subsp. aureus Mu50
uauuucacacagcuucauua

SEQ ID NO: 2049914 - RNA, 15 nt, Staphylococcus aureus subsp. aureus Mu50
uauuucaauuaucaa

SEQ ID NO: 2049915 - RNA, 14 nt, Staphylococcus aureus subsp. aureus Mu50
uauuucaauaauaa

SEQ ID NO: 2049916 - RNA, 13 nt, Staphylococcus aureus subsp. aureus Mu50
uauuucaaaugua

SEQ ID NO: 2049917 - RNA, 19 nt, Staphylococcus aureus subsp. aureus Mu50
uauuucaacuuuuuaauaa

SEQ ID NO: 2049918 - RNA, 21 nt, Staphylococcus aureus subsp. aureus Mu50
uauuucaacaaacauaaauaa

SEQ ID NO: 2049919 - RNA, 13 nt, Staphylococcus aureus subsp. aureus Mu50
uauuuauagauuu

SEQ ID NO: 2049920 - RNA, 15 nt, Staphylococcus aureus subsp. aureus Mu50
uauuuauauuaaaua

SEQ ID NO: 2049921 - RNA, 14 nt, Staphylococcus aureus subsp. aureus Mu50
uauuuauauuaaau

SEQ ID NO: 2049922 - RNA, 18 nt, Staphylococcus aureus subsp. aureus Mu50
uauuuauaaaauaaaaug

SEQ ID NO: 2049923 - RNA, 15 nt, Staphylococcus aureus subsp. aureus Mu50
uauuuauaaacaaua

SEQ ID NO: 2049924 - RNA, 12 nt, Staphylococcus aureus subsp. aureus Mu50
uauuuauaauuu

SEQ ID NO: 2049925 - RNA, 18 nt, Staphylococcus aureus subsp. aureus Mu50
uauuuauacuaaauugag

SEQ ID NO: 2049926 - RNA, 17 nt, Staphylococcus aureus subsp. aureus Mu50
uauuuauacuauaaaua

SEQ ID NO: 2049927 - RNA, 10 nt, Staphylococcus aureus subsp. aureus Mu50
uauuuauuca

SEQ ID NO: 2049928 - RNA, 11 nt, Staphylococcus aureus subsp. aureus Mu50
uauuuauucag

SEQ ID NO: 2049929 - RNA, 19 nt, Staphylococcus aureus subsp. aureus Mu50
uauuuauucuaaucuaaau

SEQ ID NO: 2049930 - RNA, 23 nt, Staphylococcus aureus subsp. aureus Mu50
uauuuauucuaaucuaaauucag

SEQ ID NO: 2049931 - RNA, 21 nt, Staphylococcus aureus subsp. aureus Mu50
uauuuauguucgauuauucuu

SEQ ID NO: 2049932 - RNA, 15 nt, Staphylococcus aureus subsp. aureus Mu50
uauuuauguuuucua

SEQ ID NO: 2049933 - RNA, 14 nt, Staphylococcus aureus subsp. aureus Mu50
uauuuaucuuuaga

SEQ ID NO: 2049934 - RNA, 20 nt, Staphylococcus aureus subsp. aureus Mu50
uauuagugauauuuuucgaa

SEQ ID NO: 2049935 - RNA, 15 nt, Staphylococcus aureus subsp. aureus Mu50
uauuauaaaauaaau

SEQ ID NO: 2049936 - RNA, 11 nt, Staphylococcus aureus subsp. aureus Mu50
uauuauagaac

SEQ ID NO: 2049937 - RNA, 15 nt, Staphylococcus aureus subsp. aureus Mu50
uauuauaguuuagau

SEQ ID NO: 2049938 - RNA, 19 nt, Staphylococcus aureus subsp. aureus Mu50
uauuauaauuguucauugg

SEQ ID NO: 2049939 - RNA, 15 nt, Staphylococcus aureus subsp. aureus Mu50
uauuauaauuuuguu

SEQ ID NO: 2049940 - RNA, 18 nt, Staphylococcus aureus subsp. aureus Mu50
uauuauaauaaauagacu

SEQ ID NO: 2049941 - RNA, 22 nt, Staphylococcus aureus subsp. aureus Mu50
uauuauaacccucguaggcaua

SEQ ID NO: 2049942 - RNA, 17 nt, Staphylococcus aureus subsp. aureus Mu50
uauuauaauagagaaac

SEQ ID NO: 2049943 - RNA, 14 nt, Staphylococcus aureus subsp. aureus Mu50
uauuauaaccacca

SEQ ID NO: 2049944 - RNA, 16 nt, Staphylococcus aureus subsp. aureus Mu50
uauuaggcuuaaauau

SEQ ID NO: 2049945 - RNA, 15 nt, Staphylococcus aureus subsp. aureus Mu50
uauuacuuauuucuu

SEQ ID NO: 2049946 - RNA, 20 nt, Staphylococcus aureus subsp. aureus Mu50
uauuacuuauuucuuuucau

SEQ ID NO: 2049947 - RNA, 19 nt, Staphylococcus aureus subsp. aureus Mu50
uauuagaacguaauguuac

SEQ ID NO: 2049948 - RNA, 21 nt, Staphylococcus aureus subsp. aureus Mu50
uauuauugaaacuaauaauuu

SEQ ID NO: 2049949 - RNA, 22 nt, Staphylococcus aureus subsp. aureus Mu50
uauuauugaaaucgauacuaau

SEQ ID NO: 2049950 - RNA, 16 nt, Staphylococcus aureus subsp. aureus Mu50
uauuauugucaucaug

SEQ ID NO: 2049951 - RNA, 19 nt, Staphylococcus aureus subsp. aureus Mu50
uauuauuauaauuuuguuu

SEQ ID NO: 2049952 - RNA, 15 nt, Staphylococcus aureus subsp. aureus Mu50
uauuauuauugaaau

SEQ ID NO: 2049953 - RNA, 17 nt, Staphylococcus aureus subsp. aureus Mu50
uauuauucauaauauau

SEQ ID NO: 2049954 - RNA, 15 nt, Staphylococcus aureus subsp. aureus Mu50
uauuauuauguuaua

SEQ ID NO: 2049955 - RNA, 18 nt, Staphylococcus aureus subsp. aureus Mu50
uauuauuccauugaugua

SEQ ID NO: 2049956 - RNA, 18 nt, Staphylococcus aureus subsp. aureus Mu50
uauuauucauaauauauu

SEQ ID NO: 2049957 - RNA, 15 nt, Staphylococcus aureus subsp. aureus Mu50
uauuauguuauaaau

SEQ ID NO: 2049958 - RNA, 23 nt, Staphylococcus aureus subsp. aureus Mu50
uauuauguuauaaauucuaucua

SEQ ID NO: 2049959 - RNA, 14 nt, Staphylococcus aureus subsp. aureus Mu50
uauuauguuauaaa

SEQ ID NO: 2049960 - RNA, 19 nt, Staphylococcus aureus subsp. aureus Mu50
uauuauccucaaauauauu

SEQ ID NO: 2049961 - RNA, 15 nt, Staphylococcus aureus subsp. aureus Mu50
uauuauccucaaaua

SEQ ID NO: 2049962 - RNA, 16 nt, Staphylococcus aureus subsp. aureus Mu50
uauuaugaauuauuaa

SEQ ID NO: 2049963 - RNA, 14 nt, Staphylococcus aureus subsp. aureus Mu50
uauuauauauauuc

SEQ ID NO: 2049964 - RNA, 16 nt, Staphylococcus aureus subsp. aureus Mu50
uauuaaauuugaaagu

SEQ ID NO: 2049965 - RNA, 20 nt, Staphylococcus aureus subsp. aureus Mu50
uauuaaauuuuguauaaccu

SEQ ID NO: 2049966 - RNA, 12 nt, Staphylococcus aureus subsp. aureus Mu50
uauuaaaggaaa

SEQ ID NO: 2049967 - RNA, 17 nt, Staphylococcus aureus subsp. aureus Mu50
uauuaaauauaugcgua

SEQ ID NO: 2049968 - RNA, 14 nt, Staphylococcus aureus subsp. aureus Mu50
uauuaaauuucuga

SEQ ID NO: 2049969 - RNA, 22 nt, Staphylococcus aureus subsp. aureus Mu50
uauuaaaagcaugauacucaau

SEQ ID NO: 2049970 - RNA, 18 nt, Staphylococcus aureus subsp. aureus Mu50
uauuaaacccaauuaacc

SEQ ID NO: 2049971 - RNA, 21 nt, Staphylococcus aureus subsp. aureus Mu50
uauuaaaauacgguacagaua

SEQ ID NO: 2049972 - RNA, 19 nt, Staphylococcus aureus subsp. aureus Mu50
uauuaaacauuuuugaauu

SEQ ID NO: 2049973 - RNA, 22 nt, Staphylococcus aureus subsp. aureus Mu50
uauuaaacauuuuugaauuuaa

SEQ ID NO: 2049974 - RNA, 16 nt, Staphylococcus aureus subsp. aureus Mu50
uauuaagugaguuuua

SEQ ID NO: 2049975 - RNA, 16 nt, Staphylococcus aureus subsp. aureus Mu50
uauuaaguauaucuuu

SEQ ID NO: 2049976 - RNA, 22 nt, Staphylococcus aureus subsp. aureus Mu50
uauuaaggggguaauacuauau

SEQ ID NO: 2049977 - RNA, 16 nt, Staphylococcus aureus subsp. aureus Mu50
uauuaagacugauuaa

SEQ ID NO: 2049978 - RNA, 17 nt, Staphylococcus aureus subsp. aureus Mu50
uauuaagacugauuaau

SEQ ID NO: 2049979 - RNA, 22 nt, Staphylococcus aureus subsp. aureus Mu50
uauuaagcuauacucauuuucu

SEQ ID NO: 2049980 - RNA, 16 nt, Staphylococcus aureus subsp. aureus Mu50
uauuacaucuauauuu

SEQ ID NO: 2049981 - RNA, 19 nt, Staphylococcus aureus subsp. aureus Mu50
uauuacuauaaaaaacagc

SEQ ID NO: 2049982 - RNA, 12 nt, Staphylococcus aureus subsp. aureus Mu50
uauuacuauaaa

SEQ ID NO: 2049983 - RNA, 17 nt, Staphylococcus aureus subsp. aureus Mu50
uauuacuaaccuauuaa

SEQ ID NO: 2049984 - RNA, 22 nt, Staphylococcus aureus subsp. aureus Mu50
uauuaaucguuaauguauaaaa

SEQ ID NO: 2049985 - RNA, 17 nt, Staphylococcus aureus subsp. aureus Mu50
uauuaaugauugacgau

SEQ ID NO: 2049986 - RNA, 15 nt, Staphylococcus aureus subsp. aureus Mu50
uauuacaaugaaaaa

SEQ ID NO: 2049987 - RNA, 18 nt, Staphylococcus aureus subsp. aureus Mu50
uauuaauuuuucaaaugu

SEQ ID NO: 2049988 - RNA, 16 nt, Staphylococcus aureus subsp. aureus Mu50
uauuaauuuuacguuu

SEQ ID NO: 2049989 - RNA, 16 nt, Staphylococcus aureus subsp. aureus Mu50
uauuaauuucauugua

SEQ ID NO: 2049990 - RNA, 12 nt, Staphylococcus aureus subsp. aureus Mu50
uauucuauuuuu

SEQ ID NO: 2049991 - RNA, 16 nt, Staphylococcus aureus subsp. aureus Mu50
uauucuauuuuucaau

SEQ ID NO: 2049992 - RNA, 14 nt, Staphylococcus aureus subsp. aureus Mu50
uauucuaaguuaaa

SEQ ID NO: 2049993 - RNA, 15 nt, Staphylococcus aureus subsp. aureus Mu50
uauucuaaauauauu

SEQ ID NO: 2049994 - RNA, 22 nt, Staphylococcus aureus subsp. aureus Mu50
uauucucugcuucuaaaacauc

SEQ ID NO: 2049995 - RNA, 18 nt, Staphylococcus aureus subsp. aureus Mu50
uauucgguuaauauucuu

SEQ ID NO: 2049996 - RNA, 21 nt, Staphylococcus aureus subsp. aureus Mu50
uauucgguuaauauucuuucg

SEQ ID NO: 2049997 - RNA, 16 nt, Staphylococcus aureus subsp. aureus Mu50
uauucuaaaaaauuaa

SEQ ID NO: 2049998 - RNA, 20 nt, Staphylococcus aureus subsp. aureus Mu50
uauucuaaaaaauuaaaaau

SEQ ID NO: 2049999 - RNA, 14 nt, Staphylococcus aureus subsp. aureus Mu50
uauucgcaccacug

SEQ ID NO: 2050000 - RNA, 18 nt, Staphylococcus aureus subsp. aureus Mu50
uauugaaaucgauacuaa

SEQ ID NO: 2050001 - RNA, 16 nt, Staphylococcus aureus subsp. aureus Mu50
uauugaaaauagaaag

SEQ ID NO: 2050002 - RNA, 12 nt, Staphylococcus aureus subsp. aureus Mu50
uauugaaacuaa

SEQ ID NO: 2050003 - RNA, 18 nt, Staphylococcus aureus subsp. aureus Mu50
uauucuuuuaauagaucu

SEQ ID NO: 2050004 - RNA, 15 nt, Staphylococcus aureus subsp. aureus Mu50
uauugaaugaauuca

SEQ ID NO: 2050005 - RNA, 20 nt, Staphylococcus aureus subsp. aureus Mu50
uauugaacaauuuuugggaa

SEQ ID NO: 2050006 - RNA, 14 nt, Staphylococcus aureus subsp. aureus Mu50
uauugaacuucuaa

SEQ ID NO: 2050007 - RNA, 14 nt, Staphylococcus aureus subsp. aureus Mu50
uauucuuaauuuaa

SEQ ID NO: 2050008 - RNA, 17 nt, Staphylococcus aureus subsp. aureus Mu50
uauucuuaaaagacauc

SEQ ID NO: 2050009 - RNA, 21 nt, Staphylococcus aureus subsp. aureus Mu50
uauucuucuaauucugaaauc

SEQ ID NO: 2050010 - RNA, 12 nt, Staphylococcus aureus subsp. aureus Mu50
uauucuuuaaua

SEQ ID NO: 2050011 - RNA, 11 nt, Staphylococcus aureus subsp. aureus Mu50
uauucuuccca

SEQ ID NO: 2050012 - RNA, 19 nt, Staphylococcus aureus subsp. aureus Mu50
uauuauuuuguauuuuuca

SEQ ID NO: 2050013 - RNA, 20 nt, Staphylococcus aureus subsp. aureus Mu50
uauuauuuuguauuuuucaa

SEQ ID NO: 2050014 - RNA, 16 nt, Staphylococcus aureus subsp. aureus Mu50
uauuauugugaaaucu

SEQ ID NO: 2050015 - RNA, 23 nt, Staphylococcus aureus subsp. aureus Mu50
uauucaacuaauuuaaagcauca

SEQ ID NO: 2050016 - RNA, 21 nt, Staphylococcus aureus subsp. aureus Mu50
uauucaacagggguaaaacuu

SEQ ID NO: 2050017 - RNA, 14 nt, Staphylococcus aureus subsp. aureus Mu50
uauucaauaauuau

SEQ ID NO: 2050018 - RNA, 15 nt, Staphylococcus aureus subsp. aureus Mu50
uauucaauaauucau

SEQ ID NO: 2050019 - RNA, 22 nt, Staphylococcus aureus subsp. aureus Mu50
uauucacuuuuuuuaauuugau

SEQ ID NO: 2050020 - RNA, 14 nt, Staphylococcus aureus subsp. aureus Mu50
uauucaauucugug

SEQ ID NO: 2050021 - RNA, 21 nt, Staphylococcus aureus subsp. aureus Mu50
uauuccgaacauguuucuaga

SEQ ID NO: 2050022 - RNA, 22 nt, Staphylococcus aureus subsp. aureus Mu50
uauuccauuggaaguucuuuug

SEQ ID NO: 2050023 - RNA, 17 nt, Staphylococcus aureus subsp. aureus Mu50
uauuccuaauaaauauc

SEQ ID NO: 2050024 - RNA, 21 nt, Staphylococcus aureus subsp. aureus Mu50
uauucagucaguaaaaauaca

SEQ ID NO: 2050025 - RNA, 16 nt, Staphylococcus aureus subsp. aureus Mu50
ucacaaucuguucaua

SEQ ID NO: 2050026 - RNA, 15 nt, Staphylococcus aureus subsp. aureus Mu50
ucacaaguucaggau

SEQ ID NO: 2050027 - RNA, 18 nt, Staphylococcus aureus subsp. aureus Mu50
ucacaaauuugaauauac

SEQ ID NO: 2050028 - RNA, 16 nt, Staphylococcus aureus subsp. aureus Mu50
ucacaacugcauauaa

SEQ ID NO: 2050029 - RNA, 20 nt, Staphylococcus aureus subsp. aureus Mu50
ucacaacugcauauaaaguc

SEQ ID NO: 2050030 - RNA, 23 nt, Staphylococcus aureus subsp. aureus Mu50
ucacacgacauguagguaauugc

SEQ ID NO: 2050031 - RNA, 14 nt, Staphylococcus aureus subsp. aureus Mu50
ucacagacuuuuua

SEQ ID NO: 2050032 - RNA, 22 nt, Staphylococcus aureus subsp. aureus Mu50
ucacaguaucuucaguuauuug

SEQ ID NO: 2050033 - RNA, 23 nt, Staphylococcus aureus subsp. aureus Mu50
ucacaucacguugugcaauaccu

SEQ ID NO: 2050034 - RNA, 18 nt, Staphylococcus aureus subsp. aureus Mu50
ucacaugaauuuuaauau

SEQ ID NO: 2050035 - RNA, 21 nt, Staphylococcus aureus subsp. aureus Mu50
ucacaugaggaucaacugaaa

SEQ ID NO: 2050036 - RNA, 18 nt, Staphylococcus aureus subsp. aureus Mu50
ucacauguaccacauuuu

SEQ ID NO: 2050037 - RNA, 16 nt, Staphylococcus aureus subsp. aureus Mu50
ucacaugugaaauaau

SEQ ID NO: 2050038 - RNA, 15 nt, Staphylococcus aureus subsp. aureus Mu50
ucacauuaaguuaaa

SEQ ID NO: 2050039 - RNA, 20 nt, Staphylococcus aureus subsp. aureus Mu50
ucacauucuugaauaaauuu

SEQ ID NO: 2050040 - RNA, 18 nt, Staphylococcus aureus subsp. aureus Mu50
ucacauucuugaauaaau

SEQ ID NO: 2050041 - RNA, 15 nt, Staphylococcus aureus subsp. aureus Mu50
ucaccacauaaaaau

SEQ ID NO: 2050042 - RNA, 16 nt, Staphylococcus aureus subsp. aureus Mu50
ucaccacauaaaaaua

SEQ ID NO: 2050043 - RNA, 15 nt, Staphylococcus aureus subsp. aureus Mu50
ucaccaauuagguuu

SEQ ID NO: 2050044 - RNA, 14 nt, Staphylococcus aureus subsp. aureus Mu50
ucaccagauuuuaa

SEQ ID NO: 2050045 - RNA, 17 nt, Staphylococcus aureus subsp. aureus Mu50
ucaccagauuuuaagug

SEQ ID NO: 2050046 - RNA, 13 nt, Staphylococcus aureus subsp. aureus Mu50
ucaccaucuuuaa

SEQ ID NO: 2050047 - RNA, 19 nt, Staphylococcus aureus subsp. aureus Mu50
ucaccauacuaaaacauga

SEQ ID NO: 2050048 - RNA, 14 nt, Staphylococcus aureus subsp. aureus Mu50
ucaccauauuuaac

SEQ ID NO: 2050049 - RNA, 18 nt, Staphylococcus aureus subsp. aureus Mu50
ucaccauauuuaacauuu

SEQ ID NO: 2050050 - RNA, 14 nt, Staphylococcus aureus subsp. aureus Mu50
ucaccgcuuucaau

SEQ ID NO: 2050051 - RNA, 23 nt, Staphylococcus aureus subsp. aureus Mu50
ucaauuaauuuagucauuacaaa

SEQ ID NO: 2050052 - RNA, 20 nt, Staphylococcus aureus subsp. aureus Mu50
ucaauuaauuuaaaugcuua

SEQ ID NO: 2050053 - RNA, 21 nt, Staphylococcus aureus subsp. aureus Mu50
ucaauucacgagcugcuucaa

SEQ ID NO: 2050054 - RNA, 14 nt, Staphylococcus aureus subsp. aureus Mu50
ucaauuaauuuaaa

SEQ ID NO: 2050055 - RNA, 14 nt, Staphylococcus aureus subsp. aureus Mu50
ucaauguuuaauuu

SEQ ID NO: 2050056 - RNA, 16 nt, Staphylococcus aureus subsp. aureus Mu50
ucaauguuuaauuuuc

SEQ ID NO: 2050057 - RNA, 15 nt, Staphylococcus aureus subsp. aureus Mu50
ucaauuguaaaucuu

SEQ ID NO: 2050058 - RNA, 20 nt, Staphylococcus aureus subsp. aureus Mu50
ucaauuuaaauaaguuacuc

SEQ ID NO: 2050059 - RNA, 16 nt, Staphylococcus aureus subsp. aureus Mu50
ucaauuguugauuuga

SEQ ID NO: 2050060 - RNA, 23 nt, Staphylococcus aureus subsp. aureus Mu50
ucaauuguugcaaaauacgauuu

SEQ ID NO: 2050061 - RNA, 14 nt, Staphylococcus aureus subsp. aureus Mu50
ucaauuucuguaau

SEQ ID NO: 2050062 - RNA, 14 nt, Staphylococcus aureus subsp. aureus Mu50
ucaauuucauuuuu

SEQ ID NO: 2050063 - RNA, 23 nt, Staphylococcus aureus subsp. aureus Mu50
ucaauuuaguccuucuuuacuaa

SEQ ID NO: 2050064 - RNA, 18 nt, Staphylococcus aureus subsp. aureus Mu50
ucaauuuaguauaaauaa

SEQ ID NO: 2050065 - RNA, 19 nt, Staphylococcus aureus subsp. aureus Mu50
ucaauuuggaaauaucuua

SEQ ID NO: 2050066 - RNA, 18 nt, Staphylococcus aureus subsp. aureus Mu50
ucaauuuggaaauaucuu

SEQ ID NO: 2050067 - RNA, 22 nt, Staphylococcus aureus subsp. aureus Mu50
ucacaaaauuaggcauucaucu

SEQ ID NO: 2050068 - RNA, 21 nt, Staphylococcus aureus subsp. aureus Mu50
ucaauuuuuucaugauuuacu

SEQ ID NO: 2050069 - RNA, 12 nt, Staphylococcus aureus subsp. aureus Mu50
ucacaaagaaau

SEQ ID NO: 2050070 - RNA, 15 nt, Staphylococcus aureus subsp. aureus Mu50
ucaaucgcauuuugu

SEQ ID NO: 2050071 - RNA, 16 nt, Staphylococcus aureus subsp. aureus Mu50
ucaauccuaaauuaua

SEQ ID NO: 2050072 - RNA, 13 nt, Staphylococcus aureus subsp. aureus Mu50
ucaauccuuuguu

SEQ ID NO: 2050073 - RNA, 18 nt, Staphylococcus aureus subsp. aureus Mu50
ucaaucccuuuuagcaua

SEQ ID NO: 2050074 - RNA, 21 nt, Staphylococcus aureus subsp. aureus Mu50
ucaauccaauuaaauauuuaa

SEQ ID NO: 2050075 - RNA, 16 nt, Staphylococcus aureus subsp. aureus Mu50
ucaaugauuuuuaaaa

SEQ ID NO: 2050076 - RNA, 14 nt, Staphylococcus aureus subsp. aureus Mu50
ucaaugauuuuaua

SEQ ID NO: 2050077 - RNA, 19 nt, Staphylococcus aureus subsp. aureus Mu50
ucaaugauuuuauaauauu

SEQ ID NO: 2050078 - RNA, 21 nt, Staphylococcus aureus subsp. aureus Mu50
ucaaugauuuuauaauauuau

SEQ ID NO: 2050079 - RNA, 15 nt, Staphylococcus aureus subsp. aureus Mu50
ucaaugaauucauuu

SEQ ID NO: 2050080 - RNA, 14 nt, Staphylococcus aureus subsp. aureus Mu50
ucaaugaauuuacu

SEQ ID NO: 2050081 - RNA, 18 nt, Staphylococcus aureus subsp. aureus Mu50
ucaaugacugagaaaaau

SEQ ID NO: 2050082 - RNA, 19 nt, Staphylococcus aureus subsp. aureus Mu50
ucaaugacugagaaaaaua

SEQ ID NO: 2050083 - RNA, 22 nt, Staphylococcus aureus subsp. aureus Mu50
ucaaugagcaagucuucuaaaa

SEQ ID NO: 2050084 - RNA, 14 nt, Staphylococcus aureus subsp. aureus Mu50
ucaauguaauuuuc

SEQ ID NO: 2050085 - RNA, 12 nt, Staphylococcus aureus subsp. aureus Mu50
ucaauaaaaaug

SEQ ID NO: 2050086 - RNA, 14 nt, Staphylococcus aureus subsp. aureus Mu50
ucaaguuuuaagug

SEQ ID NO: 2050087 - RNA, 13 nt, Staphylococcus aureus subsp. aureus Mu50
ucaauaaauauug

SEQ ID NO: 2050088 - RNA, 14 nt, Staphylococcus aureus subsp. aureus Mu50
ucaagugaaucuaa

SEQ ID NO: 2050089 - RNA, 22 nt, Staphylococcus aureus subsp. aureus Mu50
ucaagugaaucuaacugugcaa

SEQ ID NO: 2050090 - RNA, 20 nt, Staphylococcus aureus subsp. aureus Mu50
ucaaguauauccgcaucuuu

SEQ ID NO: 2050091 - RNA, 15 nt, Staphylococcus aureus subsp. aureus Mu50
ucaaguaaugauauu

SEQ ID NO: 2050092 - RNA, 20 nt, Staphylococcus aureus subsp. aureus Mu50
ucaaguaauggauugauaau

SEQ ID NO: 2050093 - RNA, 20 nt, Staphylococcus aureus subsp. aureus Mu50
ucaaguucaccguaaucuuu

SEQ ID NO: 2050094 - RNA, 11 nt, Staphylococcus aureus subsp. aureus Mu50
ucaagugcuug

SEQ ID NO: 2050095 - RNA, 16 nt, Staphylococcus aureus subsp. aureus Mu50
ucaagcuagcaucaug

SEQ ID NO: 2050096 - RNA, 20 nt, Staphylococcus aureus subsp. aureus Mu50
ucaagcugagcuuuaauuuu

SEQ ID NO: 2050097 - RNA, 19 nt, Staphylococcus aureus subsp. aureus Mu50
ucaauaacaccuuucauuu

SEQ ID NO: 2050098 - RNA, 13 nt, Staphylococcus aureus subsp. aureus Mu50
ucaauaaauaaac

SEQ ID NO: 2050099 - RNA, 15 nt, Staphylococcus aureus subsp. aureus Mu50
ucaauacuugaaaga

SEQ ID NO: 2050100 - RNA, 14 nt, Staphylococcus aureus subsp. aureus Mu50
ucaauaauuucuug

SEQ ID NO: 2050101 - RNA, 12 nt, Staphylococcus aureus subsp. aureus Mu50
ucaauaaucuua

SEQ ID NO: 2050102 - RNA, 18 nt, Staphylococcus aureus subsp. aureus Mu50
ucaauaaugugucaaaua

SEQ ID NO: 2050103 - RNA, 13 nt, Staphylococcus aureus subsp. aureus Mu50
ucaauaauuauua

SEQ ID NO: 2050104 - RNA, 13 nt, Staphylococcus aureus subsp. aureus Mu50
ucaauaauugauu

SEQ ID NO: 2050105 - RNA, 15 nt, Staphylococcus aureus subsp. aureus Mu50
ucaauagaugaaaau

SEQ ID NO: 2050106 - RNA, 20 nt, Staphylococcus aureus subsp. aureus Mu50
ucaauagcgguuuaaaaaug

SEQ ID NO: 2050107 - RNA, 22 nt, Staphylococcus aureus subsp. aureus Mu50
ucaauaggaauaccacuuaauc

SEQ ID NO: 2050108 - RNA, 14 nt, Staphylococcus aureus subsp. aureus Mu50
ucaauaguuucaau

SEQ ID NO: 2050109 - RNA, 19 nt, Staphylococcus aureus subsp. aureus Mu50
ucaauaguuucaaugccuu

SEQ ID NO: 2050110 - RNA, 16 nt, Staphylococcus aureus subsp. aureus Mu50
ucaauaucacuaucag

SEQ ID NO: 2050111 - RNA, 23 nt, Staphylococcus aureus subsp. aureus Mu50
ucaauaucuguagcgauaccuuu

SEQ ID NO: 2050112 - RNA, 14 nt, Staphylococcus aureus subsp. aureus Mu50
ucaauaucuucuaa

SEQ ID NO: 2050113 - RNA, 13 nt, Staphylococcus aureus subsp. aureus Mu50
ucaauauuaaaau

SEQ ID NO: 2050114 - RNA, 22 nt, Staphylococcus aureus subsp. aureus Mu50
ucaauauuaaucauaaugaaua

SEQ ID NO: 2050115 - RNA, 14 nt, Staphylococcus aureus subsp. aureus Mu50
ucaauauucuuauc

SEQ ID NO: 2050116 - RNA, 13 nt, Staphylococcus aureus subsp. aureus Mu50
ucaauauuuaaau

SEQ ID NO: 2050117 - RNA, 23 nt, Staphylococcus aureus subsp. aureus Mu50
ucaaucaacgagucauaaauaua

SEQ ID NO: 2050118 - RNA, 23 nt, Staphylococcus aureus subsp. aureus Mu50
ucacuguauggucuggaauaaau

SEQ ID NO: 2050119 - RNA, 17 nt, Staphylococcus aureus subsp. aureus Mu50
ucacuguuaaagauguc

SEQ ID NO: 2050120 - RNA, 13 nt, Staphylococcus aureus subsp. aureus Mu50
ucacuguuuuauu

SEQ ID NO: 2050121 - RNA, 15 nt, Staphylococcus aureus subsp. aureus Mu50
ucacuguagauucaa

SEQ ID NO: 2050122 - RNA, 14 nt, Staphylococcus aureus subsp. aureus Mu50
ucacugaaugcuaa

SEQ ID NO: 2050123 - RNA, 17 nt, Staphylococcus aureus subsp. aureus Mu50
ucacugcuuucaaguaa

SEQ ID NO: 2050124 - RNA, 20 nt, Staphylococcus aureus subsp. aureus Mu50
ucacuuacugugaaaauacc

SEQ ID NO: 2050125 - RNA, 20 nt, Staphylococcus aureus subsp. aureus Mu50
ucacuucucucuuauuaaaa

SEQ ID NO: 2050126 - RNA, 22 nt, Staphylococcus aureus subsp. aureus Mu50
ucacuucucucuuauuaaaaaa

SEQ ID NO: 2050127 - RNA, 18 nt, Staphylococcus aureus subsp. aureus Mu50
ucacuuuaggguucauug

SEQ ID NO: 2050128 - RNA, 19 nt, Staphylococcus aureus subsp. aureus Mu50
ucacuuuacccucuuuagu

SEQ ID NO: 2050129 - RNA, 21 nt, Staphylococcus aureus subsp. aureus Mu50
ucacuuuuuaaacguacauuu

SEQ ID NO: 2050130 - RNA, 20 nt, Staphylococcus aureus subsp. aureus Mu50
ucacuuggauucaaaugaca

SEQ ID NO: 2050131 - RNA, 18 nt, Staphylococcus aureus subsp. aureus Mu50
ucacuuuaacuucuuuug

SEQ ID NO: 2050132 - RNA, 15 nt, Staphylococcus aureus subsp. aureus Mu50
ucacuugguacaccu

SEQ ID NO: 2050133 - RNA, 23 nt, Staphylococcus aureus subsp. aureus Mu50
ucacuccucuauuuuaugauuug

SEQ ID NO: 2050134 - RNA, 23 nt, Staphylococcus aureus subsp. aureus Mu50
ucacuauagccaaaggcaaaaug

SEQ ID NO: 2050135 - RNA, 23 nt, Staphylococcus aureus subsp. aureus Mu50
ucacgugcuucguuuuuaguguu

SEQ ID NO: 2050136 - RNA, 14 nt, Staphylococcus aureus subsp. aureus Mu50
ucacguaaugaauc

SEQ ID NO: 2050137 - RNA, 17 nt, Staphylococcus aureus subsp. aureus Mu50
ucacuaaaguaaauaac

SEQ ID NO: 2050138 - RNA, 13 nt, Staphylococcus aureus subsp. aureus Mu50
ucacuaaaaauau

SEQ ID NO: 2050139 - RNA, 14 nt, Staphylococcus aureus subsp. aureus Mu50
ucacgauauaacau

SEQ ID NO: 2050140 - RNA, 19 nt, Staphylococcus aureus subsp. aureus Mu50
ucacgauauaacauuaaaa

SEQ ID NO: 2050141 - RNA, 14 nt, Staphylococcus aureus subsp. aureus Mu50
ucacgaauaucuua

SEQ ID NO: 2050142 - RNA, 14 nt, Staphylococcus aureus subsp. aureus Mu50
ucaccuuuaggcaa

SEQ ID NO: 2050143 - RNA, 21 nt, Staphylococcus aureus subsp. aureus Mu50
ucaccuuugaauauaguccuu

SEQ ID NO: 2050144 - RNA, 13 nt, Staphylococcus aureus subsp. aureus Mu50
ucaccuucccagu

SEQ ID NO: 2050145 - RNA, 24 nt, Staphylococcus aureus subsp. aureus Mu50
ucaccuguagacaauuguaguaau

SEQ ID NO: 2050146 - RNA, 22 nt, Staphylococcus aureus subsp. aureus Mu50
ucaccugcagcauccuuaccuu

SEQ ID NO: 2050147 - RNA, 15 nt, Staphylococcus aureus subsp. aureus Mu50
ucaccuacaacacca

SEQ ID NO: 2050148 - RNA, 18 nt, Staphylococcus aureus subsp. aureus Mu50
ucacgauuuuuaaaaugc

SEQ ID NO: 2050149 - RNA, 13 nt, Staphylococcus aureus subsp. aureus Mu50
ucacgauuuucaa

SEQ ID NO: 2050150 - RNA, 16 nt, Staphylococcus aureus subsp. aureus Mu50
ucacgauuuuuaaaau

SEQ ID NO: 2050151 - RNA, 14 nt, Staphylococcus aureus subsp. aureus Mu50
ucacgauuaauaaa

SEQ ID NO: 2050152 - RNA, 19 nt, Staphylococcus aureus subsp. aureus Mu50
ucacgauuuuuaaaaugcu

SEQ ID NO: 2050153 - RNA, 13 nt, Staphylococcus aureus subsp. aureus Mu50
ucacgccauaauc

SEQ ID NO: 2050154 - RNA, 12 nt, Staphylococcus aureus subsp. aureus Mu50
ucacgcuaacau

SEQ ID NO: 2050155 - RNA, 19 nt, Staphylococcus aureus subsp. aureus Mu50
ucagaaguuguuuagaaaa

SEQ ID NO: 2050156 - RNA, 20 nt, Staphylococcus aureus subsp. aureus Mu50
ucagaaguuguuuagaaaag

SEQ ID NO: 2050157 - RNA, 14 nt, Staphylococcus aureus subsp. aureus Mu50
ucagaaauuuaaua

SEQ ID NO: 2050158 - RNA, 20 nt, Staphylococcus aureus subsp. aureus Mu50
ucacuuuuuuuaauuugauu

SEQ ID NO: 2050159 - RNA, 17 nt, Staphylococcus aureus subsp. aureus Mu50
ucagaaugaacuucucu

SEQ ID NO: 2050160 - RNA, 12 nt, Staphylococcus aureus subsp. aureus Mu50
ucagaguagaaa

SEQ ID NO: 2050161 - RNA, 14 nt, Staphylococcus aureus subsp. aureus Mu50
ucagaguagaaagu

SEQ ID NO: 2050162 - RNA, 19 nt, Staphylococcus aureus subsp. aureus Mu50
ucagauauaaguagcauca

SEQ ID NO: 2050163 - RNA, 17 nt, Staphylococcus aureus subsp. aureus Mu50
ucagaugaauaauguuu

SEQ ID NO: 2050164 - RNA, 19 nt, Staphylococcus aureus subsp. aureus Mu50
ucagcauuaaucguauuuu

SEQ ID NO: 2050165 - RNA, 20 nt, Staphylococcus aureus subsp. aureus Mu50
ucagcauugggacauaaaau

SEQ ID NO: 2050166 - RNA, 20 nt, Staphylococcus aureus subsp. aureus Mu50
ucagcaccgacaauuauaau

SEQ ID NO: 2050167 - RNA, 18 nt, Staphylococcus aureus subsp. aureus Mu50
uagaugcuugaccuucag

SEQ ID NO: 2050168 - RNA, 19 nt, Staphylococcus aureus subsp. aureus Mu50
uagaugcauaaaaaaagaa

SEQ ID NO: 2050169 - RNA, 23 nt, Staphylococcus aureus subsp. aureus Mu50
uagaugauuagugucacaaagaa

SEQ ID NO: 2050170 - RNA, 11 nt, Staphylococcus aureus subsp. aureus Mu50
uagaugaaaug

SEQ ID NO: 2050171 - RNA, 18 nt, Staphylococcus aureus subsp. aureus Mu50
uagaaaaggcucauuugu

SEQ ID NO: 2050172 - RNA, 14 nt, Staphylococcus aureus subsp. aureus Mu50
uagaaaauaugacg

SEQ ID NO: 2050173 - RNA, 22 nt, Staphylococcus aureus subsp. aureus Mu50
uagaaaauaugacgaucuucau

SEQ ID NO: 2050174 - RNA, 19 nt, Staphylococcus aureus subsp. aureus Mu50
uagaaaaguaaguaaaaua

SEQ ID NO: 2050175 - RNA, 11 nt, Staphylococcus aureus subsp. aureus Mu50
uagaaaacuag

SEQ ID NO: 2050176 - RNA, 14 nt, Staphylococcus aureus subsp. aureus Mu50
uagaaaacuagaac

SEQ ID NO: 2050177 - RNA, 15 nt, Staphylococcus aureus subsp. aureus Mu50
uagauuaucuuucaa

SEQ ID NO: 2050178 - RNA, 20 nt, Staphylococcus aureus subsp. aureus Mu50
uagauucacuguauaaauaa

SEQ ID NO: 2050179 - RNA, 12 nt, Staphylococcus aureus subsp. aureus Mu50
uagauucuuuuc

SEQ ID NO: 2050180 - RNA, 15 nt, Staphylococcus aureus subsp. aureus Mu50
uagauugaucagcuc

SEQ ID NO: 2050181 - RNA, 17 nt, Staphylococcus aureus subsp. aureus Mu50
uagauuguauuuaauaa

SEQ ID NO: 2050182 - RNA, 18 nt, Staphylococcus aureus subsp. aureus Mu50
uagauuguauuuaauaag

SEQ ID NO: 2050183 - RNA, 13 nt, Staphylococcus aureus subsp. aureus Mu50
uagauuuaaaaug

SEQ ID NO: 2050184 - RNA, 14 nt, Staphylococcus aureus subsp. aureus Mu50
uagauuuguguguc

SEQ ID NO: 2050185 - RNA, 14 nt, Staphylococcus aureus subsp. aureus Mu50
uagauuuauaacga

SEQ ID NO: 2050186 - RNA, 12 nt, Staphylococcus aureus subsp. aureus Mu50
uagauuuuaaac

SEQ ID NO: 2050187 - RNA, 14 nt, Staphylococcus aureus subsp. aureus Mu50
uagauuuuauauaa

SEQ ID NO: 2050188 - RNA, 17 nt, Staphylococcus aureus subsp. aureus Mu50
uagauuuuauauaaaaa

SEQ ID NO: 2050189 - RNA, 19 nt, Staphylococcus aureus subsp. aureus Mu50
uagauuuuauauaaaaaga

SEQ ID NO: 2050190 - RNA, 16 nt, Staphylococcus aureus subsp. aureus Mu50
uagauuuucacuaaua

SEQ ID NO: 2050191 - RNA, 19 nt, Staphylococcus aureus subsp. aureus Mu50
uagauuuuguauuagcauc

SEQ ID NO: 2050192 - RNA, 22 nt, Staphylococcus aureus subsp. aureus Mu50
uagauuuuguauuagcaucuga

SEQ ID NO: 2050193 - RNA, 17 nt, Staphylococcus aureus subsp. aureus Mu50
uagccccaguauagaag

SEQ ID NO: 2050194 - RNA, 20 nt, Staphylococcus aureus subsp. aureus Mu50
uagcagggugcuaaauuuac

SEQ ID NO: 2050195 - RNA, 19 nt, Staphylococcus aureus subsp. aureus Mu50
uagcauuccuaauuauauu

SEQ ID NO: 2050196 - RNA, 18 nt, Staphylococcus aureus subsp. aureus Mu50
uagcaugauaaaguaugu

SEQ ID NO: 2050197 - RNA, 20 nt, Staphylococcus aureus subsp. aureus Mu50
uagcaucuuuaccauauaau

SEQ ID NO: 2050198 - RNA, 16 nt, Staphylococcus aureus subsp. aureus Mu50
uagcaaaauuauguaa

SEQ ID NO: 2050199 - RNA, 15 nt, Staphylococcus aureus subsp. aureus Mu50
uagcaaaaauacuuu

SEQ ID NO: 2050200 - RNA, 14 nt, Staphylococcus aureus subsp. aureus Mu50
uagcaaaaauacuu

SEQ ID NO: 2050201 - RNA, 20 nt, Staphylococcus aureus subsp. aureus Mu50
uagcaaccauauuuuuagaa

SEQ ID NO: 2050202 - RNA, 22 nt, Staphylococcus aureus subsp. aureus Mu50
uagcaaauauuauuaaaucaaa

SEQ ID NO: 2050203 - RNA, 17 nt, Staphylococcus aureus subsp. aureus Mu50
uagcaaauauuucuggc

SEQ ID NO: 2050204 - RNA, 16 nt, Staphylococcus aureus subsp. aureus Mu50
uagcaacugaucauuu

SEQ ID NO: 2050205 - RNA, 19 nt, Staphylococcus aureus subsp. aureus Mu50
uagcaagaauagauugauu

SEQ ID NO: 2050206 - RNA, 12 nt, Staphylococcus aureus subsp. aureus Mu50
uaggacauauaa

SEQ ID NO: 2050207 - RNA, 13 nt, Staphylococcus aureus subsp. aureus Mu50
uaggacauauaaa

SEQ ID NO: 2050208 - RNA, 18 nt, Staphylococcus aureus subsp. aureus Mu50
uaggacauauaaauguug

SEQ ID NO: 2050209 - RNA, 21 nt, Staphylococcus aureus subsp. aureus Mu50
uaggacauauaaauguugacu

SEQ ID NO: 2050210 - RNA, 13 nt, Staphylococcus aureus subsp. aureus Mu50
uagcuuagucaau

SEQ ID NO: 2050211 - RNA, 21 nt, Staphylococcus aureus subsp. aureus Mu50
uagcuuagucaauguauauuu

SEQ ID NO: 2050212 - RNA, 13 nt, Staphylococcus aureus subsp. aureus Mu50
uagcuauuaaaau

SEQ ID NO: 2050213 - RNA, 20 nt, Staphylococcus aureus subsp. aureus Mu50
uagcucaaaacaauuuaaaa

SEQ ID NO: 2050214 - RNA, 15 nt, Staphylococcus aureus subsp. aureus Mu50
uagcuauuaaaauag

SEQ ID NO: 2050215 - RNA, 17 nt, Staphylococcus aureus subsp. aureus Mu50
uaggcaggaaugauaua

SEQ ID NO: 2050216 - RNA, 18 nt, Staphylococcus aureus subsp. aureus Mu50
uaggauuuacaccuauac

SEQ ID NO: 2050217 - RNA, 18 nt, Staphylococcus aureus subsp. aureus Mu50
uaggauuugcaccuauac

SEQ ID NO: 2050218 - RNA, 18 nt, Staphylococcus aureus subsp. aureus Mu50
uagcgcgcuuauugaaaa

SEQ ID NO: 2050219 - RNA, 18 nt, Staphylococcus aureus subsp. aureus Mu50
uagcuaaugcauuauuau

SEQ ID NO: 2050220 - RNA, 15 nt, Staphylococcus aureus subsp. aureus Mu50
uagcguaauuauuau

SEQ ID NO: 2050221 - RNA, 19 nt, Staphylococcus aureus subsp. aureus Mu50
uaguacaccucuaaguuca

SEQ ID NO: 2050222 - RNA, 14 nt, Staphylococcus aureus subsp. aureus Mu50
uaguacacguguau

SEQ ID NO: 2050223 - RNA, 23 nt, Staphylococcus aureus subsp. aureus Mu50
uaguaauucuucaucuucuucaa

SEQ ID NO: 2050224 - RNA, 19 nt, Staphylococcus aureus subsp. aureus Mu50
uaguaauaacaucuaaauu

SEQ ID NO: 2050225 - RNA, 17 nt, Staphylococcus aureus subsp. aureus Mu50
uaguaagguuugaacuc

SEQ ID NO: 2050226 - RNA, 14 nt, Staphylococcus aureus subsp. aureus Mu50
uaguaaugauguga

SEQ ID NO: 2050227 - RNA, 22 nt, Staphylococcus aureus subsp. aureus Mu50
uaguaaugaugugaauuggauu

SEQ ID NO: 2050228 - RNA, 16 nt, Staphylococcus aureus subsp. aureus Mu50
uaguaauaagacaaua

SEQ ID NO: 2050229 - RNA, 19 nt, Staphylococcus aureus subsp. aureus Mu50
uaguaaauauaguuaaagu

SEQ ID NO: 2050230 - RNA, 12 nt, Staphylococcus aureus subsp. aureus Mu50
uagguuagaauu

SEQ ID NO: 2050231 - RNA, 16 nt, Staphylococcus aureus subsp. aureus Mu50
uagguucaucuuuaug

SEQ ID NO: 2050232 - RNA, 16 nt, Staphylococcus aureus subsp. aureus Mu50
uagguugauuucugcu

SEQ ID NO: 2050233 - RNA, 17 nt, Staphylococcus aureus subsp. aureus Mu50
uagguuuaauuuuaaau

SEQ ID NO: 2050234 - RNA, 17 nt, Staphylococcus aureus subsp. aureus Mu50
uaguccggggccccaac

SEQ ID NO: 2050235 - RNA, 23 nt, Staphylococcus aureus subsp. aureus Mu50
uaguccggggccccaacaaagaa

SEQ ID NO: 2050236 - RNA, 22 nt, Staphylococcus aureus subsp. aureus Mu50
uaguccuucccacuuaucauca

SEQ ID NO: 2050237 - RNA, 23 nt, Staphylococcus aureus subsp. aureus Mu50
uaguccuucuuuacuaaaccuca

SEQ ID NO: 2050238 - RNA, 16 nt, Staphylococcus aureus subsp. aureus Mu50
uagucauaauuuaaaa

SEQ ID NO: 2050239 - RNA, 20 nt, Staphylococcus aureus subsp. aureus Mu50
uagucauguuuggcauaaua

SEQ ID NO: 2050240 - RNA, 22 nt, Staphylococcus aureus subsp. aureus Mu50
uagucauguuuggcauaauaau

SEQ ID NO: 2050241 - RNA, 17 nt, Staphylococcus aureus subsp. aureus Mu50
uagucauuacaaaucau

SEQ ID NO: 2050242 - RNA, 15 nt, Staphylococcus aureus subsp. aureus Mu50
uagucauuacauuuu

SEQ ID NO: 2050243 - RNA, 15 nt, Staphylococcus aureus subsp. aureus Mu50
uaguauggaauaaau

SEQ ID NO: 2050244 - RNA, 15 nt, Staphylococcus aureus subsp. aureus Mu50
uaguauuauagccua

SEQ ID NO: 2050245 - RNA, 18 nt, Staphylococcus aureus subsp. aureus Mu50
uaguauucaaaaaauauu

SEQ ID NO: 2050246 - RNA, 19 nt, Staphylococcus aureus subsp. aureus Mu50
uaguauucaaaaaauauuu

SEQ ID NO: 2050247 - RNA, 17 nt, Staphylococcus aureus subsp. aureus Mu50
uagucaauuaaugauaa

SEQ ID NO: 2050248 - RNA, 15 nt, Staphylococcus aureus subsp. aureus Mu50
uaguauuucaucauu

SEQ ID NO: 2050249 - RNA, 22 nt, Staphylococcus aureus subsp. aureus Mu50
uaguauuucaucauuaguuuuu

SEQ ID NO: 2050250 - RNA, 19 nt, Staphylococcus aureus subsp. aureus Mu50
uaguaguuuauaucaaaaa

SEQ ID NO: 2050251 - RNA, 14 nt, Staphylococcus aureus subsp. aureus Mu50
uaguauaaauauca

SEQ ID NO: 2050252 - RNA, 14 nt, Staphylococcus aureus subsp. aureus Mu50
uaguagcuagaaca

SEQ ID NO: 2050253 - RNA, 20 nt, Staphylococcus aureus subsp. aureus Mu50
uaguagauuuauuaaauaua

SEQ ID NO: 2050254 - RNA, 15 nt, Staphylococcus aureus subsp. aureus Mu50
uaguacuuaauuuaa

SEQ ID NO: 2050255 - RNA, 16 nt, Staphylococcus aureus subsp. aureus Mu50
uaguacuuaauuuaaa

SEQ ID NO: 2050256 - RNA, 22 nt, Staphylococcus aureus subsp. aureus Mu50
uaguacuuugauaucuacagag

SEQ ID NO: 2050257 - RNA, 14 nt, Staphylococcus aureus subsp. aureus Mu50
uauaaguuaaaaau

SEQ ID NO: 2050258 - RNA, 14 nt, Staphylococcus aureus subsp. aureus Mu50
uauaaguuaaaauu

SEQ ID NO: 2050259 - RNA, 19 nt, Staphylococcus aureus subsp. aureus Mu50
uauaaguugcauauaaaaa

SEQ ID NO: 2050260 - RNA, 19 nt, Staphylococcus aureus subsp. aureus Mu50
uauaaguuugguucaguag

SEQ ID NO: 2050261 - RNA, 22 nt, Staphylococcus aureus subsp. aureus Mu50
uauaagggguauauuaaaaauu

SEQ ID NO: 2050262 - RNA, 18 nt, Staphylococcus aureus subsp. aureus Mu50
uauaaggauguacuauaa

SEQ ID NO: 2050263 - RNA, 23 nt, Staphylococcus aureus subsp. aureus Mu50
uauaaggauguacuauaaauccu

SEQ ID NO: 2050264 - RNA, 13 nt, Staphylococcus aureus subsp. aureus Mu50
uauaaguaaauaa

SEQ ID NO: 2050265 - RNA, 12 nt, Staphylococcus aureus subsp. aureus Mu50
uauaaguacaaa

SEQ ID NO: 2050266 - RNA, 18 nt, Staphylococcus aureus subsp. aureus Mu50
uauaaguauuuuaggguu

SEQ ID NO: 2050267 - RNA, 15 nt, Staphylococcus aureus subsp. aureus Mu50
uauaaguacaaauaa

SEQ ID NO: 2050268 - RNA, 16 nt, Staphylococcus aureus subsp. aureus Mu50
uauaaguaaauaauag

SEQ ID NO: 2050269 - RNA, 20 nt, Staphylococcus aureus subsp. aureus Mu50
uauaagccuuuucaaacaua

SEQ ID NO: 2050270 - RNA, 17 nt, Staphylococcus aureus subsp. aureus Mu50
uauaagcuuguaauccu

SEQ ID NO: 2050271 - RNA, 15 nt, Staphylococcus aureus subsp. aureus Mu50
uauaagccuuuucaa

SEQ ID NO: 2050272 - RNA, 17 nt, Staphylococcus aureus subsp. aureus Mu50
uauaagauagauaaauc

SEQ ID NO: 2050273 - RNA, 16 nt, Staphylococcus aureus subsp. aureus Mu50
uauaagauucauauuu

SEQ ID NO: 2050274 - RNA, 13 nt, Staphylococcus aureus subsp. aureus Mu50
uauaacuuuaaaa

SEQ ID NO: 2050275 - RNA, 18 nt, Staphylococcus aureus subsp. aureus Mu50
uauaacuuuaaaaauuaa

SEQ ID NO: 2050276 - RNA, 21 nt, Staphylococcus aureus subsp. aureus Mu50
uauaagaauuuaaaagagaau

SEQ ID NO: 2050277 - RNA, 18 nt, Staphylococcus aureus subsp. aureus Mu50
uauaacccuaaugugugg

SEQ ID NO: 2050278 - RNA, 21 nt, Staphylococcus aureus subsp. aureus Mu50
uauaaccgugaugaugugcaa

SEQ ID NO: 2050279 - RNA, 15 nt, Staphylococcus aureus subsp. aureus Mu50
uauaaccuauuaaau

SEQ ID NO: 2050280 - RNA, 20 nt, Staphylococcus aureus subsp. aureus Mu50
uauaaccauguauaucuaau

SEQ ID NO: 2050281 - RNA, 21 nt, Staphylococcus aureus subsp. aureus Mu50
uauaacccuaauguguggauu

SEQ ID NO: 2050282 - RNA, 16 nt, Staphylococcus aureus subsp. aureus Mu50
uauaacucuaaauaua

SEQ ID NO: 2050283 - RNA, 18 nt, Staphylococcus aureus subsp. aureus Mu50
uauaacugauaauacugu

SEQ ID NO: 2050284 - RNA, 20 nt, Staphylococcus aureus subsp. aureus Mu50
uauaacugcauguacaucuu

SEQ ID NO: 2050285 - RNA, 18 nt, Staphylococcus aureus subsp. aureus Mu50
uauaacacgauaauuaua

SEQ ID NO: 2050286 - RNA, 20 nt, Staphylococcus aureus subsp. aureus Mu50
uauaacaacuacuuaaauua

SEQ ID NO: 2050287 - RNA, 20 nt, Staphylococcus aureus subsp. aureus Mu50
uauaacaaaaauugcuauau

SEQ ID NO: 2050288 - RNA, 21 nt, Staphylococcus aureus subsp. aureus Mu50
uauaaaguugacaauacaaau

SEQ ID NO: 2050289 - RNA, 19 nt, Staphylococcus aureus subsp. aureus Mu50
uauaaauuugguacauaau

SEQ ID NO: 2050290 - RNA, 19 nt, Staphylococcus aureus subsp. aureus Mu50
uauaaauuuguaccaaaua

SEQ ID NO: 2050291 - RNA, 18 nt, Staphylococcus aureus subsp. aureus Mu50
uauaaagacgauuuauua

SEQ ID NO: 2050292 - RNA, 10 nt, Staphylococcus aureus subsp. aureus Mu50
uauaaagaau

SEQ ID NO: 2050293 - RNA, 13 nt, Staphylococcus aureus subsp. aureus Mu50
uauaaagaaauaa

SEQ ID NO: 2050294 - RNA, 21 nt, Staphylococcus aureus subsp. aureus Mu50
uauaaagaaauaauuuaaagg

SEQ ID NO: 2050295 - RNA, 17 nt, Staphylococcus aureus subsp. aureus Mu50
uauaaacgucacuuuau

SEQ ID NO: 2050296 - RNA, 21 nt, Staphylococcus aureus subsp. aureus Mu50
uauaaacgucacuuuauuaaa

SEQ ID NO: 2050297 - RNA, 19 nt, Staphylococcus aureus subsp. aureus Mu50
uauaaaaagaucauuaaaa

SEQ ID NO: 2050298 - RNA, 17 nt, Staphylococcus aureus subsp. aureus Mu50
uauaaaacgauaagaau

SEQ ID NO: 2050299 - RNA, 20 nt, Staphylococcus aureus subsp. aureus Mu50
uauaaaacgauaagaauuaa

SEQ ID NO: 2050300 - RNA, 14 nt, Staphylococcus aureus subsp. aureus Mu50
uauaaaauaaaaug

SEQ ID NO: 2050301 - RNA, 16 nt, Staphylococcus aureus subsp. aureus Mu50
uaguuguccauuuuau

SEQ ID NO: 2050302 - RNA, 22 nt, Staphylococcus aureus subsp. aureus Mu50
uaguuuaacaauacuacuuaau

SEQ ID NO: 2050303 - RNA, 20 nt, Staphylococcus aureus subsp. aureus Mu50
uaguuuaagucuaacuuuag

SEQ ID NO: 2050304 - RNA, 12 nt, Staphylococcus aureus subsp. aureus Mu50
uaguuuauuaau

SEQ ID NO: 2050305 - RNA, 16 nt, Staphylococcus aureus subsp. aureus Mu50
uauaaaaacagcagug

SEQ ID NO: 2050306 - RNA, 22 nt, Staphylococcus aureus subsp. aureus Mu50
uagugcucuugcaauagcaaca

SEQ ID NO: 2050307 - RNA, 17 nt, Staphylococcus aureus subsp. aureus Mu50
uagugcaaguaauuuaa

SEQ ID NO: 2050308 - RNA, 21 nt, Staphylococcus aureus subsp. aureus Mu50
uaguugccccuagcaaaaaua

SEQ ID NO: 2050309 - RNA, 23 nt, Staphylococcus aureus subsp. aureus Mu50
uaguugaucaaaaagacagcagu

SEQ ID NO: 2050310 - RNA, 21 nt, Staphylococcus aureus subsp. aureus Mu50
uaguugagcguuuaauuagaa

SEQ ID NO: 2050311 - RNA, 23 nt, Staphylococcus aureus subsp. aureus Mu50
uaguucgcgacgacguccagcua

SEQ ID NO: 2050312 - RNA, 15 nt, Staphylococcus aureus subsp. aureus Mu50
uaguucuuuaaauua

SEQ ID NO: 2050313 - RNA, 14 nt, Staphylococcus aureus subsp. aureus Mu50
uaguucuuugucug

SEQ ID NO: 2050314 - RNA, 18 nt, Staphylococcus aureus subsp. aureus Mu50
uaucgccuggugcaggca

SEQ ID NO: 2050315 - RNA, 18 nt, Staphylococcus aureus subsp. aureus Mu50
uauccucgguauuuaaug

SEQ ID NO: 2050316 - RNA, 14 nt, Staphylococcus aureus subsp. aureus Mu50
uauccugauuuaau

SEQ ID NO: 2050317 - RNA, 15 nt, Staphylococcus aureus subsp. aureus Mu50
uaucguuuauugaua

SEQ ID NO: 2050318 - RNA, 17 nt, Staphylococcus aureus subsp. aureus Mu50
uaucguaaaaaaacguc

SEQ ID NO: 2050319 - RNA, 18 nt, Staphylococcus aureus subsp. aureus Mu50
uaucuccgcuacaauuau

SEQ ID NO: 2050320 - RNA, 23 nt, Staphylococcus aureus subsp. aureus Mu50
uaucauucuguguaaauauaaau

SEQ ID NO: 2050321 - RNA, 21 nt, Staphylococcus aureus subsp. aureus Mu50
uaucauuguguccauaaauau

SEQ ID NO: 2050322 - RNA, 13 nt, Staphylococcus aureus subsp. aureus Mu50
uauccaaagacau

SEQ ID NO: 2050323 - RNA, 23 nt, Staphylococcus aureus subsp. aureus Mu50
uaucauuuaaaauauuuuuucug

SEQ ID NO: 2050324 - RNA, 23 nt, Staphylococcus aureus subsp. aureus Mu50
uaucauuuggcguucaacauuac

SEQ ID NO: 2050325 - RNA, 19 nt, Staphylococcus aureus subsp. aureus Mu50
uaucauuucaaauaagaau

SEQ ID NO: 2050326 - RNA, 22 nt, Staphylococcus aureus subsp. aureus Mu50
uauccaauacuaccuuccauuu

SEQ ID NO: 2050327 - RNA, 20 nt, Staphylococcus aureus subsp. aureus Mu50
uauccaaaauccugaaauua

SEQ ID NO: 2050328 - RNA, 19 nt, Staphylococcus aureus subsp. aureus Mu50
uauccaaggauguuauaaa

SEQ ID NO: 2050329 - RNA, 21 nt, Staphylococcus aureus subsp. aureus Mu50
uauccaaggauguuauaaaau

SEQ ID NO: 2050330 - RNA, 16 nt, Staphylococcus aureus subsp. aureus Mu50
uauccaauguauaaaa

SEQ ID NO: 2050331 - RNA, 15 nt, Staphylococcus aureus subsp. aureus Mu50
uauccauguauuuuu

SEQ ID NO: 2050332 - RNA, 20 nt, Staphylococcus aureus subsp. aureus Mu50
uauccauguauuuuucuacc

SEQ ID NO: 2050333 - RNA, 20 nt, Staphylococcus aureus subsp. aureus Mu50
uauccauuaugauguagaug

SEQ ID NO: 2050334 - RNA, 19 nt, Staphylococcus aureus subsp. aureus Mu50
uauccuaagcauaauucaa

SEQ ID NO: 2050335 - RNA, 17 nt, Staphylococcus aureus subsp. aureus Mu50
uauaugauguucaauau

SEQ ID NO: 2050336 - RNA, 23 nt, Staphylococcus aureus subsp. aureus Mu50
uauaugccgauugcucuaaucca

SEQ ID NO: 2050337 - RNA, 15 nt, Staphylococcus aureus subsp. aureus Mu50
uauauggcaucauca

SEQ ID NO: 2050338 - RNA, 16 nt, Staphylococcus aureus subsp. aureus Mu50
uauauguaaucagagu

SEQ ID NO: 2050339 - RNA, 22 nt, Staphylococcus aureus subsp. aureus Mu50
uauauguaaucagaguagaaag

SEQ ID NO: 2050340 - RNA, 17 nt, Staphylococcus aureus subsp. aureus Mu50
uauauggaauuguaucu

SEQ ID NO: 2050341 - RNA, 21 nt, Staphylococcus aureus subsp. aureus Mu50
uauaugucucucuuucuuauu

SEQ ID NO: 2050342 - RNA, 15 nt, Staphylococcus aureus subsp. aureus Mu50
uaucaaaauauaaaa

SEQ ID NO: 2050343 - RNA, 11 nt, Staphylococcus aureus subsp. aureus Mu50
uauauuuuuau

SEQ ID NO: 2050344 - RNA, 12 nt, Staphylococcus aureus subsp. aureus Mu50
uaucaaauucau

SEQ ID NO: 2050345 - RNA, 14 nt, Staphylococcus aureus subsp. aureus Mu50
uaucaacaauggaa

SEQ ID NO: 2050346 - RNA, 14 nt, Staphylococcus aureus subsp. aureus Mu50
uaucaacauaaaau

SEQ ID NO: 2050347 - RNA, 16 nt, Staphylococcus aureus subsp. aureus Mu50
uaucaacauaauauuu

SEQ ID NO: 2050348 - RNA, 20 nt, Staphylococcus aureus subsp. aureus Mu50
uaucaacauuaauaaauaau

SEQ ID NO: 2050349 - RNA, 15 nt, Staphylococcus aureus subsp. aureus Mu50
uaucaacauuaauaa

SEQ ID NO: 2050350 - RNA, 13 nt, Staphylococcus aureus subsp. aureus Mu50
uaucaagaaaaag

SEQ ID NO: 2050351 - RNA, 15 nt, Staphylococcus aureus subsp. aureus Mu50
uaucacuaucagcuu

SEQ ID NO: 2050352 - RNA, 21 nt, Staphylococcus aureus subsp. aureus Mu50
uaucaagaaaaaguuuuucug

SEQ ID NO: 2050353 - RNA, 16 nt, Staphylococcus aureus subsp. aureus Mu50
uaucacugaaugcuaa

SEQ ID NO: 2050354 - RNA, 13 nt, Staphylococcus aureus subsp. aureus Mu50
uaucacuuauuau

SEQ ID NO: 2050355 - RNA, 17 nt, Staphylococcus aureus subsp. aureus Mu50
uaucacuuuucaugaug

SEQ ID NO: 2050356 - RNA, 23 nt, Staphylococcus aureus subsp. aureus Mu50
uauauaaaguugacaauacaaau

SEQ ID NO: 2050357 - RNA, 20 nt, Staphylococcus aureus subsp. aureus Mu50
uauauaacaaguacaauaau

SEQ ID NO: 2050358 - RNA, 21 nt, Staphylococcus aureus subsp. aureus Mu50
uauauaaccauaguaauaaaa

SEQ ID NO: 2050359 - RNA, 13 nt, Staphylococcus aureus subsp. aureus Mu50
uauauaauugauu

SEQ ID NO: 2050360 - RNA, 15 nt, Staphylococcus aureus subsp. aureus Mu50
uauauaaacaaaaau

SEQ ID NO: 2050361 - RNA, 18 nt, Staphylococcus aureus subsp. aureus Mu50
uauauaaacaaaaaucua

SEQ ID NO: 2050362 - RNA, 20 nt, Staphylococcus aureus subsp. aureus Mu50
uauauaaaguugacaauaca

SEQ ID NO: 2050363 - RNA, 18 nt, Staphylococcus aureus subsp. aureus Mu50
uauagucuuaaacauaac

SEQ ID NO: 2050364 - RNA, 16 nt, Staphylococcus aureus subsp. aureus Mu50
uauaguuggcaauccu

SEQ ID NO: 2050365 - RNA, 14 nt, Staphylococcus aureus subsp. aureus Mu50
uauauaaaaacugu

SEQ ID NO: 2050366 - RNA, 15 nt, Staphylococcus aureus subsp. aureus Mu50
uauauauuaaaguaa

SEQ ID NO: 2050367 - RNA, 21 nt, Staphylococcus aureus subsp. aureus Mu50
uauauauuccacgcucacauu

SEQ ID NO: 2050368 - RNA, 15 nt, Staphylococcus aureus subsp. aureus Mu50
uauaucaacguuaau

SEQ ID NO: 2050369 - RNA, 15 nt, Staphylococcus aureus subsp. aureus Mu50
uauaucagcuuguuu

SEQ ID NO: 2050370 - RNA, 18 nt, Staphylococcus aureus subsp. aureus Mu50
uauaguguuugacaaguu

SEQ ID NO: 2050371 - RNA, 19 nt, Staphylococcus aureus subsp. aureus Mu50
uauaguguuuuauucgaua

SEQ ID NO: 2050372 - RNA, 20 nt, Staphylococcus aureus subsp. aureus Mu50
uauaguugagcguuuaauua

SEQ ID NO: 2050373 - RNA, 15 nt, Staphylococcus aureus subsp. aureus Mu50
uauagucuuaaacau

SEQ ID NO: 2050374 - RNA, 23 nt, Staphylococcus aureus subsp. aureus Mu50
uauaguccuucccacuuaucauc

SEQ ID NO: 2050375 - RNA, 16 nt, Staphylococcus aureus subsp. aureus Mu50
uauaguaauuguuaua

SEQ ID NO: 2050376 - RNA, 15 nt, Staphylococcus aureus subsp. aureus Mu50
uauaguaauaaaagu

SEQ ID NO: 2050377 - RNA, 17 nt, Staphylococcus aureus subsp. aureus Mu50
uauaguaauagcuauau

SEQ ID NO: 2050378 - RNA, 23 nt, Staphylococcus aureus subsp. aureus Mu50
uauaguaggguauugaaauaaua

SEQ ID NO: 2050379 - RNA, 21 nt, Staphylococcus aureus subsp. aureus Mu50
uauaaugauugucuuauaaga

SEQ ID NO: 2050380 - RNA, 23 nt, Staphylococcus aureus subsp. aureus Mu50
uauaauccagcgacauguccugu

SEQ ID NO: 2050381 - RNA, 14 nt, Staphylococcus aureus subsp. aureus Mu50
uauaguaagaaaag

SEQ ID NO: 2050382 - RNA, 15 nt, Staphylococcus aureus subsp. aureus Mu50
uauagguuuauaaaa

SEQ ID NO: 2050383 - RNA, 18 nt, Staphylococcus aureus subsp. aureus Mu50
uauaaucuaucuugugcu

SEQ ID NO: 2050384 - RNA, 20 nt, Staphylococcus aureus subsp. aureus Mu50
uauaaucauuuaaacgaucu

SEQ ID NO: 2050385 - RNA, 15 nt, Staphylococcus aureus subsp. aureus Mu50
uaugccauucauuaa

SEQ ID NO: 2050386 - RNA, 22 nt, Staphylococcus aureus subsp. aureus Mu50
uaugcguagcaacauuauuuuu

SEQ ID NO: 2050387 - RNA, 22 nt, Staphylococcus aureus subsp. aureus Mu50
uaugcuuguugugaauaaaauu

SEQ ID NO: 2050388 - RNA, 21 nt, Staphylococcus aureus subsp. aureus Mu50
uaugcuguguaucaucauaau

SEQ ID NO: 2050389 - RNA, 22 nt, Staphylococcus aureus subsp. aureus Mu50
uaugcuguuggcaaaacaauau

SEQ ID NO: 2050390 - RNA, 19 nt, Staphylococcus aureus subsp. aureus Mu50
uaugcugcaagucucauau

SEQ ID NO: 2050391 - RNA, 21 nt, Staphylococcus aureus subsp. aureus Mu50
uaugcucuacaaaguuauaau

SEQ ID NO: 2050392 - RNA, 16 nt, Staphylococcus aureus subsp. aureus Mu50
uauggauguauuucug

SEQ ID NO: 2050393 - RNA, 16 nt, Staphylococcus aureus subsp. aureus Mu50
uauggauaaaauuuaa

SEQ ID NO: 2050394 - RNA, 20 nt, Staphylococcus aureus subsp. aureus Mu50
uauggagcuacccuauuuua

SEQ ID NO: 2050395 - RNA, 13 nt, Staphylococcus aureus subsp. aureus Mu50
uauggagcggaag

SEQ ID NO: 2050396 - RNA, 21 nt, Staphylococcus aureus subsp. aureus Mu50
uauggcgcaauuuuuaacaaa

SEQ ID NO: 2050397 - RNA, 16 nt, Staphylococcus aureus subsp. aureus Mu50
uauguggauacaaacc

SEQ ID NO: 2050398 - RNA, 20 nt, Staphylococcus aureus subsp. aureus Mu50
uaugucuuaacaacaugauu

SEQ ID NO: 2050399 - RNA, 16 nt, Staphylococcus aureus subsp. aureus Mu50
uauguuauguaaauaa

SEQ ID NO: 2050400 - RNA, 17 nt, Staphylococcus aureus subsp. aureus Mu50
uauguucagaaauuuaa

SEQ ID NO: 2050401 - RNA, 15 nt, Staphylococcus aureus subsp. aureus Mu50
uauguuauauuaaac

SEQ ID NO: 2050402 - RNA, 21 nt, Staphylococcus aureus subsp. aureus Mu50
uauguuacuuauauauucaau

SEQ ID NO: 2050403 - RNA, 15 nt, Staphylococcus aureus subsp. aureus Mu50
uauguuauaaauucu

SEQ ID NO: 2050404 - RNA, 12 nt, Staphylococcus aureus subsp. aureus Mu50
uauguguauaug

SEQ ID NO: 2050405 - RNA, 15 nt, Staphylococcus aureus subsp. aureus Mu50
uauguguuucuagcu

SEQ ID NO: 2050406 - RNA, 20 nt, Staphylococcus aureus subsp. aureus Mu50
uauuaaaaaagaacauaaaa

SEQ ID NO: 2050407 - RNA, 21 nt, Staphylococcus aureus subsp. aureus Mu50
uauguuugggauauagaaaag

SEQ ID NO: 2050408 - RNA, 20 nt, Staphylococcus aureus subsp. aureus Mu50
uauguuuuaucaauauuagu

SEQ ID NO: 2050409 - RNA, 14 nt, Staphylococcus aureus subsp. aureus Mu50
uauguuuuugggua

SEQ ID NO: 2050410 - RNA, 15 nt, Staphylococcus aureus subsp. aureus Mu50
uauguuguuauauaa

SEQ ID NO: 2050411 - RNA, 16 nt, Staphylococcus aureus subsp. aureus Mu50
uauguuguuauauaaa

SEQ ID NO: 2050412 - RNA, 15 nt, Staphylococcus aureus subsp. aureus Mu50
uaugguucguccauu

SEQ ID NO: 2050413 - RNA, 15 nt, Staphylococcus aureus subsp. aureus Mu50
uaugguuagagaaaa

SEQ ID NO: 2050414 - RNA, 16 nt, Staphylococcus aureus subsp. aureus Mu50
uaugguguggugugau

SEQ ID NO: 2050415 - RNA, 16 nt, Staphylococcus aureus subsp. aureus Mu50
uaugguuguuuuccaa

SEQ ID NO: 2050416 - RNA, 22 nt, Staphylococcus aureus subsp. aureus Mu50
uaugguuguuuuccaauaauaa

SEQ ID NO: 2050417 - RNA, 21 nt, Staphylococcus aureus subsp. aureus Mu50
uaugguuuaccuaguuuuacu

SEQ ID NO: 2050418 - RNA, 17 nt, Staphylococcus aureus subsp. aureus Mu50
uaugguuucuuauuaaa

SEQ ID NO: 2050419 - RNA, 12 nt, Staphylococcus aureus subsp. aureus Mu50
uauguaaaaaau

SEQ ID NO: 2050420 - RNA, 13 nt, Staphylococcus aureus subsp. aureus Mu50
uauguaaauaaca

SEQ ID NO: 2050421 - RNA, 14 nt, Staphylococcus aureus subsp. aureus Mu50
uauguaaucagagu

SEQ ID NO: 2050422 - RNA, 23 nt, Staphylococcus aureus subsp. aureus Mu50
uauguaacaauuuagcaaauauu

SEQ ID NO: 2050423 - RNA, 20 nt, Staphylococcus aureus subsp. aureus Mu50
uaugucuagacuuauuugaa

SEQ ID NO: 2050424 - RNA, 22 nt, Staphylococcus aureus subsp. aureus Mu50
uaugucuagacuuauuugaaug

SEQ ID NO: 2050425 - RNA, 22 nt, Staphylococcus aureus subsp. aureus Mu50
uaugucaauagcgguuuaaaaa

SEQ ID NO: 2050426 - RNA, 14 nt, Staphylococcus aureus subsp. aureus Mu50
uaugaaauaacuag

SEQ ID NO: 2050427 - RNA, 21 nt, Staphylococcus aureus subsp. aureus Mu50
uaugaaguaagcagagccaua

SEQ ID NO: 2050428 - RNA, 19 nt, Staphylococcus aureus subsp. aureus Mu50
uaugaaucauuuuagcacc

SEQ ID NO: 2050429 - RNA, 22 nt, Staphylococcus aureus subsp. aureus Mu50
uaugaauccugugacucaauga

SEQ ID NO: 2050430 - RNA, 16 nt, Staphylococcus aureus subsp. aureus Mu50
uaugaaucgauauaau

SEQ ID NO: 2050431 - RNA, 23 nt, Staphylococcus aureus subsp. aureus Mu50
uaugaauggcaaucuauauaaau

SEQ ID NO: 2050432 - RNA, 17 nt, Staphylococcus aureus subsp. aureus Mu50
uaugaauuauuaauaag

SEQ ID NO: 2050433 - RNA, 22 nt, Staphylococcus aureus subsp. aureus Mu50
uaucuuuuguuguuuccuuaga

SEQ ID NO: 2050434 - RNA, 22 nt, Staphylococcus aureus subsp. aureus Mu50
uaucuuuuuacugcacuuuuau

SEQ ID NO: 2050435 - RNA, 14 nt, Staphylococcus aureus subsp. aureus Mu50
uaucuuuugcuucg

SEQ ID NO: 2050436 - RNA, 12 nt, Staphylococcus aureus subsp. aureus Mu50
uaucuuuucauc

SEQ ID NO: 2050437 - RNA, 14 nt, Staphylococcus aureus subsp. aureus Mu50
uaugaacaaaaaau

SEQ ID NO: 2050438 - RNA, 15 nt, Staphylococcus aureus subsp. aureus Mu50
uaugaacaauaagug

SEQ ID NO: 2050439 - RNA, 14 nt, Staphylococcus aureus subsp. aureus Mu50
uaugaaauuuuuua

SEQ ID NO: 2050440 - RNA, 18 nt, Staphylococcus aureus subsp. aureus Mu50
uaugaaaccuuugguuca

SEQ ID NO: 2050441 - RNA, 14 nt, Staphylococcus aureus subsp. aureus Mu50
uaucuuucaauuaa

SEQ ID NO: 2050442 - RNA, 19 nt, Staphylococcus aureus subsp. aureus Mu50
uaucuuucugaagaacgau

SEQ ID NO: 2050443 - RNA, 17 nt, Staphylococcus aureus subsp. aureus Mu50
uaucuuuauuugauucu

SEQ ID NO: 2050444 - RNA, 18 nt, Staphylococcus aureus subsp. aureus Mu50
uaucuuuaguauugguac

SEQ ID NO: 2050445 - RNA, 17 nt, Staphylococcus aureus subsp. aureus Mu50
uaucuuuaguauuucau

SEQ ID NO: 2050446 - RNA, 18 nt, Staphylococcus aureus subsp. aureus Mu50
uaucuugauuuuauaaau

SEQ ID NO: 2050447 - RNA, 11 nt, Staphylococcus aureus subsp. aureus Mu50
uaucuuuaauu

SEQ ID NO: 2050448 - RNA, 18 nt, Staphylococcus aureus subsp. aureus Mu50
uaucuucuuuuaauauuu

SEQ ID NO: 2050449 - RNA, 20 nt, Staphylococcus aureus subsp. aureus Mu50
uaugaauugaguauuaaauu

SEQ ID NO: 2050450 - RNA, 21 nt, Staphylococcus aureus subsp. aureus Mu50
uaugaauugaguauuaaauuu

SEQ ID NO: 2050451 - RNA, 16 nt, Staphylococcus aureus subsp. aureus Mu50
uaugaauugcuuguuu

SEQ ID NO: 2050452 - RNA, 23 nt, Staphylococcus aureus subsp. aureus Mu50
uaugaauuuagaugcauaaaaaa

SEQ ID NO: 2050453 - RNA, 22 nt, Staphylococcus aureus subsp. aureus Mu50
uaugaauuuagcaucaaaaaua

SEQ ID NO: 2050454 - RNA, 18 nt, Staphylococcus aureus subsp. aureus Mu50
uaugacugcuuuuuauua

SEQ ID NO: 2050455 - RNA, 22 nt, Staphylococcus aureus subsp. aureus Mu50
uaugacuaacgaaaaagauggu

SEQ ID NO: 2050456 - RNA, 21 nt, Staphylococcus aureus subsp. aureus Mu50
uaugacgcgugaauuaaaaaa

SEQ ID NO: 2050457 - RNA, 14 nt, Staphylococcus aureus subsp. aureus Mu50
uaugaccuuuaugu

SEQ ID NO: 2050458 - RNA, 15 nt, Staphylococcus aureus subsp. aureus Mu50
uaugauccuuuaaug

SEQ ID NO: 2050459 - RNA, 16 nt, Staphylococcus aureus subsp. aureus Mu50
uaugauaauuaauuaa

SEQ ID NO: 2050460 - RNA, 19 nt, Staphylococcus aureus subsp. aureus Mu50
uaugauacgcuuuuuaaaa

SEQ ID NO: 2050461 - RNA, 23 nt, Staphylococcus aureus subsp. aureus Mu50
uaugauacugauauuuagaauaa

SEQ ID NO: 2050462 - RNA, 16 nt, Staphylococcus aureus subsp. aureus Mu50
uaugauaaccauuaug

SEQ ID NO: 2050463 - RNA, 17 nt, Staphylococcus aureus subsp. aureus Mu50
uaugagcuuaauaaauu

SEQ ID NO: 2050464 - RNA, 20 nt, Staphylococcus aureus subsp. aureus Mu50
uaugcauaauaccaauugcu

SEQ ID NO: 2050465 - RNA, 20 nt, Staphylococcus aureus subsp. aureus Mu50
uaugcaaugcaccuauaaua

SEQ ID NO: 2050466 - RNA, 16 nt, Staphylococcus aureus subsp. aureus Mu50
uaugcacaucauugau

SEQ ID NO: 2050467 - RNA, 22 nt, Staphylococcus aureus subsp. aureus Mu50
uaugauuuucuuuaauaacuaa

SEQ ID NO: 2050468 - RNA, 19 nt, Staphylococcus aureus subsp. aureus Mu50
uaugauugcuuauuuauuu

SEQ ID NO: 2050469 - RNA, 21 nt, Staphylococcus aureus subsp. aureus Mu50
uaugauuuguuugauuuauua

SEQ ID NO: 2050470 - RNA, 16 nt, Staphylococcus aureus subsp. aureus Mu50
uaugcaaaugaaauuc

SEQ ID NO: 2050471 - RNA, 17 nt, Staphylococcus aureus subsp. aureus Mu50
uaugauuuaaaauauaa

SEQ ID NO: 2050472 - RNA, 18 nt, Staphylococcus aureus subsp. aureus Mu50
uaugauuugauuugggua

SEQ ID NO: 2050473 - RNA, 19 nt, Staphylococcus aureus subsp. aureus Mu50
uaugauuaauaaaguaauc

SEQ ID NO: 2050474 - RNA, 23 nt, Staphylococcus aureus subsp. aureus Mu50
uaugauucuaacggcguuuguuu

SEQ ID NO: 2050475 - RNA, 16 nt, Staphylococcus aureus subsp. aureus Mu50
uaugaugggaaaaaau

SEQ ID NO: 2050476 - RNA, 14 nt, Staphylococcus aureus subsp. aureus Mu50
uaugaugcuucuaa

SEQ ID NO: 2050477 - RNA, 21 nt, Staphylococcus aureus subsp. aureus Mu50
uaugaugaauuguuguacaug

SEQ ID NO: 2050478 - RNA, 16 nt, Staphylococcus aureus subsp. aureus Mu50
uacugguuaguaaaau

SEQ ID NO: 2050479 - RNA, 22 nt, Staphylococcus aureus subsp. aureus Mu50
uacuggguuuuaccauaaauug

SEQ ID NO: 2050480 - RNA, 23 nt, Staphylococcus aureus subsp. aureus Mu50
uacuggguuuuaccauaaauuga

SEQ ID NO: 2050481 - RNA, 19 nt, Staphylococcus aureus subsp. aureus Mu50
uacugcuguuuuuuauagu

SEQ ID NO: 2050482 - RNA, 17 nt, Staphylococcus aureus subsp. aureus Mu50
uacuguaguacuauagu

SEQ ID NO: 2050483 - RNA, 15 nt, Staphylococcus aureus subsp. aureus Mu50
uacugugaaaauacc

SEQ ID NO: 2050484 - RNA, 16 nt, Staphylococcus aureus subsp. aureus Mu50
uacuguuuaaauaaaa

SEQ ID NO: 2050485 - RNA, 13 nt, Staphylococcus aureus subsp. aureus Mu50
uacuguuugcuuu

SEQ ID NO: 2050486 - RNA, 15 nt, Staphylococcus aureus subsp. aureus Mu50
uacuuauauauucaa

SEQ ID NO: 2050487 - RNA, 21 nt, Staphylococcus aureus subsp. aureus Mu50
uacuuacuccguugaauucaa

SEQ ID NO: 2050488 - RNA, 17 nt, Staphylococcus aureus subsp. aureus Mu50
uacuuacgccaaucaca

SEQ ID NO: 2050489 - RNA, 18 nt, Staphylococcus aureus subsp. aureus Mu50
uacuuacgccaaucacaa

SEQ ID NO: 2050490 - RNA, 15 nt, Staphylococcus aureus subsp. aureus Mu50
uacuuaauuaauaau

SEQ ID NO: 2050491 - RNA, 14 nt, Staphylococcus aureus subsp. aureus Mu50
uacuuaauuuaaau

SEQ ID NO: 2050492 - RNA, 16 nt, Staphylococcus aureus subsp. aureus Mu50
uacuuaaauuaagaau

SEQ ID NO: 2050493 - RNA, 13 nt, Staphylococcus aureus subsp. aureus Mu50
uacuuauuucuuu

SEQ ID NO: 2050494 - RNA, 18 nt, Staphylococcus aureus subsp. aureus Mu50
uacuuauuucuuuucauu

SEQ ID NO: 2050495 - RNA, 19 nt, Staphylococcus aureus subsp. aureus Mu50
uacuuauuucuuuucauua

SEQ ID NO: 2050496 - RNA, 20 nt, Staphylococcus aureus subsp. aureus Mu50
uacuucaccacauaaaaaua

SEQ ID NO: 2050497 - RNA, 14 nt, Staphylococcus aureus subsp. aureus Mu50
uacuuccauugcuu

SEQ ID NO: 2050498 - RNA, 18 nt, Staphylococcus aureus subsp. aureus Mu50
uacuuucgaguaauacuu

SEQ ID NO: 2050499 - RNA, 17 nt, Staphylococcus aureus subsp. aureus Mu50
uacuuucaccauuuacu

SEQ ID NO: 2050500 - RNA, 18 nt, Staphylococcus aureus subsp. aureus Mu50
uacuuuggaaauuuauua

SEQ ID NO: 2050501 - RNA, 18 nt, Staphylococcus aureus subsp. aureus Mu50
uacuuuggacuuuaaagu

SEQ ID NO: 2050502 - RNA, 19 nt, Staphylococcus aureus subsp. aureus Mu50
uacuuuggacuuuaaaguu

SEQ ID NO: 2050503 - RNA, 22 nt, Staphylococcus aureus subsp. aureus Mu50
uacuuuggcagacguaucauca

SEQ ID NO: 2050504 - RNA, 21 nt, Staphylococcus aureus subsp. aureus Mu50
uacuuuuccuugauucuuaua

SEQ ID NO: 2050505 - RNA, 20 nt, Staphylococcus aureus subsp. aureus Mu50
uacuuuucucgauuaauuuu

SEQ ID NO: 2050506 - RNA, 18 nt, Staphylococcus aureus subsp. aureus Mu50
uacuuuucugucuguaaa

SEQ ID NO: 2050507 - RNA, 15 nt, Staphylococcus aureus subsp. aureus Mu50
uacuuuuccuugauu

SEQ ID NO: 2050508 - RNA, 16 nt, Staphylococcus aureus subsp. aureus Mu50
uacuuuuauaaucuuu

SEQ ID NO: 2050509 - RNA, 19 nt, Staphylococcus aureus subsp. aureus Mu50
uacuuuucucgauuaauuu

SEQ ID NO: 2050510 - RNA, 15 nt, Staphylococcus aureus subsp. aureus Mu50
uacuuuuucaucuuu

SEQ ID NO: 2050511 - RNA, 14 nt, Staphylococcus aureus subsp. aureus Mu50
uacuuuuucagaau

SEQ ID NO: 2050512 - RNA, 18 nt, Staphylococcus aureus subsp. aureus Mu50
uagaaaaauaugauugca

SEQ ID NO: 2050513 - RNA, 12 nt, Staphylococcus aureus subsp. aureus Mu50
uacuucuucuuc

SEQ ID NO: 2050514 - RNA, 21 nt, Staphylococcus aureus subsp. aureus Mu50
uacuucucaauuuaguauaaa

SEQ ID NO: 2050515 - RNA, 15 nt, Staphylococcus aureus subsp. aureus Mu50
uacuucuaauuugca

SEQ ID NO: 2050516 - RNA, 15 nt, Staphylococcus aureus subsp. aureus Mu50
uacuucucaauuuag

SEQ ID NO: 2050517 - RNA, 20 nt, Staphylococcus aureus subsp. aureus Mu50
uacuugauuagauuugugug

SEQ ID NO: 2050518 - RNA, 19 nt, Staphylococcus aureus subsp. aureus Mu50
uacuugaauaccuuuuauu

SEQ ID NO: 2050519 - RNA, 19 nt, Staphylococcus aureus subsp. aureus Mu50
uacuuguaauuaauacauc

SEQ ID NO: 2050520 - RNA, 17 nt, Staphylococcus aureus subsp. aureus Mu50
uacuuuaauuuagugaa

SEQ ID NO: 2050521 - RNA, 17 nt, Staphylococcus aureus subsp. aureus Mu50
uacuuuacauuucucgu

SEQ ID NO: 2050522 - RNA, 23 nt, Staphylococcus aureus subsp. aureus Mu50
uacuuuagaaagugauucccaaa

SEQ ID NO: 2050523 - RNA, 18 nt, Staphylococcus aureus subsp. aureus Mu50
uacuugucguauucuuca

SEQ ID NO: 2050524 - RNA, 16 nt, Staphylococcus aureus subsp. aureus Mu50
uacuugucguauucuu

SEQ ID NO: 2050525 - RNA, 17 nt, Staphylococcus aureus subsp. aureus Mu50
uacuuguaauuaauaca

SEQ ID NO: 2050526 - RNA, 18 nt, Staphylococcus aureus subsp. aureus Mu50
uacuuguaauuaauacau

SEQ ID NO: 2050527 - RNA, 20 nt, Staphylococcus aureus subsp. aureus Mu50
uacugaaacuaaauuaaaag

SEQ ID NO: 2050528 - RNA, 17 nt, Staphylococcus aureus subsp. aureus Mu50
uacucugggcauuuuga

SEQ ID NO: 2050529 - RNA, 18 nt, Staphylococcus aureus subsp. aureus Mu50
uacucugggcauuuugac

SEQ ID NO: 2050530 - RNA, 19 nt, Staphylococcus aureus subsp. aureus Mu50
uacucugggcauuuugacg

SEQ ID NO: 2050531 - RNA, 19 nt, Staphylococcus aureus subsp. aureus Mu50
uacucugaaaagccuacuu

SEQ ID NO: 2050532 - RNA, 16 nt, Staphylococcus aureus subsp. aureus Mu50
uacucuucguuuuaau

SEQ ID NO: 2050533 - RNA, 23 nt, Staphylococcus aureus subsp. aureus Mu50
uacugcaccgauaucauauaaug

SEQ ID NO: 2050534 - RNA, 22 nt, Staphylococcus aureus subsp. aureus Mu50
uacugcaauuauuuuucaaaua

SEQ ID NO: 2050535 - RNA, 14 nt, Staphylococcus aureus subsp. aureus Mu50
uacugauugaaugu

SEQ ID NO: 2050536 - RNA, 21 nt, Staphylococcus aureus subsp. aureus Mu50
uacugacucuuaauuuugcaa

SEQ ID NO: 2050537 - RNA, 18 nt, Staphylococcus aureus subsp. aureus Mu50
uacugcuucgacauugau

SEQ ID NO: 2050538 - RNA, 18 nt, Staphylococcus aureus subsp. aureus Mu50
uacucauuuagcucuacu

SEQ ID NO: 2050539 - RNA, 21 nt, Staphylococcus aureus subsp. aureus Mu50
uacucuaaaaaaggaagaaca

SEQ ID NO: 2050540 - RNA, 12 nt, Staphylococcus aureus subsp. aureus Mu50
uacuaaaacaug

SEQ ID NO: 2050541 - RNA, 21 nt, Staphylococcus aureus subsp. aureus Mu50
uacuaaaaguguuaugaauua

SEQ ID NO: 2050542 - RNA, 17 nt, Staphylococcus aureus subsp. aureus Mu50
uacuaaaccucaacauu

SEQ ID NO: 2050543 - RNA, 16 nt, Staphylococcus aureus subsp. aureus Mu50
uacgucauaaaauacc

SEQ ID NO: 2050544 - RNA, 14 nt, Staphylococcus aureus subsp. aureus Mu50
uacguuuuaaauaa

SEQ ID NO: 2050545 - RNA, 15 nt, Staphylococcus aureus subsp. aureus Mu50
uacguuuuuuuaaau

SEQ ID NO: 2050546 - RNA, 23 nt, Staphylococcus aureus subsp. aureus Mu50
uacuauuuuugacuguuaaacaa

SEQ ID NO: 2050547 - RNA, 19 nt, Staphylococcus aureus subsp. aureus Mu50
uacuauuaaaggaaaucaa

SEQ ID NO: 2050548 - RNA, 23 nt, Staphylococcus aureus subsp. aureus Mu50
uacuauuaaaggaaaucaaucca

SEQ ID NO: 2050549 - RNA, 16 nt, Staphylococcus aureus subsp. aureus Mu50
uacuauuaaauaaucg

SEQ ID NO: 2050550 - RNA, 22 nt, Staphylococcus aureus subsp. aureus Mu50
uaccccuguugaauauacuaaa

SEQ ID NO: 2050551 - RNA, 18 nt, Staphylococcus aureus subsp. aureus Mu50
uacccacuuauaaacaaa

SEQ ID NO: 2050552 - RNA, 15 nt, Staphylococcus aureus subsp. aureus Mu50
uacccuauuuuacaa

SEQ ID NO: 2050553 - RNA, 22 nt, Staphylococcus aureus subsp. aureus Mu50
uacccuugcaaauauaucaucu

SEQ ID NO: 2050554 - RNA, 21 nt, Staphylococcus aureus subsp. aureus Mu50
uacccucuuuaguuaauucuc

SEQ ID NO: 2050555 - RNA, 21 nt, Staphylococcus aureus subsp. aureus Mu50
uaccgauuguuaauuuaaagu

SEQ ID NO: 2050556 - RNA, 21 nt, Staphylococcus aureus subsp. aureus Mu50
uacauaacccuaaaaugaaua

SEQ ID NO: 2050557 - RNA, 14 nt, Staphylococcus aureus subsp. aureus Mu50
uacauaauaaaaag

SEQ ID NO: 2050558 - RNA, 20 nt, Staphylococcus aureus subsp. aureus Mu50
uacauaauuuaucaauuucu

SEQ ID NO: 2050559 - RNA, 12 nt, Staphylococcus aureus subsp. aureus Mu50
uacauaaauacc

SEQ ID NO: 2050560 - RNA, 12 nt, Staphylococcus aureus subsp. aureus Mu50
uacauaaaucua

SEQ ID NO: 2050561 - RNA, 22 nt, Staphylococcus aureus subsp. aureus Mu50
uacauaaaugcuaaaaguauaa

SEQ ID NO: 2050562 - RNA, 13 nt, Staphylococcus aureus subsp. aureus Mu50
uacauaaaucuaa

SEQ ID NO: 2050563 - RNA, 17 nt, Staphylococcus aureus subsp. aureus Mu50
uacauaaaucuaauacu

SEQ ID NO: 2050564 - RNA, 21 nt, Staphylococcus aureus subsp. aureus Mu50
uacauacggcaaauucaacuu

SEQ ID NO: 2050565 - RNA, 22 nt, Staphylococcus aureus subsp. aureus Mu50
uacauaauuuaucugcaaaaug

SEQ ID NO: 2050566 - RNA, 20 nt, Staphylococcus aureus subsp. aureus Mu50
uaccacgaacaagucuugca

SEQ ID NO: 2050567 - RNA, 15 nt, Staphylococcus aureus subsp. aureus Mu50
uaccacuugaauacu

SEQ ID NO: 2050568 - RNA, 22 nt, Staphylococcus aureus subsp. aureus Mu50
uaccacuugaauacuuuuuaac

SEQ ID NO: 2050569 - RNA, 12 nt, Staphylococcus aureus subsp. aureus Mu50
uaccagcaugaa

SEQ ID NO: 2050570 - RNA, 19 nt, Staphylococcus aureus subsp. aureus Mu50
uaccaguaacaauaacacc

SEQ ID NO: 2050571 - RNA, 15 nt, Staphylococcus aureus subsp. aureus Mu50
uacguacgguagucu

SEQ ID NO: 2050572 - RNA, 22 nt, Staphylococcus aureus subsp. aureus Mu50
uacgcaaugauuauaaauacau

SEQ ID NO: 2050573 - RNA, 20 nt, Staphylococcus aureus subsp. aureus Mu50
uacgaugaugauuuauaaaa

SEQ ID NO: 2050574 - RNA, 15 nt, Staphylococcus aureus subsp. aureus Mu50
uaccuuccauuucga

SEQ ID NO: 2050575 - RNA, 22 nt, Staphylococcus aureus subsp. aureus Mu50
uaccuucuucuacccauaauuu

SEQ ID NO: 2050576 - RNA, 18 nt, Staphylococcus aureus subsp. aureus Mu50
uaccguauuuuaauauug

SEQ ID NO: 2050577 - RNA, 19 nt, Staphylococcus aureus subsp. aureus Mu50
uaccuaaagcuaauacacc

SEQ ID NO: 2050578 - RNA, 19 nt, Staphylococcus aureus subsp. aureus Mu50
uaccguauuuuaauauuga

SEQ ID NO: 2050579 - RNA, 17 nt, Staphylococcus aureus subsp. aureus Mu50
uaccuaaccauaacaau

SEQ ID NO: 2050580 - RNA, 14 nt, Staphylococcus aureus subsp. aureus Mu50
uaccuauaaacaua

SEQ ID NO: 2050581 - RNA, 15 nt, Staphylococcus aureus subsp. aureus Mu50
uaccuaauaggauuu

SEQ ID NO: 2050582 - RNA, 14 nt, Staphylococcus aureus subsp. aureus Mu50
uaccuuuuucuacc

SEQ ID NO: 2050583 - RNA, 16 nt, Staphylococcus aureus subsp. aureus Mu50
uaccuuugucuuuuuu

SEQ ID NO: 2050584 - RNA, 22 nt, Staphylococcus aureus subsp. aureus Mu50
uaccuuugucuuuuuuaucaug

SEQ ID NO: 2050585 - RNA, 20 nt, Staphylococcus aureus subsp. aureus Mu50
uaccuuuuucuaaaccaaca

SEQ ID NO: 2050586 - RNA, 18 nt, Staphylococcus aureus subsp. aureus Mu50
uacgaacaacuaacacgu

SEQ ID NO: 2050587 - RNA, 13 nt, Staphylococcus aureus subsp. aureus Mu50
uacgaaaugcaau

SEQ ID NO: 2050588 - RNA, 19 nt, Staphylococcus aureus subsp. aureus Mu50
uacgaaaguagaauuauuu

SEQ ID NO: 2050589 - RNA, 13 nt, Staphylococcus aureus subsp. aureus Mu50
uaccuuuaauaau

SEQ ID NO: 2050590 - RNA, 16 nt, Staphylococcus aureus subsp. aureus Mu50
uaccuuuaauaauauu

SEQ ID NO: 2050591 - RNA, 14 nt, Staphylococcus aureus subsp. aureus Mu50
uaccuuuaauaucu

SEQ ID NO: 2050592 - RNA, 15 nt, Staphylococcus aureus subsp. aureus Mu50
uaccuuuaauaucua

SEQ ID NO: 2050593 - RNA, 15 nt, Staphylococcus aureus subsp. aureus Mu50
uaccuuugucuuuuu

SEQ ID NO: 2050594 - RNA, 18 nt, Staphylococcus aureus subsp. aureus Mu50
uaccuuucaaauauaucu

SEQ ID NO: 2050595 - RNA, 12 nt, Staphylococcus aureus subsp. aureus Mu50
uaccuuuccauu

SEQ ID NO: 2050596 - RNA, 17 nt, Staphylococcus aureus subsp. aureus Mu50
uacgaucauaaauauuu

SEQ ID NO: 2050597 - RNA, 22 nt, Staphylococcus aureus subsp. aureus Mu50
uacgaaucacaguuauauauuc

SEQ ID NO: 2050598 - RNA, 23 nt, Staphylococcus aureus subsp. aureus Mu50
uacgaaguuuaaaugugcaauua

SEQ ID NO: 2050599 - RNA, 10 nt, Staphylococcus aureus subsp. aureus Mu50
uaauuuuaau

SEQ ID NO: 2050600 - RNA, 16 nt, Staphylococcus aureus subsp. aureus Mu50
uaauuuuacucuguau

SEQ ID NO: 2050601 - RNA, 10 nt, Staphylococcus aureus subsp. aureus Mu50
uaauuuguua

SEQ ID NO: 2050602 - RNA, 19 nt, Staphylococcus aureus subsp. aureus Mu50
uaauuugucauuucuucuu

SEQ ID NO: 2050603 - RNA, 15 nt, Staphylococcus aureus subsp. aureus Mu50
uaauuuuaaaaauaa

SEQ ID NO: 2050604 - RNA, 21 nt, Staphylococcus aureus subsp. aureus Mu50
uaauuuucacuuucaaugaca

SEQ ID NO: 2050605 - RNA, 14 nt, Staphylococcus aureus subsp. aureus Mu50
uaauuuuauuuaau

SEQ ID NO: 2050606 - RNA, 18 nt, Staphylococcus aureus subsp. aureus Mu50
uaauuuuuauucuguaac

SEQ ID NO: 2050607 - RNA, 15 nt, Staphylococcus aureus subsp. aureus Mu50
uaauuuuuaacagcg

SEQ ID NO: 2050608 - RNA, 24 nt, Staphylococcus aureus subsp. aureus Mu50
uaauuuuuaacagcgugaauauaa

SEQ ID NO: 2050609 - RNA, 13 nt, Staphylococcus aureus subsp. aureus Mu50
uaauuuuuaaauc

SEQ ID NO: 2050610 - RNA, 23 nt, Staphylococcus aureus subsp. aureus Mu50
uaauuuucuugccaucaauuucu

SEQ ID NO: 2050611 - RNA, 21 nt, Staphylococcus aureus subsp. aureus Mu50
uaauuuuguuuugcuucuuua

SEQ ID NO: 2050612 - RNA, 18 nt, Staphylococcus aureus subsp. aureus Mu50
uaauuuugcaacauuaaa

SEQ ID NO: 2050613 - RNA, 21 nt, Staphylococcus aureus subsp. aureus Mu50
uaauuuugcaacauuaaauua

SEQ ID NO: 2050614 - RNA, 19 nt, Staphylococcus aureus subsp. aureus Mu50
uaauuuugugaauuuauuu

SEQ ID NO: 2050615 - RNA, 13 nt, Staphylococcus aureus subsp. aureus Mu50
uaauuuuguaauu

SEQ ID NO: 2050616 - RNA, 17 nt, Staphylococcus aureus subsp. aureus Mu50
uaauuuuucuaaaugau

SEQ ID NO: 2050617 - RNA, 15 nt, Staphylococcus aureus subsp. aureus Mu50
uaauuuuuugugccu

SEQ ID NO: 2050618 - RNA, 22 nt, Staphylococcus aureus subsp. aureus Mu50
uaauuuuuuuccuuucuuuuuc

SEQ ID NO: 2050619 - RNA, 13 nt, Staphylococcus aureus subsp. aureus Mu50
uacaaaacauauu

SEQ ID NO: 2050620 - RNA, 22 nt, Staphylococcus aureus subsp. aureus Mu50
uaauuuccuaaaaacugugauu

SEQ ID NO: 2050621 - RNA, 16 nt, Staphylococcus aureus subsp. aureus Mu50
uaauuuccaauaucuu

SEQ ID NO: 2050622 - RNA, 18 nt, Staphylococcus aureus subsp. aureus Mu50
uaauuucaguucuuagau

SEQ ID NO: 2050623 - RNA, 22 nt, Staphylococcus aureus subsp. aureus Mu50
uaauuucaauuuggaaauaucu

SEQ ID NO: 2050624 - RNA, 17 nt, Staphylococcus aureus subsp. aureus Mu50
uaauuucaguucuuaga

SEQ ID NO: 2050625 - RNA, 20 nt, Staphylococcus aureus subsp. aureus Mu50
uaauuuggucauagaaauuu

SEQ ID NO: 2050626 - RNA, 23 nt, Staphylococcus aureus subsp. aureus Mu50
uaauuugauguucuugaaaacaa

SEQ ID NO: 2050627 - RNA, 11 nt, Staphylococcus aureus subsp. aureus Mu50
uaauuugauua

SEQ ID NO: 2050628 - RNA, 17 nt, Staphylococcus aureus subsp. aureus Mu50
uaauuucuaugaaaaaa

SEQ ID NO: 2050629 - RNA, 13 nt, Staphylococcus aureus subsp. aureus Mu50
uaauuucuucuuc

SEQ ID NO: 2050630 - RNA, 15 nt, Staphylococcus aureus subsp. aureus Mu50
uaauucgccaucuuu

SEQ ID NO: 2050631 - RNA, 22 nt, Staphylococcus aureus subsp. aureus Mu50
uaauucuagagauaacuagaau

SEQ ID NO: 2050632 - RNA, 13 nt, Staphylococcus aureus subsp. aureus Mu50
uaauucuaagucu

SEQ ID NO: 2050633 - RNA, 20 nt, Staphylococcus aureus subsp. aureus Mu50
uaauucuauuuuugauuuaa

SEQ ID NO: 2050634 - RNA, 16 nt, Staphylococcus aureus subsp. aureus Mu50
uaauucuauuuuugau

SEQ ID NO: 2050635 - RNA, 17 nt, Staphylococcus aureus subsp. aureus Mu50
uaauucuauuuuugauu

SEQ ID NO: 2050636 - RNA, 17 nt, Staphylococcus aureus subsp. aureus Mu50
uaauucuccuaauaauu

SEQ ID NO: 2050637 - RNA, 14 nt, Staphylococcus aureus subsp. aureus Mu50
uaauuuaaaauagu

SEQ ID NO: 2050638 - RNA, 23 nt, Staphylococcus aureus subsp. aureus Mu50
uaauuuaaagaacuauuuuaaau

SEQ ID NO: 2050639 - RNA, 14 nt, Staphylococcus aureus subsp. aureus Mu50
uaauuuaaagcauc

SEQ ID NO: 2050640 - RNA, 20 nt, Staphylococcus aureus subsp. aureus Mu50
uaauuuaaagcaucauauac

SEQ ID NO: 2050641 - RNA, 19 nt, Staphylococcus aureus subsp. aureus Mu50
uaauuuaucaauuucuauu

SEQ ID NO: 2050642 - RNA, 16 nt, Staphylococcus aureus subsp. aureus Mu50
uaauuuauugauaagc

SEQ ID NO: 2050643 - RNA, 22 nt, Staphylococcus aureus subsp. aureus Mu50
uaauuuaguuauaauuucuguu

SEQ ID NO: 2050644 - RNA, 13 nt, Staphylococcus aureus subsp. aureus Mu50
uaauuuaauauuu

SEQ ID NO: 2050645 - RNA, 17 nt, Staphylococcus aureus subsp. aureus Mu50
uaauuuaauauuuagau

SEQ ID NO: 2050646 - RNA, 16 nt, Staphylococcus aureus subsp. aureus Mu50
uaauuuacauuaauuu

SEQ ID NO: 2050647 - RNA, 16 nt, Staphylococcus aureus subsp. aureus Mu50
uaauuuagacaucauu

SEQ ID NO: 2050648 - RNA, 15 nt, Staphylococcus aureus subsp. aureus Mu50
uaauuuaauaauuaa

SEQ ID NO: 2050649 - RNA, 16 nt, Staphylococcus aureus subsp. aureus Mu50
uaauuuacaauuaauu

SEQ ID NO: 2050650 - RNA, 20 nt, Staphylococcus aureus subsp. aureus Mu50
uaauuuaaaugauuucacuu

SEQ ID NO: 2050651 - RNA, 13 nt, Staphylococcus aureus subsp. aureus Mu50
uaauuuaaaugcu

SEQ ID NO: 2050652 - RNA, 14 nt, Staphylococcus aureus subsp. aureus Mu50
uaauuuaaaugcuu

SEQ ID NO: 2050653 - RNA, 15 nt, Staphylococcus aureus subsp. aureus Mu50
uacagucaacugcug

SEQ ID NO: 2050654 - RNA, 20 nt, Staphylococcus aureus subsp. aureus Mu50
uacagucaauacaaagaauu

SEQ ID NO: 2050655 - RNA, 15 nt, Staphylococcus aureus subsp. aureus Mu50
uacaguaaauugauu

SEQ ID NO: 2050656 - RNA, 17 nt, Staphylococcus aureus subsp. aureus Mu50
uacaguaauauucaacu

SEQ ID NO: 2050657 - RNA, 15 nt, Staphylococcus aureus subsp. aureus Mu50
uacagguuuaauaaa

SEQ ID NO: 2050658 - RNA, 18 nt, Staphylococcus aureus subsp. aureus Mu50
uacagguuuuaaaauuaa

SEQ ID NO: 2050659 - RNA, 19 nt, Staphylococcus aureus subsp. aureus Mu50
uacagguuuuaaaauuaaa

SEQ ID NO: 2050660 - RNA, 23 nt, Staphylococcus aureus subsp. aureus Mu50
uacaguucuauagguuuauaaaa

SEQ ID NO: 2050661 - RNA, 14 nt, Staphylococcus aureus subsp. aureus Mu50
uacagguugaauaa

SEQ ID NO: 2050662 - RNA, 22 nt, Staphylococcus aureus subsp. aureus Mu50
uacagcgugauucaucuauuau

SEQ ID NO: 2050663 - RNA, 20 nt, Staphylococcus aureus subsp. aureus Mu50
uacagcgugauucaucuauu

SEQ ID NO: 2050664 - RNA, 24 nt, Staphylococcus aureus subsp. aureus Mu50
uacacuaucauuaucaaauaaccu

SEQ ID NO: 2050665 - RNA, 17 nt, Staphylococcus aureus subsp. aureus Mu50
uacacuaucguuuuuau

SEQ ID NO: 2050666 - RNA, 14 nt, Staphylococcus aureus subsp. aureus Mu50
uacacuagucuuuu

SEQ ID NO: 2050667 - RNA, 22 nt, Staphylococcus aureus subsp. aureus Mu50
uacacugcacaucauaauaaau

SEQ ID NO: 2050668 - RNA, 19 nt, Staphylococcus aureus subsp. aureus Mu50
uacacgacgcuaaacaaag

SEQ ID NO: 2050669 - RNA, 17 nt, Staphylococcus aureus subsp. aureus Mu50
uacacgaguauuaucac

SEQ ID NO: 2050670 - RNA, 23 nt, Staphylococcus aureus subsp. aureus Mu50
uacacguaacgcaguugaaaaag

SEQ ID NO: 2050671 - RNA, 14 nt, Staphylococcus aureus subsp. aureus Mu50
uacacgcauuacuu

SEQ ID NO: 2050672 - RNA, 16 nt, Staphylococcus aureus subsp. aureus Mu50
uacacuuaauauauuc

SEQ ID NO: 2050673 - RNA, 17 nt, Staphylococcus aureus subsp. aureus Mu50
uacacuguuuuauaaau

SEQ ID NO: 2050674 - RNA, 15 nt, Staphylococcus aureus subsp. aureus Mu50
uacagcacugaaauc

SEQ ID NO: 2050675 - RNA, 14 nt, Staphylococcus aureus subsp. aureus Mu50
uacagcaucaccua

SEQ ID NO: 2050676 - RNA, 14 nt, Staphylococcus aureus subsp. aureus Mu50
uacaccuauaccuc

SEQ ID NO: 2050677 - RNA, 13 nt, Staphylococcus aureus subsp. aureus Mu50
uacaauuuccuac

SEQ ID NO: 2050678 - RNA, 15 nt, Staphylococcus aureus subsp. aureus Mu50
uacaauuuccuaccc

SEQ ID NO: 2050679 - RNA, 17 nt, Staphylococcus aureus subsp. aureus Mu50
uacaauuaaagugaaua

SEQ ID NO: 2050680 - RNA, 23 nt, Staphylococcus aureus subsp. aureus Mu50
uacaauuaauuacuguaaauaug

SEQ ID NO: 2050681 - RNA, 16 nt, Staphylococcus aureus subsp. aureus Mu50
uacaauuauauguagg

SEQ ID NO: 2050682 - RNA, 16 nt, Staphylococcus aureus subsp. aureus Mu50
uacaauuauaaaugau

SEQ ID NO: 2050683 - RNA, 23 nt, Staphylococcus aureus subsp. aureus Mu50
uacaagucuuauuuguuuaauua

SEQ ID NO: 2050684 - RNA, 14 nt, Staphylococcus aureus subsp. aureus Mu50
uacaagucuuauuu

SEQ ID NO: 2050685 - RNA, 17 nt, Staphylococcus aureus subsp. aureus Mu50
uacaacucguuuuucca

SEQ ID NO: 2050686 - RNA, 18 nt, Staphylococcus aureus subsp. aureus Mu50
uacaacucguuuuuccau

SEQ ID NO: 2050687 - RNA, 17 nt, Staphylococcus aureus subsp. aureus Mu50
uacaaagccuuaauauc

SEQ ID NO: 2050688 - RNA, 12 nt, Staphylococcus aureus subsp. aureus Mu50
uacaacuucauu

SEQ ID NO: 2050689 - RNA, 19 nt, Staphylococcus aureus subsp. aureus Mu50
uacaacucguuuuuccaug

SEQ ID NO: 2050690 - RNA, 14 nt, Staphylococcus aureus subsp. aureus Mu50
uaaucccuucaaaa

SEQ ID NO: 2050691 - RNA, 21 nt, Staphylococcus aureus subsp. aureus Mu50
uaaucccuucaaaauuuugac

SEQ ID NO: 2050692 - RNA, 23 nt, Staphylococcus aureus subsp. aureus Mu50
uaauccgagucauacucaucaga

SEQ ID NO: 2050693 - RNA, 18 nt, Staphylococcus aureus subsp. aureus Mu50
uaaucauuguguauuguu

SEQ ID NO: 2050694 - RNA, 14 nt, Staphylococcus aureus subsp. aureus Mu50
uaaucauuguguau

SEQ ID NO: 2050695 - RNA, 17 nt, Staphylococcus aureus subsp. aureus Mu50
uaauccuuguucuauuu

SEQ ID NO: 2050696 - RNA, 16 nt, Staphylococcus aureus subsp. aureus Mu50
uaauccuucuccaaaa

SEQ ID NO: 2050697 - RNA, 13 nt, Staphylococcus aureus subsp. aureus Mu50
uaauauucaacuu

SEQ ID NO: 2050698 - RNA, 14 nt, Staphylococcus aureus subsp. aureus Mu50
uaauauucaacuug

SEQ ID NO: 2050699 - RNA, 21 nt, Staphylococcus aureus subsp. aureus Mu50
uaauauucuuucguuuucauc

SEQ ID NO: 2050700 - RNA, 17 nt, Staphylococcus aureus subsp. aureus Mu50
uaauauugaaaugagcu

SEQ ID NO: 2050701 - RNA, 13 nt, Staphylococcus aureus subsp. aureus Mu50
uaauaucuuuugc

SEQ ID NO: 2050702 - RNA, 14 nt, Staphylococcus aureus subsp. aureus Mu50
uaauaucuucuuua

SEQ ID NO: 2050703 - RNA, 17 nt, Staphylococcus aureus subsp. aureus Mu50
uaauaugaaggcuuuuu

SEQ ID NO: 2050704 - RNA, 17 nt, Staphylococcus aureus subsp. aureus Mu50
uaauauuuagauacuga

SEQ ID NO: 2050705 - RNA, 17 nt, Staphylococcus aureus subsp. aureus Mu50
uaauauuggacuuugcu

SEQ ID NO: 2050706 - RNA, 14 nt, Staphylococcus aureus subsp. aureus Mu50
uaauauuucuuaga

SEQ ID NO: 2050707 - RNA, 15 nt, Staphylococcus aureus subsp. aureus Mu50
uaacguuaauauaau

SEQ ID NO: 2050708 - RNA, 20 nt, Staphylococcus aureus subsp. aureus Mu50
uaacgucauuuuuaauaaug

SEQ ID NO: 2050709 - RNA, 20 nt, Staphylococcus aureus subsp. aureus Mu50
uaacgucaacagcauaaaua

SEQ ID NO: 2050710 - RNA, 22 nt, Staphylococcus aureus subsp. aureus Mu50
uaacggaaauacaaugaauugu

SEQ ID NO: 2050711 - RNA, 15 nt, Staphylococcus aureus subsp. aureus Mu50
uaauaguguuauauu

SEQ ID NO: 2050712 - RNA, 17 nt, Staphylococcus aureus subsp. aureus Mu50
uaauaguguuauauugu

SEQ ID NO: 2050713 - RNA, 16 nt, Staphylococcus aureus subsp. aureus Mu50
uaauaguaaugaugug

SEQ ID NO: 2050714 - RNA, 12 nt, Staphylococcus aureus subsp. aureus Mu50
uaauauaaaaac

SEQ ID NO: 2050715 - RNA, 19 nt, Staphylococcus aureus subsp. aureus Mu50
uaauauaaaaacaaaagaa

SEQ ID NO: 2050716 - RNA, 20 nt, Staphylococcus aureus subsp. aureus Mu50
uaacguugcagagaauauag

SEQ ID NO: 2050717 - RNA, 15 nt, Staphylococcus aureus subsp. aureus Mu50
uaauaucuaaagauu

SEQ ID NO: 2050718 - RNA, 17 nt, Staphylococcus aureus subsp. aureus Mu50
uaauaucauauucaaaa

SEQ ID NO: 2050719 - RNA, 14 nt, Staphylococcus aureus subsp. aureus Mu50
uaauauauuuauuu

SEQ ID NO: 2050720 - RNA, 17 nt, Staphylococcus aureus subsp. aureus Mu50
uaauauauccugccaau

SEQ ID NO: 2050721 - RNA, 13 nt, Staphylococcus aureus subsp. aureus Mu50
uaauauauuaauu

SEQ ID NO: 2050722 - RNA, 14 nt, Staphylococcus aureus subsp. aureus Mu50
uaauauauuacuaa

SEQ ID NO: 2050723 - RNA, 16 nt, Staphylococcus aureus subsp. aureus Mu50
uaauauauuauaaccc

SEQ ID NO: 2050724 - RNA, 14 nt, Staphylococcus aureus subsp. aureus Mu50
uaauauaauuaauu

SEQ ID NO: 2050725 - RNA, 14 nt, Staphylococcus aureus subsp. aureus Mu50
uaauauaauuauua

SEQ ID NO: 2050726 - RNA, 17 nt, Staphylococcus aureus subsp. aureus Mu50
uaauauaauuaaacauu

SEQ ID NO: 2050727 - RNA, 22 nt, Staphylococcus aureus subsp. aureus Mu50
uaauauaacgacacuuuuuagu

SEQ ID NO: 2050728 - RNA, 17 nt, Staphylococcus aureus subsp. aureus Mu50
uaauauaacuucuauua

SEQ ID NO: 2050729 - RNA, 14 nt, Staphylococcus aureus subsp. aureus Mu50
uaauauaaaauaaa

SEQ ID NO: 2050730 - RNA, 17 nt, Staphylococcus aureus subsp. aureus Mu50
uaauucaggaaaugcau

SEQ ID NO: 2050731 - RNA, 15 nt, Staphylococcus aureus subsp. aureus Mu50
uaauucauauauacu

SEQ ID NO: 2050732 - RNA, 22 nt, Staphylococcus aureus subsp. aureus Mu50
uaauucacuuuacccucuuuag

SEQ ID NO: 2050733 - RNA, 20 nt, Staphylococcus aureus subsp. aureus Mu50
uaauuauuuuaaaaaaugau

SEQ ID NO: 2050734 - RNA, 22 nt, Staphylococcus aureus subsp. aureus Mu50
uaauucaacuuaaauggaugau

SEQ ID NO: 2050735 - RNA, 14 nt, Staphylococcus aureus subsp. aureus Mu50
uaauucaauaccua

SEQ ID NO: 2050736 - RNA, 14 nt, Staphylococcus aureus subsp. aureus Mu50
uaauuauuauauaa

SEQ ID NO: 2050737 - RNA, 15 nt, Staphylococcus aureus subsp. aureus Mu50
uaauuauucaugaau

SEQ ID NO: 2050738 - RNA, 13 nt, Staphylococcus aureus subsp. aureus Mu50
uaauuauuucucu

SEQ ID NO: 2050739 - RNA, 16 nt, Staphylococcus aureus subsp. aureus Mu50
uaauuauugagaauau

SEQ ID NO: 2050740 - RNA, 20 nt, Staphylococcus aureus subsp. aureus Mu50
uaauuauugagaauauuuau

SEQ ID NO: 2050741 - RNA, 13 nt, Staphylococcus aureus subsp. aureus Mu50
uaauuaucauaua

SEQ ID NO: 2050742 - RNA, 21 nt, Staphylococcus aureus subsp. aureus Mu50
uaauuaucauaugugauuuaa

SEQ ID NO: 2050743 - RNA, 11 nt, Staphylococcus aureus subsp. aureus Mu50
uaauuaucauu

SEQ ID NO: 2050744 - RNA, 16 nt, Staphylococcus aureus subsp. aureus Mu50
uaauuaccuuuccauu

SEQ ID NO: 2050745 - RNA, 20 nt, Staphylococcus aureus subsp. aureus Mu50
uaauuaaaacaugacaacuu

SEQ ID NO: 2050746 - RNA, 19 nt, Staphylococcus aureus subsp. aureus Mu50
uaauuaaaaaaagauuagu

SEQ ID NO: 2050747 - RNA, 17 nt, Staphylococcus aureus subsp. aureus Mu50
uaauuaaaaaauuccua

SEQ ID NO: 2050748 - RNA, 12 nt, Staphylococcus aureus subsp. aureus Mu50
uaauuaaaauaa

SEQ ID NO: 2050749 - RNA, 22 nt, Staphylococcus aureus subsp. aureus Mu50
uaauuaaaauaagauauauaau

SEQ ID NO: 2050750 - RNA, 14 nt, Staphylococcus aureus subsp. aureus Mu50
uaauuaaaauacaa

SEQ ID NO: 2050751 - RNA, 16 nt, Staphylococcus aureus subsp. aureus Mu50
uaauuaaaauacaaau

SEQ ID NO: 2050752 - RNA, 15 nt, Staphylococcus aureus subsp. aureus Mu50
uaauguuugcuuuuu

SEQ ID NO: 2050753 - RNA, 21 nt, Staphylococcus aureus subsp. aureus Mu50
uaauguuuccugauauuucaa

SEQ ID NO: 2050754 - RNA, 17 nt, Staphylococcus aureus subsp. aureus Mu50
uaauguuuucauuggau

SEQ ID NO: 2050755 - RNA, 14 nt, Staphylococcus aureus subsp. aureus Mu50
uaauuaaugccauu

SEQ ID NO: 2050756 - RNA, 13 nt, Staphylococcus aureus subsp. aureus Mu50
uaauuaauuaaaa

SEQ ID NO: 2050757 - RNA, 14 nt, Staphylococcus aureus subsp. aureus Mu50
uaauuaauuaaaau

SEQ ID NO: 2050758 - RNA, 15 nt, Staphylococcus aureus subsp. aureus Mu50
uaauuaauuaaaauu

SEQ ID NO: 2050759 - RNA, 23 nt, Staphylococcus aureus subsp. aureus Mu50
uaauuaauuacuuucauuguaaa

SEQ ID NO: 2050760 - RNA, 15 nt, Staphylococcus aureus subsp. aureus Mu50
uaauuaauaauuuaa

SEQ ID NO: 2050761 - RNA, 16 nt, Staphylococcus aureus subsp. aureus Mu50
uaauuaaaauucucuu

SEQ ID NO: 2050762 - RNA, 14 nt, Staphylococcus aureus subsp. aureus Mu50
uaaugcuaauuuaa

SEQ ID NO: 2050763 - RNA, 17 nt, Staphylococcus aureus subsp. aureus Mu50
uaaugcuacuauuaaau

SEQ ID NO: 2050764 - RNA, 22 nt, Staphylococcus aureus subsp. aureus Mu50
uaaugguugaauaacacuagaa

SEQ ID NO: 2050765 - RNA, 20 nt, Staphylococcus aureus subsp. aureus Mu50
uaaugaugacaucaauaucu

SEQ ID NO: 2050766 - RNA, 16 nt, Staphylococcus aureus subsp. aureus Mu50
uaaugauucuacagca

SEQ ID NO: 2050767 - RNA, 19 nt, Staphylococcus aureus subsp. aureus Mu50
uaaugauuuuuauuauugu

SEQ ID NO: 2050768 - RNA, 16 nt, Staphylococcus aureus subsp. aureus Mu50
uaaugauugucuuaua

SEQ ID NO: 2050769 - RNA, 13 nt, Staphylococcus aureus subsp. aureus Mu50
uaaugauuuugcu

SEQ ID NO: 2050770 - RNA, 15 nt, Staphylococcus aureus subsp. aureus Mu50
uaaugcauuauuaua

SEQ ID NO: 2050771 - RNA, 21 nt, Staphylococcus aureus subsp. aureus Mu50
uaaugcagauucuucaccaac

SEQ ID NO: 2050772 - RNA, 12 nt, Staphylococcus aureus subsp. aureus Mu50
uaaugagaguaa

SEQ ID NO: 2050773 - RNA, 16 nt, Staphylococcus aureus subsp. aureus Mu50
uaaugagaguaauguu

SEQ ID NO: 2050774 - RNA, 22 nt, Staphylococcus aureus subsp. aureus Mu50
uaaugacuucuuuauauuuauc

SEQ ID NO: 2050775 - RNA, 19 nt, Staphylococcus aureus subsp. aureus Mu50
uaaugauaguacauuuauu

SEQ ID NO: 2050776 - RNA, 20 nt, Staphylococcus aureus subsp. aureus Mu50
uaaugauacaaacccauaua

SEQ ID NO: 2050777 - RNA, 18 nt, Staphylococcus aureus subsp. aureus Mu50
uaaugauaaauuaaagcu

SEQ ID NO: 2050778 - RNA, 18 nt, Staphylococcus aureus subsp. aureus Mu50
uaaugauaauccaccaaa

SEQ ID NO: 2050779 - RNA, 16 nt, Staphylococcus aureus subsp. aureus Mu50
uaaugaacaacaaauu

SEQ ID NO: 2050780 - RNA, 13 nt, Staphylococcus aureus subsp. aureus Mu50
uaaugaacaaggg

SEQ ID NO: 2050781 - RNA, 19 nt, Staphylococcus aureus subsp. aureus Mu50
uaaugaagguaagugcuca

SEQ ID NO: 2050782 - RNA, 17 nt, Staphylococcus aureus subsp. aureus Mu50
uaaugaauaauuaaaaa

SEQ ID NO: 2050783 - RNA, 13 nt, Staphylococcus aureus subsp. aureus Mu50
uaaugaauaguaa

SEQ ID NO: 2050784 - RNA, 18 nt, Staphylococcus aureus subsp. aureus Mu50
uaaucuuuuuuuaauuaa

SEQ ID NO: 2050785 - RNA, 18 nt, Staphylococcus aureus subsp. aureus Mu50
uaaucuuuuuuacuaaaa

SEQ ID NO: 2050786 - RNA, 21 nt, Staphylococcus aureus subsp. aureus Mu50
uaaucuuuuuuacuaaaauca

SEQ ID NO: 2050787 - RNA, 16 nt, Staphylococcus aureus subsp. aureus Mu50
ggcauaaccuguaauu

SEQ ID NO: 2050788 - RNA, 15 nt, Staphylococcus aureus subsp. aureus Mu50
ggcaggaaugauaua

SEQ ID NO: 2050789 - RNA, 13 nt, Staphylococcus aureus subsp. aureus Mu50
ggccccaacacag

SEQ ID NO: 2050790 - RNA, 13 nt, Staphylococcus aureus subsp. aureus Mu50
ggcccccaacacu

SEQ ID NO: 2050791 - RNA, 15 nt, Staphylococcus aureus subsp. aureus Mu50
ggaucuuucaaagua

SEQ ID NO: 2050792 - RNA, 20 nt, Staphylococcus aureus subsp. aureus Mu50
ggauaauuuuuaacagcgug

SEQ ID NO: 2050793 - RNA, 13 nt, Staphylococcus aureus subsp. aureus Mu50
ggauaaaaauuua

SEQ ID NO: 2050794 - RNA, 18 nt, Staphylococcus aureus subsp. aureus Mu50
ggacuaacgucauuauau

SEQ ID NO: 2050795 - RNA, 20 nt, Staphylococcus aureus subsp. aureus Mu50
ggaauuuuuaugcauuauag

SEQ ID NO: 2050796 - RNA, 23 nt, Staphylococcus aureus subsp. aureus Mu50
ggaauguuccuccaccaccugca

SEQ ID NO: 2050797 - RNA, 21 nt, Staphylococcus aureus subsp. aureus Mu50
ggaauugguuuuuagugaaaa

SEQ ID NO: 2050798 - RNA, 21 nt, Staphylococcus aureus subsp. aureus Mu50
ggaauuguuaauuucaacauu

SEQ ID NO: 2050799 - RNA, 20 nt, Staphylococcus aureus subsp. aureus Mu50
ggaauauuucccuaugaaau

SEQ ID NO: 2050800 - RNA, 12 nt, Staphylococcus aureus subsp. aureus Mu50
ggaagaacagca

SEQ ID NO: 2050801 - RNA, 22 nt, Staphylococcus aureus subsp. aureus Mu50
ggaacuacuacauuauuacuga

SEQ ID NO: 2050802 - RNA, 15 nt, Staphylococcus aureus subsp. aureus Mu50
ggaagcauauuucua

SEQ ID NO: 2050803 - RNA, 17 nt, Staphylococcus aureus subsp. aureus Mu50
ggaagauaggauuuaca

SEQ ID NO: 2050804 - RNA, 15 nt, Staphylococcus aureus subsp. aureus Mu50
ggaagaccauuuuau

SEQ ID NO: 2050805 - RNA, 14 nt, Staphylococcus aureus subsp. aureus Mu50
ggaagcgucuuuuu

SEQ ID NO: 2050806 - RNA, 15 nt, Staphylococcus aureus subsp. aureus Mu50
ggaaauuuauuauaa

SEQ ID NO: 2050807 - RNA, 19 nt, Staphylococcus aureus subsp. aureus Mu50
ggaaauggcuccauuuaau

SEQ ID NO: 2050808 - RNA, 15 nt, Staphylococcus aureus subsp. aureus Mu50
ggaaauaaaaaauaa

SEQ ID NO: 2050809 - RNA, 16 nt, Staphylococcus aureus subsp. aureus Mu50
gcuuuuuuaccagcau

SEQ ID NO: 2050810 - RNA, 14 nt, Staphylococcus aureus subsp. aureus Mu50
gcuuuuuucaauuc

SEQ ID NO: 2050811 - RNA, 15 nt, Staphylococcus aureus subsp. aureus Mu50
ggaaaauacuauacu

SEQ ID NO: 2050812 - RNA, 22 nt, Staphylococcus aureus subsp. aureus Mu50
ggaaaauuauuugauauuucau

SEQ ID NO: 2050813 - RNA, 16 nt, Staphylococcus aureus subsp. aureus Mu50
gcuuucguuucuuuua

SEQ ID NO: 2050814 - RNA, 16 nt, Staphylococcus aureus subsp. aureus Mu50
gcuuucauuaauuuuu

SEQ ID NO: 2050815 - RNA, 19 nt, Staphylococcus aureus subsp. aureus Mu50
gcuuucauuaauuuuucaa

SEQ ID NO: 2050816 - RNA, 18 nt, Staphylococcus aureus subsp. aureus Mu50
gcuuuaucaacaaauuuu

SEQ ID NO: 2050817 - RNA, 22 nt, Staphylococcus aureus subsp. aureus Mu50
gcuuuguaaaauugugacgcug

SEQ ID NO: 2050818 - RNA, 20 nt, Staphylococcus aureus subsp. aureus Mu50
gcuuugucacgauagauuua

SEQ ID NO: 2050819 - RNA, 17 nt, Staphylococcus aureus subsp. aureus Mu50
gcuuuggauuucuuuuu

SEQ ID NO: 2050820 - RNA, 14 nt, Staphylococcus aureus subsp. aureus Mu50
gcuuuguuuuucac

SEQ ID NO: 2050821 - RNA, 20 nt, Staphylococcus aureus subsp. aureus Mu50
gcuuuuauuuauauuauuac

SEQ ID NO: 2050822 - RNA, 14 nt, Staphylococcus aureus subsp. aureus Mu50
gcuuuuaugcaugc

SEQ ID NO: 2050823 - RNA, 13 nt, Staphylococcus aureus subsp. aureus Mu50
gcuuuuaugcaug

SEQ ID NO: 2050824 - RNA, 13 nt, Staphylococcus aureus subsp. aureus Mu50
gcuuuuuaaaaaa

SEQ ID NO: 2050825 - RNA, 18 nt, Staphylococcus aureus subsp. aureus Mu50
gcuuuuucuacaccuaca

SEQ ID NO: 2050826 - RNA, 17 nt, Staphylococcus aureus subsp. aureus Mu50
gcuuuuucuuuuguuuu

SEQ ID NO: 2050827 - RNA, 15 nt, Staphylococcus aureus subsp. aureus Mu50
gcuuuuucaaauaau

SEQ ID NO: 2050828 - RNA, 20 nt, Staphylococcus aureus subsp. aureus Mu50
gcuuuuuauuuuguuuaucu

SEQ ID NO: 2050829 - RNA, 22 nt, Staphylococcus aureus subsp. aureus Mu50
gcuuuacguccaaaaugaacaa

SEQ ID NO: 2050830 - RNA, 20 nt, Staphylococcus aureus subsp. aureus Mu50
gcuuuagucgguguuuucuu

SEQ ID NO: 2050831 - RNA, 15 nt, Staphylococcus aureus subsp. aureus Mu50
gcuuuaauaaaucgu

SEQ ID NO: 2050832 - RNA, 19 nt, Staphylococcus aureus subsp. aureus Mu50
gcuuguucaacuaaauuuu

SEQ ID NO: 2050833 - RNA, 18 nt, Staphylococcus aureus subsp. aureus Mu50
gcuuguaauccuuguucu

SEQ ID NO: 2050834 - RNA, 22 nt, Staphylococcus aureus subsp. aureus Mu50
gcuuguacaaaaaauuguaagu

SEQ ID NO: 2050835 - RNA, 15 nt, Staphylococcus aureus subsp. aureus Mu50
gcuugugugaaauua

SEQ ID NO: 2050836 - RNA, 21 nt, Staphylococcus aureus subsp. aureus Mu50
gcuuguaacaagcuuuucauu

SEQ ID NO: 2050837 - RNA, 14 nt, Staphylococcus aureus subsp. aureus Mu50
gcuugguuaaaguu

SEQ ID NO: 2050838 - RNA, 13 nt, Staphylococcus aureus subsp. aureus Mu50
gcuuggauuuuuu

SEQ ID NO: 2050839 - RNA, 15 nt, Staphylococcus aureus subsp. aureus Mu50
gcuugcuucuuuccu

SEQ ID NO: 2050840 - RNA, 17 nt, Staphylococcus aureus subsp. aureus Mu50
gcuugcggauacauauu

SEQ ID NO: 2050841 - RNA, 17 nt, Staphylococcus aureus subsp. aureus Mu50
gcuugauuaauuuuauc

SEQ ID NO: 2050842 - RNA, 23 nt, Staphylococcus aureus subsp. aureus Mu50
gcuugagcaucuuuuacugcuuc

SEQ ID NO: 2050843 - RNA, 20 nt, Staphylococcus aureus subsp. aureus Mu50
gcuugaccuucaguuucuac

SEQ ID NO: 2050844 - RNA, 19 nt, Staphylococcus aureus subsp. aureus Mu50
gcuucgucacguaaaauau

SEQ ID NO: 2050845 - RNA, 15 nt, Staphylococcus aureus subsp. aureus Mu50
gcuucuaauuuuuca

SEQ ID NO: 2050846 - RNA, 16 nt, Staphylococcus aureus subsp. aureus Mu50
gcuugaaguuguuucu

SEQ ID NO: 2050847 - RNA, 21 nt, Staphylococcus aureus subsp. aureus Mu50
gcuugaaauuauuauuuaaau

SEQ ID NO: 2050848 - RNA, 16 nt, Staphylococcus aureus subsp. aureus Mu50
gcuucugguucuucaa

SEQ ID NO: 2050849 - RNA, 18 nt, Staphylococcus aureus subsp. aureus Mu50
gcuucuguguuggggccc

SEQ ID NO: 2050850 - RNA, 17 nt, Staphylococcus aureus subsp. aureus Mu50
gcuucuuuaaaggaaau

SEQ ID NO: 2050851 - RNA, 21 nt, Staphylococcus aureus subsp. aureus Mu50
gcuuauugaaaagauaaacaa

SEQ ID NO: 2050852 - RNA, 20 nt, Staphylococcus aureus subsp. aureus Mu50
gcuucaguuaaaucacugcu

SEQ ID NO: 2050853 - RNA, 18 nt, Staphylococcus aureus subsp. aureus Mu50
gcuucauagucacuuuua

SEQ ID NO: 2050854 - RNA, 22 nt, Staphylococcus aureus subsp. aureus Mu50
gcuucauauuuagguaauacau

SEQ ID NO: 2050855 - RNA, 22 nt, Staphylococcus aureus subsp. aureus Mu50
gcuucauuaguugcauaaucaa

SEQ ID NO: 2050856 - RNA, 17 nt, Staphylococcus aureus subsp. aureus Mu50
gcuuccacuucaucuaa

SEQ ID NO: 2050857 - RNA, 18 nt, Staphylococcus aureus subsp. aureus Mu50
gcuuccaauuuaaaauga

SEQ ID NO: 2050858 - RNA, 15 nt, Staphylococcus aureus subsp. aureus Mu50
gcuuaacuuccuuuu

SEQ ID NO: 2050859 - RNA, 18 nt, Staphylococcus aureus subsp. aureus Mu50
gcuuaagaaauuuuuucu

SEQ ID NO: 2050860 - RNA, 22 nt, Staphylococcus aureus subsp. aureus Mu50
gcuuaaguaagauuuaaacauc

SEQ ID NO: 2050861 - RNA, 13 nt, Staphylococcus aureus subsp. aureus Mu50
gcuuaauuuaugu

SEQ ID NO: 2050862 - RNA, 19 nt, Staphylococcus aureus subsp. aureus Mu50
gcuuaauuuguuuuaaaua

SEQ ID NO: 2050863 - RNA, 12 nt, Staphylococcus aureus subsp. aureus Mu50
gcuuaucauuac

SEQ ID NO: 2050864 - RNA, 13 nt, Staphylococcus aureus subsp. aureus Mu50
gcuuagauaaauu

SEQ ID NO: 2050865 - RNA, 24 nt, Staphylococcus aureus subsp. aureus Mu50
gcuuagucaauguauauuuaacau

SEQ ID NO: 2050866 - RNA, 18 nt, Staphylococcus aureus subsp. aureus Mu50
gcugguaauauuuuuguu

SEQ ID NO: 2050867 - RNA, 20 nt, Staphylococcus aureus subsp. aureus Mu50
gcugugucuuuugauuuuuu

SEQ ID NO: 2050868 - RNA, 18 nt, Staphylococcus aureus subsp. aureus Mu50
gcuguguaucaucauaau

SEQ ID NO: 2050869 - RNA, 14 nt, Staphylococcus aureus subsp. aureus Mu50
gcuguuuuauucaa

SEQ ID NO: 2050870 - RNA, 22 nt, Staphylococcus aureus subsp. aureus Mu50
gcugguugcuucuuaucaacaa

SEQ ID NO: 2050871 - RNA, 21 nt, Staphylococcus aureus subsp. aureus Mu50
gcuggacaaucuuaucauaau

SEQ ID NO: 2050872 - RNA, 21 nt, Staphylococcus aureus subsp. aureus Mu50
gcugauuuaauagcuaaagcu

SEQ ID NO: 2050873 - RNA, 14 nt, Staphylococcus aureus subsp. aureus Mu50
gcugauuuuauaaa

SEQ ID NO: 2050874 - RNA, 18 nt, Staphylococcus aureus subsp. aureus Mu50
gcugcaaucguugaaaaa

SEQ ID NO: 2050875 - RNA, 17 nt, Staphylococcus aureus subsp. aureus Mu50
gcgcaagagauaagaaa

SEQ ID NO: 2050876 - RNA, 15 nt, Staphylococcus aureus subsp. aureus Mu50
gcgccauaaucauua

SEQ ID NO: 2050877 - RNA, 13 nt, Staphylococcus aureus subsp. aureus Mu50
gcgauaaaguaug

SEQ ID NO: 2050878 - RNA, 16 nt, Staphylococcus aureus subsp. aureus Mu50
gccuaaaaauaaaauc

SEQ ID NO: 2050879 - RNA, 13 nt, Staphylococcus aureus subsp. aureus Mu50
gcggaaauaugau

SEQ ID NO: 2050880 - RNA, 17 nt, Staphylococcus aureus subsp. aureus Mu50
gcgcuuuuuuuuauaag

SEQ ID NO: 2050881 - RNA, 11 nt, Staphylococcus aureus subsp. aureus Mu50
gcguauuuuuu

SEQ ID NO: 2050882 - RNA, 20 nt, Staphylococcus aureus subsp. aureus Mu50
gcguuuaaucacaucuuuuu

SEQ ID NO: 2050883 - RNA, 13 nt, Staphylococcus aureus subsp. aureus Mu50
gcucuucuuaucu

SEQ ID NO: 2050884 - RNA, 13 nt, Staphylococcus aureus subsp. aureus Mu50
gcucuugcuaaag

SEQ ID NO: 2050885 - RNA, 17 nt, Staphylococcus aureus subsp. aureus Mu50
gcucuuuuuguaugagu

SEQ ID NO: 2050886 - RNA, 18 nt, Staphylococcus aureus subsp. aureus Mu50
gcucuuuuuguuuaucug

SEQ ID NO: 2050887 - RNA, 18 nt, Staphylococcus aureus subsp. aureus Mu50
gcucuuaaaucacuagcu

SEQ ID NO: 2050888 - RNA, 20 nt, Staphylococcus aureus subsp. aureus Mu50
gcucuuaauguacuuuucug

SEQ ID NO: 2050889 - RNA, 13 nt, Staphylococcus aureus subsp. aureus Mu50
gcucguuaaauca

SEQ ID NO: 2050890 - RNA, 19 nt, Staphylococcus aureus subsp. aureus Mu50
gcucguugcagauuuugca

SEQ ID NO: 2050891 - RNA, 23 nt, Staphylococcus aureus subsp. aureus Mu50
gcucguuuuuuuagcuauagaaa

SEQ ID NO: 2050892 - RNA, 20 nt, Staphylococcus aureus subsp. aureus Mu50
gcucuaauccaaaauaaucg

SEQ ID NO: 2050893 - RNA, 21 nt, Staphylococcus aureus subsp. aureus Mu50
gcugaaguuugaacaacaucu

SEQ ID NO: 2050894 - RNA, 14 nt, Staphylococcus aureus subsp. aureus Mu50
gcugauaauuuuuc

SEQ ID NO: 2050895 - RNA, 15 nt, Staphylococcus aureus subsp. aureus Mu50
gcucaacuauauaua

SEQ ID NO: 2050896 - RNA, 22 nt, Staphylococcus aureus subsp. aureus Mu50
gcuauuacuauaaaaaacagca

SEQ ID NO: 2050897 - RNA, 15 nt, Staphylococcus aureus subsp. aureus Mu50
gcuauguauuuuucu

SEQ ID NO: 2050898 - RNA, 13 nt, Staphylococcus aureus subsp. aureus Mu50
gcuauuaaaauag

SEQ ID NO: 2050899 - RNA, 14 nt, Staphylococcus aureus subsp. aureus Mu50
gcuauuugauacaa

SEQ ID NO: 2050900 - RNA, 20 nt, Staphylococcus aureus subsp. aureus Mu50
gcuauuucaacaaacauaaa

SEQ ID NO: 2050901 - RNA, 22 nt, Staphylococcus aureus subsp. aureus Mu50
gcuauuucaacaaacauaaaua

SEQ ID NO: 2050902 - RNA, 18 nt, Staphylococcus aureus subsp. aureus Mu50
gcuauauaauuuauaaaa

SEQ ID NO: 2050903 - RNA, 20 nt, Staphylococcus aureus subsp. aureus Mu50
gcuauauuuuuguauuuaug

SEQ ID NO: 2050904 - RNA, 21 nt, Staphylococcus aureus subsp. aureus Mu50
gcuauauuuuuguauuuaugu

SEQ ID NO: 2050905 - RNA, 19 nt, Staphylococcus aureus subsp. aureus Mu50
gcuauccauguauuuuucu

SEQ ID NO: 2050906 - RNA, 18 nt, Staphylococcus aureus subsp. aureus Mu50
gcuauaaucuaucuugug

SEQ ID NO: 2050907 - RNA, 24 nt, Staphylococcus aureus subsp. aureus Mu50
gcuaguugaaccguaacuauauga

SEQ ID NO: 2050908 - RNA, 19 nt, Staphylococcus aureus subsp. aureus Mu50
gcuauaagaacuaaugguu

SEQ ID NO: 2050909 - RNA, 14 nt, Staphylococcus aureus subsp. aureus Mu50
gcuauaaaauuuug

SEQ ID NO: 2050910 - RNA, 18 nt, Staphylococcus aureus subsp. aureus Mu50
gcuauaaaaaaucuuuug

SEQ ID NO: 2050911 - RNA, 16 nt, Staphylococcus aureus subsp. aureus Mu50
gcuagaacagauauac

SEQ ID NO: 2050912 - RNA, 22 nt, Staphylococcus aureus subsp. aureus Mu50
gcuagauuuuaaacgcucauca

SEQ ID NO: 2050913 - RNA, 15 nt, Staphylococcus aureus subsp. aureus Mu50
gcccagaauguguug

SEQ ID NO: 2050914 - RNA, 20 nt, Staphylococcus aureus subsp. aureus Mu50
gccauuuuuauuuaacacuu

SEQ ID NO: 2050915 - RNA, 12 nt, Staphylococcus aureus subsp. aureus Mu50
gcccacacccca

SEQ ID NO: 2050916 - RNA, 13 nt, Staphylococcus aureus subsp. aureus Mu50
gcccacaccccaa

SEQ ID NO: 2050917 - RNA, 16 nt, Staphylococcus aureus subsp. aureus Mu50
gccaucaauauugaua

SEQ ID NO: 2050918 - RNA, 12 nt, Staphylococcus aureus subsp. aureus Mu50
gccauauuuauu

SEQ ID NO: 2050919 - RNA, 23 nt, Staphylococcus aureus subsp. aureus Mu50
gccaugaaaaggaaaaacuuuuc

SEQ ID NO: 2050920 - RNA, 17 nt, Staphylococcus aureus subsp. aureus Mu50
gccaugaaaaggaaaaa

SEQ ID NO: 2050921 - RNA, 14 nt, Staphylococcus aureus subsp. aureus Mu50
gccaggugauugac

SEQ ID NO: 2050922 - RNA, 22 nt, Staphylococcus aureus subsp. aureus Mu50
gccacugucauguguucaaaua

SEQ ID NO: 2050923 - RNA, 21 nt, Staphylococcus aureus subsp. aureus Mu50
gccaaucuauugcaauauagu

SEQ ID NO: 2050924 - RNA, 14 nt, Staphylococcus aureus subsp. aureus Mu50
gccaagugguucag

SEQ ID NO: 2050925 - RNA, 14 nt, Staphylococcus aureus subsp. aureus Mu50
gcauuuuucaauua

SEQ ID NO: 2050926 - RNA, 18 nt, Staphylococcus aureus subsp. aureus Mu50
gccaaaggcaaaauguau

SEQ ID NO: 2050927 - RNA, 19 nt, Staphylococcus aureus subsp. aureus Mu50
gccaaauaucaguaauaau

SEQ ID NO: 2050928 - RNA, 15 nt, Staphylococcus aureus subsp. aureus Mu50
gcauugagauggucu

SEQ ID NO: 2050929 - RNA, 15 nt, Staphylococcus aureus subsp. aureus Mu50
gcauucaguuaaugu

SEQ ID NO: 2050930 - RNA, 21 nt, Staphylococcus aureus subsp. aureus Mu50
gcauuauagaugacuguagaa

SEQ ID NO: 2050931 - RNA, 23 nt, Staphylococcus aureus subsp. aureus Mu50
gcauuauuaaggggguaauacua

SEQ ID NO: 2050932 - RNA, 14 nt, Staphylococcus aureus subsp. aureus Mu50
gcauuauuauaaua

SEQ ID NO: 2050933 - RNA, 16 nt, Staphylococcus aureus subsp. aureus Mu50
gcauuauuauuucauu

SEQ ID NO: 2050934 - RNA, 16 nt, Staphylococcus aureus subsp. aureus Mu50
gcaugcuucucaauuu

SEQ ID NO: 2050935 - RNA, 17 nt, Staphylococcus aureus subsp. aureus Mu50
gcauuacgccaccaguu

SEQ ID NO: 2050936 - RNA, 15 nt, Staphylococcus aureus subsp. aureus Mu50
gcauuacuacaaacu

SEQ ID NO: 2050937 - RNA, 18 nt, Staphylococcus aureus subsp. aureus Mu50
gcauuacuacuuuauaaa

SEQ ID NO: 2050938 - RNA, 18 nt, Staphylococcus aureus subsp. aureus Mu50
gcauuaagaugauugucu

SEQ ID NO: 2050939 - RNA, 14 nt, Staphylococcus aureus subsp. aureus Mu50
gcaugacagcaaau

SEQ ID NO: 2050940 - RNA, 16 nt, Staphylococcus aureus subsp. aureus Mu50
gcaucuuuuacugcuu

SEQ ID NO: 2050941 - RNA, 17 nt, Staphylococcus aureus subsp. aureus Mu50
gcaugacuguaaguaug

SEQ ID NO: 2050942 - RNA, 13 nt, Staphylococcus aureus subsp. aureus Mu50
gcaugcgcaaaag

SEQ ID NO: 2050943 - RNA, 15 nt, Staphylococcus aureus subsp. aureus Mu50
gcaugcgcaaaagcg

SEQ ID NO: 2050944 - RNA, 19 nt, Staphylococcus aureus subsp. aureus Mu50
gcaugcgcaaaagcgcagg

SEQ ID NO: 2050945 - RNA, 18 nt, Staphylococcus aureus subsp. aureus Mu50
gcaucuccaaaggccaug

SEQ ID NO: 2050946 - RNA, 14 nt, Staphylococcus aureus subsp. aureus Mu50
gccguuauuuucaa

SEQ ID NO: 2050947 - RNA, 21 nt, Staphylococcus aureus subsp. aureus Mu50
gcccuagguuuauauaucaca

SEQ ID NO: 2050948 - RNA, 20 nt, Staphylococcus aureus subsp. aureus Mu50
gccccuagcaaaaauacuuu

SEQ ID NO: 2050949 - RNA, 14 nt, Staphylococcus aureus subsp. aureus Mu50
gcacugagcaacaa

SEQ ID NO: 2050950 - RNA, 15 nt, Staphylococcus aureus subsp. aureus Mu50
gcacugagcaacaaa

SEQ ID NO: 2050951 - RNA, 19 nt, Staphylococcus aureus subsp. aureus Mu50
gcacuaugcauaauaccaa

SEQ ID NO: 2050952 - RNA, 16 nt, Staphylococcus aureus subsp. aureus Mu50
gcacuaucaaugacau

SEQ ID NO: 2050953 - RNA, 21 nt, Staphylococcus aureus subsp. aureus Mu50
gcaccgauuuggucagcgaca

SEQ ID NO: 2050954 - RNA, 21 nt, Staphylococcus aureus subsp. aureus Mu50
gcaccgucaaacuuaaaacua

SEQ ID NO: 2050955 - RNA, 14 nt, Staphylococcus aureus subsp. aureus Mu50
gcacgagaaauguc

SEQ ID NO: 2050956 - RNA, 14 nt, Staphylococcus aureus subsp. aureus Mu50
gcaaugaaauuacc

SEQ ID NO: 2050957 - RNA, 14 nt, Staphylococcus aureus subsp. aureus Mu50
gcaaucuuaguaca

SEQ ID NO: 2050958 - RNA, 14 nt, Staphylococcus aureus subsp. aureus Mu50
gcaaucuauauaaa

SEQ ID NO: 2050959 - RNA, 18 nt, Staphylococcus aureus subsp. aureus Mu50
gcaauagcuauaacucua

SEQ ID NO: 2050960 - RNA, 16 nt, Staphylococcus aureus subsp. aureus Mu50
gcaauagcaacacguu

SEQ ID NO: 2050961 - RNA, 14 nt, Staphylococcus aureus subsp. aureus Mu50
gcaauagcaccaua

SEQ ID NO: 2050962 - RNA, 19 nt, Staphylococcus aureus subsp. aureus Mu50
gcaaguguaucgcccauac

SEQ ID NO: 2050963 - RNA, 22 nt, Staphylococcus aureus subsp. aureus Mu50
gcaagucucauaucuauuuuuc

SEQ ID NO: 2050964 - RNA, 13 nt, Staphylococcus aureus subsp. aureus Mu50
gcaacuuauaaua

SEQ ID NO: 2050965 - RNA, 18 nt, Staphylococcus aureus subsp. aureus Mu50
gcacauuuuuaguuagaa

SEQ ID NO: 2050966 - RNA, 19 nt, Staphylococcus aureus subsp. aureus Mu50
gcacaucagauauaaguag

SEQ ID NO: 2050967 - RNA, 13 nt, Staphylococcus aureus subsp. aureus Mu50
gcacauaaaucaa

SEQ ID NO: 2050968 - RNA, 19 nt, Staphylococcus aureus subsp. aureus Mu50
gcacaguggauuacagaug

SEQ ID NO: 2050969 - RNA, 16 nt, Staphylococcus aureus subsp. aureus Mu50
gcacaucauugauaga

SEQ ID NO: 2050970 - RNA, 20 nt, Staphylococcus aureus subsp. aureus Mu50
gcaauuuuagccaaauuacu

SEQ ID NO: 2050971 - RNA, 16 nt, Staphylococcus aureus subsp. aureus Mu50
gcacaaaaaaaucucc

SEQ ID NO: 2050972 - RNA, 19 nt, Staphylococcus aureus subsp. aureus Mu50
gcacaacugcauaaaagcc

SEQ ID NO: 2050973 - RNA, 13 nt, Staphylococcus aureus subsp. aureus Mu50
gcaauuucauagu

SEQ ID NO: 2050974 - RNA, 21 nt, Staphylococcus aureus subsp. aureus Mu50
gcaauuaaagucaauuuaaau

SEQ ID NO: 2050975 - RNA, 14 nt, Staphylococcus aureus subsp. aureus Mu50
gcaauuaaaaguac

SEQ ID NO: 2050976 - RNA, 19 nt, Staphylococcus aureus subsp. aureus Mu50
gcaauugaaucaaauacau

SEQ ID NO: 2050977 - RNA, 18 nt, Staphylococcus aureus subsp. aureus Mu50
gcaauuauuuuucaaaua

SEQ ID NO: 2050978 - RNA, 14 nt, Staphylococcus aureus subsp. aureus Mu50
gcauauucacgaua

SEQ ID NO: 2050979 - RNA, 19 nt, Staphylococcus aureus subsp. aureus Mu50
gcaucaaaaauaaaaaugc

SEQ ID NO: 2050980 - RNA, 19 nt, Staphylococcus aureus subsp. aureus Mu50
gcauauuuaauacauuuuu

SEQ ID NO: 2050981 - RNA, 16 nt, Staphylococcus aureus subsp. aureus Mu50
gcauauguaauacaaa

SEQ ID NO: 2050982 - RNA, 18 nt, Staphylococcus aureus subsp. aureus Mu50
gcauaucuuuaucauuau

SEQ ID NO: 2050983 - RNA, 15 nt, Staphylococcus aureus subsp. aureus Mu50
gcaucacaaaauugu

SEQ ID NO: 2050984 - RNA, 13 nt, Staphylococcus aureus subsp. aureus Mu50
gcaucaaaaauga

SEQ ID NO: 2050985 - RNA, 12 nt, Staphylococcus aureus subsp. aureus Mu50
gcaguaaaacca

SEQ ID NO: 2050986 - RNA, 12 nt, Staphylococcus aureus subsp. aureus Mu50
gcaguauauauc

SEQ ID NO: 2050987 - RNA, 15 nt, Staphylococcus aureus subsp. aureus Mu50
gcaguauauaucaaa

SEQ ID NO: 2050988 - RNA, 13 nt, Staphylococcus aureus subsp. aureus Mu50
gcauacguaaaug

SEQ ID NO: 2050989 - RNA, 19 nt, Staphylococcus aureus subsp. aureus Mu50
gcauauaaagucauacuua

SEQ ID NO: 2050990 - RNA, 16 nt, Staphylococcus aureus subsp. aureus Mu50
gcauauauauauagau

SEQ ID NO: 2050991 - RNA, 18 nt, Staphylococcus aureus subsp. aureus Mu50
gcauaucgauaaauguau

SEQ ID NO: 2050992 - RNA, 15 nt, Staphylococcus aureus subsp. aureus Mu50
gcauaaaagccucua

SEQ ID NO: 2050993 - RNA, 14 nt, Staphylococcus aureus subsp. aureus Mu50
gcauaaaaaaagaa

SEQ ID NO: 2050994 - RNA, 17 nt, Staphylococcus aureus subsp. aureus Mu50
gcaguuucugagaagaa

SEQ ID NO: 2050995 - RNA, 21 nt, Staphylococcus aureus subsp. aureus Mu50
gcagcuugaucuaaaugaucu

SEQ ID NO: 2050996 - RNA, 14 nt, Staphylococcus aureus subsp. aureus Mu50
gcaggcgaaccgaa

SEQ ID NO: 2050997 - RNA, 19 nt, Staphylococcus aureus subsp. aureus Mu50
gcaggcgaaccgaagcgca

SEQ ID NO: 2050998 - RNA, 23 nt, Staphylococcus aureus subsp. aureus Mu50
gcacuuauuuggaugguaaguau

SEQ ID NO: 2050999 - RNA, 19 nt, Staphylococcus aureus subsp. aureus Mu50
gcagauguugguucaucaa

SEQ ID NO: 2051000 - RNA, 14 nt, Staphylococcus aureus subsp. aureus Mu50
gcagcgaucuuuuu

SEQ ID NO: 2051001 - RNA, 17 nt, Staphylococcus aureus subsp. aureus Mu50
gcaaauaaaaucauaac

SEQ ID NO: 2051002 - RNA, 20 nt, Staphylococcus aureus subsp. aureus Mu50
gcaaaggcgcaccaugugcc

SEQ ID NO: 2051003 - RNA, 14 nt, Staphylococcus aureus subsp. aureus Mu50
gcaaaguaacaaua

SEQ ID NO: 2051004 - RNA, 17 nt, Staphylococcus aureus subsp. aureus Mu50
gcaaauuaucauuaaau

SEQ ID NO: 2051005 - RNA, 15 nt, Staphylococcus aureus subsp. aureus Mu50
gcaaauuauauagaa

SEQ ID NO: 2051006 - RNA, 18 nt, Staphylococcus aureus subsp. aureus Mu50
gcaaauuauauagaaaac

SEQ ID NO: 2051007 - RNA, 17 nt, Staphylococcus aureus subsp. aureus Mu50
gcaaaucucgucacaua

SEQ ID NO: 2051008 - RNA, 13 nt, Staphylococcus aureus subsp. aureus Mu50
gcaaauauuaaau

SEQ ID NO: 2051009 - RNA, 14 nt, Staphylococcus aureus subsp. aureus Mu50
gcaaauauuaaauu

SEQ ID NO: 2051010 - RNA, 13 nt, Staphylococcus aureus subsp. aureus Mu50
gcaaauauaucau

SEQ ID NO: 2051011 - RNA, 11 nt, Staphylococcus aureus subsp. aureus Mu50
gcaaauacuuc

SEQ ID NO: 2051012 - RNA, 13 nt, Staphylococcus aureus subsp. aureus Mu50
gcaaauauuucug

SEQ ID NO: 2051013 - RNA, 19 nt, Staphylococcus aureus subsp. aureus Mu50
gcaaauauuauuaaaucaa

SEQ ID NO: 2051014 - RNA, 18 nt, Staphylococcus aureus subsp. aureus Mu50
gcaaacggcccaacugga

SEQ ID NO: 2051015 - RNA, 16 nt, Staphylococcus aureus subsp. aureus Mu50
gcaaacuugauucaau

SEQ ID NO: 2051016 - RNA, 21 nt, Staphylococcus aureus subsp. aureus Mu50
gcaaaauuauguaaaaaauau

SEQ ID NO: 2051017 - RNA, 18 nt, Staphylococcus aureus subsp. aureus Mu50
gcaaaauuauguaaaaaa

SEQ ID NO: 2051018 - RNA, 18 nt, Staphylococcus aureus subsp. aureus Mu50
gcaaacacaguacaaaua

SEQ ID NO: 2051019 - RNA, 15 nt, Staphylococcus aureus subsp. aureus Mu50
gcaaacacaguacaa

SEQ ID NO: 2051020 - RNA, 19 nt, Staphylococcus aureus subsp. aureus Mu50
gcaaaauacgauuuguuca

SEQ ID NO: 2051021 - RNA, 11 nt, Staphylococcus aureus subsp. aureus Mu50
gcaaaaucaac

SEQ ID NO: 2051022 - RNA, 13 nt, Staphylococcus aureus subsp. aureus Mu50
gauuuuucuuaua

SEQ ID NO: 2051023 - RNA, 13 nt, Staphylococcus aureus subsp. aureus Mu50
gcaaaaauacuuu

SEQ ID NO: 2051024 - RNA, 18 nt, Staphylococcus aureus subsp. aureus Mu50
gcaaaaauaauaugaauu

SEQ ID NO: 2051025 - RNA, 15 nt, Staphylococcus aureus subsp. aureus Mu50
gauuucaguucauca

SEQ ID NO: 2051026 - RNA, 16 nt, Staphylococcus aureus subsp. aureus Mu50
gauuucaguucaucau

SEQ ID NO: 2051027 - RNA, 18 nt, Staphylococcus aureus subsp. aureus Mu50
gauuuauuuuuuucuuca

SEQ ID NO: 2051028 - RNA, 14 nt, Staphylococcus aureus subsp. aureus Mu50
gauuucaaugagaa

SEQ ID NO: 2051029 - RNA, 13 nt, Staphylococcus aureus subsp. aureus Mu50
gauuuauucuaaa

SEQ ID NO: 2051030 - RNA, 12 nt, Staphylococcus aureus subsp. aureus Mu50
gauuuuaauuau

SEQ ID NO: 2051031 - RNA, 15 nt, Staphylococcus aureus subsp. aureus Mu50
gauuuuaacaagaua

SEQ ID NO: 2051032 - RNA, 13 nt, Staphylococcus aureus subsp. aureus Mu50
gauuuuagauuua

SEQ ID NO: 2051033 - RNA, 14 nt, Staphylococcus aureus subsp. aureus Mu50
gauuuuacuugaau

SEQ ID NO: 2051034 - RNA, 23 nt, Staphylococcus aureus subsp. aureus Mu50
gauuugccaaaaguuauauaaau

SEQ ID NO: 2051035 - RNA, 16 nt, Staphylococcus aureus subsp. aureus Mu50
gauuugauaagugaug

SEQ ID NO: 2051036 - RNA, 14 nt, Staphylococcus aureus subsp. aureus Mu50
gauuugaaauuuau

SEQ ID NO: 2051037 - RNA, 21 nt, Staphylococcus aureus subsp. aureus Mu50
gauuguuuauucgguccuuug

SEQ ID NO: 2051038 - RNA, 16 nt, Staphylococcus aureus subsp. aureus Mu50
gauuguuucaccagcu

SEQ ID NO: 2051039 - RNA, 23 nt, Staphylococcus aureus subsp. aureus Mu50
gauuguuucaccagcuuguaaau

SEQ ID NO: 2051040 - RNA, 21 nt, Staphylococcus aureus subsp. aureus Mu50
gauuuaaaauauaaauuucuu

SEQ ID NO: 2051041 - RNA, 16 nt, Staphylococcus aureus subsp. aureus Mu50
gauuuaaguuuauaau

SEQ ID NO: 2051042 - RNA, 16 nt, Staphylococcus aureus subsp. aureus Mu50
gauucuuaucuuuaau

SEQ ID NO: 2051043 - RNA, 18 nt, Staphylococcus aureus subsp. aureus Mu50
gauucuuaucuuuaauca

SEQ ID NO: 2051044 - RNA, 12 nt, Staphylococcus aureus subsp. aureus Mu50
gauugaaaaaau

SEQ ID NO: 2051045 - RNA, 14 nt, Staphylococcus aureus subsp. aureus Mu50
gauugaaaaaauaa

SEQ ID NO: 2051046 - RNA, 16 nt, Staphylococcus aureus subsp. aureus Mu50
gauuauuaacuuuaau

SEQ ID NO: 2051047 - RNA, 20 nt, Staphylococcus aureus subsp. aureus Mu50
gauuauuaugccuuugauuu

SEQ ID NO: 2051048 - RNA, 12 nt, Staphylococcus aureus subsp. aureus Mu50
gauuauucuuca

SEQ ID NO: 2051049 - RNA, 20 nt, Staphylococcus aureus subsp. aureus Mu50
gauuauuuaaaacuuguaaa

SEQ ID NO: 2051050 - RNA, 21 nt, Staphylococcus aureus subsp. aureus Mu50
gauucucuaacgauuucuagu

SEQ ID NO: 2051051 - RNA, 19 nt, Staphylococcus aureus subsp. aureus Mu50
gauuaauccaguaaucaaa

SEQ ID NO: 2051052 - RNA, 17 nt, Staphylococcus aureus subsp. aureus Mu50
gauuauguaauucuagc

SEQ ID NO: 2051053 - RNA, 22 nt, Staphylococcus aureus subsp. aureus Mu50
gauuaucuguaauuaauccauc

SEQ ID NO: 2051054 - RNA, 22 nt, Staphylococcus aureus subsp. aureus Mu50
gauuaucugacauuguugcuaa

SEQ ID NO: 2051055 - RNA, 18 nt, Staphylococcus aureus subsp. aureus Mu50
gauuauauuuuucuucag

SEQ ID NO: 2051056 - RNA, 12 nt, Staphylococcus aureus subsp. aureus Mu50
gauuaacauuau

SEQ ID NO: 2051057 - RNA, 15 nt, Staphylococcus aureus subsp. aureus Mu50
gauuaacaaggaagc

SEQ ID NO: 2051058 - RNA, 19 nt, Staphylococcus aureus subsp. aureus Mu50
gauuaacaaggaagcauga

SEQ ID NO: 2051059 - RNA, 20 nt, Staphylococcus aureus subsp. aureus Mu50
gauuaacaaggaagcaugag

SEQ ID NO: 2051060 - RNA, 12 nt, Staphylococcus aureus subsp. aureus Mu50
gauuaaaagugu

SEQ ID NO: 2051061 - RNA, 13 nt, Staphylococcus aureus subsp. aureus Mu50
gaugucgaaaaua

SEQ ID NO: 2051062 - RNA, 15 nt, Staphylococcus aureus subsp. aureus Mu50
gaugucgaaaaguau

SEQ ID NO: 2051063 - RNA, 18 nt, Staphylococcus aureus subsp. aureus Mu50
gaugucaugucuagauuu

SEQ ID NO: 2051064 - RNA, 22 nt, Staphylococcus aureus subsp. aureus Mu50
gaugguguuaaguuuucaauuc

SEQ ID NO: 2051065 - RNA, 16 nt, Staphylococcus aureus subsp. aureus Mu50
gaugguuaaugacuau

SEQ ID NO: 2051066 - RNA, 14 nt, Staphylococcus aureus subsp. aureus Mu50
gaugguuaucacuu

SEQ ID NO: 2051067 - RNA, 16 nt, Staphylococcus aureus subsp. aureus Mu50
gaugucacauaugacu

SEQ ID NO: 2051068 - RNA, 16 nt, Staphylococcus aureus subsp. aureus Mu50
gaugguacuaaaguug

SEQ ID NO: 2051069 - RNA, 19 nt, Staphylococcus aureus subsp. aureus Mu50
gaugggagaaauuuuucac

SEQ ID NO: 2051070 - RNA, 16 nt, Staphylococcus aureus subsp. aureus Mu50
gaugcuugaauguuug

SEQ ID NO: 2051071 - RNA, 22 nt, Staphylococcus aureus subsp. aureus Mu50
gaugcuucgaauuuaacaucuu

SEQ ID NO: 2051072 - RNA, 19 nt, Staphylococcus aureus subsp. aureus Mu50
gaugcuucgcacaacugca

SEQ ID NO: 2051073 - RNA, 19 nt, Staphylococcus aureus subsp. aureus Mu50
gaugcuucgcaucacugca

SEQ ID NO: 2051074 - RNA, 19 nt, Staphylococcus aureus subsp. aureus Mu50
gaugcuucucacaacugca

SEQ ID NO: 2051075 - RNA, 19 nt, Staphylococcus aureus subsp. aureus Mu50
gaugcgugcgaagucacuu

SEQ ID NO: 2051076 - RNA, 16 nt, Staphylococcus aureus subsp. aureus Mu50
gaugcuaaaaauauug

SEQ ID NO: 2051077 - RNA, 16 nt, Staphylococcus aureus subsp. aureus Mu50
gaugagauaaaaucau

SEQ ID NO: 2051078 - RNA, 16 nt, Staphylococcus aureus subsp. aureus Mu50
gaugaaugauugcauu

SEQ ID NO: 2051079 - RNA, 22 nt, Staphylococcus aureus subsp. aureus Mu50
gaugaauggauuuucuucacca

SEQ ID NO: 2051080 - RNA, 18 nt, Staphylococcus aureus subsp. aureus Mu50
gaugaauuuuuauuuuua

SEQ ID NO: 2051081 - RNA, 21 nt, Staphylococcus aureus subsp. aureus Mu50
gaugacugaaccaauccaaua

SEQ ID NO: 2051082 - RNA, 13 nt, Staphylococcus aureus subsp. aureus Mu50
gaugagaaauguu

SEQ ID NO: 2051083 - RNA, 18 nt, Staphylococcus aureus subsp. aureus Mu50
gaugacuguagaaaacau

SEQ ID NO: 2051084 - RNA, 14 nt, Staphylococcus aureus subsp. aureus Mu50
gaugaauaaauaga

SEQ ID NO: 2051085 - RNA, 13 nt, Staphylococcus aureus subsp. aureus Mu50
gaucgguauuuuc

SEQ ID NO: 2051086 - RNA, 15 nt, Staphylococcus aureus subsp. aureus Mu50
gaucgauacuuuuug

SEQ ID NO: 2051087 - RNA, 19 nt, Staphylococcus aureus subsp. aureus Mu50
gaucgcccauacuaaauaa

SEQ ID NO: 2051088 - RNA, 13 nt, Staphylococcus aureus subsp. aureus Mu50
gauauguuuauau

SEQ ID NO: 2051089 - RNA, 20 nt, Staphylococcus aureus subsp. aureus Mu50
gauauguuuggauaucuuug

SEQ ID NO: 2051090 - RNA, 17 nt, Staphylococcus aureus subsp. aureus Mu50
gauauuaggcuuaaaua

SEQ ID NO: 2051091 - RNA, 16 nt, Staphylococcus aureus subsp. aureus Mu50
gauauugaucugauuu

SEQ ID NO: 2051092 - RNA, 15 nt, Staphylococcus aureus subsp. aureus Mu50
gauauggaucauaau

SEQ ID NO: 2051093 - RNA, 19 nt, Staphylococcus aureus subsp. aureus Mu50
gauaugcucucuucaaagu

SEQ ID NO: 2051094 - RNA, 20 nt, Staphylococcus aureus subsp. aureus Mu50
gauaucugacauuucaucaa

SEQ ID NO: 2051095 - RNA, 17 nt, Staphylococcus aureus subsp. aureus Mu50
gauaucuggauuaacug

SEQ ID NO: 2051096 - RNA, 19 nt, Staphylococcus aureus subsp. aureus Mu50
gauaucuuuuaauucuuaa

SEQ ID NO: 2051097 - RNA, 13 nt, Staphylococcus aureus subsp. aureus Mu50
gauaucaauguau

SEQ ID NO: 2051098 - RNA, 19 nt, Staphylococcus aureus subsp. aureus Mu50
gauaucagcuaaguuaaau

SEQ ID NO: 2051099 - RNA, 21 nt, Staphylococcus aureus subsp. aureus Mu50
gauagcaccguaacauaugua

SEQ ID NO: 2051100 - RNA, 17 nt, Staphylococcus aureus subsp. aureus Mu50
gaucauuauuuagaauu

SEQ ID NO: 2051101 - RNA, 17 nt, Staphylococcus aureus subsp. aureus Mu50
gaucauuuucaacauaa

SEQ ID NO: 2051102 - RNA, 19 nt, Staphylococcus aureus subsp. aureus Mu50
gauccaaaguacucaagua

SEQ ID NO: 2051103 - RNA, 16 nt, Staphylococcus aureus subsp. aureus Mu50
gaucaagcugagcuuu

SEQ ID NO: 2051104 - RNA, 15 nt, Staphylococcus aureus subsp. aureus Mu50
gaucaacuauauaua

SEQ ID NO: 2051105 - RNA, 23 nt, Staphylococcus aureus subsp. aureus Mu50
gauauuuaacaaaauuaagaaga

SEQ ID NO: 2051106 - RNA, 22 nt, Staphylococcus aureus subsp. aureus Mu50
gauauuuagaauaagaaauaaa

SEQ ID NO: 2051107 - RNA, 18 nt, Staphylococcus aureus subsp. aureus Mu50
gauaauccaccaaauaca

SEQ ID NO: 2051108 - RNA, 20 nt, Staphylococcus aureus subsp. aureus Mu50
gauaauacuguuuaaauaaa

SEQ ID NO: 2051109 - RNA, 18 nt, Staphylococcus aureus subsp. aureus Mu50
gauaauagcuugagcauc

SEQ ID NO: 2051110 - RNA, 20 nt, Staphylococcus aureus subsp. aureus Mu50
gauaauuauacguuacuaaa

SEQ ID NO: 2051111 - RNA, 13 nt, Staphylococcus aureus subsp. aureus Mu50
gauacaaaccuaa

SEQ ID NO: 2051112 - RNA, 18 nt, Staphylococcus aureus subsp. aureus Mu50
gauacaaaggauuauuaa

SEQ ID NO: 2051113 - RNA, 18 nt, Staphylococcus aureus subsp. aureus Mu50
gauaauuugagaaaugaa

SEQ ID NO: 2051114 - RNA, 13 nt, Staphylococcus aureus subsp. aureus Mu50
gauaauuucuucu

SEQ ID NO: 2051115 - RNA, 21 nt, Staphylococcus aureus subsp. aureus Mu50
gauaaugauaguguaugaaug

SEQ ID NO: 2051116 - RNA, 15 nt, Staphylococcus aureus subsp. aureus Mu50
gauaaugcaccugug

SEQ ID NO: 2051117 - RNA, 22 nt, Staphylococcus aureus subsp. aureus Mu50
gauaauguacauguauaaaaga

SEQ ID NO: 2051118 - RNA, 23 nt, Staphylococcus aureus subsp. aureus Mu50
gauaauuaaaauaagauauauaa

SEQ ID NO: 2051119 - RNA, 22 nt, Staphylococcus aureus subsp. aureus Mu50
gauaccagccagcuuagcauag

SEQ ID NO: 2051120 - RNA, 16 nt, Staphylococcus aureus subsp. aureus Mu50
gauaccaaacugccua

SEQ ID NO: 2051121 - RNA, 19 nt, Staphylococcus aureus subsp. aureus Mu50
gauaccaaauauauuuuua

SEQ ID NO: 2051122 - RNA, 15 nt, Staphylococcus aureus subsp. aureus Mu50
gauacauucuauuaa

SEQ ID NO: 2051123 - RNA, 22 nt, Staphylococcus aureus subsp. aureus Mu50
gauagaugcuggcuuaguaguu

SEQ ID NO: 2051124 - RNA, 14 nt, Staphylococcus aureus subsp. aureus Mu50
gauagaugaaaaug

SEQ ID NO: 2051125 - RNA, 14 nt, Staphylococcus aureus subsp. aureus Mu50
gauacuuugaaaga

SEQ ID NO: 2051126 - RNA, 16 nt, Staphylococcus aureus subsp. aureus Mu50
gauacuuuuaaauuau

SEQ ID NO: 2051127 - RNA, 22 nt, Staphylococcus aureus subsp. aureus Mu50
gauacuuuuuguaguccuucuu

SEQ ID NO: 2051128 - RNA, 14 nt, Staphylococcus aureus subsp. aureus Mu50
gauacgcuuuuuaa

SEQ ID NO: 2051129 - RNA, 19 nt, Staphylococcus aureus subsp. aureus Mu50
gauacgcuuuuuaaaaaau

SEQ ID NO: 2051130 - RNA, 18 nt, Staphylococcus aureus subsp. aureus Mu50
gauacugauauuuagaau

SEQ ID NO: 2051131 - RNA, 23 nt, Staphylococcus aureus subsp. aureus Mu50
gauaaaauaauuguucuucagaa

SEQ ID NO: 2051132 - RNA, 20 nt, Staphylococcus aureus subsp. aureus Mu50
gauaaaaguuguauucugaa

SEQ ID NO: 2051133 - RNA, 19 nt, Staphylococcus aureus subsp. aureus Mu50
gauaaaaauuuaugucuua

SEQ ID NO: 2051134 - RNA, 19 nt, Staphylococcus aureus subsp. aureus Mu50
gauaaaaccaccuaccauu

SEQ ID NO: 2051135 - RNA, 17 nt, Staphylococcus aureus subsp. aureus Mu50
gaguucaucuuguacag

SEQ ID NO: 2051136 - RNA, 12 nt, Staphylococcus aureus subsp. aureus Mu50
gaguuauaucuu

SEQ ID NO: 2051137 - RNA, 14 nt, Staphylococcus aureus subsp. aureus Mu50
gaguuaauccucau

SEQ ID NO: 2051138 - RNA, 13 nt, Staphylococcus aureus subsp. aureus Mu50
gaguuaaacgaaa

SEQ ID NO: 2051139 - RNA, 16 nt, Staphylococcus aureus subsp. aureus Mu50
gaauuugcacaaagau

SEQ ID NO: 2051140 - RNA, 13 nt, Staphylococcus aureus subsp. aureus Mu50
gaguauaucagcu

SEQ ID NO: 2051141 - RNA, 17 nt, Staphylococcus aureus subsp. aureus Mu50
gaauuucuuuaagugac

SEQ ID NO: 2051142 - RNA, 15 nt, Staphylococcus aureus subsp. aureus Mu50
gaauuucgaaaagaa

SEQ ID NO: 2051143 - RNA, 18 nt, Staphylococcus aureus subsp. aureus Mu50
gaguaucaugcuuuuaau

SEQ ID NO: 2051144 - RNA, 21 nt, Staphylococcus aureus subsp. aureus Mu50
gaguauccugauuuaauguua

SEQ ID NO: 2051145 - RNA, 13 nt, Staphylococcus aureus subsp. aureus Mu50
gaguauuaaauuu

SEQ ID NO: 2051146 - RNA, 16 nt, Staphylococcus aureus subsp. aureus Mu50
gaguauuuuugcguua

SEQ ID NO: 2051147 - RNA, 18 nt, Staphylococcus aureus subsp. aureus Mu50
gagugcacuuguaauauu

SEQ ID NO: 2051148 - RNA, 12 nt, Staphylococcus aureus subsp. aureus Mu50
gagugauagaaa

SEQ ID NO: 2051149 - RNA, 15 nt, Staphylococcus aureus subsp. aureus Mu50
cuuuuauauuuuuau

SEQ ID NO: 2051150 - RNA, 13 nt, Staphylococcus aureus subsp. aureus Mu50
cuuuuauauuuuu

SEQ ID NO: 2051151 - RNA, 14 nt, Staphylococcus aureus subsp. aureus Mu50
cuuuuauuacuuau

SEQ ID NO: 2051152 - RNA, 19 nt, Staphylococcus aureus subsp. aureus Mu50
cuuuuauuacuuauuucuu

SEQ ID NO: 2051153 - RNA, 16 nt, Staphylococcus aureus subsp. aureus Mu50
cuuuuauuauuuuaug

SEQ ID NO: 2051154 - RNA, 18 nt, Staphylococcus aureus subsp. aureus Mu50
cuuuuaugucuaguucuu

SEQ ID NO: 2051155 - RNA, 23 nt, Staphylococcus aureus subsp. aureus Mu50
cuuuuauuaaagaaacaugauug

SEQ ID NO: 2051156 - RNA, 20 nt, Staphylococcus aureus subsp. aureus Mu50
cuuuuauccaauguauaaaa

SEQ ID NO: 2051157 - RNA, 14 nt, Staphylococcus aureus subsp. aureus Mu50
cuuuuaugcaugcg

SEQ ID NO: 2051158 - RNA, 10 nt, Staphylococcus aureus subsp. aureus Mu50
cuuuuaugca

SEQ ID NO: 2051159 - RNA, 14 nt, Staphylococcus aureus subsp. aureus Mu50
cuuuuacauuugua

SEQ ID NO: 2051160 - RNA, 18 nt, Staphylococcus aureus subsp. aureus Mu50
cuuuuacaaacuucacau

SEQ ID NO: 2051161 - RNA, 20 nt, Staphylococcus aureus subsp. aureus Mu50
cuuuuaccucugauaaauga

SEQ ID NO: 2051162 - RNA, 19 nt, Staphylococcus aureus subsp. aureus Mu50
cuuuuagaguuuuuauuau

SEQ ID NO: 2051163 - RNA, 19 nt, Staphylococcus aureus subsp. aureus Mu50
cuuuucauuaucauuaagu

SEQ ID NO: 2051164 - RNA, 18 nt, Staphylococcus aureus subsp. aureus Mu50
cuuuucaaacauauucau

SEQ ID NO: 2051165 - RNA, 14 nt, Staphylococcus aureus subsp. aureus Mu50
cuuuuccauucaua

SEQ ID NO: 2051166 - RNA, 21 nt, Staphylococcus aureus subsp. aureus Mu50
cuuuuccauaaauauuuaaaa

SEQ ID NO: 2051167 - RNA, 23 nt, Staphylococcus aureus subsp. aureus Mu50
cuuuguucugcuuuuucuuuauc

SEQ ID NO: 2051168 - RNA, 15 nt, Staphylococcus aureus subsp. aureus Mu50
cuuuguuggggccca

SEQ ID NO: 2051169 - RNA, 20 nt, Staphylococcus aureus subsp. aureus Mu50
cuuuguuggggcccacaccc

SEQ ID NO: 2051170 - RNA, 21 nt, Staphylococcus aureus subsp. aureus Mu50
cuuuguuggggcccacacccc

SEQ ID NO: 2051171 - RNA, 22 nt, Staphylococcus aureus subsp. aureus Mu50
cuuuguuggggcccacacccca

SEQ ID NO: 2051172 - RNA, 18 nt, Staphylococcus aureus subsp. aureus Mu50
cuuuuaaaccguguucuu

SEQ ID NO: 2051173 - RNA, 17 nt, Staphylococcus aureus subsp. aureus Mu50
cuuuuaaaccguguucu

SEQ ID NO: 2051174 - RNA, 12 nt, Staphylococcus aureus subsp. aureus Mu50
cuuuuaaaaaac

SEQ ID NO: 2051175 - RNA, 14 nt, Staphylococcus aureus subsp. aureus Mu50
cuuuguuuucagua

SEQ ID NO: 2051176 - RNA, 13 nt, Staphylococcus aureus subsp. aureus Mu50
cuuuuaaucaaau

SEQ ID NO: 2051177 - RNA, 20 nt, Staphylococcus aureus subsp. aureus Mu50
cuuuuaaucaaauuaucugu

SEQ ID NO: 2051178 - RNA, 16 nt, Staphylococcus aureus subsp. aureus Mu50
cuuuuaauaucuucua

SEQ ID NO: 2051179 - RNA, 17 nt, Staphylococcus aureus subsp. aureus Mu50
cuuuuacaaacuucaca

SEQ ID NO: 2051180 - RNA, 23 nt, Staphylococcus aureus subsp. aureus Mu50
cuuuuacaaacuucacaucaugu

SEQ ID NO: 2051181 - RNA, 22 nt, Staphylococcus aureus subsp. aureus Mu50
cuuuuaacccacauuaaauauu

SEQ ID NO: 2051182 - RNA, 20 nt, Staphylococcus aureus subsp. aureus Mu50
cuuuuaaauuaugacuuauu

SEQ ID NO: 2051183 - RNA, 19 nt, Staphylococcus aureus subsp. aureus Mu50
cuuugucacgauagauuua

SEQ ID NO: 2051184 - RNA, 23 nt, Staphylococcus aureus subsp. aureus Mu50
cuuuguauggaaauggugguuac

SEQ ID NO: 2051185 - RNA, 18 nt, Staphylococcus aureus subsp. aureus Mu50
cuuuguagccuucaacua

SEQ ID NO: 2051186 - RNA, 14 nt, Staphylococcus aureus subsp. aureus Mu50
cuuuguguuugcuu

SEQ ID NO: 2051187 - RNA, 16 nt, Staphylococcus aureus subsp. aureus Mu50
cuuuguguuugcuuuu

SEQ ID NO: 2051188 - RNA, 22 nt, Staphylococcus aureus subsp. aureus Mu50
cuuucuugaugaauuaaacuga

SEQ ID NO: 2051189 - RNA, 13 nt, Staphylococcus aureus subsp. aureus Mu50
cuuucuuuuucau

SEQ ID NO: 2051190 - RNA, 17 nt, Staphylococcus aureus subsp. aureus Mu50
cuuucuuuuucaucuuu

SEQ ID NO: 2051191 - RNA, 18 nt, Staphylococcus aureus subsp. aureus Mu50
cuuugaaagaaggaauaa

SEQ ID NO: 2051192 - RNA, 19 nt, Staphylococcus aureus subsp. aureus Mu50
cuuuugauuuuuuuguucu

SEQ ID NO: 2051193 - RNA, 15 nt, Staphylococcus aureus subsp. aureus Mu50
cuuuuguuuuaccau

SEQ ID NO: 2051194 - RNA, 13 nt, Staphylococcus aureus subsp. aureus Mu50
cuuuuguaaaaaa

SEQ ID NO: 2051195 - RNA, 23 nt, Staphylococcus aureus subsp. aureus Mu50
cuuuuuagccccagcaaauacuu

SEQ ID NO: 2051196 - RNA, 12 nt, Staphylococcus aureus subsp. aureus Mu50
cuuuuuaggaug

SEQ ID NO: 2051197 - RNA, 21 nt, Staphylococcus aureus subsp. aureus Mu50
cuuuuuaggaaugauagauuu

SEQ ID NO: 2051198 - RNA, 19 nt, Staphylococcus aureus subsp. aureus Mu50
cuuuuuaucaacaaauuua

SEQ ID NO: 2051199 - RNA, 17 nt, Staphylococcus aureus subsp. aureus Mu50
cuuuuuauuauacuuua

SEQ ID NO: 2051200 - RNA, 15 nt, Staphylococcus aureus subsp. aureus Mu50
cuuuuuauaucaaaa

SEQ ID NO: 2051201 - RNA, 21 nt, Staphylococcus aureus subsp. aureus Mu50
cuuuuucaaauaauauaaaac

SEQ ID NO: 2051202 - RNA, 21 nt, Staphylococcus aureus subsp. aureus Mu50
cuuuuuauuuuaauauuuucu

SEQ ID NO: 2051203 - RNA, 23 nt, Staphylococcus aureus subsp. aureus Mu50
cuuuuuaaacguacauuuuuaug

SEQ ID NO: 2051204 - RNA, 21 nt, Staphylococcus aureus subsp. aureus Mu50
cuuuuuaaaaucguuaaggaa

SEQ ID NO: 2051205 - RNA, 12 nt, Staphylococcus aureus subsp. aureus Mu50
cuuuuuaaagua

SEQ ID NO: 2051206 - RNA, 16 nt, Staphylococcus aureus subsp. aureus Mu50
cuuuuuaaaaucguua

SEQ ID NO: 2051207 - RNA, 12 nt, Staphylococcus aureus subsp. aureus Mu50
cuuuuuaaaaaa

SEQ ID NO: 2051208 - RNA, 17 nt, Staphylococcus aureus subsp. aureus Mu50
cuuuuuacauuuucaaa

SEQ ID NO: 2051209 - RNA, 21 nt, Staphylococcus aureus subsp. aureus Mu50
cuuuuuaacuauguuacuuau

SEQ ID NO: 2051210 - RNA, 21 nt, Staphylococcus aureus subsp. aureus Mu50
cuuuuuacuaggaauauaaaa

SEQ ID NO: 2051211 - RNA, 17 nt, Staphylococcus aureus subsp. aureus Mu50
cuuuuuagccccagcaa

SEQ ID NO: 2051212 - RNA, 22 nt, Staphylococcus aureus subsp. aureus Mu50
cuuuuugacauauuuuuuaaau

SEQ ID NO: 2051213 - RNA, 20 nt, Staphylococcus aureus subsp. aureus Mu50
cuuuuugacucagaaucuua

SEQ ID NO: 2051214 - RNA, 22 nt, Staphylococcus aureus subsp. aureus Mu50
cuuuuugccuggcaacguucua

SEQ ID NO: 2051215 - RNA, 19 nt, Staphylococcus aureus subsp. aureus Mu50
cuuuuugacauauuuuuua

SEQ ID NO: 2051216 - RNA, 12 nt, Staphylococcus aureus subsp. aureus Mu50
cuuuuucuuuca

SEQ ID NO: 2051217 - RNA, 12 nt, Staphylococcus aureus subsp. aureus Mu50
cuuuuucacauu

SEQ ID NO: 2051218 - RNA, 15 nt, Staphylococcus aureus subsp. aureus Mu50
cuuuuucuaaauaaa

SEQ ID NO: 2051219 - RNA, 16 nt, Staphylococcus aureus subsp. aureus Mu50
cuuuuucuaaauaaac

SEQ ID NO: 2051220 - RNA, 15 nt, Staphylococcus aureus subsp. aureus Mu50
gaaaagagaaacaaa

SEQ ID NO: 2051221 - RNA, 23 nt, Staphylococcus aureus subsp. aureus Mu50
gaaaacguugaguauuacuugaa

SEQ ID NO: 2051222 - RNA, 16 nt, Staphylococcus aureus subsp. aureus Mu50
gaaaacuauuuuaaaa

SEQ ID NO: 2051223 - RNA, 17 nt, Staphylococcus aureus subsp. aureus Mu50
gaaaauaaaacaaauua

SEQ ID NO: 2051224 - RNA, 18 nt, Staphylococcus aureus subsp. aureus Mu50
gaaaauaagcuuguaaca

SEQ ID NO: 2051225 - RNA, 20 nt, Staphylococcus aureus subsp. aureus Mu50
gaaaauaaucgaacagaaaa

SEQ ID NO: 2051226 - RNA, 18 nt, Staphylococcus aureus subsp. aureus Mu50
gaaaauagccauauucau

SEQ ID NO: 2051227 - RNA, 19 nt, Staphylococcus aureus subsp. aureus Mu50
gaaaauagcuauuaaaaua

SEQ ID NO: 2051228 - RNA, 22 nt, Staphylococcus aureus subsp. aureus Mu50
gaaaauagcuauuaaaauagag

SEQ ID NO: 2051229 - RNA, 13 nt, Staphylococcus aureus subsp. aureus Mu50
gaaaauagcuguu

SEQ ID NO: 2051230 - RNA, 20 nt, Staphylococcus aureus subsp. aureus Mu50
gaaaauagcuguuugauauu

SEQ ID NO: 2051231 - RNA, 17 nt, Staphylococcus aureus subsp. aureus Mu50
gaaaauaccucuacauu

SEQ ID NO: 2051232 - RNA, 17 nt, Staphylococcus aureus subsp. aureus Mu50
gaaaauacuauacugau

SEQ ID NO: 2051233 - RNA, 14 nt, Staphylococcus aureus subsp. aureus Mu50
gaaaauagaaagaa

SEQ ID NO: 2051234 - RNA, 14 nt, Staphylococcus aureus subsp. aureus Mu50
gaaaauaaaaacca

SEQ ID NO: 2051235 - RNA, 18 nt, Staphylococcus aureus subsp. aureus Mu50
gaaaagugaaaacuucuc

SEQ ID NO: 2051236 - RNA, 20 nt, Staphylococcus aureus subsp. aureus Mu50
gaaaauauaguggugguacu

SEQ ID NO: 2051237 - RNA, 15 nt, Staphylococcus aureus subsp. aureus Mu50
gaaaauaugauaacu

SEQ ID NO: 2051238 - RNA, 14 nt, Staphylococcus aureus subsp. aureus Mu50
gaaaaucaucauua

SEQ ID NO: 2051239 - RNA, 22 nt, Staphylococcus aureus subsp. aureus Mu50
gaaaaugacgauacguauauag

SEQ ID NO: 2051240 - RNA, 22 nt, Staphylococcus aureus subsp. aureus Mu50
gaaaauuucucacugcuguucu

SEQ ID NO: 2051241 - RNA, 18 nt, Staphylococcus aureus subsp. aureus Mu50
gaaaauucgcuuguaaca

SEQ ID NO: 2051242 - RNA, 14 nt, Staphylococcus aureus subsp. aureus Mu50
gaaaauugcuaaaa

SEQ ID NO: 2051243 - RNA, 21 nt, Staphylococcus aureus subsp. aureus Mu50
gaaaauuauuugauauuucau

SEQ ID NO: 2051244 - RNA, 16 nt, Staphylococcus aureus subsp. aureus Mu50
gaaacacacuaaaagc

SEQ ID NO: 2051245 - RNA, 15 nt, Staphylococcus aureus subsp. aureus Mu50
gaaacacacuaaaag

SEQ ID NO: 2051246 - RNA, 22 nt, Staphylococcus aureus subsp. aureus Mu50
gaaacaauucauuaauaggauu

SEQ ID NO: 2051247 - RNA, 20 nt, Staphylococcus aureus subsp. aureus Mu50
gaaaaagugauaauuaaaau

SEQ ID NO: 2051248 - RNA, 15 nt, Staphylococcus aureus subsp. aureus Mu50
gaaaaagaugaaaaa

SEQ ID NO: 2051249 - RNA, 18 nt, Staphylococcus aureus subsp. aureus Mu50
gaaaaagaugaaaaaguc

SEQ ID NO: 2051250 - RNA, 19 nt, Staphylococcus aureus subsp. aureus Mu50
gaaaaaccaaguuuugcac

SEQ ID NO: 2051251 - RNA, 17 nt, Staphylococcus aureus subsp. aureus Mu50
gaaaaacuguaaaucau

SEQ ID NO: 2051252 - RNA, 20 nt, Staphylococcus aureus subsp. aureus Mu50
gaaaaagauucggaaaauau

SEQ ID NO: 2051253 - RNA, 12 nt, Staphylococcus aureus subsp. aureus Mu50
gaaaaauuaaaa

SEQ ID NO: 2051254 - RNA, 18 nt, Staphylococcus aureus subsp. aureus Mu50
gaaaaauuucaaaaauag

SEQ ID NO: 2051255 - RNA, 22 nt, Staphylococcus aureus subsp. aureus Mu50
gaaaaaauuaauaauuuuccau

SEQ ID NO: 2051256 - RNA, 13 nt, Staphylococcus aureus subsp. aureus Mu50
cuuuuuuuuauaa

SEQ ID NO: 2051257 - RNA, 16 nt, Staphylococcus aureus subsp. aureus Mu50
cuuuuuuuaaaucuuc

SEQ ID NO: 2051258 - RNA, 23 nt, Staphylococcus aureus subsp. aureus Mu50
cuuuuuuuaaaucuucuauuuuc

SEQ ID NO: 2051259 - RNA, 15 nt, Staphylococcus aureus subsp. aureus Mu50
cuuuuuucauuucuu

SEQ ID NO: 2051260 - RNA, 20 nt, Staphylococcus aureus subsp. aureus Mu50
cuuuuuuauuuuauaagaau

SEQ ID NO: 2051261 - RNA, 13 nt, Staphylococcus aureus subsp. aureus Mu50
cuuuuuuauauuc

SEQ ID NO: 2051262 - RNA, 20 nt, Staphylococcus aureus subsp. aureus Mu50
cuuuuugucucucaacauuu

SEQ ID NO: 2051263 - RNA, 21 nt, Staphylococcus aureus subsp. aureus Mu50
cuuuuugcguuuuuaaauaau

SEQ ID NO: 2051264 - RNA, 18 nt, Staphylococcus aureus subsp. aureus Mu50
cuuuuuguuaauuuuuua

SEQ ID NO: 2051265 - RNA, 16 nt, Staphylococcus aureus subsp. aureus Mu50
cuuuuuuaagaucaau

SEQ ID NO: 2051266 - RNA, 17 nt, Staphylococcus aureus subsp. aureus Mu50
cuuuuuuaagcuuauca

SEQ ID NO: 2051267 - RNA, 12 nt, Staphylococcus aureus subsp. aureus Mu50
cuuuuuuaaguu

SEQ ID NO: 2051268 - RNA, 14 nt, Staphylococcus aureus subsp. aureus Mu50
gaaacauuaaaaua

SEQ ID NO: 2051269 - RNA, 21 nt, Staphylococcus aureus subsp. aureus Mu50
gaaaccuuucgauaaacuaca

SEQ ID NO: 2051270 - RNA, 14 nt, Staphylococcus aureus subsp. aureus Mu50
gaaacuaauaauuu

SEQ ID NO: 2051271 - RNA, 13 nt, Staphylococcus aureus subsp. aureus Mu50
gaaacuaaauuaa

SEQ ID NO: 2051272 - RNA, 17 nt, Staphylococcus aureus subsp. aureus Mu50
gaaagaugauauauuca

SEQ ID NO: 2051273 - RNA, 21 nt, Staphylococcus aureus subsp. aureus Mu50
gaaagguauaucuucauuuaa

SEQ ID NO: 2051274 - RNA, 20 nt, Staphylococcus aureus subsp. aureus Mu50
gaaaguauuagauauauuug

SEQ ID NO: 2051275 - RNA, 20 nt, Staphylococcus aureus subsp. aureus Mu50
gaaagucaacaauugcuaau

SEQ ID NO: 2051276 - RNA, 20 nt, Staphylococcus aureus subsp. aureus Mu50
gaaaguaucuaugaaauuuu

SEQ ID NO: 2051277 - RNA, 18 nt, Staphylococcus aureus subsp. aureus Mu50
gaaaguaccuaaaauaga

SEQ ID NO: 2051278 - RNA, 16 nt, Staphylococcus aureus subsp. aureus Mu50
gaaauaccuccugauu

SEQ ID NO: 2051279 - RNA, 17 nt, Staphylococcus aureus subsp. aureus Mu50
gaaauacuugaauuuaa

SEQ ID NO: 2051280 - RNA, 22 nt, Staphylococcus aureus subsp. aureus Mu50
gaaauacuugaauuuaauaagu

SEQ ID NO: 2051281 - RNA, 21 nt, Staphylococcus aureus subsp. aureus Mu50
gaaauagguaucuuaaagcau

SEQ ID NO: 2051282 - RNA, 23 nt, Staphylococcus aureus subsp. aureus Mu50
gaaauauaccaaccaaaaccaaa

SEQ ID NO: 2051283 - RNA, 21 nt, Staphylococcus aureus subsp. aureus Mu50
gaaauaggcgcuuguaaaauu

SEQ ID NO: 2051284 - RNA, 15 nt, Staphylococcus aureus subsp. aureus Mu50
gaaauaucaagaugu

SEQ ID NO: 2051285 - RNA, 19 nt, Staphylococcus aureus subsp. aureus Mu50
gaaauauuugaaaauuuca

SEQ ID NO: 2051286 - RNA, 17 nt, Staphylococcus aureus subsp. aureus Mu50
gaaauauuguaaucacu

SEQ ID NO: 2051287 - RNA, 16 nt, Staphylococcus aureus subsp. aureus Mu50
gaaagugauucccaaa

SEQ ID NO: 2051288 - RNA, 19 nt, Staphylococcus aureus subsp. aureus Mu50
gaacagcggaauacagaug

SEQ ID NO: 2051289 - RNA, 13 nt, Staphylococcus aureus subsp. aureus Mu50
gaacauaaauaaa

SEQ ID NO: 2051290 - RNA, 17 nt, Staphylococcus aureus subsp. aureus Mu50
gaacauaaauaaacuuu

SEQ ID NO: 2051291 - RNA, 16 nt, Staphylococcus aureus subsp. aureus Mu50
gaacaucugaaaaaau

SEQ ID NO: 2051292 - RNA, 15 nt, Staphylococcus aureus subsp. aureus Mu50
gaacaucugaaaaaa

SEQ ID NO: 2051293 - RNA, 19 nt, Staphylococcus aureus subsp. aureus Mu50
gaacaucuaguuauuucau

SEQ ID NO: 2051294 - RNA, 11 nt, Staphylococcus aureus subsp. aureus Mu50
gaacaucuaau

SEQ ID NO: 2051295 - RNA, 14 nt, Staphylococcus aureus subsp. aureus Mu50
gaacauuaaaagga

SEQ ID NO: 2051296 - RNA, 16 nt, Staphylococcus aureus subsp. aureus Mu50
gaacaugaaugauauu

SEQ ID NO: 2051297 - RNA, 14 nt, Staphylococcus aureus subsp. aureus Mu50
gaaccaacaauaaa

SEQ ID NO: 2051298 - RNA, 23 nt, Staphylococcus aureus subsp. aureus Mu50
gaacaaucggaagcauauuucua

SEQ ID NO: 2051299 - RNA, 13 nt, Staphylococcus aureus subsp. aureus Mu50
gaacaauaauaug

SEQ ID NO: 2051300 - RNA, 23 nt, Staphylococcus aureus subsp. aureus Mu50
gaacaaucaauacagagucuaca

SEQ ID NO: 2051301 - RNA, 16 nt, Staphylococcus aureus subsp. aureus Mu50
gaacagcacauuuuua

SEQ ID NO: 2051302 - RNA, 17 nt, Staphylococcus aureus subsp. aureus Mu50
gaacacgaaauggugaa

SEQ ID NO: 2051303 - RNA, 18 nt, Staphylococcus aureus subsp. aureus Mu50
gaaauuguguuucuuuua

SEQ ID NO: 2051304 - RNA, 22 nt, Staphylococcus aureus subsp. aureus Mu50
gaaauuuuuuagugaaaaaguu

SEQ ID NO: 2051305 - RNA, 15 nt, Staphylococcus aureus subsp. aureus Mu50
gaacaaaauaacaug

SEQ ID NO: 2051306 - RNA, 23 nt, Staphylococcus aureus subsp. aureus Mu50
gaaauuuuucacuucaaacaaag

SEQ ID NO: 2051307 - RNA, 16 nt, Staphylococcus aureus subsp. aureus Mu50
gaacaacauuaggaug

SEQ ID NO: 2051308 - RNA, 20 nt, Staphylococcus aureus subsp. aureus Mu50
gaacaacauugagauuaucu

SEQ ID NO: 2051309 - RNA, 22 nt, Staphylococcus aureus subsp. aureus Mu50
gaaauucuacagguaaugcaag

SEQ ID NO: 2051310 - RNA, 21 nt, Staphylococcus aureus subsp. aureus Mu50
gaaauucuacaggcaaugcaa

SEQ ID NO: 2051311 - RNA, 23 nt, Staphylococcus aureus subsp. aureus Mu50
gaaauucuacaggcaaugcaagu

SEQ ID NO: 2051312 - RNA, 20 nt, Staphylococcus aureus subsp. aureus Mu50
gaaauucucaguguuggggg

SEQ ID NO: 2051313 - RNA, 21 nt, Staphylococcus aureus subsp. aureus Mu50
gaaauucucuuuguuggggcc

SEQ ID NO: 2051314 - RNA, 17 nt, Staphylococcus aureus subsp. aureus Mu50
gaaauucgcuugauuaa

SEQ ID NO: 2051315 - RNA, 16 nt, Staphylococcus aureus subsp. aureus Mu50
gaaauucuacaggcaa

SEQ ID NO: 2051316 - RNA, 14 nt, Staphylococcus aureus subsp. aureus Mu50
gaaauuaaaucgac

SEQ ID NO: 2051317 - RNA, 16 nt, Staphylococcus aureus subsp. aureus Mu50
gaaauuaaaucgacaa

SEQ ID NO: 2051318 - RNA, 16 nt, Staphylococcus aureus subsp. aureus Mu50
gaaauguuuuggaaaa

SEQ ID NO: 2051319 - RNA, 18 nt, Staphylococcus aureus subsp. aureus Mu50
gaaauguuuuggaaaaau

SEQ ID NO: 2051320 - RNA, 14 nt, Staphylococcus aureus subsp. aureus Mu50
gaaauuagauuuua

SEQ ID NO: 2051321 - RNA, 21 nt, Staphylococcus aureus subsp. aureus Mu50
gaaauguuuaucaauucccug

SEQ ID NO: 2051322 - RNA, 11 nt, Staphylococcus aureus subsp. aureus Mu50
gaaauuagaaa

SEQ ID NO: 2051323 - RNA, 12 nt, Staphylococcus aureus subsp. aureus Mu50
gaaaugaaugag

SEQ ID NO: 2051324 - RNA, 15 nt, Staphylococcus aureus subsp. aureus Mu50
gaaaugauaauuuaa

SEQ ID NO: 2051325 - RNA, 11 nt, Staphylococcus aureus subsp. aureus Mu50
gaaauggcucc

SEQ ID NO: 2051326 - RNA, 19 nt, Staphylococcus aureus subsp. aureus Mu50
gaaauguauaugagguuca

SEQ ID NO: 2051327 - RNA, 20 nt, Staphylococcus aureus subsp. aureus Mu50
gaaauccgcauaaauuagau

SEQ ID NO: 2051328 - RNA, 17 nt, Staphylococcus aureus subsp. aureus Mu50
gaaaucaccagauuuua

SEQ ID NO: 2051329 - RNA, 20 nt, Staphylococcus aureus subsp. aureus Mu50
gaaaucaaaaauaauuauga

SEQ ID NO: 2051330 - RNA, 21 nt, Staphylococcus aureus subsp. aureus Mu50
gaaaucaaaaauaauuaugaa

SEQ ID NO: 2051331 - RNA, 14 nt, Staphylococcus aureus subsp. aureus Mu50
gaaaucaaaaauaa

SEQ ID NO: 2051332 - RNA, 21 nt, Staphylococcus aureus subsp. aureus Mu50
gaaauccucuuauaccaaggg

SEQ ID NO: 2051333 - RNA, 16 nt, Staphylococcus aureus subsp. aureus Mu50
gaacuuuucaaacaau

SEQ ID NO: 2051334 - RNA, 14 nt, Staphylococcus aureus subsp. aureus Mu50
gaacuuuuguucua

SEQ ID NO: 2051335 - RNA, 13 nt, Staphylococcus aureus subsp. aureus Mu50
gaacuuuaaaaau

SEQ ID NO: 2051336 - RNA, 15 nt, Staphylococcus aureus subsp. aureus Mu50
gaacuuuaauaccag

SEQ ID NO: 2051337 - RNA, 16 nt, Staphylococcus aureus subsp. aureus Mu50
gaagaaacuuaaucaa

SEQ ID NO: 2051338 - RNA, 14 nt, Staphylococcus aureus subsp. aureus Mu50
gaagaauacaaaua

SEQ ID NO: 2051339 - RNA, 21 nt, Staphylococcus aureus subsp. aureus Mu50
gaagaaucaggaccaaauaga

SEQ ID NO: 2051340 - RNA, 15 nt, Staphylococcus aureus subsp. aureus Mu50
gaagaauacaaauau

SEQ ID NO: 2051341 - RNA, 20 nt, Staphylococcus aureus subsp. aureus Mu50
gaagcaguuguugguuuugc

SEQ ID NO: 2051342 - RNA, 15 nt, Staphylococcus aureus subsp. aureus Mu50
gaagcacagaaaauu

SEQ ID NO: 2051343 - RNA, 14 nt, Staphylococcus aureus subsp. aureus Mu50
gaagcacagaaaau

SEQ ID NO: 2051344 - RNA, 18 nt, Staphylococcus aureus subsp. aureus Mu50
gaaggaaaauaaaaacca

SEQ ID NO: 2051345 - RNA, 23 nt, Staphylococcus aureus subsp. aureus Mu50
gaacuuauaaguccgauuugaua

SEQ ID NO: 2051346 - RNA, 17 nt, Staphylococcus aureus subsp. aureus Mu50
gaacuagacaagaugcu

SEQ ID NO: 2051347 - RNA, 18 nt, Staphylococcus aureus subsp. aureus Mu50
gaacguaaguuuaguuca

SEQ ID NO: 2051348 - RNA, 19 nt, Staphylococcus aureus subsp. aureus Mu50
gaacguguuugaauggcaa

SEQ ID NO: 2051349 - RNA, 18 nt, Staphylococcus aureus subsp. aureus Mu50
gaacguguuugaauggca

SEQ ID NO: 2051350 - RNA, 15 nt, Staphylococcus aureus subsp. aureus Mu50
gaacgaaacuuuaau

SEQ ID NO: 2051351 - RNA, 17 nt, Staphylococcus aureus subsp. aureus Mu50
gaaccuauauuaagcau

SEQ ID NO: 2051352 - RNA, 21 nt, Staphylococcus aureus subsp. aureus Mu50
gaaccuauuuuuuauaugaug

SEQ ID NO: 2051353 - RNA, 21 nt, Staphylococcus aureus subsp. aureus Mu50
gaacgauauuuuaaaaaguaa

SEQ ID NO: 2051354 - RNA, 17 nt, Staphylococcus aureus subsp. aureus Mu50
gaaccauacucuaacuu

SEQ ID NO: 2051355 - RNA, 14 nt, Staphylococcus aureus subsp. aureus Mu50
gaaccccauucacu

SEQ ID NO: 2051356 - RNA, 16 nt, Staphylococcus aureus subsp. aureus Mu50
gaauuaguacuugaaa

SEQ ID NO: 2051357 - RNA, 17 nt, Staphylococcus aureus subsp. aureus Mu50
gaauuaucuuuacgaua

SEQ ID NO: 2051358 - RNA, 17 nt, Staphylococcus aureus subsp. aureus Mu50
gaauuauucaaguaaua

SEQ ID NO: 2051359 - RNA, 15 nt, Staphylococcus aureus subsp. aureus Mu50
gaauuauuuaaaaug

SEQ ID NO: 2051360 - RNA, 17 nt, Staphylococcus aureus subsp. aureus Mu50
gaauuauuuaaaaugcu

SEQ ID NO: 2051361 - RNA, 17 nt, Staphylococcus aureus subsp. aureus Mu50
gaauuagauuuacgguu

SEQ ID NO: 2051362 - RNA, 23 nt, Staphylococcus aureus subsp. aureus Mu50
gaauuaauaauuuuuuuccuuuc

SEQ ID NO: 2051363 - RNA, 18 nt, Staphylococcus aureus subsp. aureus Mu50
gaauucacgcaauaucau

SEQ ID NO: 2051364 - RNA, 16 nt, Staphylococcus aureus subsp. aureus Mu50
gaauuauuuagaaacu

SEQ ID NO: 2051365 - RNA, 22 nt, Staphylococcus aureus subsp. aureus Mu50
gaauucaaccaauuauuaaagc

SEQ ID NO: 2051366 - RNA, 18 nt, Staphylococcus aureus subsp. aureus Mu50
gaauuauucaaguaauau

SEQ ID NO: 2051367 - RNA, 13 nt, Staphylococcus aureus subsp. aureus Mu50
gaauucauucaau

SEQ ID NO: 2051368 - RNA, 23 nt, Staphylococcus aureus subsp. aureus Mu50
gaauuuacuccuuacaauaaaga

SEQ ID NO: 2051369 - RNA, 13 nt, Staphylococcus aureus subsp. aureus Mu50
gaauugaguauua

SEQ ID NO: 2051370 - RNA, 21 nt, Staphylococcus aureus subsp. aureus Mu50
gaaugcaaaucaaauacauca

SEQ ID NO: 2051371 - RNA, 18 nt, Staphylococcus aureus subsp. aureus Mu50
gaaugccguaacccaugg

SEQ ID NO: 2051372 - RNA, 22 nt, Staphylococcus aureus subsp. aureus Mu50
gaauuaacuagugccucuuuua

SEQ ID NO: 2051373 - RNA, 19 nt, Staphylococcus aureus subsp. aureus Mu50
gaauuaacaacaaauauaa

SEQ ID NO: 2051374 - RNA, 15 nt, Staphylococcus aureus subsp. aureus Mu50
gaaugugaugauuaa

SEQ ID NO: 2051375 - RNA, 13 nt, Staphylococcus aureus subsp. aureus Mu50
gaauguuccuugu

SEQ ID NO: 2051376 - RNA, 18 nt, Staphylococcus aureus subsp. aureus Mu50
gaauguauucuaagaguu

SEQ ID NO: 2051377 - RNA, 13 nt, Staphylococcus aureus subsp. aureus Mu50
gaauguacaauuu

SEQ ID NO: 2051378 - RNA, 19 nt, Staphylococcus aureus subsp. aureus Mu50
gaaugguugucuccacacu

SEQ ID NO: 2051379 - RNA, 19 nt, Staphylococcus aureus subsp. aureus Mu50
gaaugagugucaugcuuaa

SEQ ID NO: 2051380 - RNA, 17 nt, Staphylococcus aureus subsp. aureus Mu50
gaaugaugaguauacuu

SEQ ID NO: 2051381 - RNA, 14 nt, Staphylococcus aureus subsp. aureus Mu50
gaaugauuuauaaa

SEQ ID NO: 2051382 - RNA, 14 nt, Staphylococcus aureus subsp. aureus Mu50
gaaugaauaauucc

SEQ ID NO: 2051383 - RNA, 14 nt, Staphylococcus aureus subsp. aureus Mu50
gaaugaaguaauau

SEQ ID NO: 2051384 - RNA, 18 nt, Staphylococcus aureus subsp. aureus Mu50
gaaucuuacauugauaaa

SEQ ID NO: 2051385 - RNA, 17 nt, Staphylococcus aureus subsp. aureus Mu50
gaaucuuauuuuguuuu

SEQ ID NO: 2051386 - RNA, 16 nt, Staphylococcus aureus subsp. aureus Mu50
gaaucuuggaaguauc

SEQ ID NO: 2051387 - RNA, 15 nt, Staphylococcus aureus subsp. aureus Mu50
gaaucuaaacuauaa

SEQ ID NO: 2051388 - RNA, 14 nt, Staphylococcus aureus subsp. aureus Mu50
gaaucuagaauaua

SEQ ID NO: 2051389 - RNA, 14 nt, Staphylococcus aureus subsp. aureus Mu50
gaaucggugucuuu

SEQ ID NO: 2051390 - RNA, 12 nt, Staphylococcus aureus subsp. aureus Mu50
gaaucaacaauu

SEQ ID NO: 2051391 - RNA, 20 nt, Staphylococcus aureus subsp. aureus Mu50
gaaucacaguuauauauucc

SEQ ID NO: 2051392 - RNA, 21 nt, Staphylococcus aureus subsp. aureus Mu50
gaaucagaugauuuaauucug

SEQ ID NO: 2051393 - RNA, 19 nt, Staphylococcus aureus subsp. aureus Mu50
gaaucccauaacaaucauu

SEQ ID NO: 2051394 - RNA, 19 nt, Staphylococcus aureus subsp. aureus Mu50
gaauccuaugccaaauaac

SEQ ID NO: 2051395 - RNA, 15 nt, Staphylococcus aureus subsp. aureus Mu50
gaaucgauauaauga

SEQ ID NO: 2051396 - RNA, 12 nt, Staphylococcus aureus subsp. aureus Mu50
gaauccuuaauu

SEQ ID NO: 2051397 - RNA, 12 nt, Staphylococcus aureus subsp. aureus Mu50
gaaguuguuucu

SEQ ID NO: 2051398 - RNA, 22 nt, Staphylococcus aureus subsp. aureus Mu50
gaaguugcucgcgcucuucuuc

SEQ ID NO: 2051399 - RNA, 13 nt, Staphylococcus aureus subsp. aureus Mu50
gaauaaaaaaguu

SEQ ID NO: 2051400 - RNA, 14 nt, Staphylococcus aureus subsp. aureus Mu50
gaaguauugccaaa

SEQ ID NO: 2051401 - RNA, 22 nt, Staphylococcus aureus subsp. aureus Mu50
gaaggccauuuuuauuuaacac

SEQ ID NO: 2051402 - RNA, 16 nt, Staphylococcus aureus subsp. aureus Mu50
gaagggguuuuuucuu

SEQ ID NO: 2051403 - RNA, 21 nt, Staphylococcus aureus subsp. aureus Mu50
gaauaagugguuguucccauu

SEQ ID NO: 2051404 - RNA, 13 nt, Staphylococcus aureus subsp. aureus Mu50
gaauaauauauuu

SEQ ID NO: 2051405 - RNA, 21 nt, Staphylococcus aureus subsp. aureus Mu50
gaauaaauuuugcgaaaauau

SEQ ID NO: 2051406 - RNA, 15 nt, Staphylococcus aureus subsp. aureus Mu50
gaauaaauagauaau

SEQ ID NO: 2051407 - RNA, 15 nt, Staphylococcus aureus subsp. aureus Mu50
gaauaacgucauaug

SEQ ID NO: 2051408 - RNA, 19 nt, Staphylococcus aureus subsp. aureus Mu50
gaauaacuguuuaucauga

SEQ ID NO: 2051409 - RNA, 18 nt, Staphylococcus aureus subsp. aureus Mu50
gaauacucuucaaucuac

SEQ ID NO: 2051410 - RNA, 20 nt, Staphylococcus aureus subsp. aureus Mu50
gaauacucuucaaucuacca

SEQ ID NO: 2051411 - RNA, 14 nt, Staphylococcus aureus subsp. aureus Mu50
gaauacuaaaagug

SEQ ID NO: 2051412 - RNA, 15 nt, Staphylococcus aureus subsp. aureus Mu50
gaauacuaaaagugu

SEQ ID NO: 2051413 - RNA, 23 nt, Staphylococcus aureus subsp. aureus Mu50
gaauaauuagauuuaaaauguca

SEQ ID NO: 2051414 - RNA, 21 nt, Staphylococcus aureus subsp. aureus Mu50
gaauacacgacgcuaaacaaa

SEQ ID NO: 2051415 - RNA, 17 nt, Staphylococcus aureus subsp. aureus Mu50
gaauauagcugugauuu

SEQ ID NO: 2051416 - RNA, 21 nt, Staphylococcus aureus subsp. aureus Mu50
gaauaugaauugcuuguuuua

SEQ ID NO: 2051417 - RNA, 18 nt, Staphylococcus aureus subsp. aureus Mu50
gaauaucuuaaagaauua

SEQ ID NO: 2051418 - RNA, 22 nt, Staphylococcus aureus subsp. aureus Mu50
gaauauuaacaccagauaucau

SEQ ID NO: 2051419 - RNA, 23 nt, Staphylococcus aureus subsp. aureus Mu50
gaauauuugcuuuuuguguaucu

SEQ ID NO: 2051420 - RNA, 23 nt, Staphylococcus aureus subsp. aureus Mu50
gaauauuucccuaugaaauaacu

SEQ ID NO: 2051421 - RNA, 17 nt, Staphylococcus aureus subsp. aureus Mu50
gaauacuuuauuugaua

SEQ ID NO: 2051422 - RNA, 19 nt, Staphylococcus aureus subsp. aureus Mu50
gaauauacuuaauuuaaau

SEQ ID NO: 2051423 - RNA, 14 nt, Staphylococcus aureus subsp. aureus Mu50
gaauauaauaacaa

SEQ ID NO: 2051424 - RNA, 22 nt, Staphylococcus aureus subsp. aureus Mu50
gaauauaaguaaucauaauaau

SEQ ID NO: 2051425 - RNA, 23 nt, Staphylococcus aureus subsp. aureus Mu50
gaauauaacaacuacuuaaauua

SEQ ID NO: 2051426 - RNA, 23 nt, Staphylococcus aureus subsp. aureus Mu50
gaauagugagcguauuauuauug

SEQ ID NO: 2051427 - RNA, 21 nt, Staphylococcus aureus subsp. aureus Mu50
cuuaaaauuuaaauauugaag

SEQ ID NO: 2051428 - RNA, 15 nt, Staphylococcus aureus subsp. aureus Mu50
cuuaaaauuuaaaua

SEQ ID NO: 2051429 - RNA, 22 nt, Staphylococcus aureus subsp. aureus Mu50
cuuaaaagacauccacagaauu

SEQ ID NO: 2051430 - RNA, 17 nt, Staphylococcus aureus subsp. aureus Mu50
cuuaaaagacauccaca

SEQ ID NO: 2051431 - RNA, 20 nt, Staphylococcus aureus subsp. aureus Mu50
cuuaaaagacauccacagaa

SEQ ID NO: 2051432 - RNA, 12 nt, Staphylococcus aureus subsp. aureus Mu50
cuuaaaaacaau

SEQ ID NO: 2051433 - RNA, 11 nt, Staphylococcus aureus subsp. aureus Mu50
cuuaaaaacaa

SEQ ID NO: 2051434 - RNA, 13 nt, Staphylococcus aureus subsp. aureus Mu50
cuguuuuuuuaug

SEQ ID NO: 2051435 - RNA, 18 nt, Staphylococcus aureus subsp. aureus Mu50
cuguuuuaucuacaguuu

SEQ ID NO: 2051436 - RNA, 19 nt, Staphylococcus aureus subsp. aureus Mu50
cuguuuugcgguuuuuuug

SEQ ID NO: 2051437 - RNA, 21 nt, Staphylococcus aureus subsp. aureus Mu50
cuguucuuucgucuuguaaac

SEQ ID NO: 2051438 - RNA, 16 nt, Staphylococcus aureus subsp. aureus Mu50
cugucucauuaaugua

SEQ ID NO: 2051439 - RNA, 19 nt, Staphylococcus aureus subsp. aureus Mu50
cugucucaucuucuaaauc

SEQ ID NO: 2051440 - RNA, 16 nt, Staphylococcus aureus subsp. aureus Mu50
cugucuaaaaacauaa

SEQ ID NO: 2051441 - RNA, 21 nt, Staphylococcus aureus subsp. aureus Mu50
cuguuggaauaccuuuuucua

SEQ ID NO: 2051442 - RNA, 16 nt, Staphylococcus aureus subsp. aureus Mu50
cuguuggcaaaacaau

SEQ ID NO: 2051443 - RNA, 17 nt, Staphylococcus aureus subsp. aureus Mu50
cuuacagacaaacauua

SEQ ID NO: 2051444 - RNA, 23 nt, Staphylococcus aureus subsp. aureus Mu50
cuuacaauagugugcaaguuggc

SEQ ID NO: 2051445 - RNA, 14 nt, Staphylococcus aureus subsp. aureus Mu50
cuuacaauaaucac

SEQ ID NO: 2051446 - RNA, 15 nt, Staphylococcus aureus subsp. aureus Mu50
cuuaauuuguuuuaa

SEQ ID NO: 2051447 - RNA, 23 nt, Staphylococcus aureus subsp. aureus Mu50
cuuaauuuaaaucuguacuucua

SEQ ID NO: 2051448 - RNA, 14 nt, Staphylococcus aureus subsp. aureus Mu50
cuuacaaauauacu

SEQ ID NO: 2051449 - RNA, 20 nt, Staphylococcus aureus subsp. aureus Mu50
cuuaauuuugcaacauuaaa

SEQ ID NO: 2051450 - RNA, 23 nt, Staphylococcus aureus subsp. aureus Mu50
cuuaauuuugcaacauuaaauua

SEQ ID NO: 2051451 - RNA, 19 nt, Staphylococcus aureus subsp. aureus Mu50
cuuaccuuuauguucaaau

SEQ ID NO: 2051452 - RNA, 17 nt, Staphylococcus aureus subsp. aureus Mu50
cuuaccuacuuuuuugg

SEQ ID NO: 2051453 - RNA, 18 nt, Staphylococcus aureus subsp. aureus Mu50
cuuaccuuucaaauauau

SEQ ID NO: 2051454 - RNA, 16 nt, Staphylococcus aureus subsp. aureus Mu50
cuuaaagaauuaagua

SEQ ID NO: 2051455 - RNA, 23 nt, Staphylococcus aureus subsp. aureus Mu50
cuuaaauacaaacccuuuaaaca

SEQ ID NO: 2051456 - RNA, 22 nt, Staphylococcus aureus subsp. aureus Mu50
cuuaaauacaauuucuucauuu

SEQ ID NO: 2051457 - RNA, 21 nt, Staphylococcus aureus subsp. aureus Mu50
cuuaaauaucgacaaauuaaa

SEQ ID NO: 2051458 - RNA, 18 nt, Staphylococcus aureus subsp. aureus Mu50
cuuaauaucauauucaaa

SEQ ID NO: 2051459 - RNA, 19 nt, Staphylococcus aureus subsp. aureus Mu50
cuuaauuaauaauuuaacu

SEQ ID NO: 2051460 - RNA, 12 nt, Staphylococcus aureus subsp. aureus Mu50
cuuaauucuuca

SEQ ID NO: 2051461 - RNA, 18 nt, Staphylococcus aureus subsp. aureus Mu50
cuuaauucuucaucaaua

SEQ ID NO: 2051462 - RNA, 14 nt, Staphylococcus aureus subsp. aureus Mu50
cuuaauuaauaauu

SEQ ID NO: 2051463 - RNA, 20 nt, Staphylococcus aureus subsp. aureus Mu50
cuuaucaguuugcacuucaa

SEQ ID NO: 2051464 - RNA, 14 nt, Staphylococcus aureus subsp. aureus Mu50
cuuaucauuacuug

SEQ ID NO: 2051465 - RNA, 22 nt, Staphylococcus aureus subsp. aureus Mu50
cuuaucaaaaccgcuauaaaau

SEQ ID NO: 2051466 - RNA, 18 nt, Staphylococcus aureus subsp. aureus Mu50
cuuaucaacagcuucaaa

SEQ ID NO: 2051467 - RNA, 14 nt, Staphylococcus aureus subsp. aureus Mu50
cuuaucaacaacaa

SEQ ID NO: 2051468 - RNA, 21 nt, Staphylococcus aureus subsp. aureus Mu50
cuuauaaguucaaccauauga

SEQ ID NO: 2051469 - RNA, 22 nt, Staphylococcus aureus subsp. aureus Mu50
cuuagcacuuggauuuuaauua

SEQ ID NO: 2051470 - RNA, 23 nt, Staphylococcus aureus subsp. aureus Mu50
cuuagcacuuggauuuuaauuau

SEQ ID NO: 2051471 - RNA, 15 nt, Staphylococcus aureus subsp. aureus Mu50
cuuacuacuuaauua

SEQ ID NO: 2051472 - RNA, 16 nt, Staphylococcus aureus subsp. aureus Mu50
cuuacuacuuaauuaa

SEQ ID NO: 2051473 - RNA, 16 nt, Staphylococcus aureus subsp. aureus Mu50
cuuacugcaauuauuu

SEQ ID NO: 2051474 - RNA, 13 nt, Staphylococcus aureus subsp. aureus Mu50
cuuacugaaacua

SEQ ID NO: 2051475 - RNA, 16 nt, Staphylococcus aureus subsp. aureus Mu50
cuuacugaaacuaaau

SEQ ID NO: 2051476 - RNA, 19 nt, Staphylococcus aureus subsp. aureus Mu50
cuuagauaaauuaauauga

SEQ ID NO: 2051477 - RNA, 14 nt, Staphylococcus aureus subsp. aureus Mu50
cuuagauaaauuaa

SEQ ID NO: 2051478 - RNA, 21 nt, Staphylococcus aureus subsp. aureus Mu50
cuuagauuuucacuaauauuu

SEQ ID NO: 2051479 - RNA, 14 nt, Staphylococcus aureus subsp. aureus Mu50
cuucacauuuaucc

SEQ ID NO: 2051480 - RNA, 22 nt, Staphylococcus aureus subsp. aureus Mu50
cuuauuauuuuguauuuuucaa

SEQ ID NO: 2051481 - RNA, 12 nt, Staphylococcus aureus subsp. aureus Mu50
cuuauuauuuau

SEQ ID NO: 2051482 - RNA, 20 nt, Staphylococcus aureus subsp. aureus Mu50
cuuauuauuuuguauuuuuc

SEQ ID NO: 2051483 - RNA, 20 nt, Staphylococcus aureus subsp. aureus Mu50
cuuauuaaauaagaugaaau

SEQ ID NO: 2051484 - RNA, 11 nt, Staphylococcus aureus subsp. aureus Mu50
cuuauuaacuu

SEQ ID NO: 2051485 - RNA, 15 nt, Staphylococcus aureus subsp. aureus Mu50
cuucacuaaaaauau

SEQ ID NO: 2051486 - RNA, 17 nt, Staphylococcus aureus subsp. aureus Mu50
cuucacuaaaaauauau

SEQ ID NO: 2051487 - RNA, 20 nt, Staphylococcus aureus subsp. aureus Mu50
cuucauaaucguauucauau

SEQ ID NO: 2051488 - RNA, 22 nt, Staphylococcus aureus subsp. aureus Mu50
cuucauaguucaaauugaacuu

SEQ ID NO: 2051489 - RNA, 17 nt, Staphylococcus aureus subsp. aureus Mu50
cuucauauccuucauua

SEQ ID NO: 2051490 - RNA, 19 nt, Staphylococcus aureus subsp. aureus Mu50
cuucaguaauuucuccaag

SEQ ID NO: 2051491 - RNA, 20 nt, Staphylococcus aureus subsp. aureus Mu50
cuucaguacgguuauuuaau

SEQ ID NO: 2051492 - RNA, 16 nt, Staphylococcus aureus subsp. aureus Mu50
cuucaguuaaaucuuu

SEQ ID NO: 2051493 - RNA, 21 nt, Staphylococcus aureus subsp. aureus Mu50
cuucaguuaaaucuuuaacuu

SEQ ID NO: 2051494 - RNA, 21 nt, Staphylococcus aureus subsp. aureus Mu50
cuucgccaagccaucuuucuu

SEQ ID NO: 2051495 - RNA, 18 nt, Staphylococcus aureus subsp. aureus Mu50
cuucgccaagccaucuuu

SEQ ID NO: 2051496 - RNA, 19 nt, Staphylococcus aureus subsp. aureus Mu50
cuuccauucggauaaauaa

SEQ ID NO: 2051497 - RNA, 21 nt, Staphylococcus aureus subsp. aureus Mu50
cuuccauuaaggauaguucuu

SEQ ID NO: 2051498 - RNA, 14 nt, Staphylococcus aureus subsp. aureus Mu50
cuuccgcacugccu

SEQ ID NO: 2051499 - RNA, 16 nt, Staphylococcus aureus subsp. aureus Mu50
cuuccaucacaucaua

SEQ ID NO: 2051500 - RNA, 18 nt, Staphylococcus aureus subsp. aureus Mu50
cuucauuuauaacauuua

SEQ ID NO: 2051501 - RNA, 15 nt, Staphylococcus aureus subsp. aureus Mu50
cuucauugaugaugu

SEQ ID NO: 2051502 - RNA, 21 nt, Staphylococcus aureus subsp. aureus Mu50
cuucauuaguugcauaaucaa

SEQ ID NO: 2051503 - RNA, 23 nt, Staphylococcus aureus subsp. aureus Mu50
cuucauuauauaauucuucaaau

SEQ ID NO: 2051504 - RNA, 20 nt, Staphylococcus aureus subsp. aureus Mu50
cuucauuaucaauagaugaa

SEQ ID NO: 2051505 - RNA, 15 nt, Staphylococcus aureus subsp. aureus Mu50
cuuucauuguaaauu

SEQ ID NO: 2051506 - RNA, 11 nt, Staphylococcus aureus subsp. aureus Mu50
cuuucugaaga

SEQ ID NO: 2051507 - RNA, 18 nt, Staphylococcus aureus subsp. aureus Mu50
cuuucucaucuauuuaau

SEQ ID NO: 2051508 - RNA, 14 nt, Staphylococcus aureus subsp. aureus Mu50
cuuuauauauaaag

SEQ ID NO: 2051509 - RNA, 12 nt, Staphylococcus aureus subsp. aureus Mu50
cuuuauaugaag

SEQ ID NO: 2051510 - RNA, 18 nt, Staphylococcus aureus subsp. aureus Mu50
cuuuaaucauagcauuaa

SEQ ID NO: 2051511 - RNA, 19 nt, Staphylococcus aureus subsp. aureus Mu50
cuuuaauauaauuauuaaa

SEQ ID NO: 2051512 - RNA, 19 nt, Staphylococcus aureus subsp. aureus Mu50
cuuuaauagcgucaaguuu

SEQ ID NO: 2051513 - RNA, 16 nt, Staphylococcus aureus subsp. aureus Mu50
cuuuauuauuuaaucu

SEQ ID NO: 2051514 - RNA, 15 nt, Staphylococcus aureus subsp. aureus Mu50
cuuuauuacuuuaau

SEQ ID NO: 2051515 - RNA, 21 nt, Staphylococcus aureus subsp. aureus Mu50
cuuuaugugcaucauuuauau

SEQ ID NO: 2051516 - RNA, 16 nt, Staphylococcus aureus subsp. aureus Mu50
cuuucaccauuuacuu

SEQ ID NO: 2051517 - RNA, 21 nt, Staphylococcus aureus subsp. aureus Mu50
cuuucaggcuuuguuuuucac

SEQ ID NO: 2051518 - RNA, 19 nt, Staphylococcus aureus subsp. aureus Mu50
cuuguacacauccucauaa

SEQ ID NO: 2051519 - RNA, 18 nt, Staphylococcus aureus subsp. aureus Mu50
cuuguaauauaacaagua

SEQ ID NO: 2051520 - RNA, 21 nt, Staphylococcus aureus subsp. aureus Mu50
cuugucaguuuuuuuauaagc

SEQ ID NO: 2051521 - RNA, 15 nt, Staphylococcus aureus subsp. aureus Mu50
cuugucaguuuuuuu

SEQ ID NO: 2051522 - RNA, 16 nt, Staphylococcus aureus subsp. aureus Mu50
cuuguacgauaacuac

SEQ ID NO: 2051523 - RNA, 16 nt, Staphylococcus aureus subsp. aureus Mu50
cuuguaaacuucuuuu

SEQ ID NO: 2051524 - RNA, 21 nt, Staphylococcus aureus subsp. aureus Mu50
cuuguaacaagcauuuuucaa

SEQ ID NO: 2051525 - RNA, 22 nt, Staphylococcus aureus subsp. aureus Mu50
cuuguaacaagcuuuucauuuu

SEQ ID NO: 2051526 - RNA, 16 nt, Staphylococcus aureus subsp. aureus Mu50
cuuggacuaauaauug

SEQ ID NO: 2051527 - RNA, 17 nt, Staphylococcus aureus subsp. aureus Mu50
cuuguccucuaaaacau

SEQ ID NO: 2051528 - RNA, 23 nt, Staphylococcus aureus subsp. aureus Mu50
cuuguuacacaugaguuaaacga

SEQ ID NO: 2051529 - RNA, 13 nt, Staphylococcus aureus subsp. aureus Mu50
cuuguuaaaauaa

SEQ ID NO: 2051530 - RNA, 20 nt, Staphylococcus aureus subsp. aureus Mu50
cuuguugaacucugauauug

SEQ ID NO: 2051531 - RNA, 13 nt, Staphylococcus aureus subsp. aureus Mu50
cuuguucuuuacu

SEQ ID NO: 2051532 - RNA, 19 nt, Staphylococcus aureus subsp. aureus Mu50
cuuguucuccgaucaugcc

SEQ ID NO: 2051533 - RNA, 22 nt, Staphylococcus aureus subsp. aureus Mu50
cuuguucgauaaucguuaaaac

SEQ ID NO: 2051534 - RNA, 15 nt, Staphylococcus aureus subsp. aureus Mu50
cuuguucuaaaauaa

SEQ ID NO: 2051535 - RNA, 18 nt, Staphylococcus aureus subsp. aureus Mu50
cuuguuggcuuuuuuaau

SEQ ID NO: 2051536 - RNA, 18 nt, Staphylococcus aureus subsp. aureus Mu50
cuuguuuagggaauccca

SEQ ID NO: 2051537 - RNA, 12 nt, Staphylococcus aureus subsp. aureus Mu50
cuuguuuuaaau

SEQ ID NO: 2051538 - RNA, 13 nt, Staphylococcus aureus subsp. aureus Mu50
cuuuaaacauauu

SEQ ID NO: 2051539 - RNA, 17 nt, Staphylococcus aureus subsp. aureus Mu50
cuuuaaacucguaaauu

SEQ ID NO: 2051540 - RNA, 20 nt, Staphylococcus aureus subsp. aureus Mu50
cuuuaaacucguaaauuuua

SEQ ID NO: 2051541 - RNA, 17 nt, Staphylococcus aureus subsp. aureus Mu50
cuuuaaaaauuaaguaa

SEQ ID NO: 2051542 - RNA, 11 nt, Staphylococcus aureus subsp. aureus Mu50
cuuuaaaucuu

SEQ ID NO: 2051543 - RNA, 21 nt, Staphylococcus aureus subsp. aureus Mu50
cuuuaaaucuuguucuaauug

SEQ ID NO: 2051544 - RNA, 14 nt, Staphylococcus aureus subsp. aureus Mu50
cuuuaaauuauaua

SEQ ID NO: 2051545 - RNA, 20 nt, Staphylococcus aureus subsp. aureus Mu50
cuuuaacaguuguaaucauu

SEQ ID NO: 2051546 - RNA, 12 nt, Staphylococcus aureus subsp. aureus Mu50
cuuuaauacuac

SEQ ID NO: 2051547 - RNA, 21 nt, Staphylococcus aureus subsp. aureus Mu50
cuuuaauacuaccguuuuuau

SEQ ID NO: 2051548 - RNA, 15 nt, Staphylococcus aureus subsp. aureus Mu50
cuuuaauaaccuuua

SEQ ID NO: 2051549 - RNA, 22 nt, Staphylococcus aureus subsp. aureus Mu50
cuuuaauaaccuuuaaaacauc

SEQ ID NO: 2051550 - RNA, 20 nt, Staphylococcus aureus subsp. aureus Mu50
cuugccuucaaauucucaau

SEQ ID NO: 2051551 - RNA, 14 nt, Staphylococcus aureus subsp. aureus Mu50
cuugccuucaaauu

SEQ ID NO: 2051552 - RNA, 17 nt, Staphylococcus aureus subsp. aureus Mu50
cuugaaccccauucacu

SEQ ID NO: 2051553 - RNA, 14 nt, Staphylococcus aureus subsp. aureus Mu50
cuugagcaucuuuu

SEQ ID NO: 2051554 - RNA, 14 nt, Staphylococcus aureus subsp. aureus Mu50
cuugagcaucacuc

SEQ ID NO: 2051555 - RNA, 15 nt, Staphylococcus aureus subsp. aureus Mu50
cuugagcuauucaua

SEQ ID NO: 2051556 - RNA, 19 nt, Staphylococcus aureus subsp. aureus Mu50
cuugagcuguuacacuuuu

SEQ ID NO: 2051557 - RNA, 21 nt, Staphylococcus aureus subsp. aureus Mu50
cuucuuuaaaggaaauggcuc

SEQ ID NO: 2051558 - RNA, 17 nt, Staphylococcus aureus subsp. aureus Mu50
cuucuuuuuuguaucuc

SEQ ID NO: 2051559 - RNA, 16 nt, Staphylococcus aureus subsp. aureus Mu50
cuucuuuuuuuaacuu

SEQ ID NO: 2051560 - RNA, 22 nt, Staphylococcus aureus subsp. aureus Mu50
cuugaaacaucuugauauucau

SEQ ID NO: 2051561 - RNA, 22 nt, Staphylococcus aureus subsp. aureus Mu50
cuugauggugguaccacauaca

SEQ ID NO: 2051562 - RNA, 12 nt, Staphylococcus aureus subsp. aureus Mu50
cuugauucuuau

SEQ ID NO: 2051563 - RNA, 14 nt, Staphylococcus aureus subsp. aureus Mu50
cuugcacaccagug

SEQ ID NO: 2051564 - RNA, 14 nt, Staphylococcus aureus subsp. aureus Mu50
cuugauaaaaaaug

SEQ ID NO: 2051565 - RNA, 15 nt, Staphylococcus aureus subsp. aureus Mu50
cuugauaaaauaaau

SEQ ID NO: 2051566 - RNA, 13 nt, Staphylococcus aureus subsp. aureus Mu50
cuugauaaaaaau

SEQ ID NO: 2051567 - RNA, 12 nt, Staphylococcus aureus subsp. aureus Mu50
cuucucuaucag

SEQ ID NO: 2051568 - RNA, 18 nt, Staphylococcus aureus subsp. aureus Mu50
cuucucccuuaaauacaa

SEQ ID NO: 2051569 - RNA, 17 nt, Staphylococcus aureus subsp. aureus Mu50
cuucugcuacuuguugu

SEQ ID NO: 2051570 - RNA, 21 nt, Staphylococcus aureus subsp. aureus Mu50
cuucuggagccccuuguucuc

SEQ ID NO: 2051571 - RNA, 15 nt, Staphylococcus aureus subsp. aureus Mu50
cuucuuguuucaaac

SEQ ID NO: 2051572 - RNA, 22 nt, Staphylococcus aureus subsp. aureus Mu50
cuucuugagguuuugguucuga

SEQ ID NO: 2051573 - RNA, 17 nt, Staphylococcus aureus subsp. aureus Mu50
cuucuucucuaaucacu

SEQ ID NO: 2051574 - RNA, 24 nt, Staphylococcus aureus subsp. aureus Mu50
cuucuuaaaucaacaucaucuuua

SEQ ID NO: 2051575 - RNA, 20 nt, Staphylococcus aureus subsp. aureus Mu50
cuucuuaacuugaaauguug

SEQ ID NO: 2051576 - RNA, 21 nt, Staphylococcus aureus subsp. aureus Mu50
cuucuuaaaauaugauuuaaa

SEQ ID NO: 2051577 - RNA, 22 nt, Staphylococcus aureus subsp. aureus Mu50
cuucuucaggaauaucuuucaa

SEQ ID NO: 2051578 - RNA, 18 nt, Staphylococcus aureus subsp. aureus Mu50
cuggaauauuaacaccag

SEQ ID NO: 2051579 - RNA, 14 nt, Staphylococcus aureus subsp. aureus Mu50
cuggaauaccuaac

SEQ ID NO: 2051580 - RNA, 18 nt, Staphylococcus aureus subsp. aureus Mu50
cuggaacuuuaauaccag

SEQ ID NO: 2051581 - RNA, 14 nt, Staphylococcus aureus subsp. aureus Mu50
cuggaauugggaaa

SEQ ID NO: 2051582 - RNA, 19 nt, Staphylococcus aureus subsp. aureus Mu50
cuggaauugggaaauauuu

SEQ ID NO: 2051583 - RNA, 21 nt, Staphylococcus aureus subsp. aureus Mu50
cugcuucuucagguguuuuac

SEQ ID NO: 2051584 - RNA, 20 nt, Staphylococcus aureus subsp. aureus Mu50
cugcuaauuuuuucaucauu

SEQ ID NO: 2051585 - RNA, 19 nt, Staphylococcus aureus subsp. aureus Mu50
cugcuuuuaauaucuucua

SEQ ID NO: 2051586 - RNA, 16 nt, Staphylococcus aureus subsp. aureus Mu50
cugcuuuauuuuauca

SEQ ID NO: 2051587 - RNA, 21 nt, Staphylococcus aureus subsp. aureus Mu50
cugcuuuauuuuaucaucuau

SEQ ID NO: 2051588 - RNA, 15 nt, Staphylococcus aureus subsp. aureus Mu50
cugucgcucauccuc

SEQ ID NO: 2051589 - RNA, 18 nt, Staphylococcus aureus subsp. aureus Mu50
cuguauaaccauaaugaa

SEQ ID NO: 2051590 - RNA, 21 nt, Staphylococcus aureus subsp. aureus Mu50
cuguauucgguuaauauucuu

SEQ ID NO: 2051591 - RNA, 14 nt, Staphylococcus aureus subsp. aureus Mu50
cuguauuuaauaaa

SEQ ID NO: 2051592 - RNA, 12 nt, Staphylococcus aureus subsp. aureus Mu50
cuguauuuacua

SEQ ID NO: 2051593 - RNA, 13 nt, Staphylococcus aureus subsp. aureus Mu50
cuguaaaacauuc

SEQ ID NO: 2051594 - RNA, 20 nt, Staphylococcus aureus subsp. aureus Mu50
cuguaacaaagucucuagua

SEQ ID NO: 2051595 - RNA, 17 nt, Staphylococcus aureus subsp. aureus Mu50
cuguaaauuaucuaaag

SEQ ID NO: 2051596 - RNA, 18 nt, Staphylococcus aureus subsp. aureus Mu50
cuguacgauucaauuuaa

SEQ ID NO: 2051597 - RNA, 12 nt, Staphylococcus aureus subsp. aureus Mu50
cuguaccugcua

SEQ ID NO: 2051598 - RNA, 20 nt, Staphylococcus aureus subsp. aureus Mu50
cuguaccguauuuuaauauu

SEQ ID NO: 2051599 - RNA, 21 nt, Staphylococcus aureus subsp. aureus Mu50
cuguaccaucacuaaaguaaa

SEQ ID NO: 2051600 - RNA, 15 nt, Staphylococcus aureus subsp. aureus Mu50
cuggggaagaccauu

SEQ ID NO: 2051601 - RNA, 22 nt, Staphylococcus aureus subsp. aureus Mu50
cuggugcaggcaucauaucaua

SEQ ID NO: 2051602 - RNA, 15 nt, Staphylococcus aureus subsp. aureus Mu50
cugccauauagauau

SEQ ID NO: 2051603 - RNA, 19 nt, Staphylococcus aureus subsp. aureus Mu50
cugccauaaacauggucaa

SEQ ID NO: 2051604 - RNA, 14 nt, Staphylococcus aureus subsp. aureus Mu50
cugaucguaacauu

SEQ ID NO: 2051605 - RNA, 15 nt, Staphylococcus aureus subsp. aureus Mu50
cugaucguaacauua

SEQ ID NO: 2051606 - RNA, 16 nt, Staphylococcus aureus subsp. aureus Mu50
cugauuaauuauugag

SEQ ID NO: 2051607 - RNA, 23 nt, Staphylococcus aureus subsp. aureus Mu50
cugauugcugcuguacaauuucg

SEQ ID NO: 2051608 - RNA, 19 nt, Staphylococcus aureus subsp. aureus Mu50
cugauugggcugauaauaa

SEQ ID NO: 2051609 - RNA, 22 nt, Staphylococcus aureus subsp. aureus Mu50
cugcaagucguucucuuaaaua

SEQ ID NO: 2051610 - RNA, 21 nt, Staphylococcus aureus subsp. aureus Mu50
cugcaaacuugauucaauaua

SEQ ID NO: 2051611 - RNA, 23 nt, Staphylococcus aureus subsp. aureus Mu50
cugcaaacacaguacaaauaaca

SEQ ID NO: 2051612 - RNA, 19 nt, Staphylococcus aureus subsp. aureus Mu50
cugcaaacacaguacaaau

SEQ ID NO: 2051613 - RNA, 21 nt, Staphylococcus aureus subsp. aureus Mu50
cugcaaacacaguacaaauaa

SEQ ID NO: 2051614 - RNA, 16 nt, Staphylococcus aureus subsp. aureus Mu50
cugcaaacacaguaca

SEQ ID NO: 2051615 - RNA, 22 nt, Staphylococcus aureus subsp. aureus Mu50
cugcaaaauguuacacaaauua

SEQ ID NO: 2051616 - RNA, 19 nt, Staphylococcus aureus subsp. aureus Mu50
cugcaaaauguuacacaaa

SEQ ID NO: 2051617 - RNA, 16 nt, Staphylococcus aureus subsp. aureus Mu50
cugcaaucguugaaaa

SEQ ID NO: 2051618 - RNA, 16 nt, Staphylococcus aureus subsp. aureus Mu50
cugcacuuaugauacu

SEQ ID NO: 2051619 - RNA, 18 nt, Staphylococcus aureus subsp. aureus Mu50
cugagcuuuaauuuuuug

SEQ ID NO: 2051620 - RNA, 20 nt, Staphylococcus aureus subsp. aureus Mu50
cucuauuuuaugauuugauu

SEQ ID NO: 2051621 - RNA, 17 nt, Staphylococcus aureus subsp. aureus Mu50
cucuaucaguccgcuuu

SEQ ID NO: 2051622 - RNA, 19 nt, Staphylococcus aureus subsp. aureus Mu50
cucuaucaaauuaccauuc

SEQ ID NO: 2051623 - RNA, 17 nt, Staphylococcus aureus subsp. aureus Mu50
cucuauuuauaacacuu

SEQ ID NO: 2051624 - RNA, 22 nt, Staphylococcus aureus subsp. aureus Mu50
cugauauugaucugauuucacu

SEQ ID NO: 2051625 - RNA, 21 nt, Staphylococcus aureus subsp. aureus Mu50
cugaucauuuucauuuaaucc

SEQ ID NO: 2051626 - RNA, 17 nt, Staphylococcus aureus subsp. aureus Mu50
cugauacagaaccaaca

SEQ ID NO: 2051627 - RNA, 15 nt, Staphylococcus aureus subsp. aureus Mu50
cugauaauuuuucuu

SEQ ID NO: 2051628 - RNA, 22 nt, Staphylococcus aureus subsp. aureus Mu50
cugauacagaaccaacaauaaa

SEQ ID NO: 2051629 - RNA, 18 nt, Staphylococcus aureus subsp. aureus Mu50
cugauaauacuguuuaaa

SEQ ID NO: 2051630 - RNA, 22 nt, Staphylococcus aureus subsp. aureus Mu50
cugauaauacuguuuaaauaaa

SEQ ID NO: 2051631 - RNA, 18 nt, Staphylococcus aureus subsp. aureus Mu50
cuagcggaacguaaguuu

SEQ ID NO: 2051632 - RNA, 23 nt, Staphylococcus aureus subsp. aureus Mu50
cuauaaauacgucaucuuuauuu

SEQ ID NO: 2051633 - RNA, 16 nt, Staphylococcus aureus subsp. aureus Mu50
cuauaaauacaaauau

SEQ ID NO: 2051634 - RNA, 16 nt, Staphylococcus aureus subsp. aureus Mu50
cuauaacaccaauuaa

SEQ ID NO: 2051635 - RNA, 19 nt, Staphylococcus aureus subsp. aureus Mu50
cuauaaaaguacuuuaaaa

SEQ ID NO: 2051636 - RNA, 23 nt, Staphylococcus aureus subsp. aureus Mu50
cuauaaaaguacuuuaaaauugu

SEQ ID NO: 2051637 - RNA, 23 nt, Staphylococcus aureus subsp. aureus Mu50
cuauaaaaucaucguauuucaua

SEQ ID NO: 2051638 - RNA, 15 nt, Staphylococcus aureus subsp. aureus Mu50
cuauaaaauuuugaa

SEQ ID NO: 2051639 - RNA, 11 nt, Staphylococcus aureus subsp. aureus Mu50
cuauagaaaaa

SEQ ID NO: 2051640 - RNA, 18 nt, Staphylococcus aureus subsp. aureus Mu50
cuauacugaugaaaacuu

SEQ ID NO: 2051641 - RNA, 14 nt, Staphylococcus aureus subsp. aureus Mu50
cuauagaaaaagua

SEQ ID NO: 2051642 - RNA, 16 nt, Staphylococcus aureus subsp. aureus Mu50
cuauagaauuuuucau

SEQ ID NO: 2051643 - RNA, 22 nt, Staphylococcus aureus subsp. aureus Mu50
cuauacaauuauggauaaaauu

SEQ ID NO: 2051644 - RNA, 17 nt, Staphylococcus aureus subsp. aureus Mu50
cuauaccauuccaaaaa

SEQ ID NO: 2051645 - RNA, 13 nt, Staphylococcus aureus subsp. aureus Mu50
cuauaauaauuaa

SEQ ID NO: 2051646 - RNA, 20 nt, Staphylococcus aureus subsp. aureus Mu50
cuauaauuggcagauagaau

SEQ ID NO: 2051647 - RNA, 15 nt, Staphylococcus aureus subsp. aureus Mu50
cuauaauucacuuua

SEQ ID NO: 2051648 - RNA, 21 nt, Staphylococcus aureus subsp. aureus Mu50
cuaugauauauguaacauaaa

SEQ ID NO: 2051649 - RNA, 23 nt, Staphylococcus aureus subsp. aureus Mu50
cuaugaauuuagcaucaaaaaua

SEQ ID NO: 2051650 - RNA, 23 nt, Staphylococcus aureus subsp. aureus Mu50
cuaugcuuagcgaacgcuagcau

SEQ ID NO: 2051651 - RNA, 16 nt, Staphylococcus aureus subsp. aureus Mu50
cuauggcacaaaugaa

SEQ ID NO: 2051652 - RNA, 23 nt, Staphylococcus aureus subsp. aureus Mu50
cuauggcgcaauuuuuaacaaaa

SEQ ID NO: 2051653 - RNA, 15 nt, Staphylococcus aureus subsp. aureus Mu50
cuaucgauacuaaac

SEQ ID NO: 2051654 - RNA, 17 nt, Staphylococcus aureus subsp. aureus Mu50
cuaucgccuaaaaauaa

SEQ ID NO: 2051655 - RNA, 20 nt, Staphylococcus aureus subsp. aureus Mu50
cuaucucuuuaguuaaaagu

SEQ ID NO: 2051656 - RNA, 21 nt, Staphylococcus aureus subsp. aureus Mu50
cuaucuguaccguauuuuaau

SEQ ID NO: 2051657 - RNA, 22 nt, Staphylococcus aureus subsp. aureus Mu50
cuaucuccgcuacaauuauaug

SEQ ID NO: 2051658 - RNA, 18 nt, Staphylococcus aureus subsp. aureus Mu50
cuaucgccuaaaaauaaa

SEQ ID NO: 2051659 - RNA, 21 nt, Staphylococcus aureus subsp. aureus Mu50
cuaucgccuaaaaauaaaauc

SEQ ID NO: 2051660 - RNA, 14 nt, Staphylococcus aureus subsp. aureus Mu50
cuaucucuuuaguu

SEQ ID NO: 2051661 - RNA, 13 nt, Staphylococcus aureus subsp. aureus Mu50
cuauauaaaguug

SEQ ID NO: 2051662 - RNA, 14 nt, Staphylococcus aureus subsp. aureus Mu50
cuauauaaaguuga

SEQ ID NO: 2051663 - RNA, 20 nt, Staphylococcus aureus subsp. aureus Mu50
cuauauaugaauugaguauu

SEQ ID NO: 2051664 - RNA, 19 nt, Staphylococcus aureus subsp. aureus Mu50
cuauauaugaauugaguau

SEQ ID NO: 2051665 - RNA, 13 nt, Staphylococcus aureus subsp. aureus Mu50
cuauaugaaaaga

SEQ ID NO: 2051666 - RNA, 18 nt, Staphylococcus aureus subsp. aureus Mu50
cuagccuucaauauuucu

SEQ ID NO: 2051667 - RNA, 19 nt, Staphylococcus aureus subsp. aureus Mu50
cuagccuucaauauuucuu

SEQ ID NO: 2051668 - RNA, 22 nt, Staphylococcus aureus subsp. aureus Mu50
cuagcauguuuugagcaauaau

SEQ ID NO: 2051669 - RNA, 17 nt, Staphylococcus aureus subsp. aureus Mu50
cuagcauaucuuuauca

SEQ ID NO: 2051670 - RNA, 19 nt, Staphylococcus aureus subsp. aureus Mu50
cuagcaagaauagauugau

SEQ ID NO: 2051671 - RNA, 17 nt, Staphylococcus aureus subsp. aureus Mu50
cuagauaccaaacugcc

SEQ ID NO: 2051672 - RNA, 18 nt, Staphylococcus aureus subsp. aureus Mu50
cuagaaagaccauuguau

SEQ ID NO: 2051673 - RNA, 14 nt, Staphylococcus aureus subsp. aureus Mu50
cuagaaaguaaugc

SEQ ID NO: 2051674 - RNA, 21 nt, Staphylococcus aureus subsp. aureus Mu50
cuagaaaguaaugcuguacua

SEQ ID NO: 2051675 - RNA, 17 nt, Staphylococcus aureus subsp. aureus Mu50
cuagagauaacuagaau

SEQ ID NO: 2051676 - RNA, 19 nt, Staphylococcus aureus subsp. aureus Mu50
cuagagcguuuugcuuuag

SEQ ID NO: 2051677 - RNA, 16 nt, Staphylococcus aureus subsp. aureus Mu50
cuacuauuuaaucuua

SEQ ID NO: 2051678 - RNA, 21 nt, Staphylococcus aureus subsp. aureus Mu50
cuacuaaucuuuuuuuaauua

SEQ ID NO: 2051679 - RNA, 23 nt, Staphylococcus aureus subsp. aureus Mu50
cuaauacuucaccacauaaaaau

SEQ ID NO: 2051680 - RNA, 14 nt, Staphylococcus aureus subsp. aureus Mu50
cuaauagcauuugu

SEQ ID NO: 2051681 - RNA, 15 nt, Staphylococcus aureus subsp. aureus Mu50
cuaauagcauuugua

SEQ ID NO: 2051682 - RNA, 22 nt, Staphylococcus aureus subsp. aureus Mu50
cuaauacuuucacuuuuuauau

SEQ ID NO: 2051683 - RNA, 22 nt, Staphylococcus aureus subsp. aureus Mu50
cuaauacauacggcaaauucaa

SEQ ID NO: 2051684 - RNA, 22 nt, Staphylococcus aureus subsp. aureus Mu50
cuaauacacuugauaaaacuaa

SEQ ID NO: 2051685 - RNA, 15 nt, Staphylococcus aureus subsp. aureus Mu50
cuaccuguuggcuuu

SEQ ID NO: 2051686 - RNA, 13 nt, Staphylococcus aureus subsp. aureus Mu50
cuaccuuccauuu

SEQ ID NO: 2051687 - RNA, 23 nt, Staphylococcus aureus subsp. aureus Mu50
cuacgauuuucaagaccaaauau

SEQ ID NO: 2051688 - RNA, 18 nt, Staphylococcus aureus subsp. aureus Mu50
cucagguuguuaggggcu

SEQ ID NO: 2051689 - RNA, 20 nt, Staphylococcus aureus subsp. aureus Mu50
cucagguauaggugcaguua

SEQ ID NO: 2051690 - RNA, 20 nt, Staphylococcus aureus subsp. aureus Mu50
cucauccgccaauuaaaauu

SEQ ID NO: 2051691 - RNA, 17 nt, Staphylococcus aureus subsp. aureus Mu50
cucaucgaauucauuug

SEQ ID NO: 2051692 - RNA, 12 nt, Staphylococcus aureus subsp. aureus Mu50
cucaucuaauuu

SEQ ID NO: 2051693 - RNA, 17 nt, Staphylococcus aureus subsp. aureus Mu50
cucaucuacuauuuaau

SEQ ID NO: 2051694 - RNA, 22 nt, Staphylococcus aureus subsp. aureus Mu50
cucaucuauuuaauaauguauc

SEQ ID NO: 2051695 - RNA, 13 nt, Staphylococcus aureus subsp. aureus Mu50
cucauuaauaaau

SEQ ID NO: 2051696 - RNA, 20 nt, Staphylococcus aureus subsp. aureus Mu50
cucauuagcgaaaacuaaag

SEQ ID NO: 2051697 - RNA, 23 nt, Staphylococcus aureus subsp. aureus Mu50
cucaccuuuagacaauauuuuua

SEQ ID NO: 2051698 - RNA, 13 nt, Staphylococcus aureus subsp. aureus Mu50
cucacaugugaaa

SEQ ID NO: 2051699 - RNA, 15 nt, Staphylococcus aureus subsp. aureus Mu50
cucaaugaauuuacu

SEQ ID NO: 2051700 - RNA, 22 nt, Staphylococcus aureus subsp. aureus Mu50
cucaaugauuguaauaucuaaa

SEQ ID NO: 2051701 - RNA, 24 nt, Staphylococcus aureus subsp. aureus Mu50
cucaauuucauuugaaauaguuaa

SEQ ID NO: 2051702 - RNA, 21 nt, Staphylococcus aureus subsp. aureus Mu50
cucaauuuaguauaaauaaaa

SEQ ID NO: 2051703 - RNA, 16 nt, Staphylococcus aureus subsp. aureus Mu50
cucaagugauuuccca

SEQ ID NO: 2051704 - RNA, 17 nt, Staphylococcus aureus subsp. aureus Mu50
cucaacauuaaaaugug

SEQ ID NO: 2051705 - RNA, 16 nt, Staphylococcus aureus subsp. aureus Mu50
cuauuuaaaagacaau

SEQ ID NO: 2051706 - RNA, 15 nt, Staphylococcus aureus subsp. aureus Mu50
cuauuacuauaaaaa

SEQ ID NO: 2051707 - RNA, 22 nt, Staphylococcus aureus subsp. aureus Mu50
cuauuacuacauaauuuaucaa

SEQ ID NO: 2051708 - RNA, 20 nt, Staphylococcus aureus subsp. aureus Mu50
cuauuagauacauauaagaa

SEQ ID NO: 2051709 - RNA, 20 nt, Staphylococcus aureus subsp. aureus Mu50
cuauuaauaucauaguuguc

SEQ ID NO: 2051710 - RNA, 20 nt, Staphylococcus aureus subsp. aureus Mu50
cuauuaacugaccuaacaau

SEQ ID NO: 2051711 - RNA, 17 nt, Staphylococcus aureus subsp. aureus Mu50
cuauuaauuacgucaua

SEQ ID NO: 2051712 - RNA, 17 nt, Staphylococcus aureus subsp. aureus Mu50
cuauuucacucuacaau

SEQ ID NO: 2051713 - RNA, 14 nt, Staphylococcus aureus subsp. aureus Mu50
cuauuuauugagau

SEQ ID NO: 2051714 - RNA, 17 nt, Staphylococcus aureus subsp. aureus Mu50
cuauuuauugagauaga

SEQ ID NO: 2051715 - RNA, 20 nt, Staphylococcus aureus subsp. aureus Mu50
cucaaagguuuacuauuaaa

SEQ ID NO: 2051716 - RNA, 18 nt, Staphylococcus aureus subsp. aureus Mu50
cucaaagguuuacuauua

SEQ ID NO: 2051717 - RNA, 14 nt, Staphylococcus aureus subsp. aureus Mu50
cuauuuguggaaau

SEQ ID NO: 2051718 - RNA, 17 nt, Staphylococcus aureus subsp. aureus Mu50
cuauuuguggaaauaaa

SEQ ID NO: 2051719 - RNA, 21 nt, Staphylococcus aureus subsp. aureus Mu50
cuauuuuccaucacauaacua

SEQ ID NO: 2051720 - RNA, 19 nt, Staphylococcus aureus subsp. aureus Mu50
cuauuuuuuauguuuuaau

SEQ ID NO: 2051721 - RNA, 16 nt, Staphylococcus aureus subsp. aureus Mu50
cuauuuuugauuuaau

SEQ ID NO: 2051722 - RNA, 17 nt, Staphylococcus aureus subsp. aureus Mu50
cuauuuuugauuuaaua

SEQ ID NO: 2051723 - RNA, 11 nt, Staphylococcus aureus subsp. aureus Mu50
cuauuuuuaau

SEQ ID NO: 2051724 - RNA, 15 nt, Staphylococcus aureus subsp. aureus Mu50
cucgauauaugucuc

SEQ ID NO: 2051725 - RNA, 16 nt, Staphylococcus aureus subsp. aureus Mu50
cucgauaacuuacuau

SEQ ID NO: 2051726 - RNA, 15 nt, Staphylococcus aureus subsp. aureus Mu50
cucuaaaacuuuuuc

SEQ ID NO: 2051727 - RNA, 15 nt, Staphylococcus aureus subsp. aureus Mu50
cucguuuuuccaugu

SEQ ID NO: 2051728 - RNA, 12 nt, Staphylococcus aureus subsp. aureus Mu50
cucuaaauaaaa

SEQ ID NO: 2051729 - RNA, 12 nt, Staphylococcus aureus subsp. aureus Mu50
cucgguuuuuuc

SEQ ID NO: 2051730 - RNA, 12 nt, Staphylococcus aureus subsp. aureus Mu50
cucguaauaaug

SEQ ID NO: 2051731 - RNA, 23 nt, Staphylococcus aureus subsp. aureus Mu50
cucgguuuuuucgguuuauuuaa

SEQ ID NO: 2051732 - RNA, 18 nt, Staphylococcus aureus subsp. aureus Mu50
cucguaaauuuuaucuaa

SEQ ID NO: 2051733 - RNA, 22 nt, Staphylococcus aureus subsp. aureus Mu50
cucccuuaaauacaauuucuuc

SEQ ID NO: 2051734 - RNA, 19 nt, Staphylococcus aureus subsp. aureus Mu50
cucccauaacaccuacuga

SEQ ID NO: 2051735 - RNA, 22 nt, Staphylococcus aureus subsp. aureus Mu50
cuccuaaagguaacuuuuuaac

SEQ ID NO: 2051736 - RNA, 18 nt, Staphylococcus aureus subsp. aureus Mu50
cuccucaaaagcuguagu

SEQ ID NO: 2051737 - RNA, 21 nt, Staphylococcus aureus subsp. aureus Mu50
cucauuuguauagauuguauu

SEQ ID NO: 2051738 - RNA, 20 nt, Staphylococcus aureus subsp. aureus Mu50
cucauuuuuauaaauuuugg

SEQ ID NO: 2051739 - RNA, 17 nt, Staphylococcus aureus subsp. aureus Mu50
cuccaaaaauaauuaaa

SEQ ID NO: 2051740 - RNA, 14 nt, Staphylococcus aureus subsp. aureus Mu50
cucauuuuuuuaau

SEQ ID NO: 2051741 - RNA, 22 nt, Staphylococcus aureus subsp. aureus Mu50
cucauuuuuuuaauuauuuccc

SEQ ID NO: 2051742 - RNA, 20 nt, Staphylococcus aureus subsp. aureus Mu50
cuccaaaaauaauuaaaucc

SEQ ID NO: 2051743 - RNA, 23 nt, Staphylococcus aureus subsp. aureus Mu50
cuccaguggaaaugauaauuuaa

SEQ ID NO: 2051744 - RNA, 14 nt, Staphylococcus aureus subsp. aureus Mu50
cgugguaugauuuu

SEQ ID NO: 2051745 - RNA, 21 nt, Staphylococcus aureus subsp. aureus Mu50
cgugguucaaaaaucauacca

SEQ ID NO: 2051746 - RNA, 20 nt, Staphylococcus aureus subsp. aureus Mu50
cgugcuuuuaaauguauuuu

SEQ ID NO: 2051747 - RNA, 17 nt, Staphylococcus aureus subsp. aureus Mu50
cguggauguguuuuaau

SEQ ID NO: 2051748 - RNA, 13 nt, Staphylococcus aureus subsp. aureus Mu50
cgugguucccaau

SEQ ID NO: 2051749 - RNA, 20 nt, Staphylococcus aureus subsp. aureus Mu50
cguguauacaacauguguau

SEQ ID NO: 2051750 - RNA, 15 nt, Staphylococcus aureus subsp. aureus Mu50
cgugucaaaugccgc

SEQ ID NO: 2051751 - RNA, 19 nt, Staphylococcus aureus subsp. aureus Mu50
cgugucaaaugccgcuucu

SEQ ID NO: 2051752 - RNA, 17 nt, Staphylococcus aureus subsp. aureus Mu50
cguuaauaauuuguuuu

SEQ ID NO: 2051753 - RNA, 20 nt, Staphylococcus aureus subsp. aureus Mu50
cguguuugaauggcaaauau

SEQ ID NO: 2051754 - RNA, 17 nt, Staphylococcus aureus subsp. aureus Mu50
cguguguuuucuuuuca

SEQ ID NO: 2051755 - RNA, 13 nt, Staphylococcus aureus subsp. aureus Mu50
cguuauucauuug

SEQ ID NO: 2051756 - RNA, 16 nt, Staphylococcus aureus subsp. aureus Mu50
cguuauuuucaauaaa

SEQ ID NO: 2051757 - RNA, 22 nt, Staphylococcus aureus subsp. aureus Mu50
cguuaguacggcugcuuuaacu

SEQ ID NO: 2051758 - RNA, 22 nt, Staphylococcus aureus subsp. aureus Mu50
cguuaguauaaacguccaaaca

SEQ ID NO: 2051759 - RNA, 19 nt, Staphylococcus aureus subsp. aureus Mu50
cguucaagaacaaucaaua

SEQ ID NO: 2051760 - RNA, 12 nt, Staphylococcus aureus subsp. aureus Mu50
cguuauuuuuug

SEQ ID NO: 2051761 - RNA, 17 nt, Staphylococcus aureus subsp. aureus Mu50
cguugguauucaucuuc

SEQ ID NO: 2051762 - RNA, 14 nt, Staphylococcus aureus subsp. aureus Mu50
cguucucuuaaaua

SEQ ID NO: 2051763 - RNA, 14 nt, Staphylococcus aureus subsp. aureus Mu50
cguucuguuuugcg

SEQ ID NO: 2051764 - RNA, 16 nt, Staphylococcus aureus subsp. aureus Mu50
cguucuuguauuuccu

SEQ ID NO: 2051765 - RNA, 15 nt, Staphylococcus aureus subsp. aureus Mu50
cguuuuagacauaaa

SEQ ID NO: 2051766 - RNA, 17 nt, Staphylococcus aureus subsp. aureus Mu50
cguuuuuuuaaauacau

SEQ ID NO: 2051767 - RNA, 15 nt, Staphylococcus aureus subsp. aureus Mu50
cuaaaaaaauuaaaa

SEQ ID NO: 2051768 - RNA, 12 nt, Staphylococcus aureus subsp. aureus Mu50
cguuuguacucu

SEQ ID NO: 2051769 - RNA, 16 nt, Staphylococcus aureus subsp. aureus Mu50
cguuuguacuucacua

SEQ ID NO: 2051770 - RNA, 17 nt, Staphylococcus aureus subsp. aureus Mu50
cguuuguguguuuuaaa

SEQ ID NO: 2051771 - RNA, 20 nt, Staphylococcus aureus subsp. aureus Mu50
cuaaacauuuuugugcaaaa

SEQ ID NO: 2051772 - RNA, 15 nt, Staphylococcus aureus subsp. aureus Mu50
cuaaaccucaacauu

SEQ ID NO: 2051773 - RNA, 19 nt, Staphylococcus aureus subsp. aureus Mu50
cuaaacauuuuauacucug

SEQ ID NO: 2051774 - RNA, 23 nt, Staphylococcus aureus subsp. aureus Mu50
cuaaaaaugucguauauguaauc

SEQ ID NO: 2051775 - RNA, 17 nt, Staphylococcus aureus subsp. aureus Mu50
cuaaaacaucacuugcu

SEQ ID NO: 2051776 - RNA, 21 nt, Staphylococcus aureus subsp. aureus Mu50
cuaaaacaaauucauauuaac

SEQ ID NO: 2051777 - RNA, 17 nt, Staphylococcus aureus subsp. aureus Mu50
cuaaaacggaaauaacc

SEQ ID NO: 2051778 - RNA, 20 nt, Staphylococcus aureus subsp. aureus Mu50
cuaaaaccuauuccuaauaa

SEQ ID NO: 2051779 - RNA, 13 nt, Staphylococcus aureus subsp. aureus Mu50
cuaaaaacauaaa

SEQ ID NO: 2051780 - RNA, 21 nt, Staphylococcus aureus subsp. aureus Mu50
cuaacaauuugaggauacaua

SEQ ID NO: 2051781 - RNA, 18 nt, Staphylococcus aureus subsp. aureus Mu50
cuaacagcauuuccuaug

SEQ ID NO: 2051782 - RNA, 18 nt, Staphylococcus aureus subsp. aureus Mu50
cuaacauaauuuuuauuu

SEQ ID NO: 2051783 - RNA, 15 nt, Staphylococcus aureus subsp. aureus Mu50
cuaacaguuaauaug

SEQ ID NO: 2051784 - RNA, 13 nt, Staphylococcus aureus subsp. aureus Mu50
cuaacauugguac

SEQ ID NO: 2051785 - RNA, 23 nt, Staphylococcus aureus subsp. aureus Mu50
cuaacauugguaccuuuuuauua

SEQ ID NO: 2051786 - RNA, 11 nt, Staphylococcus aureus subsp. aureus Mu50
cuaaauugucg

SEQ ID NO: 2051787 - RNA, 14 nt, Staphylococcus aureus subsp. aureus Mu50
cuaaauucuuuuug

SEQ ID NO: 2051788 - RNA, 15 nt, Staphylococcus aureus subsp. aureus Mu50
cuaaauuuacgaaag

SEQ ID NO: 2051789 - RNA, 22 nt, Staphylococcus aureus subsp. aureus Mu50
cuaaauucaguucaaacagaaa

SEQ ID NO: 2051790 - RNA, 10 nt, Staphylococcus aureus subsp. aureus Mu50
cuaaaugauu

SEQ ID NO: 2051791 - RNA, 23 nt, Staphylococcus aureus subsp. aureus Mu50
cuaaaugcacgagcaacaucuuu

SEQ ID NO: 2051792 - RNA, 20 nt, Staphylococcus aureus subsp. aureus Mu50
cuaaagaaugacguuaucau

SEQ ID NO: 2051793 - RNA, 18 nt, Staphylococcus aureus subsp. aureus Mu50
cuaaaccuuuuuuaaguu

SEQ ID NO: 2051794 - RNA, 17 nt, Staphylococcus aureus subsp. aureus Mu50
cuaaacgauaaauuaac

SEQ ID NO: 2051795 - RNA, 17 nt, Staphylococcus aureus subsp. aureus Mu50
cuaagcaucguaaaaaa

SEQ ID NO: 2051796 - RNA, 21 nt, Staphylococcus aureus subsp. aureus Mu50
cuaagcaucguaaaaaacaaa

SEQ ID NO: 2051797 - RNA, 22 nt, Staphylococcus aureus subsp. aureus Mu50
cuaacuuuaugggguguauuuu

SEQ ID NO: 2051798 - RNA, 12 nt, Staphylococcus aureus subsp. aureus Mu50
cuaagaaccuuu

SEQ ID NO: 2051799 - RNA, 19 nt, Staphylococcus aureus subsp. aureus Mu50
cuaagucuuuuaaaugaug

SEQ ID NO: 2051800 - RNA, 15 nt, Staphylococcus aureus subsp. aureus Mu50
cuaaguuaugacuaa

SEQ ID NO: 2051801 - RNA, 13 nt, Staphylococcus aureus subsp. aureus Mu50
cuaagugguugaa

SEQ ID NO: 2051802 - RNA, 13 nt, Staphylococcus aureus subsp. aureus Mu50
cuaaguguuuuau

SEQ ID NO: 2051803 - RNA, 19 nt, Staphylococcus aureus subsp. aureus Mu50
cuaacgauuucuaguuuau

SEQ ID NO: 2051804 - RNA, 19 nt, Staphylococcus aureus subsp. aureus Mu50
cuaacggcguuuguuucuu

SEQ ID NO: 2051805 - RNA, 19 nt, Staphylococcus aureus subsp. aureus Mu50
cuaaccaucauaaauguua

SEQ ID NO: 2051806 - RNA, 18 nt, Staphylococcus aureus subsp. aureus Mu50
cuaaccaucauaaauguu

SEQ ID NO: 2051807 - RNA, 15 nt, Staphylococcus aureus subsp. aureus Mu50
cuaaccacuucuuca

SEQ ID NO: 2051808 - RNA, 16 nt, Staphylococcus aureus subsp. aureus Mu50
cgucuuguaaacuucu

SEQ ID NO: 2051809 - RNA, 13 nt, Staphylococcus aureus subsp. aureus Mu50
cgucgugauggcu

SEQ ID NO: 2051810 - RNA, 18 nt, Staphylococcus aureus subsp. aureus Mu50
cgugauggcuacuuuuuc

SEQ ID NO: 2051811 - RNA, 22 nt, Staphylococcus aureus subsp. aureus Mu50
cgugaauucgaugacuuuuuaa

SEQ ID NO: 2051812 - RNA, 14 nt, Staphylococcus aureus subsp. aureus Mu50
cgugcaaauaaaaa

SEQ ID NO: 2051813 - RNA, 18 nt, Staphylococcus aureus subsp. aureus Mu50
cgugcaaauaaaaaaguu

SEQ ID NO: 2051814 - RNA, 22 nt, Staphylococcus aureus subsp. aureus Mu50
cgcgcuuauugaaaagauaaac

SEQ ID NO: 2051815 - RNA, 14 nt, Staphylococcus aureus subsp. aureus Mu50
cgcucuuuucaaaa

SEQ ID NO: 2051816 - RNA, 19 nt, Staphylococcus aureus subsp. aureus Mu50
cgcuaauuuuacucuguau

SEQ ID NO: 2051817 - RNA, 14 nt, Staphylococcus aureus subsp. aureus Mu50
cgcguauuccauug

SEQ ID NO: 2051818 - RNA, 13 nt, Staphylococcus aureus subsp. aureus Mu50
cgcgucugauucu

SEQ ID NO: 2051819 - RNA, 17 nt, Staphylococcus aureus subsp. aureus Mu50
cgcgucugauucucuaa

SEQ ID NO: 2051820 - RNA, 22 nt, Staphylococcus aureus subsp. aureus Mu50
cggaucauuauuuagaauucua

SEQ ID NO: 2051821 - RNA, 20 nt, Staphylococcus aureus subsp. aureus Mu50
cgcuucuucuucagaaauac

SEQ ID NO: 2051822 - RNA, 21 nt, Staphylococcus aureus subsp. aureus Mu50
cgcuucauugaugaugugcua

SEQ ID NO: 2051823 - RNA, 14 nt, Staphylococcus aureus subsp. aureus Mu50
cgcuucaauuauuu

SEQ ID NO: 2051824 - RNA, 14 nt, Staphylococcus aureus subsp. aureus Mu50
cgcuuauuuuacua

SEQ ID NO: 2051825 - RNA, 21 nt, Staphylococcus aureus subsp. aureus Mu50
cggaagauaggauuuacaccu

SEQ ID NO: 2051826 - RNA, 21 nt, Staphylococcus aureus subsp. aureus Mu50
cggaagauaggauuugcaccu

SEQ ID NO: 2051827 - RNA, 12 nt, Staphylococcus aureus subsp. aureus Mu50
cggaauaaaaua

SEQ ID NO: 2051828 - RNA, 15 nt, Staphylococcus aureus subsp. aureus Mu50
cggaauaacuuuuua

SEQ ID NO: 2051829 - RNA, 10 nt, Staphylococcus aureus subsp. aureus Mu50
cggacugaug

SEQ ID NO: 2051830 - RNA, 13 nt, Staphylococcus aureus subsp. aureus Mu50
cggacugaaagaa

SEQ ID NO: 2051831 - RNA, 19 nt, Staphylococcus aureus subsp. aureus Mu50
cggacaaguugcacauuau

SEQ ID NO: 2051832 - RNA, 21 nt, Staphylococcus aureus subsp. aureus Mu50
cggaauugguuuuuagugaaa

SEQ ID NO: 2051833 - RNA, 20 nt, Staphylococcus aureus subsp. aureus Mu50
cguacauuuaugauuguuua

SEQ ID NO: 2051834 - RNA, 18 nt, Staphylococcus aureus subsp. aureus Mu50
cguacaaagguaauagaa

SEQ ID NO: 2051835 - RNA, 10 nt, Staphylococcus aureus subsp. aureus Mu50
cguaaaguuu

SEQ ID NO: 2051836 - RNA, 20 nt, Staphylococcus aureus subsp. aureus Mu50
cguaagcaguuaauaagaaa

SEQ ID NO: 2051837 - RNA, 20 nt, Staphylococcus aureus subsp. aureus Mu50
cggggccccaacacagagaa

SEQ ID NO: 2051838 - RNA, 19 nt, Staphylococcus aureus subsp. aureus Mu50
cggggccccaacaaagaag

SEQ ID NO: 2051839 - RNA, 17 nt, Staphylococcus aureus subsp. aureus Mu50
cggggccccaacacaga

SEQ ID NO: 2051840 - RNA, 18 nt, Staphylococcus aureus subsp. aureus Mu50
cggggccccaacacagag

SEQ ID NO: 2051841 - RNA, 17 nt, Staphylococcus aureus subsp. aureus Mu50
cggggaauuuuuaugca

SEQ ID NO: 2051842 - RNA, 20 nt, Staphylococcus aureus subsp. aureus Mu50
cgggggauuauuuauauuuu

SEQ ID NO: 2051843 - RNA, 19 nt, Staphylococcus aureus subsp. aureus Mu50
cgguauuuuaaauuuauaa

SEQ ID NO: 2051844 - RNA, 15 nt, Staphylococcus aureus subsp. aureus Mu50
cgggaacaucauaau

SEQ ID NO: 2051845 - RNA, 14 nt, Staphylococcus aureus subsp. aureus Mu50
cccuggaaaaugau

SEQ ID NO: 2051846 - RNA, 18 nt, Staphylococcus aureus subsp. aureus Mu50
ccgaaaauugcuaaaaaa

SEQ ID NO: 2051847 - RNA, 24 nt, Staphylococcus aureus subsp. aureus Mu50
ccgaaaaaaccgagaaucuccauu

SEQ ID NO: 2051848 - RNA, 22 nt, Staphylococcus aureus subsp. aureus Mu50
ccgaacaucugaaaaaauuaau

SEQ ID NO: 2051849 - RNA, 18 nt, Staphylococcus aureus subsp. aureus Mu50
ccgauuuugauauaaaaa

SEQ ID NO: 2051850 - RNA, 17 nt, Staphylococcus aureus subsp. aureus Mu50
ccgauuuugauauaaaa

SEQ ID NO: 2051851 - RNA, 13 nt, Staphylococcus aureus subsp. aureus Mu50
ccgauuguuucac

SEQ ID NO: 2051852 - RNA, 20 nt, Staphylococcus aureus subsp. aureus Mu50
ccgauuuauuuauaaaauaa

SEQ ID NO: 2051853 - RNA, 14 nt, Staphylococcus aureus subsp. aureus Mu50
ccgacuauuuuuga

SEQ ID NO: 2051854 - RNA, 18 nt, Staphylococcus aureus subsp. aureus Mu50
ccgacuugauaaaaaaug

SEQ ID NO: 2051855 - RNA, 23 nt, Staphylococcus aureus subsp. aureus Mu50
ccuguauagcgguguuuugagag

SEQ ID NO: 2051856 - RNA, 15 nt, Staphylococcus aureus subsp. aureus Mu50
ccuguagaauuucuu

SEQ ID NO: 2051857 - RNA, 12 nt, Staphylococcus aureus subsp. aureus Mu50
ccucuugccuug

SEQ ID NO: 2051858 - RNA, 14 nt, Staphylococcus aureus subsp. aureus Mu50
ccucuccuucggcu

SEQ ID NO: 2051859 - RNA, 17 nt, Staphylococcus aureus subsp. aureus Mu50
ccucguuccgggaagga

SEQ ID NO: 2051860 - RNA, 16 nt, Staphylococcus aureus subsp. aureus Mu50
ccucgguauucaauuc

SEQ ID NO: 2051861 - RNA, 13 nt, Staphylococcus aureus subsp. aureus Mu50
ccucaucgaguuu

SEQ ID NO: 2051862 - RNA, 21 nt, Staphylococcus aureus subsp. aureus Mu50
ccuaccgcuaaaauucuuuca

SEQ ID NO: 2051863 - RNA, 17 nt, Staphylococcus aureus subsp. aureus Mu50
ccucauuccaggaagga

SEQ ID NO: 2051864 - RNA, 12 nt, Staphylococcus aureus subsp. aureus Mu50
ccuccaaagcua

SEQ ID NO: 2051865 - RNA, 18 nt, Staphylococcus aureus subsp. aureus Mu50
ccgugaggaauaugaauu

SEQ ID NO: 2051866 - RNA, 19 nt, Staphylococcus aureus subsp. aureus Mu50
ccuaaccuguuugagauau

SEQ ID NO: 2051867 - RNA, 13 nt, Staphylococcus aureus subsp. aureus Mu50
ccuaacuuuuauu

SEQ ID NO: 2051868 - RNA, 19 nt, Staphylococcus aureus subsp. aureus Mu50
ccuaacuuuuauuaucagc

SEQ ID NO: 2051869 - RNA, 18 nt, Staphylococcus aureus subsp. aureus Mu50
ccuaauaauaaaauagcu

SEQ ID NO: 2051870 - RNA, 22 nt, Staphylococcus aureus subsp. aureus Mu50
ccuaaucugcaacgauuuuaaa

SEQ ID NO: 2051871 - RNA, 20 nt, Staphylococcus aureus subsp. aureus Mu50
ccuaauacacuugauaaaac

SEQ ID NO: 2051872 - RNA, 12 nt, Staphylococcus aureus subsp. aureus Mu50
ccuaaugcuuua

SEQ ID NO: 2051873 - RNA, 22 nt, Staphylococcus aureus subsp. aureus Mu50
ccuacagauuuuaaaaauucau

SEQ ID NO: 2051874 - RNA, 17 nt, Staphylococcus aureus subsp. aureus Mu50
ccuaauucgccaucuuu

SEQ ID NO: 2051875 - RNA, 23 nt, Staphylococcus aureus subsp. aureus Mu50
ccuaauucgccaucuuuuuuagc

SEQ ID NO: 2051876 - RNA, 22 nt, Staphylococcus aureus subsp. aureus Mu50
ccguaaaaucagucauucacau

SEQ ID NO: 2051877 - RNA, 14 nt, Staphylococcus aureus subsp. aureus Mu50
ccggcuuuuucuuu

SEQ ID NO: 2051878 - RNA, 19 nt, Staphylococcus aureus subsp. aureus Mu50
cgaggaaauccuuaaaugg

SEQ ID NO: 2051879 - RNA, 20 nt, Staphylococcus aureus subsp. aureus Mu50
cgagcugcuucaacuacuuc

SEQ ID NO: 2051880 - RNA, 15 nt, Staphylococcus aureus subsp. aureus Mu50
cgagcguugguaacg

SEQ ID NO: 2051881 - RNA, 20 nt, Staphylococcus aureus subsp. aureus Mu50
cgagcuaauaugucuagacu

SEQ ID NO: 2051882 - RNA, 19 nt, Staphylococcus aureus subsp. aureus Mu50
cgaguuuguuucuaaauuc

SEQ ID NO: 2051883 - RNA, 20 nt, Staphylococcus aureus subsp. aureus Mu50
cgaguguuuuaaucuuauuc

SEQ ID NO: 2051884 - RNA, 17 nt, Staphylococcus aureus subsp. aureus Mu50
cgauaagcaaaaauucu

SEQ ID NO: 2051885 - RNA, 14 nt, Staphylococcus aureus subsp. aureus Mu50
cgauaauagauacc

SEQ ID NO: 2051886 - RNA, 20 nt, Staphylococcus aureus subsp. aureus Mu50
cgauaauuugagaaaugaaa

SEQ ID NO: 2051887 - RNA, 22 nt, Staphylococcus aureus subsp. aureus Mu50
cgauaauuugagaaaugaaacu

SEQ ID NO: 2051888 - RNA, 20 nt, Staphylococcus aureus subsp. aureus Mu50
cgauauuaugucgagguguu

SEQ ID NO: 2051889 - RNA, 14 nt, Staphylococcus aureus subsp. aureus Mu50
cgacguuuaaaugc

SEQ ID NO: 2051890 - RNA, 21 nt, Staphylococcus aureus subsp. aureus Mu50
cgacuuuuagauuaucuuuca

SEQ ID NO: 2051891 - RNA, 20 nt, Staphylococcus aureus subsp. aureus Mu50
cgacgcuaaacaaaggggau

SEQ ID NO: 2051892 - RNA, 20 nt, Staphylococcus aureus subsp. aureus Mu50
cgagauguguccuaauaagu

SEQ ID NO: 2051893 - RNA, 18 nt, Staphylococcus aureus subsp. aureus Mu50
cgagcaguauauaucaaa

SEQ ID NO: 2051894 - RNA, 17 nt, Staphylococcus aureus subsp. aureus Mu50
cgagccauuauuauuuu

SEQ ID NO: 2051895 - RNA, 11 nt, Staphylococcus aureus subsp. aureus Mu50
cgcauacuuuu

SEQ ID NO: 2051896 - RNA, 18 nt, Staphylococcus aureus subsp. aureus Mu50
cgcauacuuuuucagaau

SEQ ID NO: 2051897 - RNA, 14 nt, Staphylococcus aureus subsp. aureus Mu50
cgcauuuaaauaua

SEQ ID NO: 2051898 - RNA, 12 nt, Staphylococcus aureus subsp. aureus Mu50
cgcauuguugua

SEQ ID NO: 2051899 - RNA, 22 nt, Staphylococcus aureus subsp. aureus Mu50
cgccaauacagaacuuuaauaa

SEQ ID NO: 2051900 - RNA, 12 nt, Staphylococcus aureus subsp. aureus Mu50
cgcaauuuuuaa

SEQ ID NO: 2051901 - RNA, 13 nt, Staphylococcus aureus subsp. aureus Mu50
cgcaauuaaaagu

SEQ ID NO: 2051902 - RNA, 14 nt, Staphylococcus aureus subsp. aureus Mu50
cgcaaugucuugug

SEQ ID NO: 2051903 - RNA, 15 nt, Staphylococcus aureus subsp. aureus Mu50
cgcaaugauuauaaa

SEQ ID NO: 2051904 - RNA, 22 nt, Staphylococcus aureus subsp. aureus Mu50
cgcaaugauaucuuuuccaaaa

SEQ ID NO: 2051905 - RNA, 21 nt, Staphylococcus aureus subsp. aureus Mu50
cgcaaucauuagcgaaaaccu

SEQ ID NO: 2051906 - RNA, 21 nt, Staphylococcus aureus subsp. aureus Mu50
cgauuuauuuauaaaauaaaa

SEQ ID NO: 2051907 - RNA, 15 nt, Staphylococcus aureus subsp. aureus Mu50
cgauuuuaaagaaaa

SEQ ID NO: 2051908 - RNA, 16 nt, Staphylococcus aureus subsp. aureus Mu50
cgauuuauuauuacca

SEQ ID NO: 2051909 - RNA, 12 nt, Staphylococcus aureus subsp. aureus Mu50
cgauguccuuua

SEQ ID NO: 2051910 - RNA, 19 nt, Staphylococcus aureus subsp. aureus Mu50
cgaaauaguucaaaauacu

SEQ ID NO: 2051911 - RNA, 18 nt, Staphylococcus aureus subsp. aureus Mu50
cgaaauggugaacuaaau

SEQ ID NO: 2051912 - RNA, 13 nt, Staphylococcus aureus subsp. aureus Mu50
cgaaauucucuuu

SEQ ID NO: 2051913 - RNA, 15 nt, Staphylococcus aureus subsp. aureus Mu50
cgaaaguaucuauga

SEQ ID NO: 2051914 - RNA, 18 nt, Staphylococcus aureus subsp. aureus Mu50
cgaacgauagauucugau

SEQ ID NO: 2051915 - RNA, 23 nt, Staphylococcus aureus subsp. aureus Mu50
cgaaccgaagcgcagugaccuca

SEQ ID NO: 2051916 - RNA, 21 nt, Staphylococcus aureus subsp. aureus Mu50
cgaacaugguaucuuuaauuu

SEQ ID NO: 2051917 - RNA, 14 nt, Staphylococcus aureus subsp. aureus Mu50
cgaacauaaauaaa

SEQ ID NO: 2051918 - RNA, 17 nt, Staphylococcus aureus subsp. aureus Mu50
ccuuuuuauuuuuugga

SEQ ID NO: 2051919 - RNA, 19 nt, Staphylococcus aureus subsp. aureus Mu50
ccuuuuuuuaagguucuuu

SEQ ID NO: 2051920 - RNA, 14 nt, Staphylococcus aureus subsp. aureus Mu50
cgaaaauaaaacaa

SEQ ID NO: 2051921 - RNA, 16 nt, Staphylococcus aureus subsp. aureus Mu50
cgaaaaguauaugaau

SEQ ID NO: 2051922 - RNA, 22 nt, Staphylococcus aureus subsp. aureus Mu50
cgaaaauagcuauuaaaauaga

SEQ ID NO: 2051923 - RNA, 18 nt, Staphylococcus aureus subsp. aureus Mu50
cgaaaauugcuaaaaaaa

SEQ ID NO: 2051924 - RNA, 21 nt, Staphylococcus aureus subsp. aureus Mu50
cgaaaaaugccaacuauaccu

SEQ ID NO: 2051925 - RNA, 10 nt, Staphylococcus aureus subsp. aureus Mu50
cgaaaagaaa

SEQ ID NO: 2051926 - RNA, 11 nt, Staphylococcus aureus subsp. aureus Mu50
ccuuuucaaau

SEQ ID NO: 2051927 - RNA, 24 nt, Staphylococcus aureus subsp. aureus Mu50
ccuuugauguuuucuauaauauuu

SEQ ID NO: 2051928 - RNA, 14 nt, Staphylococcus aureus subsp. aureus Mu50
ccuuucuuuuucga

SEQ ID NO: 2051929 - RNA, 19 nt, Staphylococcus aureus subsp. aureus Mu50
ccuuuauauucuaauauuc

SEQ ID NO: 2051930 - RNA, 22 nt, Staphylococcus aureus subsp. aureus Mu50
ccuuuaguguguuuaaaaggaa

SEQ ID NO: 2051931 - RNA, 15 nt, Staphylococcus aureus subsp. aureus Mu50
ccuuuagucauguuu

SEQ ID NO: 2051932 - RNA, 16 nt, Staphylococcus aureus subsp. aureus Mu50
ccuuuagccaaugcuu

SEQ ID NO: 2051933 - RNA, 17 nt, Staphylococcus aureus subsp. aureus Mu50
ccuuuagccaaugcuuc

SEQ ID NO: 2051934 - RNA, 20 nt, Staphylococcus aureus subsp. aureus Mu50
ccuuucauuuuagcaaaagc

SEQ ID NO: 2051935 - RNA, 20 nt, Staphylococcus aureus subsp. aureus Mu50
ccuuuccauucguauaagaa

SEQ ID NO: 2051936 - RNA, 15 nt, Staphylococcus aureus subsp. aureus Mu50
ccuuguaaauuuaaa

SEQ ID NO: 2051937 - RNA, 20 nt, Staphylococcus aureus subsp. aureus Mu50
ccuuuacgccauucaucauc

SEQ ID NO: 2051938 - RNA, 22 nt, Staphylococcus aureus subsp. aureus Mu50
ccuuuaauuguuaaaucaccaa

SEQ ID NO: 2051939 - RNA, 19 nt, Staphylococcus aureus subsp. aureus Mu50
ccuuuacaacauacaugcc

SEQ ID NO: 2051940 - RNA, 15 nt, Staphylococcus aureus subsp. aureus Mu50
ccuuuaauuacacua

SEQ ID NO: 2051941 - RNA, 22 nt, Staphylococcus aureus subsp. aureus Mu50
ccuuuaagaagucgaauucacc

SEQ ID NO: 2051942 - RNA, 12 nt, Staphylococcus aureus subsp. aureus Mu50
ccuuuaaaacau

SEQ ID NO: 2051943 - RNA, 20 nt, Staphylococcus aureus subsp. aureus Mu50
ccuuguucuccgaucaugcc

SEQ ID NO: 2051944 - RNA, 19 nt, Staphylococcus aureus subsp. aureus Mu50
ccuucgcauacuuuuucag

SEQ ID NO: 2051945 - RNA, 17 nt, Staphylococcus aureus subsp. aureus Mu50
ccuucgcauacuuuuuc

SEQ ID NO: 2051946 - RNA, 15 nt, Staphylococcus aureus subsp. aureus Mu50
ccuucuuuauaacuu

SEQ ID NO: 2051947 - RNA, 15 nt, Staphylococcus aureus subsp. aureus Mu50
ccuucuuucgcuuca

SEQ ID NO: 2051948 - RNA, 16 nt, Staphylococcus aureus subsp. aureus Mu50
ccuucuauauaguaaa

SEQ ID NO: 2051949 - RNA, 15 nt, Staphylococcus aureus subsp. aureus Mu50
ccuucucaucauuuu

SEQ ID NO: 2051950 - RNA, 23 nt, Staphylococcus aureus subsp. aureus Mu50
cgaagggcggucaauuuuaccau

SEQ ID NO: 2051951 - RNA, 12 nt, Staphylococcus aureus subsp. aureus Mu50
cgaaguuuaaau

SEQ ID NO: 2051952 - RNA, 15 nt, Staphylococcus aureus subsp. aureus Mu50
cgaacuuuuguucua

SEQ ID NO: 2051953 - RNA, 19 nt, Staphylococcus aureus subsp. aureus Mu50
cgacaaauuaaaaaacaau

SEQ ID NO: 2051954 - RNA, 16 nt, Staphylococcus aureus subsp. aureus Mu50
cgacaccaacauauuu

SEQ ID NO: 2051955 - RNA, 15 nt, Staphylococcus aureus subsp. aureus Mu50
cgacaauuccauaag

SEQ ID NO: 2051956 - RNA, 22 nt, Staphylococcus aureus subsp. aureus Mu50
cgacaauuauaauaaaacuugu

SEQ ID NO: 2051957 - RNA, 17 nt, Staphylococcus aureus subsp. aureus Mu50
cgacacgaacaacauua

SEQ ID NO: 2051958 - RNA, 15 nt, Staphylococcus aureus subsp. aureus Mu50
cgaauaccaagacca

SEQ ID NO: 2051959 - RNA, 20 nt, Staphylococcus aureus subsp. aureus Mu50
cgaauucaccuucccaguca

SEQ ID NO: 2051960 - RNA, 17 nt, Staphylococcus aureus subsp. aureus Mu50
cgaauugguaaaaaucu

SEQ ID NO: 2051961 - RNA, 18 nt, Staphylococcus aureus subsp. aureus Mu50
cgaauucuccguuaauuu

SEQ ID NO: 2051962 - RNA, 22 nt, Staphylococcus aureus subsp. aureus Mu50
cgaauucucgauuuuuuuauau

SEQ ID NO: 2051963 - RNA, 22 nt, Staphylococcus aureus subsp. aureus Mu50
cgaauguauugcuauaagaacu

SEQ ID NO: 2051964 - RNA, 18 nt, Staphylococcus aureus subsp. aureus Mu50
cgacauuuguaaauauuu

SEQ ID NO: 2051965 - RNA, 20 nt, Staphylococcus aureus subsp. aureus Mu50
cgacauguccauaauauccu

SEQ ID NO: 2051966 - RNA, 17 nt, Staphylococcus aureus subsp. aureus Mu50
cccagaugaauuuuuau

SEQ ID NO: 2051967 - RNA, 16 nt, Staphylococcus aureus subsp. aureus Mu50
cccaacgaugaaacuc

SEQ ID NO: 2051968 - RNA, 13 nt, Staphylococcus aureus subsp. aureus Mu50
ccauugucaugcc

SEQ ID NO: 2051969 - RNA, 18 nt, Staphylococcus aureus subsp. aureus Mu50
cccaagaugguauugcuu

SEQ ID NO: 2051970 - RNA, 16 nt, Staphylococcus aureus subsp. aureus Mu50
cccacaucuuuuuaaa

SEQ ID NO: 2051971 - RNA, 12 nt, Staphylococcus aureus subsp. aureus Mu50
ccauucguaaua

SEQ ID NO: 2051972 - RNA, 12 nt, Staphylococcus aureus subsp. aureus Mu50
ccauucauuaag

SEQ ID NO: 2051973 - RNA, 19 nt, Staphylococcus aureus subsp. aureus Mu50
ccauucaucgucucacuua

SEQ ID NO: 2051974 - RNA, 18 nt, Staphylococcus aureus subsp. aureus Mu50
ccauucaaaguauauacu

SEQ ID NO: 2051975 - RNA, 16 nt, Staphylococcus aureus subsp. aureus Mu50
ccauuauuauuuuuuu

SEQ ID NO: 2051976 - RNA, 13 nt, Staphylococcus aureus subsp. aureus Mu50
cccauacugauua

SEQ ID NO: 2051977 - RNA, 16 nt, Staphylococcus aureus subsp. aureus Mu50
cccauaccuacaaaua

SEQ ID NO: 2051978 - RNA, 17 nt, Staphylococcus aureus subsp. aureus Mu50
cccauaccuacaaauau

SEQ ID NO: 2051979 - RNA, 12 nt, Staphylococcus aureus subsp. aureus Mu50
cccccaacacaa

SEQ ID NO: 2051980 - RNA, 21 nt, Staphylococcus aureus subsp. aureus Mu50
ccccuagcaaaaauacuuuuu

SEQ ID NO: 2051981 - RNA, 16 nt, Staphylococcus aureus subsp. aureus Mu50
ccaugagaaaccgcuu

SEQ ID NO: 2051982 - RNA, 19 nt, Staphylococcus aureus subsp. aureus Mu50
ccaucugugucagcauuca

SEQ ID NO: 2051983 - RNA, 18 nt, Staphylococcus aureus subsp. aureus Mu50
ccaugaaaaggaaaaacu

SEQ ID NO: 2051984 - RNA, 20 nt, Staphylococcus aureus subsp. aureus Mu50
ccaucucgugaaaauaauac

SEQ ID NO: 2051985 - RNA, 20 nt, Staphylococcus aureus subsp. aureus Mu50
ccauacuucuauuuuauaau

SEQ ID NO: 2051986 - RNA, 14 nt, Staphylococcus aureus subsp. aureus Mu50
ccauacucuaacuu

SEQ ID NO: 2051987 - RNA, 24 nt, Staphylococcus aureus subsp. aureus Mu50
ccauacuucuauuuuauaauaaau

SEQ ID NO: 2051988 - RNA, 15 nt, Staphylococcus aureus subsp. aureus Mu50
ccauacuaaauaagu

SEQ ID NO: 2051989 - RNA, 20 nt, Staphylococcus aureus subsp. aureus Mu50
ccauaauuaaauaacuuuuu

SEQ ID NO: 2051990 - RNA, 17 nt, Staphylococcus aureus subsp. aureus Mu50
ccauaguaauaaaauga

SEQ ID NO: 2051991 - RNA, 19 nt, Staphylococcus aureus subsp. aureus Mu50
ccauaguaauaaaaugaug

SEQ ID NO: 2051992 - RNA, 17 nt, Staphylococcus aureus subsp. aureus Mu50
ccauauagauauuagcu

SEQ ID NO: 2051993 - RNA, 22 nt, Staphylococcus aureus subsp. aureus Mu50
ccauaaggauuuuuaauuuuau

SEQ ID NO: 2051994 - RNA, 19 nt, Staphylococcus aureus subsp. aureus Mu50
ccauaaguaaaacugcaau

SEQ ID NO: 2051995 - RNA, 21 nt, Staphylococcus aureus subsp. aureus Mu50
ccagcuuagcauagcguucaa

SEQ ID NO: 2051996 - RNA, 22 nt, Staphylococcus aureus subsp. aureus Mu50
ccagaauguguuggcuuuuuga

SEQ ID NO: 2051997 - RNA, 19 nt, Staphylococcus aureus subsp. aureus Mu50
ccacuuuuguuaaaaaaug

SEQ ID NO: 2051998 - RNA, 20 nt, Staphylococcus aureus subsp. aureus Mu50
ccagaugcaaugauaccuuu

SEQ ID NO: 2051999 - RNA, 18 nt, Staphylococcus aureus subsp. aureus Mu50
ccacggcauuuaagccug

SEQ ID NO: 2052000 - RNA, 20 nt, Staphylococcus aureus subsp. aureus Mu50
ccaccuacgcccaucaucac

SEQ ID NO: 2052001 - RNA, 14 nt, Staphylococcus aureus subsp. aureus Mu50
ccaccuuguuuaag

SEQ ID NO: 2052002 - RNA, 21 nt, Staphylococcus aureus subsp. aureus Mu50
ccaccuuguuuaaguuuuuca

SEQ ID NO: 2052003 - RNA, 20 nt, Staphylococcus aureus subsp. aureus Mu50
ccaccacauuugguggagaa

SEQ ID NO: 2052004 - RNA, 12 nt, Staphylococcus aureus subsp. aureus Mu50
ccacauuuuccu

SEQ ID NO: 2052005 - RNA, 18 nt, Staphylococcus aureus subsp. aureus Mu50
ccaccaccugugacaaau

SEQ ID NO: 2052006 - RNA, 16 nt, Staphylococcus aureus subsp. aureus Mu50
ccaccagucguaauga

SEQ ID NO: 2052007 - RNA, 13 nt, Staphylococcus aureus subsp. aureus Mu50
ccacaacauguuu

SEQ ID NO: 2052008 - RNA, 22 nt, Staphylococcus aureus subsp. aureus Mu50
ccaauucauuuuauaaaucaaa

SEQ ID NO: 2052009 - RNA, 17 nt, Staphylococcus aureus subsp. aureus Mu50
ccaauuccaauaaacaa

SEQ ID NO: 2052010 - RNA, 16 nt, Staphylococcus aureus subsp. aureus Mu50
ccaauugauuuugcug

SEQ ID NO: 2052011 - RNA, 22 nt, Staphylococcus aureus subsp. aureus Mu50
ccaauuaaaucgauuaagaaug

SEQ ID NO: 2052012 - RNA, 12 nt, Staphylococcus aureus subsp. aureus Mu50
ccaauguguuua

SEQ ID NO: 2052013 - RNA, 21 nt, Staphylococcus aureus subsp. aureus Mu50
ccaauaccgaauaauuuugau

SEQ ID NO: 2052014 - RNA, 16 nt, Staphylococcus aureus subsp. aureus Mu50
ccaauaucauauuuga

SEQ ID NO: 2052015 - RNA, 17 nt, Staphylococcus aureus subsp. aureus Mu50
ccaauaucauauuugaa

SEQ ID NO: 2052016 - RNA, 14 nt, Staphylococcus aureus subsp. aureus Mu50
ccaauaucauauuu

SEQ ID NO: 2052017 - RNA, 21 nt, Staphylococcus aureus subsp. aureus Mu50
ccaauauauucaccuacaaca

SEQ ID NO: 2052018 - RNA, 20 nt, Staphylococcus aureus subsp. aureus Mu50
ccaauacagaacuuuaauaa

SEQ ID NO: 2052019 - RNA, 14 nt, Staphylococcus aureus subsp. aureus Mu50
ccaauaauaaauca

SEQ ID NO: 2052020 - RNA, 23 nt, Staphylococcus aureus subsp. aureus Mu50
ccaauaaaaugucagcaacuucu

SEQ ID NO: 2052021 - RNA, 19 nt, Staphylococcus aureus subsp. aureus Mu50
ccaauaaaaugcaauuuuu

SEQ ID NO: 2052022 - RNA, 14 nt, Staphylococcus aureus subsp. aureus Mu50
ccaauaaaauguca

SEQ ID NO: 2052023 - RNA, 18 nt, Staphylococcus aureus subsp. aureus Mu50
ccaaucaucauuaaaucu

SEQ ID NO: 2052024 - RNA, 21 nt, Staphylococcus aureus subsp. aureus Mu50
ccaaucgauuuuauaucuuuc

SEQ ID NO: 2052025 - RNA, 10 nt, Staphylococcus aureus subsp. aureus Mu50
ccaaugaauc

SEQ ID NO: 2052026 - RNA, 16 nt, Staphylococcus aureus subsp. aureus Mu50
ccaagauuaugacaac

SEQ ID NO: 2052027 - RNA, 20 nt, Staphylococcus aureus subsp. aureus Mu50
ccaagauaaaucaucauucu

SEQ ID NO: 2052028 - RNA, 21 nt, Staphylococcus aureus subsp. aureus Mu50
ccaagaagacauuggauuacu

SEQ ID NO: 2052029 - RNA, 17 nt, Staphylococcus aureus subsp. aureus Mu50
ccaaguccaauuccaau

SEQ ID NO: 2052030 - RNA, 19 nt, Staphylococcus aureus subsp. aureus Mu50
ccaaguacgcaauuuaaua

SEQ ID NO: 2052031 - RNA, 17 nt, Staphylococcus aureus subsp. aureus Mu50
ccaauaaaacuaugugu

SEQ ID NO: 2052032 - RNA, 19 nt, Staphylococcus aureus subsp. aureus Mu50
ccaaguuuugcacgcauac

SEQ ID NO: 2052033 - RNA, 21 nt, Staphylococcus aureus subsp. aureus Mu50
ccaacauauaaaaaauuauua

SEQ ID NO: 2052034 - RNA, 17 nt, Staphylococcus aureus subsp. aureus Mu50
ccaacauguaacaaaau

SEQ ID NO: 2052035 - RNA, 13 nt, Staphylococcus aureus subsp. aureus Mu50
ccaacacauaaau

SEQ ID NO: 2052036 - RNA, 16 nt, Staphylococcus aureus subsp. aureus Mu50
ccaacaccuaauauuu

SEQ ID NO: 2052037 - RNA, 22 nt, Staphylococcus aureus subsp. aureus Mu50
ccaacacagagaaauucgaaaa

SEQ ID NO: 2052038 - RNA, 22 nt, Staphylococcus aureus subsp. aureus Mu50
ccaacacagagaauuucgaaaa

SEQ ID NO: 2052039 - RNA, 21 nt, Staphylococcus aureus subsp. aureus Mu50
ccaacaauagguacaacuaaa

SEQ ID NO: 2052040 - RNA, 22 nt, Staphylococcus aureus subsp. aureus Mu50
ccaaaugugguggguauauaau

SEQ ID NO: 2052041 - RNA, 23 nt, Staphylococcus aureus subsp. aureus Mu50
ccaaaugugguggguauauaauu

SEQ ID NO: 2052042 - RNA, 22 nt, Staphylococcus aureus subsp. aureus Mu50
ccaaauuuaggcaugucaaauc

SEQ ID NO: 2052043 - RNA, 14 nt, Staphylococcus aureus subsp. aureus Mu50
ccaacuugcacauu

SEQ ID NO: 2052044 - RNA, 20 nt, Staphylococcus aureus subsp. aureus Mu50
ccaacugucgguucaucuaa

SEQ ID NO: 2052045 - RNA, 17 nt, Staphylococcus aureus subsp. aureus Mu50
ccaaauauuuuaucugu

SEQ ID NO: 2052046 - RNA, 20 nt, Staphylococcus aureus subsp. aureus Mu50
ccaaauauaguaauuguuau

SEQ ID NO: 2052047 - RNA, 17 nt, Staphylococcus aureus subsp. aureus Mu50
ccaaaucggaauaaaau

SEQ ID NO: 2052048 - RNA, 19 nt, Staphylococcus aureus subsp. aureus Mu50
ccaaaucggaauaaaauaa

SEQ ID NO: 2052049 - RNA, 21 nt, Staphylococcus aureus subsp. aureus Mu50
ccaaagaaagcuaauaucaau

SEQ ID NO: 2052050 - RNA, 16 nt, Staphylococcus aureus subsp. aureus Mu50
ccaaagcugaauuuua

SEQ ID NO: 2052051 - RNA, 21 nt, Staphylococcus aureus subsp. aureus Mu50
ccaaaaauuagccgaaaaaca

SEQ ID NO: 2052052 - RNA, 16 nt, Staphylococcus aureus subsp. aureus Mu50
ccaaaacauuuuguga

SEQ ID NO: 2052053 - RNA, 17 nt, Staphylococcus aureus subsp. aureus Mu50
ccaaaaguuauauaaau

SEQ ID NO: 2052054 - RNA, 18 nt, Staphylococcus aureus subsp. aureus Mu50
ccaaaaugguuaaaaucg

SEQ ID NO: 2052055 - RNA, 21 nt, Staphylococcus aureus subsp. aureus Mu50
ccaaacaaccugugauaaaaa

SEQ ID NO: 2052056 - RNA, 22 nt, Staphylococcus aureus subsp. aureus Mu50
ccaaacaaccugugauaaaaau

SEQ ID NO: 2052057 - RNA, 19 nt, Staphylococcus aureus subsp. aureus Mu50
cagguaaugcaaguuggcg

SEQ ID NO: 2052058 - RNA, 22 nt, Staphylococcus aureus subsp. aureus Mu50
caguaaucaugcauucuaugau

SEQ ID NO: 2052059 - RNA, 16 nt, Staphylococcus aureus subsp. aureus Mu50
caguaaucaaaguauc

SEQ ID NO: 2052060 - RNA, 18 nt, Staphylococcus aureus subsp. aureus Mu50
caguaaauugauucuuug

SEQ ID NO: 2052061 - RNA, 17 nt, Staphylococcus aureus subsp. aureus Mu50
caguaacaauaacaccu

SEQ ID NO: 2052062 - RNA, 13 nt, Staphylococcus aureus subsp. aureus Mu50
cagguuaacauuu

SEQ ID NO: 2052063 - RNA, 14 nt, Staphylococcus aureus subsp. aureus Mu50
caguacaaauaaca

SEQ ID NO: 2052064 - RNA, 16 nt, Staphylococcus aureus subsp. aureus Mu50
caguaggacauauaaa

SEQ ID NO: 2052065 - RNA, 22 nt, Staphylococcus aureus subsp. aureus Mu50
caguacgguuauuuaauaaugc

SEQ ID NO: 2052066 - RNA, 17 nt, Staphylococcus aureus subsp. aureus Mu50
caguauguggauacaaa

SEQ ID NO: 2052067 - RNA, 17 nt, Staphylococcus aureus subsp. aureus Mu50
caguuuccauaaauaaa

SEQ ID NO: 2052068 - RNA, 18 nt, Staphylococcus aureus subsp. aureus Mu50
caguuuuacuauaaugau

SEQ ID NO: 2052069 - RNA, 22 nt, Staphylococcus aureus subsp. aureus Mu50
cauaaaauuaacuuaaaauuua

SEQ ID NO: 2052070 - RNA, 16 nt, Staphylococcus aureus subsp. aureus Mu50
cauaaaauuucugcuu

SEQ ID NO: 2052071 - RNA, 16 nt, Staphylococcus aureus subsp. aureus Mu50
cauaaaagacagaaau

SEQ ID NO: 2052072 - RNA, 12 nt, Staphylococcus aureus subsp. aureus Mu50
caguuuuuauau

SEQ ID NO: 2052073 - RNA, 14 nt, Staphylococcus aureus subsp. aureus Mu50
cauaaaaaaagaac

SEQ ID NO: 2052074 - RNA, 22 nt, Staphylococcus aureus subsp. aureus Mu50
cauaaucauuaguuaugugcua

SEQ ID NO: 2052075 - RNA, 14 nt, Staphylococcus aureus subsp. aureus Mu50
cauaauauauuaac

SEQ ID NO: 2052076 - RNA, 19 nt, Staphylococcus aureus subsp. aureus Mu50
cauaauauuucuuaccauu

SEQ ID NO: 2052077 - RNA, 21 nt, Staphylococcus aureus subsp. aureus Mu50
cauaauaucuuacuacuuaau

SEQ ID NO: 2052078 - RNA, 15 nt, Staphylococcus aureus subsp. aureus Mu50
cauaaucaagucugc

SEQ ID NO: 2052079 - RNA, 16 nt, Staphylococcus aureus subsp. aureus Mu50
cauaagucacauuuau

SEQ ID NO: 2052080 - RNA, 13 nt, Staphylococcus aureus subsp. aureus Mu50
cauaauaaaaagg

SEQ ID NO: 2052081 - RNA, 15 nt, Staphylococcus aureus subsp. aureus Mu50
cauaagaaaauacua

SEQ ID NO: 2052082 - RNA, 17 nt, Staphylococcus aureus subsp. aureus Mu50
cauaaagugcguuuuuc

SEQ ID NO: 2052083 - RNA, 19 nt, Staphylococcus aureus subsp. aureus Mu50
cauaaagugcguuuuucga

SEQ ID NO: 2052084 - RNA, 16 nt, Staphylococcus aureus subsp. aureus Mu50
cauaaagcuguuuauu

SEQ ID NO: 2052085 - RNA, 14 nt, Staphylococcus aureus subsp. aureus Mu50
cauaaaguuuauuu

SEQ ID NO: 2052086 - RNA, 16 nt, Staphylococcus aureus subsp. aureus Mu50
cauaaaguuuauuuau

SEQ ID NO: 2052087 - RNA, 17 nt, Staphylococcus aureus subsp. aureus Mu50
cauaaggucuuggacua

SEQ ID NO: 2052088 - RNA, 18 nt, Staphylococcus aureus subsp. aureus Mu50
cauaaggacucuguuuaa

SEQ ID NO: 2052089 - RNA, 18 nt, Staphylococcus aureus subsp. aureus Mu50
cagugaucuuuuuuauau

SEQ ID NO: 2052090 - RNA, 23 nt, Staphylococcus aureus subsp. aureus Mu50
cagugcuauguauuuuucuuaau

SEQ ID NO: 2052091 - RNA, 15 nt, Staphylococcus aureus subsp. aureus Mu50
cagugccuugcugga

SEQ ID NO: 2052092 - RNA, 18 nt, Staphylococcus aureus subsp. aureus Mu50
caguuauuuuaauaacga

SEQ ID NO: 2052093 - RNA, 12 nt, Staphylococcus aureus subsp. aureus Mu50
caguuagugcuu

SEQ ID NO: 2052094 - RNA, 14 nt, Staphylococcus aureus subsp. aureus Mu50
caguuaauaauuuu

SEQ ID NO: 2052095 - RNA, 15 nt, Staphylococcus aureus subsp. aureus Mu50
caguuacuucaguuu

SEQ ID NO: 2052096 - RNA, 23 nt, Staphylococcus aureus subsp. aureus Mu50
caggcgaaccgaagcgcagugac

SEQ ID NO: 2052097 - RNA, 14 nt, Staphylococcus aureus subsp. aureus Mu50
caggcaaugcaagu

SEQ ID NO: 2052098 - RNA, 18 nt, Staphylococcus aureus subsp. aureus Mu50
caggcaaugcgaguuggg

SEQ ID NO: 2052099 - RNA, 14 nt, Staphylococcus aureus subsp. aureus Mu50
cagcuuuaauaaua

SEQ ID NO: 2052100 - RNA, 17 nt, Staphylococcus aureus subsp. aureus Mu50
cagcuuuaauaauauga

SEQ ID NO: 2052101 - RNA, 19 nt, Staphylococcus aureus subsp. aureus Mu50
cagcuucuaaguaauauaa

SEQ ID NO: 2052102 - RNA, 16 nt, Staphylococcus aureus subsp. aureus Mu50
cagcuacaaauaauga

SEQ ID NO: 2052103 - RNA, 19 nt, Staphylococcus aureus subsp. aureus Mu50
cagcucuuaaaucacuagc

SEQ ID NO: 2052104 - RNA, 13 nt, Staphylococcus aureus subsp. aureus Mu50
cagcuaaauauuu

SEQ ID NO: 2052105 - RNA, 15 nt, Staphylococcus aureus subsp. aureus Mu50
cagcuaaaaaguaua

SEQ ID NO: 2052106 - RNA, 21 nt, Staphylococcus aureus subsp. aureus Mu50
cagcuaaaaaguauacuaaac

SEQ ID NO: 2052107 - RNA, 21 nt, Staphylococcus aureus subsp. aureus Mu50
cagcuaaugucaugaaaauaa

SEQ ID NO: 2052108 - RNA, 12 nt, Staphylococcus aureus subsp. aureus Mu50
cagcuaacaaaa

SEQ ID NO: 2052109 - RNA, 19 nt, Staphylococcus aureus subsp. aureus Mu50
cauguaaugcuuaaaaaca

SEQ ID NO: 2052110 - RNA, 21 nt, Staphylococcus aureus subsp. aureus Mu50
cauguaaugcuuaaaaacaau

SEQ ID NO: 2052111 - RNA, 16 nt, Staphylococcus aureus subsp. aureus Mu50
cauguaaugcuuaaaa

SEQ ID NO: 2052112 - RNA, 18 nt, Staphylococcus aureus subsp. aureus Mu50
cauguaccacauuuuccu

SEQ ID NO: 2052113 - RNA, 15 nt, Staphylococcus aureus subsp. aureus Mu50
cauguacauugguuu

SEQ ID NO: 2052114 - RNA, 21 nt, Staphylococcus aureus subsp. aureus Mu50
cauguacguuuuuuuaaauac

SEQ ID NO: 2052115 - RNA, 13 nt, Staphylococcus aureus subsp. aureus Mu50
caugguuuaauuc

SEQ ID NO: 2052116 - RNA, 12 nt, Staphylococcus aureus subsp. aureus Mu50
cauguauaaaag

SEQ ID NO: 2052117 - RNA, 19 nt, Staphylococcus aureus subsp. aureus Mu50
cauguauaaaagauauaaa

SEQ ID NO: 2052118 - RNA, 16 nt, Staphylococcus aureus subsp. aureus Mu50
cauguauaucuaauac

SEQ ID NO: 2052119 - RNA, 15 nt, Staphylococcus aureus subsp. aureus Mu50
caugucaauuuuuuc

SEQ ID NO: 2052120 - RNA, 17 nt, Staphylococcus aureus subsp. aureus Mu50
caugcuuaauuuaugug

SEQ ID NO: 2052121 - RNA, 19 nt, Staphylococcus aureus subsp. aureus Mu50
caugauacugaaauuucau

SEQ ID NO: 2052122 - RNA, 21 nt, Staphylococcus aureus subsp. aureus Mu50
caugagauuauuuuuuuaaau

SEQ ID NO: 2052123 - RNA, 17 nt, Staphylococcus aureus subsp. aureus Mu50
caugauuuacuaaugcu

SEQ ID NO: 2052124 - RNA, 16 nt, Staphylococcus aureus subsp. aureus Mu50
caugauugaaauccuu

SEQ ID NO: 2052125 - RNA, 23 nt, Staphylococcus aureus subsp. aureus Mu50
caugaauuuuaauauauuuggag

SEQ ID NO: 2052126 - RNA, 18 nt, Staphylococcus aureus subsp. aureus Mu50
caugaauuuuaauauauu

SEQ ID NO: 2052127 - RNA, 15 nt, Staphylococcus aureus subsp. aureus Mu50
caugacagcaucauc

SEQ ID NO: 2052128 - RNA, 17 nt, Staphylococcus aureus subsp. aureus Mu50
caugacucacuaaucuc

SEQ ID NO: 2052129 - RNA, 20 nt, Staphylococcus aureus subsp. aureus Mu50
caugaaucaacaauuuaaac

SEQ ID NO: 2052130 - RNA, 21 nt, Staphylococcus aureus subsp. aureus Mu50
caugaaucaacaauuuaaacg

SEQ ID NO: 2052131 - RNA, 18 nt, Staphylococcus aureus subsp. aureus Mu50
caugaaucgcauuuaaau

SEQ ID NO: 2052132 - RNA, 13 nt, Staphylococcus aureus subsp. aureus Mu50
caucucuauuuuu

SEQ ID NO: 2052133 - RNA, 14 nt, Staphylococcus aureus subsp. aureus Mu50
caucucuaugucuc

SEQ ID NO: 2052134 - RNA, 15 nt, Staphylococcus aureus subsp. aureus Mu50
cauuucguauauaua

SEQ ID NO: 2052135 - RNA, 20 nt, Staphylococcus aureus subsp. aureus Mu50
cauuucaugugucacaauga

SEQ ID NO: 2052136 - RNA, 13 nt, Staphylococcus aureus subsp. aureus Mu50
cauuucagaaaua

SEQ ID NO: 2052137 - RNA, 16 nt, Staphylococcus aureus subsp. aureus Mu50
cauuucagaaauacau

SEQ ID NO: 2052138 - RNA, 16 nt, Staphylococcus aureus subsp. aureus Mu50
cauuucaauauuaaaa

SEQ ID NO: 2052139 - RNA, 15 nt, Staphylococcus aureus subsp. aureus Mu50
cauuuaucuaacaau

SEQ ID NO: 2052140 - RNA, 15 nt, Staphylococcus aureus subsp. aureus Mu50
cauuuaguuaaauac

SEQ ID NO: 2052141 - RNA, 12 nt, Staphylococcus aureus subsp. aureus Mu50
cauuuauuuuca

SEQ ID NO: 2052142 - RNA, 22 nt, Staphylococcus aureus subsp. aureus Mu50
cauuuauuuucaauaaauaaac

SEQ ID NO: 2052143 - RNA, 23 nt, Staphylococcus aureus subsp. aureus Mu50
cauuuauuuucuuuggugaaagu

SEQ ID NO: 2052144 - RNA, 13 nt, Staphylococcus aureus subsp. aureus Mu50
cauuguauaaaaa

SEQ ID NO: 2052145 - RNA, 17 nt, Staphylococcus aureus subsp. aureus Mu50
cauugucaugccuucau

SEQ ID NO: 2052146 - RNA, 14 nt, Staphylococcus aureus subsp. aureus Mu50
cauuguaauaccaa

SEQ ID NO: 2052147 - RNA, 22 nt, Staphylococcus aureus subsp. aureus Mu50
cauuguaaauauaguaauaaaa

SEQ ID NO: 2052148 - RNA, 13 nt, Staphylococcus aureus subsp. aureus Mu50
cauuguaaaaugu

SEQ ID NO: 2052149 - RNA, 15 nt, Staphylococcus aureus subsp. aureus Mu50
cauugguuucaucau

SEQ ID NO: 2052150 - RNA, 19 nt, Staphylococcus aureus subsp. aureus Mu50
cauucuuuuucucaaugug

SEQ ID NO: 2052151 - RNA, 21 nt, Staphylococcus aureus subsp. aureus Mu50
cauucuuuuucucaaugugag

SEQ ID NO: 2052152 - RNA, 15 nt, Staphylococcus aureus subsp. aureus Mu50
cauucuuuauagaaa

SEQ ID NO: 2052153 - RNA, 14 nt, Staphylococcus aureus subsp. aureus Mu50
cauuacuacuuuau

SEQ ID NO: 2052154 - RNA, 18 nt, Staphylococcus aureus subsp. aureus Mu50
cauuacuaucuucaucau

SEQ ID NO: 2052155 - RNA, 19 nt, Staphylococcus aureus subsp. aureus Mu50
cauuacuaucuucaucaua

SEQ ID NO: 2052156 - RNA, 18 nt, Staphylococcus aureus subsp. aureus Mu50
cauuauaauggacuaauu

SEQ ID NO: 2052157 - RNA, 21 nt, Staphylococcus aureus subsp. aureus Mu50
cauuauaauggacuaauuuau

SEQ ID NO: 2052158 - RNA, 22 nt, Staphylococcus aureus subsp. aureus Mu50
cauguuccccauuaauuaacaa

SEQ ID NO: 2052159 - RNA, 16 nt, Staphylococcus aureus subsp. aureus Mu50
caugugucuuccaauc

SEQ ID NO: 2052160 - RNA, 12 nt, Staphylococcus aureus subsp. aureus Mu50
cauuauuaagug

SEQ ID NO: 2052161 - RNA, 20 nt, Staphylococcus aureus subsp. aureus Mu50
cauuaucaagaacuuuaaaa

SEQ ID NO: 2052162 - RNA, 13 nt, Staphylococcus aureus subsp. aureus Mu50
cauuauuaaauag

SEQ ID NO: 2052163 - RNA, 15 nt, Staphylococcus aureus subsp. aureus Mu50
cauuauuuagaauuc

SEQ ID NO: 2052164 - RNA, 17 nt, Staphylococcus aureus subsp. aureus Mu50
cauuauuuauauuuaga

SEQ ID NO: 2052165 - RNA, 14 nt, Staphylococcus aureus subsp. aureus Mu50
cauucaauguuuaa

SEQ ID NO: 2052166 - RNA, 18 nt, Staphylococcus aureus subsp. aureus Mu50
cauuauuugauaaauaaa

SEQ ID NO: 2052167 - RNA, 16 nt, Staphylococcus aureus subsp. aureus Mu50
cauuauuugcugcuaa

SEQ ID NO: 2052168 - RNA, 12 nt, Staphylococcus aureus subsp. aureus Mu50
cauucaaauaaa

SEQ ID NO: 2052169 - RNA, 21 nt, Staphylococcus aureus subsp. aureus Mu50
cauucauuuaguuaaauacaa

SEQ ID NO: 2052170 - RNA, 20 nt, Staphylococcus aureus subsp. aureus Mu50
cauucauuaagcuuuguuug

SEQ ID NO: 2052171 - RNA, 12 nt, Staphylococcus aureus subsp. aureus Mu50
cauuccaaaaau

SEQ ID NO: 2052172 - RNA, 22 nt, Staphylococcus aureus subsp. aureus Mu50
cauuccaaaguaccaucucuau

SEQ ID NO: 2052173 - RNA, 14 nt, Staphylococcus aureus subsp. aureus Mu50
cauucacuacuuuu

SEQ ID NO: 2052174 - RNA, 17 nt, Staphylococcus aureus subsp. aureus Mu50
cauucauaaaugacuga

SEQ ID NO: 2052175 - RNA, 21 nt, Staphylococcus aureus subsp. aureus Mu50
cauucauaccgaagaaacuaa

SEQ ID NO: 2052176 - RNA, 18 nt, Staphylococcus aureus subsp. aureus Mu50
cauagaugcauaaaaacc

SEQ ID NO: 2052177 - RNA, 18 nt, Staphylococcus aureus subsp. aureus Mu50
cauagaugacgaucuaua

SEQ ID NO: 2052178 - RNA, 15 nt, Staphylococcus aureus subsp. aureus Mu50
cauaauuaaauaacu

SEQ ID NO: 2052179 - RNA, 14 nt, Staphylococcus aureus subsp. aureus Mu50
cauaauuaauaaca

SEQ ID NO: 2052180 - RNA, 18 nt, Staphylococcus aureus subsp. aureus Mu50
cauacaaauuuuuuuuau

SEQ ID NO: 2052181 - RNA, 13 nt, Staphylococcus aureus subsp. aureus Mu50
cauacaaauuuuu

SEQ ID NO: 2052182 - RNA, 15 nt, Staphylococcus aureus subsp. aureus Mu50
cauaauuuaaaagau

SEQ ID NO: 2052183 - RNA, 20 nt, Staphylococcus aureus subsp. aureus Mu50
cauaauguaagcgaauacaa

SEQ ID NO: 2052184 - RNA, 14 nt, Staphylococcus aureus subsp. aureus Mu50
cauaauucuagaga

SEQ ID NO: 2052185 - RNA, 16 nt, Staphylococcus aureus subsp. aureus Mu50
cauagacacuuaacuu

SEQ ID NO: 2052186 - RNA, 21 nt, Staphylococcus aureus subsp. aureus Mu50
cauaggcgcuuuuuuuuauaa

SEQ ID NO: 2052187 - RNA, 19 nt, Staphylococcus aureus subsp. aureus Mu50
cauaggcuugccaauguga

SEQ ID NO: 2052188 - RNA, 15 nt, Staphylococcus aureus subsp. aureus Mu50
cauaggcuugccaau

SEQ ID NO: 2052189 - RNA, 16 nt, Staphylococcus aureus subsp. aureus Mu50
cauagcuaaauaaauu

SEQ ID NO: 2052190 - RNA, 18 nt, Staphylococcus aureus subsp. aureus Mu50
cauagcucuucuuuuucu

SEQ ID NO: 2052191 - RNA, 23 nt, Staphylococcus aureus subsp. aureus Mu50
cauaggcgcuguuccaaauucau

SEQ ID NO: 2052192 - RNA, 17 nt, Staphylococcus aureus subsp. aureus Mu50
cauauacucuaaaaaag

SEQ ID NO: 2052193 - RNA, 17 nt, Staphylococcus aureus subsp. aureus Mu50
cauauacgacauuuuua

SEQ ID NO: 2052194 - RNA, 19 nt, Staphylococcus aureus subsp. aureus Mu50
cauauacgacauuuuuaga

SEQ ID NO: 2052195 - RNA, 16 nt, Staphylococcus aureus subsp. aureus Mu50
cauauacucuaaaaaa

SEQ ID NO: 2052196 - RNA, 14 nt, Staphylococcus aureus subsp. aureus Mu50
cauauaaacaacug

SEQ ID NO: 2052197 - RNA, 12 nt, Staphylococcus aureus subsp. aureus Mu50
cauauaaaaacc

SEQ ID NO: 2052198 - RNA, 16 nt, Staphylococcus aureus subsp. aureus Mu50
cauagugguguuuaua

SEQ ID NO: 2052199 - RNA, 16 nt, Staphylococcus aureus subsp. aureus Mu50
cauaguuauuaaaucu

SEQ ID NO: 2052200 - RNA, 20 nt, Staphylococcus aureus subsp. aureus Mu50
cauauucauaauaucgauga

SEQ ID NO: 2052201 - RNA, 11 nt, Staphylococcus aureus subsp. aureus Mu50
cauauuuauau

SEQ ID NO: 2052202 - RNA, 13 nt, Staphylococcus aureus subsp. aureus Mu50
cauauuuauggug

SEQ ID NO: 2052203 - RNA, 22 nt, Staphylococcus aureus subsp. aureus Mu50
caucaaucgcuuuagcaauuga

SEQ ID NO: 2052204 - RNA, 23 nt, Staphylococcus aureus subsp. aureus Mu50
caucaaucccuuuuagcauaauu

SEQ ID NO: 2052205 - RNA, 22 nt, Staphylococcus aureus subsp. aureus Mu50
caucaaugagcaagucuucuaa

SEQ ID NO: 2052206 - RNA, 14 nt, Staphylococcus aureus subsp. aureus Mu50
caucaauaucaaau

SEQ ID NO: 2052207 - RNA, 23 nt, Staphylococcus aureus subsp. aureus Mu50
caucacgugauaaugacucaagu

SEQ ID NO: 2052208 - RNA, 19 nt, Staphylococcus aureus subsp. aureus Mu50
caucaauuuaguccuucuu

SEQ ID NO: 2052209 - RNA, 12 nt, Staphylococcus aureus subsp. aureus Mu50
caucaauuucua

SEQ ID NO: 2052210 - RNA, 13 nt, Staphylococcus aureus subsp. aureus Mu50
caucacuuuuuaa

SEQ ID NO: 2052211 - RNA, 14 nt, Staphylococcus aureus subsp. aureus Mu50
caucacugcauaua

SEQ ID NO: 2052212 - RNA, 18 nt, Staphylococcus aureus subsp. aureus Mu50
caucacucgcaaucgaga

SEQ ID NO: 2052213 - RNA, 22 nt, Staphylococcus aureus subsp. aureus Mu50
caucuccaaaggccaugagcuc

SEQ ID NO: 2052214 - RNA, 22 nt, Staphylococcus aureus subsp. aureus Mu50
caucuacaacgccaauagguuc

SEQ ID NO: 2052215 - RNA, 23 nt, Staphylococcus aureus subsp. aureus Mu50
caucguaaaaaacaaaaaaaccg

SEQ ID NO: 2052216 - RNA, 15 nt, Staphylococcus aureus subsp. aureus Mu50
caucgaucuaaauau

SEQ ID NO: 2052217 - RNA, 20 nt, Staphylococcus aureus subsp. aureus Mu50
caucgauuuaucauuauuug

SEQ ID NO: 2052218 - RNA, 14 nt, Staphylococcus aureus subsp. aureus Mu50
cauccccagccauu

SEQ ID NO: 2052219 - RNA, 13 nt, Staphylococcus aureus subsp. aureus Mu50
caucauuaaaauc

SEQ ID NO: 2052220 - RNA, 16 nt, Staphylococcus aureus subsp. aureus Mu50
caucauguuuaucuac

SEQ ID NO: 2052221 - RNA, 19 nt, Staphylococcus aureus subsp. aureus Mu50
caucauuaguuuuuaaaau

SEQ ID NO: 2052222 - RNA, 14 nt, Staphylococcus aureus subsp. aureus Mu50
cauccaauuauguu

SEQ ID NO: 2052223 - RNA, 19 nt, Staphylococcus aureus subsp. aureus Mu50
cauccaauuauguuuaucu

SEQ ID NO: 2052224 - RNA, 21 nt, Staphylococcus aureus subsp. aureus Mu50
cauccaauuauguuuaucuac

SEQ ID NO: 2052225 - RNA, 13 nt, Staphylococcus aureus subsp. aureus Mu50
cauccauacaaau

SEQ ID NO: 2052226 - RNA, 14 nt, Staphylococcus aureus subsp. aureus Mu50
cauccauacaaauc

SEQ ID NO: 2052227 - RNA, 15 nt, Staphylococcus aureus subsp. aureus Mu50
caaaaucuuuacuug

SEQ ID NO: 2052228 - RNA, 23 nt, Staphylococcus aureus subsp. aureus Mu50
caaaaugccaagaagacauugga

SEQ ID NO: 2052229 - RNA, 15 nt, Staphylococcus aureus subsp. aureus Mu50
caaaaugguaucaau

SEQ ID NO: 2052230 - RNA, 22 nt, Staphylococcus aureus subsp. aureus Mu50
caaaaugguuaaaaucgcagca

SEQ ID NO: 2052231 - RNA, 18 nt, Staphylococcus aureus subsp. aureus Mu50
caaaauguuuaacaauaa

SEQ ID NO: 2052232 - RNA, 22 nt, Staphylococcus aureus subsp. aureus Mu50
caaacaacaucacuuuaggguu

SEQ ID NO: 2052233 - RNA, 12 nt, Staphylococcus aureus subsp. aureus Mu50
caaacaauacag

SEQ ID NO: 2052234 - RNA, 12 nt, Staphylococcus aureus subsp. aureus Mu50
caaacaauacau

SEQ ID NO: 2052235 - RNA, 23 nt, Staphylococcus aureus subsp. aureus Mu50
caaaauuugaaauauaccaacca

SEQ ID NO: 2052236 - RNA, 12 nt, Staphylococcus aureus subsp. aureus Mu50
caaaauuuucua

SEQ ID NO: 2052237 - RNA, 17 nt, Staphylococcus aureus subsp. aureus Mu50
caaaauuauguaaaaaa

SEQ ID NO: 2052238 - RNA, 19 nt, Staphylococcus aureus subsp. aureus Mu50
caaaauuauguaaaaaaua

SEQ ID NO: 2052239 - RNA, 12 nt, Staphylococcus aureus subsp. aureus Mu50
caaaauugucuc

SEQ ID NO: 2052240 - RNA, 18 nt, Staphylococcus aureus subsp. aureus Mu50
caaaauaauagcaguuuc

SEQ ID NO: 2052241 - RNA, 15 nt, Staphylococcus aureus subsp. aureus Mu50
caaaauaacauguuu

SEQ ID NO: 2052242 - RNA, 24 nt, Staphylococcus aureus subsp. aureus Mu50
caaaauacucaacacgauagucau

SEQ ID NO: 2052243 - RNA, 13 nt, Staphylococcus aureus subsp. aureus Mu50
caaaauaguaaag

SEQ ID NO: 2052244 - RNA, 12 nt, Staphylococcus aureus subsp. aureus Mu50
caaaauauaaaa

SEQ ID NO: 2052245 - RNA, 14 nt, Staphylococcus aureus subsp. aureus Mu50
caaaauauaaaauc

SEQ ID NO: 2052246 - RNA, 15 nt, Staphylococcus aureus subsp. aureus Mu50
caaaauauacuaaau

SEQ ID NO: 2052247 - RNA, 20 nt, Staphylococcus aureus subsp. aureus Mu50
caaaauauacuaaauuugaa

SEQ ID NO: 2052248 - RNA, 21 nt, Staphylococcus aureus subsp. aureus Mu50
caaaaucaccuuuuuuaacuu

SEQ ID NO: 2052249 - RNA, 14 nt, Staphylococcus aureus subsp. aureus Mu50
caaaaguaugauuu

SEQ ID NO: 2052250 - RNA, 21 nt, Staphylococcus aureus subsp. aureus Mu50
caaaaguuauauaaauuugua

SEQ ID NO: 2052251 - RNA, 14 nt, Staphylococcus aureus subsp. aureus Mu50
auuuuucaaauguu

SEQ ID NO: 2052252 - RNA, 13 nt, Staphylococcus aureus subsp. aureus Mu50
auuuuuauuuaua

SEQ ID NO: 2052253 - RNA, 20 nt, Staphylococcus aureus subsp. aureus Mu50
auuuuuaucccacuccuuau

SEQ ID NO: 2052254 - RNA, 20 nt, Staphylococcus aureus subsp. aureus Mu50
caaacuaaaaggucaucuga

SEQ ID NO: 2052255 - RNA, 12 nt, Staphylococcus aureus subsp. aureus Mu50
caaacauuuguu

SEQ ID NO: 2052256 - RNA, 20 nt, Staphylococcus aureus subsp. aureus Mu50
caaacauuacccuuuaaacu

SEQ ID NO: 2052257 - RNA, 21 nt, Staphylococcus aureus subsp. aureus Mu50
caaacauuaaucuauauaaaa

SEQ ID NO: 2052258 - RNA, 14 nt, Staphylococcus aureus subsp. aureus Mu50
caaaccaccaaaaa

SEQ ID NO: 2052259 - RNA, 13 nt, Staphylococcus aureus subsp. aureus Mu50
caaaccaccaaaa

SEQ ID NO: 2052260 - RNA, 23 nt, Staphylococcus aureus subsp. aureus Mu50
caaacauuucgguaugauauuuc

SEQ ID NO: 2052261 - RNA, 22 nt, Staphylococcus aureus subsp. aureus Mu50
caaacccuuuaaacauauuuac

SEQ ID NO: 2052262 - RNA, 18 nt, Staphylococcus aureus subsp. aureus Mu50
caaaccauaaguaaaacu

SEQ ID NO: 2052263 - RNA, 20 nt, Staphylococcus aureus subsp. aureus Mu50
caaacauagauacaaaguac

SEQ ID NO: 2052264 - RNA, 18 nt, Staphylococcus aureus subsp. aureus Mu50
caaagcuugauuuaacaa

SEQ ID NO: 2052265 - RNA, 19 nt, Staphylococcus aureus subsp. aureus Mu50
caaagcuaaguuugaagga

SEQ ID NO: 2052266 - RNA, 22 nt, Staphylococcus aureus subsp. aureus Mu50
caaagcgauaaaguaugaguga

SEQ ID NO: 2052267 - RNA, 17 nt, Staphylococcus aureus subsp. aureus Mu50
caaagacuaaaaagaag

SEQ ID NO: 2052268 - RNA, 14 nt, Staphylococcus aureus subsp. aureus Mu50
caaauauuucuaaa

SEQ ID NO: 2052269 - RNA, 15 nt, Staphylococcus aureus subsp. aureus Mu50
caaauagacaccaaa

SEQ ID NO: 2052270 - RNA, 18 nt, Staphylococcus aureus subsp. aureus Mu50
caaauagacaccaaaaaa

SEQ ID NO: 2052271 - RNA, 14 nt, Staphylococcus aureus subsp. aureus Mu50
caaauauauuugua

SEQ ID NO: 2052272 - RNA, 18 nt, Staphylococcus aureus subsp. aureus Mu50
caaauaucaguaauaaua

SEQ ID NO: 2052273 - RNA, 19 nt, Staphylococcus aureus subsp. aureus Mu50
caaauaaauaagugauaaa

SEQ ID NO: 2052274 - RNA, 14 nt, Staphylococcus aureus subsp. aureus Mu50
caaauaaaucaaac

SEQ ID NO: 2052275 - RNA, 15 nt, Staphylococcus aureus subsp. aureus Mu50
caaauaacguuaaua

SEQ ID NO: 2052276 - RNA, 15 nt, Staphylococcus aureus subsp. aureus Mu50
caaauaacaaacauu

SEQ ID NO: 2052277 - RNA, 17 nt, Staphylococcus aureus subsp. aureus Mu50
caaauaaauuaaauuuu

SEQ ID NO: 2052278 - RNA, 12 nt, Staphylococcus aureus subsp. aureus Mu50
caaauaaauguc

SEQ ID NO: 2052279 - RNA, 20 nt, Staphylococcus aureus subsp. aureus Mu50
caaauaaauguccgacuuga

SEQ ID NO: 2052280 - RNA, 17 nt, Staphylococcus aureus subsp. aureus Mu50
caaagggcgaaauggau

SEQ ID NO: 2052281 - RNA, 13 nt, Staphylococcus aureus subsp. aureus Mu50
caacaaaagaugu

SEQ ID NO: 2052282 - RNA, 22 nt, Staphylococcus aureus subsp. aureus Mu50
caacaaacgcugauuuaauagc

SEQ ID NO: 2052283 - RNA, 12 nt, Staphylococcus aureus subsp. aureus Mu50
caacaaacauaa

SEQ ID NO: 2052284 - RNA, 19 nt, Staphylococcus aureus subsp. aureus Mu50
caacaaagugcaauuauuu

SEQ ID NO: 2052285 - RNA, 17 nt, Staphylococcus aureus subsp. aureus Mu50
caaauucauauuaacug

SEQ ID NO: 2052286 - RNA, 15 nt, Staphylococcus aureus subsp. aureus Mu50
caaauucauuuguau

SEQ ID NO: 2052287 - RNA, 13 nt, Staphylococcus aureus subsp. aureus Mu50
caaauucauuugu

SEQ ID NO: 2052288 - RNA, 14 nt, Staphylococcus aureus subsp. aureus Mu50
caaauucauuugua

SEQ ID NO: 2052289 - RNA, 20 nt, Staphylococcus aureus subsp. aureus Mu50
caaauuugugauuaugcaua

SEQ ID NO: 2052290 - RNA, 15 nt, Staphylococcus aureus subsp. aureus Mu50
caaaugaaccagcua

SEQ ID NO: 2052291 - RNA, 15 nt, Staphylococcus aureus subsp. aureus Mu50
caaaugaauggagca

SEQ ID NO: 2052292 - RNA, 15 nt, Staphylococcus aureus subsp. aureus Mu50
caaaugaaauucuuu

SEQ ID NO: 2052293 - RNA, 18 nt, Staphylococcus aureus subsp. aureus Mu50
caaaugaaaaaguaaaau

SEQ ID NO: 2052294 - RNA, 20 nt, Staphylococcus aureus subsp. aureus Mu50
caaaugaaaaaguaaaaucu

SEQ ID NO: 2052295 - RNA, 22 nt, Staphylococcus aureus subsp. aureus Mu50
caaaugaaaaaguaaaaucuuu

SEQ ID NO: 2052296 - RNA, 15 nt, Staphylococcus aureus subsp. aureus Mu50
caaaucuuuuaaauu

SEQ ID NO: 2052297 - RNA, 16 nt, Staphylococcus aureus subsp. aureus Mu50
caaauucaacuuuaau

SEQ ID NO: 2052298 - RNA, 13 nt, Staphylococcus aureus subsp. aureus Mu50
caaauuaaaaaac

SEQ ID NO: 2052299 - RNA, 18 nt, Staphylococcus aureus subsp. aureus Mu50
caaauguaagaacgaaac

SEQ ID NO: 2052300 - RNA, 16 nt, Staphylococcus aureus subsp. aureus Mu50
caacacccauauaauu

SEQ ID NO: 2052301 - RNA, 15 nt, Staphylococcus aureus subsp. aureus Mu50
caacaccuaauauuu

SEQ ID NO: 2052302 - RNA, 12 nt, Staphylococcus aureus subsp. aureus Mu50
caacaaauuuaa

SEQ ID NO: 2052303 - RNA, 15 nt, Staphylococcus aureus subsp. aureus Mu50
caacaacaaguucuu

SEQ ID NO: 2052304 - RNA, 19 nt, Staphylococcus aureus subsp. aureus Mu50
caacaacuaagauauauug

SEQ ID NO: 2052305 - RNA, 15 nt, Staphylococcus aureus subsp. aureus Mu50
caacaguuuuaaaga

SEQ ID NO: 2052306 - RNA, 11 nt, Staphylococcus aureus subsp. aureus Mu50
caacaguaauu

SEQ ID NO: 2052307 - RNA, 21 nt, Staphylococcus aureus subsp. aureus Mu50
caacaguuucuuggucugcug

SEQ ID NO: 2052308 - RNA, 23 nt, Staphylococcus aureus subsp. aureus Mu50
caacaguuucuuggucugcugua

SEQ ID NO: 2052309 - RNA, 20 nt, Staphylococcus aureus subsp. aureus Mu50
caaggauguuauaaaaugaa

SEQ ID NO: 2052310 - RNA, 18 nt, Staphylococcus aureus subsp. aureus Mu50
caaggauguuauaaaaug

SEQ ID NO: 2052311 - RNA, 17 nt, Staphylococcus aureus subsp. aureus Mu50
caagcuuuuuaggaaug

SEQ ID NO: 2052312 - RNA, 16 nt, Staphylococcus aureus subsp. aureus Mu50
caagcuuuuuaggaau

SEQ ID NO: 2052313 - RNA, 22 nt, Staphylococcus aureus subsp. aureus Mu50
caagcuuaauaagcugaaauaa

SEQ ID NO: 2052314 - RNA, 23 nt, Staphylococcus aureus subsp. aureus Mu50
caagauuaugacaacauaacaaa

SEQ ID NO: 2052315 - RNA, 18 nt, Staphylococcus aureus subsp. aureus Mu50
caagauuaugacaacaua

SEQ ID NO: 2052316 - RNA, 18 nt, Staphylococcus aureus subsp. aureus Mu50
caagaugguauugcuuua

SEQ ID NO: 2052317 - RNA, 17 nt, Staphylococcus aureus subsp. aureus Mu50
caaguacacgaauacca

SEQ ID NO: 2052318 - RNA, 15 nt, Staphylococcus aureus subsp. aureus Mu50
caagguuuucgccaa

SEQ ID NO: 2052319 - RNA, 18 nt, Staphylococcus aureus subsp. aureus Mu50
caaguguaucgcccauac

SEQ ID NO: 2052320 - RNA, 20 nt, Staphylococcus aureus subsp. aureus Mu50
caagucguucucuuaaauau

SEQ ID NO: 2052321 - RNA, 22 nt, Staphylococcus aureus subsp. aureus Mu50
caagucucauaucuauuuuucg

SEQ ID NO: 2052322 - RNA, 23 nt, Staphylococcus aureus subsp. aureus Mu50
caagucuaguucgaacacacacu

SEQ ID NO: 2052323 - RNA, 18 nt, Staphylococcus aureus subsp. aureus Mu50
caagucuucuaaaaaauc

SEQ ID NO: 2052324 - RNA, 14 nt, Staphylococcus aureus subsp. aureus Mu50
caagugcagauguu

SEQ ID NO: 2052325 - RNA, 17 nt, Staphylococcus aureus subsp. aureus Mu50
caauaagcgcaauuaaa

SEQ ID NO: 2052326 - RNA, 15 nt, Staphylococcus aureus subsp. aureus Mu50
caaguuuaaaauacg

SEQ ID NO: 2052327 - RNA, 14 nt, Staphylococcus aureus subsp. aureus Mu50
caaguuguuuuuug

SEQ ID NO: 2052328 - RNA, 22 nt, Staphylococcus aureus subsp. aureus Mu50
caaguuggggaaggacaggaau

SEQ ID NO: 2052329 - RNA, 23 nt, Staphylococcus aureus subsp. aureus Mu50
caaguuggcuggcccccaacacu

SEQ ID NO: 2052330 - RNA, 17 nt, Staphylococcus aureus subsp. aureus Mu50
caaguugcacauuauaa

SEQ ID NO: 2052331 - RNA, 16 nt, Staphylococcus aureus subsp. aureus Mu50
caaguuggcggggccc

SEQ ID NO: 2052332 - RNA, 19 nt, Staphylococcus aureus subsp. aureus Mu50
caauaaugugcaaguuggg

SEQ ID NO: 2052333 - RNA, 11 nt, Staphylococcus aureus subsp. aureus Mu50
caauaauguua

SEQ ID NO: 2052334 - RNA, 17 nt, Staphylococcus aureus subsp. aureus Mu50
caauacauaaugguuca

SEQ ID NO: 2052335 - RNA, 17 nt, Staphylococcus aureus subsp. aureus Mu50
caauacauuaauauaaa

SEQ ID NO: 2052336 - RNA, 20 nt, Staphylococcus aureus subsp. aureus Mu50
caauaccgaauaauuuugau

SEQ ID NO: 2052337 - RNA, 16 nt, Staphylococcus aureus subsp. aureus Mu50
caauauacaaugcuga

SEQ ID NO: 2052338 - RNA, 12 nt, Staphylococcus aureus subsp. aureus Mu50
caauauacuuuu

SEQ ID NO: 2052339 - RNA, 17 nt, Staphylococcus aureus subsp. aureus Mu50
caauauaauuuccuaaa

SEQ ID NO: 2052340 - RNA, 22 nt, Staphylococcus aureus subsp. aureus Mu50
caauauauaaugguucuauaau

SEQ ID NO: 2052341 - RNA, 14 nt, Staphylococcus aureus subsp. aureus Mu50
caauauacuuuuua

SEQ ID NO: 2052342 - RNA, 16 nt, Staphylococcus aureus subsp. aureus Mu50
caauagcaauugaaua

SEQ ID NO: 2052343 - RNA, 14 nt, Staphylococcus aureus subsp. aureus Mu50
caauagaugaaaau

SEQ ID NO: 2052344 - RNA, 21 nt, Staphylococcus aureus subsp. aureus Mu50
caauacgaaaucaaaaauaau

SEQ ID NO: 2052345 - RNA, 21 nt, Staphylococcus aureus subsp. aureus Mu50
caauauguggcgcucuuauaa

SEQ ID NO: 2052346 - RNA, 17 nt, Staphylococcus aureus subsp. aureus Mu50
caauauacuuuuuaaau

SEQ ID NO: 2052347 - RNA, 19 nt, Staphylococcus aureus subsp. aureus Mu50
caaucaacuuagaauuuac

SEQ ID NO: 2052348 - RNA, 13 nt, Staphylococcus aureus subsp. aureus Mu50
caauauuaaaauu

SEQ ID NO: 2052349 - RNA, 13 nt, Staphylococcus aureus subsp. aureus Mu50
caauauuaaaaua

SEQ ID NO: 2052350 - RNA, 13 nt, Staphylococcus aureus subsp. aureus Mu50
caauauuaaaauc

SEQ ID NO: 2052351 - RNA, 16 nt, Staphylococcus aureus subsp. aureus Mu50
caaucacuauauuuca

SEQ ID NO: 2052352 - RNA, 14 nt, Staphylococcus aureus subsp. aureus Mu50
caagaacuuuaaaa

SEQ ID NO: 2052353 - RNA, 20 nt, Staphylococcus aureus subsp. aureus Mu50
caagaaacaauucauuaaua

SEQ ID NO: 2052354 - RNA, 23 nt, Staphylococcus aureus subsp. aureus Mu50
caacuucuucuccguauuuaccu

SEQ ID NO: 2052355 - RNA, 17 nt, Staphylococcus aureus subsp. aureus Mu50
caacuugugguuggaag

SEQ ID NO: 2052356 - RNA, 22 nt, Staphylococcus aureus subsp. aureus Mu50
caacuugagcauuuuuauguua

SEQ ID NO: 2052357 - RNA, 19 nt, Staphylococcus aureus subsp. aureus Mu50
caacuugaucauuauaaaa

SEQ ID NO: 2052358 - RNA, 16 nt, Staphylococcus aureus subsp. aureus Mu50
caacuuuuuaauaaua

SEQ ID NO: 2052359 - RNA, 23 nt, Staphylococcus aureus subsp. aureus Mu50
caacuuuuuuaacagcugcaguc

SEQ ID NO: 2052360 - RNA, 21 nt, Staphylococcus aureus subsp. aureus Mu50
caacuuuagcauauucgcuua

SEQ ID NO: 2052361 - RNA, 17 nt, Staphylococcus aureus subsp. aureus Mu50
caacuuuacgauaaaua

SEQ ID NO: 2052362 - RNA, 22 nt, Staphylococcus aureus subsp. aureus Mu50
caacuugugguuggaagucugc

SEQ ID NO: 2052363 - RNA, 23 nt, Staphylococcus aureus subsp. aureus Mu50
caacuugugguuggaagucugcu

SEQ ID NO: 2052364 - RNA, 23 nt, Staphylococcus aureus subsp. aureus Mu50
caacuuuaaucaaaaaagacuca

SEQ ID NO: 2052365 - RNA, 19 nt, Staphylococcus aureus subsp. aureus Mu50
caacuuuaauuuuucauua

SEQ ID NO: 2052366 - RNA, 21 nt, Staphylococcus aureus subsp. aureus Mu50
caacuuuaauuuuucauuaau

SEQ ID NO: 2052367 - RNA, 21 nt, Staphylococcus aureus subsp. aureus Mu50
caagagguaaaucuguuuaaa

SEQ ID NO: 2052368 - RNA, 13 nt, Staphylococcus aureus subsp. aureus Mu50
caagauaaaucau

SEQ ID NO: 2052369 - RNA, 14 nt, Staphylococcus aureus subsp. aureus Mu50
caagauaaaucauc

SEQ ID NO: 2052370 - RNA, 16 nt, Staphylococcus aureus subsp. aureus Mu50
caagaauuaaugaaau

SEQ ID NO: 2052371 - RNA, 22 nt, Staphylococcus aureus subsp. aureus Mu50
caagaauuauggcagauccaua

SEQ ID NO: 2052372 - RNA, 19 nt, Staphylococcus aureus subsp. aureus Mu50
caagagaauuaauaauuuu

SEQ ID NO: 2052373 - RNA, 14 nt, Staphylococcus aureus subsp. aureus Mu50
caagagauaagaaa

SEQ ID NO: 2052374 - RNA, 22 nt, Staphylococcus aureus subsp. aureus Mu50
caaccuuugguuguuaggggcu

SEQ ID NO: 2052375 - RNA, 17 nt, Staphylococcus aureus subsp. aureus Mu50
caacgagucauaaauau

SEQ ID NO: 2052376 - RNA, 14 nt, Staphylococcus aureus subsp. aureus Mu50
caacauauuauaua

SEQ ID NO: 2052377 - RNA, 17 nt, Staphylococcus aureus subsp. aureus Mu50
caacauauuauauauau

SEQ ID NO: 2052378 - RNA, 17 nt, Staphylococcus aureus subsp. aureus Mu50
caaccugugauaaaaau

SEQ ID NO: 2052379 - RNA, 18 nt, Staphylococcus aureus subsp. aureus Mu50
caaccugugauaaaaauc

SEQ ID NO: 2052380 - RNA, 20 nt, Staphylococcus aureus subsp. aureus Mu50
caacguuauucguuaacaau

SEQ ID NO: 2052381 - RNA, 15 nt, Staphylococcus aureus subsp. aureus Mu50
caacguucuacucua

SEQ ID NO: 2052382 - RNA, 18 nt, Staphylococcus aureus subsp. aureus Mu50
caacuaaaggucccauua

SEQ ID NO: 2052383 - RNA, 19 nt, Staphylococcus aureus subsp. aureus Mu50
caacuauauauaguugauc

SEQ ID NO: 2052384 - RNA, 15 nt, Staphylococcus aureus subsp. aureus Mu50
caacuauaugugucg

SEQ ID NO: 2052385 - RNA, 22 nt, Staphylococcus aureus subsp. aureus Mu50
auuuuaguucacaugaauuuua

SEQ ID NO: 2052386 - RNA, 13 nt, Staphylococcus aureus subsp. aureus Mu50
auuuuauacauaa

SEQ ID NO: 2052387 - RNA, 13 nt, Staphylococcus aureus subsp. aureus Mu50
auuuuauaagaau

SEQ ID NO: 2052388 - RNA, 14 nt, Staphylococcus aureus subsp. aureus Mu50
auuuuauaagaauu

SEQ ID NO: 2052389 - RNA, 18 nt, Staphylococcus aureus subsp. aureus Mu50
auuuuauaagaauuuaaa

SEQ ID NO: 2052390 - RNA, 17 nt, Staphylococcus aureus subsp. aureus Mu50
auuuuauaaaucauaga

SEQ ID NO: 2052391 - RNA, 15 nt, Staphylococcus aureus subsp. aureus Mu50
auuuuauaaaucaua

SEQ ID NO: 2052392 - RNA, 14 nt, Staphylococcus aureus subsp. aureus Mu50
auuuuaucaucuau

SEQ ID NO: 2052393 - RNA, 16 nt, Staphylococcus aureus subsp. aureus Mu50
auuuuaucuaaacauu

SEQ ID NO: 2052394 - RNA, 20 nt, Staphylococcus aureus subsp. aureus Mu50
auuuuaucuaaagcuauaaa

SEQ ID NO: 2052395 - RNA, 23 nt, Staphylococcus aureus subsp. aureus Mu50
auuuuaucuaaagcuauaaaaaa

SEQ ID NO: 2052396 - RNA, 12 nt, Staphylococcus aureus subsp. aureus Mu50
auuuuauauauc

SEQ ID NO: 2052397 - RNA, 12 nt, Staphylococcus aureus subsp. aureus Mu50
auuuuauauuuu

SEQ ID NO: 2052398 - RNA, 14 nt, Staphylococcus aureus subsp. aureus Mu50
auuuuauauuuuag

SEQ ID NO: 2052399 - RNA, 14 nt, Staphylococcus aureus subsp. aureus Mu50
auuuuaucaaauuc

SEQ ID NO: 2052400 - RNA, 23 nt, Staphylococcus aureus subsp. aureus Mu50
auuuuauccaaaccaauuuuaac

SEQ ID NO: 2052401 - RNA, 19 nt, Staphylococcus aureus subsp. aureus Mu50
auuuucauuuaauccuucu

SEQ ID NO: 2052402 - RNA, 19 nt, Staphylococcus aureus subsp. aureus Mu50
auuuucauuguauguugaa

SEQ ID NO: 2052403 - RNA, 20 nt, Staphylococcus aureus subsp. aureus Mu50
auuuucaaguaaugauauua

SEQ ID NO: 2052404 - RNA, 18 nt, Staphylococcus aureus subsp. aureus Mu50
auuuucaaguuuaaaaua

SEQ ID NO: 2052405 - RNA, 14 nt, Staphylococcus aureus subsp. aureus Mu50
auuuucaacacacu

SEQ ID NO: 2052406 - RNA, 16 nt, Staphylococcus aureus subsp. aureus Mu50
auuuucaaaacugcca

SEQ ID NO: 2052407 - RNA, 18 nt, Staphylococcus aureus subsp. aureus Mu50
auuuucaaaacugccaaa

SEQ ID NO: 2052408 - RNA, 19 nt, Staphylococcus aureus subsp. aureus Mu50
auuuucaaaacugccaaaa

SEQ ID NO: 2052409 - RNA, 15 nt, Staphylococcus aureus subsp. aureus Mu50
auuuuaucugaaaau

SEQ ID NO: 2052410 - RNA, 22 nt, Staphylococcus aureus subsp. aureus Mu50
auuuugcgaaaauaucauuucu

SEQ ID NO: 2052411 - RNA, 20 nt, Staphylococcus aureus subsp. aureus Mu50
auuuugacgccagaauaaau

SEQ ID NO: 2052412 - RNA, 16 nt, Staphylococcus aureus subsp. aureus Mu50
auuuugaauaaaaaaa

SEQ ID NO: 2052413 - RNA, 16 nt, Staphylococcus aureus subsp. aureus Mu50
auuuucuuuuuuaauu

SEQ ID NO: 2052414 - RNA, 20 nt, Staphylococcus aureus subsp. aureus Mu50
auuuucuuuuuuaauucuau

SEQ ID NO: 2052415 - RNA, 15 nt, Staphylococcus aureus subsp. aureus Mu50
auuuucuuuuucuaa

SEQ ID NO: 2052416 - RNA, 21 nt, Staphylococcus aureus subsp. aureus Mu50
auuuucuuuuucuaaauaaac

SEQ ID NO: 2052417 - RNA, 20 nt, Staphylococcus aureus subsp. aureus Mu50
auuuucuugccaucaauuuc

SEQ ID NO: 2052418 - RNA, 15 nt, Staphylococcus aureus subsp. aureus Mu50
auuuuggaacauauu

SEQ ID NO: 2052419 - RNA, 13 nt, Staphylococcus aureus subsp. aureus Mu50
auuuuggauuuuu

SEQ ID NO: 2052420 - RNA, 23 nt, Staphylococcus aureus subsp. aureus Mu50
auuuuuaacagcgugaauauaag

SEQ ID NO: 2052421 - RNA, 13 nt, Staphylococcus aureus subsp. aureus Mu50
auuuuuaguuaaa

SEQ ID NO: 2052422 - RNA, 15 nt, Staphylococcus aureus subsp. aureus Mu50
auuuuuagacauuaa

SEQ ID NO: 2052423 - RNA, 12 nt, Staphylococcus aureus subsp. aureus Mu50
auuuuuaauaua

SEQ ID NO: 2052424 - RNA, 14 nt, Staphylococcus aureus subsp. aureus Mu50
auuuuuaauuauuu

SEQ ID NO: 2052425 - RNA, 17 nt, Staphylococcus aureus subsp. aureus Mu50
auuuuuaauuucuggua

SEQ ID NO: 2052426 - RNA, 15 nt, Staphylococcus aureus subsp. aureus Mu50
auuugagaaaugaaa

SEQ ID NO: 2052427 - RNA, 17 nt, Staphylococcus aureus subsp. aureus Mu50
auuugcaccuauaccuc

SEQ ID NO: 2052428 - RNA, 18 nt, Staphylococcus aureus subsp. aureus Mu50
auuugcaccuauaccucg

SEQ ID NO: 2052429 - RNA, 15 nt, Staphylococcus aureus subsp. aureus Mu50
auuugacacauuauu

SEQ ID NO: 2052430 - RNA, 21 nt, Staphylococcus aureus subsp. aureus Mu50
auuugcuguuaauaaaucauu

SEQ ID NO: 2052431 - RNA, 23 nt, Staphylococcus aureus subsp. aureus Mu50
auuugccauauacacacuaagga

SEQ ID NO: 2052432 - RNA, 21 nt, Staphylococcus aureus subsp. aureus Mu50
auuugcagaacguucuaaggu

SEQ ID NO: 2052433 - RNA, 16 nt, Staphylococcus aureus subsp. aureus Mu50
auuuguaaucccauuu

SEQ ID NO: 2052434 - RNA, 20 nt, Staphylococcus aureus subsp. aureus Mu50
auuuguaaucccauuuuaaa

SEQ ID NO: 2052435 - RNA, 13 nt, Staphylococcus aureus subsp. aureus Mu50
auuuguaauacaa

SEQ ID NO: 2052436 - RNA, 14 nt, Staphylococcus aureus subsp. aureus Mu50
auuuguaauacaag

SEQ ID NO: 2052437 - RNA, 23 nt, Staphylococcus aureus subsp. aureus Mu50
auuugguggagaaccuuuaaaag

SEQ ID NO: 2052438 - RNA, 19 nt, Staphylococcus aureus subsp. aureus Mu50
auuuguaaagacaccauca

SEQ ID NO: 2052439 - RNA, 15 nt, Staphylococcus aureus subsp. aureus Mu50
auuuguaaauauuuu

SEQ ID NO: 2052440 - RNA, 22 nt, Staphylococcus aureus subsp. aureus Mu50
auuuguagcuugaauaauauau

SEQ ID NO: 2052441 - RNA, 24 nt, Staphylococcus aureus subsp. aureus Mu50
auuuguuuauuaguuauguuaguc

SEQ ID NO: 2052442 - RNA, 13 nt, Staphylococcus aureus subsp. aureus Mu50
auuuguuuuaaau

SEQ ID NO: 2052443 - RNA, 16 nt, Staphylococcus aureus subsp. aureus Mu50
auuuuaaaaauaaaaa

SEQ ID NO: 2052444 - RNA, 16 nt, Staphylococcus aureus subsp. aureus Mu50
auuuuaaaagauaaau

SEQ ID NO: 2052445 - RNA, 15 nt, Staphylococcus aureus subsp. aureus Mu50
auuuuaaaaaugcug

SEQ ID NO: 2052446 - RNA, 18 nt, Staphylococcus aureus subsp. aureus Mu50
auuuuaauuaauuaucau

SEQ ID NO: 2052447 - RNA, 17 nt, Staphylococcus aureus subsp. aureus Mu50
auuuuaaugauuuuuca

SEQ ID NO: 2052448 - RNA, 13 nt, Staphylococcus aureus subsp. aureus Mu50
auuuuaauuuuca

SEQ ID NO: 2052449 - RNA, 10 nt, Staphylococcus aureus subsp. aureus Mu50
auuucuuugu

SEQ ID NO: 2052450 - RNA, 15 nt, Staphylococcus aureus subsp. aureus Mu50
auuucuuuugaaucu

SEQ ID NO: 2052451 - RNA, 19 nt, Staphylococcus aureus subsp. aureus Mu50
auuucuuuuuaaaaucguu

SEQ ID NO: 2052452 - RNA, 15 nt, Staphylococcus aureus subsp. aureus Mu50
auuucuuuuuaaaau

SEQ ID NO: 2052453 - RNA, 12 nt, Staphylococcus aureus subsp. aureus Mu50
auuugaauacuu

SEQ ID NO: 2052454 - RNA, 17 nt, Staphylococcus aureus subsp. aureus Mu50
auuucuugcuucauuga

SEQ ID NO: 2052455 - RNA, 22 nt, Staphylococcus aureus subsp. aureus Mu50
auuucuugugcgguaaccauuu

SEQ ID NO: 2052456 - RNA, 14 nt, Staphylococcus aureus subsp. aureus Mu50
auuucuguaccaaa

SEQ ID NO: 2052457 - RNA, 14 nt, Staphylococcus aureus subsp. aureus Mu50
auuucuuaccauuu

SEQ ID NO: 2052458 - RNA, 19 nt, Staphylococcus aureus subsp. aureus Mu50
auuucuggcguacauauaa

SEQ ID NO: 2052459 - RNA, 20 nt, Staphylococcus aureus subsp. aureus Mu50
auuucggggacguucaugga

SEQ ID NO: 2052460 - RNA, 17 nt, Staphylococcus aureus subsp. aureus Mu50
auuucgguauuuuaaau

SEQ ID NO: 2052461 - RNA, 21 nt, Staphylococcus aureus subsp. aureus Mu50
auuucgguauuuuaaauuuau

SEQ ID NO: 2052462 - RNA, 20 nt, Staphylococcus aureus subsp. aureus Mu50
auuucguggaccuauuguau

SEQ ID NO: 2052463 - RNA, 13 nt, Staphylococcus aureus subsp. aureus Mu50
auuucuaauuuag

SEQ ID NO: 2052464 - RNA, 18 nt, Staphylococcus aureus subsp. aureus Mu50
auuucuacccguuuuuug

SEQ ID NO: 2052465 - RNA, 23 nt, Staphylococcus aureus subsp. aureus Mu50
auuucuacccguuuuuugguucu

SEQ ID NO: 2052466 - RNA, 14 nt, Staphylococcus aureus subsp. aureus Mu50
auuucuacucgaaa

SEQ ID NO: 2052467 - RNA, 16 nt, Staphylococcus aureus subsp. aureus Mu50
auuucugacaacuuaa

SEQ ID NO: 2052468 - RNA, 13 nt, Staphylococcus aureus subsp. aureus Mu50
auuucucuuucaa

SEQ ID NO: 2052469 - RNA, 21 nt, Staphylococcus aureus subsp. aureus Mu50
auuucugaaaugauacauuau

SEQ ID NO: 2052470 - RNA, 18 nt, Staphylococcus aureus subsp. aureus Mu50
auuucuagcucuccuaca

SEQ ID NO: 2052471 - RNA, 20 nt, Staphylococcus aureus subsp. aureus Mu50
auuucuaucaaauaaugaau

SEQ ID NO: 2052472 - RNA, 18 nt, Staphylococcus aureus subsp. aureus Mu50
auuuaauuccauuaaguu

SEQ ID NO: 2052473 - RNA, 12 nt, Staphylococcus aureus subsp. aureus Mu50
auuuaauuuuuc

SEQ ID NO: 2052474 - RNA, 15 nt, Staphylococcus aureus subsp. aureus Mu50
auuuaauuuuucuaa

SEQ ID NO: 2052475 - RNA, 19 nt, Staphylococcus aureus subsp. aureus Mu50
auuuaauuuuucuaaauga

SEQ ID NO: 2052476 - RNA, 21 nt, Staphylococcus aureus subsp. aureus Mu50
auuuaauuuuucuaaaugauu

SEQ ID NO: 2052477 - RNA, 20 nt, Staphylococcus aureus subsp. aureus Mu50
auuuaaacauccaauuaugu

SEQ ID NO: 2052478 - RNA, 21 nt, Staphylococcus aureus subsp. aureus Mu50
auuuaaaaucggacaacugag

SEQ ID NO: 2052479 - RNA, 19 nt, Staphylococcus aureus subsp. aureus Mu50
auuuaaaaugcuuguucaa

SEQ ID NO: 2052480 - RNA, 21 nt, Staphylococcus aureus subsp. aureus Mu50
auuuaaaauaguucuuuaaau

SEQ ID NO: 2052481 - RNA, 14 nt, Staphylococcus aureus subsp. aureus Mu50
auuuaaaagagaau

SEQ ID NO: 2052482 - RNA, 17 nt, Staphylococcus aureus subsp. aureus Mu50
auuuaaaauauuauuuu

SEQ ID NO: 2052483 - RNA, 14 nt, Staphylococcus aureus subsp. aureus Mu50
auuuaagauuuaau

SEQ ID NO: 2052484 - RNA, 18 nt, Staphylococcus aureus subsp. aureus Mu50
auuuaagggucacaccca

SEQ ID NO: 2052485 - RNA, 16 nt, Staphylococcus aureus subsp. aureus Mu50
auuuaaaaaucaaaga

SEQ ID NO: 2052486 - RNA, 12 nt, Staphylococcus aureus subsp. aureus Mu50
auuuaaaagaaa

SEQ ID NO: 2052487 - RNA, 19 nt, Staphylococcus aureus subsp. aureus Mu50
auuuaaaauaauagauaau

SEQ ID NO: 2052488 - RNA, 19 nt, Staphylococcus aureus subsp. aureus Mu50
auuguuuugagauauuugu

SEQ ID NO: 2052489 - RNA, 19 nt, Staphylococcus aureus subsp. aureus Mu50
auuguuuuggcuuugagug

SEQ ID NO: 2052490 - RNA, 13 nt, Staphylococcus aureus subsp. aureus Mu50
auuguuuuuaaaa

SEQ ID NO: 2052491 - RNA, 17 nt, Staphylococcus aureus subsp. aureus Mu50
auuuauauuaaauacua

SEQ ID NO: 2052492 - RNA, 19 nt, Staphylococcus aureus subsp. aureus Mu50
auuuagguaauacaucauc

SEQ ID NO: 2052493 - RNA, 19 nt, Staphylococcus aureus subsp. aureus Mu50
auuuauauuuacacagaau

SEQ ID NO: 2052494 - RNA, 15 nt, Staphylococcus aureus subsp. aureus Mu50
auuuauauuuagaau

SEQ ID NO: 2052495 - RNA, 14 nt, Staphylococcus aureus subsp. aureus Mu50
auuuaucaauaaau

SEQ ID NO: 2052496 - RNA, 13 nt, Staphylococcus aureus subsp. aureus Mu50
auuuauauuuuau

SEQ ID NO: 2052497 - RNA, 18 nt, Staphylococcus aureus subsp. aureus Mu50
auuuaucaauuucuauuu

SEQ ID NO: 2052498 - RNA, 16 nt, Staphylococcus aureus subsp. aureus Mu50
auuuaucauacuucaa

SEQ ID NO: 2052499 - RNA, 22 nt, Staphylococcus aureus subsp. aureus Mu50
auuuacuugauuagauuugugu

SEQ ID NO: 2052500 - RNA, 20 nt, Staphylococcus aureus subsp. aureus Mu50
auuuagaaacaaucguugaa

SEQ ID NO: 2052501 - RNA, 21 nt, Staphylococcus aureus subsp. aureus Mu50
auuuagaaacuuccaacauau

SEQ ID NO: 2052502 - RNA, 21 nt, Staphylococcus aureus subsp. aureus Mu50
auuuaggaguauccugauuua

SEQ ID NO: 2052503 - RNA, 23 nt, Staphylococcus aureus subsp. aureus Mu50
auuuaggaguauccugauuuaau

SEQ ID NO: 2052504 - RNA, 18 nt, Staphylococcus aureus subsp. aureus Mu50
auuuagcaaauauuucug

SEQ ID NO: 2052505 - RNA, 15 nt, Staphylococcus aureus subsp. aureus Mu50
auuuagcaucaaaaa

SEQ ID NO: 2052506 - RNA, 16 nt, Staphylococcus aureus subsp. aureus Mu50
auuuacgauacaucau

SEQ ID NO: 2052507 - RNA, 21 nt, Staphylococcus aureus subsp. aureus Mu50
auuuaccuuugucuuuuuuau

SEQ ID NO: 2052508 - RNA, 15 nt, Staphylococcus aureus subsp. aureus Mu50
auuuaccuucuucua

SEQ ID NO: 2052509 - RNA, 22 nt, Staphylococcus aureus subsp. aureus Mu50
auuuaccucuugauaaaauaaa

SEQ ID NO: 2052510 - RNA, 15 nt, Staphylococcus aureus subsp. aureus Mu50
auuuacaccuauacc

SEQ ID NO: 2052511 - RNA, 17 nt, Staphylococcus aureus subsp. aureus Mu50
auuuacaccuauaccuc

SEQ ID NO: 2052512 - RNA, 21 nt, Staphylococcus aureus subsp. aureus Mu50
auuuacacagaaugauauaac

SEQ ID NO: 2052513 - RNA, 16 nt, Staphylococcus aureus subsp. aureus Mu50
auuuacacacaugaua

SEQ ID NO: 2052514 - RNA, 20 nt, Staphylococcus aureus subsp. aureus Mu50
auuuacaaauguauaaauaa

SEQ ID NO: 2052515 - RNA, 16 nt, Staphylococcus aureus subsp. aureus Mu50
auuuccucgguuuuau

SEQ ID NO: 2052516 - RNA, 18 nt, Staphylococcus aureus subsp. aureus Mu50
auuuccuaaaaacuguga

SEQ ID NO: 2052517 - RNA, 16 nt, Staphylococcus aureus subsp. aureus Mu50
auuucgcuuuuuuuau

SEQ ID NO: 2052518 - RNA, 15 nt, Staphylococcus aureus subsp. aureus Mu50
auuucgccucaucua

SEQ ID NO: 2052519 - RNA, 18 nt, Staphylococcus aureus subsp. aureus Mu50
auuucgccucaucuaauu

SEQ ID NO: 2052520 - RNA, 13 nt, Staphylococcus aureus subsp. aureus Mu50
auuucgauuuuca

SEQ ID NO: 2052521 - RNA, 20 nt, Staphylococcus aureus subsp. aureus Mu50
auuucgacaucuagaugaaa

SEQ ID NO: 2052522 - RNA, 17 nt, Staphylococcus aureus subsp. aureus Mu50
auuucccauuuaucuaa

SEQ ID NO: 2052523 - RNA, 18 nt, Staphylococcus aureus subsp. aureus Mu50
auuucccacgugccucau

SEQ ID NO: 2052524 - RNA, 15 nt, Staphylococcus aureus subsp. aureus Mu50
auuucaucaauaauu

SEQ ID NO: 2052525 - RNA, 11 nt, Staphylococcus aureus subsp. aureus Mu50
auuucaucaaa

SEQ ID NO: 2052526 - RNA, 13 nt, Staphylococcus aureus subsp. aureus Mu50
auuucaucaaauc

SEQ ID NO: 2052527 - RNA, 21 nt, Staphylococcus aureus subsp. aureus Mu50
auuucauuugaaauaguuaaa

SEQ ID NO: 2052528 - RNA, 13 nt, Staphylococcus aureus subsp. aureus Mu50
auuucauuuaugc

SEQ ID NO: 2052529 - RNA, 20 nt, Staphylococcus aureus subsp. aureus Mu50
auuucaguucuuagauuuuc

SEQ ID NO: 2052530 - RNA, 18 nt, Staphylococcus aureus subsp. aureus Mu50
auuucauagggaaauauu

SEQ ID NO: 2052531 - RNA, 14 nt, Staphylococcus aureus subsp. aureus Mu50
auuucagaaauaca

SEQ ID NO: 2052532 - RNA, 11 nt, Staphylococcus aureus subsp. aureus Mu50
auuucacuuua

SEQ ID NO: 2052533 - RNA, 15 nt, Staphylococcus aureus subsp. aureus Mu50
auuucaccgcuuuca

SEQ ID NO: 2052534 - RNA, 21 nt, Staphylococcus aureus subsp. aureus Mu50
auuuaucuugauuuuauaaau

SEQ ID NO: 2052535 - RNA, 21 nt, Staphylococcus aureus subsp. aureus Mu50
auuuauguguugugauauaua

SEQ ID NO: 2052536 - RNA, 23 nt, Staphylococcus aureus subsp. aureus Mu50
auuucaauuuggaaauaucuuac

SEQ ID NO: 2052537 - RNA, 16 nt, Staphylococcus aureus subsp. aureus Mu50
auuccuaauuauauua

SEQ ID NO: 2052538 - RNA, 17 nt, Staphylococcus aureus subsp. aureus Mu50
auuccuagcuuuuaugu

SEQ ID NO: 2052539 - RNA, 22 nt, Staphylococcus aureus subsp. aureus Mu50
auuccuuggugucgaaauuguu

SEQ ID NO: 2052540 - RNA, 20 nt, Staphylococcus aureus subsp. aureus Mu50
auucgaacuaucaauauaau

SEQ ID NO: 2052541 - RNA, 18 nt, Staphylococcus aureus subsp. aureus Mu50
auucgaacuaucaauaua

SEQ ID NO: 2052542 - RNA, 15 nt, Staphylococcus aureus subsp. aureus Mu50
auucgaaagccaauu

SEQ ID NO: 2052543 - RNA, 22 nt, Staphylococcus aureus subsp. aureus Mu50
auucgaaaagaaauucuacagg

SEQ ID NO: 2052544 - RNA, 16 nt, Staphylococcus aureus subsp. aureus Mu50
auucgcaccacuggcc

SEQ ID NO: 2052545 - RNA, 15 nt, Staphylococcus aureus subsp. aureus Mu50
auucgccuaaauggu

SEQ ID NO: 2052546 - RNA, 21 nt, Staphylococcus aureus subsp. aureus Mu50
auucaugaaucgaacuaguac

SEQ ID NO: 2052547 - RNA, 16 nt, Staphylococcus aureus subsp. aureus Mu50
auucaucucagcaaua

SEQ ID NO: 2052548 - RNA, 14 nt, Staphylococcus aureus subsp. aureus Mu50
auucauauuuauau

SEQ ID NO: 2052549 - RNA, 12 nt, Staphylococcus aureus subsp. aureus Mu50
auucauauuaac

SEQ ID NO: 2052550 - RNA, 17 nt, Staphylococcus aureus subsp. aureus Mu50
auucauauauacugccc

SEQ ID NO: 2052551 - RNA, 14 nt, Staphylococcus aureus subsp. aureus Mu50
auucauaucuuuca

SEQ ID NO: 2052552 - RNA, 19 nt, Staphylococcus aureus subsp. aureus Mu50
auucauacacugcacauca

SEQ ID NO: 2052553 - RNA, 20 nt, Staphylococcus aureus subsp. aureus Mu50
auucauacacugcacaucau

SEQ ID NO: 2052554 - RNA, 19 nt, Staphylococcus aureus subsp. aureus Mu50
auucauaacguguuugcuc

SEQ ID NO: 2052555 - RNA, 19 nt, Staphylococcus aureus subsp. aureus Mu50
auguugacucguuauucaa

SEQ ID NO: 2052556 - RNA, 20 nt, Staphylococcus aureus subsp. aureus Mu50
auguucuuauaaaaaacaau

SEQ ID NO: 2052557 - RNA, 21 nt, Staphylococcus aureus subsp. aureus Mu50
auucagucaguaaaaauacau

SEQ ID NO: 2052558 - RNA, 18 nt, Staphylococcus aureus subsp. aureus Mu50
auucagucaguaaaaaua

SEQ ID NO: 2052559 - RNA, 22 nt, Staphylococcus aureus subsp. aureus Mu50
auguugaagggaguauuuuuua

SEQ ID NO: 2052560 - RNA, 16 nt, Staphylococcus aureus subsp. aureus Mu50
auuccacuacaaucau

SEQ ID NO: 2052561 - RNA, 20 nt, Staphylococcus aureus subsp. aureus Mu50
auuccauuggaaguucuuuu

SEQ ID NO: 2052562 - RNA, 19 nt, Staphylococcus aureus subsp. aureus Mu50
auucauuacauguuacuga

SEQ ID NO: 2052563 - RNA, 13 nt, Staphylococcus aureus subsp. aureus Mu50
auucauuuaaaaa

SEQ ID NO: 2052564 - RNA, 15 nt, Staphylococcus aureus subsp. aureus Mu50
auucauuaauaggau

SEQ ID NO: 2052565 - RNA, 16 nt, Staphylococcus aureus subsp. aureus Mu50
auucauuuaaaaauca

SEQ ID NO: 2052566 - RNA, 20 nt, Staphylococcus aureus subsp. aureus Mu50
auucauuucgauuaauuuaa

SEQ ID NO: 2052567 - RNA, 17 nt, Staphylococcus aureus subsp. aureus Mu50
auucauuuaaaaaucaa

SEQ ID NO: 2052568 - RNA, 14 nt, Staphylococcus aureus subsp. aureus Mu50
auucauuuuauaaa

SEQ ID NO: 2052569 - RNA, 20 nt, Staphylococcus aureus subsp. aureus Mu50
auucauuuuauaaaucaaag

SEQ ID NO: 2052570 - RNA, 13 nt, Staphylococcus aureus subsp. aureus Mu50
auucauuuuaaau

SEQ ID NO: 2052571 - RNA, 15 nt, Staphylococcus aureus subsp. aureus Mu50
auuccaaaaauugua

SEQ ID NO: 2052572 - RNA, 19 nt, Staphylococcus aureus subsp. aureus Mu50
auuccaaucuauuuuaaac

SEQ ID NO: 2052573 - RNA, 16 nt, Staphylococcus aureus subsp. aureus Mu50
auuccaauuucaagug

SEQ ID NO: 2052574 - RNA, 13 nt, Staphylococcus aureus subsp. aureus Mu50
auugauucuuugg

SEQ ID NO: 2052575 - RNA, 17 nt, Staphylococcus aureus subsp. aureus Mu50
auugauucuuuggugaa

SEQ ID NO: 2052576 - RNA, 19 nt, Staphylococcus aureus subsp. aureus Mu50
auugcauacguaaauggua

SEQ ID NO: 2052577 - RNA, 23 nt, Staphylococcus aureus subsp. aureus Mu50
auugcagguaaacggaauaacuu

SEQ ID NO: 2052578 - RNA, 19 nt, Staphylococcus aureus subsp. aureus Mu50
auugauucuagugaaauac

SEQ ID NO: 2052579 - RNA, 20 nt, Staphylococcus aureus subsp. aureus Mu50
auugauggcuucucuuaguu

SEQ ID NO: 2052580 - RNA, 15 nt, Staphylococcus aureus subsp. aureus Mu50
auugauuaaauaaau

SEQ ID NO: 2052581 - RNA, 16 nt, Staphylococcus aureus subsp. aureus Mu50
auugaugucaauuuca

SEQ ID NO: 2052582 - RNA, 18 nt, Staphylococcus aureus subsp. aureus Mu50
auugaugucacauaugac

SEQ ID NO: 2052583 - RNA, 14 nt, Staphylococcus aureus subsp. aureus Mu50
auugaugaauaaau

SEQ ID NO: 2052584 - RNA, 21 nt, Staphylococcus aureus subsp. aureus Mu50
auugaauuguagauccaauuc

SEQ ID NO: 2052585 - RNA, 21 nt, Staphylococcus aureus subsp. aureus Mu50
auugaccaacguucgauaacg

SEQ ID NO: 2052586 - RNA, 16 nt, Staphylococcus aureus subsp. aureus Mu50
auugauauucuaaaaa

SEQ ID NO: 2052587 - RNA, 23 nt, Staphylococcus aureus subsp. aureus Mu50
auugauagcaccguaacauaugu

SEQ ID NO: 2052588 - RNA, 20 nt, Staphylococcus aureus subsp. aureus Mu50
auugcugggcuaccgauugu

SEQ ID NO: 2052589 - RNA, 13 nt, Staphylococcus aureus subsp. aureus Mu50
auuggcauuuacg

SEQ ID NO: 2052590 - RNA, 18 nt, Staphylococcus aureus subsp. aureus Mu50
auuggcauuuacgaaguu

SEQ ID NO: 2052591 - RNA, 19 nt, Staphylococcus aureus subsp. aureus Mu50
auuggaaucaucuuuuuga

SEQ ID NO: 2052592 - RNA, 20 nt, Staphylococcus aureus subsp. aureus Mu50
auuggaaucaucuuuuugaa

SEQ ID NO: 2052593 - RNA, 18 nt, Staphylococcus aureus subsp. aureus Mu50
auuggaaucccaaugcuu

SEQ ID NO: 2052594 - RNA, 21 nt, Staphylococcus aureus subsp. aureus Mu50
auugccaguaucucuuuucua

SEQ ID NO: 2052595 - RNA, 17 nt, Staphylococcus aureus subsp. aureus Mu50
auucuacagguaaugca

SEQ ID NO: 2052596 - RNA, 19 nt, Staphylococcus aureus subsp. aureus Mu50
auucuagauucauauuuau

SEQ ID NO: 2052597 - RNA, 15 nt, Staphylococcus aureus subsp. aureus Mu50
auucucagucucuuu

SEQ ID NO: 2052598 - RNA, 20 nt, Staphylococcus aureus subsp. aureus Mu50
auucucagucucuuugaagg

SEQ ID NO: 2052599 - RNA, 14 nt, Staphylococcus aureus subsp. aureus Mu50
auucugaaaucagu

SEQ ID NO: 2052600 - RNA, 14 nt, Staphylococcus aureus subsp. aureus Mu50
auucuaaaacggaa

SEQ ID NO: 2052601 - RNA, 15 nt, Staphylococcus aureus subsp. aureus Mu50
auucuaaaagaauua

SEQ ID NO: 2052602 - RNA, 12 nt, Staphylococcus aureus subsp. aureus Mu50
auucuacaggua

SEQ ID NO: 2052603 - RNA, 14 nt, Staphylococcus aureus subsp. aureus Mu50
auucuacagguaau

SEQ ID NO: 2052604 - RNA, 13 nt, Staphylococcus aureus subsp. aureus Mu50
auucuacaaacaa

SEQ ID NO: 2052605 - RNA, 17 nt, Staphylococcus aureus subsp. aureus Mu50
auucuaaguuaaaaccu

SEQ ID NO: 2052606 - RNA, 23 nt, Staphylococcus aureus subsp. aureus Mu50
auucguugauuuagcauacauua

SEQ ID NO: 2052607 - RNA, 24 nt, Staphylococcus aureus subsp. aureus Mu50
auucguaaauccuuuauauucuaa

SEQ ID NO: 2052608 - RNA, 15 nt, Staphylococcus aureus subsp. aureus Mu50
auucguaauuuauga

SEQ ID NO: 2052609 - RNA, 14 nt, Staphylococcus aureus subsp. aureus Mu50
auucuuuucaagaa

SEQ ID NO: 2052610 - RNA, 19 nt, Staphylococcus aureus subsp. aureus Mu50
auucuuuguauuuauacua

SEQ ID NO: 2052611 - RNA, 21 nt, Staphylococcus aureus subsp. aureus Mu50
auucuuuuaauagaucuuugu

SEQ ID NO: 2052612 - RNA, 21 nt, Staphylococcus aureus subsp. aureus Mu50
auugaaauuauccuacugcug

SEQ ID NO: 2052613 - RNA, 14 nt, Staphylococcus aureus subsp. aureus Mu50
auugaaaugagcuu

SEQ ID NO: 2052614 - RNA, 14 nt, Staphylococcus aureus subsp. aureus Mu50
auucuuuuuaacua

SEQ ID NO: 2052615 - RNA, 14 nt, Staphylococcus aureus subsp. aureus Mu50
auugaacuucuaac

SEQ ID NO: 2052616 - RNA, 15 nt, Staphylococcus aureus subsp. aureus Mu50
auugaaaugauagau

SEQ ID NO: 2052617 - RNA, 13 nt, Staphylococcus aureus subsp. aureus Mu50
auucuuucucuau

SEQ ID NO: 2052618 - RNA, 23 nt, Staphylococcus aureus subsp. aureus Mu50
auucuuuaccuuuaccaguauca

SEQ ID NO: 2052619 - RNA, 19 nt, Staphylococcus aureus subsp. aureus Mu50
auucugcagcgacaucuuu

SEQ ID NO: 2052620 - RNA, 17 nt, Staphylococcus aureus subsp. aureus Mu50
auucugagauugagaau

SEQ ID NO: 2052621 - RNA, 18 nt, Staphylococcus aureus subsp. aureus Mu50
auucugauucgauggaua

SEQ ID NO: 2052622 - RNA, 19 nt, Staphylococcus aureus subsp. aureus Mu50
auucugauucgauggauac

SEQ ID NO: 2052623 - RNA, 19 nt, Staphylococcus aureus subsp. aureus Mu50
auucuugaauaaauuuuau

SEQ ID NO: 2052624 - RNA, 15 nt, Staphylococcus aureus subsp. aureus Mu50
auucuugaaaaguuu

SEQ ID NO: 2052625 - RNA, 12 nt, Staphylococcus aureus subsp. aureus Mu50
auucuucauuua

SEQ ID NO: 2052626 - RNA, 21 nt, Staphylococcus aureus subsp. aureus Mu50
auucuucccaaaaauuguuca

SEQ ID NO: 2052627 - RNA, 14 nt, Staphylococcus aureus subsp. aureus Mu50
cacuccucuauuuu

SEQ ID NO: 2052628 - RNA, 15 nt, Staphylococcus aureus subsp. aureus Mu50
cacuccuuaaacaaa

SEQ ID NO: 2052629 - RNA, 19 nt, Staphylococcus aureus subsp. aureus Mu50
cacucauaaccgcuucuuu

SEQ ID NO: 2052630 - RNA, 20 nt, Staphylococcus aureus subsp. aureus Mu50
cacucauaaccgcuucuuuu

SEQ ID NO: 2052631 - RNA, 20 nt, Staphylococcus aureus subsp. aureus Mu50
cacucauaaucaagucugca

SEQ ID NO: 2052632 - RNA, 15 nt, Staphylococcus aureus subsp. aureus Mu50
cacucauucaauuua

SEQ ID NO: 2052633 - RNA, 15 nt, Staphylococcus aureus subsp. aureus Mu50
cacucacuucaacgu

SEQ ID NO: 2052634 - RNA, 20 nt, Staphylococcus aureus subsp. aureus Mu50
cacucacuucaacgucaucu

SEQ ID NO: 2052635 - RNA, 18 nt, Staphylococcus aureus subsp. aureus Mu50
cacuaggauguucaucaa

SEQ ID NO: 2052636 - RNA, 18 nt, Staphylococcus aureus subsp. aureus Mu50
cacuagauaguuuauacu

SEQ ID NO: 2052637 - RNA, 13 nt, Staphylococcus aureus subsp. aureus Mu50
cacuaucauuauc

SEQ ID NO: 2052638 - RNA, 19 nt, Staphylococcus aureus subsp. aureus Mu50
cacuaucauuaucaaauaa

SEQ ID NO: 2052639 - RNA, 16 nt, Staphylococcus aureus subsp. aureus Mu50
cacuauauccuuuuug

SEQ ID NO: 2052640 - RNA, 18 nt, Staphylococcus aureus subsp. aureus Mu50
cacuagucuuuuuauuuu

SEQ ID NO: 2052641 - RNA, 22 nt, Staphylococcus aureus subsp. aureus Mu50
cacuacaguguaugaugaacuu

SEQ ID NO: 2052642 - RNA, 23 nt, Staphylococcus aureus subsp. aureus Mu50
cacuaaauguucuggaauaccua

SEQ ID NO: 2052643 - RNA, 14 nt, Staphylococcus aureus subsp. aureus Mu50
cacuaaauucaaua

SEQ ID NO: 2052644 - RNA, 23 nt, Staphylococcus aureus subsp. aureus Mu50
cacgugcuucguuuuuaguguua

SEQ ID NO: 2052645 - RNA, 23 nt, Staphylococcus aureus subsp. aureus Mu50
cacguugugcaauaccuguucca

SEQ ID NO: 2052646 - RNA, 20 nt, Staphylococcus aureus subsp. aureus Mu50
cacguucuugguauuuuuua

SEQ ID NO: 2052647 - RNA, 12 nt, Staphylococcus aureus subsp. aureus Mu50
cacguaaaauau

SEQ ID NO: 2052648 - RNA, 23 nt, Staphylococcus aureus subsp. aureus Mu50
cacgauuacgcucauaugucugu

SEQ ID NO: 2052649 - RNA, 20 nt, Staphylococcus aureus subsp. aureus Mu50
cacgauaaaaauaaaaaacg

SEQ ID NO: 2052650 - RNA, 23 nt, Staphylococcus aureus subsp. aureus Mu50
cacgauauaacauuaaaaugaua

SEQ ID NO: 2052651 - RNA, 16 nt, Staphylococcus aureus subsp. aureus Mu50
cacgcauuacuuuaga

SEQ ID NO: 2052652 - RNA, 16 nt, Staphylococcus aureus subsp. aureus Mu50
cacgcugaaauuuuuu

SEQ ID NO: 2052653 - RNA, 21 nt, Staphylococcus aureus subsp. aureus Mu50
cacgcucauuuucuguugcag

SEQ ID NO: 2052654 - RNA, 13 nt, Staphylococcus aureus subsp. aureus Mu50
cacgcguucaaau

SEQ ID NO: 2052655 - RNA, 17 nt, Staphylococcus aureus subsp. aureus Mu50
cacccugcuuaucauua

SEQ ID NO: 2052656 - RNA, 21 nt, Staphylococcus aureus subsp. aureus Mu50
caccuggucguacuuucaaau

SEQ ID NO: 2052657 - RNA, 17 nt, Staphylococcus aureus subsp. aureus Mu50
caccuuaccuacuuuuu

SEQ ID NO: 2052658 - RNA, 20 nt, Staphylococcus aureus subsp. aureus Mu50
caccugcuaguucagcuucu

SEQ ID NO: 2052659 - RNA, 17 nt, Staphylococcus aureus subsp. aureus Mu50
caccuuuagacaauauu

SEQ ID NO: 2052660 - RNA, 17 nt, Staphylococcus aureus subsp. aureus Mu50
cacgaacaagucuugca

SEQ ID NO: 2052661 - RNA, 19 nt, Staphylococcus aureus subsp. aureus Mu50
caccuuuggcuacugcacc

SEQ ID NO: 2052662 - RNA, 22 nt, Staphylococcus aureus subsp. aureus Mu50
cacgaaauggugaacuaaauug

SEQ ID NO: 2052663 - RNA, 19 nt, Staphylococcus aureus subsp. aureus Mu50
cacgacgcuaaacaaaggg

SEQ ID NO: 2052664 - RNA, 20 nt, Staphylococcus aureus subsp. aureus Mu50
cacgacgcuaaacaaagggg

SEQ ID NO: 2052665 - RNA, 13 nt, Staphylococcus aureus subsp. aureus Mu50
cacgauaaaaaua

SEQ ID NO: 2052666 - RNA, 17 nt, Staphylococcus aureus subsp. aureus Mu50
cacgagcugcuucaacu

SEQ ID NO: 2052667 - RNA, 11 nt, Staphylococcus aureus subsp. aureus Mu50
cacgagaaaug

SEQ ID NO: 2052668 - RNA, 12 nt, Staphylococcus aureus subsp. aureus Mu50
caccugcaauuu

SEQ ID NO: 2052669 - RNA, 17 nt, Staphylococcus aureus subsp. aureus Mu50
caccugauugacaaugu

SEQ ID NO: 2052670 - RNA, 15 nt, Staphylococcus aureus subsp. aureus Mu50
caccugcagcauccu

SEQ ID NO: 2052671 - RNA, 19 nt, Staphylococcus aureus subsp. aureus Mu50
caccuacaaauauuucuaa

SEQ ID NO: 2052672 - RNA, 20 nt, Staphylococcus aureus subsp. aureus Mu50
caccuauuuuuugagcacuu

SEQ ID NO: 2052673 - RNA, 14 nt, Staphylococcus aureus subsp. aureus Mu50
caccuauuaggauc

SEQ ID NO: 2052674 - RNA, 17 nt, Staphylococcus aureus subsp. aureus Mu50
caccuauacauaacccu

SEQ ID NO: 2052675 - RNA, 18 nt, Staphylococcus aureus subsp. aureus Mu50
caccguaaucuuuuaacu

SEQ ID NO: 2052676 - RNA, 18 nt, Staphylococcus aureus subsp. aureus Mu50
caccauauuuaacauuuu

SEQ ID NO: 2052677 - RNA, 13 nt, Staphylococcus aureus subsp. aureus Mu50
caccagccucugu

SEQ ID NO: 2052678 - RNA, 23 nt, Staphylococcus aureus subsp. aureus Mu50
caccagccucuguguuggggccc

SEQ ID NO: 2052679 - RNA, 17 nt, Staphylococcus aureus subsp. aureus Mu50
caccagccccaauuagc

SEQ ID NO: 2052680 - RNA, 23 nt, Staphylococcus aureus subsp. aureus Mu50
caccaucuguaacuaauaugauu

SEQ ID NO: 2052681 - RNA, 16 nt, Staphylococcus aureus subsp. aureus Mu50
caccagaacaauucaa

SEQ ID NO: 2052682 - RNA, 16 nt, Staphylococcus aureus subsp. aureus Mu50
caccaccugcaauuug

SEQ ID NO: 2052683 - RNA, 22 nt, Staphylococcus aureus subsp. aureus Mu50
caccaaauccaucuaauucaau

SEQ ID NO: 2052684 - RNA, 23 nt, Staphylococcus aureus subsp. aureus Mu50
caccaacaauagguacaacuaaa

SEQ ID NO: 2052685 - RNA, 13 nt, Staphylococcus aureus subsp. aureus Mu50
caccaacaacuuu

SEQ ID NO: 2052686 - RNA, 15 nt, Staphylococcus aureus subsp. aureus Mu50
caccaaaaaucaucc

SEQ ID NO: 2052687 - RNA, 23 nt, Staphylococcus aureus subsp. aureus Mu50
cacauuuuuaguuagaaaguauu

SEQ ID NO: 2052688 - RNA, 18 nt, Staphylococcus aureus subsp. aureus Mu50
cacauuuacuuaagaacu

SEQ ID NO: 2052689 - RNA, 22 nt, Staphylococcus aureus subsp. aureus Mu50
cacauucugcccugcaaugcaa

SEQ ID NO: 2052690 - RNA, 17 nt, Staphylococcus aureus subsp. aureus Mu50
cacauucaaauaaauga

SEQ ID NO: 2052691 - RNA, 16 nt, Staphylococcus aureus subsp. aureus Mu50
cacauucaauauuuga

SEQ ID NO: 2052692 - RNA, 16 nt, Staphylococcus aureus subsp. aureus Mu50
cacauccccuuugaua

SEQ ID NO: 2052693 - RNA, 21 nt, Staphylococcus aureus subsp. aureus Mu50
cacaucgaucuaaauauauua

SEQ ID NO: 2052694 - RNA, 15 nt, Staphylococcus aureus subsp. aureus Mu50
cacaucgcauaauau

SEQ ID NO: 2052695 - RNA, 21 nt, Staphylococcus aureus subsp. aureus Mu50
cacaugcacuuuauuaaaaau

SEQ ID NO: 2052696 - RNA, 14 nt, Staphylococcus aureus subsp. aureus Mu50
cacauuaacaaggc

SEQ ID NO: 2052697 - RNA, 23 nt, Staphylococcus aureus subsp. aureus Mu50
cacauguacguuuuuuuaaauac

SEQ ID NO: 2052698 - RNA, 21 nt, Staphylococcus aureus subsp. aureus Mu50
cacagagaaauucgaaaagaa

SEQ ID NO: 2052699 - RNA, 18 nt, Staphylococcus aureus subsp. aureus Mu50
cacagacguuuuugaauc

SEQ ID NO: 2052700 - RNA, 18 nt, Staphylococcus aureus subsp. aureus Mu50
cacagcgauuaaaugaug

SEQ ID NO: 2052701 - RNA, 12 nt, Staphylococcus aureus subsp. aureus Mu50
cacauaaaucaa

SEQ ID NO: 2052702 - RNA, 13 nt, Staphylococcus aureus subsp. aureus Mu50
cacauacauuuug

SEQ ID NO: 2052703 - RNA, 20 nt, Staphylococcus aureus subsp. aureus Mu50
cacaaugcccuuaaagcaca

SEQ ID NO: 2052704 - RNA, 15 nt, Staphylococcus aureus subsp. aureus Mu50
cacaauuguauaaug

SEQ ID NO: 2052705 - RNA, 22 nt, Staphylococcus aureus subsp. aureus Mu50
cacaccaccaccugugacaaau

SEQ ID NO: 2052706 - RNA, 15 nt, Staphylococcus aureus subsp. aureus Mu50
cacacaugauaauuu

SEQ ID NO: 2052707 - RNA, 22 nt, Staphylococcus aureus subsp. aureus Mu50
cacacagguaaauuuaaaauaa

SEQ ID NO: 2052708 - RNA, 18 nt, Staphylococcus aureus subsp. aureus Mu50
cacacacaguuuauaaua

SEQ ID NO: 2052709 - RNA, 17 nt, Staphylococcus aureus subsp. aureus Mu50
cacaaucuguucauaau

SEQ ID NO: 2052710 - RNA, 18 nt, Staphylococcus aureus subsp. aureus Mu50
cacaccccaacucgcauu

SEQ ID NO: 2052711 - RNA, 18 nt, Staphylococcus aureus subsp. aureus Mu50
cacacuauuguaagcuga

SEQ ID NO: 2052712 - RNA, 15 nt, Staphylococcus aureus subsp. aureus Mu50
cacacuuuaaacaag

SEQ ID NO: 2052713 - RNA, 14 nt, Staphylococcus aureus subsp. aureus Mu50
cacacuuuaaacaa

SEQ ID NO: 2052714 - RNA, 16 nt, Staphylococcus aureus subsp. aureus Mu50
cacaaccagucagaaa

SEQ ID NO: 2052715 - RNA, 14 nt, Staphylococcus aureus subsp. aureus Mu50
cacaacacauaaau

SEQ ID NO: 2052716 - RNA, 17 nt, Staphylococcus aureus subsp. aureus Mu50
cacaacacauaaauuaa

SEQ ID NO: 2052717 - RNA, 19 nt, Staphylococcus aureus subsp. aureus Mu50
cacaaagauauguuuauau

SEQ ID NO: 2052718 - RNA, 14 nt, Staphylococcus aureus subsp. aureus Mu50
cacaaauaaaggca

SEQ ID NO: 2052719 - RNA, 17 nt, Staphylococcus aureus subsp. aureus Mu50
caauuucuucauuuuca

SEQ ID NO: 2052720 - RNA, 23 nt, Staphylococcus aureus subsp. aureus Mu50
caauuugcuguccacuauauccu

SEQ ID NO: 2052721 - RNA, 15 nt, Staphylococcus aureus subsp. aureus Mu50
caauuuggaaauauc

SEQ ID NO: 2052722 - RNA, 13 nt, Staphylococcus aureus subsp. aureus Mu50
caauuucuguaau

SEQ ID NO: 2052723 - RNA, 17 nt, Staphylococcus aureus subsp. aureus Mu50
caauuuauuauuaacug

SEQ ID NO: 2052724 - RNA, 16 nt, Staphylococcus aureus subsp. aureus Mu50
caauuuauuuuuauau

SEQ ID NO: 2052725 - RNA, 23 nt, Staphylococcus aureus subsp. aureus Mu50
caauuucacgcugaaauuuuuua

SEQ ID NO: 2052726 - RNA, 14 nt, Staphylococcus aureus subsp. aureus Mu50
cacaaaaaugaaga

SEQ ID NO: 2052727 - RNA, 19 nt, Staphylococcus aureus subsp. aureus Mu50
caauuuuucacuuauaaca

SEQ ID NO: 2052728 - RNA, 18 nt, Staphylococcus aureus subsp. aureus Mu50
caauuuuuacuaaaucau

SEQ ID NO: 2052729 - RNA, 16 nt, Staphylococcus aureus subsp. aureus Mu50
caauuuuuaacaaaau

SEQ ID NO: 2052730 - RNA, 15 nt, Staphylococcus aureus subsp. aureus Mu50
caauuuuuucaucuu

SEQ ID NO: 2052731 - RNA, 16 nt, Staphylococcus aureus subsp. aureus Mu50
caauuuugacuacuaa

SEQ ID NO: 2052732 - RNA, 17 nt, Staphylococcus aureus subsp. aureus Mu50
caauuuugacuacuaau

SEQ ID NO: 2052733 - RNA, 13 nt, Staphylococcus aureus subsp. aureus Mu50
caauuuuaccaug

SEQ ID NO: 2052734 - RNA, 17 nt, Staphylococcus aureus subsp. aureus Mu50
caauuuuaaaucuuuua

SEQ ID NO: 2052735 - RNA, 22 nt, Staphylococcus aureus subsp. aureus Mu50
caauuuguccuucgcuaugacc

SEQ ID NO: 2052736 - RNA, 19 nt, Staphylococcus aureus subsp. aureus Mu50
caauuuggucauauaaaca

SEQ ID NO: 2052737 - RNA, 20 nt, Staphylococcus aureus subsp. aureus Mu50
caauuuguaacuauugaaaa

SEQ ID NO: 2052738 - RNA, 15 nt, Staphylococcus aureus subsp. aureus Mu50
caauuaaaacuauaa

SEQ ID NO: 2052739 - RNA, 20 nt, Staphylococcus aureus subsp. aureus Mu50
caauuaaucggaucauuauu

SEQ ID NO: 2052740 - RNA, 17 nt, Staphylococcus aureus subsp. aureus Mu50
caauuaaugauaaaccg

SEQ ID NO: 2052741 - RNA, 22 nt, Staphylococcus aureus subsp. aureus Mu50
caauuaauuuagucauuacaaa

SEQ ID NO: 2052742 - RNA, 23 nt, Staphylococcus aureus subsp. aureus Mu50
caauuaauuuagucauuacaaau

SEQ ID NO: 2052743 - RNA, 23 nt, Staphylococcus aureus subsp. aureus Mu50
caauuagaaaacaucuuacugcu

SEQ ID NO: 2052744 - RNA, 17 nt, Staphylococcus aureus subsp. aureus Mu50
caauuaucaacauaaua

SEQ ID NO: 2052745 - RNA, 15 nt, Staphylococcus aureus subsp. aureus Mu50
caauuacucuuuuuc

SEQ ID NO: 2052746 - RNA, 20 nt, Staphylococcus aureus subsp. aureus Mu50
caauuacucuuuuucuuuca

SEQ ID NO: 2052747 - RNA, 18 nt, Staphylococcus aureus subsp. aureus Mu50
caauuaucaacauaauau

SEQ ID NO: 2052748 - RNA, 14 nt, Staphylococcus aureus subsp. aureus Mu50
caauuauggauaaa

SEQ ID NO: 2052749 - RNA, 12 nt, Staphylococcus aureus subsp. aureus Mu50
caauuauggaua

SEQ ID NO: 2052750 - RNA, 13 nt, Staphylococcus aureus subsp. aureus Mu50
caauuuaaauaag

SEQ ID NO: 2052751 - RNA, 18 nt, Staphylococcus aureus subsp. aureus Mu50
caauugcauacguaaaug

SEQ ID NO: 2052752 - RNA, 13 nt, Staphylococcus aureus subsp. aureus Mu50
caauugcauacgu

SEQ ID NO: 2052753 - RNA, 24 nt, Staphylococcus aureus subsp. aureus Mu50
caauugcaaugaauaacaagaaaa

SEQ ID NO: 2052754 - RNA, 12 nt, Staphylococcus aureus subsp. aureus Mu50
caauugcaauga

SEQ ID NO: 2052755 - RNA, 15 nt, Staphylococcus aureus subsp. aureus Mu50
caauugcaaugaaua

SEQ ID NO: 2052756 - RNA, 17 nt, Staphylococcus aureus subsp. aureus Mu50
caauucggauuauauuu

SEQ ID NO: 2052757 - RNA, 21 nt, Staphylococcus aureus subsp. aureus Mu50
caauucugugagguaaaacua

SEQ ID NO: 2052758 - RNA, 22 nt, Staphylococcus aureus subsp. aureus Mu50
caauucauuaauaggauuauua

SEQ ID NO: 2052759 - RNA, 19 nt, Staphylococcus aureus subsp. aureus Mu50
auccuuguucuauuugaua

SEQ ID NO: 2052760 - RNA, 17 nt, Staphylococcus aureus subsp. aureus Mu50
auccuugcuaucaaacu

SEQ ID NO: 2052761 - RNA, 23 nt, Staphylococcus aureus subsp. aureus Mu50
aucgaacuaguacgaaaugcaau

SEQ ID NO: 2052762 - RNA, 16 nt, Staphylococcus aureus subsp. aureus Mu50
auccuuugcucaccuu

SEQ ID NO: 2052763 - RNA, 14 nt, Staphylococcus aureus subsp. aureus Mu50
aucgaauuuucaaa

SEQ ID NO: 2052764 - RNA, 22 nt, Staphylococcus aureus subsp. aureus Mu50
aucgaauuuucaaagacguaca

SEQ ID NO: 2052765 - RNA, 14 nt, Staphylococcus aureus subsp. aureus Mu50
aucgaauucauuug

SEQ ID NO: 2052766 - RNA, 18 nt, Staphylococcus aureus subsp. aureus Mu50
aucgauugccauagaaau

SEQ ID NO: 2052767 - RNA, 14 nt, Staphylococcus aureus subsp. aureus Mu50
aucgauuaguuuuu

SEQ ID NO: 2052768 - RNA, 18 nt, Staphylococcus aureus subsp. aureus Mu50
aucgauuaguuuuugguu

SEQ ID NO: 2052769 - RNA, 19 nt, Staphylococcus aureus subsp. aureus Mu50
aucgaugacuuugucuuua

SEQ ID NO: 2052770 - RNA, 14 nt, Staphylococcus aureus subsp. aureus Mu50
aucgcuugcuucuu

SEQ ID NO: 2052771 - RNA, 22 nt, Staphylococcus aureus subsp. aureus Mu50
aucuaacaaucguuuuaaugcc

SEQ ID NO: 2052772 - RNA, 18 nt, Staphylococcus aureus subsp. aureus Mu50
aucguaacauaucagcuu

SEQ ID NO: 2052773 - RNA, 14 nt, Staphylococcus aureus subsp. aureus Mu50
aucguaaaaaacaa

SEQ ID NO: 2052774 - RNA, 13 nt, Staphylococcus aureus subsp. aureus Mu50
aucguaaacauaa

SEQ ID NO: 2052775 - RNA, 19 nt, Staphylococcus aureus subsp. aureus Mu50
auccugcuuauuaauuguu

SEQ ID NO: 2052776 - RNA, 14 nt, Staphylococcus aureus subsp. aureus Mu50
auccuggaauauua

SEQ ID NO: 2052777 - RNA, 16 nt, Staphylococcus aureus subsp. aureus Mu50
auccuggaauauuaac

SEQ ID NO: 2052778 - RNA, 15 nt, Staphylococcus aureus subsp. aureus Mu50
auccugccaauauau

SEQ ID NO: 2052779 - RNA, 16 nt, Staphylococcus aureus subsp. aureus Mu50
auccugccaauauauu

SEQ ID NO: 2052780 - RNA, 17 nt, Staphylococcus aureus subsp. aureus Mu50
auccugccaauauauuc

SEQ ID NO: 2052781 - RNA, 19 nt, Staphylococcus aureus subsp. aureus Mu50
auccugccaauauauucac

SEQ ID NO: 2052782 - RNA, 14 nt, Staphylococcus aureus subsp. aureus Mu50
auccuaauuuuucu

SEQ ID NO: 2052783 - RNA, 17 nt, Staphylococcus aureus subsp. aureus Mu50
auccuaauuuuucucca

SEQ ID NO: 2052784 - RNA, 16 nt, Staphylococcus aureus subsp. aureus Mu50
auccucaguuauacca

SEQ ID NO: 2052785 - RNA, 21 nt, Staphylococcus aureus subsp. aureus Mu50
auccuauggcgcaauuuuuaa

SEQ ID NO: 2052786 - RNA, 17 nt, Staphylococcus aureus subsp. aureus Mu50
auccuaugccaaauaac

SEQ ID NO: 2052787 - RNA, 20 nt, Staphylococcus aureus subsp. aureus Mu50
auccuauggcgcaauuuuua

SEQ ID NO: 2052788 - RNA, 19 nt, Staphylococcus aureus subsp. aureus Mu50
aucccuuuuagcauaauua

SEQ ID NO: 2052789 - RNA, 16 nt, Staphylococcus aureus subsp. aureus Mu50
aucccuguaaaaccau

SEQ ID NO: 2052790 - RNA, 22 nt, Staphylococcus aureus subsp. aureus Mu50
auccgauuuugauauaaaaagu

SEQ ID NO: 2052791 - RNA, 14 nt, Staphylococcus aureus subsp. aureus Mu50
auccccauuuaugu

SEQ ID NO: 2052792 - RNA, 19 nt, Staphylococcus aureus subsp. aureus Mu50
auccccagccauuuguugu

SEQ ID NO: 2052793 - RNA, 14 nt, Staphylococcus aureus subsp. aureus Mu50
aucccauuuuaaag

SEQ ID NO: 2052794 - RNA, 16 nt, Staphylococcus aureus subsp. aureus Mu50
aucccucuaucaaauu

SEQ ID NO: 2052795 - RNA, 19 nt, Staphylococcus aureus subsp. aureus Mu50
auccagcgacauguccugu

SEQ ID NO: 2052796 - RNA, 17 nt, Staphylococcus aureus subsp. aureus Mu50
auccaguaaucaaagau

SEQ ID NO: 2052797 - RNA, 19 nt, Staphylococcus aureus subsp. aureus Mu50
aucccauaacaaucauuuc

SEQ ID NO: 2052798 - RNA, 14 nt, Staphylococcus aureus subsp. aureus Mu50
auccaucuacaccc

SEQ ID NO: 2052799 - RNA, 13 nt, Staphylococcus aureus subsp. aureus Mu50
auccaucuaauuc

SEQ ID NO: 2052800 - RNA, 20 nt, Staphylococcus aureus subsp. aureus Mu50
auccaucaauaccauaauua

SEQ ID NO: 2052801 - RNA, 18 nt, Staphylococcus aureus subsp. aureus Mu50
aucauuuuuaauuuugac

SEQ ID NO: 2052802 - RNA, 18 nt, Staphylococcus aureus subsp. aureus Mu50
auccaaaauccugaaauu

SEQ ID NO: 2052803 - RNA, 18 nt, Staphylococcus aureus subsp. aureus Mu50
aucauuuggcguucaaca

SEQ ID NO: 2052804 - RNA, 12 nt, Staphylococcus aureus subsp. aureus Mu50
aucauuuguguu

SEQ ID NO: 2052805 - RNA, 21 nt, Staphylococcus aureus subsp. aureus Mu50
auccaaggauguuauaaaaug

SEQ ID NO: 2052806 - RNA, 20 nt, Staphylococcus aureus subsp. aureus Mu50
aucauuguggcuuuuuuuau

SEQ ID NO: 2052807 - RNA, 15 nt, Staphylococcus aureus subsp. aureus Mu50
aucauugguuucauc

SEQ ID NO: 2052808 - RNA, 16 nt, Staphylococcus aureus subsp. aureus Mu50
aucauuguaaaacaaa

SEQ ID NO: 2052809 - RNA, 16 nt, Staphylococcus aureus subsp. aureus Mu50
aucauuucugucgcuu

SEQ ID NO: 2052810 - RNA, 18 nt, Staphylococcus aureus subsp. aureus Mu50
aucauuucagaaauacau

SEQ ID NO: 2052811 - RNA, 22 nt, Staphylococcus aureus subsp. aureus Mu50
aucauucuuuauagaaaccaaa

SEQ ID NO: 2052812 - RNA, 17 nt, Staphylococcus aureus subsp. aureus Mu50
aucauucuuuauagaaa

SEQ ID NO: 2052813 - RNA, 22 nt, Staphylococcus aureus subsp. aureus Mu50
aucauugauauagucaaugaau

SEQ ID NO: 2052814 - RNA, 21 nt, Staphylococcus aureus subsp. aureus Mu50
aucauucuguguaaauauaaa

SEQ ID NO: 2052815 - RNA, 19 nt, Staphylococcus aureus subsp. aureus Mu50
aucauucuguguaaauaua

SEQ ID NO: 2052816 - RNA, 20 nt, Staphylococcus aureus subsp. aureus Mu50
aucauucuguguaaauauaa

SEQ ID NO: 2052817 - RNA, 16 nt, Staphylococcus aureus subsp. aureus Mu50
aucauucauuugcaaa

SEQ ID NO: 2052818 - RNA, 23 nt, Staphylococcus aureus subsp. aureus Mu50
aucauguaaugcuuaaaaacaau

SEQ ID NO: 2052819 - RNA, 23 nt, Staphylococcus aureus subsp. aureus Mu50
aucaugugcuuuguuuaucaauu

SEQ ID NO: 2052820 - RNA, 15 nt, Staphylococcus aureus subsp. aureus Mu50
aucauuaauaauuaa

SEQ ID NO: 2052821 - RNA, 20 nt, Staphylococcus aureus subsp. aureus Mu50
aucauuaauuggauuuuuac

SEQ ID NO: 2052822 - RNA, 11 nt, Staphylococcus aureus subsp. aureus Mu50
aucauuaaaau

SEQ ID NO: 2052823 - RNA, 12 nt, Staphylococcus aureus subsp. aureus Mu50
aucauuaaaauc

SEQ ID NO: 2052824 - RNA, 20 nt, Staphylococcus aureus subsp. aureus Mu50
aucauguucuaaugcugcuu

SEQ ID NO: 2052825 - RNA, 14 nt, Staphylococcus aureus subsp. aureus Mu50
aucauuaucaaaua

SEQ ID NO: 2052826 - RNA, 19 nt, Staphylococcus aureus subsp. aureus Mu50
aucauuauuugauaaauaa

SEQ ID NO: 2052827 - RNA, 16 nt, Staphylococcus aureus subsp. aureus Mu50
aucauuagcaauuuca

SEQ ID NO: 2052828 - RNA, 15 nt, Staphylococcus aureus subsp. aureus Mu50
aucauuauaaaaugg

SEQ ID NO: 2052829 - RNA, 16 nt, Staphylococcus aureus subsp. aureus Mu50
aucauuaguuuuuaaa

SEQ ID NO: 2052830 - RNA, 20 nt, Staphylococcus aureus subsp. aureus Mu50
aucauuaguuuuuaaaauua

SEQ ID NO: 2052831 - RNA, 19 nt, Staphylococcus aureus subsp. aureus Mu50
aucaugacuauuuuccauc

SEQ ID NO: 2052832 - RNA, 24 nt, Staphylococcus aureus subsp. aureus Mu50
aucaugacuauuuuccaucacaua

SEQ ID NO: 2052833 - RNA, 16 nt, Staphylococcus aureus subsp. aureus Mu50
aucaugaaguugguuu

SEQ ID NO: 2052834 - RNA, 20 nt, Staphylococcus aureus subsp. aureus Mu50
aucaucuuuuugaaauuucg

SEQ ID NO: 2052835 - RNA, 15 nt, Staphylococcus aureus subsp. aureus Mu50
aucaugcaaaacuaa

SEQ ID NO: 2052836 - RNA, 21 nt, Staphylococcus aureus subsp. aureus Mu50
aucauggucaacuuuuuuaac

SEQ ID NO: 2052837 - RNA, 13 nt, Staphylococcus aureus subsp. aureus Mu50
aucaugccuucau

SEQ ID NO: 2052838 - RNA, 19 nt, Staphylococcus aureus subsp. aureus Mu50
aucaugccuucaugaauaa

SEQ ID NO: 2052839 - RNA, 17 nt, Staphylococcus aureus subsp. aureus Mu50
aucaugcucguuuuuau

SEQ ID NO: 2052840 - RNA, 11 nt, Staphylococcus aureus subsp. aureus Mu50
aucaugcuuuu

SEQ ID NO: 2052841 - RNA, 18 nt, Staphylococcus aureus subsp. aureus Mu50
aucaugcuuuuaauauua

SEQ ID NO: 2052842 - RNA, 21 nt, Staphylococcus aureus subsp. aureus Mu50
aucaucacuguagauucaaau

SEQ ID NO: 2052843 - RNA, 16 nt, Staphylococcus aureus subsp. aureus Mu50
aucauccauaaaaaua

SEQ ID NO: 2052844 - RNA, 21 nt, Staphylococcus aureus subsp. aureus Mu50
aucaucaacaaucuuuuucau

SEQ ID NO: 2052845 - RNA, 17 nt, Staphylococcus aureus subsp. aureus Mu50
aucaucacacucucccc

SEQ ID NO: 2052846 - RNA, 11 nt, Staphylococcus aureus subsp. aureus Mu50
aucaucuauuc

SEQ ID NO: 2052847 - RNA, 19 nt, Staphylococcus aureus subsp. aureus Mu50
aucaucguauuucauauau

SEQ ID NO: 2052848 - RNA, 14 nt, Staphylococcus aureus subsp. aureus Mu50
aucaucuauucaac

SEQ ID NO: 2052849 - RNA, 23 nt, Staphylococcus aureus subsp. aureus Mu50
aucaucuccuugguuauuaaaau

SEQ ID NO: 2052850 - RNA, 18 nt, Staphylococcus aureus subsp. aureus Mu50
aucaucucugcuuuaaua

SEQ ID NO: 2052851 - RNA, 17 nt, Staphylococcus aureus subsp. aureus Mu50
aucaucgcaaauacaua

SEQ ID NO: 2052852 - RNA, 14 nt, Staphylococcus aureus subsp. aureus Mu50
aucaucgaacauga

SEQ ID NO: 2052853 - RNA, 15 nt, Staphylococcus aureus subsp. aureus Mu50
aucauauucaaaaua

SEQ ID NO: 2052854 - RNA, 15 nt, Staphylococcus aureus subsp. aureus Mu50
aucauaugucuuaac

SEQ ID NO: 2052855 - RNA, 14 nt, Staphylococcus aureus subsp. aureus Mu50
aucauaucauacca

SEQ ID NO: 2052856 - RNA, 17 nt, Staphylococcus aureus subsp. aureus Mu50
aucauauaaaucaaaua

SEQ ID NO: 2052857 - RNA, 23 nt, Staphylococcus aureus subsp. aureus Mu50
aucauauaaugguugaauaacac

SEQ ID NO: 2052858 - RNA, 16 nt, Staphylococcus aureus subsp. aureus Mu50
aucauagcauuaagau

SEQ ID NO: 2052859 - RNA, 13 nt, Staphylococcus aureus subsp. aureus Mu50
aucauacgagaaa

SEQ ID NO: 2052860 - RNA, 12 nt, Staphylococcus aureus subsp. aureus Mu50
aucauaaauauu

SEQ ID NO: 2052861 - RNA, 13 nt, Staphylococcus aureus subsp. aureus Mu50
aucauaauauuga

SEQ ID NO: 2052862 - RNA, 17 nt, Staphylococcus aureus subsp. aureus Mu50
aucauaauuuuguuuug

SEQ ID NO: 2052863 - RNA, 17 nt, Staphylococcus aureus subsp. aureus Mu50
aucauaaucauaaaaau

SEQ ID NO: 2052864 - RNA, 13 nt, Staphylococcus aureus subsp. aureus Mu50
aucauaaagauaa

SEQ ID NO: 2052865 - RNA, 19 nt, Staphylococcus aureus subsp. aureus Mu50
aucaguuuuugaauauuug

SEQ ID NO: 2052866 - RNA, 13 nt, Staphylococcus aureus subsp. aureus Mu50
aucaguuuuuaaa

SEQ ID NO: 2052867 - RNA, 17 nt, Staphylococcus aureus subsp. aureus Mu50
aucaguccgcuuuuuca

SEQ ID NO: 2052868 - RNA, 19 nt, Staphylococcus aureus subsp. aureus Mu50
aucagugugauuuuggaac

SEQ ID NO: 2052869 - RNA, 12 nt, Staphylococcus aureus subsp. aureus Mu50
aucaguuauuuu

SEQ ID NO: 2052870 - RNA, 15 nt, Staphylococcus aureus subsp. aureus Mu50
aucaguuauuuuaau

SEQ ID NO: 2052871 - RNA, 16 nt, Staphylococcus aureus subsp. aureus Mu50
aucaguauaaucagca

SEQ ID NO: 2052872 - RNA, 23 nt, Staphylococcus aureus subsp. aureus Mu50
aucaguaccaaagaaaucaccag

SEQ ID NO: 2052873 - RNA, 13 nt, Staphylococcus aureus subsp. aureus Mu50
aucaguaauaaua

SEQ ID NO: 2052874 - RNA, 23 nt, Staphylococcus aureus subsp. aureus Mu50
aucaaucgcuuuagcaauugaau

SEQ ID NO: 2052875 - RNA, 17 nt, Staphylococcus aureus subsp. aureus Mu50
aucaaucgcuuuagcaa

SEQ ID NO: 2052876 - RNA, 17 nt, Staphylococcus aureus subsp. aureus Mu50
aucaauccaucaauacc

SEQ ID NO: 2052877 - RNA, 15 nt, Staphylococcus aureus subsp. aureus Mu50
aucaggaccaaauag

SEQ ID NO: 2052878 - RNA, 16 nt, Staphylococcus aureus subsp. aureus Mu50
augcaugcgcaaaagc

SEQ ID NO: 2052879 - RNA, 17 nt, Staphylococcus aureus subsp. aureus Mu50
augcaugcgcaaaagcg

SEQ ID NO: 2052880 - RNA, 21 nt, Staphylococcus aureus subsp. aureus Mu50
augcaugcgcaaaagcgcagg

SEQ ID NO: 2052881 - RNA, 12 nt, Staphylococcus aureus subsp. aureus Mu50
augccaaauaac

SEQ ID NO: 2052882 - RNA, 23 nt, Staphylococcus aureus subsp. aureus Mu50
augccaaauaacguuaauauaau

SEQ ID NO: 2052883 - RNA, 21 nt, Staphylococcus aureus subsp. aureus Mu50
augcucuauauauccauucaa

SEQ ID NO: 2052884 - RNA, 19 nt, Staphylococcus aureus subsp. aureus Mu50
augcucucuucaaaguaga

SEQ ID NO: 2052885 - RNA, 20 nt, Staphylococcus aureus subsp. aureus Mu50
augcucuauauauccauuca

SEQ ID NO: 2052886 - RNA, 15 nt, Staphylococcus aureus subsp. aureus Mu50
augcucguauagaaa

SEQ ID NO: 2052887 - RNA, 21 nt, Staphylococcus aureus subsp. aureus Mu50
augcucccuucaaaguuuuca

SEQ ID NO: 2052888 - RNA, 21 nt, Staphylococcus aureus subsp. aureus Mu50
augcuacacgaguauuaucac

SEQ ID NO: 2052889 - RNA, 18 nt, Staphylococcus aureus subsp. aureus Mu50
augcucaaguugauuauu

SEQ ID NO: 2052890 - RNA, 12 nt, Staphylococcus aureus subsp. aureus Mu50
augcuguuuuau

SEQ ID NO: 2052891 - RNA, 18 nt, Staphylococcus aureus subsp. aureus Mu50
augcuucaauauucuuau

SEQ ID NO: 2052892 - RNA, 19 nt, Staphylococcus aureus subsp. aureus Mu50
augcuucaauauucuuauc

SEQ ID NO: 2052893 - RNA, 14 nt, Staphylococcus aureus subsp. aureus Mu50
augcuuuaaaucga

SEQ ID NO: 2052894 - RNA, 17 nt, Staphylococcus aureus subsp. aureus Mu50
augcuuguacaaaaaau

SEQ ID NO: 2052895 - RNA, 17 nt, Staphylococcus aureus subsp. aureus Mu50
augcuuggacauauacu

SEQ ID NO: 2052896 - RNA, 19 nt, Staphylococcus aureus subsp. aureus Mu50
augcuucgcacaacugcau

SEQ ID NO: 2052897 - RNA, 17 nt, Staphylococcus aureus subsp. aureus Mu50
augcuucgaauuuaaca

SEQ ID NO: 2052898 - RNA, 22 nt, Staphylococcus aureus subsp. aureus Mu50
augcuuccuuuuuguuauaucu

SEQ ID NO: 2052899 - RNA, 17 nt, Staphylococcus aureus subsp. aureus Mu50
augcugaauaaauaacu

SEQ ID NO: 2052900 - RNA, 17 nt, Staphylococcus aureus subsp. aureus Mu50
augcugauaauuuuucu

SEQ ID NO: 2052901 - RNA, 21 nt, Staphylococcus aureus subsp. aureus Mu50
auggaaguuguugcuuuggua

SEQ ID NO: 2052902 - RNA, 15 nt, Staphylococcus aureus subsp. aureus Mu50
augcuuuuaauauua

SEQ ID NO: 2052903 - RNA, 17 nt, Staphylococcus aureus subsp. aureus Mu50
augcuuuuaauauuaua

SEQ ID NO: 2052904 - RNA, 20 nt, Staphylococcus aureus subsp. aureus Mu50
augcuuuuuuuacaauauga

SEQ ID NO: 2052905 - RNA, 23 nt, Staphylococcus aureus subsp. aureus Mu50
augcuuuuuuuacaauaugauua

SEQ ID NO: 2052906 - RNA, 16 nt, Staphylococcus aureus subsp. aureus Mu50
auggaugaauauauug

SEQ ID NO: 2052907 - RNA, 21 nt, Staphylococcus aureus subsp. aureus Mu50
auggaucauaaucauaaaaau

SEQ ID NO: 2052908 - RNA, 15 nt, Staphylococcus aureus subsp. aureus Mu50
auggagcggaagaua

SEQ ID NO: 2052909 - RNA, 16 nt, Staphylococcus aureus subsp. aureus Mu50
auggagcggaagauag

SEQ ID NO: 2052910 - RNA, 18 nt, Staphylococcus aureus subsp. aureus Mu50
auggagcggaagauagga

SEQ ID NO: 2052911 - RNA, 22 nt, Staphylococcus aureus subsp. aureus Mu50
auggacuaagauauaaggaaaa

SEQ ID NO: 2052912 - RNA, 16 nt, Staphylococcus aureus subsp. aureus Mu50
auggacaguuuuuaua

SEQ ID NO: 2052913 - RNA, 14 nt, Staphylococcus aureus subsp. aureus Mu50
augucuaaaaaugu

SEQ ID NO: 2052914 - RNA, 21 nt, Staphylococcus aureus subsp. aureus Mu50
augugcaucauuuauaugaug

SEQ ID NO: 2052915 - RNA, 22 nt, Staphylococcus aureus subsp. aureus Mu50
augucuuaggcgcuacaauguu

SEQ ID NO: 2052916 - RNA, 18 nt, Staphylococcus aureus subsp. aureus Mu50
augucucucuuucuuauu

SEQ ID NO: 2052917 - RNA, 17 nt, Staphylococcus aureus subsp. aureus Mu50
auguguaugauagaaua

SEQ ID NO: 2052918 - RNA, 22 nt, Staphylococcus aureus subsp. aureus Mu50
augugucaaauaggcauaauga

SEQ ID NO: 2052919 - RNA, 22 nt, Staphylococcus aureus subsp. aureus Mu50
augugcugugucuuuugauuuu

SEQ ID NO: 2052920 - RNA, 21 nt, Staphylococcus aureus subsp. aureus Mu50
auguuagaugacuuugucaua

SEQ ID NO: 2052921 - RNA, 21 nt, Staphylococcus aureus subsp. aureus Mu50
auguuauauuaaacuuauaac

SEQ ID NO: 2052922 - RNA, 18 nt, Staphylococcus aureus subsp. aureus Mu50
auguuagugacaagguau

SEQ ID NO: 2052923 - RNA, 19 nt, Staphylococcus aureus subsp. aureus Mu50
auguuacacaaauuaaaac

SEQ ID NO: 2052924 - RNA, 13 nt, Staphylococcus aureus subsp. aureus Mu50
auguguugcauua

SEQ ID NO: 2052925 - RNA, 20 nt, Staphylococcus aureus subsp. aureus Mu50
auguuccuuguuuuaaacuu

SEQ ID NO: 2052926 - RNA, 15 nt, Staphylococcus aureus subsp. aureus Mu50
auguuauuagauacu

SEQ ID NO: 2052927 - RNA, 22 nt, Staphylococcus aureus subsp. aureus Mu50
auguucccuuaccauuucuuca

SEQ ID NO: 2052928 - RNA, 18 nt, Staphylococcus aureus subsp. aureus Mu50
auguuccccauuaauuaa

SEQ ID NO: 2052929 - RNA, 23 nt, Staphylococcus aureus subsp. aureus Mu50
augucacugcaaacacaguacaa

SEQ ID NO: 2052930 - RNA, 18 nt, Staphylococcus aureus subsp. aureus Mu50
augucacugcaaacacag

SEQ ID NO: 2052931 - RNA, 21 nt, Staphylococcus aureus subsp. aureus Mu50
augucagucguuguaaaacua

SEQ ID NO: 2052932 - RNA, 14 nt, Staphylococcus aureus subsp. aureus Mu50
augucacauaugac

SEQ ID NO: 2052933 - RNA, 15 nt, Staphylococcus aureus subsp. aureus Mu50
augucacauaugacu

SEQ ID NO: 2052934 - RNA, 19 nt, Staphylococcus aureus subsp. aureus Mu50
augucaauagcgguuuaaa

SEQ ID NO: 2052935 - RNA, 19 nt, Staphylococcus aureus subsp. aureus Mu50
augucaauuuuuucaugau

SEQ ID NO: 2052936 - RNA, 17 nt, Staphylococcus aureus subsp. aureus Mu50
auguauuuuuauuuaua

SEQ ID NO: 2052937 - RNA, 19 nt, Staphylococcus aureus subsp. aureus Mu50
auguauuuaguaucaugau

SEQ ID NO: 2052938 - RNA, 14 nt, Staphylococcus aureus subsp. aureus Mu50
auguauuuauuacu

SEQ ID NO: 2052939 - RNA, 21 nt, Staphylococcus aureus subsp. aureus Mu50
augucauagccuauuuaaaag

SEQ ID NO: 2052940 - RNA, 16 nt, Staphylococcus aureus subsp. aureus Mu50
augucauagccuauuu

SEQ ID NO: 2052941 - RNA, 15 nt, Staphylococcus aureus subsp. aureus Mu50
augucaugaaaauaa

SEQ ID NO: 2052942 - RNA, 13 nt, Staphylococcus aureus subsp. aureus Mu50
auguauugcuaua

SEQ ID NO: 2052943 - RNA, 17 nt, Staphylococcus aureus subsp. aureus Mu50
auguauucuuagauauu

SEQ ID NO: 2052944 - RNA, 16 nt, Staphylococcus aureus subsp. aureus Mu50
auguacuauaaauccu

SEQ ID NO: 2052945 - RNA, 22 nt, Staphylococcus aureus subsp. aureus Mu50
auguacuuuucugucuguaaau

SEQ ID NO: 2052946 - RNA, 18 nt, Staphylococcus aureus subsp. aureus Mu50
auguacguuuuuuuaaau

SEQ ID NO: 2052947 - RNA, 23 nt, Staphylococcus aureus subsp. aureus Mu50
auguaccgaauccuucaucaaua

SEQ ID NO: 2052948 - RNA, 23 nt, Staphylococcus aureus subsp. aureus Mu50
auguacguuuuuuuaaauacaua

SEQ ID NO: 2052949 - RNA, 17 nt, Staphylococcus aureus subsp. aureus Mu50
auguacauguauaaaag

SEQ ID NO: 2052950 - RNA, 23 nt, Staphylococcus aureus subsp. aureus Mu50
auguacacuuuugauuguuuaaa

SEQ ID NO: 2052951 - RNA, 18 nt, Staphylococcus aureus subsp. aureus Mu50
auguacauuguaaauaua

SEQ ID NO: 2052952 - RNA, 20 nt, Staphylococcus aureus subsp. aureus Mu50
auguacacgagucauuaaau

SEQ ID NO: 2052953 - RNA, 21 nt, Staphylococcus aureus subsp. aureus Mu50
auguacaaccuuugcuuaaac

SEQ ID NO: 2052954 - RNA, 15 nt, Staphylococcus aureus subsp. aureus Mu50
auguaauuguuuuuu

SEQ ID NO: 2052955 - RNA, 17 nt, Staphylococcus aureus subsp. aureus Mu50
auguaacuuuagacaua

SEQ ID NO: 2052956 - RNA, 22 nt, Staphylococcus aureus subsp. aureus Mu50
auguaacauaaagcuguuuauu

SEQ ID NO: 2052957 - RNA, 13 nt, Staphylococcus aureus subsp. aureus Mu50
auguaauuauuuu

SEQ ID NO: 2052958 - RNA, 16 nt, Staphylococcus aureus subsp. aureus Mu50
auguaauuauuuuucu

SEQ ID NO: 2052959 - RNA, 18 nt, Staphylococcus aureus subsp. aureus Mu50
auguaaaugaaauaggcg

SEQ ID NO: 2052960 - RNA, 16 nt, Staphylococcus aureus subsp. aureus Mu50
auguaacaauuuagca

SEQ ID NO: 2052961 - RNA, 13 nt, Staphylococcus aureus subsp. aureus Mu50
augguugucucca

SEQ ID NO: 2052962 - RNA, 16 nt, Staphylococcus aureus subsp. aureus Mu50
auguaaauaaaaauua

SEQ ID NO: 2052963 - RNA, 17 nt, Staphylococcus aureus subsp. aureus Mu50
augguuccaaguauuuu

SEQ ID NO: 2052964 - RNA, 19 nt, Staphylococcus aureus subsp. aureus Mu50
augguuccaaguauuuucu

SEQ ID NO: 2052965 - RNA, 21 nt, Staphylococcus aureus subsp. aureus Mu50
auggucaaucacuccucuauu

SEQ ID NO: 2052966 - RNA, 14 nt, Staphylococcus aureus subsp. aureus Mu50
augguaucuuuaau

SEQ ID NO: 2052967 - RNA, 22 nt, Staphylococcus aureus subsp. aureus Mu50
auggguauuuuguucaguuaaa

SEQ ID NO: 2052968 - RNA, 17 nt, Staphylococcus aureus subsp. aureus Mu50
auggguaaucuuuagga

SEQ ID NO: 2052969 - RNA, 20 nt, Staphylococcus aureus subsp. aureus Mu50
auggcuucucuuaguuuuaa

SEQ ID NO: 2052970 - RNA, 17 nt, Staphylococcus aureus subsp. aureus Mu50
auggcaaucuauauaaa

SEQ ID NO: 2052971 - RNA, 19 nt, Staphylococcus aureus subsp. aureus Mu50
auggcugcaucaauaugac

SEQ ID NO: 2052972 - RNA, 20 nt, Staphylococcus aureus subsp. aureus Mu50
auggcugcaucaauaugacc

SEQ ID NO: 2052973 - RNA, 17 nt, Staphylococcus aureus subsp. aureus Mu50
auggcugcaucaauaug

SEQ ID NO: 2052974 - RNA, 13 nt, Staphylococcus aureus subsp. aureus Mu50
augauuuugcuuu

SEQ ID NO: 2052975 - RNA, 17 nt, Staphylococcus aureus subsp. aureus Mu50
augauugcaaauuauca

SEQ ID NO: 2052976 - RNA, 16 nt, Staphylococcus aureus subsp. aureus Mu50
augauucguauucaaa

SEQ ID NO: 2052977 - RNA, 14 nt, Staphylococcus aureus subsp. aureus Mu50
augauucguauuca

SEQ ID NO: 2052978 - RNA, 15 nt, Staphylococcus aureus subsp. aureus Mu50
augauugaaauccuu

SEQ ID NO: 2052979 - RNA, 23 nt, Staphylococcus aureus subsp. aureus Mu50
augauucguauucaaaguuuuca

SEQ ID NO: 2052980 - RNA, 22 nt, Staphylococcus aureus subsp. aureus Mu50
augauuuuuauuauugucauca

SEQ ID NO: 2052981 - RNA, 21 nt, Staphylococcus aureus subsp. aureus Mu50
augcauaauuaggauuaacau

SEQ ID NO: 2052982 - RNA, 21 nt, Staphylococcus aureus subsp. aureus Mu50
augcauacacuugauuaucau

SEQ ID NO: 2052983 - RNA, 14 nt, Staphylococcus aureus subsp. aureus Mu50
augcacuccuauug

SEQ ID NO: 2052984 - RNA, 21 nt, Staphylococcus aureus subsp. aureus Mu50
augcacuuuauuaaaaauccu

SEQ ID NO: 2052985 - RNA, 21 nt, Staphylococcus aureus subsp. aureus Mu50
augcacgcgugccaacaucuu

SEQ ID NO: 2052986 - RNA, 17 nt, Staphylococcus aureus subsp. aureus Mu50
augcaccuuuacaacau

SEQ ID NO: 2052987 - RNA, 21 nt, Staphylococcus aureus subsp. aureus Mu50
augaugcuucuaacugaauua

SEQ ID NO: 2052988 - RNA, 17 nt, Staphylococcus aureus subsp. aureus Mu50
augauuaacuuucuaau

SEQ ID NO: 2052989 - RNA, 16 nt, Staphylococcus aureus subsp. aureus Mu50
augauuaauuaaagau

SEQ ID NO: 2052990 - RNA, 16 nt, Staphylococcus aureus subsp. aureus Mu50
augauuacuuuaagau

SEQ ID NO: 2052991 - RNA, 23 nt, Staphylococcus aureus subsp. aureus Mu50
augauuacguugguuuaaaaauu

SEQ ID NO: 2052992 - RNA, 22 nt, Staphylococcus aureus subsp. aureus Mu50
augauuaauuaaagauuaaaau

SEQ ID NO: 2052993 - RNA, 22 nt, Staphylococcus aureus subsp. aureus Mu50
augauuacuuuaagauuauuug

SEQ ID NO: 2052994 - RNA, 17 nt, Staphylococcus aureus subsp. aureus Mu50
augauuauauuuucuca

SEQ ID NO: 2052995 - RNA, 15 nt, Staphylococcus aureus subsp. aureus Mu50
augauauguucgcuu

SEQ ID NO: 2052996 - RNA, 16 nt, Staphylococcus aureus subsp. aureus Mu50
augauauuacauauaa

SEQ ID NO: 2052997 - RNA, 20 nt, Staphylococcus aureus subsp. aureus Mu50
augauauuaggcuuaaauau

SEQ ID NO: 2052998 - RNA, 17 nt, Staphylococcus aureus subsp. aureus Mu50
augauaucuuuuccaaa

SEQ ID NO: 2052999 - RNA, 17 nt, Staphylococcus aureus subsp. aureus Mu50
augauauuuaacaaaau

SEQ ID NO: 2053000 - RNA, 18 nt, Staphylococcus aureus subsp. aureus Mu50
augauauuuaacaaaauu

SEQ ID NO: 2053001 - RNA, 22 nt, Staphylococcus aureus subsp. aureus Mu50
augauauugaaaguguaugcau

SEQ ID NO: 2053002 - RNA, 20 nt, Staphylococcus aureus subsp. aureus Mu50
augauauugauuugauucau

SEQ ID NO: 2053003 - RNA, 23 nt, Staphylococcus aureus subsp. aureus Mu50
augauauugauuugauucauuac

SEQ ID NO: 2053004 - RNA, 16 nt, Staphylococcus aureus subsp. aureus Mu50
augauauuuaacaaaa

SEQ ID NO: 2053005 - RNA, 18 nt, Staphylococcus aureus subsp. aureus Mu50
augaucagggaaaucauc

SEQ ID NO: 2053006 - RNA, 12 nt, Staphylococcus aureus subsp. aureus Mu50
augauacauuau

SEQ ID NO: 2053007 - RNA, 18 nt, Staphylococcus aureus subsp. aureus Mu50
augauaauuaauuaaaau

SEQ ID NO: 2053008 - RNA, 18 nt, Staphylococcus aureus subsp. aureus Mu50
augauaauuaaugccauu

SEQ ID NO: 2053009 - RNA, 22 nt, Staphylococcus aureus subsp. aureus Mu50
augauaauccaccaaauacagu

SEQ ID NO: 2053010 - RNA, 22 nt, Staphylococcus aureus subsp. aureus Mu50
augauaguguaugaauggcaau

SEQ ID NO: 2053011 - RNA, 19 nt, Staphylococcus aureus subsp. aureus Mu50
augauaguguauguuuuug

SEQ ID NO: 2053012 - RNA, 18 nt, Staphylococcus aureus subsp. aureus Mu50
augauacgugguuuuauu

SEQ ID NO: 2053013 - RNA, 19 nt, Staphylococcus aureus subsp. aureus Mu50
augauacguacguugaugu

SEQ ID NO: 2053014 - RNA, 18 nt, Staphylococcus aureus subsp. aureus Mu50
augauacgccuaaauauu

SEQ ID NO: 2053015 - RNA, 18 nt, Staphylococcus aureus subsp. aureus Mu50
augauacgcuuuuuaaaa

SEQ ID NO: 2053016 - RNA, 17 nt, Staphylococcus aureus subsp. aureus Mu50
augauacugauauuuag

SEQ ID NO: 2053017 - RNA, 16 nt, Staphylococcus aureus subsp. aureus Mu50
augauagaauacuaaa

SEQ ID NO: 2053018 - RNA, 18 nt, Staphylococcus aureus subsp. aureus Mu50
augauacucaauaaaauu

SEQ ID NO: 2053019 - RNA, 15 nt, Staphylococcus aureus subsp. aureus Mu50
augauagauuuagga

SEQ ID NO: 2053020 - RNA, 23 nt, Staphylococcus aureus subsp. aureus Mu50
augacuaugcaaaugaaauucuu

SEQ ID NO: 2053021 - RNA, 15 nt, Staphylococcus aureus subsp. aureus Mu50
augacuauuuuccau

SEQ ID NO: 2053022 - RNA, 18 nt, Staphylococcus aureus subsp. aureus Mu50
augacugagaaaaauauu

SEQ ID NO: 2053023 - RNA, 22 nt, Staphylococcus aureus subsp. aureus Mu50
augacugagaaaaauauuucua

SEQ ID NO: 2053024 - RNA, 18 nt, Staphylococcus aureus subsp. aureus Mu50
augaauuuuauaaauuaa

SEQ ID NO: 2053025 - RNA, 13 nt, Staphylococcus aureus subsp. aureus Mu50
augaauuuuauaa

SEQ ID NO: 2053026 - RNA, 15 nt, Staphylococcus aureus subsp. aureus Mu50
augacaaauuaucac

SEQ ID NO: 2053027 - RNA, 16 nt, Staphylococcus aureus subsp. aureus Mu50
augacaccuaauacca

SEQ ID NO: 2053028 - RNA, 16 nt, Staphylococcus aureus subsp. aureus Mu50
augaccuaauauauua

SEQ ID NO: 2053029 - RNA, 23 nt, Staphylococcus aureus subsp. aureus Mu50
augacggugaaaguucauuacaa

SEQ ID NO: 2053030 - RNA, 16 nt, Staphylococcus aureus subsp. aureus Mu50
augacaucaauaucuu

SEQ ID NO: 2053031 - RNA, 13 nt, Staphylococcus aureus subsp. aureus Mu50
augacaucaauau

SEQ ID NO: 2053032 - RNA, 14 nt, Staphylococcus aureus subsp. aureus Mu50
augacaucaauauc

SEQ ID NO: 2053033 - RNA, 15 nt, Staphylococcus aureus subsp. aureus Mu50
augaccauugucaug

SEQ ID NO: 2053034 - RNA, 13 nt, Staphylococcus aureus subsp. aureus Mu50
aucuuuuguuguu

SEQ ID NO: 2053035 - RNA, 21 nt, Staphylococcus aureus subsp. aureus Mu50
aucuuuuucaugcuauuuaaa

SEQ ID NO: 2053036 - RNA, 13 nt, Staphylococcus aureus subsp. aureus Mu50
aucuuuuugaaau

SEQ ID NO: 2053037 - RNA, 14 nt, Staphylococcus aureus subsp. aureus Mu50
aucuuuuaaauuua

SEQ ID NO: 2053038 - RNA, 22 nt, Staphylococcus aureus subsp. aureus Mu50
aucuuuguaaccuaaaaacaaa

SEQ ID NO: 2053039 - RNA, 17 nt, Staphylococcus aureus subsp. aureus Mu50
aucuuuguaaauuuuua

SEQ ID NO: 2053040 - RNA, 21 nt, Staphylococcus aureus subsp. aureus Mu50
aucuuuagagacuuauuuuau

SEQ ID NO: 2053041 - RNA, 23 nt, Staphylococcus aureus subsp. aureus Mu50
aucuuguucuucgucaaauucaa

SEQ ID NO: 2053042 - RNA, 17 nt, Staphylococcus aureus subsp. aureus Mu50
aucuuguucuaauuguu

SEQ ID NO: 2053043 - RNA, 16 nt, Staphylococcus aureus subsp. aureus Mu50
aucuuuaguauuggua

SEQ ID NO: 2053044 - RNA, 19 nt, Staphylococcus aureus subsp. aureus Mu50
aucuuuaguauuucaucau

SEQ ID NO: 2053045 - RNA, 14 nt, Staphylococcus aureus subsp. aureus Mu50
augaaauucuuuug

SEQ ID NO: 2053046 - RNA, 18 nt, Staphylococcus aureus subsp. aureus Mu50
augaaaacuuaaaaauga

SEQ ID NO: 2053047 - RNA, 16 nt, Staphylococcus aureus subsp. aureus Mu50
augaaauuagauuuua

SEQ ID NO: 2053048 - RNA, 13 nt, Staphylococcus aureus subsp. aureus Mu50
aucuuuuuuuaau

SEQ ID NO: 2053049 - RNA, 14 nt, Staphylococcus aureus subsp. aureus Mu50
aucuuuuuuuuuau

SEQ ID NO: 2053050 - RNA, 23 nt, Staphylococcus aureus subsp. aureus Mu50
aucuucguauaguacuaaaagua

SEQ ID NO: 2053051 - RNA, 22 nt, Staphylococcus aureus subsp. aureus Mu50
aucuucguauaguacuaaaagu

SEQ ID NO: 2053052 - RNA, 23 nt, Staphylococcus aureus subsp. aureus Mu50
aucuucgacuacaaguuuauaau

SEQ ID NO: 2053053 - RNA, 16 nt, Staphylococcus aureus subsp. aureus Mu50
aucuucccaucuuuua

SEQ ID NO: 2053054 - RNA, 21 nt, Staphylococcus aureus subsp. aureus Mu50
aucuugcuuggauaauugcau

SEQ ID NO: 2053055 - RNA, 20 nt, Staphylococcus aureus subsp. aureus Mu50
aucuugcuuauugauauaag

SEQ ID NO: 2053056 - RNA, 21 nt, Staphylococcus aureus subsp. aureus Mu50
aucuugucuaguucgauuuuu

SEQ ID NO: 2053057 - RNA, 18 nt, Staphylococcus aureus subsp. aureus Mu50
aucuucuaaaucaauaua

SEQ ID NO: 2053058 - RNA, 17 nt, Staphylococcus aureus subsp. aureus Mu50
aucuaagauuaauguau

SEQ ID NO: 2053059 - RNA, 13 nt, Staphylococcus aureus subsp. aureus Mu50
aucuaauaaauau

SEQ ID NO: 2053060 - RNA, 18 nt, Staphylococcus aureus subsp. aureus Mu50
aucuaacugugcaacaaa

SEQ ID NO: 2053061 - RNA, 13 nt, Staphylococcus aureus subsp. aureus Mu50
aucuaacuggaaa

SEQ ID NO: 2053062 - RNA, 16 nt, Staphylococcus aureus subsp. aureus Mu50
aucuaacuggaaauga

SEQ ID NO: 2053063 - RNA, 18 nt, Staphylococcus aureus subsp. aureus Mu50
aucuaacuggaaaugaua

SEQ ID NO: 2053064 - RNA, 19 nt, Staphylococcus aureus subsp. aureus Mu50
aucuaauuauucaugaauc

SEQ ID NO: 2053065 - RNA, 14 nt, Staphylococcus aureus subsp. aureus Mu50
aucuaauucguaau

SEQ ID NO: 2053066 - RNA, 16 nt, Staphylococcus aureus subsp. aureus Mu50
aucuaauucguaauuu

SEQ ID NO: 2053067 - RNA, 22 nt, Staphylococcus aureus subsp. aureus Mu50
aucuaauacuucaccacauaaa

SEQ ID NO: 2053068 - RNA, 20 nt, Staphylococcus aureus subsp. aureus Mu50
aucuaaugggucaaugacug

SEQ ID NO: 2053069 - RNA, 17 nt, Staphylococcus aureus subsp. aureus Mu50
aucuaaucuuaauuguc

SEQ ID NO: 2053070 - RNA, 23 nt, Staphylococcus aureus subsp. aureus Mu50
aucuaaugcaacuugaucauuau

SEQ ID NO: 2053071 - RNA, 14 nt, Staphylococcus aureus subsp. aureus Mu50
aucugcuuuucuau

SEQ ID NO: 2053072 - RNA, 13 nt, Staphylococcus aureus subsp. aureus Mu50
aucuguaucaaaa

SEQ ID NO: 2053073 - RNA, 16 nt, Staphylococcus aureus subsp. aureus Mu50
aucuguagaaacacuu

SEQ ID NO: 2053074 - RNA, 16 nt, Staphylococcus aureus subsp. aureus Mu50
aucuguagguaagaaa

SEQ ID NO: 2053075 - RNA, 19 nt, Staphylococcus aureus subsp. aureus Mu50
aucuguaccguauuuuaau

SEQ ID NO: 2053076 - RNA, 22 nt, Staphylococcus aureus subsp. aureus Mu50
aucuguaacaaagucucuagua

SEQ ID NO: 2053077 - RNA, 18 nt, Staphylococcus aureus subsp. aureus Mu50
aucuguaacauaaacaau

SEQ ID NO: 2053078 - RNA, 16 nt, Staphylococcus aureus subsp. aureus Mu50
aucuuacuacuuaauu

SEQ ID NO: 2053079 - RNA, 20 nt, Staphylococcus aureus subsp. aureus Mu50
aucuuacugcuguuuuuuau

SEQ ID NO: 2053080 - RNA, 14 nt, Staphylococcus aureus subsp. aureus Mu50
aucuuaagucauca

SEQ ID NO: 2053081 - RNA, 19 nt, Staphylococcus aureus subsp. aureus Mu50
aucuuagacgcuguuuuaa

SEQ ID NO: 2053082 - RNA, 21 nt, Staphylococcus aureus subsp. aureus Mu50
aucuuaguuaaaauucaguau

SEQ ID NO: 2053083 - RNA, 22 nt, Staphylococcus aureus subsp. aureus Mu50
aucuuauaacaaaaauugcuau

SEQ ID NO: 2053084 - RNA, 15 nt, Staphylococcus aureus subsp. aureus Mu50
aucuguuguuauaua

SEQ ID NO: 2053085 - RNA, 23 nt, Staphylococcus aureus subsp. aureus Mu50
aucuguuacagguuuuaaaauua

SEQ ID NO: 2053086 - RNA, 22 nt, Staphylococcus aureus subsp. aureus Mu50
aucuuaaagcauaucucaagau

SEQ ID NO: 2053087 - RNA, 21 nt, Staphylococcus aureus subsp. aureus Mu50
aucuuaaguacauaaaugcua

SEQ ID NO: 2053088 - RNA, 22 nt, Staphylococcus aureus subsp. aureus Mu50
aucuguuuuagguuuguugcuu

SEQ ID NO: 2053089 - RNA, 15 nt, Staphylococcus aureus subsp. aureus Mu50
aucuucaucauugua

SEQ ID NO: 2053090 - RNA, 18 nt, Staphylococcus aureus subsp. aureus Mu50
aucuucaauauuuaaauu

SEQ ID NO: 2053091 - RNA, 22 nt, Staphylococcus aureus subsp. aureus Mu50
aucuucaacauaacucaaauau

SEQ ID NO: 2053092 - RNA, 23 nt, Staphylococcus aureus subsp. aureus Mu50
aucuucaacauaacucaaauauc

SEQ ID NO: 2053093 - RNA, 20 nt, Staphylococcus aureus subsp. aureus Mu50
aucuuaugauacuuugaaag

SEQ ID NO: 2053094 - RNA, 22 nt, Staphylococcus aureus subsp. aureus Mu50
aucuuaugauacuuugaaagaa

SEQ ID NO: 2053095 - RNA, 12 nt, Staphylococcus aureus subsp. aureus Mu50
aucuuauuauua

SEQ ID NO: 2053096 - RNA, 13 nt, Staphylococcus aureus subsp. aureus Mu50
aucuuauuauuaa

SEQ ID NO: 2053097 - RNA, 20 nt, Staphylococcus aureus subsp. aureus Mu50
aucuuaugacugcuuuuuau

SEQ ID NO: 2053098 - RNA, 18 nt, Staphylococcus aureus subsp. aureus Mu50
aucuuaugacugcuuuuu

SEQ ID NO: 2053099 - RNA, 19 nt, Staphylococcus aureus subsp. aureus Mu50
auaugcguagcaacauuau

SEQ ID NO: 2053100 - RNA, 23 nt, Staphylococcus aureus subsp. aureus Mu50
auaugcuguuggcaaaacaauau

SEQ ID NO: 2053101 - RNA, 21 nt, Staphylococcus aureus subsp. aureus Mu50
auaugcuuguugugaauaaaa

SEQ ID NO: 2053102 - RNA, 23 nt, Staphylococcus aureus subsp. aureus Mu50
auauggcaucaucaccauacuaa

SEQ ID NO: 2053103 - RNA, 15 nt, Staphylococcus aureus subsp. aureus Mu50
auauggaaaauguau

SEQ ID NO: 2053104 - RNA, 12 nt, Staphylococcus aureus subsp. aureus Mu50
auaugauuuaaa

SEQ ID NO: 2053105 - RNA, 16 nt, Staphylococcus aureus subsp. aureus Mu50
auaugcaucaacagau

SEQ ID NO: 2053106 - RNA, 17 nt, Staphylococcus aureus subsp. aureus Mu50
auaugcaacuuauaaua

SEQ ID NO: 2053107 - RNA, 15 nt, Staphylococcus aureus subsp. aureus Mu50
auaugauugaaugaa

SEQ ID NO: 2053108 - RNA, 18 nt, Staphylococcus aureus subsp. aureus Mu50
auaugauugcaaauuauc

SEQ ID NO: 2053109 - RNA, 13 nt, Staphylococcus aureus subsp. aureus Mu50
auaugauugguuu

SEQ ID NO: 2053110 - RNA, 17 nt, Staphylococcus aureus subsp. aureus Mu50
auaugacgcgugaauua

SEQ ID NO: 2053111 - RNA, 13 nt, Staphylococcus aureus subsp. aureus Mu50
auaugaacaaaaa

SEQ ID NO: 2053112 - RNA, 11 nt, Staphylococcus aureus subsp. aureus Mu50
auaugaaaugu

SEQ ID NO: 2053113 - RNA, 17 nt, Staphylococcus aureus subsp. aureus Mu50
auaugaaucuagaauau

SEQ ID NO: 2053114 - RNA, 21 nt, Staphylococcus aureus subsp. aureus Mu50
auaugaagcguuuuuauuaca

SEQ ID NO: 2053115 - RNA, 13 nt, Staphylococcus aureus subsp. aureus Mu50
auaugaauugagu

SEQ ID NO: 2053116 - RNA, 22 nt, Staphylococcus aureus subsp. aureus Mu50
auaugaauugcuuguuuuaaau

SEQ ID NO: 2053117 - RNA, 20 nt, Staphylococcus aureus subsp. aureus Mu50
auaugaauuuagaugcauaa

SEQ ID NO: 2053118 - RNA, 14 nt, Staphylococcus aureus subsp. aureus Mu50
auaucucaagauau

SEQ ID NO: 2053119 - RNA, 14 nt, Staphylococcus aureus subsp. aureus Mu50
auaucuauuuuucg

SEQ ID NO: 2053120 - RNA, 14 nt, Staphylococcus aureus subsp. aureus Mu50
auaucucaaagauu

SEQ ID NO: 2053121 - RNA, 17 nt, Staphylococcus aureus subsp. aureus Mu50
auauccugccaauauau

SEQ ID NO: 2053122 - RNA, 18 nt, Staphylococcus aureus subsp. aureus Mu50
auauccuggaauauuaac

SEQ ID NO: 2053123 - RNA, 20 nt, Staphylococcus aureus subsp. aureus Mu50
auaucauaccaaaaaguauu

SEQ ID NO: 2053124 - RNA, 14 nt, Staphylococcus aureus subsp. aureus Mu50
auauaugauaaaua

SEQ ID NO: 2053125 - RNA, 18 nt, Staphylococcus aureus subsp. aureus Mu50
auauaugccgauugcucu

SEQ ID NO: 2053126 - RNA, 16 nt, Staphylococcus aureus subsp. aureus Mu50
auauauguaacauaaa

SEQ ID NO: 2053127 - RNA, 18 nt, Staphylococcus aureus subsp. aureus Mu50
auauauccugccaauaua

SEQ ID NO: 2053128 - RNA, 19 nt, Staphylococcus aureus subsp. aureus Mu50
auauaucuagccugaaaua

SEQ ID NO: 2053129 - RNA, 15 nt, Staphylococcus aureus subsp. aureus Mu50
auauaugaaauauuu

SEQ ID NO: 2053130 - RNA, 22 nt, Staphylococcus aureus subsp. aureus Mu50
auaucaugggcaguaauuuuca

SEQ ID NO: 2053131 - RNA, 15 nt, Staphylococcus aureus subsp. aureus Mu50
auaucaucauuuaaa

SEQ ID NO: 2053132 - RNA, 17 nt, Staphylococcus aureus subsp. aureus Mu50
auaucaugcaaaacuaa

SEQ ID NO: 2053133 - RNA, 14 nt, Staphylococcus aureus subsp. aureus Mu50
auaucaucucuaug

SEQ ID NO: 2053134 - RNA, 22 nt, Staphylococcus aureus subsp. aureus Mu50
auaucaugcacaauauucguag

SEQ ID NO: 2053135 - RNA, 23 nt, Staphylococcus aureus subsp. aureus Mu50
auaguccggggccccaacaaaga

SEQ ID NO: 2053136 - RNA, 14 nt, Staphylococcus aureus subsp. aureus Mu50
auaguuaccaaaau

SEQ ID NO: 2053137 - RNA, 20 nt, Staphylococcus aureus subsp. aureus Mu50
auaguuaagauuuuaacuuc

SEQ ID NO: 2053138 - RNA, 22 nt, Staphylococcus aureus subsp. aureus Mu50
auaguccgcguguacuuuacca

SEQ ID NO: 2053139 - RNA, 18 nt, Staphylococcus aureus subsp. aureus Mu50
auaguccggggccccaac

SEQ ID NO: 2053140 - RNA, 22 nt, Staphylococcus aureus subsp. aureus Mu50
auagucuuaaacauaacaugac

SEQ ID NO: 2053141 - RNA, 22 nt, Staphylococcus aureus subsp. aureus Mu50
auaguucaaauugaacuucuuu

SEQ ID NO: 2053142 - RNA, 21 nt, Staphylococcus aureus subsp. aureus Mu50
auauaaaggaauagcuacaau

SEQ ID NO: 2053143 - RNA, 22 nt, Staphylococcus aureus subsp. aureus Mu50
auauaaagaaauaauuuaaagg

SEQ ID NO: 2053144 - RNA, 20 nt, Staphylococcus aureus subsp. aureus Mu50
auaguccgcguguacuuuac

SEQ ID NO: 2053145 - RNA, 14 nt, Staphylococcus aureus subsp. aureus Mu50
auagucaucuguua

SEQ ID NO: 2053146 - RNA, 19 nt, Staphylococcus aureus subsp. aureus Mu50
auaguauuaacuauaaaua

SEQ ID NO: 2053147 - RNA, 17 nt, Staphylococcus aureus subsp. aureus Mu50
auaguauuaacuauaaa

SEQ ID NO: 2053148 - RNA, 15 nt, Staphylococcus aureus subsp. aureus Mu50
auauaaggaaaagga

SEQ ID NO: 2053149 - RNA, 16 nt, Staphylococcus aureus subsp. aureus Mu50
auauaaguauaaugau

SEQ ID NO: 2053150 - RNA, 14 nt, Staphylococcus aureus subsp. aureus Mu50
auauaaauaggcag

SEQ ID NO: 2053151 - RNA, 14 nt, Staphylococcus aureus subsp. aureus Mu50
auauaaauaugguu

SEQ ID NO: 2053152 - RNA, 13 nt, Staphylococcus aureus subsp. aureus Mu50
auauaaauaggca

SEQ ID NO: 2053153 - RNA, 13 nt, Staphylococcus aureus subsp. aureus Mu50
auauaauagaaau

SEQ ID NO: 2053154 - RNA, 11 nt, Staphylococcus aureus subsp. aureus Mu50
auauaauccag

SEQ ID NO: 2053155 - RNA, 22 nt, Staphylococcus aureus subsp. aureus Mu50
auauaaugcugauaauuuuucu

SEQ ID NO: 2053156 - RNA, 19 nt, Staphylococcus aureus subsp. aureus Mu50
auauaauggcacugcaauc

SEQ ID NO: 2053157 - RNA, 15 nt, Staphylococcus aureus subsp. aureus Mu50
auauacgacauuuuu

SEQ ID NO: 2053158 - RNA, 20 nt, Staphylococcus aureus subsp. aureus Mu50
auauacgacauuuuuagaca

SEQ ID NO: 2053159 - RNA, 16 nt, Staphylococcus aureus subsp. aureus Mu50
auauacgaauccucau

SEQ ID NO: 2053160 - RNA, 21 nt, Staphylococcus aureus subsp. aureus Mu50
auauacccagaugaauuuuua

SEQ ID NO: 2053161 - RNA, 22 nt, Staphylococcus aureus subsp. aureus Mu50
auauagauggcuuuuuuugcug

SEQ ID NO: 2053162 - RNA, 18 nt, Staphylococcus aureus subsp. aureus Mu50
auauagagccaugaaaag

SEQ ID NO: 2053163 - RNA, 21 nt, Staphylococcus aureus subsp. aureus Mu50
auauagagccaugaaaaggaa

SEQ ID NO: 2053164 - RNA, 22 nt, Staphylococcus aureus subsp. aureus Mu50
auauacgauugaguugaaaaua

SEQ ID NO: 2053165 - RNA, 14 nt, Staphylococcus aureus subsp. aureus Mu50
auauacucuaaaaa

SEQ ID NO: 2053166 - RNA, 18 nt, Staphylococcus aureus subsp. aureus Mu50
auauagcggugucaauau

SEQ ID NO: 2053167 - RNA, 15 nt, Staphylococcus aureus subsp. aureus Mu50
auauagcauaaaauu

SEQ ID NO: 2053168 - RNA, 14 nt, Staphylococcus aureus subsp. aureus Mu50
auauaguaaaauaa

SEQ ID NO: 2053169 - RNA, 19 nt, Staphylococcus aureus subsp. aureus Mu50
auauaguggugguacuuuu

SEQ ID NO: 2053170 - RNA, 15 nt, Staphylococcus aureus subsp. aureus Mu50
auauaguugaucaaa

SEQ ID NO: 2053171 - RNA, 17 nt, Staphylococcus aureus subsp. aureus Mu50
auauagucuaugaauaa

SEQ ID NO: 2053172 - RNA, 18 nt, Staphylococcus aureus subsp. aureus Mu50
auauauaaggcgcucucu

SEQ ID NO: 2053173 - RNA, 11 nt, Staphylococcus aureus subsp. aureus Mu50
auauauaaaag

SEQ ID NO: 2053174 - RNA, 16 nt, Staphylococcus aureus subsp. aureus Mu50
auauauaacaaguaca

SEQ ID NO: 2053175 - RNA, 13 nt, Staphylococcus aureus subsp. aureus Mu50
auauauaaccaua

SEQ ID NO: 2053176 - RNA, 14 nt, Staphylococcus aureus subsp. aureus Mu50
auauauauauuaaa

SEQ ID NO: 2053177 - RNA, 11 nt, Staphylococcus aureus subsp. aureus Mu50
auauauauucg

SEQ ID NO: 2053178 - RNA, 13 nt, Staphylococcus aureus subsp. aureus Mu50
auauauagauuaa

SEQ ID NO: 2053179 - RNA, 17 nt, Staphylococcus aureus subsp. aureus Mu50
auauuaaucauaaugaa

SEQ ID NO: 2053180 - RNA, 13 nt, Staphylococcus aureus subsp. aureus Mu50
auauuaauuuuac

SEQ ID NO: 2053181 - RNA, 15 nt, Staphylococcus aureus subsp. aureus Mu50
auauuaagauguaua

SEQ ID NO: 2053182 - RNA, 15 nt, Staphylococcus aureus subsp. aureus Mu50
auauuaauagaaagu

SEQ ID NO: 2053183 - RNA, 17 nt, Staphylococcus aureus subsp. aureus Mu50
auauuaauauaaaauaa

SEQ ID NO: 2053184 - RNA, 14 nt, Staphylococcus aureus subsp. aureus Mu50
auauuaacaccaga

SEQ ID NO: 2053185 - RNA, 15 nt, Staphylococcus aureus subsp. aureus Mu50
auauuaaaacaauga

SEQ ID NO: 2053186 - RNA, 14 nt, Staphylococcus aureus subsp. aureus Mu50
auauuauaaaaaca

SEQ ID NO: 2053187 - RNA, 21 nt, Staphylococcus aureus subsp. aureus Mu50
auauuacuuuggaaauuuauu

SEQ ID NO: 2053188 - RNA, 21 nt, Staphylococcus aureus subsp. aureus Mu50
auauuaauuuuacguuuauuu

SEQ ID NO: 2053189 - RNA, 13 nt, Staphylococcus aureus subsp. aureus Mu50
auauuacauauaa

SEQ ID NO: 2053190 - RNA, 19 nt, Staphylococcus aureus subsp. aureus Mu50
auauuacuaaccuauuaaa

SEQ ID NO: 2053191 - RNA, 22 nt, Staphylococcus aureus subsp. aureus Mu50
auauuacuaaccuauuaaaaaa

SEQ ID NO: 2053192 - RNA, 19 nt, Staphylococcus aureus subsp. aureus Mu50
auauuacuuuggaaauuua

SEQ ID NO: 2053193 - RNA, 22 nt, Staphylococcus aureus subsp. aureus Mu50
auaugucucucuuucuuauuca

SEQ ID NO: 2053194 - RNA, 16 nt, Staphylococcus aureus subsp. aureus Mu50
auauguguuaacugau

SEQ ID NO: 2053195 - RNA, 19 nt, Staphylococcus aureus subsp. aureus Mu50
auauguguaugauagaaua

SEQ ID NO: 2053196 - RNA, 20 nt, Staphylococcus aureus subsp. aureus Mu50
auauguggcacucauaaccg

SEQ ID NO: 2053197 - RNA, 21 nt, Staphylococcus aureus subsp. aureus Mu50
auaugucucucuuucuuauuc

SEQ ID NO: 2053198 - RNA, 15 nt, Staphylococcus aureus subsp. aureus Mu50
auauguuuuauaaua

SEQ ID NO: 2053199 - RNA, 16 nt, Staphylococcus aureus subsp. aureus Mu50
auauuaaaaauuucaa

SEQ ID NO: 2053200 - RNA, 13 nt, Staphylococcus aureus subsp. aureus Mu50
auauuaaaacaau

SEQ ID NO: 2053201 - RNA, 19 nt, Staphylococcus aureus subsp. aureus Mu50
auauguuuggauaucuuug

SEQ ID NO: 2053202 - RNA, 22 nt, Staphylococcus aureus subsp. aureus Mu50
auauguuuauauugcaaaaaua

SEQ ID NO: 2053203 - RNA, 15 nt, Staphylococcus aureus subsp. aureus Mu50
auauguacuauuauc

SEQ ID NO: 2053204 - RNA, 12 nt, Staphylococcus aureus subsp. aureus Mu50
auauguaaauga

SEQ ID NO: 2053205 - RNA, 23 nt, Staphylococcus aureus subsp. aureus Mu50
auauguauagaggauauuuauuc

SEQ ID NO: 2053206 - RNA, 16 nt, Staphylococcus aureus subsp. aureus Mu50
auaugguuagagaaaa

SEQ ID NO: 2053207 - RNA, 11 nt, Staphylococcus aureus subsp. aureus Mu50
auauucuuuuu

SEQ ID NO: 2053208 - RNA, 22 nt, Staphylococcus aureus subsp. aureus Mu50
auauucuuucguuuucaucaac

SEQ ID NO: 2053209 - RNA, 23 nt, Staphylococcus aureus subsp. aureus Mu50
auauucuuucguuuucaucaacg

SEQ ID NO: 2053210 - RNA, 23 nt, Staphylococcus aureus subsp. aureus Mu50
auauugagaauauuaagauguau

SEQ ID NO: 2053211 - RNA, 17 nt, Staphylococcus aureus subsp. aureus Mu50
auauugaauugaaaaau

SEQ ID NO: 2053212 - RNA, 19 nt, Staphylococcus aureus subsp. aureus Mu50
auauugaaaguguaugcau

SEQ ID NO: 2053213 - RNA, 22 nt, Staphylococcus aureus subsp. aureus Mu50
auauugaaaugagcuuaaguua

SEQ ID NO: 2053214 - RNA, 14 nt, Staphylococcus aureus subsp. aureus Mu50
auauucuuuuuaac

SEQ ID NO: 2053215 - RNA, 15 nt, Staphylococcus aureus subsp. aureus Mu50
auauucauauuacuu

SEQ ID NO: 2053216 - RNA, 22 nt, Staphylococcus aureus subsp. aureus Mu50
auauucauguucuuguaauccu

SEQ ID NO: 2053217 - RNA, 16 nt, Staphylococcus aureus subsp. aureus Mu50
auauuauauuuugaau

SEQ ID NO: 2053218 - RNA, 12 nt, Staphylococcus aureus subsp. aureus Mu50
auauuauauaua

SEQ ID NO: 2053219 - RNA, 15 nt, Staphylococcus aureus subsp. aureus Mu50
auauuauauauauuc

SEQ ID NO: 2053220 - RNA, 22 nt, Staphylococcus aureus subsp. aureus Mu50
auauuuagauuggucaaacuua

SEQ ID NO: 2053221 - RNA, 20 nt, Staphylococcus aureus subsp. aureus Mu50
auauuuagaauaagaaauaa

SEQ ID NO: 2053222 - RNA, 22 nt, Staphylococcus aureus subsp. aureus Mu50
auauuuaucgcgauuauuacca

SEQ ID NO: 2053223 - RNA, 12 nt, Staphylococcus aureus subsp. aureus Mu50
auauuuauucua

SEQ ID NO: 2053224 - RNA, 17 nt, Staphylococcus aureus subsp. aureus Mu50
auauuuaguuaauuauu

SEQ ID NO: 2053225 - RNA, 13 nt, Staphylococcus aureus subsp. aureus Mu50
auauuuacacaga

SEQ ID NO: 2053226 - RNA, 17 nt, Staphylococcus aureus subsp. aureus Mu50
auauuuacacagaauga

SEQ ID NO: 2053227 - RNA, 21 nt, Staphylococcus aureus subsp. aureus Mu50
auauuuacacagaaugauaua

SEQ ID NO: 2053228 - RNA, 12 nt, Staphylococcus aureus subsp. aureus Mu50
auauuuaacauu

SEQ ID NO: 2053229 - RNA, 16 nt, Staphylococcus aureus subsp. aureus Mu50
auauuuaacaaaauua

SEQ ID NO: 2053230 - RNA, 19 nt, Staphylococcus aureus subsp. aureus Mu50
auauuguagggaguauugu

SEQ ID NO: 2053231 - RNA, 19 nt, Staphylococcus aureus subsp. aureus Mu50
auauuuaaaugucuuucaa

SEQ ID NO: 2053232 - RNA, 15 nt, Staphylococcus aureus subsp. aureus Mu50
auauuuaacaaaauu

SEQ ID NO: 2053233 - RNA, 13 nt, Staphylococcus aureus subsp. aureus Mu50
aucaagaaauguu

SEQ ID NO: 2053234 - RNA, 13 nt, Staphylococcus aureus subsp. aureus Mu50
aucaagaauauaa

SEQ ID NO: 2053235 - RNA, 16 nt, Staphylococcus aureus subsp. aureus Mu50
aucaagagguaaaucu

SEQ ID NO: 2053236 - RNA, 12 nt, Staphylococcus aureus subsp. aureus Mu50
aucaauccauca

SEQ ID NO: 2053237 - RNA, 23 nt, Staphylococcus aureus subsp. aureus Mu50
aucaacauauuuaucucuuucuu

SEQ ID NO: 2053238 - RNA, 17 nt, Staphylococcus aureus subsp. aureus Mu50
aucaacugcuucacgau

SEQ ID NO: 2053239 - RNA, 14 nt, Staphylococcus aureus subsp. aureus Mu50
aucaacuauauaua

SEQ ID NO: 2053240 - RNA, 18 nt, Staphylococcus aureus subsp. aureus Mu50
aucaacugaaauuuuucc

SEQ ID NO: 2053241 - RNA, 13 nt, Staphylococcus aureus subsp. aureus Mu50
aucaacaauuuaa

SEQ ID NO: 2053242 - RNA, 18 nt, Staphylococcus aureus subsp. aureus Mu50
aucaaauacauuucaaaa

SEQ ID NO: 2053243 - RNA, 14 nt, Staphylococcus aureus subsp. aureus Mu50
aucaaauuaucugu

SEQ ID NO: 2053244 - RNA, 21 nt, Staphylococcus aureus subsp. aureus Mu50
aucaaaguacuaacguuuuaa

SEQ ID NO: 2053245 - RNA, 20 nt, Staphylococcus aureus subsp. aureus Mu50
aucaaagaggcuuuaaaauu

SEQ ID NO: 2053246 - RNA, 20 nt, Staphylococcus aureus subsp. aureus Mu50
aucaaagaggaacagcggaa

SEQ ID NO: 2053247 - RNA, 18 nt, Staphylococcus aureus subsp. aureus Mu50
aucaaagcuauauaugaa

SEQ ID NO: 2053248 - RNA, 18 nt, Staphylococcus aureus subsp. aureus Mu50
aucaaaaugguaucaaua

SEQ ID NO: 2053249 - RNA, 23 nt, Staphylococcus aureus subsp. aureus Mu50
aucaaagaaaaagugauaauuaa

SEQ ID NO: 2053250 - RNA, 22 nt, Staphylococcus aureus subsp. aureus Mu50
aucaaaaucgguuugauuaaaa

SEQ ID NO: 2053251 - RNA, 20 nt, Staphylococcus aureus subsp. aureus Mu50
aucaaaauauaaaauccuaa

SEQ ID NO: 2053252 - RNA, 12 nt, Staphylococcus aureus subsp. aureus Mu50
aucaaaauauaa

SEQ ID NO: 2053253 - RNA, 18 nt, Staphylococcus aureus subsp. aureus Mu50
auauuugaaaauuucacc

SEQ ID NO: 2053254 - RNA, 21 nt, Staphylococcus aureus subsp. aureus Mu50
auauuucugggcuuucuuuuu

SEQ ID NO: 2053255 - RNA, 15 nt, Staphylococcus aureus subsp. aureus Mu50
auauuucuuaccauu

SEQ ID NO: 2053256 - RNA, 20 nt, Staphylococcus aureus subsp. aureus Mu50
auauuuccaaauugaaauua

SEQ ID NO: 2053257 - RNA, 17 nt, Staphylococcus aureus subsp. aureus Mu50
auauuuauuuuauaaua

SEQ ID NO: 2053258 - RNA, 13 nt, Staphylococcus aureus subsp. aureus Mu50
auauuuauuuaau

SEQ ID NO: 2053259 - RNA, 14 nt, Staphylococcus aureus subsp. aureus Mu50
auauuuauuuuaau

SEQ ID NO: 2053260 - RNA, 14 nt, Staphylococcus aureus subsp. aureus Mu50
auauuuauuuuaua

SEQ ID NO: 2053261 - RNA, 17 nt, Staphylococcus aureus subsp. aureus Mu50
auauuucccuaugaaau

SEQ ID NO: 2053262 - RNA, 19 nt, Staphylococcus aureus subsp. aureus Mu50
auauuucccuaugaaauaa

SEQ ID NO: 2053263 - RNA, 15 nt, Staphylococcus aureus subsp. aureus Mu50
auauuucgguauuuu

SEQ ID NO: 2053264 - RNA, 19 nt, Staphylococcus aureus subsp. aureus Mu50
auauuucgguauuuuaaau

SEQ ID NO: 2053265 - RNA, 22 nt, Staphylococcus aureus subsp. aureus Mu50
auauuucgguuagucuuaaucc

SEQ ID NO: 2053266 - RNA, 22 nt, Staphylococcus aureus subsp. aureus Mu50
auauuucucauacuauaagcaa

SEQ ID NO: 2053267 - RNA, 14 nt, Staphylococcus aureus subsp. aureus Mu50
auauuucuaaauua

SEQ ID NO: 2053268 - RNA, 16 nt, Staphylococcus aureus subsp. aureus Mu50
auauuucuaaaccauu

SEQ ID NO: 2053269 - RNA, 20 nt, Staphylococcus aureus subsp. aureus Mu50
auacauaucggcccauaaua

SEQ ID NO: 2053270 - RNA, 23 nt, Staphylococcus aureus subsp. aureus Mu50
auacauaucggcccauaauagcu

SEQ ID NO: 2053271 - RNA, 15 nt, Staphylococcus aureus subsp. aureus Mu50
auacauaucuuuugc

SEQ ID NO: 2053272 - RNA, 14 nt, Staphylococcus aureus subsp. aureus Mu50
auacauaucuuuug

SEQ ID NO: 2053273 - RNA, 12 nt, Staphylococcus aureus subsp. aureus Mu50
auacauacugau

SEQ ID NO: 2053274 - RNA, 13 nt, Staphylococcus aureus subsp. aureus Mu50
auacauacugauu

SEQ ID NO: 2053275 - RNA, 22 nt, Staphylococcus aureus subsp. aureus Mu50
auacauagguucaucuuuaugc

SEQ ID NO: 2053276 - RNA, 14 nt, Staphylococcus aureus subsp. aureus Mu50
auacaucaauuucu

SEQ ID NO: 2053277 - RNA, 13 nt, Staphylococcus aureus subsp. aureus Mu50
auacaucaauauc

SEQ ID NO: 2053278 - RNA, 16 nt, Staphylococcus aureus subsp. aureus Mu50
auacauguacauuauc

SEQ ID NO: 2053279 - RNA, 18 nt, Staphylococcus aureus subsp. aureus Mu50
auacauuaauauaaauau

SEQ ID NO: 2053280 - RNA, 12 nt, Staphylococcus aureus subsp. aureus Mu50
auacauuauuaa

SEQ ID NO: 2053281 - RNA, 21 nt, Staphylococcus aureus subsp. aureus Mu50
auacauuccaaaguaccaucu

SEQ ID NO: 2053282 - RNA, 17 nt, Staphylococcus aureus subsp. aureus Mu50
auacauugauaaauuuu

SEQ ID NO: 2053283 - RNA, 13 nt, Staphylococcus aureus subsp. aureus Mu50
auacauuuugaaa

SEQ ID NO: 2053284 - RNA, 19 nt, Staphylococcus aureus subsp. aureus Mu50
auacagaucucaauccaau

SEQ ID NO: 2053285 - RNA, 18 nt, Staphylococcus aureus subsp. aureus Mu50
auacaguuguuauuuuug

SEQ ID NO: 2053286 - RNA, 19 nt, Staphylococcus aureus subsp. aureus Mu50
auacauaccacacuuuaaa

SEQ ID NO: 2053287 - RNA, 20 nt, Staphylococcus aureus subsp. aureus Mu50
auaauuuuaucuaaagcuau

SEQ ID NO: 2053288 - RNA, 20 nt, Staphylococcus aureus subsp. aureus Mu50
auaauuuuccaucuauccga

SEQ ID NO: 2053289 - RNA, 21 nt, Staphylococcus aureus subsp. aureus Mu50
auaauuuuucuucuuuuuuau

SEQ ID NO: 2053290 - RNA, 15 nt, Staphylococcus aureus subsp. aureus Mu50
auacaaagaauuaug

SEQ ID NO: 2053291 - RNA, 18 nt, Staphylococcus aureus subsp. aureus Mu50
auacaaaucguaaacaua

SEQ ID NO: 2053292 - RNA, 17 nt, Staphylococcus aureus subsp. aureus Mu50
auacaaauuauaaauuu

SEQ ID NO: 2053293 - RNA, 13 nt, Staphylococcus aureus subsp. aureus Mu50
auacaaauuuuuu

SEQ ID NO: 2053294 - RNA, 17 nt, Staphylococcus aureus subsp. aureus Mu50
auacaacaguaaucaug

SEQ ID NO: 2053295 - RNA, 12 nt, Staphylococcus aureus subsp. aureus Mu50
auacaaauugau

SEQ ID NO: 2053296 - RNA, 15 nt, Staphylococcus aureus subsp. aureus Mu50
auacaauagaaauga

SEQ ID NO: 2053297 - RNA, 13 nt, Staphylococcus aureus subsp. aureus Mu50
auacacaaauuuu

SEQ ID NO: 2053298 - RNA, 15 nt, Staphylococcus aureus subsp. aureus Mu50
auacacaaauuuuuu

SEQ ID NO: 2053299 - RNA, 17 nt, Staphylococcus aureus subsp. aureus Mu50
auacacagauuacucug

SEQ ID NO: 2053300 - RNA, 22 nt, Staphylococcus aureus subsp. aureus Mu50
auacaauuauggauaaaauuua

SEQ ID NO: 2053301 - RNA, 20 nt, Staphylococcus aureus subsp. aureus Mu50
auacaaacccuuuaaacaua

SEQ ID NO: 2053302 - RNA, 21 nt, Staphylococcus aureus subsp. aureus Mu50
auacaauuucuucauuuucau

SEQ ID NO: 2053303 - RNA, 20 nt, Staphylococcus aureus subsp. aureus Mu50
auacaauuauggauaaaauu

SEQ ID NO: 2053304 - RNA, 21 nt, Staphylococcus aureus subsp. aureus Mu50
auacaaugaauuucuaauuua

SEQ ID NO: 2053305 - RNA, 15 nt, Staphylococcus aureus subsp. aureus Mu50
auacacuuacaaaua

SEQ ID NO: 2053306 - RNA, 19 nt, Staphylococcus aureus subsp. aureus Mu50
auacagaaccaacaauaaa

SEQ ID NO: 2053307 - RNA, 22 nt, Staphylococcus aureus subsp. aureus Mu50
auacagaaccaacaauaaaucu

SEQ ID NO: 2053308 - RNA, 15 nt, Staphylococcus aureus subsp. aureus Mu50
auacaccuuuacuca

SEQ ID NO: 2053309 - RNA, 22 nt, Staphylococcus aureus subsp. aureus Mu50
auacacugcacaucauaauaaa

SEQ ID NO: 2053310 - RNA, 15 nt, Staphylococcus aureus subsp. aureus Mu50
auaaugacuauaaca

SEQ ID NO: 2053311 - RNA, 17 nt, Staphylococcus aureus subsp. aureus Mu50
auaaugacgagaauuaa

SEQ ID NO: 2053312 - RNA, 19 nt, Staphylococcus aureus subsp. aureus Mu50
auaaugacaaauuaucacu

SEQ ID NO: 2053313 - RNA, 14 nt, Staphylococcus aureus subsp. aureus Mu50
auaaugacucaagu

SEQ ID NO: 2053314 - RNA, 14 nt, Staphylococcus aureus subsp. aureus Mu50
auaaugauaaauua

SEQ ID NO: 2053315 - RNA, 21 nt, Staphylococcus aureus subsp. aureus Mu50
auaaucucauucuuuaauaua

SEQ ID NO: 2053316 - RNA, 15 nt, Staphylococcus aureus subsp. aureus Mu50
auaaucucuucaauu

SEQ ID NO: 2053317 - RNA, 19 nt, Staphylococcus aureus subsp. aureus Mu50
auaaucucuucaauuuauu

SEQ ID NO: 2053318 - RNA, 20 nt, Staphylococcus aureus subsp. aureus Mu50
auaaucgaacauaaauaaac

SEQ ID NO: 2053319 - RNA, 18 nt, Staphylococcus aureus subsp. aureus Mu50
auaaucucauucuuuaau

SEQ ID NO: 2053320 - RNA, 16 nt, Staphylococcus aureus subsp. aureus Mu50
auaaucgaacauaaau

SEQ ID NO: 2053321 - RNA, 18 nt, Staphylococcus aureus subsp. aureus Mu50
auaaucgaacauaaauaa

SEQ ID NO: 2053322 - RNA, 18 nt, Staphylococcus aureus subsp. aureus Mu50
auaaucccaaccauucua

SEQ ID NO: 2053323 - RNA, 17 nt, Staphylococcus aureus subsp. aureus Mu50
auaauccauucuucuug

SEQ ID NO: 2053324 - RNA, 11 nt, Staphylococcus aureus subsp. aureus Mu50
auaauccauuc

SEQ ID NO: 2053325 - RNA, 21 nt, Staphylococcus aureus subsp. aureus Mu50
auaauccaagauauauaacua

SEQ ID NO: 2053326 - RNA, 12 nt, Staphylococcus aureus subsp. aureus Mu50
auaaucaucauu

SEQ ID NO: 2053327 - RNA, 18 nt, Staphylococcus aureus subsp. aureus Mu50
auaaucauccauauaugc

SEQ ID NO: 2053328 - RNA, 17 nt, Staphylococcus aureus subsp. aureus Mu50
auaauucagaugaauaa

SEQ ID NO: 2053329 - RNA, 21 nt, Staphylococcus aureus subsp. aureus Mu50
auaauucaguguuacuauaca

SEQ ID NO: 2053330 - RNA, 17 nt, Staphylococcus aureus subsp. aureus Mu50
auaauuauuaaacuuug

SEQ ID NO: 2053331 - RNA, 12 nt, Staphylococcus aureus subsp. aureus Mu50
auaauuagucau

SEQ ID NO: 2053332 - RNA, 16 nt, Staphylococcus aureus subsp. aureus Mu50
auaauuaugaaaagua

SEQ ID NO: 2053333 - RNA, 16 nt, Staphylococcus aureus subsp. aureus Mu50
auaaugucuuacuugu

SEQ ID NO: 2053334 - RNA, 16 nt, Staphylococcus aureus subsp. aureus Mu50
auaaugugaaaaaucu

SEQ ID NO: 2053335 - RNA, 18 nt, Staphylococcus aureus subsp. aureus Mu50
auaauguacauguauaaa

SEQ ID NO: 2053336 - RNA, 16 nt, Staphylococcus aureus subsp. aureus Mu50
auaauguauaaaacag

SEQ ID NO: 2053337 - RNA, 17 nt, Staphylococcus aureus subsp. aureus Mu50
auaaugguugaauaaca

SEQ ID NO: 2053338 - RNA, 21 nt, Staphylococcus aureus subsp. aureus Mu50
auaauguaauuguuuuuucuu

SEQ ID NO: 2053339 - RNA, 13 nt, Staphylococcus aureus subsp. aureus Mu50
auaauguacacuu

SEQ ID NO: 2053340 - RNA, 16 nt, Staphylococcus aureus subsp. aureus Mu50
auaauguacauguaua

SEQ ID NO: 2053341 - RNA, 18 nt, Staphylococcus aureus subsp. aureus Mu50
auaauugauaauggauua

SEQ ID NO: 2053342 - RNA, 16 nt, Staphylococcus aureus subsp. aureus Mu50
auaauugcuuuagaaa

SEQ ID NO: 2053343 - RNA, 15 nt, Staphylococcus aureus subsp. aureus Mu50
auaauugcauuacua

SEQ ID NO: 2053344 - RNA, 23 nt, Staphylococcus aureus subsp. aureus Mu50
auaauugauugucauauaaaaca

SEQ ID NO: 2053345 - RNA, 14 nt, Staphylococcus aureus subsp. aureus Mu50
auaauuuaaaagau

SEQ ID NO: 2053346 - RNA, 12 nt, Staphylococcus aureus subsp. aureus Mu50
auaauuuaaaag

SEQ ID NO: 2053347 - RNA, 23 nt, Staphylococcus aureus subsp. aureus Mu50
auaauuuaaagaacuauuuuaaa

SEQ ID NO: 2053348 - RNA, 23 nt, Staphylococcus aureus subsp. aureus Mu50
auaauuuaaaggcauaauaacca

SEQ ID NO: 2053349 - RNA, 15 nt, Staphylococcus aureus subsp. aureus Mu50
auaauuuaauaaugu

SEQ ID NO: 2053350 - RNA, 15 nt, Staphylococcus aureus subsp. aureus Mu50
auaauuuccuaaaaa

SEQ ID NO: 2053351 - RNA, 17 nt, Staphylococcus aureus subsp. aureus Mu50
auaauuucaguucuuag

SEQ ID NO: 2053352 - RNA, 22 nt, Staphylococcus aureus subsp. aureus Mu50
auaauuuauuuagcaucuuuac

SEQ ID NO: 2053353 - RNA, 19 nt, Staphylococcus aureus subsp. aureus Mu50
auaauuugagaaaugaaac

SEQ ID NO: 2053354 - RNA, 19 nt, Staphylococcus aureus subsp. aureus Mu50
auaauuugguuaauacguu

SEQ ID NO: 2053355 - RNA, 11 nt, Staphylococcus aureus subsp. aureus Mu50
auaauuuuaau

SEQ ID NO: 2053356 - RNA, 16 nt, Staphylococcus aureus subsp. aureus Mu50
auaauuuuaauauuau

SEQ ID NO: 2053357 - RNA, 12 nt, Staphylococcus aureus subsp. aureus Mu50
auaauuuuaaaa

SEQ ID NO: 2053358 - RNA, 14 nt, Staphylococcus aureus subsp. aureus Mu50
auaauuuuaaaaau

SEQ ID NO: 2053359 - RNA, 15 nt, Staphylococcus aureus subsp. aureus Mu50
auaccaaauauauuu

SEQ ID NO: 2053360 - RNA, 20 nt, Staphylococcus aureus subsp. aureus Mu50
auacauuuugcucuaaacuu

SEQ ID NO: 2053361 - RNA, 15 nt, Staphylococcus aureus subsp. aureus Mu50
auacauuuuuauaca

SEQ ID NO: 2053362 - RNA, 21 nt, Staphylococcus aureus subsp. aureus Mu50
auaccaaggguuucuggcucu

SEQ ID NO: 2053363 - RNA, 12 nt, Staphylococcus aureus subsp. aureus Mu50
auaccaagacca

SEQ ID NO: 2053364 - RNA, 22 nt, Staphylococcus aureus subsp. aureus Mu50
auaccacuugaauacuuuuuaa

SEQ ID NO: 2053365 - RNA, 14 nt, Staphylococcus aureus subsp. aureus Mu50
auaccacuuaaucg

SEQ ID NO: 2053366 - RNA, 22 nt, Staphylococcus aureus subsp. aureus Mu50
auaccacgacucauuagauaaa

SEQ ID NO: 2053367 - RNA, 18 nt, Staphylococcus aureus subsp. aureus Mu50
auaccacacuuuaaacaa

SEQ ID NO: 2053368 - RNA, 19 nt, Staphylococcus aureus subsp. aureus Mu50
auaccacacuuuaaacaag

SEQ ID NO: 2053369 - RNA, 21 nt, Staphylococcus aureus subsp. aureus Mu50
auaccacaucgcauaauaucu

SEQ ID NO: 2053370 - RNA, 18 nt, Staphylococcus aureus subsp. aureus Mu50
auacccgcgauacugcca

SEQ ID NO: 2053371 - RNA, 17 nt, Staphylococcus aureus subsp. aureus Mu50
auacccuacuauauauc

SEQ ID NO: 2053372 - RNA, 14 nt, Staphylococcus aureus subsp. aureus Mu50
auacccaccacauu

SEQ ID NO: 2053373 - RNA, 16 nt, Staphylococcus aureus subsp. aureus Mu50
auaccauuccaaaaau

SEQ ID NO: 2053374 - RNA, 15 nt, Staphylococcus aureus subsp. aureus Mu50
auaccauaauuaaau

SEQ ID NO: 2053375 - RNA, 19 nt, Staphylococcus aureus subsp. aureus Mu50
auaccaguggaaauuaugu

SEQ ID NO: 2053376 - RNA, 14 nt, Staphylococcus aureus subsp. aureus Mu50
auaccuaaaauacc

SEQ ID NO: 2053377 - RNA, 18 nt, Staphylococcus aureus subsp. aureus Mu50
auaccuaauucaauaccu

SEQ ID NO: 2053378 - RNA, 16 nt, Staphylococcus aureus subsp. aureus Mu50
auaccuaccacaauaa

SEQ ID NO: 2053379 - RNA, 22 nt, Staphylococcus aureus subsp. aureus Mu50
auaccuaucccuguaaaaccau

SEQ ID NO: 2053380 - RNA, 12 nt, Staphylococcus aureus subsp. aureus Mu50
auaccuuuaaua

SEQ ID NO: 2053381 - RNA, 21 nt, Staphylococcus aureus subsp. aureus Mu50
auaccuuuaauaucuaauucu

SEQ ID NO: 2053382 - RNA, 14 nt, Staphylococcus aureus subsp. aureus Mu50
auacgaauuaaaau

SEQ ID NO: 2053383 - RNA, 18 nt, Staphylococcus aureus subsp. aureus Mu50
auaccuuuaauuguuaaa

SEQ ID NO: 2053384 - RNA, 23 nt, Staphylococcus aureus subsp. aureus Mu50
auaccuuuaauuguuaaaucacc

SEQ ID NO: 2053385 - RNA, 19 nt, Staphylococcus aureus subsp. aureus Mu50
auaccuuuacuuucauuac

SEQ ID NO: 2053386 - RNA, 16 nt, Staphylococcus aureus subsp. aureus Mu50
auaccuuuuucuacca

SEQ ID NO: 2053387 - RNA, 13 nt, Staphylococcus aureus subsp. aureus Mu50
auaccgaauaauu

SEQ ID NO: 2053388 - RNA, 18 nt, Staphylococcus aureus subsp. aureus Mu50
auaccgaauaauuuugau

SEQ ID NO: 2053389 - RNA, 21 nt, Staphylococcus aureus subsp. aureus Mu50
auaccgaauaauuuugauaua

SEQ ID NO: 2053390 - RNA, 14 nt, Staphylococcus aureus subsp. aureus Mu50
auacguuuauaucu

SEQ ID NO: 2053391 - RNA, 16 nt, Staphylococcus aureus subsp. aureus Mu50
auacguuuauaucuua

SEQ ID NO: 2053392 - RNA, 12 nt, Staphylococcus aureus subsp. aureus Mu50
auacuaaaacau

SEQ ID NO: 2053393 - RNA, 13 nt, Staphylococcus aureus subsp. aureus Mu50
auacuaaaacaug

SEQ ID NO: 2053394 - RNA, 17 nt, Staphylococcus aureus subsp. aureus Mu50
auacuaaauugagaagu

SEQ ID NO: 2053395 - RNA, 16 nt, Staphylococcus aureus subsp. aureus Mu50
auacuaaauugagaag

SEQ ID NO: 2053396 - RNA, 15 nt, Staphylococcus aureus subsp. aureus Mu50
auacuaaauuugaaa

SEQ ID NO: 2053397 - RNA, 15 nt, Staphylococcus aureus subsp. aureus Mu50
auacuaaucaaagaa

SEQ ID NO: 2053398 - RNA, 19 nt, Staphylococcus aureus subsp. aureus Mu50
auacuaaucaaagaaaaag

SEQ ID NO: 2053399 - RNA, 22 nt, Staphylococcus aureus subsp. aureus Mu50
auacuaaucaaagaaaaaguga

SEQ ID NO: 2053400 - RNA, 19 nt, Staphylococcus aureus subsp. aureus Mu50
auacuaauaucuucuuuau

SEQ ID NO: 2053401 - RNA, 20 nt, Staphylococcus aureus subsp. aureus Mu50
auacgcgcuucaucaaugga

SEQ ID NO: 2053402 - RNA, 14 nt, Staphylococcus aureus subsp. aureus Mu50
auacgccuaaauau

SEQ ID NO: 2053403 - RNA, 20 nt, Staphylococcus aureus subsp. aureus Mu50
auacgacauuuuuagacauu

SEQ ID NO: 2053404 - RNA, 19 nt, Staphylococcus aureus subsp. aureus Mu50
auacgcuuuuuaaaaaauu

SEQ ID NO: 2053405 - RNA, 22 nt, Staphylococcus aureus subsp. aureus Mu50
auagcauaaaauuucugcuucu

SEQ ID NO: 2053406 - RNA, 21 nt, Staphylococcus aureus subsp. aureus Mu50
auagcaaccauauuuuuagaa

SEQ ID NO: 2053407 - RNA, 23 nt, Staphylococcus aureus subsp. aureus Mu50
auagauuuaucaccuuuaggcaa

SEQ ID NO: 2053408 - RNA, 15 nt, Staphylococcus aureus subsp. aureus Mu50
auagauuugaauuaa

SEQ ID NO: 2053409 - RNA, 19 nt, Staphylococcus aureus subsp. aureus Mu50
auagccguuaacaucagua

SEQ ID NO: 2053410 - RNA, 17 nt, Staphylococcus aureus subsp. aureus Mu50
auagccuauuuaaaaga

SEQ ID NO: 2053411 - RNA, 15 nt, Staphylococcus aureus subsp. aureus Mu50
auagauaucauuuua

SEQ ID NO: 2053412 - RNA, 13 nt, Staphylococcus aureus subsp. aureus Mu50
auagauugaaaaa

SEQ ID NO: 2053413 - RNA, 16 nt, Staphylococcus aureus subsp. aureus Mu50
auagacugccaauaaa

SEQ ID NO: 2053414 - RNA, 14 nt, Staphylococcus aureus subsp. aureus Mu50
auagauaaugcacc

SEQ ID NO: 2053415 - RNA, 19 nt, Staphylococcus aureus subsp. aureus Mu50
auagauagaaauugugcuu

SEQ ID NO: 2053416 - RNA, 22 nt, Staphylococcus aureus subsp. aureus Mu50
auagauagacuuucuugaugaa

SEQ ID NO: 2053417 - RNA, 22 nt, Staphylococcus aureus subsp. aureus Mu50
auagacuaauuaucuucaucau

SEQ ID NO: 2053418 - RNA, 15 nt, Staphylococcus aureus subsp. aureus Mu50
auagacaccaaaaaa

SEQ ID NO: 2053419 - RNA, 20 nt, Staphylococcus aureus subsp. aureus Mu50
auacuucaccacauaaaaau

SEQ ID NO: 2053420 - RNA, 14 nt, Staphylococcus aureus subsp. aureus Mu50
auacuucaucugua

SEQ ID NO: 2053421 - RNA, 22 nt, Staphylococcus aureus subsp. aureus Mu50
auacuuuuggucuguugaaguc

SEQ ID NO: 2053422 - RNA, 13 nt, Staphylococcus aureus subsp. aureus Mu50
auacuuuuuaaau

SEQ ID NO: 2053423 - RNA, 21 nt, Staphylococcus aureus subsp. aureus Mu50
auagaaaaugaguacaacaua

SEQ ID NO: 2053424 - RNA, 18 nt, Staphylococcus aureus subsp. aureus Mu50
auagaaaaauuucaaaaa

SEQ ID NO: 2053425 - RNA, 15 nt, Staphylococcus aureus subsp. aureus Mu50
auacuuaauuuaaau

SEQ ID NO: 2053426 - RNA, 17 nt, Staphylococcus aureus subsp. aureus Mu50
auacuuacugaaacuaa

SEQ ID NO: 2053427 - RNA, 16 nt, Staphylococcus aureus subsp. aureus Mu50
auacuuaauauaguua

SEQ ID NO: 2053428 - RNA, 15 nt, Staphylococcus aureus subsp. aureus Mu50
auacuaguucaacuc

SEQ ID NO: 2053429 - RNA, 13 nt, Staphylococcus aureus subsp. aureus Mu50
auacuauacugau

SEQ ID NO: 2053430 - RNA, 19 nt, Staphylococcus aureus subsp. aureus Mu50
auacuacuuguuuguuuuu

SEQ ID NO: 2053431 - RNA, 17 nt, Staphylococcus aureus subsp. aureus Mu50
auacuacuguugacauu

SEQ ID NO: 2053432 - RNA, 17 nt, Staphylococcus aureus subsp. aureus Mu50
auacuacauauaaugcc

SEQ ID NO: 2053433 - RNA, 22 nt, Staphylococcus aureus subsp. aureus Mu50
auacuaauuucuauagaaaaag

SEQ ID NO: 2053434 - RNA, 23 nt, Staphylococcus aureus subsp. aureus Mu50
auacuaaucuucaacuucgauau

SEQ ID NO: 2053435 - RNA, 13 nt, Staphylococcus aureus subsp. aureus Mu50
auagaauuuuuca

SEQ ID NO: 2053436 - RNA, 12 nt, Staphylococcus aureus subsp. aureus Mu50
auagaauuuuuc

SEQ ID NO: 2053437 - RNA, 15 nt, Staphylococcus aureus subsp. aureus Mu50
auagaaugucgauau

SEQ ID NO: 2053438 - RNA, 15 nt, Staphylococcus aureus subsp. aureus Mu50
auagaaugaauaauu

SEQ ID NO: 2053439 - RNA, 15 nt, Staphylococcus aureus subsp. aureus Mu50
auagaaguauggaug

SEQ ID NO: 2053440 - RNA, 15 nt, Staphylococcus aureus subsp. aureus Mu50
auagaaauaaucaca

SEQ ID NO: 2053441 - RNA, 16 nt, Staphylococcus aureus subsp. aureus Mu50
auagaaauaaucacau

SEQ ID NO: 2053442 - RNA, 12 nt, Staphylococcus aureus subsp. aureus Mu50
auagaaaugaua

SEQ ID NO: 2053443 - RNA, 23 nt, Staphylococcus aureus subsp. aureus Mu50
auagaaccuauuuuuuauaugau

SEQ ID NO: 2053444 - RNA, 14 nt, Staphylococcus aureus subsp. aureus Mu50
auagaacaaaaugu

SEQ ID NO: 2053445 - RNA, 14 nt, Staphylococcus aureus subsp. aureus Mu50
aguuuguaauaauu

SEQ ID NO: 2053446 - RNA, 15 nt, Staphylococcus aureus subsp. aureus Mu50
aguuuuauuuauaaa

SEQ ID NO: 2053447 - RNA, 22 nt, Staphylococcus aureus subsp. aureus Mu50
aguuuuauuuauaaacaauaaa

SEQ ID NO: 2053448 - RNA, 22 nt, Staphylococcus aureus subsp. aureus Mu50
aguuuccauaaauaaaaugcua

SEQ ID NO: 2053449 - RNA, 22 nt, Staphylococcus aureus subsp. aureus Mu50
aguuucaucaaguauaaauguu

SEQ ID NO: 2053450 - RNA, 18 nt, Staphylococcus aureus subsp. aureus Mu50
aguuucaucuucaacuuu

SEQ ID NO: 2053451 - RNA, 16 nt, Staphylococcus aureus subsp. aureus Mu50
aguuuauuaauauuag

SEQ ID NO: 2053452 - RNA, 14 nt, Staphylococcus aureus subsp. aureus Mu50
auaaaaaaugaaug

SEQ ID NO: 2053453 - RNA, 12 nt, Staphylococcus aureus subsp. aureus Mu50
auaaaaaauaac

SEQ ID NO: 2053454 - RNA, 22 nt, Staphylococcus aureus subsp. aureus Mu50
aguuuuuuaaaauaaugauaua

SEQ ID NO: 2053455 - RNA, 22 nt, Staphylococcus aureus subsp. aureus Mu50
aguuuuugguagcauuuuagau

SEQ ID NO: 2053456 - RNA, 20 nt, Staphylococcus aureus subsp. aureus Mu50
aguuuuucaggguuuaagau

SEQ ID NO: 2053457 - RNA, 22 nt, Staphylococcus aureus subsp. aureus Mu50
aguugcgaacucguuauagaua

SEQ ID NO: 2053458 - RNA, 16 nt, Staphylococcus aureus subsp. aureus Mu50
aguuggggaugggccc

SEQ ID NO: 2053459 - RNA, 21 nt, Staphylococcus aureus subsp. aureus Mu50
aguuggcugauagaugaaaau

SEQ ID NO: 2053460 - RNA, 22 nt, Staphylococcus aureus subsp. aureus Mu50
aguugaucaaaaauguuaucua

SEQ ID NO: 2053461 - RNA, 12 nt, Staphylococcus aureus subsp. aureus Mu50
aguugauaaugu

SEQ ID NO: 2053462 - RNA, 17 nt, Staphylococcus aureus subsp. aureus Mu50
aguugagucaauuucuu

SEQ ID NO: 2053463 - RNA, 13 nt, Staphylococcus aureus subsp. aureus Mu50
aguucuuuuugau

SEQ ID NO: 2053464 - RNA, 19 nt, Staphylococcus aureus subsp. aureus Mu50
aguuguacuacuugauucu

SEQ ID NO: 2053465 - RNA, 15 nt, Staphylococcus aureus subsp. aureus Mu50
aguuguccauuuuau

SEQ ID NO: 2053466 - RNA, 15 nt, Staphylococcus aureus subsp. aureus Mu50
aguuguaucauuaau

SEQ ID NO: 2053467 - RNA, 16 nt, Staphylococcus aureus subsp. aureus Mu50
aguuggggugagggcc

SEQ ID NO: 2053468 - RNA, 18 nt, Staphylococcus aureus subsp. aureus Mu50
aguugguggaugucaugu

SEQ ID NO: 2053469 - RNA, 17 nt, Staphylococcus aureus subsp. aureus Mu50
aguuuagguugauuucu

SEQ ID NO: 2053470 - RNA, 20 nt, Staphylococcus aureus subsp. aureus Mu50
aguugugguuguuaauguau

SEQ ID NO: 2053471 - RNA, 23 nt, Staphylococcus aureus subsp. aureus Mu50
aguuuauugccgguuaaauuauu

SEQ ID NO: 2053472 - RNA, 16 nt, Staphylococcus aureus subsp. aureus Mu50
aguuaaaguacuuaca

SEQ ID NO: 2053473 - RNA, 23 nt, Staphylococcus aureus subsp. aureus Mu50
aguuaaaguuccaaguuaaugca

SEQ ID NO: 2053474 - RNA, 16 nt, Staphylococcus aureus subsp. aureus Mu50
aguuaaaucacugcuu

SEQ ID NO: 2053475 - RNA, 14 nt, Staphylococcus aureus subsp. aureus Mu50
aguuaaaucuguau

SEQ ID NO: 2053476 - RNA, 14 nt, Staphylococcus aureus subsp. aureus Mu50
aguuaaauaguaag

SEQ ID NO: 2053477 - RNA, 13 nt, Staphylococcus aureus subsp. aureus Mu50
aguuaauuauuua

SEQ ID NO: 2053478 - RNA, 17 nt, Staphylococcus aureus subsp. aureus Mu50
aguuaauugaaugaaaa

SEQ ID NO: 2053479 - RNA, 15 nt, Staphylococcus aureus subsp. aureus Mu50
aguuaauguaaaguu

SEQ ID NO: 2053480 - RNA, 15 nt, Staphylococcus aureus subsp. aureus Mu50
aguuauaucaucaac

SEQ ID NO: 2053481 - RNA, 14 nt, Staphylococcus aureus subsp. aureus Mu50
aguuauaugugcuu

SEQ ID NO: 2053482 - RNA, 17 nt, Staphylococcus aureus subsp. aureus Mu50
aguuaugacuaacgaaa

SEQ ID NO: 2053483 - RNA, 21 nt, Staphylococcus aureus subsp. aureus Mu50
aguuaugaugggaaaaaaugg

SEQ ID NO: 2053484 - RNA, 18 nt, Staphylococcus aureus subsp. aureus Mu50
aguuaugcugucaaacaa

SEQ ID NO: 2053485 - RNA, 13 nt, Staphylococcus aureus subsp. aureus Mu50
aguuauuaagcca

SEQ ID NO: 2053486 - RNA, 12 nt, Staphylococcus aureus subsp. aureus Mu50
aguuauuaaauc

SEQ ID NO: 2053487 - RNA, 15 nt, Staphylococcus aureus subsp. aureus Mu50
aguucuauauaauuu

SEQ ID NO: 2053488 - RNA, 21 nt, Staphylococcus aureus subsp. aureus Mu50
aguucuagauuauuuaaaaau

SEQ ID NO: 2053489 - RNA, 20 nt, Staphylococcus aureus subsp. aureus Mu50
aguuccguugaauuaacaau

SEQ ID NO: 2053490 - RNA, 18 nt, Staphylococcus aureus subsp. aureus Mu50
aguucaggaucaagugca

SEQ ID NO: 2053491 - RNA, 13 nt, Staphylococcus aureus subsp. aureus Mu50
auaaaaauuuauu

SEQ ID NO: 2053492 - RNA, 15 nt, Staphylococcus aureus subsp. aureus Mu50
auaaaaauuuauuca

SEQ ID NO: 2053493 - RNA, 16 nt, Staphylococcus aureus subsp. aureus Mu50
auaaaaaugcucaagu

SEQ ID NO: 2053494 - RNA, 17 nt, Staphylococcus aureus subsp. aureus Mu50
auaaaaaucuuggugau

SEQ ID NO: 2053495 - RNA, 20 nt, Staphylococcus aureus subsp. aureus Mu50
auaaaacuaaugauaguaca

SEQ ID NO: 2053496 - RNA, 17 nt, Staphylococcus aureus subsp. aureus Mu50
auaaaacuaauuaggua

SEQ ID NO: 2053497 - RNA, 16 nt, Staphylococcus aureus subsp. aureus Mu50
auaaaacuauguguau

SEQ ID NO: 2053498 - RNA, 20 nt, Staphylococcus aureus subsp. aureus Mu50
auaaaagucgauaaauauga

SEQ ID NO: 2053499 - RNA, 22 nt, Staphylococcus aureus subsp. aureus Mu50
auaaaagucgauaaauaugaug

SEQ ID NO: 2053500 - RNA, 17 nt, Staphylococcus aureus subsp. aureus Mu50
auaaaauaaaaaaauga

SEQ ID NO: 2053501 - RNA, 12 nt, Staphylococcus aureus subsp. aureus Mu50
auaaaauaaaua

SEQ ID NO: 2053502 - RNA, 22 nt, Staphylococcus aureus subsp. aureus Mu50
auaaaauaaucgguaauuacuu

SEQ ID NO: 2053503 - RNA, 23 nt, Staphylococcus aureus subsp. aureus Mu50
auaaaauaauuguucuucagaaa

SEQ ID NO: 2053504 - RNA, 21 nt, Staphylococcus aureus subsp. aureus Mu50
auaaaaguuaggcgacuuaac

SEQ ID NO: 2053505 - RNA, 19 nt, Staphylococcus aureus subsp. aureus Mu50
auaaaacuuauaacugaua

SEQ ID NO: 2053506 - RNA, 19 nt, Staphylococcus aureus subsp. aureus Mu50
auaaaagccucuaaugauu

SEQ ID NO: 2053507 - RNA, 18 nt, Staphylococcus aureus subsp. aureus Mu50
auaaaaucauuaauaauu

SEQ ID NO: 2053508 - RNA, 22 nt, Staphylococcus aureus subsp. aureus Mu50
auaaaauccuaagcaucguaaa

SEQ ID NO: 2053509 - RNA, 13 nt, Staphylococcus aureus subsp. aureus Mu50
auaaaaucauuaa

SEQ ID NO: 2053510 - RNA, 20 nt, Staphylococcus aureus subsp. aureus Mu50
auaaaauauaucuuaugaua

SEQ ID NO: 2053511 - RNA, 20 nt, Staphylococcus aureus subsp. aureus Mu50
auaaaaucaucguauuucau

SEQ ID NO: 2053512 - RNA, 13 nt, Staphylococcus aureus subsp. aureus Mu50
auaaaauuuaaaa

SEQ ID NO: 2053513 - RNA, 15 nt, Staphylococcus aureus subsp. aureus Mu50
auaaaaugaauaauu

SEQ ID NO: 2053514 - RNA, 16 nt, Staphylococcus aureus subsp. aureus Mu50
auaaaaugcuacaauu

SEQ ID NO: 2053515 - RNA, 21 nt, Staphylococcus aureus subsp. aureus Mu50
auaaaaugcauagcucuucuu

SEQ ID NO: 2053516 - RNA, 13 nt, Staphylococcus aureus subsp. aureus Mu50
auaaaauguuguu

SEQ ID NO: 2053517 - RNA, 20 nt, Staphylococcus aureus subsp. aureus Mu50
auaaaauggugcgaauaaua

SEQ ID NO: 2053518 - RNA, 16 nt, Staphylococcus aureus subsp. aureus Mu50
auaaaauuaaaacagc

SEQ ID NO: 2053519 - RNA, 18 nt, Staphylococcus aureus subsp. aureus Mu50
auaaacguccaaacacaa

SEQ ID NO: 2053520 - RNA, 23 nt, Staphylococcus aureus subsp. aureus Mu50
auaaaccaaaucggaauaaaaua

SEQ ID NO: 2053521 - RNA, 20 nt, Staphylococcus aureus subsp. aureus Mu50
auaaacgacgcaagugacuu

SEQ ID NO: 2053522 - RNA, 14 nt, Staphylococcus aureus subsp. aureus Mu50
auaaaauuucugcu

SEQ ID NO: 2053523 - RNA, 15 nt, Staphylococcus aureus subsp. aureus Mu50
auaaagucauacuua

SEQ ID NO: 2053524 - RNA, 16 nt, Staphylococcus aureus subsp. aureus Mu50
auaaagucauacuuau

SEQ ID NO: 2053525 - RNA, 15 nt, Staphylococcus aureus subsp. aureus Mu50
auaaagucauauggu

SEQ ID NO: 2053526 - RNA, 17 nt, Staphylococcus aureus subsp. aureus Mu50
auaaaguuuguaauauu

SEQ ID NO: 2053527 - RNA, 22 nt, Staphylococcus aureus subsp. aureus Mu50
auaaagaaugauuuauaaaaaa

SEQ ID NO: 2053528 - RNA, 21 nt, Staphylococcus aureus subsp. aureus Mu50
auaaagacaccuucaauaucu

SEQ ID NO: 2053529 - RNA, 19 nt, Staphylococcus aureus subsp. aureus Mu50
auaaaguaugagugauaga

SEQ ID NO: 2053530 - RNA, 17 nt, Staphylococcus aureus subsp. aureus Mu50
auaaauagauaauauau

SEQ ID NO: 2053531 - RNA, 21 nt, Staphylococcus aureus subsp. aureus Mu50
auaaauaccgucuucucuauc

SEQ ID NO: 2053532 - RNA, 23 nt, Staphylococcus aureus subsp. aureus Mu50
auaaauaaaaggcauucuuccaa

SEQ ID NO: 2053533 - RNA, 22 nt, Staphylococcus aureus subsp. aureus Mu50
auaaauaaaaauacauaauuaa

SEQ ID NO: 2053534 - RNA, 12 nt, Staphylococcus aureus subsp. aureus Mu50
auaaauauaaaa

SEQ ID NO: 2053535 - RNA, 13 nt, Staphylococcus aureus subsp. aureus Mu50
auaaaugucacug

SEQ ID NO: 2053536 - RNA, 17 nt, Staphylococcus aureus subsp. aureus Mu50
auaaaugcuaaaaguau

SEQ ID NO: 2053537 - RNA, 19 nt, Staphylococcus aureus subsp. aureus Mu50
auaaauucucuuggauagu

SEQ ID NO: 2053538 - RNA, 22 nt, Staphylococcus aureus subsp. aureus Mu50
auaaaucauacgagaaauuaga

SEQ ID NO: 2053539 - RNA, 16 nt, Staphylococcus aureus subsp. aureus Mu50
auaaaucauucuuuau

SEQ ID NO: 2053540 - RNA, 16 nt, Staphylococcus aureus subsp. aureus Mu50
auaaaucaagaaaugu

SEQ ID NO: 2053541 - RNA, 17 nt, Staphylococcus aureus subsp. aureus Mu50
auaaaucaagaaauguu

SEQ ID NO: 2053542 - RNA, 20 nt, Staphylococcus aureus subsp. aureus Mu50
auaaaucaagaaauguuaaa

SEQ ID NO: 2053543 - RNA, 15 nt, Staphylococcus aureus subsp. aureus Mu50
auaaaugacauuuaa

SEQ ID NO: 2053544 - RNA, 18 nt, Staphylococcus aureus subsp. aureus Mu50
auaaaugacuucacauuu

SEQ ID NO: 2053545 - RNA, 15 nt, Staphylococcus aureus subsp. aureus Mu50
auaacaucuaaauuu

SEQ ID NO: 2053546 - RNA, 17 nt, Staphylococcus aureus subsp. aureus Mu50
auaacauuaaaaugaua

SEQ ID NO: 2053547 - RNA, 15 nt, Staphylococcus aureus subsp. aureus Mu50
auaacaucaaauaga

SEQ ID NO: 2053548 - RNA, 22 nt, Staphylococcus aureus subsp. aureus Mu50
auaacaggugcuuacuuuuaaa

SEQ ID NO: 2053549 - RNA, 18 nt, Staphylococcus aureus subsp. aureus Mu50
auaacaguuaauuauacc

SEQ ID NO: 2053550 - RNA, 23 nt, Staphylococcus aureus subsp. aureus Mu50
auaaccuuguucuuuacuccaaa

SEQ ID NO: 2053551 - RNA, 17 nt, Staphylococcus aureus subsp. aureus Mu50
auaaccauguauaucua

SEQ ID NO: 2053552 - RNA, 17 nt, Staphylococcus aureus subsp. aureus Mu50
auaaccauguaaaauua

SEQ ID NO: 2053553 - RNA, 15 nt, Staphylococcus aureus subsp. aureus Mu50
auaaccuuuaaaaca

SEQ ID NO: 2053554 - RNA, 22 nt, Staphylococcus aureus subsp. aureus Mu50
auaaccuuuaaaacaucauuca

SEQ ID NO: 2053555 - RNA, 20 nt, Staphylococcus aureus subsp. aureus Mu50
auaacgagcaguauauauca

SEQ ID NO: 2053556 - RNA, 21 nt, Staphylococcus aureus subsp. aureus Mu50
auaaauugaaguacauuaaaa

SEQ ID NO: 2053557 - RNA, 22 nt, Staphylococcus aureus subsp. aureus Mu50
auaaauugaaguacauuaaaac

SEQ ID NO: 2053558 - RNA, 20 nt, Staphylococcus aureus subsp. aureus Mu50
auaaauugaguuuuuuaaaa

SEQ ID NO: 2053559 - RNA, 22 nt, Staphylococcus aureus subsp. aureus Mu50
auaaauugaguuuuuuaaaaua

SEQ ID NO: 2053560 - RNA, 22 nt, Staphylococcus aureus subsp. aureus Mu50
auaaauuuagauauuauaaaaa

SEQ ID NO: 2053561 - RNA, 20 nt, Staphylococcus aureus subsp. aureus Mu50
auaaauuuaacguuauucau

SEQ ID NO: 2053562 - RNA, 16 nt, Staphylococcus aureus subsp. aureus Mu50
auaacaacuacuuaaa

SEQ ID NO: 2053563 - RNA, 14 nt, Staphylococcus aureus subsp. aureus Mu50
auaacaagaaguaa

SEQ ID NO: 2053564 - RNA, 17 nt, Staphylococcus aureus subsp. aureus Mu50
auaacaagaaguaaugu

SEQ ID NO: 2053565 - RNA, 20 nt, Staphylococcus aureus subsp. aureus Mu50
auaacaaguauaaaugcagc

SEQ ID NO: 2053566 - RNA, 16 nt, Staphylococcus aureus subsp. aureus Mu50
auaacaacgauaauug

SEQ ID NO: 2053567 - RNA, 13 nt, Staphylococcus aureus subsp. aureus Mu50
auaacaauuuuaa

SEQ ID NO: 2053568 - RNA, 16 nt, Staphylococcus aureus subsp. aureus Mu50
auaacagcuacaaaua

SEQ ID NO: 2053569 - RNA, 21 nt, Staphylococcus aureus subsp. aureus Mu50
auaacagcuacaaauaaugag

SEQ ID NO: 2053570 - RNA, 22 nt, Staphylococcus aureus subsp. aureus Mu50
auaacaaugcagcuguauuuaa

SEQ ID NO: 2053571 - RNA, 18 nt, Staphylococcus aureus subsp. aureus Mu50
agucucccauaacaccua

SEQ ID NO: 2053572 - RNA, 16 nt, Staphylococcus aureus subsp. aureus Mu50
agucgguguuuucuua

SEQ ID NO: 2053573 - RNA, 19 nt, Staphylococcus aureus subsp. aureus Mu50
agugaaagucguuguugaa

SEQ ID NO: 2053574 - RNA, 17 nt, Staphylococcus aureus subsp. aureus Mu50
agugaaaguauuagaua

SEQ ID NO: 2053575 - RNA, 14 nt, Staphylococcus aureus subsp. aureus Mu50
agugaaauaccucc

SEQ ID NO: 2053576 - RNA, 16 nt, Staphylococcus aureus subsp. aureus Mu50
agugaaaucauuuaaa

SEQ ID NO: 2053577 - RNA, 13 nt, Staphylococcus aureus subsp. aureus Mu50
agugaaaagaaca

SEQ ID NO: 2053578 - RNA, 15 nt, Staphylococcus aureus subsp. aureus Mu50
agucucguaauaaug

SEQ ID NO: 2053579 - RNA, 18 nt, Staphylococcus aureus subsp. aureus Mu50
agugaaggagauuaagca

SEQ ID NO: 2053580 - RNA, 16 nt, Staphylococcus aureus subsp. aureus Mu50
agugaaguacgacggu

SEQ ID NO: 2053581 - RNA, 16 nt, Staphylococcus aureus subsp. aureus Mu50
agugauaaauaaugca

SEQ ID NO: 2053582 - RNA, 13 nt, Staphylococcus aureus subsp. aureus Mu50
agugauaauuaaa

SEQ ID NO: 2053583 - RNA, 23 nt, Staphylococcus aureus subsp. aureus Mu50
agugaugugauguguuguuuuaa

SEQ ID NO: 2053584 - RNA, 12 nt, Staphylococcus aureus subsp. aureus Mu50
agugauucccaa

SEQ ID NO: 2053585 - RNA, 12 nt, Staphylococcus aureus subsp. aureus Mu50
agugauuuaaaa

SEQ ID NO: 2053586 - RNA, 15 nt, Staphylococcus aureus subsp. aureus Mu50
agugauuuaaaaaau

SEQ ID NO: 2053587 - RNA, 14 nt, Staphylococcus aureus subsp. aureus Mu50
agugcaauuauuuc

SEQ ID NO: 2053588 - RNA, 19 nt, Staphylococcus aureus subsp. aureus Mu50
agugcuuccacuucaucua

SEQ ID NO: 2053589 - RNA, 18 nt, Staphylococcus aureus subsp. aureus Mu50
agugcuuuuaaucaaauu

SEQ ID NO: 2053590 - RNA, 14 nt, Staphylococcus aureus subsp. aureus Mu50
aguggaaauuaugu

SEQ ID NO: 2053591 - RNA, 17 nt, Staphylococcus aureus subsp. aureus Mu50
agucauuugauuuaaaa

SEQ ID NO: 2053592 - RNA, 15 nt, Staphylococcus aureus subsp. aureus Mu50
agucaugucccauaa

SEQ ID NO: 2053593 - RNA, 19 nt, Staphylococcus aureus subsp. aureus Mu50
agucaucaaccucauuuga

SEQ ID NO: 2053594 - RNA, 18 nt, Staphylococcus aureus subsp. aureus Mu50
agucauaggcuugccaau

SEQ ID NO: 2053595 - RNA, 12 nt, Staphylococcus aureus subsp. aureus Mu50
aguccauuuucu

SEQ ID NO: 2053596 - RNA, 16 nt, Staphylococcus aureus subsp. aureus Mu50
aguccauuuucuuuuu

SEQ ID NO: 2053597 - RNA, 19 nt, Staphylococcus aureus subsp. aureus Mu50
aguccaauuccaauaaaca

SEQ ID NO: 2053598 - RNA, 19 nt, Staphylococcus aureus subsp. aureus Mu50
agucgcaauggcaauugau

SEQ ID NO: 2053599 - RNA, 15 nt, Staphylococcus aureus subsp. aureus Mu50
agucgauaaguuuuu

SEQ ID NO: 2053600 - RNA, 17 nt, Staphylococcus aureus subsp. aureus Mu50
agucggggccccaacac

SEQ ID NO: 2053601 - RNA, 18 nt, Staphylococcus aureus subsp. aureus Mu50
agucggggccccaacaca

SEQ ID NO: 2053602 - RNA, 14 nt, Staphylococcus aureus subsp. aureus Mu50
agucccgcuuaaaa

SEQ ID NO: 2053603 - RNA, 13 nt, Staphylococcus aureus subsp. aureus Mu50
aguauuuucucua

SEQ ID NO: 2053604 - RNA, 22 nt, Staphylococcus aureus subsp. aureus Mu50
aguauuuuugcguuaauaauuu

SEQ ID NO: 2053605 - RNA, 16 nt, Staphylococcus aureus subsp. aureus Mu50
aguauuuuuuauguuc

SEQ ID NO: 2053606 - RNA, 18 nt, Staphylococcus aureus subsp. aureus Mu50
aguauuugccuuuugaau

SEQ ID NO: 2053607 - RNA, 20 nt, Staphylococcus aureus subsp. aureus Mu50
aguauugccaaauuucucuu

SEQ ID NO: 2053608 - RNA, 21 nt, Staphylococcus aureus subsp. aureus Mu50
aguauugccguuauuuucaau

SEQ ID NO: 2053609 - RNA, 21 nt, Staphylococcus aureus subsp. aureus Mu50
aguauuguuuuauauuuaaac

SEQ ID NO: 2053610 - RNA, 15 nt, Staphylococcus aureus subsp. aureus Mu50
aguauuaugauugcu

SEQ ID NO: 2053611 - RNA, 15 nt, Staphylococcus aureus subsp. aureus Mu50
aguauucaaaaaaua

SEQ ID NO: 2053612 - RNA, 18 nt, Staphylococcus aureus subsp. aureus Mu50
aguauggcgaaauguuuu

SEQ ID NO: 2053613 - RNA, 14 nt, Staphylococcus aureus subsp. aureus Mu50
aguaucucauuuuu

SEQ ID NO: 2053614 - RNA, 14 nt, Staphylococcus aureus subsp. aureus Mu50
aguaucuaugaaau

SEQ ID NO: 2053615 - RNA, 21 nt, Staphylococcus aureus subsp. aureus Mu50
aguaucucuuuucuauucaaa

SEQ ID NO: 2053616 - RNA, 17 nt, Staphylococcus aureus subsp. aureus Mu50
aguaucuaaauauuaaa

SEQ ID NO: 2053617 - RNA, 21 nt, Staphylococcus aureus subsp. aureus Mu50
aguaucauguucuuauaaaaa

SEQ ID NO: 2053618 - RNA, 17 nt, Staphylococcus aureus subsp. aureus Mu50
aguaucauaauuuuguu

SEQ ID NO: 2053619 - RNA, 23 nt, Staphylococcus aureus subsp. aureus Mu50
aguaucauuguguccauaaauau

SEQ ID NO: 2053620 - RNA, 19 nt, Staphylococcus aureus subsp. aureus Mu50
agucaauguauauuuaaca

SEQ ID NO: 2053621 - RNA, 23 nt, Staphylococcus aureus subsp. aureus Mu50
agucaauguauauuuaacaucaa

SEQ ID NO: 2053622 - RNA, 13 nt, Staphylococcus aureus subsp. aureus Mu50
agucaaucaaguu

SEQ ID NO: 2053623 - RNA, 17 nt, Staphylococcus aureus subsp. aureus Mu50
agucaccauauuuaaca

SEQ ID NO: 2053624 - RNA, 14 nt, Staphylococcus aureus subsp. aureus Mu50
agucaccauauuua

SEQ ID NO: 2053625 - RNA, 16 nt, Staphylococcus aureus subsp. aureus Mu50
agucaacaauugcuaa

SEQ ID NO: 2053626 - RNA, 22 nt, Staphylococcus aureus subsp. aureus Mu50
agucaacugcugcuaaaauaaa

SEQ ID NO: 2053627 - RNA, 19 nt, Staphylococcus aureus subsp. aureus Mu50
agucaauaauuuuaucuaa

SEQ ID NO: 2053628 - RNA, 13 nt, Staphylococcus aureus subsp. aureus Mu50
agucauaaauaua

SEQ ID NO: 2053629 - RNA, 16 nt, Staphylococcus aureus subsp. aureus Mu50
agucauaaauauaaaa

SEQ ID NO: 2053630 - RNA, 16 nt, Staphylococcus aureus subsp. aureus Mu50
agucaggggccccaac

SEQ ID NO: 2053631 - RNA, 22 nt, Staphylococcus aureus subsp. aureus Mu50
agucaggggccccaacacagag

SEQ ID NO: 2053632 - RNA, 18 nt, Staphylococcus aureus subsp. aureus Mu50
aguauauccgcaucuuuu

SEQ ID NO: 2053633 - RNA, 15 nt, Staphylococcus aureus subsp. aureus Mu50
aguauauaucaaaua

SEQ ID NO: 2053634 - RNA, 17 nt, Staphylococcus aureus subsp. aureus Mu50
aguauauaucaaauaca

SEQ ID NO: 2053635 - RNA, 16 nt, Staphylococcus aureus subsp. aureus Mu50
aguauaauuuucuguc

SEQ ID NO: 2053636 - RNA, 13 nt, Staphylococcus aureus subsp. aureus Mu50
aguauaauuaaac

SEQ ID NO: 2053637 - RNA, 15 nt, Staphylococcus aureus subsp. aureus Mu50
aguaguguauucauu

SEQ ID NO: 2053638 - RNA, 18 nt, Staphylococcus aureus subsp. aureus Mu50
aguaguuaucuaaugauc

SEQ ID NO: 2053639 - RNA, 17 nt, Staphylococcus aureus subsp. aureus Mu50
aguaguuguacuucuuu

SEQ ID NO: 2053640 - RNA, 20 nt, Staphylococcus aureus subsp. aureus Mu50
aguaguugacugaacgaaaa

SEQ ID NO: 2053641 - RNA, 13 nt, Staphylococcus aureus subsp. aureus Mu50
aguauaaauaaaa

SEQ ID NO: 2053642 - RNA, 20 nt, Staphylococcus aureus subsp. aureus Mu50
aguauaaauaaaaauacaua

SEQ ID NO: 2053643 - RNA, 20 nt, Staphylococcus aureus subsp. aureus Mu50
aguauaaaccgccaacuaau

SEQ ID NO: 2053644 - RNA, 23 nt, Staphylococcus aureus subsp. aureus Mu50
aguauaaaccgccaacuaauguu

SEQ ID NO: 2053645 - RNA, 20 nt, Staphylococcus aureus subsp. aureus Mu50
aguaggguauugaaauaaua

SEQ ID NO: 2053646 - RNA, 14 nt, Staphylococcus aureus subsp. aureus Mu50
aguagucacuguuu

SEQ ID NO: 2053647 - RNA, 22 nt, Staphylococcus aureus subsp. aureus Mu50
aguagcucaaaacaauuuaaaa

SEQ ID NO: 2053648 - RNA, 16 nt, Staphylococcus aureus subsp. aureus Mu50
aguagcuagaacagau

SEQ ID NO: 2053649 - RNA, 24 nt, Staphylococcus aureus subsp. aureus Mu50
aguagcuuguuuagaagcuucugc

SEQ ID NO: 2053650 - RNA, 18 nt, Staphylococcus aureus subsp. aureus Mu50
aguaggauaauuucaauu

SEQ ID NO: 2053651 - RNA, 16 nt, Staphylococcus aureus subsp. aureus Mu50
aguagccacaauuuug

SEQ ID NO: 2053652 - RNA, 19 nt, Staphylococcus aureus subsp. aureus Mu50
aguagauugauauccuuaa

SEQ ID NO: 2053653 - RNA, 17 nt, Staphylococcus aureus subsp. aureus Mu50
aguagaaccuauauuaa

SEQ ID NO: 2053654 - RNA, 17 nt, Staphylococcus aureus subsp. aureus Mu50
aguacuuuuacaaacuu

SEQ ID NO: 2053655 - RNA, 16 nt, Staphylococcus aureus subsp. aureus Mu50
aguagacauugaaagg

SEQ ID NO: 2053656 - RNA, 13 nt, Staphylococcus aureus subsp. aureus Mu50
aguagaauuauuu

SEQ ID NO: 2053657 - RNA, 20 nt, Staphylococcus aureus subsp. aureus Mu50
aguacuaagcuuucauuaau

SEQ ID NO: 2053658 - RNA, 16 nt, Staphylococcus aureus subsp. aureus Mu50
aguacuaaaaguauga

SEQ ID NO: 2053659 - RNA, 23 nt, Staphylococcus aureus subsp. aureus Mu50
aguacuuuaaaauuguauagaau

SEQ ID NO: 2053660 - RNA, 23 nt, Staphylococcus aureus subsp. aureus Mu50
aguacuuggaaaauacuauacug

SEQ ID NO: 2053661 - RNA, 23 nt, Staphylococcus aureus subsp. aureus Mu50
aguacgcaauuuaauauuauaag

SEQ ID NO: 2053662 - RNA, 18 nt, Staphylococcus aureus subsp. aureus Mu50
aguacggcugcuuuaacu

SEQ ID NO: 2053663 - RNA, 22 nt, Staphylococcus aureus subsp. aureus Mu50
aguacggcugcuuuaacuguac

SEQ ID NO: 2053664 - RNA, 16 nt, Staphylococcus aureus subsp. aureus Mu50
aguacgguuauuuaau

SEQ ID NO: 2053665 - RNA, 17 nt, Staphylococcus aureus subsp. aureus Mu50
agccucuugccuugaaa

SEQ ID NO: 2053666 - RNA, 19 nt, Staphylococcus aureus subsp. aureus Mu50
agccucuugccuugaaauc

SEQ ID NO: 2053667 - RNA, 19 nt, Staphylococcus aureus subsp. aureus Mu50
agccugaaauagaaauguc

SEQ ID NO: 2053668 - RNA, 15 nt, Staphylococcus aureus subsp. aureus Mu50
agccuauccauucaa

SEQ ID NO: 2053669 - RNA, 18 nt, Staphylococcus aureus subsp. aureus Mu50
agcgaccgugguucaaaa

SEQ ID NO: 2053670 - RNA, 22 nt, Staphylococcus aureus subsp. aureus Mu50
agcgaaaguaucuaugaaauuu

SEQ ID NO: 2053671 - RNA, 15 nt, Staphylococcus aureus subsp. aureus Mu50
agccuuuucaaacau

SEQ ID NO: 2053672 - RNA, 13 nt, Staphylococcus aureus subsp. aureus Mu50
agccuucuaucuu

SEQ ID NO: 2053673 - RNA, 17 nt, Staphylococcus aureus subsp. aureus Mu50
agccuuaaaauauuuaa

SEQ ID NO: 2053674 - RNA, 17 nt, Staphylococcus aureus subsp. aureus Mu50
agccuuaauaucaugca

SEQ ID NO: 2053675 - RNA, 22 nt, Staphylococcus aureus subsp. aureus Mu50
agccauuuccggaagucaagaa

SEQ ID NO: 2053676 - RNA, 23 nt, Staphylococcus aureus subsp. aureus Mu50
agccauuuguuguaaaccagcua

SEQ ID NO: 2053677 - RNA, 17 nt, Staphylococcus aureus subsp. aureus Mu50
agccauuuguuguaaac

SEQ ID NO: 2053678 - RNA, 18 nt, Staphylococcus aureus subsp. aureus Mu50
agccccuuacaaccuuug

SEQ ID NO: 2053679 - RNA, 17 nt, Staphylococcus aureus subsp. aureus Mu50
agcgcaccaauuaucaa

SEQ ID NO: 2053680 - RNA, 22 nt, Staphylococcus aureus subsp. aureus Mu50
agcgauuuuaaagaaaaguuua

SEQ ID NO: 2053681 - RNA, 21 nt, Staphylococcus aureus subsp. aureus Mu50
agcgccuaugugaugguaaau

SEQ ID NO: 2053682 - RNA, 15 nt, Staphylococcus aureus subsp. aureus Mu50
agcuacaauuaaagu

SEQ ID NO: 2053683 - RNA, 12 nt, Staphylococcus aureus subsp. aureus Mu50
agcuauaaaagu

SEQ ID NO: 2053684 - RNA, 14 nt, Staphylococcus aureus subsp. aureus Mu50
agcuaggguuaaaa

SEQ ID NO: 2053685 - RNA, 21 nt, Staphylococcus aureus subsp. aureus Mu50
agcguuucuugaucuaaugua

SEQ ID NO: 2053686 - RNA, 13 nt, Staphylococcus aureus subsp. aureus Mu50
agcuauagaaaug

SEQ ID NO: 2053687 - RNA, 19 nt, Staphylococcus aureus subsp. aureus Mu50
agcucuuaaaucacuagcu

SEQ ID NO: 2053688 - RNA, 15 nt, Staphylococcus aureus subsp. aureus Mu50
agcucuucaaauuua

SEQ ID NO: 2053689 - RNA, 17 nt, Staphylococcus aureus subsp. aureus Mu50
agcucguuaaaucacau

SEQ ID NO: 2053690 - RNA, 15 nt, Staphylococcus aureus subsp. aureus Mu50
agcugauuaaaaugu

SEQ ID NO: 2053691 - RNA, 17 nt, Staphylococcus aureus subsp. aureus Mu50
agcugauuaaaauguua

SEQ ID NO: 2053692 - RNA, 13 nt, Staphylococcus aureus subsp. aureus Mu50
agcugauuuuuca

SEQ ID NO: 2053693 - RNA, 21 nt, Staphylococcus aureus subsp. aureus Mu50
agcaaugcaugcuucucaauu

SEQ ID NO: 2053694 - RNA, 14 nt, Staphylococcus aureus subsp. aureus Mu50
agcaauaucaucau

SEQ ID NO: 2053695 - RNA, 19 nt, Staphylococcus aureus subsp. aureus Mu50
agcaauaucaucauuuaaa

SEQ ID NO: 2053696 - RNA, 15 nt, Staphylococcus aureus subsp. aureus Mu50
agcaaucauaauacu

SEQ ID NO: 2053697 - RNA, 13 nt, Staphylococcus aureus subsp. aureus Mu50
agcaacaaaagau

SEQ ID NO: 2053698 - RNA, 16 nt, Staphylococcus aureus subsp. aureus Mu50
agcaaauugauuaaau

SEQ ID NO: 2053699 - RNA, 20 nt, Staphylococcus aureus subsp. aureus Mu50
agcaaauugauuaaauaaau

SEQ ID NO: 2053700 - RNA, 14 nt, Staphylococcus aureus subsp. aureus Mu50
agcaacauuauuuu

SEQ ID NO: 2053701 - RNA, 13 nt, Staphylococcus aureus subsp. aureus Mu50
agauuuuguugua

SEQ ID NO: 2053702 - RNA, 16 nt, Staphylococcus aureus subsp. aureus Mu50
agcaaaauuauguaaa

SEQ ID NO: 2053703 - RNA, 21 nt, Staphylococcus aureus subsp. aureus Mu50
agcaaaauuauguaaaaaaua

SEQ ID NO: 2053704 - RNA, 15 nt, Staphylococcus aureus subsp. aureus Mu50
agcaaauaaaaucau

SEQ ID NO: 2053705 - RNA, 16 nt, Staphylococcus aureus subsp. aureus Mu50
agcaaauauuauuaaa

SEQ ID NO: 2053706 - RNA, 13 nt, Staphylococcus aureus subsp. aureus Mu50
agcaaauaaaauc

SEQ ID NO: 2053707 - RNA, 20 nt, Staphylococcus aureus subsp. aureus Mu50
agcaaauuauauagaaaacu

SEQ ID NO: 2053708 - RNA, 15 nt, Staphylococcus aureus subsp. aureus Mu50
agcaaaugcacugua

SEQ ID NO: 2053709 - RNA, 12 nt, Staphylococcus aureus subsp. aureus Mu50
agauaaugcacc

SEQ ID NO: 2053710 - RNA, 15 nt, Staphylococcus aureus subsp. aureus Mu50
agauaauagagaacu

SEQ ID NO: 2053711 - RNA, 21 nt, Staphylococcus aureus subsp. aureus Mu50
agauaauagagaacuugcuuu

SEQ ID NO: 2053712 - RNA, 17 nt, Staphylococcus aureus subsp. aureus Mu50
agauaaguaauaauaua

SEQ ID NO: 2053713 - RNA, 16 nt, Staphylococcus aureus subsp. aureus Mu50
agauaaguuacuagca

SEQ ID NO: 2053714 - RNA, 23 nt, Staphylococcus aureus subsp. aureus Mu50
agauuguaaaaauacauaauaaa

SEQ ID NO: 2053715 - RNA, 19 nt, Staphylococcus aureus subsp. aureus Mu50
agauuuaguuuuuuuaaag

SEQ ID NO: 2053716 - RNA, 22 nt, Staphylococcus aureus subsp. aureus Mu50
agauuuaguuuuuuuaaaguuu

SEQ ID NO: 2053717 - RNA, 20 nt, Staphylococcus aureus subsp. aureus Mu50
agauuugaauuaaaguggaa

SEQ ID NO: 2053718 - RNA, 14 nt, Staphylococcus aureus subsp. aureus Mu50
agauuuuauauaaa

SEQ ID NO: 2053719 - RNA, 14 nt, Staphylococcus aureus subsp. aureus Mu50
agauuuuaaaucaa

SEQ ID NO: 2053720 - RNA, 12 nt, Staphylococcus aureus subsp. aureus Mu50
agauuuuaaauc

SEQ ID NO: 2053721 - RNA, 20 nt, Staphylococcus aureus subsp. aureus Mu50
agcacuauaacaagguguuc

SEQ ID NO: 2053722 - RNA, 16 nt, Staphylococcus aureus subsp. aureus Mu50
agcacuaucuuuugcu

SEQ ID NO: 2053723 - RNA, 14 nt, Staphylococcus aureus subsp. aureus Mu50
agcacgagaaaugu

SEQ ID NO: 2053724 - RNA, 15 nt, Staphylococcus aureus subsp. aureus Mu50
agcacgagaaauguc

SEQ ID NO: 2053725 - RNA, 14 nt, Staphylococcus aureus subsp. aureus Mu50
agcaccauuauuaa

SEQ ID NO: 2053726 - RNA, 18 nt, Staphylococcus aureus subsp. aureus Mu50
agcaccguaacauaugua

SEQ ID NO: 2053727 - RNA, 23 nt, Staphylococcus aureus subsp. aureus Mu50
agcaccgauuuggucagcgacau

SEQ ID NO: 2053728 - RNA, 13 nt, Staphylococcus aureus subsp. aureus Mu50
agcacauuuuuag

SEQ ID NO: 2053729 - RNA, 20 nt, Staphylococcus aureus subsp. aureus Mu50
agcacauuuuuaguuagaaa

SEQ ID NO: 2053730 - RNA, 14 nt, Staphylococcus aureus subsp. aureus Mu50
agcacaaacuaaaa

SEQ ID NO: 2053731 - RNA, 13 nt, Staphylococcus aureus subsp. aureus Mu50
agcaauuucauca

SEQ ID NO: 2053732 - RNA, 17 nt, Staphylococcus aureus subsp. aureus Mu50
agcaauugaaucaaaua

SEQ ID NO: 2053733 - RNA, 20 nt, Staphylococcus aureus subsp. aureus Mu50
agcaguaagacgauuucaau

SEQ ID NO: 2053734 - RNA, 18 nt, Staphylococcus aureus subsp. aureus Mu50
agcaguauauaucaaaua

SEQ ID NO: 2053735 - RNA, 20 nt, Staphylococcus aureus subsp. aureus Mu50
agcaguaaguugauuucuac

SEQ ID NO: 2053736 - RNA, 22 nt, Staphylococcus aureus subsp. aureus Mu50
agcaguaggauaauuucaauuu

SEQ ID NO: 2053737 - RNA, 21 nt, Staphylococcus aureus subsp. aureus Mu50
agcauaccuuuauuauuuaau

SEQ ID NO: 2053738 - RNA, 14 nt, Staphylococcus aureus subsp. aureus Mu50
agcaguuucugaga

SEQ ID NO: 2053739 - RNA, 21 nt, Staphylococcus aureus subsp. aureus Mu50
agcaguuguugguuuugcaac

SEQ ID NO: 2053740 - RNA, 16 nt, Staphylococcus aureus subsp. aureus Mu50
agcaucugcaugguuu

SEQ ID NO: 2053741 - RNA, 21 nt, Staphylococcus aureus subsp. aureus Mu50
agcaucuugucuaguucgauu

SEQ ID NO: 2053742 - RNA, 14 nt, Staphylococcus aureus subsp. aureus Mu50
agcaucguaaaaaa

SEQ ID NO: 2053743 - RNA, 19 nt, Staphylococcus aureus subsp. aureus Mu50
agcaucgauuuauuauuac

SEQ ID NO: 2053744 - RNA, 19 nt, Staphylococcus aureus subsp. aureus Mu50
agcaucacaguguugaauu

SEQ ID NO: 2053745 - RNA, 13 nt, Staphylococcus aureus subsp. aureus Mu50
agcauauuucuaa

SEQ ID NO: 2053746 - RNA, 19 nt, Staphylococcus aureus subsp. aureus Mu50
agcauaucuuuaucauuau

SEQ ID NO: 2053747 - RNA, 22 nt, Staphylococcus aureus subsp. aureus Mu50
agccagcuuagcauagcguuca

SEQ ID NO: 2053748 - RNA, 18 nt, Staphylococcus aureus subsp. aureus Mu50
agccauaccuuauuucag

SEQ ID NO: 2053749 - RNA, 14 nt, Staphylococcus aureus subsp. aureus Mu50
agccaucuuucuuu

SEQ ID NO: 2053750 - RNA, 13 nt, Staphylococcus aureus subsp. aureus Mu50
agccauuaaacca

SEQ ID NO: 2053751 - RNA, 20 nt, Staphylococcus aureus subsp. aureus Mu50
agcaugaaucgcauuuaaau

SEQ ID NO: 2053752 - RNA, 11 nt, Staphylococcus aureus subsp. aureus Mu50
agcauuauuau

SEQ ID NO: 2053753 - RNA, 18 nt, Staphylococcus aureus subsp. aureus Mu50
agcauuagcaaauauuau

SEQ ID NO: 2053754 - RNA, 22 nt, Staphylococcus aureus subsp. aureus Mu50
agcauuagcaaauauuauuaaa

SEQ ID NO: 2053755 - RNA, 14 nt, Staphylococcus aureus subsp. aureus Mu50
agccacagcgaccu

SEQ ID NO: 2053756 - RNA, 22 nt, Staphylococcus aureus subsp. aureus Mu50
agccaaaucuuuaauaaccuuu

SEQ ID NO: 2053757 - RNA, 18 nt, Staphylococcus aureus subsp. aureus Mu50
acuuguaauauaacaagu

SEQ ID NO: 2053758 - RNA, 16 nt, Staphylococcus aureus subsp. aureus Mu50
acuuguaaucauacca

SEQ ID NO: 2053759 - RNA, 19 nt, Staphylococcus aureus subsp. aureus Mu50
acuuggauucaaaugacau

SEQ ID NO: 2053760 - RNA, 14 nt, Staphylococcus aureus subsp. aureus Mu50
acuuggccuaaguu

SEQ ID NO: 2053761 - RNA, 21 nt, Staphylococcus aureus subsp. aureus Mu50
acuuggcuuaggaugaaaaua

SEQ ID NO: 2053762 - RNA, 13 nt, Staphylococcus aureus subsp. aureus Mu50
acuugggauuuuu

SEQ ID NO: 2053763 - RNA, 14 nt, Staphylococcus aureus subsp. aureus Mu50
acuugcgcaugcuu

SEQ ID NO: 2053764 - RNA, 20 nt, Staphylococcus aureus subsp. aureus Mu50
acuugcuguugcaauaaaau

SEQ ID NO: 2053765 - RNA, 21 nt, Staphylococcus aureus subsp. aureus Mu50
acuugcuguugcaauaaaauc

SEQ ID NO: 2053766 - RNA, 17 nt, Staphylococcus aureus subsp. aureus Mu50
acuuggauucaaaugac

SEQ ID NO: 2053767 - RNA, 18 nt, Staphylococcus aureus subsp. aureus Mu50
acuuggauucaaaugaca

SEQ ID NO: 2053768 - RNA, 22 nt, Staphylococcus aureus subsp. aureus Mu50
acuugcacauuaucguaagcug

SEQ ID NO: 2053769 - RNA, 15 nt, Staphylococcus aureus subsp. aureus Mu50
acuugaugaaacuga

SEQ ID NO: 2053770 - RNA, 16 nt, Staphylococcus aureus subsp. aureus Mu50
acuugaugaaacugau

SEQ ID NO: 2053771 - RNA, 15 nt, Staphylococcus aureus subsp. aureus Mu50
acuucuuuuuuguau

SEQ ID NO: 2053772 - RNA, 18 nt, Staphylococcus aureus subsp. aureus Mu50
acuugaauaccuuuuauu

SEQ ID NO: 2053773 - RNA, 16 nt, Staphylococcus aureus subsp. aureus Mu50
acuugaauuuaauaag

SEQ ID NO: 2053774 - RNA, 17 nt, Staphylococcus aureus subsp. aureus Mu50
acuugaccacuuuuguu

SEQ ID NO: 2053775 - RNA, 16 nt, Staphylococcus aureus subsp. aureus Mu50
acuugauaaaacuaau

SEQ ID NO: 2053776 - RNA, 20 nt, Staphylococcus aureus subsp. aureus Mu50
acuugauaaaacuaaugaua

SEQ ID NO: 2053777 - RNA, 15 nt, Staphylococcus aureus subsp. aureus Mu50
acuucugauucuuca

SEQ ID NO: 2053778 - RNA, 16 nt, Staphylococcus aureus subsp. aureus Mu50
acuucugauucuucac

SEQ ID NO: 2053779 - RNA, 23 nt, Staphylococcus aureus subsp. aureus Mu50
acuucucucuuauuaaaaaagaa

SEQ ID NO: 2053780 - RNA, 17 nt, Staphylococcus aureus subsp. aureus Mu50
acuucuucuucagacca

SEQ ID NO: 2053781 - RNA, 16 nt, Staphylococcus aureus subsp. aureus Mu50
acuucuuuuguuuuac

SEQ ID NO: 2053782 - RNA, 14 nt, Staphylococcus aureus subsp. aureus Mu50
acuucuuuugcaaa

SEQ ID NO: 2053783 - RNA, 21 nt, Staphylococcus aureus subsp. aureus Mu50
acuucuuuugcaaaacgcauu

SEQ ID NO: 2053784 - RNA, 16 nt, Staphylococcus aureus subsp. aureus Mu50
acuucuuuauauuuau

SEQ ID NO: 2053785 - RNA, 14 nt, Staphylococcus aureus subsp. aureus Mu50
acuuccaacauaua

SEQ ID NO: 2053786 - RNA, 14 nt, Staphylococcus aureus subsp. aureus Mu50
acuuccaucaaucc

SEQ ID NO: 2053787 - RNA, 22 nt, Staphylococcus aureus subsp. aureus Mu50
acuucuauuuuauaauaaauuu

SEQ ID NO: 2053788 - RNA, 17 nt, Staphylococcus aureus subsp. aureus Mu50
acuucucaauuuaguau

SEQ ID NO: 2053789 - RNA, 15 nt, Staphylococcus aureus subsp. aureus Mu50
acuucuaauaguaau

SEQ ID NO: 2053790 - RNA, 15 nt, Staphylococcus aureus subsp. aureus Mu50
acuucuaauuugcaa

SEQ ID NO: 2053791 - RNA, 16 nt, Staphylococcus aureus subsp. aureus Mu50
acuucuaauuugcaaa

SEQ ID NO: 2053792 - RNA, 18 nt, Staphylococcus aureus subsp. aureus Mu50
acuguaguggaagacaau

SEQ ID NO: 2053793 - RNA, 12 nt, Staphylococcus aureus subsp. aureus Mu50
acuguauaccuc

SEQ ID NO: 2053794 - RNA, 23 nt, Staphylococcus aureus subsp. aureus Mu50
acuguauaaauaaccgcacuuuc

SEQ ID NO: 2053795 - RNA, 19 nt, Staphylococcus aureus subsp. aureus Mu50
acuguauaaggauguacua

SEQ ID NO: 2053796 - RNA, 20 nt, Staphylococcus aureus subsp. aureus Mu50
acuguaugccgccuaauaau

SEQ ID NO: 2053797 - RNA, 22 nt, Staphylococcus aureus subsp. aureus Mu50
acuguauuuuaacgucauuuuu

SEQ ID NO: 2053798 - RNA, 22 nt, Staphylococcus aureus subsp. aureus Mu50
acuguauagcuggcuuuuuaau

SEQ ID NO: 2053799 - RNA, 13 nt, Staphylococcus aureus subsp. aureus Mu50
acuguaaaucauc

SEQ ID NO: 2053800 - RNA, 12 nt, Staphylococcus aureus subsp. aureus Mu50
acuguaaaucau

SEQ ID NO: 2053801 - RNA, 19 nt, Staphylococcus aureus subsp. aureus Mu50
acugugauauuaauugaaa

SEQ ID NO: 2053802 - RNA, 22 nt, Staphylococcus aureus subsp. aureus Mu50
acugugauauuaauugaaaaac

SEQ ID NO: 2053803 - RNA, 17 nt, Staphylococcus aureus subsp. aureus Mu50
acuuaaugcuucaaaug

SEQ ID NO: 2053804 - RNA, 13 nt, Staphylococcus aureus subsp. aureus Mu50
acuuaauuaaaaa

SEQ ID NO: 2053805 - RNA, 22 nt, Staphylococcus aureus subsp. aureus Mu50
acuuaauuaauaauuuaacuaa

SEQ ID NO: 2053806 - RNA, 21 nt, Staphylococcus aureus subsp. aureus Mu50
acuguuucacguaaugaauca

SEQ ID NO: 2053807 - RNA, 16 nt, Staphylococcus aureus subsp. aureus Mu50
acuguuggaauaccuu

SEQ ID NO: 2053808 - RNA, 13 nt, Staphylococcus aureus subsp. aureus Mu50
acuucaucuaaau

SEQ ID NO: 2053809 - RNA, 13 nt, Staphylococcus aureus subsp. aureus Mu50
acuucauaaguca

SEQ ID NO: 2053810 - RNA, 17 nt, Staphylococcus aureus subsp. aureus Mu50
acuucauaagucacagu

SEQ ID NO: 2053811 - RNA, 19 nt, Staphylococcus aureus subsp. aureus Mu50
acuucaucuguaucaauca

SEQ ID NO: 2053812 - RNA, 19 nt, Staphylococcus aureus subsp. aureus Mu50
acuucaacgucaucugcuu

SEQ ID NO: 2053813 - RNA, 14 nt, Staphylococcus aureus subsp. aureus Mu50
acuucaaacaaagg

SEQ ID NO: 2053814 - RNA, 16 nt, Staphylococcus aureus subsp. aureus Mu50
acuuauuuuucaucau

SEQ ID NO: 2053815 - RNA, 18 nt, Staphylococcus aureus subsp. aureus Mu50
acuuauuugccauauaca

SEQ ID NO: 2053816 - RNA, 20 nt, Staphylococcus aureus subsp. aureus Mu50
acuuauuugccauauacaca

SEQ ID NO: 2053817 - RNA, 13 nt, Staphylococcus aureus subsp. aureus Mu50
acuuacuuuucua

SEQ ID NO: 2053818 - RNA, 22 nt, Staphylococcus aureus subsp. aureus Mu50
acuuacuuuucuaaacaacuuc

SEQ ID NO: 2053819 - RNA, 15 nt, Staphylococcus aureus subsp. aureus Mu50
acuuauuauuuugua

SEQ ID NO: 2053820 - RNA, 19 nt, Staphylococcus aureus subsp. aureus Mu50
acuuauugacgaguagauu

SEQ ID NO: 2053821 - RNA, 12 nt, Staphylococcus aureus subsp. aureus Mu50
acuuauucuuca

SEQ ID NO: 2053822 - RNA, 15 nt, Staphylococcus aureus subsp. aureus Mu50
acuuauuaauuaaua

SEQ ID NO: 2053823 - RNA, 18 nt, Staphylococcus aureus subsp. aureus Mu50
acuuauuaauuaauagag

SEQ ID NO: 2053824 - RNA, 21 nt, Staphylococcus aureus subsp. aureus Mu50
acuuauuaauuaauagagaca

SEQ ID NO: 2053825 - RNA, 13 nt, Staphylococcus aureus subsp. aureus Mu50
acuuacaagucua

SEQ ID NO: 2053826 - RNA, 13 nt, Staphylococcus aureus subsp. aureus Mu50
acuuacaaauaua

SEQ ID NO: 2053827 - RNA, 18 nt, Staphylococcus aureus subsp. aureus Mu50
acuuacaaauauugugga

SEQ ID NO: 2053828 - RNA, 23 nt, Staphylococcus aureus subsp. aureus Mu50
acuuaccaugaugagauaaaauc

SEQ ID NO: 2053829 - RNA, 13 nt, Staphylococcus aureus subsp. aureus Mu50
acuuacauuacau

SEQ ID NO: 2053830 - RNA, 17 nt, Staphylococcus aureus subsp. aureus Mu50
acuuacauuacauauau

SEQ ID NO: 2053831 - RNA, 23 nt, Staphylococcus aureus subsp. aureus Mu50
acuuacauuuuaauaaaaucauc

SEQ ID NO: 2053832 - RNA, 18 nt, Staphylococcus aureus subsp. aureus Mu50
acuuacugugaaaauacc

SEQ ID NO: 2053833 - RNA, 15 nt, Staphylococcus aureus subsp. aureus Mu50
acuuaccuaauagga

SEQ ID NO: 2053834 - RNA, 15 nt, Staphylococcus aureus subsp. aureus Mu50
acuuucgcuugcaaa

SEQ ID NO: 2053835 - RNA, 14 nt, Staphylococcus aureus subsp. aureus Mu50
acuuucuaauuguu

SEQ ID NO: 2053836 - RNA, 18 nt, Staphylococcus aureus subsp. aureus Mu50
acuuuccgccuucaaucc

SEQ ID NO: 2053837 - RNA, 18 nt, Staphylococcus aureus subsp. aureus Mu50
acuuucuuuuguuuuuau

SEQ ID NO: 2053838 - RNA, 23 nt, Staphylococcus aureus subsp. aureus Mu50
acuuugaauugguugaucaauua

SEQ ID NO: 2053839 - RNA, 17 nt, Staphylococcus aureus subsp. aureus Mu50
acuuugauauguuuccu

SEQ ID NO: 2053840 - RNA, 14 nt, Staphylococcus aureus subsp. aureus Mu50
acuuugauauguuu

SEQ ID NO: 2053841 - RNA, 19 nt, Staphylococcus aureus subsp. aureus Mu50
acuuuggaaauuuauuaua

SEQ ID NO: 2053842 - RNA, 17 nt, Staphylococcus aureus subsp. aureus Mu50
acuuuggucaacuuuuu

SEQ ID NO: 2053843 - RNA, 19 nt, Staphylococcus aureus subsp. aureus Mu50
acuuuguucugcuuuuucu

SEQ ID NO: 2053844 - RNA, 21 nt, Staphylococcus aureus subsp. aureus Mu50
acuuuguucugcuuuuucuuu

SEQ ID NO: 2053845 - RNA, 19 nt, Staphylococcus aureus subsp. aureus Mu50
acuuugucuuuaaugaaag

SEQ ID NO: 2053846 - RNA, 15 nt, Staphylococcus aureus subsp. aureus Mu50
acuuuuagaguuuuu

SEQ ID NO: 2053847 - RNA, 22 nt, Staphylococcus aureus subsp. aureus Mu50
acuuuuagaguuuuuauuauua

SEQ ID NO: 2053848 - RNA, 17 nt, Staphylococcus aureus subsp. aureus Mu50
acuuuuauaaucuuuua

SEQ ID NO: 2053849 - RNA, 13 nt, Staphylococcus aureus subsp. aureus Mu50
acuuuuagauuau

SEQ ID NO: 2053850 - RNA, 18 nt, Staphylococcus aureus subsp. aureus Mu50
acuuuacgauaaauagug

SEQ ID NO: 2053851 - RNA, 13 nt, Staphylococcus aureus subsp. aureus Mu50
acuuuaguauauu

SEQ ID NO: 2053852 - RNA, 16 nt, Staphylococcus aureus subsp. aureus Mu50
acuuucacuuuuuaua

SEQ ID NO: 2053853 - RNA, 23 nt, Staphylococcus aureus subsp. aureus Mu50
acuuucaaacaaaucuuuuaaau

SEQ ID NO: 2053854 - RNA, 16 nt, Staphylococcus aureus subsp. aureus Mu50
acuuuacccucuuuag

SEQ ID NO: 2053855 - RNA, 13 nt, Staphylococcus aureus subsp. aureus Mu50
acuuuaccaucuu

SEQ ID NO: 2053856 - RNA, 15 nt, Staphylococcus aureus subsp. aureus Mu50
acuuuaauuuuucau

SEQ ID NO: 2053857 - RNA, 20 nt, Staphylococcus aureus subsp. aureus Mu50
acuuuaccaauaucaugcaa

SEQ ID NO: 2053858 - RNA, 23 nt, Staphylococcus aureus subsp. aureus Mu50
acuuuaauaucagguacaaaugg

SEQ ID NO: 2053859 - RNA, 22 nt, Staphylococcus aureus subsp. aureus Mu50
acuuuaauacuaccguuuuuau

SEQ ID NO: 2053860 - RNA, 22 nt, Staphylococcus aureus subsp. aureus Mu50
acuuuaaaguuaaaguuuuguu

SEQ ID NO: 2053861 - RNA, 16 nt, Staphylococcus aureus subsp. aureus Mu50
acuuguuuguuuuugu

SEQ ID NO: 2053862 - RNA, 22 nt, Staphylococcus aureus subsp. aureus Mu50
acuuuaaaauuguauagaaugu

SEQ ID NO: 2053863 - RNA, 15 nt, Staphylococcus aureus subsp. aureus Mu50
acuuuaaaauuguau

SEQ ID NO: 2053864 - RNA, 18 nt, Staphylococcus aureus subsp. aureus Mu50
acuugucguauucuucaa

SEQ ID NO: 2053865 - RNA, 19 nt, Staphylococcus aureus subsp. aureus Mu50
acuuguucaacaacugcga

SEQ ID NO: 2053866 - RNA, 22 nt, Staphylococcus aureus subsp. aureus Mu50
acuuguucaauacuucuuguuc

SEQ ID NO: 2053867 - RNA, 20 nt, Staphylococcus aureus subsp. aureus Mu50
agaaauacucaguuuauuga

SEQ ID NO: 2053868 - RNA, 12 nt, Staphylococcus aureus subsp. aureus Mu50
agaaaucaccag

SEQ ID NO: 2053869 - RNA, 16 nt, Staphylococcus aureus subsp. aureus Mu50
agaaaucaccagauuu

SEQ ID NO: 2053870 - RNA, 16 nt, Staphylococcus aureus subsp. aureus Mu50
agaaacuuccaacaua

SEQ ID NO: 2053871 - RNA, 16 nt, Staphylococcus aureus subsp. aureus Mu50
agaaacacaaggaaua

SEQ ID NO: 2053872 - RNA, 23 nt, Staphylococcus aureus subsp. aureus Mu50
agaaaaggcucauuuguuaaauu

SEQ ID NO: 2053873 - RNA, 17 nt, Staphylococcus aureus subsp. aureus Mu50
agaaaagggcaaaaaag

SEQ ID NO: 2053874 - RNA, 18 nt, Staphylococcus aureus subsp. aureus Mu50
agaaaaggauuauaggua

SEQ ID NO: 2053875 - RNA, 21 nt, Staphylococcus aureus subsp. aureus Mu50
agaaaagcagucgaacaauga

SEQ ID NO: 2053876 - RNA, 16 nt, Staphylococcus aureus subsp. aureus Mu50
agaaaacuauuuuaaa

SEQ ID NO: 2053877 - RNA, 17 nt, Staphylococcus aureus subsp. aureus Mu50
agaaaacuauuuuaaaa

SEQ ID NO: 2053878 - RNA, 16 nt, Staphylococcus aureus subsp. aureus Mu50
agaaaacauaaauaca

SEQ ID NO: 2053879 - RNA, 17 nt, Staphylococcus aureus subsp. aureus Mu50
agaaaacauaaauacaa

SEQ ID NO: 2053880 - RNA, 18 nt, Staphylococcus aureus subsp. aureus Mu50
agaaaacauaaauacaaa

SEQ ID NO: 2053881 - RNA, 15 nt, Staphylococcus aureus subsp. aureus Mu50
acuuuuauugccaua

SEQ ID NO: 2053882 - RNA, 15 nt, Staphylococcus aureus subsp. aureus Mu50
acuuuuauuuuuuau

SEQ ID NO: 2053883 - RNA, 16 nt, Staphylococcus aureus subsp. aureus Mu50
agagcacgagaaaugu

SEQ ID NO: 2053884 - RNA, 20 nt, Staphylococcus aureus subsp. aureus Mu50
agagcucaaccucuuaguuc

SEQ ID NO: 2053885 - RNA, 19 nt, Staphylococcus aureus subsp. aureus Mu50
agauaaaucgauaaaaugu

SEQ ID NO: 2053886 - RNA, 18 nt, Staphylococcus aureus subsp. aureus Mu50
agauaaagcuucgucaau

SEQ ID NO: 2053887 - RNA, 17 nt, Staphylococcus aureus subsp. aureus Mu50
agauaaauuaauaugaa

SEQ ID NO: 2053888 - RNA, 20 nt, Staphylococcus aureus subsp. aureus Mu50
agauaacuagaaugauuaaa

SEQ ID NO: 2053889 - RNA, 19 nt, Staphylococcus aureus subsp. aureus Mu50
agagaaauucgaaaagaaa

SEQ ID NO: 2053890 - RNA, 20 nt, Staphylococcus aureus subsp. aureus Mu50
agagaaauucgaaaagaaau

SEQ ID NO: 2053891 - RNA, 21 nt, Staphylococcus aureus subsp. aureus Mu50
agagaaauucgaaaagaaauu

SEQ ID NO: 2053892 - RNA, 17 nt, Staphylococcus aureus subsp. aureus Mu50
agagaaauucgaaaaga

SEQ ID NO: 2053893 - RNA, 20 nt, Staphylococcus aureus subsp. aureus Mu50
agagaacgcuuuauuacuuu

SEQ ID NO: 2053894 - RNA, 20 nt, Staphylococcus aureus subsp. aureus Mu50
agagaaguuucuauagaauu

SEQ ID NO: 2053895 - RNA, 19 nt, Staphylococcus aureus subsp. aureus Mu50
agagaauauagauuuugua

SEQ ID NO: 2053896 - RNA, 21 nt, Staphylococcus aureus subsp. aureus Mu50
agagaauuucgaaaagaaauu

SEQ ID NO: 2053897 - RNA, 19 nt, Staphylococcus aureus subsp. aureus Mu50
agagaauuucgaaaagaaa

SEQ ID NO: 2053898 - RNA, 17 nt, Staphylococcus aureus subsp. aureus Mu50
agagaauuucgaaaaga

SEQ ID NO: 2053899 - RNA, 18 nt, Staphylococcus aureus subsp. aureus Mu50
agagaauuucgaaaagaa

SEQ ID NO: 2053900 - RNA, 23 nt, Staphylococcus aureus subsp. aureus Mu50
agagaauuuuaauuaauuaucau

SEQ ID NO: 2053901 - RNA, 16 nt, Staphylococcus aureus subsp. aureus Mu50
agagaaacaaaacaaa

SEQ ID NO: 2053902 - RNA, 23 nt, Staphylococcus aureus subsp. aureus Mu50
agagaaagaauaaauguuaaaga

SEQ ID NO: 2053903 - RNA, 11 nt, Staphylococcus aureus subsp. aureus Mu50
agagaaauucg

SEQ ID NO: 2053904 - RNA, 16 nt, Staphylococcus aureus subsp. aureus Mu50
agacuucuuucaauua

SEQ ID NO: 2053905 - RNA, 22 nt, Staphylococcus aureus subsp. aureus Mu50
agacuugguuacuuaguaagga

SEQ ID NO: 2053906 - RNA, 24 nt, Staphylococcus aureus subsp. aureus Mu50
agacuugguuacuuaguaaggaau

SEQ ID NO: 2053907 - RNA, 11 nt, Staphylococcus aureus subsp. aureus Mu50
agacuuucuug

SEQ ID NO: 2053908 - RNA, 13 nt, Staphylococcus aureus subsp. aureus Mu50
agacucacuucuu

SEQ ID NO: 2053909 - RNA, 14 nt, Staphylococcus aureus subsp. aureus Mu50
agacucacuucuua

SEQ ID NO: 2053910 - RNA, 15 nt, Staphylococcus aureus subsp. aureus Mu50
agacaugagauuauu

SEQ ID NO: 2053911 - RNA, 14 nt, Staphylococcus aureus subsp. aureus Mu50
agacauuacauuua

SEQ ID NO: 2053912 - RNA, 12 nt, Staphylococcus aureus subsp. aureus Mu50
agacauuaaaaa

SEQ ID NO: 2053913 - RNA, 22 nt, Staphylococcus aureus subsp. aureus Mu50
agaccuucuucucuaaucacuu

SEQ ID NO: 2053914 - RNA, 11 nt, Staphylococcus aureus subsp. aureus Mu50
agacauccaug

SEQ ID NO: 2053915 - RNA, 20 nt, Staphylococcus aureus subsp. aureus Mu50
agacaauguucuuuucaaca

SEQ ID NO: 2053916 - RNA, 15 nt, Staphylococcus aureus subsp. aureus Mu50
agaauuaacaacaaa

SEQ ID NO: 2053917 - RNA, 20 nt, Staphylococcus aureus subsp. aureus Mu50
agaauuaacaacaaauauaa

SEQ ID NO: 2053918 - RNA, 23 nt, Staphylococcus aureus subsp. aureus Mu50
agaauuaauaauuuuuuuccuuu

SEQ ID NO: 2053919 - RNA, 18 nt, Staphylococcus aureus subsp. aureus Mu50
agaauuauucaaguaaua

SEQ ID NO: 2053920 - RNA, 23 nt, Staphylococcus aureus subsp. aureus Mu50
agaaauucuacagguaaugcaag

SEQ ID NO: 2053921 - RNA, 17 nt, Staphylococcus aureus subsp. aureus Mu50
agaaauucuacaaacaa

SEQ ID NO: 2053922 - RNA, 21 nt, Staphylococcus aureus subsp. aureus Mu50
agaaaugacgauaccuuuaau

SEQ ID NO: 2053923 - RNA, 16 nt, Staphylococcus aureus subsp. aureus Mu50
agaaauucgaaaagaa

SEQ ID NO: 2053924 - RNA, 16 nt, Staphylococcus aureus subsp. aureus Mu50
agaaaugucaguuuug

SEQ ID NO: 2053925 - RNA, 21 nt, Staphylococcus aureus subsp. aureus Mu50
agaaauuaccguuuauuucgu

SEQ ID NO: 2053926 - RNA, 19 nt, Staphylococcus aureus subsp. aureus Mu50
agaaugacaccuaauacca

SEQ ID NO: 2053927 - RNA, 17 nt, Staphylococcus aureus subsp. aureus Mu50
agaaugcgauuuccuuu

SEQ ID NO: 2053928 - RNA, 18 nt, Staphylococcus aureus subsp. aureus Mu50
agaaugcaccaacaauag

SEQ ID NO: 2053929 - RNA, 16 nt, Staphylococcus aureus subsp. aureus Mu50
agaaugccauaccugc

SEQ ID NO: 2053930 - RNA, 13 nt, Staphylococcus aureus subsp. aureus Mu50
agaaguuucuaua

SEQ ID NO: 2053931 - RNA, 19 nt, Staphylococcus aureus subsp. aureus Mu50
agaaguuguuuagaaaagu

SEQ ID NO: 2053932 - RNA, 14 nt, Staphylococcus aureus subsp. aureus Mu50
agaauaaacuuuau

SEQ ID NO: 2053933 - RNA, 16 nt, Staphylococcus aureus subsp. aureus Mu50
agaauaaacaacauac

SEQ ID NO: 2053934 - RNA, 12 nt, Staphylococcus aureus subsp. aureus Mu50
agaauaaaaggc

SEQ ID NO: 2053935 - RNA, 13 nt, Staphylococcus aureus subsp. aureus Mu50
agaauauauguau

SEQ ID NO: 2053936 - RNA, 21 nt, Staphylococcus aureus subsp. aureus Mu50
agaauauauguauaacauuau

SEQ ID NO: 2053937 - RNA, 18 nt, Staphylococcus aureus subsp. aureus Mu50
agaauaguuaccaaaauu

SEQ ID NO: 2053938 - RNA, 16 nt, Staphylococcus aureus subsp. aureus Mu50
acggcugcuuuaacug

SEQ ID NO: 2053939 - RNA, 14 nt, Staphylococcus aureus subsp. aureus Mu50
acggcugcuuuaac

SEQ ID NO: 2053940 - RNA, 18 nt, Staphylococcus aureus subsp. aureus Mu50
acgcuuuauucuucccaa

SEQ ID NO: 2053941 - RNA, 15 nt, Staphylococcus aureus subsp. aureus Mu50
acgcuucaauuauuu

SEQ ID NO: 2053942 - RNA, 22 nt, Staphylococcus aureus subsp. aureus Mu50
acgcugaaauuuuuuagugaaa

SEQ ID NO: 2053943 - RNA, 16 nt, Staphylococcus aureus subsp. aureus Mu50
acgcuaaacaaagggg

SEQ ID NO: 2053944 - RNA, 17 nt, Staphylococcus aureus subsp. aureus Mu50
acgcgugaauuaaaaaa

SEQ ID NO: 2053945 - RNA, 17 nt, Staphylococcus aureus subsp. aureus Mu50
acgcucaacuauauaua

SEQ ID NO: 2053946 - RNA, 23 nt, Staphylococcus aureus subsp. aureus Mu50
acgcauuacuuuagaaagugauu

SEQ ID NO: 2053947 - RNA, 14 nt, Staphylococcus aureus subsp. aureus Mu50
acgcaguugaaaaa

SEQ ID NO: 2053948 - RNA, 19 nt, Staphylococcus aureus subsp. aureus Mu50
acgcacuaucaaugacauc

SEQ ID NO: 2053949 - RNA, 14 nt, Staphylococcus aureus subsp. aureus Mu50
acgcacuauuuuua

SEQ ID NO: 2053950 - RNA, 13 nt, Staphylococcus aureus subsp. aureus Mu50
acgccuuuccauu

SEQ ID NO: 2053951 - RNA, 18 nt, Staphylococcus aureus subsp. aureus Mu50
acugaaugcuaauacuaa

SEQ ID NO: 2053952 - RNA, 13 nt, Staphylococcus aureus subsp. aureus Mu50
acugaaauuuuuc

SEQ ID NO: 2053953 - RNA, 22 nt, Staphylococcus aureus subsp. aureus Mu50
acugacacuuuaaccacuccuu

SEQ ID NO: 2053954 - RNA, 15 nt, Staphylococcus aureus subsp. aureus Mu50
acugaauuuuaacua

SEQ ID NO: 2053955 - RNA, 15 nt, Staphylococcus aureus subsp. aureus Mu50
acucuucguuuuaau

SEQ ID NO: 2053956 - RNA, 20 nt, Staphylococcus aureus subsp. aureus Mu50
acucccgcauuauuauuaaa

SEQ ID NO: 2053957 - RNA, 24 nt, Staphylococcus aureus subsp. aureus Mu50
acucguaaauuuuaucuaaacauu

SEQ ID NO: 2053958 - RNA, 15 nt, Staphylococcus aureus subsp. aureus Mu50
acucguaaauuuuau

SEQ ID NO: 2053959 - RNA, 19 nt, Staphylococcus aureus subsp. aureus Mu50
acucguaaauuuuaucuaa

SEQ ID NO: 2053960 - RNA, 17 nt, Staphylococcus aureus subsp. aureus Mu50
acucggggaauuuuuau

SEQ ID NO: 2053961 - RNA, 23 nt, Staphylococcus aureus subsp. aureus Mu50
acucguuauagauaaguagugga

SEQ ID NO: 2053962 - RNA, 16 nt, Staphylococcus aureus subsp. aureus Mu50
acucguugcacucuuu

SEQ ID NO: 2053963 - RNA, 13 nt, Staphylococcus aureus subsp. aureus Mu50
acucguuuuucca

SEQ ID NO: 2053964 - RNA, 15 nt, Staphylococcus aureus subsp. aureus Mu50
acucguuuuuccaug

SEQ ID NO: 2053965 - RNA, 15 nt, Staphylococcus aureus subsp. aureus Mu50
acucuaaaaguugua

SEQ ID NO: 2053966 - RNA, 21 nt, Staphylococcus aureus subsp. aureus Mu50
acucuaaaaguuguaauuuaa

SEQ ID NO: 2053967 - RNA, 20 nt, Staphylococcus aureus subsp. aureus Mu50
acucacauucugcccugcaa

SEQ ID NO: 2053968 - RNA, 22 nt, Staphylococcus aureus subsp. aureus Mu50
acucacauucugcccugcaaug

SEQ ID NO: 2053969 - RNA, 14 nt, Staphylococcus aureus subsp. aureus Mu50
acuaucuuuugcuu

SEQ ID NO: 2053970 - RNA, 17 nt, Staphylococcus aureus subsp. aureus Mu50
acuaucuacaauaacca

SEQ ID NO: 2053971 - RNA, 15 nt, Staphylococcus aureus subsp. aureus Mu50
acuaucuucaucaua

SEQ ID NO: 2053972 - RNA, 14 nt, Staphylococcus aureus subsp. aureus Mu50
acuaucuauaauac

SEQ ID NO: 2053973 - RNA, 16 nt, Staphylococcus aureus subsp. aureus Mu50
acucaauucucuaacu

SEQ ID NO: 2053974 - RNA, 21 nt, Staphylococcus aureus subsp. aureus Mu50
acuaugcaaaugaaauucuuu

SEQ ID NO: 2053975 - RNA, 15 nt, Staphylococcus aureus subsp. aureus Mu50
acucaauuucauuug

SEQ ID NO: 2053976 - RNA, 18 nt, Staphylococcus aureus subsp. aureus Mu50
acucaauuucauuugaaa

SEQ ID NO: 2053977 - RNA, 18 nt, Staphylococcus aureus subsp. aureus Mu50
acucagaaucuuacauug

SEQ ID NO: 2053978 - RNA, 12 nt, Staphylococcus aureus subsp. aureus Mu50
acucacuucuua

SEQ ID NO: 2053979 - RNA, 13 nt, Staphylococcus aureus subsp. aureus Mu50
acucacuucaacg

SEQ ID NO: 2053980 - RNA, 21 nt, Staphylococcus aureus subsp. aureus Mu50
acucauacaaauuuuuuuuau

SEQ ID NO: 2053981 - RNA, 15 nt, Staphylococcus aureus subsp. aureus Mu50
acucaguuauauuaa

SEQ ID NO: 2053982 - RNA, 17 nt, Staphylococcus aureus subsp. aureus Mu50
acuccaguuuauaacug

SEQ ID NO: 2053983 - RNA, 21 nt, Staphylococcus aureus subsp. aureus Mu50
acucauccauugaucuuuuau

SEQ ID NO: 2053984 - RNA, 21 nt, Staphylococcus aureus subsp. aureus Mu50
acucauaccaaaaacauuaac

SEQ ID NO: 2053985 - RNA, 14 nt, Staphylococcus aureus subsp. aureus Mu50
acucauaaucaagu

SEQ ID NO: 2053986 - RNA, 15 nt, Staphylococcus aureus subsp. aureus Mu50
acucauaccaaaaac

SEQ ID NO: 2053987 - RNA, 21 nt, Staphylococcus aureus subsp. aureus Mu50
acucaucuguccgauaucuuu

SEQ ID NO: 2053988 - RNA, 13 nt, Staphylococcus aureus subsp. aureus Mu50
acucauuauaaau

SEQ ID NO: 2053989 - RNA, 12 nt, Staphylococcus aureus subsp. aureus Mu50
acucauuuucug

SEQ ID NO: 2053990 - RNA, 22 nt, Staphylococcus aureus subsp. aureus Mu50
acuaaaugaauugcuuguucuu

SEQ ID NO: 2053991 - RNA, 16 nt, Staphylococcus aureus subsp. aureus Mu50
acuaaaugaauugcuu

SEQ ID NO: 2053992 - RNA, 20 nt, Staphylococcus aureus subsp. aureus Mu50
acuaacauguuauugcuuau

SEQ ID NO: 2053993 - RNA, 14 nt, Staphylococcus aureus subsp. aureus Mu50
acuaagauauauug

SEQ ID NO: 2053994 - RNA, 21 nt, Staphylococcus aureus subsp. aureus Mu50
acuaagauaucuggauuaacu

SEQ ID NO: 2053995 - RNA, 19 nt, Staphylococcus aureus subsp. aureus Mu50
acuaaguaaccaagucuaa

SEQ ID NO: 2053996 - RNA, 19 nt, Staphylococcus aureus subsp. aureus Mu50
acuaagcuuucauuaauuu

SEQ ID NO: 2053997 - RNA, 22 nt, Staphylococcus aureus subsp. aureus Mu50
acuaagcuuucauuaauuuuuc

SEQ ID NO: 2053998 - RNA, 15 nt, Staphylococcus aureus subsp. aureus Mu50
acuaacugaagacac

SEQ ID NO: 2053999 - RNA, 20 nt, Staphylococcus aureus subsp. aureus Mu50
acuaaucguuccaacaacua

SEQ ID NO: 2054000 - RNA, 16 nt, Staphylococcus aureus subsp. aureus Mu50
acuaaucaaagaaaaa

SEQ ID NO: 2054001 - RNA, 21 nt, Staphylococcus aureus subsp. aureus Mu50
acuaauauuucuuagauacuc

SEQ ID NO: 2054002 - RNA, 23 nt, Staphylococcus aureus subsp. aureus Mu50
acuaaucaacuuuuuguuaauuu

SEQ ID NO: 2054003 - RNA, 17 nt, Staphylococcus aureus subsp. aureus Mu50
acuaauaugauugguuu

SEQ ID NO: 2054004 - RNA, 19 nt, Staphylococcus aureus subsp. aureus Mu50
acuaaguuauuuaguacau

SEQ ID NO: 2054005 - RNA, 20 nt, Staphylococcus aureus subsp. aureus Mu50
acuaaguuauuuaguacaua

SEQ ID NO: 2054006 - RNA, 14 nt, Staphylococcus aureus subsp. aureus Mu50
acuaauaauugucc

SEQ ID NO: 2054007 - RNA, 19 nt, Staphylococcus aureus subsp. aureus Mu50
acuaauauauuaauuuuac

SEQ ID NO: 2054008 - RNA, 19 nt, Staphylococcus aureus subsp. aureus Mu50
acuagcuaaugcacgugag

SEQ ID NO: 2054009 - RNA, 23 nt, Staphylococcus aureus subsp. aureus Mu50
acuaggaauauaaaacugugcau

SEQ ID NO: 2054010 - RNA, 14 nt, Staphylococcus aureus subsp. aureus Mu50
acuagggguuuuua

SEQ ID NO: 2054011 - RNA, 16 nt, Staphylococcus aureus subsp. aureus Mu50
acuagggguuuuuaau

SEQ ID NO: 2054012 - RNA, 14 nt, Staphylococcus aureus subsp. aureus Mu50
acuaguaauagaau

SEQ ID NO: 2054013 - RNA, 22 nt, Staphylococcus aureus subsp. aureus Mu50
acuaguaauagaauagucaauu

SEQ ID NO: 2054014 - RNA, 18 nt, Staphylococcus aureus subsp. aureus Mu50
acuaguacgaaaugcaau

SEQ ID NO: 2054015 - RNA, 14 nt, Staphylococcus aureus subsp. aureus Mu50
acuaucguuuuuau

SEQ ID NO: 2054016 - RNA, 22 nt, Staphylococcus aureus subsp. aureus Mu50
acuauagccaaaggcaaaaugu

SEQ ID NO: 2054017 - RNA, 15 nt, Staphylococcus aureus subsp. aureus Mu50
acuauagauaggaua

SEQ ID NO: 2054018 - RNA, 14 nt, Staphylococcus aureus subsp. aureus Mu50
acuauacaaucaua

SEQ ID NO: 2054019 - RNA, 16 nt, Staphylococcus aureus subsp. aureus Mu50
acuauaauuucuuaau

SEQ ID NO: 2054020 - RNA, 20 nt, Staphylococcus aureus subsp. aureus Mu50
acuauaaugauguauuuuag

SEQ ID NO: 2054021 - RNA, 12 nt, Staphylococcus aureus subsp. aureus Mu50
acuacaagugga

SEQ ID NO: 2054022 - RNA, 21 nt, Staphylococcus aureus subsp. aureus Mu50
acuacacacguagaaagaugu

SEQ ID NO: 2054023 - RNA, 19 nt, Staphylococcus aureus subsp. aureus Mu50
acuacacacguagaaagau

SEQ ID NO: 2054024 - RNA, 19 nt, Staphylococcus aureus subsp. aureus Mu50
acuacacuccccuuaucaa

SEQ ID NO: 2054025 - RNA, 19 nt, Staphylococcus aureus subsp. aureus Mu50
acuagauaguuuauacuuu

SEQ ID NO: 2054026 - RNA, 21 nt, Staphylococcus aureus subsp. aureus Mu50
acuagcauuagcaaauauuau

SEQ ID NO: 2054027 - RNA, 18 nt, Staphylococcus aureus subsp. aureus Mu50
acgugguugguuaccauc

SEQ ID NO: 2054028 - RNA, 16 nt, Staphylococcus aureus subsp. aureus Mu50
acguguaaauguuaaa

SEQ ID NO: 2054029 - RNA, 19 nt, Staphylococcus aureus subsp. aureus Mu50
acgugauaaugacucaagu

SEQ ID NO: 2054030 - RNA, 13 nt, Staphylococcus aureus subsp. aureus Mu50
acgugaacaacau

SEQ ID NO: 2054031 - RNA, 19 nt, Staphylococcus aureus subsp. aureus Mu50
acgucacuuuauuaaauaa

SEQ ID NO: 2054032 - RNA, 15 nt, Staphylococcus aureus subsp. aureus Mu50
acguaucaaaauuuu

SEQ ID NO: 2054033 - RNA, 19 nt, Staphylococcus aureus subsp. aureus Mu50
acguauauaaguuaaaauu

SEQ ID NO: 2054034 - RNA, 16 nt, Staphylococcus aureus subsp. aureus Mu50
acccuacuauauauca

SEQ ID NO: 2054035 - RNA, 18 nt, Staphylococcus aureus subsp. aureus Mu50
acccuuuaaauuuaacuc

SEQ ID NO: 2054036 - RNA, 16 nt, Staphylococcus aureus subsp. aureus Mu50
accgaauaauuuugau

SEQ ID NO: 2054037 - RNA, 23 nt, Staphylococcus aureus subsp. aureus Mu50
acccauuuuuuuccaagcaucau

SEQ ID NO: 2054038 - RNA, 15 nt, Staphylococcus aureus subsp. aureus Mu50
acccauggauucuga

SEQ ID NO: 2054039 - RNA, 16 nt, Staphylococcus aureus subsp. aureus Mu50
acccauggauucugau

SEQ ID NO: 2054040 - RNA, 16 nt, Staphylococcus aureus subsp. aureus Mu50
acccauauuaaauuuu

SEQ ID NO: 2054041 - RNA, 18 nt, Staphylococcus aureus subsp. aureus Mu50
acccauaauuuaaaugau

SEQ ID NO: 2054042 - RNA, 16 nt, Staphylococcus aureus subsp. aureus Mu50
accauuuuauauuuua

SEQ ID NO: 2054043 - RNA, 13 nt, Staphylococcus aureus subsp. aureus Mu50
accauuuuuuuau

SEQ ID NO: 2054044 - RNA, 14 nt, Staphylococcus aureus subsp. aureus Mu50
accauuaauaguaa

SEQ ID NO: 2054045 - RNA, 15 nt, Staphylococcus aureus subsp. aureus Mu50
accauguuuuuuaag

SEQ ID NO: 2054046 - RNA, 18 nt, Staphylococcus aureus subsp. aureus Mu50
accauggcgauuccaauc

SEQ ID NO: 2054047 - RNA, 21 nt, Staphylococcus aureus subsp. aureus Mu50
accaucaacgccauauuuauu

SEQ ID NO: 2054048 - RNA, 19 nt, Staphylococcus aureus subsp. aureus Mu50
accaucaacgccauauuua

SEQ ID NO: 2054049 - RNA, 18 nt, Staphylococcus aureus subsp. aureus Mu50
accauauuuuuagaaaag

SEQ ID NO: 2054050 - RNA, 22 nt, Staphylococcus aureus subsp. aureus Mu50
accaucuuuaauacgaauuuca

SEQ ID NO: 2054051 - RNA, 14 nt, Staphylococcus aureus subsp. aureus Mu50
accaucucuauuuu

SEQ ID NO: 2054052 - RNA, 21 nt, Staphylococcus aureus subsp. aureus Mu50
accaccuacgcccaucaucac

SEQ ID NO: 2054053 - RNA, 19 nt, Staphylococcus aureus subsp. aureus Mu50
accacuauaauuucuuaau

SEQ ID NO: 2054054 - RNA, 17 nt, Staphylococcus aureus subsp. aureus Mu50
accacuucuucaccugc

SEQ ID NO: 2054055 - RNA, 23 nt, Staphylococcus aureus subsp. aureus Mu50
accacuugaauacuuuuuaacug

SEQ ID NO: 2054056 - RNA, 14 nt, Staphylococcus aureus subsp. aureus Mu50
accagcuaaccaaa

SEQ ID NO: 2054057 - RNA, 18 nt, Staphylococcus aureus subsp. aureus Mu50
accagcuaaccaaauaau

SEQ ID NO: 2054058 - RNA, 17 nt, Staphylococcus aureus subsp. aureus Mu50
accacacuuuaaacaag

SEQ ID NO: 2054059 - RNA, 23 nt, Staphylococcus aureus subsp. aureus Mu50
accacacuuuaaacaagcaucau

SEQ ID NO: 2054060 - RNA, 14 nt, Staphylococcus aureus subsp. aureus Mu50
accacauaaaaaua

SEQ ID NO: 2054061 - RNA, 13 nt, Staphylococcus aureus subsp. aureus Mu50
accaauuagcaug

SEQ ID NO: 2054062 - RNA, 20 nt, Staphylococcus aureus subsp. aureus Mu50
accaaugauagugaauaaug

SEQ ID NO: 2054063 - RNA, 22 nt, Staphylococcus aureus subsp. aureus Mu50
accaacaauugcacuuggugau

SEQ ID NO: 2054064 - RNA, 22 nt, Staphylococcus aureus subsp. aureus Mu50
accaagaccagguccugggaau

SEQ ID NO: 2054065 - RNA, 22 nt, Staphylococcus aureus subsp. aureus Mu50
accaagcccaugcccgauaaaa

SEQ ID NO: 2054066 - RNA, 13 nt, Staphylococcus aureus subsp. aureus Mu50
accaaaauuauau

SEQ ID NO: 2054067 - RNA, 19 nt, Staphylococcus aureus subsp. aureus Mu50
acauuuugccccucauuca

SEQ ID NO: 2054068 - RNA, 23 nt, Staphylococcus aureus subsp. aureus Mu50
acauuuuuauacaacuucacuuc

SEQ ID NO: 2054069 - RNA, 14 nt, Staphylococcus aureus subsp. aureus Mu50
acauuuuuggcuua

SEQ ID NO: 2054070 - RNA, 15 nt, Staphylococcus aureus subsp. aureus Mu50
acauuuuugaauuua

SEQ ID NO: 2054071 - RNA, 12 nt, Staphylococcus aureus subsp. aureus Mu50
accaacaagguu

SEQ ID NO: 2054072 - RNA, 15 nt, Staphylococcus aureus subsp. aureus Mu50
accaacaacuuuguu

SEQ ID NO: 2054073 - RNA, 19 nt, Staphylococcus aureus subsp. aureus Mu50
accaaaucggaauaaaaua

SEQ ID NO: 2054074 - RNA, 17 nt, Staphylococcus aureus subsp. aureus Mu50
accaaaccauaaguaaa

SEQ ID NO: 2054075 - RNA, 22 nt, Staphylococcus aureus subsp. aureus Mu50
acauuucgguaugauauuucua

SEQ ID NO: 2054076 - RNA, 17 nt, Staphylococcus aureus subsp. aureus Mu50
acauuuucaaaaccaau

SEQ ID NO: 2054077 - RNA, 18 nt, Staphylococcus aureus subsp. aureus Mu50
acauuuuaucugaaaaua

SEQ ID NO: 2054078 - RNA, 14 nt, Staphylococcus aureus subsp. aureus Mu50
acauuuuaugucca

SEQ ID NO: 2054079 - RNA, 17 nt, Staphylococcus aureus subsp. aureus Mu50
acauuuuaucugaaaau

SEQ ID NO: 2054080 - RNA, 23 nt, Staphylococcus aureus subsp. aureus Mu50
acauuugguggagaaccaaaaau

SEQ ID NO: 2054081 - RNA, 14 nt, Staphylococcus aureus subsp. aureus Mu50
acauuuuaaaucua

SEQ ID NO: 2054082 - RNA, 18 nt, Staphylococcus aureus subsp. aureus Mu50
acauuuaaaaaaugcgcu

SEQ ID NO: 2054083 - RNA, 22 nt, Staphylococcus aureus subsp. aureus Mu50
acauugugaaaguuuuugucuu

SEQ ID NO: 2054084 - RNA, 15 nt, Staphylococcus aureus subsp. aureus Mu50
acauugguuuuuacu

SEQ ID NO: 2054085 - RNA, 15 nt, Staphylococcus aureus subsp. aureus Mu50
acauuguaaaaugcu

SEQ ID NO: 2054086 - RNA, 21 nt, Staphylococcus aureus subsp. aureus Mu50
acauuguaaauauaguaauaa

SEQ ID NO: 2054087 - RNA, 22 nt, Staphylococcus aureus subsp. aureus Mu50
acauuguaaaaugcucccuuca

SEQ ID NO: 2054088 - RNA, 20 nt, Staphylococcus aureus subsp. aureus Mu50
acauuauguucuucaccagu

SEQ ID NO: 2054089 - RNA, 13 nt, Staphylococcus aureus subsp. aureus Mu50
acauuauuaaaua

SEQ ID NO: 2054090 - RNA, 19 nt, Staphylococcus aureus subsp. aureus Mu50
acauuauuuauauuuagaa

SEQ ID NO: 2054091 - RNA, 21 nt, Staphylococcus aureus subsp. aureus Mu50
acauucaaauaaaugacauuu

SEQ ID NO: 2054092 - RNA, 14 nt, Staphylococcus aureus subsp. aureus Mu50
acauucaaauaaau

SEQ ID NO: 2054093 - RNA, 13 nt, Staphylococcus aureus subsp. aureus Mu50
acauuauugaaau

SEQ ID NO: 2054094 - RNA, 17 nt, Staphylococcus aureus subsp. aureus Mu50
acauucauuuaguuaaa

SEQ ID NO: 2054095 - RNA, 21 nt, Staphylococcus aureus subsp. aureus Mu50
acauucauuuaguuaaauaca

SEQ ID NO: 2054096 - RNA, 22 nt, Staphylococcus aureus subsp. aureus Mu50
acauuccaaaguaccaucucua

SEQ ID NO: 2054097 - RNA, 16 nt, Staphylococcus aureus subsp. aureus Mu50
acauuccucuauugua

SEQ ID NO: 2054098 - RNA, 12 nt, Staphylococcus aureus subsp. aureus Mu50
acauugaauaaa

SEQ ID NO: 2054099 - RNA, 13 nt, Staphylococcus aureus subsp. aureus Mu50
acauugaauaaau

SEQ ID NO: 2054100 - RNA, 21 nt, Staphylococcus aureus subsp. aureus Mu50
acauucugcccugcaaugcaa

SEQ ID NO: 2054101 - RNA, 16 nt, Staphylococcus aureus subsp. aureus Mu50
acauucuucaaaaaau

SEQ ID NO: 2054102 - RNA, 19 nt, Staphylococcus aureus subsp. aureus Mu50
acauucuucaaaaaauaau

SEQ ID NO: 2054103 - RNA, 18 nt, Staphylococcus aureus subsp. aureus Mu50
acauucuugaauaaauuu

SEQ ID NO: 2054104 - RNA, 17 nt, Staphylococcus aureus subsp. aureus Mu50
acauugaugucaauuuc

SEQ ID NO: 2054105 - RNA, 16 nt, Staphylococcus aureus subsp. aureus Mu50
acauugauaaaauaau

SEQ ID NO: 2054106 - RNA, 17 nt, Staphylococcus aureus subsp. aureus Mu50
acauuggauuacuucca

SEQ ID NO: 2054107 - RNA, 14 nt, Staphylococcus aureus subsp. aureus Mu50
acauuaaaacaaua

SEQ ID NO: 2054108 - RNA, 21 nt, Staphylococcus aureus subsp. aureus Mu50
acauuaaaauguguuuucaac

SEQ ID NO: 2054109 - RNA, 12 nt, Staphylococcus aureus subsp. aureus Mu50
acauuaaauauu

SEQ ID NO: 2054110 - RNA, 23 nt, Staphylococcus aureus subsp. aureus Mu50
acauuaaagaaaauaucugaaaa

SEQ ID NO: 2054111 - RNA, 14 nt, Staphylococcus aureus subsp. aureus Mu50
acauuaaguuaaac

SEQ ID NO: 2054112 - RNA, 14 nt, Staphylococcus aureus subsp. aureus Mu50
acauuaaauuauua

SEQ ID NO: 2054113 - RNA, 15 nt, Staphylococcus aureus subsp. aureus Mu50
acauuaaucuauaua

SEQ ID NO: 2054114 - RNA, 12 nt, Staphylococcus aureus subsp. aureus Mu50
acauuaauauaa

SEQ ID NO: 2054115 - RNA, 14 nt, Staphylococcus aureus subsp. aureus Mu50
acaucggaauucaa

SEQ ID NO: 2054116 - RNA, 13 nt, Staphylococcus aureus subsp. aureus Mu50
acaucuuuuuaaa

SEQ ID NO: 2054117 - RNA, 20 nt, Staphylococcus aureus subsp. aureus Mu50
acaucuuuuuaaaaggugug

SEQ ID NO: 2054118 - RNA, 21 nt, Staphylococcus aureus subsp. aureus Mu50
acaugaacaaucagauaaguu

SEQ ID NO: 2054119 - RNA, 23 nt, Staphylococcus aureus subsp. aureus Mu50
acaucuuucgagguaauuucacc

SEQ ID NO: 2054120 - RNA, 20 nt, Staphylococcus aureus subsp. aureus Mu50
acauccucauaauuaucaua

SEQ ID NO: 2054121 - RNA, 21 nt, Staphylococcus aureus subsp. aureus Mu50
acaucauaauaaaucuaucua

SEQ ID NO: 2054122 - RNA, 23 nt, Staphylococcus aureus subsp. aureus Mu50
acauaugucuuucuaaguuugaa

SEQ ID NO: 2054123 - RNA, 15 nt, Staphylococcus aureus subsp. aureus Mu50
acauaugacuuuauu

SEQ ID NO: 2054124 - RNA, 14 nt, Staphylococcus aureus subsp. aureus Mu50
acaucaauaucuuc

SEQ ID NO: 2054125 - RNA, 15 nt, Staphylococcus aureus subsp. aureus Mu50
acaucaauaucuucu

SEQ ID NO: 2054126 - RNA, 14 nt, Staphylococcus aureus subsp. aureus Mu50
acauauuauauaua

SEQ ID NO: 2054127 - RNA, 15 nt, Staphylococcus aureus subsp. aureus Mu50
acauauuauaaaagu

SEQ ID NO: 2054128 - RNA, 20 nt, Staphylococcus aureus subsp. aureus Mu50
acagcauuuccuaugugcug

SEQ ID NO: 2054129 - RNA, 19 nt, Staphylococcus aureus subsp. aureus Mu50
acaguuuuuauauuaagac

SEQ ID NO: 2054130 - RNA, 16 nt, Staphylococcus aureus subsp. aureus Mu50
acauaauagacuuaua

SEQ ID NO: 2054131 - RNA, 17 nt, Staphylococcus aureus subsp. aureus Mu50
acauaauagacuuauau

SEQ ID NO: 2054132 - RNA, 21 nt, Staphylococcus aureus subsp. aureus Mu50
acauaaggucuuggacuaaua

SEQ ID NO: 2054133 - RNA, 19 nt, Staphylococcus aureus subsp. aureus Mu50
acauaaccuaauucgccau

SEQ ID NO: 2054134 - RNA, 18 nt, Staphylococcus aureus subsp. aureus Mu50
acauaaaaaugcucaagu

SEQ ID NO: 2054135 - RNA, 14 nt, Staphylococcus aureus subsp. aureus Mu50
acauaaaacuuaca

SEQ ID NO: 2054136 - RNA, 16 nt, Staphylococcus aureus subsp. aureus Mu50
acauaaaacuuacauu

SEQ ID NO: 2054137 - RNA, 14 nt, Staphylococcus aureus subsp. aureus Mu50
acauaacuaugcuu

SEQ ID NO: 2054138 - RNA, 20 nt, Staphylococcus aureus subsp. aureus Mu50
acauagcuuaauaauuaaua

SEQ ID NO: 2054139 - RNA, 19 nt, Staphylococcus aureus subsp. aureus Mu50
acauagguauaaucauuua

SEQ ID NO: 2054140 - RNA, 16 nt, Staphylococcus aureus subsp. aureus Mu50
acauauaaaaaauuau

SEQ ID NO: 2054141 - RNA, 13 nt, Staphylococcus aureus subsp. aureus Mu50
acauauaagaauu

SEQ ID NO: 2054142 - RNA, 17 nt, Staphylococcus aureus subsp. aureus Mu50
acauagaguaauuuuac

SEQ ID NO: 2054143 - RNA, 16 nt, Staphylococcus aureus subsp. aureus Mu50
acauagaguaauuuua

SEQ ID NO: 2054144 - RNA, 14 nt, Staphylococcus aureus subsp. aureus Mu50
acauacguuauuuu

SEQ ID NO: 2054145 - RNA, 13 nt, Staphylococcus aureus subsp. aureus Mu50
acagagaaauucg

SEQ ID NO: 2054146 - RNA, 15 nt, Staphylococcus aureus subsp. aureus Mu50
acagauaaagcuucg

SEQ ID NO: 2054147 - RNA, 22 nt, Staphylococcus aureus subsp. aureus Mu50
acagauaagaauauuuaaguuu

SEQ ID NO: 2054148 - RNA, 12 nt, Staphylococcus aureus subsp. aureus Mu50
acagcaaauaaa

SEQ ID NO: 2054149 - RNA, 18 nt, Staphylococcus aureus subsp. aureus Mu50
acagcaguaggauaauuu

SEQ ID NO: 2054150 - RNA, 22 nt, Staphylococcus aureus subsp. aureus Mu50
acagcaguaggauaauuucaau

SEQ ID NO: 2054151 - RNA, 22 nt, Staphylococcus aureus subsp. aureus Mu50
acagcaguaagacgauuucaau

SEQ ID NO: 2054152 - RNA, 16 nt, Staphylococcus aureus subsp. aureus Mu50
acagcaguaagauauu

SEQ ID NO: 2054153 - RNA, 14 nt, Staphylococcus aureus subsp. aureus Mu50
acacuaaauguucu

SEQ ID NO: 2054154 - RNA, 20 nt, Staphylococcus aureus subsp. aureus Mu50
acacguucuugguauuuuuu

SEQ ID NO: 2054155 - RNA, 21 nt, Staphylococcus aureus subsp. aureus Mu50
acacuagucuuuuuauuuuaa

SEQ ID NO: 2054156 - RNA, 12 nt, Staphylococcus aureus subsp. aureus Mu50
acacuauuauag

SEQ ID NO: 2054157 - RNA, 19 nt, Staphylococcus aureus subsp. aureus Mu50
acacuaaaaccuauuccua

SEQ ID NO: 2054158 - RNA, 16 nt, Staphylococcus aureus subsp. aureus Mu50
acacuacgcugaugaa

SEQ ID NO: 2054159 - RNA, 13 nt, Staphylococcus aureus subsp. aureus Mu50
acaccaacauauu

SEQ ID NO: 2054160 - RNA, 21 nt, Staphylococcus aureus subsp. aureus Mu50
acacauuauugaaauuuuuaa

SEQ ID NO: 2054161 - RNA, 22 nt, Staphylococcus aureus subsp. aureus Mu50
acacauucuuauuugaaaugau

SEQ ID NO: 2054162 - RNA, 13 nt, Staphylococcus aureus subsp. aureus Mu50
acaccagauauca

SEQ ID NO: 2054163 - RNA, 14 nt, Staphylococcus aureus subsp. aureus Mu50
acaccccaacuugc

SEQ ID NO: 2054164 - RNA, 15 nt, Staphylococcus aureus subsp. aureus Mu50
acaccuauaccucau

SEQ ID NO: 2054165 - RNA, 20 nt, Staphylococcus aureus subsp. aureus Mu50
acacgacgcuaaacaaaggg

SEQ ID NO: 2054166 - RNA, 18 nt, Staphylococcus aureus subsp. aureus Mu50
acacgaauaccaagacca

SEQ ID NO: 2054167 - RNA, 20 nt, Staphylococcus aureus subsp. aureus Mu50
acacgaauaccaagaccagg

SEQ ID NO: 2054168 - RNA, 21 nt, Staphylococcus aureus subsp. aureus Mu50
acacgaguauuaucacauaga

SEQ ID NO: 2054169 - RNA, 14 nt, Staphylococcus aureus subsp. aureus Mu50
acaccuucaauauc

SEQ ID NO: 2054170 - RNA, 19 nt, Staphylococcus aureus subsp. aureus Mu50
acaccuuuacucacagacu

SEQ ID NO: 2054171 - RNA, 15 nt, Staphylococcus aureus subsp. aureus Mu50
acaccuauaccucgu

SEQ ID NO: 2054172 - RNA, 19 nt, Staphylococcus aureus subsp. aureus Mu50
acaaucuccauuagaacua

SEQ ID NO: 2054173 - RNA, 20 nt, Staphylococcus aureus subsp. aureus Mu50
acaaucggaagcauauuucu

SEQ ID NO: 2054174 - RNA, 21 nt, Staphylococcus aureus subsp. aureus Mu50
acaaucuuuuucaugcuauuu

SEQ ID NO: 2054175 - RNA, 23 nt, Staphylococcus aureus subsp. aureus Mu50
acaaucuuuuucaugcuauuuaa

SEQ ID NO: 2054176 - RNA, 15 nt, Staphylococcus aureus subsp. aureus Mu50
acaaugaaaaaacga

SEQ ID NO: 2054177 - RNA, 13 nt, Staphylococcus aureus subsp. aureus Mu50
acaaucuguucau

SEQ ID NO: 2054178 - RNA, 20 nt, Staphylococcus aureus subsp. aureus Mu50
acaaucuuaucauaaucuuc

SEQ ID NO: 2054179 - RNA, 15 nt, Staphylococcus aureus subsp. aureus Mu50
acaaugcagcuguau

SEQ ID NO: 2054180 - RNA, 14 nt, Staphylococcus aureus subsp. aureus Mu50
acaaugauuaaaau

SEQ ID NO: 2054181 - RNA, 16 nt, Staphylococcus aureus subsp. aureus Mu50
acaaugauuaaaauua

SEQ ID NO: 2054182 - RNA, 14 nt, Staphylococcus aureus subsp. aureus Mu50
acaaucacagcaau

SEQ ID NO: 2054183 - RNA, 21 nt, Staphylococcus aureus subsp. aureus Mu50
acaaucaacuuagaauuuaca

SEQ ID NO: 2054184 - RNA, 19 nt, Staphylococcus aureus subsp. aureus Mu50
acaaucacagcaauaauaa

SEQ ID NO: 2054185 - RNA, 18 nt, Staphylococcus aureus subsp. aureus Mu50
acaauauuaaaauuaaaa

SEQ ID NO: 2054186 - RNA, 19 nt, Staphylococcus aureus subsp. aureus Mu50
acaauauuaaaauuaaaac

SEQ ID NO: 2054187 - RNA, 18 nt, Staphylococcus aureus subsp. aureus Mu50
acaauauucguaaauccu

SEQ ID NO: 2054188 - RNA, 16 nt, Staphylococcus aureus subsp. aureus Mu50
acaauagguacaacua

SEQ ID NO: 2054189 - RNA, 22 nt, Staphylococcus aureus subsp. aureus Mu50
acaauaguauuaacuauaaaua

SEQ ID NO: 2054190 - RNA, 18 nt, Staphylococcus aureus subsp. aureus Mu50
acaaguugcacauuauaa

SEQ ID NO: 2054191 - RNA, 16 nt, Staphylococcus aureus subsp. aureus Mu50
acaaguugcugaauaa

SEQ ID NO: 2054192 - RNA, 14 nt, Staphylococcus aureus subsp. aureus Mu50
acaauaaaauuacu

SEQ ID NO: 2054193 - RNA, 11 nt, Staphylococcus aureus subsp. aureus Mu50
acaauaaaauu

SEQ ID NO: 2054194 - RNA, 16 nt, Staphylococcus aureus subsp. aureus Mu50
acaauaaccauuucau

SEQ ID NO: 2054195 - RNA, 15 nt, Staphylococcus aureus subsp. aureus Mu50
acaauaacuguucuu

SEQ ID NO: 2054196 - RNA, 17 nt, Staphylococcus aureus subsp. aureus Mu50
acaauacgaaaucaaaa

SEQ ID NO: 2054197 - RNA, 22 nt, Staphylococcus aureus subsp. aureus Mu50
acaauacgaaaucaaaaauaau

SEQ ID NO: 2054198 - RNA, 20 nt, Staphylococcus aureus subsp. aureus Mu50
acaauaagcgcaauuaaaag

SEQ ID NO: 2054199 - RNA, 16 nt, Staphylococcus aureus subsp. aureus Mu50
acaauacauaaugguu

SEQ ID NO: 2054200 - RNA, 20 nt, Staphylococcus aureus subsp. aureus Mu50
acaagguaugaaauaacaau

SEQ ID NO: 2054201 - RNA, 13 nt, Staphylococcus aureus subsp. aureus Mu50
acaagucauuauc

SEQ ID NO: 2054202 - RNA, 18 nt, Staphylococcus aureus subsp. aureus Mu50
acaagucuuuacucuaca

SEQ ID NO: 2054203 - RNA, 15 nt, Staphylococcus aureus subsp. aureus Mu50
acaaguacaauaaua

SEQ ID NO: 2054204 - RNA, 15 nt, Staphylococcus aureus subsp. aureus Mu50
acaaguauaaaugca

SEQ ID NO: 2054205 - RNA, 21 nt, Staphylococcus aureus subsp. aureus Mu50
acacacaugauaauuuuuagu

SEQ ID NO: 2054206 - RNA, 21 nt, Staphylococcus aureus subsp. aureus Mu50
acacacuguugaaaaugacua

SEQ ID NO: 2054207 - RNA, 22 nt, Staphylococcus aureus subsp. aureus Mu50
acacaaauuuuuuguaaacaug

SEQ ID NO: 2054208 - RNA, 17 nt, Staphylococcus aureus subsp. aureus Mu50
acacaaauuaaaacucg

SEQ ID NO: 2054209 - RNA, 23 nt, Staphylococcus aureus subsp. aureus Mu50
acacaaauaaaggcaacaaauau

SEQ ID NO: 2054210 - RNA, 21 nt, Staphylococcus aureus subsp. aureus Mu50
acacagcuaaacgcaauacga

SEQ ID NO: 2054211 - RNA, 14 nt, Staphylococcus aureus subsp. aureus Mu50
acacagguaaauuu

SEQ ID NO: 2054212 - RNA, 16 nt, Staphylococcus aureus subsp. aureus Mu50
acacagguaaauuuaa

SEQ ID NO: 2054213 - RNA, 20 nt, Staphylococcus aureus subsp. aureus Mu50
acacagguaaauuuaaaaua

SEQ ID NO: 2054214 - RNA, 14 nt, Staphylococcus aureus subsp. aureus Mu50
acacaguacaaaua

SEQ ID NO: 2054215 - RNA, 13 nt, Staphylococcus aureus subsp. aureus Mu50
acacaguacaaau

SEQ ID NO: 2054216 - RNA, 12 nt, Staphylococcus aureus subsp. aureus Mu50
acacauacaccu

SEQ ID NO: 2054217 - RNA, 13 nt, Staphylococcus aureus subsp. aureus Mu50
acacaucacuaua

SEQ ID NO: 2054218 - RNA, 22 nt, Staphylococcus aureus subsp. aureus Mu50
acacaucuauguggcuacuuga

SEQ ID NO: 2054219 - RNA, 20 nt, Staphylococcus aureus subsp. aureus Mu50
acaaugcauccaaauauuaa

SEQ ID NO: 2054220 - RNA, 17 nt, Staphylococcus aureus subsp. aureus Mu50
acaaugcgcaaugaaaa

SEQ ID NO: 2054221 - RNA, 18 nt, Staphylococcus aureus subsp. aureus Mu50
acaaugcauccaaauauu

SEQ ID NO: 2054222 - RNA, 21 nt, Staphylococcus aureus subsp. aureus Mu50
acaaugcagcuguauuuaaua

SEQ ID NO: 2054223 - RNA, 13 nt, Staphylococcus aureus subsp. aureus Mu50
acaaugcgcaaug

SEQ ID NO: 2054224 - RNA, 19 nt, Staphylococcus aureus subsp. aureus Mu50
acaauguuauuagauacuu

SEQ ID NO: 2054225 - RNA, 16 nt, Staphylococcus aureus subsp. aureus Mu50
acaauuauaaaugauu

SEQ ID NO: 2054226 - RNA, 15 nt, Staphylococcus aureus subsp. aureus Mu50
acaauuauaauaaaa

SEQ ID NO: 2054227 - RNA, 13 nt, Staphylococcus aureus subsp. aureus Mu50
acaauugcagaga

SEQ ID NO: 2054228 - RNA, 20 nt, Staphylococcus aureus subsp. aureus Mu50
acaauuuagcaaauauuucu

SEQ ID NO: 2054229 - RNA, 17 nt, Staphylococcus aureus subsp. aureus Mu50
acaauuuaaacgcacua

SEQ ID NO: 2054230 - RNA, 17 nt, Staphylococcus aureus subsp. aureus Mu50
acaauuuauuaaaacga

SEQ ID NO: 2054231 - RNA, 13 nt, Staphylococcus aureus subsp. aureus Mu50
acaauuuaaacgc

SEQ ID NO: 2054232 - RNA, 16 nt, Staphylococcus aureus subsp. aureus Mu50
acaauugcuaauccau

SEQ ID NO: 2054233 - RNA, 16 nt, Staphylococcus aureus subsp. aureus Mu50
acaauuuuccuuccaa

SEQ ID NO: 2054234 - RNA, 15 nt, Staphylococcus aureus subsp. aureus Mu50
acaauuuuccuucca

SEQ ID NO: 2054235 - RNA, 15 nt, Staphylococcus aureus subsp. aureus Mu50
acaauuuuuaaaaac

SEQ ID NO: 2054236 - RNA, 18 nt, Staphylococcus aureus subsp. aureus Mu50
acaauuuuugggaagaau

SEQ ID NO: 2054237 - RNA, 12 nt, Staphylococcus aureus subsp. aureus Mu50
acacaaagaauu

SEQ ID NO: 2054238 - RNA, 22 nt, Staphylococcus aureus subsp. aureus Mu50
aauuauaauaaaacuugugaua

SEQ ID NO: 2054239 - RNA, 14 nt, Staphylococcus aureus subsp. aureus Mu50
aauuauaauaaaac

SEQ ID NO: 2054240 - RNA, 17 nt, Staphylococcus aureus subsp. aureus Mu50
aauuauacaaauuauaa

SEQ ID NO: 2054241 - RNA, 20 nt, Staphylococcus aureus subsp. aureus Mu50
aauuauacaaauuauaaauu

SEQ ID NO: 2054242 - RNA, 21 nt, Staphylococcus aureus subsp. aureus Mu50
aauuauacguuacuaaacuuu

SEQ ID NO: 2054243 - RNA, 16 nt, Staphylococcus aureus subsp. aureus Mu50
aauuucaucaaaucca

SEQ ID NO: 2054244 - RNA, 18 nt, Staphylococcus aureus subsp. aureus Mu50
aauuuccaauaucuucuu

SEQ ID NO: 2054245 - RNA, 21 nt, Staphylococcus aureus subsp. aureus Mu50
aauuuccaauaucuucuuuua

SEQ ID NO: 2054246 - RNA, 17 nt, Staphylococcus aureus subsp. aureus Mu50
aauuucauuuuugauaa

SEQ ID NO: 2054247 - RNA, 14 nt, Staphylococcus aureus subsp. aureus Mu50
aauuucaugugcaa

SEQ ID NO: 2054248 - RNA, 19 nt, Staphylococcus aureus subsp. aureus Mu50
aauuucuauagaaaaagua

SEQ ID NO: 2054249 - RNA, 14 nt, Staphylococcus aureus subsp. aureus Mu50
aauuucuaauuaaa

SEQ ID NO: 2054250 - RNA, 19 nt, Staphylococcus aureus subsp. aureus Mu50
aauuucgaaaagaaauucu

SEQ ID NO: 2054251 - RNA, 14 nt, Staphylococcus aureus subsp. aureus Mu50
aauuucgaaaagaa

SEQ ID NO: 2054252 - RNA, 15 nt, Staphylococcus aureus subsp. aureus Mu50
aauuucgaaaagaaa

SEQ ID NO: 2054253 - RNA, 21 nt, Staphylococcus aureus subsp. aureus Mu50
aauuucgacaucuagaugaaa

SEQ ID NO: 2054254 - RNA, 18 nt, Staphylococcus aureus subsp. aureus Mu50
aauuucgauuuucaccaa

SEQ ID NO: 2054255 - RNA, 16 nt, Staphylococcus aureus subsp. aureus Mu50
aauuucgacaucuaga

SEQ ID NO: 2054256 - RNA, 15 nt, Staphylococcus aureus subsp. aureus Mu50
aauuucugaacauaa

SEQ ID NO: 2054257 - RNA, 19 nt, Staphylococcus aureus subsp. aureus Mu50
aauuucucccguuugauuu

SEQ ID NO: 2054258 - RNA, 17 nt, Staphylococcus aureus subsp. aureus Mu50
aauuucuaugaaaaaaa

SEQ ID NO: 2054259 - RNA, 18 nt, Staphylococcus aureus subsp. aureus Mu50
aauuucucuuucaagacc

SEQ ID NO: 2054260 - RNA, 14 nt, Staphylococcus aureus subsp. aureus Mu50
aauuucuuuaagug

SEQ ID NO: 2054261 - RNA, 16 nt, Staphylococcus aureus subsp. aureus Mu50
aauuuguuuuaaauac

SEQ ID NO: 2054262 - RNA, 20 nt, Staphylococcus aureus subsp. aureus Mu50
aauuuguguucaaaucacaa

SEQ ID NO: 2054263 - RNA, 15 nt, Staphylococcus aureus subsp. aureus Mu50
aauuuuaauauauuu

SEQ ID NO: 2054264 - RNA, 20 nt, Staphylococcus aureus subsp. aureus Mu50
aauuuuaauuaauuaucaua

SEQ ID NO: 2054265 - RNA, 11 nt, Staphylococcus aureus subsp. aureus Mu50
aauuuuaaauc

SEQ ID NO: 2054266 - RNA, 21 nt, Staphylococcus aureus subsp. aureus Mu50
aauuuuaaauauugauauaaa

SEQ ID NO: 2054267 - RNA, 12 nt, Staphylococcus aureus subsp. aureus Mu50
aauuuuaccaug

SEQ ID NO: 2054268 - RNA, 17 nt, Staphylococcus aureus subsp. aureus Mu50
aauuuuauuagguaaua

SEQ ID NO: 2054269 - RNA, 13 nt, Staphylococcus aureus subsp. aureus Mu50
aauuuuauauauc

SEQ ID NO: 2054270 - RNA, 19 nt, Staphylococcus aureus subsp. aureus Mu50
aauuuuaucuuauuauuaa

SEQ ID NO: 2054271 - RNA, 16 nt, Staphylococcus aureus subsp. aureus Mu50
aauuugcacaaagaua

SEQ ID NO: 2054272 - RNA, 12 nt, Staphylococcus aureus subsp. aureus Mu50
aauuugauuaaa

SEQ ID NO: 2054273 - RNA, 13 nt, Staphylococcus aureus subsp. aureus Mu50
aauuugauuaaaa

SEQ ID NO: 2054274 - RNA, 23 nt, Staphylococcus aureus subsp. aureus Mu50
aauuugauuaaaaacgucucuau

SEQ ID NO: 2054275 - RNA, 17 nt, Staphylococcus aureus subsp. aureus Mu50
aauuugauuaaauucau

SEQ ID NO: 2054276 - RNA, 13 nt, Staphylococcus aureus subsp. aureus Mu50
aauuugaaauaua

SEQ ID NO: 2054277 - RNA, 16 nt, Staphylococcus aureus subsp. aureus Mu50
aauuugaaauauacca

SEQ ID NO: 2054278 - RNA, 12 nt, Staphylococcus aureus subsp. aureus Mu50
aauuugaaauug

SEQ ID NO: 2054279 - RNA, 14 nt, Staphylococcus aureus subsp. aureus Mu50
aauuuguaauacaa

SEQ ID NO: 2054280 - RNA, 16 nt, Staphylococcus aureus subsp. aureus Mu50
aauuuggucauauaaa

SEQ ID NO: 2054281 - RNA, 18 nt, Staphylococcus aureus subsp. aureus Mu50
acaaaauuaagaagaaau

SEQ ID NO: 2054282 - RNA, 18 nt, Staphylococcus aureus subsp. aureus Mu50
acaaaauugucucacuug

SEQ ID NO: 2054283 - RNA, 16 nt, Staphylococcus aureus subsp. aureus Mu50
acaaaauaacauguuu

SEQ ID NO: 2054284 - RNA, 20 nt, Staphylococcus aureus subsp. aureus Mu50
acaaaaaauaucuuuuuguu

SEQ ID NO: 2054285 - RNA, 13 nt, Staphylococcus aureus subsp. aureus Mu50
acaaaaagaauuu

SEQ ID NO: 2054286 - RNA, 22 nt, Staphylococcus aureus subsp. aureus Mu50
acaaaaagaauuucgaaaagaa

SEQ ID NO: 2054287 - RNA, 17 nt, Staphylococcus aureus subsp. aureus Mu50
acaaaaagacuuccaau

SEQ ID NO: 2054288 - RNA, 14 nt, Staphylococcus aureus subsp. aureus Mu50
acaaaaaauuguaa

SEQ ID NO: 2054289 - RNA, 13 nt, Staphylococcus aureus subsp. aureus Mu50
acaaaaaugaaga

SEQ ID NO: 2054290 - RNA, 16 nt, Staphylococcus aureus subsp. aureus Mu50
acaaaaauauagcuau

SEQ ID NO: 2054291 - RNA, 20 nt, Staphylococcus aureus subsp. aureus Mu50
aauuuuucuaaaugauuuau

SEQ ID NO: 2054292 - RNA, 19 nt, Staphylococcus aureus subsp. aureus Mu50
aauuuuucauuaauacaag

SEQ ID NO: 2054293 - RNA, 19 nt, Staphylococcus aureus subsp. aureus Mu50
aauuuuuaugcauuauaga

SEQ ID NO: 2054294 - RNA, 17 nt, Staphylococcus aureus subsp. aureus Mu50
aauuuuugggaagaaua

SEQ ID NO: 2054295 - RNA, 19 nt, Staphylococcus aureus subsp. aureus Mu50
aauuuuuguaauacaucua

SEQ ID NO: 2054296 - RNA, 21 nt, Staphylococcus aureus subsp. aureus Mu50
aauuuuccuuccaauaauaaa

SEQ ID NO: 2054297 - RNA, 19 nt, Staphylococcus aureus subsp. aureus Mu50
aauuuucuguuuaauuaaa

SEQ ID NO: 2054298 - RNA, 13 nt, Staphylococcus aureus subsp. aureus Mu50
aauuuucuaaaua

SEQ ID NO: 2054299 - RNA, 13 nt, Staphylococcus aureus subsp. aureus Mu50
aauuuuuaacaaa

SEQ ID NO: 2054300 - RNA, 14 nt, Staphylococcus aureus subsp. aureus Mu50
aauuuuuaacaaaa

SEQ ID NO: 2054301 - RNA, 21 nt, Staphylococcus aureus subsp. aureus Mu50
aauuuuuaacaaaauauacua

SEQ ID NO: 2054302 - RNA, 15 nt, Staphylococcus aureus subsp. aureus Mu50
aauuuucuugccauc

SEQ ID NO: 2054303 - RNA, 15 nt, Staphylococcus aureus subsp. aureus Mu50
aauuuucuaaauaua

SEQ ID NO: 2054304 - RNA, 12 nt, Staphylococcus aureus subsp. aureus Mu50
aauuuucuuuuu

SEQ ID NO: 2054305 - RNA, 12 nt, Staphylococcus aureus subsp. aureus Mu50
aauuuugaagaa

SEQ ID NO: 2054306 - RNA, 13 nt, Staphylococcus aureus subsp. aureus Mu50
aauuuugauauag

SEQ ID NO: 2054307 - RNA, 20 nt, Staphylococcus aureus subsp. aureus Mu50
aauuuugacauaaaaaauaa

SEQ ID NO: 2054308 - RNA, 20 nt, Staphylococcus aureus subsp. aureus Mu50
aauuuugacgcucagguaua

SEQ ID NO: 2054309 - RNA, 14 nt, Staphylococcus aureus subsp. aureus Mu50
acaacauaacaaag

SEQ ID NO: 2054310 - RNA, 21 nt, Staphylococcus aureus subsp. aureus Mu50
acaacaucgauuuaucauuau

SEQ ID NO: 2054311 - RNA, 18 nt, Staphylococcus aureus subsp. aureus Mu50
acaaccugugauaaaaau

SEQ ID NO: 2054312 - RNA, 21 nt, Staphylococcus aureus subsp. aureus Mu50
acaaccugugauaaaaaucuu

SEQ ID NO: 2054313 - RNA, 13 nt, Staphylococcus aureus subsp. aureus Mu50
acaacugauuuaa

SEQ ID NO: 2054314 - RNA, 17 nt, Staphylococcus aureus subsp. aureus Mu50
acaacuaauaacaaaua

SEQ ID NO: 2054315 - RNA, 16 nt, Staphylococcus aureus subsp. aureus Mu50
acaacuauucccacuc

SEQ ID NO: 2054316 - RNA, 17 nt, Staphylococcus aureus subsp. aureus Mu50
acaacuauucccacuca

SEQ ID NO: 2054317 - RNA, 22 nt, Staphylococcus aureus subsp. aureus Mu50
acaacuauucccacucaauugu

SEQ ID NO: 2054318 - RNA, 19 nt, Staphylococcus aureus subsp. aureus Mu50
acaacuugaacuaaaacga

SEQ ID NO: 2054319 - RNA, 16 nt, Staphylococcus aureus subsp. aureus Mu50
acaacuuuaauuuuuc

SEQ ID NO: 2054320 - RNA, 23 nt, Staphylococcus aureus subsp. aureus Mu50
acaacuucuucuccguauuuacc

SEQ ID NO: 2054321 - RNA, 19 nt, Staphylococcus aureus subsp. aureus Mu50
acaagauucauacacugca

SEQ ID NO: 2054322 - RNA, 15 nt, Staphylococcus aureus subsp. aureus Mu50
acaagcaucaugaaa

SEQ ID NO: 2054323 - RNA, 16 nt, Staphylococcus aureus subsp. aureus Mu50
acaagccaagauaaau

SEQ ID NO: 2054324 - RNA, 20 nt, Staphylococcus aureus subsp. aureus Mu50
acaagcaucaugaaauuaga

SEQ ID NO: 2054325 - RNA, 21 nt, Staphylococcus aureus subsp. aureus Mu50
acaagccaagauaaaucauca

SEQ ID NO: 2054326 - RNA, 20 nt, Staphylococcus aureus subsp. aureus Mu50
acaaaccauuccaauuucaa

SEQ ID NO: 2054327 - RNA, 19 nt, Staphylococcus aureus subsp. aureus Mu50
acaaacgacuaaccacauu

SEQ ID NO: 2054328 - RNA, 13 nt, Staphylococcus aureus subsp. aureus Mu50
acaaagauauguu

SEQ ID NO: 2054329 - RNA, 17 nt, Staphylococcus aureus subsp. aureus Mu50
acaaagauauguuuaua

SEQ ID NO: 2054330 - RNA, 14 nt, Staphylococcus aureus subsp. aureus Mu50
acaaaguuaaccau

SEQ ID NO: 2054331 - RNA, 18 nt, Staphylococcus aureus subsp. aureus Mu50
acaaagucugucugaauu

SEQ ID NO: 2054332 - RNA, 16 nt, Staphylococcus aureus subsp. aureus Mu50
acaaauguauaaauaa

SEQ ID NO: 2054333 - RNA, 18 nt, Staphylococcus aureus subsp. aureus Mu50
acaaauguauaaauaaua

SEQ ID NO: 2054334 - RNA, 11 nt, Staphylococcus aureus subsp. aureus Mu50
acaaauuauua

SEQ ID NO: 2054335 - RNA, 17 nt, Staphylococcus aureus subsp. aureus Mu50
acaaauuaaaaaacaau

SEQ ID NO: 2054336 - RNA, 12 nt, Staphylococcus aureus subsp. aureus Mu50
acaaauuauuaa

SEQ ID NO: 2054337 - RNA, 21 nt, Staphylococcus aureus subsp. aureus Mu50
acaaauuugaauauacuuaau

SEQ ID NO: 2054338 - RNA, 15 nt, Staphylococcus aureus subsp. aureus Mu50
acaacaaucaaauua

SEQ ID NO: 2054339 - RNA, 21 nt, Staphylococcus aureus subsp. aureus Mu50
acaaauaaaggcaacaaauau

SEQ ID NO: 2054340 - RNA, 14 nt, Staphylococcus aureus subsp. aureus Mu50
acaaauaacaaaca

SEQ ID NO: 2054341 - RNA, 14 nt, Staphylococcus aureus subsp. aureus Mu50
acaaauaauuuaca

SEQ ID NO: 2054342 - RNA, 23 nt, Staphylococcus aureus subsp. aureus Mu50
acaaauauacuugccuucaaauu

SEQ ID NO: 2054343 - RNA, 22 nt, Staphylococcus aureus subsp. aureus Mu50
acaaauauaucuagccugaaau

SEQ ID NO: 2054344 - RNA, 14 nt, Staphylococcus aureus subsp. aureus Mu50
acaaauauuucuaa

SEQ ID NO: 2054345 - RNA, 20 nt, Staphylococcus aureus subsp. aureus Mu50
acaaaucaugacauaaaacu

SEQ ID NO: 2054346 - RNA, 11 nt, Staphylococcus aureus subsp. aureus Mu50
acaaaugaaaa

SEQ ID NO: 2054347 - RNA, 19 nt, Staphylococcus aureus subsp. aureus Mu50
acaaaucuuuuaaauuuag

SEQ ID NO: 2054348 - RNA, 18 nt, Staphylococcus aureus subsp. aureus Mu50
acaaaugccuuaucuaua

SEQ ID NO: 2054349 - RNA, 16 nt, Staphylococcus aureus subsp. aureus Mu50
aaggccauuuguagac

SEQ ID NO: 2054350 - RNA, 16 nt, Staphylococcus aureus subsp. aureus Mu50
aaggcgaaacauuaaa

SEQ ID NO: 2054351 - RNA, 18 nt, Staphylococcus aureus subsp. aureus Mu50
aaggcgcucucuuuuuag

SEQ ID NO: 2054352 - RNA, 16 nt, Staphylococcus aureus subsp. aureus Mu50
aaggcgcucucuuuuu

SEQ ID NO: 2054353 - RNA, 16 nt, Staphylococcus aureus subsp. aureus Mu50
aaggugauugaacaau

SEQ ID NO: 2054354 - RNA, 17 nt, Staphylococcus aureus subsp. aureus Mu50
aagguuguucuauacau

SEQ ID NO: 2054355 - RNA, 23 nt, Staphylococcus aureus subsp. aureus Mu50
aagguuguuuuucaucauuaaaa

SEQ ID NO: 2054356 - RNA, 21 nt, Staphylococcus aureus subsp. aureus Mu50
aagguacguuguaauaguaag

SEQ ID NO: 2054357 - RNA, 23 nt, Staphylococcus aureus subsp. aureus Mu50
aagcuguuggugaguguuucaua

SEQ ID NO: 2054358 - RNA, 18 nt, Staphylococcus aureus subsp. aureus Mu50
aagcuuucauuaauuuuu

SEQ ID NO: 2054359 - RNA, 15 nt, Staphylococcus aureus subsp. aureus Mu50
aagcuuuaguuaaau

SEQ ID NO: 2054360 - RNA, 17 nt, Staphylococcus aureus subsp. aureus Mu50
aagcuuuaguuaaauag

SEQ ID NO: 2054361 - RNA, 23 nt, Staphylococcus aureus subsp. aureus Mu50
aagcugucuuacugcuguuuuua

SEQ ID NO: 2054362 - RNA, 14 nt, Staphylococcus aureus subsp. aureus Mu50
aagcugucauaccu

SEQ ID NO: 2054363 - RNA, 17 nt, Staphylococcus aureus subsp. aureus Mu50
aaggauaagaacgagaa

SEQ ID NO: 2054364 - RNA, 19 nt, Staphylococcus aureus subsp. aureus Mu50
aaggaucauguuccccauu

SEQ ID NO: 2054365 - RNA, 12 nt, Staphylococcus aureus subsp. aureus Mu50
aaggaucauguu

SEQ ID NO: 2054366 - RNA, 19 nt, Staphylococcus aureus subsp. aureus Mu50
aagcuuuuacgccuucuuu

SEQ ID NO: 2054367 - RNA, 23 nt, Staphylococcus aureus subsp. aureus Mu50
aagcuuuuacgccuucuuuauaa

SEQ ID NO: 2054368 - RNA, 20 nt, Staphylococcus aureus subsp. aureus Mu50
aaggaauagcuacaauuaaa

SEQ ID NO: 2054369 - RNA, 20 nt, Staphylococcus aureus subsp. aureus Mu50
aaggaaucguaaagcuguug

SEQ ID NO: 2054370 - RNA, 23 nt, Staphylococcus aureus subsp. aureus Mu50
aagcgucuuuuuuguaugaguuc

SEQ ID NO: 2054371 - RNA, 14 nt, Staphylococcus aureus subsp. aureus Mu50
aagccaagauaaau

SEQ ID NO: 2054372 - RNA, 16 nt, Staphylococcus aureus subsp. aureus Mu50
aagccaacacauaaau

SEQ ID NO: 2054373 - RNA, 21 nt, Staphylococcus aureus subsp. aureus Mu50
aagcugauuucuaucaaauaa

SEQ ID NO: 2054374 - RNA, 22 nt, Staphylococcus aureus subsp. aureus Mu50
aagcugauuucuaucaaauaau

SEQ ID NO: 2054375 - RNA, 18 nt, Staphylococcus aureus subsp. aureus Mu50
aagcuaucguaaacaaca

SEQ ID NO: 2054376 - RNA, 17 nt, Staphylococcus aureus subsp. aureus Mu50
aagcuaauucauauuca

SEQ ID NO: 2054377 - RNA, 23 nt, Staphylococcus aureus subsp. aureus Mu50
aagcuaauucauauucaaauuua

SEQ ID NO: 2054378 - RNA, 21 nt, Staphylococcus aureus subsp. aureus Mu50
aagcuauaaaaaaucuuuuga

SEQ ID NO: 2054379 - RNA, 16 nt, Staphylococcus aureus subsp. aureus Mu50
aagugcuguuacuucu

SEQ ID NO: 2054380 - RNA, 20 nt, Staphylococcus aureus subsp. aureus Mu50
aagugcuguuacuucucccu

SEQ ID NO: 2054381 - RNA, 19 nt, Staphylococcus aureus subsp. aureus Mu50
aagugcauauuuaauacau

SEQ ID NO: 2054382 - RNA, 22 nt, Staphylococcus aureus subsp. aureus Mu50
aagugcagauguugguucauca

SEQ ID NO: 2054383 - RNA, 22 nt, Staphylococcus aureus subsp. aureus Mu50
aagugauuucuucauuaucaau

SEQ ID NO: 2054384 - RNA, 13 nt, Staphylococcus aureus subsp. aureus Mu50
aagugaugugaug

SEQ ID NO: 2054385 - RNA, 18 nt, Staphylococcus aureus subsp. aureus Mu50
aagugaaaucauuuaaau

SEQ ID NO: 2054386 - RNA, 20 nt, Staphylococcus aureus subsp. aureus Mu50
aagugaaaguauuagauaua

SEQ ID NO: 2054387 - RNA, 21 nt, Staphylococcus aureus subsp. aureus Mu50
aagucuucaucuuuaaagaaa

SEQ ID NO: 2054388 - RNA, 19 nt, Staphylococcus aureus subsp. aureus Mu50
aagucuugugauaauucuu

SEQ ID NO: 2054389 - RNA, 23 nt, Staphylococcus aureus subsp. aureus Mu50
aagucuuuaauagcgucaaguuu

SEQ ID NO: 2054390 - RNA, 17 nt, Staphylococcus aureus subsp. aureus Mu50
aaguuaauuauguauuu

SEQ ID NO: 2054391 - RNA, 14 nt, Staphylococcus aureus subsp. aureus Mu50
aaguuaauuaugua

SEQ ID NO: 2054392 - RNA, 15 nt, Staphylococcus aureus subsp. aureus Mu50
aaguuacaauaucau

SEQ ID NO: 2054393 - RNA, 19 nt, Staphylococcus aureus subsp. aureus Mu50
aaguuaacuauaacaauag

SEQ ID NO: 2054394 - RNA, 20 nt, Staphylococcus aureus subsp. aureus Mu50
aaguuaaucagaaaagcagu

SEQ ID NO: 2054395 - RNA, 19 nt, Staphylococcus aureus subsp. aureus Mu50
aaguuaaaauugguuugga

SEQ ID NO: 2054396 - RNA, 22 nt, Staphylococcus aureus subsp. aureus Mu50
aaguuaaaaccuuuucaaauua

SEQ ID NO: 2054397 - RNA, 15 nt, Staphylococcus aureus subsp. aureus Mu50
aaguguuaaugucuu

SEQ ID NO: 2054398 - RNA, 14 nt, Staphylococcus aureus subsp. aureus Mu50
aaguguuauaaaua

SEQ ID NO: 2054399 - RNA, 20 nt, Staphylococcus aureus subsp. aureus Mu50
aaguguuauaaauagagaac

SEQ ID NO: 2054400 - RNA, 15 nt, Staphylococcus aureus subsp. aureus Mu50
aaguggcaaacauuu

SEQ ID NO: 2054401 - RNA, 20 nt, Staphylococcus aureus subsp. aureus Mu50
aagugcuugguuaaaguuaa

SEQ ID NO: 2054402 - RNA, 23 nt, Staphylococcus aureus subsp. aureus Mu50
aaguaucgccaaucuauugcaau

SEQ ID NO: 2054403 - RNA, 19 nt, Staphylococcus aureus subsp. aureus Mu50
aaguaauaaaauaaaaaaa

SEQ ID NO: 2054404 - RNA, 20 nt, Staphylococcus aureus subsp. aureus Mu50
aaguaucgccaucauucacc

SEQ ID NO: 2054405 - RNA, 15 nt, Staphylococcus aureus subsp. aureus Mu50
aaguaauaauauaaa

SEQ ID NO: 2054406 - RNA, 19 nt, Staphylococcus aureus subsp. aureus Mu50
aaguaucgccaaucuauug

SEQ ID NO: 2054407 - RNA, 14 nt, Staphylococcus aureus subsp. aureus Mu50
aaguaaguaaaaua

SEQ ID NO: 2054408 - RNA, 16 nt, Staphylococcus aureus subsp. aureus Mu50
aaguaacucaagugau

SEQ ID NO: 2054409 - RNA, 22 nt, Staphylococcus aureus subsp. aureus Mu50
aagucacaguaucuucaguuau

SEQ ID NO: 2054410 - RNA, 15 nt, Staphylococcus aureus subsp. aureus Mu50
aagucacauuuauaa

SEQ ID NO: 2054411 - RNA, 14 nt, Staphylococcus aureus subsp. aureus Mu50
aaguauuagauaua

SEQ ID NO: 2054412 - RNA, 17 nt, Staphylococcus aureus subsp. aureus Mu50
aagucaauaauuuuauc

SEQ ID NO: 2054413 - RNA, 22 nt, Staphylococcus aureus subsp. aureus Mu50
aaguaugucaucuucaauucuu

SEQ ID NO: 2054414 - RNA, 16 nt, Staphylococcus aureus subsp. aureus Mu50
aaguauggaaguuguu

SEQ ID NO: 2054415 - RNA, 14 nt, Staphylococcus aureus subsp. aureus Mu50
aaguauggcaguuu

SEQ ID NO: 2054416 - RNA, 22 nt, Staphylococcus aureus subsp. aureus Mu50
aaguauggcgaaauguuuugga

SEQ ID NO: 2054417 - RNA, 20 nt, Staphylococcus aureus subsp. aureus Mu50
aaguaugucaucuucaauuc

SEQ ID NO: 2054418 - RNA, 21 nt, Staphylococcus aureus subsp. aureus Mu50
aaguaugagacgcauugcaag

SEQ ID NO: 2054419 - RNA, 18 nt, Staphylococcus aureus subsp. aureus Mu50
aaguaucuaugaaauuuu

SEQ ID NO: 2054420 - RNA, 20 nt, Staphylococcus aureus subsp. aureus Mu50
aaguaucuaugaaauuuuuu

SEQ ID NO: 2054421 - RNA, 15 nt, Staphylococcus aureus subsp. aureus Mu50
aagucacaguguaau

SEQ ID NO: 2054422 - RNA, 22 nt, Staphylococcus aureus subsp. aureus Mu50
aagucaggaucacguuuuucuu

SEQ ID NO: 2054423 - RNA, 18 nt, Staphylococcus aureus subsp. aureus Mu50
aagucuaauguuggaaaa

SEQ ID NO: 2054424 - RNA, 16 nt, Staphylococcus aureus subsp. aureus Mu50
aagucuagcauuagaa

SEQ ID NO: 2054425 - RNA, 19 nt, Staphylococcus aureus subsp. aureus Mu50
aaguuuacagguugaauaa

SEQ ID NO: 2054426 - RNA, 13 nt, Staphylococcus aureus subsp. aureus Mu50
aaguuugaaucau

SEQ ID NO: 2054427 - RNA, 22 nt, Staphylococcus aureus subsp. aureus Mu50
aaguuucgcugcuacaccaccu

SEQ ID NO: 2054428 - RNA, 16 nt, Staphylococcus aureus subsp. aureus Mu50
aaguuucggaaaaaga

SEQ ID NO: 2054429 - RNA, 23 nt, Staphylococcus aureus subsp. aureus Mu50
aaguuuuucaggguuuaagauuu

SEQ ID NO: 2054430 - RNA, 13 nt, Staphylococcus aureus subsp. aureus Mu50
aaguuuucauuuu

SEQ ID NO: 2054431 - RNA, 21 nt, Staphylococcus aureus subsp. aureus Mu50
aaguuugguuucuuaacauaa

SEQ ID NO: 2054432 - RNA, 19 nt, Staphylococcus aureus subsp. aureus Mu50
aaguuugucuuugaacaua

SEQ ID NO: 2054433 - RNA, 18 nt, Staphylococcus aureus subsp. aureus Mu50
aaguuuuagcuuguuguu

SEQ ID NO: 2054434 - RNA, 15 nt, Staphylococcus aureus subsp. aureus Mu50
aaguucuagauuauu

SEQ ID NO: 2054435 - RNA, 18 nt, Staphylococcus aureus subsp. aureus Mu50
aaguuuaagucaguccau

SEQ ID NO: 2054436 - RNA, 15 nt, Staphylococcus aureus subsp. aureus Mu50
aaguuguaauuuaaa

SEQ ID NO: 2054437 - RNA, 19 nt, Staphylococcus aureus subsp. aureus Mu50
aaguuguggucuaaccauc

SEQ ID NO: 2054438 - RNA, 18 nt, Staphylococcus aureus subsp. aureus Mu50
aaguugguccaaaucgug

SEQ ID NO: 2054439 - RNA, 21 nt, Staphylococcus aureus subsp. aureus Mu50
aaguuggggaugggccccaac

SEQ ID NO: 2054440 - RNA, 15 nt, Staphylococcus aureus subsp. aureus Mu50
aauaaaaugcuacaa

SEQ ID NO: 2054441 - RNA, 16 nt, Staphylococcus aureus subsp. aureus Mu50
aauaaaauauaucuua

SEQ ID NO: 2054442 - RNA, 22 nt, Staphylococcus aureus subsp. aureus Mu50
aauaaaauugugccauuugcaa

SEQ ID NO: 2054443 - RNA, 12 nt, Staphylococcus aureus subsp. aureus Mu50
aauaaaaugaug

SEQ ID NO: 2054444 - RNA, 12 nt, Staphylococcus aureus subsp. aureus Mu50
aauaaaccagug

SEQ ID NO: 2054445 - RNA, 22 nt, Staphylococcus aureus subsp. aureus Mu50
aauaaacaacugcaauagcuau

SEQ ID NO: 2054446 - RNA, 21 nt, Staphylococcus aureus subsp. aureus Mu50
aauaaaacgacucauuauaaa

SEQ ID NO: 2054447 - RNA, 20 nt, Staphylococcus aureus subsp. aureus Mu50
aauaaaacgcuucauauaaa

SEQ ID NO: 2054448 - RNA, 20 nt, Staphylococcus aureus subsp. aureus Mu50
aauaaaacgugcaaauaaaa

SEQ ID NO: 2054449 - RNA, 17 nt, Staphylococcus aureus subsp. aureus Mu50
aauaaaaauuauauaaa

SEQ ID NO: 2054450 - RNA, 14 nt, Staphylococcus aureus subsp. aureus Mu50
aauaaaacuuauaa

SEQ ID NO: 2054451 - RNA, 13 nt, Staphylococcus aureus subsp. aureus Mu50
aauaaaaggcuuu

SEQ ID NO: 2054452 - RNA, 18 nt, Staphylococcus aureus subsp. aureus Mu50
aauaaaagucgauaaaua

SEQ ID NO: 2054453 - RNA, 13 nt, Staphylococcus aureus subsp. aureus Mu50
aauaaaaaaccaa

SEQ ID NO: 2054454 - RNA, 13 nt, Staphylococcus aureus subsp. aureus Mu50
aauaaaaaaugca

SEQ ID NO: 2054455 - RNA, 15 nt, Staphylococcus aureus subsp. aureus Mu50
aauaaaaauacauaa

SEQ ID NO: 2054456 - RNA, 17 nt, Staphylococcus aureus subsp. aureus Mu50
aauaaaaacuucuauca

SEQ ID NO: 2054457 - RNA, 16 nt, Staphylococcus aureus subsp. aureus Mu50
aauaaaaaggagcgac

SEQ ID NO: 2054458 - RNA, 18 nt, Staphylococcus aureus subsp. aureus Mu50
aauaaaaaccagcuaaca

SEQ ID NO: 2054459 - RNA, 15 nt, Staphylococcus aureus subsp. aureus Mu50
aauaaaaaaugcacu

SEQ ID NO: 2054460 - RNA, 19 nt, Staphylococcus aureus subsp. aureus Mu50
aagauuagcuaugaagaaa

SEQ ID NO: 2054461 - RNA, 15 nt, Staphylococcus aureus subsp. aureus Mu50
aagauuaugaaaaca

SEQ ID NO: 2054462 - RNA, 16 nt, Staphylococcus aureus subsp. aureus Mu50
aagauuaugaaaacau

SEQ ID NO: 2054463 - RNA, 21 nt, Staphylococcus aureus subsp. aureus Mu50
aagauuaugaaaacauuauua

SEQ ID NO: 2054464 - RNA, 16 nt, Staphylococcus aureus subsp. aureus Mu50
aagaugucgaaaagua

SEQ ID NO: 2054465 - RNA, 21 nt, Staphylococcus aureus subsp. aureus Mu50
aagauguauaugaauuuuaua

SEQ ID NO: 2054466 - RNA, 21 nt, Staphylococcus aureus subsp. aureus Mu50
aagaugcuuuaauuaaaguua

SEQ ID NO: 2054467 - RNA, 18 nt, Staphylococcus aureus subsp. aureus Mu50
aagaugguuuuguuuugc

SEQ ID NO: 2054468 - RNA, 21 nt, Staphylococcus aureus subsp. aureus Mu50
aagauguuugcaacauauuuu

SEQ ID NO: 2054469 - RNA, 23 nt, Staphylococcus aureus subsp. aureus Mu50
aagauguugaguuguaaguuauu

SEQ ID NO: 2054470 - RNA, 20 nt, Staphylococcus aureus subsp. aureus Mu50
aagaugcuuuaauuaaaguu

SEQ ID NO: 2054471 - RNA, 18 nt, Staphylococcus aureus subsp. aureus Mu50
aagaugccucaguuagaa

SEQ ID NO: 2054472 - RNA, 21 nt, Staphylococcus aureus subsp. aureus Mu50
aagaugauuauucucuuuauu

SEQ ID NO: 2054473 - RNA, 21 nt, Staphylococcus aureus subsp. aureus Mu50
aagaucacacgacauguaggu

SEQ ID NO: 2054474 - RNA, 18 nt, Staphylococcus aureus subsp. aureus Mu50
aagaucauuuucaacaua

SEQ ID NO: 2054475 - RNA, 20 nt, Staphylococcus aureus subsp. aureus Mu50
aagauaggauuuacaccuau

SEQ ID NO: 2054476 - RNA, 19 nt, Staphylococcus aureus subsp. aureus Mu50
aagauagaaugaauaauuc

SEQ ID NO: 2054477 - RNA, 22 nt, Staphylococcus aureus subsp. aureus Mu50
aagauagagcccuuagcaauau

SEQ ID NO: 2054478 - RNA, 14 nt, Staphylococcus aureus subsp. aureus Mu50
aagauaauauuaaa

SEQ ID NO: 2054479 - RNA, 13 nt, Staphylococcus aureus subsp. aureus Mu50
aagauauccauua

SEQ ID NO: 2054480 - RNA, 20 nt, Staphylococcus aureus subsp. aureus Mu50
aagauauauaacuaugguca

SEQ ID NO: 2054481 - RNA, 15 nt, Staphylococcus aureus subsp. aureus Mu50
aagauauauuguaag

SEQ ID NO: 2054482 - RNA, 14 nt, Staphylococcus aureus subsp. aureus Mu50
aagauauuuccaaa

SEQ ID NO: 2054483 - RNA, 15 nt, Staphylococcus aureus subsp. aureus Mu50
aagauauaaggaaaa

SEQ ID NO: 2054484 - RNA, 14 nt, Staphylococcus aureus subsp. aureus Mu50
aagauauagaauuc

SEQ ID NO: 2054485 - RNA, 17 nt, Staphylococcus aureus subsp. aureus Mu50
aagauagguuuauuucu

SEQ ID NO: 2054486 - RNA, 20 nt, Staphylococcus aureus subsp. aureus Mu50
aagauaggauuugcaccuau

SEQ ID NO: 2054487 - RNA, 18 nt, Staphylococcus aureus subsp. aureus Mu50
aagcaucuccaauuuaau

SEQ ID NO: 2054488 - RNA, 18 nt, Staphylococcus aureus subsp. aureus Mu50
aagcaucuucaauauuua

SEQ ID NO: 2054489 - RNA, 15 nt, Staphylococcus aureus subsp. aureus Mu50
aagcaucguaaaaaa

SEQ ID NO: 2054490 - RNA, 17 nt, Staphylococcus aureus subsp. aureus Mu50
aagcaucguaaaaaaca

SEQ ID NO: 2054491 - RNA, 18 nt, Staphylococcus aureus subsp. aureus Mu50
aagcaucguaaaaaacaa

SEQ ID NO: 2054492 - RNA, 14 nt, Staphylococcus aureus subsp. aureus Mu50
aagcauauuucuaa

SEQ ID NO: 2054493 - RNA, 14 nt, Staphylococcus aureus subsp. aureus Mu50
aagcaucgaacaau

SEQ ID NO: 2054494 - RNA, 17 nt, Staphylococcus aureus subsp. aureus Mu50
aagcauaccuacagaau

SEQ ID NO: 2054495 - RNA, 11 nt, Staphylococcus aureus subsp. aureus Mu50
aagcauuuguc

SEQ ID NO: 2054496 - RNA, 14 nt, Staphylococcus aureus subsp. aureus Mu50
aagcauuuuucaau

SEQ ID NO: 2054497 - RNA, 20 nt, Staphylococcus aureus subsp. aureus Mu50
aagcauuuuucaauuauagu

SEQ ID NO: 2054498 - RNA, 20 nt, Staphylococcus aureus subsp. aureus Mu50
aagcaugacacucauucaau

SEQ ID NO: 2054499 - RNA, 23 nt, Staphylococcus aureus subsp. aureus Mu50
aagcacgugguugguuaccaucu

SEQ ID NO: 2054500 - RNA, 17 nt, Staphylococcus aureus subsp. aureus Mu50
aagcacagaaaauuaua

SEQ ID NO: 2054501 - RNA, 19 nt, Staphylococcus aureus subsp. aureus Mu50
aagcacagaaaauuauacu

SEQ ID NO: 2054502 - RNA, 14 nt, Staphylococcus aureus subsp. aureus Mu50
aagcaauacgauug

SEQ ID NO: 2054503 - RNA, 23 nt, Staphylococcus aureus subsp. aureus Mu50
aagcaauacgauugcaauugcuu

SEQ ID NO: 2054504 - RNA, 13 nt, Staphylococcus aureus subsp. aureus Mu50
aagcaaucauaau

SEQ ID NO: 2054505 - RNA, 18 nt, Staphylococcus aureus subsp. aureus Mu50
aagcaaucuuaguacaaa

SEQ ID NO: 2054506 - RNA, 13 nt, Staphylococcus aureus subsp. aureus Mu50
aagauaaauaaaa

SEQ ID NO: 2054507 - RNA, 17 nt, Staphylococcus aureus subsp. aureus Mu50
aagagccacuaaugauu

SEQ ID NO: 2054508 - RNA, 19 nt, Staphylococcus aureus subsp. aureus Mu50
aagagguauacaguuaugc

SEQ ID NO: 2054509 - RNA, 21 nt, Staphylococcus aureus subsp. aureus Mu50
aagaggcgccacaacauguuu

SEQ ID NO: 2054510 - RNA, 22 nt, Staphylococcus aureus subsp. aureus Mu50
aagaggacaacuaauaacaaau

SEQ ID NO: 2054511 - RNA, 11 nt, Staphylococcus aureus subsp. aureus Mu50
aagacugccau

SEQ ID NO: 2054512 - RNA, 15 nt, Staphylococcus aureus subsp. aureus Mu50
aagacuucccaaucg

SEQ ID NO: 2054513 - RNA, 12 nt, Staphylococcus aureus subsp. aureus Mu50
aagacuucccua

SEQ ID NO: 2054514 - RNA, 21 nt, Staphylococcus aureus subsp. aureus Mu50
aagacuucccuauauguaggg

SEQ ID NO: 2054515 - RNA, 16 nt, Staphylococcus aureus subsp. aureus Mu50
aagacucaauuucauu

SEQ ID NO: 2054516 - RNA, 21 nt, Staphylococcus aureus subsp. aureus Mu50
aagagauacugguuaguaaaa

SEQ ID NO: 2054517 - RNA, 21 nt, Staphylococcus aureus subsp. aureus Mu50
aagagaaucgaaccaaauuuu

SEQ ID NO: 2054518 - RNA, 17 nt, Staphylococcus aureus subsp. aureus Mu50
aagaauacaugacucca

SEQ ID NO: 2054519 - RNA, 17 nt, Staphylococcus aureus subsp. aureus Mu50
aagaauacaaauauuaa

SEQ ID NO: 2054520 - RNA, 15 nt, Staphylococcus aureus subsp. aureus Mu50
aagaauaaacaacau

SEQ ID NO: 2054521 - RNA, 19 nt, Staphylococcus aureus subsp. aureus Mu50
aagaauaaaaaaguugauu

SEQ ID NO: 2054522 - RNA, 14 nt, Staphylococcus aureus subsp. aureus Mu50
aagaauaaacaaca

SEQ ID NO: 2054523 - RNA, 15 nt, Staphylococcus aureus subsp. aureus Mu50
aagaaguuuccaacg

SEQ ID NO: 2054524 - RNA, 16 nt, Staphylococcus aureus subsp. aureus Mu50
aagaauaaaaaaguug

SEQ ID NO: 2054525 - RNA, 15 nt, Staphylococcus aureus subsp. aureus Mu50
aaauugacucaaaga

SEQ ID NO: 2054526 - RNA, 17 nt, Staphylococcus aureus subsp. aureus Mu50
aaauucuuauaaaauaa

SEQ ID NO: 2054527 - RNA, 18 nt, Staphylococcus aureus subsp. aureus Mu50
aaauucuuuucaagaaau

SEQ ID NO: 2054528 - RNA, 14 nt, Staphylococcus aureus subsp. aureus Mu50
aaauucuuuuguaa

SEQ ID NO: 2054529 - RNA, 11 nt, Staphylococcus aureus subsp. aureus Mu50
aaauucuuuuu

SEQ ID NO: 2054530 - RNA, 13 nt, Staphylococcus aureus subsp. aureus Mu50
aaauugaaauuau

SEQ ID NO: 2054531 - RNA, 20 nt, Staphylococcus aureus subsp. aureus Mu50
aaauucuuauaaaauaaaaa

SEQ ID NO: 2054532 - RNA, 19 nt, Staphylococcus aureus subsp. aureus Mu50
aaauugaccgacaaaacuu

SEQ ID NO: 2054533 - RNA, 15 nt, Staphylococcus aureus subsp. aureus Mu50
aaauugacgcauuaa

SEQ ID NO: 2054534 - RNA, 22 nt, Staphylococcus aureus subsp. aureus Mu50
aaauugaaauguuuaucaauuc

SEQ ID NO: 2054535 - RNA, 13 nt, Staphylococcus aureus subsp. aureus Mu50
aaauugaacuuug

SEQ ID NO: 2054536 - RNA, 18 nt, Staphylococcus aureus subsp. aureus Mu50
aaauugaacuuuguaucu

SEQ ID NO: 2054537 - RNA, 14 nt, Staphylococcus aureus subsp. aureus Mu50
aagaauuaaguagu

SEQ ID NO: 2054538 - RNA, 16 nt, Staphylococcus aureus subsp. aureus Mu50
aagaaugauuuauaaa

SEQ ID NO: 2054539 - RNA, 17 nt, Staphylococcus aureus subsp. aureus Mu50
aagaaugauuuauaaaa

SEQ ID NO: 2054540 - RNA, 22 nt, Staphylococcus aureus subsp. aureus Mu50
aagaaucagcuaaauauuuuac

SEQ ID NO: 2054541 - RNA, 15 nt, Staphylococcus aureus subsp. aureus Mu50
aagaauauaacgaau

SEQ ID NO: 2054542 - RNA, 16 nt, Staphylococcus aureus subsp. aureus Mu50
aagaauuauucaagua

SEQ ID NO: 2054543 - RNA, 13 nt, Staphylococcus aureus subsp. aureus Mu50
aagaauuuaaaag

SEQ ID NO: 2054544 - RNA, 16 nt, Staphylococcus aureus subsp. aureus Mu50
aagaauuuaaaagaga

SEQ ID NO: 2054545 - RNA, 19 nt, Staphylococcus aureus subsp. aureus Mu50
aagaauuucgaaaagaaau

SEQ ID NO: 2054546 - RNA, 20 nt, Staphylococcus aureus subsp. aureus Mu50
aagaauuucgaaaagaaauu

SEQ ID NO: 2054547 - RNA, 17 nt, Staphylococcus aureus subsp. aureus Mu50
aagaauuucgaaaagaa

SEQ ID NO: 2054548 - RNA, 21 nt, Staphylococcus aureus subsp. aureus Mu50
aagaccguauccuguguaaaa

SEQ ID NO: 2054549 - RNA, 16 nt, Staphylococcus aureus subsp. aureus Mu50
aagaccccgaaaagag

SEQ ID NO: 2054550 - RNA, 14 nt, Staphylococcus aureus subsp. aureus Mu50
aagaccauuuuaua

SEQ ID NO: 2054551 - RNA, 15 nt, Staphylococcus aureus subsp. aureus Mu50
aagaccauuuuauau

SEQ ID NO: 2054552 - RNA, 19 nt, Staphylococcus aureus subsp. aureus Mu50
aagaccauuuuauauuuua

SEQ ID NO: 2054553 - RNA, 21 nt, Staphylococcus aureus subsp. aureus Mu50
aagaccauuuuauauuuuagu

SEQ ID NO: 2054554 - RNA, 12 nt, Staphylococcus aureus subsp. aureus Mu50
aagacauaugca

SEQ ID NO: 2054555 - RNA, 22 nt, Staphylococcus aureus subsp. aureus Mu50
aagacauacucacaaaaaacac

SEQ ID NO: 2054556 - RNA, 15 nt, Staphylococcus aureus subsp. aureus Mu50
aagacaugagauuau

SEQ ID NO: 2054557 - RNA, 19 nt, Staphylococcus aureus subsp. aureus Mu50
aagacauacagucaauaca

SEQ ID NO: 2054558 - RNA, 20 nt, Staphylococcus aureus subsp. aureus Mu50
aagacauacagucaauacaa

SEQ ID NO: 2054559 - RNA, 21 nt, Staphylococcus aureus subsp. aureus Mu50
aagacauacucacaaaaaaca

SEQ ID NO: 2054560 - RNA, 13 nt, Staphylococcus aureus subsp. aureus Mu50
aagaccauuuuau

SEQ ID NO: 2054561 - RNA, 22 nt, Staphylococcus aureus subsp. aureus Mu50
aagaccaaauauuuuaucugua

SEQ ID NO: 2054562 - RNA, 16 nt, Staphylococcus aureus subsp. aureus Mu50
aagaccaaauauuuua

SEQ ID NO: 2054563 - RNA, 18 nt, Staphylococcus aureus subsp. aureus Mu50
aaugucgaucuaacaauu

SEQ ID NO: 2054564 - RNA, 22 nt, Staphylococcus aureus subsp. aureus Mu50
aaugucgaucuaacaauugcag

SEQ ID NO: 2054565 - RNA, 20 nt, Staphylococcus aureus subsp. aureus Mu50
aauguccgacuugauaaaaa

SEQ ID NO: 2054566 - RNA, 22 nt, Staphylococcus aureus subsp. aureus Mu50
aauguccgacuugauaaaaaau

SEQ ID NO: 2054567 - RNA, 18 nt, Staphylococcus aureus subsp. aureus Mu50
aauguccgacuugauaaa

SEQ ID NO: 2054568 - RNA, 21 nt, Staphylococcus aureus subsp. aureus Mu50
aauguauugcuauaagaacua

SEQ ID NO: 2054569 - RNA, 15 nt, Staphylococcus aureus subsp. aureus Mu50
aaugugagauauaaa

SEQ ID NO: 2054570 - RNA, 17 nt, Staphylococcus aureus subsp. aureus Mu50
aaugugagauauaaagg

SEQ ID NO: 2054571 - RNA, 19 nt, Staphylococcus aureus subsp. aureus Mu50
aaugucucuuuucacgaau

SEQ ID NO: 2054572 - RNA, 15 nt, Staphylococcus aureus subsp. aureus Mu50
aaugucuuacuuguc

SEQ ID NO: 2054573 - RNA, 21 nt, Staphylococcus aureus subsp. aureus Mu50
aaugucguauauguaaucaga

SEQ ID NO: 2054574 - RNA, 16 nt, Staphylococcus aureus subsp. aureus Mu50
aaugucucuuuucacg

SEQ ID NO: 2054575 - RNA, 15 nt, Staphylococcus aureus subsp. aureus Mu50
aaugucuaaaaaugu

SEQ ID NO: 2054576 - RNA, 22 nt, Staphylococcus aureus subsp. aureus Mu50
aaugucgcacuauaaaauucac

SEQ ID NO: 2054577 - RNA, 14 nt, Staphylococcus aureus subsp. aureus Mu50
aaugucguauaugu

SEQ ID NO: 2054578 - RNA, 22 nt, Staphylococcus aureus subsp. aureus Mu50
aaugggaauuguauuagcaauu

SEQ ID NO: 2054579 - RNA, 15 nt, Staphylococcus aureus subsp. aureus Mu50
aaugggcgugccauu

SEQ ID NO: 2054580 - RNA, 13 nt, Staphylococcus aureus subsp. aureus Mu50
aauguaugauaua

SEQ ID NO: 2054581 - RNA, 15 nt, Staphylococcus aureus subsp. aureus Mu50
aauguauuaaacauu

SEQ ID NO: 2054582 - RNA, 22 nt, Staphylococcus aureus subsp. aureus Mu50
aauguauucuucuaauucugaa

SEQ ID NO: 2054583 - RNA, 13 nt, Staphylococcus aureus subsp. aureus Mu50
aauguaucaccua

SEQ ID NO: 2054584 - RNA, 14 nt, Staphylococcus aureus subsp. aureus Mu50
aauguauaaaaagu

SEQ ID NO: 2054585 - RNA, 17 nt, Staphylococcus aureus subsp. aureus Mu50
aauguauaaauaauaaa

SEQ ID NO: 2054586 - RNA, 15 nt, Staphylococcus aureus subsp. aureus Mu50
aauguauauuuaaca

SEQ ID NO: 2054587 - RNA, 21 nt, Staphylococcus aureus subsp. aureus Mu50
aauguaguuaagauaccuuuu

SEQ ID NO: 2054588 - RNA, 15 nt, Staphylococcus aureus subsp. aureus Mu50
aaugcuguacuauau

SEQ ID NO: 2054589 - RNA, 19 nt, Staphylococcus aureus subsp. aureus Mu50
aauggauuauuaugccuuu

SEQ ID NO: 2054590 - RNA, 20 nt, Staphylococcus aureus subsp. aureus Mu50
aauggauuuggucaaguuuu

SEQ ID NO: 2054591 - RNA, 19 nt, Staphylococcus aureus subsp. aureus Mu50
aaugcucuauauauccauu

SEQ ID NO: 2054592 - RNA, 15 nt, Staphylococcus aureus subsp. aureus Mu50
aaugcucuauauauc

SEQ ID NO: 2054593 - RNA, 20 nt, Staphylococcus aureus subsp. aureus Mu50
aaugcucuauauauccauuc

SEQ ID NO: 2054594 - RNA, 22 nt, Staphylococcus aureus subsp. aureus Mu50
aauggcacuuaauauaaggaag

SEQ ID NO: 2054595 - RNA, 16 nt, Staphylococcus aureus subsp. aureus Mu50
aauggcaaucuauaua

SEQ ID NO: 2054596 - RNA, 19 nt, Staphylococcus aureus subsp. aureus Mu50
aauggcaaucuauauaaau

SEQ ID NO: 2054597 - RNA, 21 nt, Staphylococcus aureus subsp. aureus Mu50
aauggcaaucuauauaaaugu

SEQ ID NO: 2054598 - RNA, 16 nt, Staphylococcus aureus subsp. aureus Mu50
aauggcacuuaauaua

SEQ ID NO: 2054599 - RNA, 23 nt, Staphylococcus aureus subsp. aureus Mu50
aaugccauuguuauccaaaacau

SEQ ID NO: 2054600 - RNA, 13 nt, Staphylococcus aureus subsp. aureus Mu50
aaugccauaccug

SEQ ID NO: 2054601 - RNA, 20 nt, Staphylococcus aureus subsp. aureus Mu50
aaugccauuguuauccaaaa

SEQ ID NO: 2054602 - RNA, 23 nt, Staphylococcus aureus subsp. aureus Mu50
aaugcagauucuucaccaacuuu

SEQ ID NO: 2054603 - RNA, 21 nt, Staphylococcus aureus subsp. aureus Mu50
aaugcacgagcaacaucuuuu

SEQ ID NO: 2054604 - RNA, 16 nt, Staphylococcus aureus subsp. aureus Mu50
aaugcaccugugauaa

SEQ ID NO: 2054605 - RNA, 16 nt, Staphylococcus aureus subsp. aureus Mu50
aaugcuaauuuaacug

SEQ ID NO: 2054606 - RNA, 15 nt, Staphylococcus aureus subsp. aureus Mu50
aaugcuacuauuaaa

SEQ ID NO: 2054607 - RNA, 13 nt, Staphylococcus aureus subsp. aureus Mu50
aaugcuaucaugc

SEQ ID NO: 2054608 - RNA, 12 nt, Staphylococcus aureus subsp. aureus Mu50
aaugcuauauuu

SEQ ID NO: 2054609 - RNA, 14 nt, Staphylococcus aureus subsp. aureus Mu50
aaugcuauauuuag

SEQ ID NO: 2054610 - RNA, 19 nt, Staphylococcus aureus subsp. aureus Mu50
aaugcucccuucaaaguag

SEQ ID NO: 2054611 - RNA, 19 nt, Staphylococcus aureus subsp. aureus Mu50
aauguuacacaaauuaaaa

SEQ ID NO: 2054612 - RNA, 18 nt, Staphylococcus aureus subsp. aureus Mu50
aauguuacacaaauuaaa

SEQ ID NO: 2054613 - RNA, 17 nt, Staphylococcus aureus subsp. aureus Mu50
aauguuaaagauuauua

SEQ ID NO: 2054614 - RNA, 16 nt, Staphylococcus aureus subsp. aureus Mu50
aauguuaaauucuaaa

SEQ ID NO: 2054615 - RNA, 17 nt, Staphylococcus aureus subsp. aureus Mu50
aauguuaaauucuaaaa

SEQ ID NO: 2054616 - RNA, 24 nt, Staphylococcus aureus subsp. aureus Mu50
aauguuaucuugcuuauugauaua

SEQ ID NO: 2054617 - RNA, 22 nt, Staphylococcus aureus subsp. aureus Mu50
aauguuauugcuuauuuuugua

SEQ ID NO: 2054618 - RNA, 16 nt, Staphylococcus aureus subsp. aureus Mu50
aauguuauuaaccauc

SEQ ID NO: 2054619 - RNA, 14 nt, Staphylococcus aureus subsp. aureus Mu50
aauguuauuagaua

SEQ ID NO: 2054620 - RNA, 17 nt, Staphylococcus aureus subsp. aureus Mu50
aauguucaaaaaaugaa

SEQ ID NO: 2054621 - RNA, 23 nt, Staphylococcus aureus subsp. aureus Mu50
aauguguuaauacuucauauccu

SEQ ID NO: 2054622 - RNA, 18 nt, Staphylococcus aureus subsp. aureus Mu50
aauguguacuuaaaaaua

SEQ ID NO: 2054623 - RNA, 23 nt, Staphylococcus aureus subsp. aureus Mu50
aauguguaugguuuuguacauau

SEQ ID NO: 2054624 - RNA, 18 nt, Staphylococcus aureus subsp. aureus Mu50
aauguguuaauacuucau

SEQ ID NO: 2054625 - RNA, 16 nt, Staphylococcus aureus subsp. aureus Mu50
aaugugcuuguaacaa

SEQ ID NO: 2054626 - RNA, 14 nt, Staphylococcus aureus subsp. aureus Mu50
aaugugaugauuaa

SEQ ID NO: 2054627 - RNA, 23 nt, Staphylococcus aureus subsp. aureus Mu50
aauguuguuugcggcuuccucuc

SEQ ID NO: 2054628 - RNA, 11 nt, Staphylococcus aureus subsp. aureus Mu50
aauguugaaug

SEQ ID NO: 2054629 - RNA, 19 nt, Staphylococcus aureus subsp. aureus Mu50
aauguuucuucaauugucu

SEQ ID NO: 2054630 - RNA, 23 nt, Staphylococcus aureus subsp. aureus Mu50
aauguuugaagugauuugccaaa

SEQ ID NO: 2054631 - RNA, 12 nt, Staphylococcus aureus subsp. aureus Mu50
aauguuugcuuu

SEQ ID NO: 2054632 - RNA, 22 nt, Staphylococcus aureus subsp. aureus Mu50
aauguuuaauuuucuaaauaua

SEQ ID NO: 2054633 - RNA, 22 nt, Staphylococcus aureus subsp. aureus Mu50
aauuaaaacagcaaauaaaauc

SEQ ID NO: 2054634 - RNA, 18 nt, Staphylococcus aureus subsp. aureus Mu50
aauuaaaacuauaauaaa

SEQ ID NO: 2054635 - RNA, 23 nt, Staphylococcus aureus subsp. aureus Mu50
aauguuuucagccacugucaugu

SEQ ID NO: 2054636 - RNA, 16 nt, Staphylococcus aureus subsp. aureus Mu50
aauguuuuauguauuu

SEQ ID NO: 2054637 - RNA, 16 nt, Staphylococcus aureus subsp. aureus Mu50
aauguuuuggaaaaau

SEQ ID NO: 2054638 - RNA, 21 nt, Staphylococcus aureus subsp. aureus Mu50
aauuacagcgugauucaucua

SEQ ID NO: 2054639 - RNA, 12 nt, Staphylococcus aureus subsp. aureus Mu50
aauuaauguaau

SEQ ID NO: 2054640 - RNA, 22 nt, Staphylococcus aureus subsp. aureus Mu50
aauuaccaaugaauaaauugau

SEQ ID NO: 2054641 - RNA, 21 nt, Staphylococcus aureus subsp. aureus Mu50
aauuacacccuuuaaauuuaa

SEQ ID NO: 2054642 - RNA, 18 nt, Staphylococcus aureus subsp. aureus Mu50
aauuaaucggaucauuau

SEQ ID NO: 2054643 - RNA, 13 nt, Staphylococcus aureus subsp. aureus Mu50
aauuaaugauaaa

SEQ ID NO: 2054644 - RNA, 16 nt, Staphylococcus aureus subsp. aureus Mu50
aauuaaucaauuuaau

SEQ ID NO: 2054645 - RNA, 15 nt, Staphylococcus aureus subsp. aureus Mu50
aauuaauacaucaau

SEQ ID NO: 2054646 - RNA, 17 nt, Staphylococcus aureus subsp. aureus Mu50
aauuaauacaucaauau

SEQ ID NO: 2054647 - RNA, 22 nt, Staphylococcus aureus subsp. aureus Mu50
aauuaauaacauccccaaaaau

SEQ ID NO: 2054648 - RNA, 19 nt, Staphylococcus aureus subsp. aureus Mu50
aauuaauagagacauuuua

SEQ ID NO: 2054649 - RNA, 14 nt, Staphylococcus aureus subsp. aureus Mu50
aauuacgacaagaa

SEQ ID NO: 2054650 - RNA, 21 nt, Staphylococcus aureus subsp. aureus Mu50
aauuaccguuuauuucgugga

SEQ ID NO: 2054651 - RNA, 20 nt, Staphylococcus aureus subsp. aureus Mu50
aauuacuugaauauuauuca

SEQ ID NO: 2054652 - RNA, 18 nt, Staphylococcus aureus subsp. aureus Mu50
aauuacuuucauuguaaa

SEQ ID NO: 2054653 - RNA, 19 nt, Staphylococcus aureus subsp. aureus Mu50
aauuagaaccaucauucau

SEQ ID NO: 2054654 - RNA, 11 nt, Staphylococcus aureus subsp. aureus Mu50
aauuaauaauu

SEQ ID NO: 2054655 - RNA, 22 nt, Staphylococcus aureus subsp. aureus Mu50
aauuaagaaaaucauucauuug

SEQ ID NO: 2054656 - RNA, 19 nt, Staphylococcus aureus subsp. aureus Mu50
aauuaacuauacuuuuaua

SEQ ID NO: 2054657 - RNA, 14 nt, Staphylococcus aureus subsp. aureus Mu50
aauuaacuugauau

SEQ ID NO: 2054658 - RNA, 22 nt, Staphylococcus aureus subsp. aureus Mu50
aauuaacuuaaaauuuaaauau

SEQ ID NO: 2054659 - RNA, 21 nt, Staphylococcus aureus subsp. aureus Mu50
aauuaaacaagccuuaaaaua

SEQ ID NO: 2054660 - RNA, 15 nt, Staphylococcus aureus subsp. aureus Mu50
aauuaaaauuuguua

SEQ ID NO: 2054661 - RNA, 14 nt, Staphylococcus aureus subsp. aureus Mu50
aauuaaaaaaccug

SEQ ID NO: 2054662 - RNA, 12 nt, Staphylococcus aureus subsp. aureus Mu50
aauuaaaauaac

SEQ ID NO: 2054663 - RNA, 15 nt, Staphylococcus aureus subsp. aureus Mu50
aauuaaauaaugaua

SEQ ID NO: 2054664 - RNA, 15 nt, Staphylococcus aureus subsp. aureus Mu50
aauuaaaguggaaag

SEQ ID NO: 2054665 - RNA, 14 nt, Staphylococcus aureus subsp. aureus Mu50
aauuaaaguuaaag

SEQ ID NO: 2054666 - RNA, 17 nt, Staphylococcus aureus subsp. aureus Mu50
aauuaaagauuaaaaua

SEQ ID NO: 2054667 - RNA, 20 nt, Staphylococcus aureus subsp. aureus Mu50
aaucgauauaaugaaguuau

SEQ ID NO: 2054668 - RNA, 22 nt, Staphylococcus aureus subsp. aureus Mu50
aaucgauuuuauaucuuucuga

SEQ ID NO: 2054669 - RNA, 16 nt, Staphylococcus aureus subsp. aureus Mu50
aaucgcagcaaugaca

SEQ ID NO: 2054670 - RNA, 18 nt, Staphylococcus aureus subsp. aureus Mu50
aaucgugcccauaugauu

SEQ ID NO: 2054671 - RNA, 14 nt, Staphylococcus aureus subsp. aureus Mu50
aaucguuaaggaaa

SEQ ID NO: 2054672 - RNA, 15 nt, Staphylococcus aureus subsp. aureus Mu50
aaucguugaaaaaua

SEQ ID NO: 2054673 - RNA, 20 nt, Staphylococcus aureus subsp. aureus Mu50
aaucggaucauuauuuagaa

SEQ ID NO: 2054674 - RNA, 21 nt, Staphylococcus aureus subsp. aureus Mu50
aaucaucgaacaugaaugaua

SEQ ID NO: 2054675 - RNA, 15 nt, Staphylococcus aureus subsp. aureus Mu50
aauccuuuauauuua

SEQ ID NO: 2054676 - RNA, 12 nt, Staphylococcus aureus subsp. aureus Mu50
aaucaucauugc

SEQ ID NO: 2054677 - RNA, 15 nt, Staphylococcus aureus subsp. aureus Mu50
aaucgaacagaaaau

SEQ ID NO: 2054678 - RNA, 17 nt, Staphylococcus aureus subsp. aureus Mu50
aauccuuuguuuguaag

SEQ ID NO: 2054679 - RNA, 14 nt, Staphylococcus aureus subsp. aureus Mu50
aaucgauaaaaugu

SEQ ID NO: 2054680 - RNA, 17 nt, Staphylococcus aureus subsp. aureus Mu50
aaucgaguuugaaauaa

SEQ ID NO: 2054681 - RNA, 19 nt, Staphylococcus aureus subsp. aureus Mu50
aaucgaaccaaauuuuaua

SEQ ID NO: 2054682 - RNA, 14 nt, Staphylococcus aureus subsp. aureus Mu50
aaucgaacauaaau

SEQ ID NO: 2054683 - RNA, 16 nt, Staphylococcus aureus subsp. aureus Mu50
aaucucuuuacaccau

SEQ ID NO: 2054684 - RNA, 15 nt, Staphylococcus aureus subsp. aureus Mu50
aaucugcaaaugccu

SEQ ID NO: 2054685 - RNA, 16 nt, Staphylococcus aureus subsp. aureus Mu50
aaucuaaacuauaaua

SEQ ID NO: 2054686 - RNA, 15 nt, Staphylococcus aureus subsp. aureus Mu50
aaucguuucaugcac

SEQ ID NO: 2054687 - RNA, 14 nt, Staphylococcus aureus subsp. aureus Mu50
aaucguuugccaua

SEQ ID NO: 2054688 - RNA, 12 nt, Staphylococcus aureus subsp. aureus Mu50
aaucucaaaauu

SEQ ID NO: 2054689 - RNA, 22 nt, Staphylococcus aureus subsp. aureus Mu50
aaucuccauuuaaggauuuccu

SEQ ID NO: 2054690 - RNA, 17 nt, Staphylococcus aureus subsp. aureus Mu50
aaucucauucuuuaaua

SEQ ID NO: 2054691 - RNA, 20 nt, Staphylococcus aureus subsp. aureus Mu50
aaucucauucuuuaauauaa

SEQ ID NO: 2054692 - RNA, 21 nt, Staphylococcus aureus subsp. aureus Mu50
aaugacauuuaauacuuuucu

SEQ ID NO: 2054693 - RNA, 18 nt, Staphylococcus aureus subsp. aureus Mu50
aaugacuaugcaaaugaa

SEQ ID NO: 2054694 - RNA, 15 nt, Staphylococcus aureus subsp. aureus Mu50
aaugaccauugucau

SEQ ID NO: 2054695 - RNA, 20 nt, Staphylococcus aureus subsp. aureus Mu50
aaugaccauugucaugccuu

SEQ ID NO: 2054696 - RNA, 19 nt, Staphylococcus aureus subsp. aureus Mu50
aaugacuucuuuauauuua

SEQ ID NO: 2054697 - RNA, 20 nt, Staphylococcus aureus subsp. aureus Mu50
aaugacuucacauuuauccu

SEQ ID NO: 2054698 - RNA, 14 nt, Staphylococcus aureus subsp. aureus Mu50
aaugacugaauuaa

SEQ ID NO: 2054699 - RNA, 23 nt, Staphylococcus aureus subsp. aureus Mu50
aaugacuauaacaccaauuaaau

SEQ ID NO: 2054700 - RNA, 21 nt, Staphylococcus aureus subsp. aureus Mu50
aaugacugaauuaauauccaa

SEQ ID NO: 2054701 - RNA, 14 nt, Staphylococcus aureus subsp. aureus Mu50
aaugauaauuuaau

SEQ ID NO: 2054702 - RNA, 16 nt, Staphylococcus aureus subsp. aureus Mu50
aaugauaauccaccaa

SEQ ID NO: 2054703 - RNA, 18 nt, Staphylococcus aureus subsp. aureus Mu50
aaugagugcuuauuuguu

SEQ ID NO: 2054704 - RNA, 21 nt, Staphylococcus aureus subsp. aureus Mu50
aaugcaauacauuaauauaaa

SEQ ID NO: 2054705 - RNA, 15 nt, Staphylococcus aureus subsp. aureus Mu50
aaugauugcauugau

SEQ ID NO: 2054706 - RNA, 22 nt, Staphylococcus aureus subsp. aureus Mu50
aaugauugucuuauaagauaua

SEQ ID NO: 2054707 - RNA, 12 nt, Staphylococcus aureus subsp. aureus Mu50
aaugauuauaaa

SEQ ID NO: 2054708 - RNA, 17 nt, Staphylococcus aureus subsp. aureus Mu50
aaugauuaaaaaucaaa

SEQ ID NO: 2054709 - RNA, 14 nt, Staphylococcus aureus subsp. aureus Mu50
aaugauuauaaaua

SEQ ID NO: 2054710 - RNA, 17 nt, Staphylococcus aureus subsp. aureus Mu50
aaugauuauaaauacau

SEQ ID NO: 2054711 - RNA, 21 nt, Staphylococcus aureus subsp. aureus Mu50
aaugauucuuaucuuuaauca

SEQ ID NO: 2054712 - RNA, 23 nt, Staphylococcus aureus subsp. aureus Mu50
aaugauucuuaucuuuaaucaaa

SEQ ID NO: 2054713 - RNA, 22 nt, Staphylococcus aureus subsp. aureus Mu50
aaugauugaauauuguuguaaa

SEQ ID NO: 2054714 - RNA, 15 nt, Staphylococcus aureus subsp. aureus Mu50
aaugauagugaauaa

SEQ ID NO: 2054715 - RNA, 19 nt, Staphylococcus aureus subsp. aureus Mu50
aaugauagaugcuggcuua

SEQ ID NO: 2054716 - RNA, 14 nt, Staphylococcus aureus subsp. aureus Mu50
aaugaagaauacaa

SEQ ID NO: 2054717 - RNA, 15 nt, Staphylococcus aureus subsp. aureus Mu50
aaugaagaauacaaa

SEQ ID NO: 2054718 - RNA, 19 nt, Staphylococcus aureus subsp. aureus Mu50
aaugaagaauacaaauauu

SEQ ID NO: 2054719 - RNA, 14 nt, Staphylococcus aureus subsp. aureus Mu50
aaucuuuauuaaua

SEQ ID NO: 2054720 - RNA, 14 nt, Staphylococcus aureus subsp. aureus Mu50
aaucuuuaucaguu

SEQ ID NO: 2054721 - RNA, 15 nt, Staphylococcus aureus subsp. aureus Mu50
aaucuuuaucaguuu

SEQ ID NO: 2054722 - RNA, 19 nt, Staphylococcus aureus subsp. aureus Mu50
aaucuuguugaacucugau

SEQ ID NO: 2054723 - RNA, 21 nt, Staphylococcus aureus subsp. aureus Mu50
aaucuuuacuuguaauuaaua

SEQ ID NO: 2054724 - RNA, 16 nt, Staphylococcus aureus subsp. aureus Mu50
aaucuugauuauauuu

SEQ ID NO: 2054725 - RNA, 23 nt, Staphylococcus aureus subsp. aureus Mu50
aaucuucuccaaucaucauuaaa

SEQ ID NO: 2054726 - RNA, 20 nt, Staphylococcus aureus subsp. aureus Mu50
aaucugcaacgauuuuaaaa

SEQ ID NO: 2054727 - RNA, 19 nt, Staphylococcus aureus subsp. aureus Mu50
aaucugcaacgauuuuaaa

SEQ ID NO: 2054728 - RNA, 21 nt, Staphylococcus aureus subsp. aureus Mu50
aaucugcuuuauuuuaucauc

SEQ ID NO: 2054729 - RNA, 13 nt, Staphylococcus aureus subsp. aureus Mu50
aaucacaauauaa

SEQ ID NO: 2054730 - RNA, 15 nt, Staphylococcus aureus subsp. aureus Mu50
aaucacaguuauaua

SEQ ID NO: 2054731 - RNA, 22 nt, Staphylococcus aureus subsp. aureus Mu50
aaucacauuaauuggauuaaau

SEQ ID NO: 2054732 - RNA, 13 nt, Staphylococcus aureus subsp. aureus Mu50
aaucaauuauuga

SEQ ID NO: 2054733 - RNA, 18 nt, Staphylococcus aureus subsp. aureus Mu50
aaucaagucugcauuaau

SEQ ID NO: 2054734 - RNA, 19 nt, Staphylococcus aureus subsp. aureus Mu50
aaucaagcaaugcaugcuu

SEQ ID NO: 2054735 - RNA, 12 nt, Staphylococcus aureus subsp. aureus Mu50
aaucaagaauau

SEQ ID NO: 2054736 - RNA, 19 nt, Staphylococcus aureus subsp. aureus Mu50
aaucaacguauauaaguua

SEQ ID NO: 2054737 - RNA, 15 nt, Staphylococcus aureus subsp. aureus Mu50
aaucaagaaauguua

SEQ ID NO: 2054738 - RNA, 20 nt, Staphylococcus aureus subsp. aureus Mu50
aaucagugaaauaucaagau

SEQ ID NO: 2054739 - RNA, 16 nt, Staphylococcus aureus subsp. aureus Mu50
aaucagaugauuuaau

SEQ ID NO: 2054740 - RNA, 15 nt, Staphylococcus aureus subsp. aureus Mu50
aaucacgauuuucaa

SEQ ID NO: 2054741 - RNA, 15 nt, Staphylococcus aureus subsp. aureus Mu50
aaucacgcuaacauu

SEQ ID NO: 2054742 - RNA, 20 nt, Staphylococcus aureus subsp. aureus Mu50
aaucacuaucuguuguuaua

SEQ ID NO: 2054743 - RNA, 21 nt, Staphylococcus aureus subsp. aureus Mu50
aaucacuccucuauuuuauga

SEQ ID NO: 2054744 - RNA, 15 nt, Staphylococcus aureus subsp. aureus Mu50
aaucaccuuuggcua

SEQ ID NO: 2054745 - RNA, 19 nt, Staphylococcus aureus subsp. aureus Mu50
aauauuuuucaauuaaaug

SEQ ID NO: 2054746 - RNA, 22 nt, Staphylococcus aureus subsp. aureus Mu50
aauauuuucuuagaaaaucaag

SEQ ID NO: 2054747 - RNA, 23 nt, Staphylococcus aureus subsp. aureus Mu50
aauauuuuucaauuaaauguuua

SEQ ID NO: 2054748 - RNA, 13 nt, Staphylococcus aureus subsp. aureus Mu50
aauauuuuuuaaa

SEQ ID NO: 2054749 - RNA, 16 nt, Staphylococcus aureus subsp. aureus Mu50
aauauuuuuuaaaaug

SEQ ID NO: 2054750 - RNA, 17 nt, Staphylococcus aureus subsp. aureus Mu50
aauauuuuuuaaaauga

SEQ ID NO: 2054751 - RNA, 21 nt, Staphylococcus aureus subsp. aureus Mu50
aauauuuauuguuuuuaaaau

SEQ ID NO: 2054752 - RNA, 17 nt, Staphylococcus aureus subsp. aureus Mu50
aauauuuauauuaaaua

SEQ ID NO: 2054753 - RNA, 19 nt, Staphylococcus aureus subsp. aureus Mu50
aauauuuauauuaaauacu

SEQ ID NO: 2054754 - RNA, 22 nt, Staphylococcus aureus subsp. aureus Mu50
aauauuuauauuaaauacuaua

SEQ ID NO: 2054755 - RNA, 21 nt, Staphylococcus aureus subsp. aureus Mu50
aauauuuaucaauaaaucagu

SEQ ID NO: 2054756 - RNA, 23 nt, Staphylococcus aureus subsp. aureus Mu50
aauauuuaucaauaaaucaguag

SEQ ID NO: 2054757 - RNA, 15 nt, Staphylococcus aureus subsp. aureus Mu50
aauauuucuuaccau

SEQ ID NO: 2054758 - RNA, 21 nt, Staphylococcus aureus subsp. aureus Mu50
aauauuucuuagauacucacu

SEQ ID NO: 2054759 - RNA, 17 nt, Staphylococcus aureus subsp. aureus Mu50
aauauuucuaaaccauu

SEQ ID NO: 2054760 - RNA, 20 nt, Staphylococcus aureus subsp. aureus Mu50
aauauuucccuaugaaauaa

SEQ ID NO: 2054761 - RNA, 22 nt, Staphylococcus aureus subsp. aureus Mu50
aauauuugauaaguagaaaaua

SEQ ID NO: 2054762 - RNA, 15 nt, Staphylococcus aureus subsp. aureus Mu50
aauauuugaaaauuu

SEQ ID NO: 2054763 - RNA, 22 nt, Staphylococcus aureus subsp. aureus Mu50
aauauuugaacgagcaccuuuu

SEQ ID NO: 2054764 - RNA, 23 nt, Staphylococcus aureus subsp. aureus Mu50
aaucaaaaauaauuaugaaaagu

SEQ ID NO: 2054765 - RNA, 21 nt, Staphylococcus aureus subsp. aureus Mu50
aaucaaagaggcacagcggaa

SEQ ID NO: 2054766 - RNA, 20 nt, Staphylococcus aureus subsp. aureus Mu50
aaucaaagaggcuuuaaaau

SEQ ID NO: 2054767 - RNA, 21 nt, Staphylococcus aureus subsp. aureus Mu50
aaucaaagaggcuuuaaaauu

SEQ ID NO: 2054768 - RNA, 17 nt, Staphylococcus aureus subsp. aureus Mu50
aaucaacaguuuuauua

SEQ ID NO: 2054769 - RNA, 21 nt, Staphylococcus aureus subsp. aureus Mu50
aaucaacaucaucuuuaauuu

SEQ ID NO: 2054770 - RNA, 22 nt, Staphylococcus aureus subsp. aureus Mu50
aaucaaaguucguaauugucuu

SEQ ID NO: 2054771 - RNA, 20 nt, Staphylococcus aureus subsp. aureus Mu50
aaucaaauuagucauccaaa

SEQ ID NO: 2054772 - RNA, 22 nt, Staphylococcus aureus subsp. aureus Mu50
aauauucuaugcucuacgaagu

SEQ ID NO: 2054773 - RNA, 18 nt, Staphylococcus aureus subsp. aureus Mu50
aauauugaacaauuuuug

SEQ ID NO: 2054774 - RNA, 12 nt, Staphylococcus aureus subsp. aureus Mu50
aauauugaauaa

SEQ ID NO: 2054775 - RNA, 17 nt, Staphylococcus aureus subsp. aureus Mu50
aauauugaauaaucauc

SEQ ID NO: 2054776 - RNA, 14 nt, Staphylococcus aureus subsp. aureus Mu50
aauauugaugaaua

SEQ ID NO: 2054777 - RNA, 19 nt, Staphylococcus aureus subsp. aureus Mu50
aauauuggaauacucuuca

SEQ ID NO: 2054778 - RNA, 21 nt, Staphylococcus aureus subsp. aureus Mu50
aauauuuacauugccacuuuu

SEQ ID NO: 2054779 - RNA, 18 nt, Staphylococcus aureus subsp. aureus Mu50
aauauuuaaccuuuaaaa

SEQ ID NO: 2054780 - RNA, 14 nt, Staphylococcus aureus subsp. aureus Mu50
aauauuuaaguuuc

SEQ ID NO: 2054781 - RNA, 17 nt, Staphylococcus aureus subsp. aureus Mu50
aauauuuaaaauauuau

SEQ ID NO: 2054782 - RNA, 16 nt, Staphylococcus aureus subsp. aureus Mu50
aauauuuaaauuuuaa

SEQ ID NO: 2054783 - RNA, 18 nt, Staphylococcus aureus subsp. aureus Mu50
aauauuaauauaaaauaa

SEQ ID NO: 2054784 - RNA, 18 nt, Staphylococcus aureus subsp. aureus Mu50
aauauuauuaaaucaaag

SEQ ID NO: 2054785 - RNA, 18 nt, Staphylococcus aureus subsp. aureus Mu50
aauauuauucauaauaua

SEQ ID NO: 2054786 - RNA, 13 nt, Staphylococcus aureus subsp. aureus Mu50
aauauuauuuuua

SEQ ID NO: 2054787 - RNA, 20 nt, Staphylococcus aureus subsp. aureus Mu50
aauauuauaaguugcauaua

SEQ ID NO: 2054788 - RNA, 12 nt, Staphylococcus aureus subsp. aureus Mu50
aauauuauaagu

SEQ ID NO: 2054789 - RNA, 23 nt, Staphylococcus aureus subsp. aureus Mu50
aauaugauguuaaaaaauaugua

SEQ ID NO: 2054790 - RNA, 18 nt, Staphylococcus aureus subsp. aureus Mu50
aauaugauugcaaauuau

SEQ ID NO: 2054791 - RNA, 17 nt, Staphylococcus aureus subsp. aureus Mu50
aauaugauguuaaaaaa

SEQ ID NO: 2054792 - RNA, 14 nt, Staphylococcus aureus subsp. aureus Mu50
aauaugauauuaag

SEQ ID NO: 2054793 - RNA, 21 nt, Staphylococcus aureus subsp. aureus Mu50
aauaugauccuuuaaugcuuu

SEQ ID NO: 2054794 - RNA, 18 nt, Staphylococcus aureus subsp. aureus Mu50
aauaugauaacucguaau

SEQ ID NO: 2054795 - RNA, 22 nt, Staphylococcus aureus subsp. aureus Mu50
aauaugagugaaaguuugaagg

SEQ ID NO: 2054796 - RNA, 13 nt, Staphylococcus aureus subsp. aureus Mu50
aauaugacacaua

SEQ ID NO: 2054797 - RNA, 22 nt, Staphylococcus aureus subsp. aureus Mu50
aauaugaaucuagaauauaaca

SEQ ID NO: 2054798 - RNA, 14 nt, Staphylococcus aureus subsp. aureus Mu50
aauaucaagauguu

SEQ ID NO: 2054799 - RNA, 13 nt, Staphylococcus aureus subsp. aureus Mu50
aauaucaaaauau

SEQ ID NO: 2054800 - RNA, 14 nt, Staphylococcus aureus subsp. aureus Mu50
aauauauuuuaugu

SEQ ID NO: 2054801 - RNA, 13 nt, Staphylococcus aureus subsp. aureus Mu50
aauauauuuauuu

SEQ ID NO: 2054802 - RNA, 16 nt, Staphylococcus aureus subsp. aureus Mu50
aauauauuuauuuuug

SEQ ID NO: 2054803 - RNA, 19 nt, Staphylococcus aureus subsp. aureus Mu50
aauauauguauaacauuau

SEQ ID NO: 2054804 - RNA, 20 nt, Staphylococcus aureus subsp. aureus Mu50
aauauauguauaacauuauu

SEQ ID NO: 2054805 - RNA, 22 nt, Staphylococcus aureus subsp. aureus Mu50
aauauauuaacaacuuuauuau

SEQ ID NO: 2054806 - RNA, 22 nt, Staphylococcus aureus subsp. aureus Mu50
aauauauuagugauauuuuucg

SEQ ID NO: 2054807 - RNA, 22 nt, Staphylococcus aureus subsp. aureus Mu50
aauauauucggcaaaagauguu

SEQ ID NO: 2054808 - RNA, 21 nt, Staphylococcus aureus subsp. aureus Mu50
aauauaacaacuacuuaaauu

SEQ ID NO: 2054809 - RNA, 16 nt, Staphylococcus aureus subsp. aureus Mu50
aauauaacaucaaaua

SEQ ID NO: 2054810 - RNA, 16 nt, Staphylococcus aureus subsp. aureus Mu50
aauauaaguaaucaua

SEQ ID NO: 2054811 - RNA, 14 nt, Staphylococcus aureus subsp. aureus Mu50
aauauaaaacgaua

SEQ ID NO: 2054812 - RNA, 19 nt, Staphylococcus aureus subsp. aureus Mu50
aauauaaaaaagaucacug

SEQ ID NO: 2054813 - RNA, 12 nt, Staphylococcus aureus subsp. aureus Mu50
aauauaaaauaa

SEQ ID NO: 2054814 - RNA, 15 nt, Staphylococcus aureus subsp. aureus Mu50
aauauaaaauaaagu

SEQ ID NO: 2054815 - RNA, 20 nt, Staphylococcus aureus subsp. aureus Mu50
aauaucgauuuuggcacaua

SEQ ID NO: 2054816 - RNA, 18 nt, Staphylococcus aureus subsp. aureus Mu50
aauaucaaaauauaaaau

SEQ ID NO: 2054817 - RNA, 14 nt, Staphylococcus aureus subsp. aureus Mu50
aauaucaauuuuua

SEQ ID NO: 2054818 - RNA, 22 nt, Staphylococcus aureus subsp. aureus Mu50
aauaucuucuucuaaccacuuc

SEQ ID NO: 2054819 - RNA, 18 nt, Staphylococcus aureus subsp. aureus Mu50
aauaugaacaaaaaauaa

SEQ ID NO: 2054820 - RNA, 23 nt, Staphylococcus aureus subsp. aureus Mu50
aauaugaacaaaaaauaaaaacu

SEQ ID NO: 2054821 - RNA, 14 nt, Staphylococcus aureus subsp. aureus Mu50
aauaucuaaagauu

SEQ ID NO: 2054822 - RNA, 14 nt, Staphylococcus aureus subsp. aureus Mu50
aauaucuuacugcu

SEQ ID NO: 2054823 - RNA, 23 nt, Staphylococcus aureus subsp. aureus Mu50
aauaucuucguguccuagacgau

SEQ ID NO: 2054824 - RNA, 13 nt, Staphylococcus aureus subsp. aureus Mu50
aauaucuugucau

SEQ ID NO: 2054825 - RNA, 16 nt, Staphylococcus aureus subsp. aureus Mu50
aauaucuaaacaauuc

SEQ ID NO: 2054826 - RNA, 20 nt, Staphylococcus aureus subsp. aureus Mu50
aauagguucauuauuuaaau

SEQ ID NO: 2054827 - RNA, 14 nt, Staphylococcus aureus subsp. aureus Mu50
aauaguaaagugaa

SEQ ID NO: 2054828 - RNA, 13 nt, Staphylococcus aureus subsp. aureus Mu50
aauaggaauacca

SEQ ID NO: 2054829 - RNA, 20 nt, Staphylococcus aureus subsp. aureus Mu50
aauagcuuucguuucuuuua

SEQ ID NO: 2054830 - RNA, 22 nt, Staphylococcus aureus subsp. aureus Mu50
aauagcuuucguuucuuuuaua

SEQ ID NO: 2054831 - RNA, 15 nt, Staphylococcus aureus subsp. aureus Mu50
aauaguuucaaugcc

SEQ ID NO: 2054832 - RNA, 17 nt, Staphylococcus aureus subsp. aureus Mu50
aauaguucuuuaaauua

SEQ ID NO: 2054833 - RNA, 18 nt, Staphylococcus aureus subsp. aureus Mu50
aauaguucuuuaaauuau

SEQ ID NO: 2054834 - RNA, 21 nt, Staphylococcus aureus subsp. aureus Mu50
aauaguucuuuaaauuauaua

SEQ ID NO: 2054835 - RNA, 18 nt, Staphylococcus aureus subsp. aureus Mu50
aauaguaaagugaaauaa

SEQ ID NO: 2054836 - RNA, 18 nt, Staphylococcus aureus subsp. aureus Mu50
aauagucaauuaaugaua

SEQ ID NO: 2054837 - RNA, 19 nt, Staphylococcus aureus subsp. aureus Mu50
aauagacugccaauaaaau

SEQ ID NO: 2054838 - RNA, 20 nt, Staphylococcus aureus subsp. aureus Mu50
aauagacugccaauaaaaug

SEQ ID NO: 2054839 - RNA, 18 nt, Staphylococcus aureus subsp. aureus Mu50
aauagcuauaacucuaaa

SEQ ID NO: 2054840 - RNA, 21 nt, Staphylococcus aureus subsp. aureus Mu50
aauagcuauaacucuaaauau

SEQ ID NO: 2054841 - RNA, 17 nt, Staphylococcus aureus subsp. aureus Mu50
aauagcuauauuuaaaa

SEQ ID NO: 2054842 - RNA, 14 nt, Staphylococcus aureus subsp. aureus Mu50
aauagcuauauuuu

SEQ ID NO: 2054843 - RNA, 23 nt, Staphylococcus aureus subsp. aureus Mu50
aauagcuauauuuuuguauuuau

SEQ ID NO: 2054844 - RNA, 15 nt, Staphylococcus aureus subsp. aureus Mu50
aauagcuauuaaaau

SEQ ID NO: 2054845 - RNA, 19 nt, Staphylococcus aureus subsp. aureus Mu50
aauaccauugugaugauaa

SEQ ID NO: 2054846 - RNA, 17 nt, Staphylococcus aureus subsp. aureus Mu50
aauaccauaauuaaaua

SEQ ID NO: 2054847 - RNA, 13 nt, Staphylococcus aureus subsp. aureus Mu50
aauaccuuuuucu

SEQ ID NO: 2054848 - RNA, 15 nt, Staphylococcus aureus subsp. aureus Mu50
aauaccuuuuucuaa

SEQ ID NO: 2054849 - RNA, 20 nt, Staphylococcus aureus subsp. aureus Mu50
aauaccuuuuucuaaaccaa

SEQ ID NO: 2054850 - RNA, 23 nt, Staphylococcus aureus subsp. aureus Mu50
aauaccuuugccguauuucaaau

SEQ ID NO: 2054851 - RNA, 20 nt, Staphylococcus aureus subsp. aureus Mu50
aauaccuuugccguauuuca

SEQ ID NO: 2054852 - RNA, 19 nt, Staphylococcus aureus subsp. aureus Mu50
aauacguuuaauaaugguu

SEQ ID NO: 2054853 - RNA, 17 nt, Staphylococcus aureus subsp. aureus Mu50
aauacguguguuuucuu

SEQ ID NO: 2054854 - RNA, 21 nt, Staphylococcus aureus subsp. aureus Mu50
aauacguguguuuucuuuuca

SEQ ID NO: 2054855 - RNA, 22 nt, Staphylococcus aureus subsp. aureus Mu50
aauacguaucaagaaaaaguuu

SEQ ID NO: 2054856 - RNA, 13 nt, Staphylococcus aureus subsp. aureus Mu50
aauacgaaguuuc

SEQ ID NO: 2054857 - RNA, 15 nt, Staphylococcus aureus subsp. aureus Mu50
aauacgaguggauac

SEQ ID NO: 2054858 - RNA, 21 nt, Staphylococcus aureus subsp. aureus Mu50
aauacgaguggauacuauacu

SEQ ID NO: 2054859 - RNA, 21 nt, Staphylococcus aureus subsp. aureus Mu50
aauacgaguguuuuaaucuua

SEQ ID NO: 2054860 - RNA, 21 nt, Staphylococcus aureus subsp. aureus Mu50
aauacgaugaugauuuauaaa

SEQ ID NO: 2054861 - RNA, 19 nt, Staphylococcus aureus subsp. aureus Mu50
aauacuugaauuuaauaag

SEQ ID NO: 2054862 - RNA, 21 nt, Staphylococcus aureus subsp. aureus Mu50
aauagaacgaaauaguucaaa

SEQ ID NO: 2054863 - RNA, 19 nt, Staphylococcus aureus subsp. aureus Mu50
aauacuucuuguucgauaa

SEQ ID NO: 2054864 - RNA, 20 nt, Staphylococcus aureus subsp. aureus Mu50
aauacuugaaagauuuguag

SEQ ID NO: 2054865 - RNA, 13 nt, Staphylococcus aureus subsp. aureus Mu50
aauacuucguuau

SEQ ID NO: 2054866 - RNA, 14 nt, Staphylococcus aureus subsp. aureus Mu50
aauacuucaccaca

SEQ ID NO: 2054867 - RNA, 16 nt, Staphylococcus aureus subsp. aureus Mu50
aauacuucaccacaua

SEQ ID NO: 2054868 - RNA, 19 nt, Staphylococcus aureus subsp. aureus Mu50
aauacuguuuaaauaaaau

SEQ ID NO: 2054869 - RNA, 14 nt, Staphylococcus aureus subsp. aureus Mu50
aauacucaguuuau

SEQ ID NO: 2054870 - RNA, 15 nt, Staphylococcus aureus subsp. aureus Mu50
aauacucaguuuauu

SEQ ID NO: 2054871 - RNA, 19 nt, Staphylococcus aureus subsp. aureus Mu50
aauacuauacugaugaaaa

SEQ ID NO: 2054872 - RNA, 14 nt, Staphylococcus aureus subsp. aureus Mu50
aauacuauaugaaa

SEQ ID NO: 2054873 - RNA, 19 nt, Staphylococcus aureus subsp. aureus Mu50
aauacuauaugaaaagaga

SEQ ID NO: 2054874 - RNA, 18 nt, Staphylococcus aureus subsp. aureus Mu50
aauacuaacugaagacac

SEQ ID NO: 2054875 - RNA, 14 nt, Staphylococcus aureus subsp. aureus Mu50
aauacuaagauuag

SEQ ID NO: 2054876 - RNA, 17 nt, Staphylococcus aureus subsp. aureus Mu50
aauacuaccuuccauuu

SEQ ID NO: 2054877 - RNA, 16 nt, Staphylococcus aureus subsp. aureus Mu50
aauacauuucaaaaaa

SEQ ID NO: 2054878 - RNA, 15 nt, Staphylococcus aureus subsp. aureus Mu50
aauacauuuugcucu

SEQ ID NO: 2054879 - RNA, 17 nt, Staphylococcus aureus subsp. aureus Mu50
aauacauuucaaaaaaa

SEQ ID NO: 2054880 - RNA, 19 nt, Staphylococcus aureus subsp. aureus Mu50
aauacaugugggauaucuu

SEQ ID NO: 2054881 - RNA, 18 nt, Staphylococcus aureus subsp. aureus Mu50
aauacaucuaauaaauau

SEQ ID NO: 2054882 - RNA, 14 nt, Staphylococcus aureus subsp. aureus Mu50
aauacaucaucaag

SEQ ID NO: 2054883 - RNA, 16 nt, Staphylococcus aureus subsp. aureus Mu50
aauacauacugauuaa

SEQ ID NO: 2054884 - RNA, 13 nt, Staphylococcus aureus subsp. aureus Mu50
aauacauacugau

SEQ ID NO: 2054885 - RNA, 18 nt, Staphylococcus aureus subsp. aureus Mu50
aauacauagguucaucuu

SEQ ID NO: 2054886 - RNA, 21 nt, Staphylococcus aureus subsp. aureus Mu50
aauacauacugauuaaacugu

SEQ ID NO: 2054887 - RNA, 16 nt, Staphylococcus aureus subsp. aureus Mu50
aauacacuugauaaaa

SEQ ID NO: 2054888 - RNA, 18 nt, Staphylococcus aureus subsp. aureus Mu50
aauacacuugauaaaacu

SEQ ID NO: 2054889 - RNA, 19 nt, Staphylococcus aureus subsp. aureus Mu50
aauacacuugauaaaacua

SEQ ID NO: 2054890 - RNA, 23 nt, Staphylococcus aureus subsp. aureus Mu50
aauacacuugauaaaacuaauga

SEQ ID NO: 2054891 - RNA, 16 nt, Staphylococcus aureus subsp. aureus Mu50
aauacaaauauaucua

SEQ ID NO: 2054892 - RNA, 19 nt, Staphylococcus aureus subsp. aureus Mu50
aauacaagucuuuacucua

SEQ ID NO: 2054893 - RNA, 21 nt, Staphylococcus aureus subsp. aureus Mu50
aauacacgaucaguugaguca

SEQ ID NO: 2054894 - RNA, 20 nt, Staphylococcus aureus subsp. aureus Mu50
aauacacgacgcuaaacaaa

SEQ ID NO: 2054895 - RNA, 21 nt, Staphylococcus aureus subsp. aureus Mu50
aauacacgacgcuaaacaaag

SEQ ID NO: 2054896 - RNA, 22 nt, Staphylococcus aureus subsp. aureus Mu50
aauacacgacgcuaaacaaagg

SEQ ID NO: 2054897 - RNA, 20 nt, Staphylococcus aureus subsp. aureus Mu50
aauacaauuucuucauuuuc

SEQ ID NO: 2054898 - RNA, 19 nt, Staphylococcus aureus subsp. aureus Mu50
aauacaauuucuucauuuu

SEQ ID NO: 2054899 - RNA, 18 nt, Staphylococcus aureus subsp. aureus Mu50
aauaaagcaauguugcau

SEQ ID NO: 2054900 - RNA, 22 nt, Staphylococcus aureus subsp. aureus Mu50
aauaaagcguccucuugugaaa

SEQ ID NO: 2054901 - RNA, 14 nt, Staphylococcus aureus subsp. aureus Mu50
aauacaaagaauua

SEQ ID NO: 2054902 - RNA, 22 nt, Staphylococcus aureus subsp. aureus Mu50
aauacaaagccuuaauaucaug

SEQ ID NO: 2054903 - RNA, 16 nt, Staphylococcus aureus subsp. aureus Mu50
aaauuauuguuuuaau

SEQ ID NO: 2054904 - RNA, 23 nt, Staphylococcus aureus subsp. aureus Mu50
aaauuauuuauucauuauagucu

SEQ ID NO: 2054905 - RNA, 20 nt, Staphylococcus aureus subsp. aureus Mu50
aaauuauugaauuugaauaa

SEQ ID NO: 2054906 - RNA, 19 nt, Staphylococcus aureus subsp. aureus Mu50
aaauuauugaauuugaaua

SEQ ID NO: 2054907 - RNA, 12 nt, Staphylococcus aureus subsp. aureus Mu50
aaauuauauuua

SEQ ID NO: 2054908 - RNA, 13 nt, Staphylococcus aureus subsp. aureus Mu50
aaauuaugacuaa

SEQ ID NO: 2054909 - RNA, 13 nt, Staphylococcus aureus subsp. aureus Mu50
aaauuauuauuua

SEQ ID NO: 2054910 - RNA, 18 nt, Staphylococcus aureus subsp. aureus Mu50
aaauuaugauuauauuuu

SEQ ID NO: 2054911 - RNA, 20 nt, Staphylococcus aureus subsp. aureus Mu50
aaauuaugacuuauuuuuca

SEQ ID NO: 2054912 - RNA, 13 nt, Staphylococcus aureus subsp. aureus Mu50
aaauuaugauuau

SEQ ID NO: 2054913 - RNA, 15 nt, Staphylococcus aureus subsp. aureus Mu50
aaauuagucauccaa

SEQ ID NO: 2054914 - RNA, 18 nt, Staphylococcus aureus subsp. aureus Mu50
aaauuaggcauucaucua

SEQ ID NO: 2054915 - RNA, 20 nt, Staphylococcus aureus subsp. aureus Mu50
aaauuagauuuuaugcuuua

SEQ ID NO: 2054916 - RNA, 22 nt, Staphylococcus aureus subsp. aureus Mu50
aaauuagcaagugaguaacauu

SEQ ID NO: 2054917 - RNA, 13 nt, Staphylococcus aureus subsp. aureus Mu50
aaauuauauaaau

SEQ ID NO: 2054918 - RNA, 15 nt, Staphylococcus aureus subsp. aureus Mu50
aaauuauauagaaaa

SEQ ID NO: 2054919 - RNA, 14 nt, Staphylococcus aureus subsp. aureus Mu50
aaauuaucagaauc

SEQ ID NO: 2054920 - RNA, 22 nt, Staphylococcus aureus subsp. aureus Mu50
aaauuauaaauuugguacauaa

SEQ ID NO: 2054921 - RNA, 18 nt, Staphylococcus aureus subsp. aureus Mu50
aaauuauacaaauuauaa

SEQ ID NO: 2054922 - RNA, 23 nt, Staphylococcus aureus subsp. aureus Mu50
uuuuuuuauaaguuaaaaaugua

SEQ ID NO: 2054923 - RNA, 12 nt, Staphylococcus aureus subsp. aureus Mu50
aaauuaaugaac

SEQ ID NO: 2054924 - RNA, 13 nt, Staphylococcus aureus subsp. aureus Mu50
uuuuuuccuuucu

SEQ ID NO: 2054925 - RNA, 15 nt, Staphylococcus aureus subsp. aureus Mu50
uuuuuucauuucuuu

SEQ ID NO: 2054926 - RNA, 17 nt, Staphylococcus aureus subsp. aureus Mu50
aaauuacaaauuaucua

SEQ ID NO: 2054927 - RNA, 21 nt, Staphylococcus aureus subsp. aureus Mu50
aaauuacaacuuuuagaguuu

SEQ ID NO: 2054928 - RNA, 12 nt, Staphylococcus aureus subsp. aureus Mu50
aaauuacuaacg

SEQ ID NO: 2054929 - RNA, 16 nt, Staphylococcus aureus subsp. aureus Mu50
aaauuacacccuuuaa

SEQ ID NO: 2054930 - RNA, 15 nt, Staphylococcus aureus subsp. aureus Mu50
aaauuacacccuuua

SEQ ID NO: 2054931 - RNA, 15 nt, Staphylococcus aureus subsp. aureus Mu50
aaauuacuauauuua

SEQ ID NO: 2054932 - RNA, 22 nt, Staphylococcus aureus subsp. aureus Mu50
aaauuacuugaauauuauucau

SEQ ID NO: 2054933 - RNA, 12 nt, Staphylococcus aureus subsp. aureus Mu50
aaauucucuuuu

SEQ ID NO: 2054934 - RNA, 21 nt, Staphylococcus aureus subsp. aureus Mu50
aaauucucuuuuaaauucuua

SEQ ID NO: 2054935 - RNA, 17 nt, Staphylococcus aureus subsp. aureus Mu50
aaauucucaguguuggg

SEQ ID NO: 2054936 - RNA, 20 nt, Staphylococcus aureus subsp. aureus Mu50
aaauucuauaauuuuaauua

SEQ ID NO: 2054937 - RNA, 22 nt, Staphylococcus aureus subsp. aureus Mu50
aaauucuacaggcaaugcaagu

SEQ ID NO: 2054938 - RNA, 22 nt, Staphylococcus aureus subsp. aureus Mu50
aaauucuacaggcaaugcgagu

SEQ ID NO: 2054939 - RNA, 17 nt, Staphylococcus aureus subsp. aureus Mu50
aaauucuacagguaaug

SEQ ID NO: 2054940 - RNA, 21 nt, Staphylococcus aureus subsp. aureus Mu50
aaauucuacagguaaugcaag

SEQ ID NO: 2054941 - RNA, 21 nt, Staphylococcus aureus subsp. aureus Mu50
aaauucgcuugauuaauuuua

SEQ ID NO: 2054942 - RNA, 22 nt, Staphylococcus aureus subsp. aureus Mu50
aaauucgcuugauuaauuuuau

SEQ ID NO: 2054943 - RNA, 16 nt, Staphylococcus aureus subsp. aureus Mu50
aaauucgcaagccuuc

SEQ ID NO: 2054944 - RNA, 13 nt, Staphylococcus aureus subsp. aureus Mu50
aaauucaguaucu

SEQ ID NO: 2054945 - RNA, 13 nt, Staphylococcus aureus subsp. aureus Mu50
aaauucauuugua

SEQ ID NO: 2054946 - RNA, 16 nt, Staphylococcus aureus subsp. aureus Mu50
aaauucaacgucauca

SEQ ID NO: 2054947 - RNA, 21 nt, Staphylococcus aureus subsp. aureus Mu50
aaauucaacuuuaaucaaaaa

SEQ ID NO: 2054948 - RNA, 18 nt, Staphylococcus aureus subsp. aureus Mu50
aaauucaacuaugaaauu

SEQ ID NO: 2054949 - RNA, 21 nt, Staphylococcus aureus subsp. aureus Mu50
uuuuugauaguaauaguuaac

SEQ ID NO: 2054950 - RNA, 13 nt, Staphylococcus aureus subsp. aureus Mu50
uuuuuguauuuau

SEQ ID NO: 2054951 - RNA, 15 nt, Staphylococcus aureus subsp. aureus Mu50
uuuuuguaauacauc

SEQ ID NO: 2054952 - RNA, 15 nt, Staphylococcus aureus subsp. aureus Mu50
uuuuuggucaccaaa

SEQ ID NO: 2054953 - RNA, 13 nt, Staphylococcus aureus subsp. aureus Mu50
uuuuugucaguaa

SEQ ID NO: 2054954 - RNA, 13 nt, Staphylococcus aureus subsp. aureus Mu50
uuuuuuaaaauga

SEQ ID NO: 2054955 - RNA, 18 nt, Staphylococcus aureus subsp. aureus Mu50
uuuuuguugcaauugccu

SEQ ID NO: 2054956 - RNA, 13 nt, Staphylococcus aureus subsp. aureus Mu50
uuuuuguuuucaa

SEQ ID NO: 2054957 - RNA, 14 nt, Staphylococcus aureus subsp. aureus Mu50
uuuuuguugcaauu

SEQ ID NO: 2054958 - RNA, 13 nt, Staphylococcus aureus subsp. aureus Mu50
uuuuuuaaaguuu

SEQ ID NO: 2054959 - RNA, 21 nt, Staphylococcus aureus subsp. aureus Mu50
uuuuuuaauuaaguuaaaaua

SEQ ID NO: 2054960 - RNA, 13 nt, Staphylococcus aureus subsp. aureus Mu50
uuuuucgcauuaa

SEQ ID NO: 2054961 - RNA, 22 nt, Staphylococcus aureus subsp. aureus Mu50
uuuuucuaaaugauuuauucua

SEQ ID NO: 2054962 - RNA, 19 nt, Staphylococcus aureus subsp. aureus Mu50
uuuuucuccuuuguauaag

SEQ ID NO: 2054963 - RNA, 22 nt, Staphylococcus aureus subsp. aureus Mu50
uuuuucucaaugugagauauaa

SEQ ID NO: 2054964 - RNA, 12 nt, Staphylococcus aureus subsp. aureus Mu50
uuuuucuuucau

SEQ ID NO: 2054965 - RNA, 14 nt, Staphylococcus aureus subsp. aureus Mu50
uuuuucuuuuguuu

SEQ ID NO: 2054966 - RNA, 13 nt, Staphylococcus aureus subsp. aureus Mu50
aaauuaagaauaa

SEQ ID NO: 2054967 - RNA, 24 nt, Staphylococcus aureus subsp. aureus Mu50
aaauuaacuuagguuauuauaaaa

SEQ ID NO: 2054968 - RNA, 21 nt, Staphylococcus aureus subsp. aureus Mu50
aaauuaagaagaaauacuuga

SEQ ID NO: 2054969 - RNA, 16 nt, Staphylococcus aureus subsp. aureus Mu50
aaauuaagaagaaaua

SEQ ID NO: 2054970 - RNA, 17 nt, Staphylococcus aureus subsp. aureus Mu50
aaauuaagaagaaauac

SEQ ID NO: 2054971 - RNA, 18 nt, Staphylococcus aureus subsp. aureus Mu50
aaauuaagaagaaauacu

SEQ ID NO: 2054972 - RNA, 22 nt, Staphylococcus aureus subsp. aureus Mu50
aaauuaacuuagguuauuauaa

SEQ ID NO: 2054973 - RNA, 15 nt, Staphylococcus aureus subsp. aureus Mu50
aaauuaauagagaaa

SEQ ID NO: 2054974 - RNA, 17 nt, Staphylococcus aureus subsp. aureus Mu50
aaauuaauaugaacaaa

SEQ ID NO: 2054975 - RNA, 11 nt, Staphylococcus aureus subsp. aureus Mu50
aaauuaacuag

SEQ ID NO: 2054976 - RNA, 17 nt, Staphylococcus aureus subsp. aureus Mu50
aaauuaacuuaaaauuu

SEQ ID NO: 2054977 - RNA, 20 nt, Staphylococcus aureus subsp. aureus Mu50
aaauuaacuuaaaauuuaaa

SEQ ID NO: 2054978 - RNA, 17 nt, Staphylococcus aureus subsp. aureus Mu50
aaauuaaagcaaauuau

SEQ ID NO: 2054979 - RNA, 21 nt, Staphylococcus aureus subsp. aureus Mu50
uuuuuuaugcacaaaaaaauc

SEQ ID NO: 2054980 - RNA, 21 nt, Staphylococcus aureus subsp. aureus Mu50
uuuuuuauauguuauauuaaa

SEQ ID NO: 2054981 - RNA, 15 nt, Staphylococcus aureus subsp. aureus Mu50
uuuuuuaauuugauu

SEQ ID NO: 2054982 - RNA, 18 nt, Staphylococcus aureus subsp. aureus Mu50
aaaugugcaauuagaaua

SEQ ID NO: 2054983 - RNA, 14 nt, Staphylococcus aureus subsp. aureus Mu50
uuuuuuauuugucu

SEQ ID NO: 2054984 - RNA, 19 nt, Staphylococcus aureus subsp. aureus Mu50
aaauguuaaugcuucguaa

SEQ ID NO: 2054985 - RNA, 21 nt, Staphylococcus aureus subsp. aureus Mu50
aaauguuacacaaauuaaaac

SEQ ID NO: 2054986 - RNA, 16 nt, Staphylococcus aureus subsp. aureus Mu50
aaauguuaaauucuaa

SEQ ID NO: 2054987 - RNA, 18 nt, Staphylococcus aureus subsp. aureus Mu50
aaauguugacuacucaau

SEQ ID NO: 2054988 - RNA, 14 nt, Staphylococcus aureus subsp. aureus Mu50
aaauguuauugcuu

SEQ ID NO: 2054989 - RNA, 16 nt, Staphylococcus aureus subsp. aureus Mu50
aaauguuuaacaauaa

SEQ ID NO: 2054990 - RNA, 18 nt, Staphylococcus aureus subsp. aureus Mu50
aaauuaaaaaacaaaacu

SEQ ID NO: 2054991 - RNA, 16 nt, Staphylococcus aureus subsp. aureus Mu50
aaauuaaaaaacaaaa

SEQ ID NO: 2054992 - RNA, 22 nt, Staphylococcus aureus subsp. aureus Mu50
uuuuguugcucagugcauuuuu

SEQ ID NO: 2054993 - RNA, 18 nt, Staphylococcus aureus subsp. aureus Mu50
uuuuguugcucagugcau

SEQ ID NO: 2054994 - RNA, 20 nt, Staphylococcus aureus subsp. aureus Mu50
uuuuguucuaaguguuuuau

SEQ ID NO: 2054995 - RNA, 13 nt, Staphylococcus aureus subsp. aureus Mu50
uuuuguuaaaaaa

SEQ ID NO: 2054996 - RNA, 23 nt, Staphylococcus aureus subsp. aureus Mu50
uuuugugccucuuguguuucagc

SEQ ID NO: 2054997 - RNA, 17 nt, Staphylococcus aureus subsp. aureus Mu50
uuuuguguucggaauuu

SEQ ID NO: 2054998 - RNA, 16 nt, Staphylococcus aureus subsp. aureus Mu50
uuuugugauuuuuaau

SEQ ID NO: 2054999 - RNA, 15 nt, Staphylococcus aureus subsp. aureus Mu50
uuuuguaaacauggu

SEQ ID NO: 2055000 - RNA, 19 nt, Staphylococcus aureus subsp. aureus Mu50
uuuuguaagacuucccaau

SEQ ID NO: 2055001 - RNA, 23 nt, Staphylococcus aureus subsp. aureus Mu50
uuuuguaauugaaaugauagaug

SEQ ID NO: 2055002 - RNA, 23 nt, Staphylococcus aureus subsp. aureus Mu50
uuuuguuucaaacgugauuuuau

SEQ ID NO: 2055003 - RNA, 19 nt, Staphylococcus aureus subsp. aureus Mu50
uuuuuaaaauuaucaauug

SEQ ID NO: 2055004 - RNA, 17 nt, Staphylococcus aureus subsp. aureus Mu50
uuuuuaaaaaauuuaaa

SEQ ID NO: 2055005 - RNA, 22 nt, Staphylococcus aureus subsp. aureus Mu50
uuuuuaaaaaauuuaaauaaua

SEQ ID NO: 2055006 - RNA, 17 nt, Staphylococcus aureus subsp. aureus Mu50
uuuuuaaaugauuuaau

SEQ ID NO: 2055007 - RNA, 23 nt, Staphylococcus aureus subsp. aureus Mu50
uuuuuaacauagcuuaauaauua

SEQ ID NO: 2055008 - RNA, 18 nt, Staphylococcus aureus subsp. aureus Mu50
uuuuuaacagcuuuuucu

SEQ ID NO: 2055009 - RNA, 11 nt, Staphylococcus aureus subsp. aureus Mu50
uuuuuaaauac

SEQ ID NO: 2055010 - RNA, 18 nt, Staphylococcus aureus subsp. aureus Mu50
uuuuuaauguauucuucu

SEQ ID NO: 2055011 - RNA, 14 nt, Staphylococcus aureus subsp. aureus Mu50
uuuuuaauaaugca

SEQ ID NO: 2055012 - RNA, 16 nt, Staphylococcus aureus subsp. aureus Mu50
uuuuuaauauauuuau

SEQ ID NO: 2055013 - RNA, 16 nt, Staphylococcus aureus subsp. aureus Mu50
uuuuuaacugccauau

SEQ ID NO: 2055014 - RNA, 20 nt, Staphylococcus aureus subsp. aureus Mu50
uuuuuaugcacaaaaaaauc

SEQ ID NO: 2055015 - RNA, 13 nt, Staphylococcus aureus subsp. aureus Mu50
uuuuuauuaugaa

SEQ ID NO: 2055016 - RNA, 15 nt, Staphylococcus aureus subsp. aureus Mu50
uuuuuaucaucuucu

SEQ ID NO: 2055017 - RNA, 11 nt, Staphylococcus aureus subsp. aureus Mu50
uuuuuauauua

SEQ ID NO: 2055018 - RNA, 23 nt, Staphylococcus aureus subsp. aureus Mu50
uuuuuauauuauuucaauacccu

SEQ ID NO: 2055019 - RNA, 15 nt, Staphylococcus aureus subsp. aureus Mu50
uuuuuaguuaaagua

SEQ ID NO: 2055020 - RNA, 22 nt, Staphylococcus aureus subsp. aureus Mu50
uuuuuaguuagaaaguauuuau

SEQ ID NO: 2055021 - RNA, 19 nt, Staphylococcus aureus subsp. aureus Mu50
uuuuuacuaggaauauaaa

SEQ ID NO: 2055022 - RNA, 14 nt, Staphylococcus aureus subsp. aureus Mu50
uuuuucaauucgcu

SEQ ID NO: 2055023 - RNA, 14 nt, Staphylococcus aureus subsp. aureus Mu50
uuuuucaaauaaua

SEQ ID NO: 2055024 - RNA, 15 nt, Staphylococcus aureus subsp. aureus Mu50
uuuuuauuuuacuua

SEQ ID NO: 2055025 - RNA, 15 nt, Staphylococcus aureus subsp. aureus Mu50
uuuuucauauucaca

SEQ ID NO: 2055026 - RNA, 15 nt, Staphylococcus aureus subsp. aureus Mu50
uuuucugcuuucgcu

SEQ ID NO: 2055027 - RNA, 23 nt, Staphylococcus aureus subsp. aureus Mu50
uuuucucaacaguuucuuggucu

SEQ ID NO: 2055028 - RNA, 13 nt, Staphylococcus aureus subsp. aureus Mu50
uuuucuauggcac

SEQ ID NO: 2055029 - RNA, 16 nt, Staphylococcus aureus subsp. aureus Mu50
uuuucuagcuauaucc

SEQ ID NO: 2055030 - RNA, 15 nt, Staphylococcus aureus subsp. aureus Mu50
uuuucuaaauauaua

SEQ ID NO: 2055031 - RNA, 12 nt, Staphylococcus aureus subsp. aureus Mu50
uuuucuaaauga

SEQ ID NO: 2055032 - RNA, 22 nt, Staphylococcus aureus subsp. aureus Mu50
uuuucuuuauuuuaaacaugaa

SEQ ID NO: 2055033 - RNA, 14 nt, Staphylococcus aureus subsp. aureus Mu50
uuuucuuuucaaaa

SEQ ID NO: 2055034 - RNA, 12 nt, Staphylococcus aureus subsp. aureus Mu50
uuuucuuuuguu

SEQ ID NO: 2055035 - RNA, 11 nt, Staphylococcus aureus subsp. aureus Mu50
uuuucuuaauu

SEQ ID NO: 2055036 - RNA, 18 nt, Staphylococcus aureus subsp. aureus Mu50
uuuucuugguuugagaau

SEQ ID NO: 2055037 - RNA, 20 nt, Staphylococcus aureus subsp. aureus Mu50
uuuugacuguuaaacaaggu

SEQ ID NO: 2055038 - RNA, 19 nt, Staphylococcus aureus subsp. aureus Mu50
uuuugacaaauccuaauuu

SEQ ID NO: 2055039 - RNA, 12 nt, Staphylococcus aureus subsp. aureus Mu50
uuuugaauauuu

SEQ ID NO: 2055040 - RNA, 18 nt, Staphylococcus aureus subsp. aureus Mu50
uuuugauacguaaacacu

SEQ ID NO: 2055041 - RNA, 21 nt, Staphylococcus aureus subsp. aureus Mu50
uuuugagcacuuaauaaguca

SEQ ID NO: 2055042 - RNA, 18 nt, Staphylococcus aureus subsp. aureus Mu50
uuuugauuuacgugcauu

SEQ ID NO: 2055043 - RNA, 18 nt, Staphylococcus aureus subsp. aureus Mu50
uuuugcguuuuuaaauaa

SEQ ID NO: 2055044 - RNA, 15 nt, Staphylococcus aureus subsp. aureus Mu50
uuuugcuauuucaac

SEQ ID NO: 2055045 - RNA, 16 nt, Staphylococcus aureus subsp. aureus Mu50
uuuuaaaguuuaaaua

SEQ ID NO: 2055046 - RNA, 16 nt, Staphylococcus aureus subsp. aureus Mu50
uuuuaaauaaaaugca

SEQ ID NO: 2055047 - RNA, 18 nt, Staphylococcus aureus subsp. aureus Mu50
uuuuaaaucuacaauauu

SEQ ID NO: 2055048 - RNA, 23 nt, Staphylococcus aureus subsp. aureus Mu50
uuuuaaauaaucgaaaauuucag

SEQ ID NO: 2055049 - RNA, 17 nt, Staphylococcus aureus subsp. aureus Mu50
uuuuaaauguauuuuua

SEQ ID NO: 2055050 - RNA, 13 nt, Staphylococcus aureus subsp. aureus Mu50
uuuuaaauuacua

SEQ ID NO: 2055051 - RNA, 17 nt, Staphylococcus aureus subsp. aureus Mu50
uuuuaaaucuauauaaa

SEQ ID NO: 2055052 - RNA, 19 nt, Staphylococcus aureus subsp. aureus Mu50
uuuuaaacguacauuuuua

SEQ ID NO: 2055053 - RNA, 16 nt, Staphylococcus aureus subsp. aureus Mu50
uuuuaaagaaaaguuu

SEQ ID NO: 2055054 - RNA, 11 nt, Staphylococcus aureus subsp. aureus Mu50
uuuuaaaggac

SEQ ID NO: 2055055 - RNA, 20 nt, Staphylococcus aureus subsp. aureus Mu50
uuuuaaaggaccacuuagau

SEQ ID NO: 2055056 - RNA, 14 nt, Staphylococcus aureus subsp. aureus Mu50
uuuuaaaaugauag

SEQ ID NO: 2055057 - RNA, 21 nt, Staphylococcus aureus subsp. aureus Mu50
uuuuaaaaucucauaauaauu

SEQ ID NO: 2055058 - RNA, 17 nt, Staphylococcus aureus subsp. aureus Mu50
uuuuaaaagauaaauaa

SEQ ID NO: 2055059 - RNA, 15 nt, Staphylococcus aureus subsp. aureus Mu50
uuuuaaaaauucaua

SEQ ID NO: 2055060 - RNA, 19 nt, Staphylococcus aureus subsp. aureus Mu50
uuuuaaaaaauuuaaauaa

SEQ ID NO: 2055061 - RNA, 12 nt, Staphylococcus aureus subsp. aureus Mu50
uuuuaaaaaccu

SEQ ID NO: 2055062 - RNA, 12 nt, Staphylococcus aureus subsp. aureus Mu50
uuuguuuuaaaa

SEQ ID NO: 2055063 - RNA, 12 nt, Staphylococcus aureus subsp. aureus Mu50
uuuguuuguaag

SEQ ID NO: 2055064 - RNA, 19 nt, Staphylococcus aureus subsp. aureus Mu50
uuuguuguuuuaauuucac

SEQ ID NO: 2055065 - RNA, 13 nt, Staphylococcus aureus subsp. aureus Mu50
uuuguuuugaaug

SEQ ID NO: 2055066 - RNA, 16 nt, Staphylococcus aureus subsp. aureus Mu50
uuuguuuugcuucuuu

SEQ ID NO: 2055067 - RNA, 13 nt, Staphylococcus aureus subsp. aureus Mu50
uuuguuuuuauau

SEQ ID NO: 2055068 - RNA, 13 nt, Staphylococcus aureus subsp. aureus Mu50
uuuguuuucagua

SEQ ID NO: 2055069 - RNA, 14 nt, Staphylococcus aureus subsp. aureus Mu50
uuuguuuucaguaa

SEQ ID NO: 2055070 - RNA, 14 nt, Staphylococcus aureus subsp. aureus Mu50
uuuguuuucacugu

SEQ ID NO: 2055071 - RNA, 21 nt, Staphylococcus aureus subsp. aureus Mu50
uuuguuaccaaacaauacaua

SEQ ID NO: 2055072 - RNA, 15 nt, Staphylococcus aureus subsp. aureus Mu50
uuuguuacuucuaau

SEQ ID NO: 2055073 - RNA, 14 nt, Staphylococcus aureus subsp. aureus Mu50
uuuguucaaucacu

SEQ ID NO: 2055074 - RNA, 19 nt, Staphylococcus aureus subsp. aureus Mu50
uuuguucuuggcucaacaa

SEQ ID NO: 2055075 - RNA, 21 nt, Staphylococcus aureus subsp. aureus Mu50
uuuguugguguuuagucuuuu

SEQ ID NO: 2055076 - RNA, 12 nt, Staphylococcus aureus subsp. aureus Mu50
uuuuaagugaug

SEQ ID NO: 2055077 - RNA, 21 nt, Staphylococcus aureus subsp. aureus Mu50
uuuuaacuuccuaaaauuuac

SEQ ID NO: 2055078 - RNA, 21 nt, Staphylococcus aureus subsp. aureus Mu50
uuuuaauauauuuauuuuuga

SEQ ID NO: 2055079 - RNA, 17 nt, Staphylococcus aureus subsp. aureus Mu50
uuuuaauauauuuauuu

SEQ ID NO: 2055080 - RNA, 20 nt, Staphylococcus aureus subsp. aureus Mu50
uuuuaacugguugauaaaua

SEQ ID NO: 2055081 - RNA, 12 nt, Staphylococcus aureus subsp. aureus Mu50
uuuuaacuuaau

SEQ ID NO: 2055082 - RNA, 17 nt, Staphylococcus aureus subsp. aureus Mu50
uuuuaagaucaauauca

SEQ ID NO: 2055083 - RNA, 13 nt, Staphylococcus aureus subsp. aureus Mu50
uuuuaaauuuaag

SEQ ID NO: 2055084 - RNA, 12 nt, Staphylococcus aureus subsp. aureus Mu50
uuuuaaauuuag

SEQ ID NO: 2055085 - RNA, 21 nt, Staphylococcus aureus subsp. aureus Mu50
uuuuaacauagcuuaauaauu

SEQ ID NO: 2055086 - RNA, 20 nt, Staphylococcus aureus subsp. aureus Mu50
uuuuaacagcgugaauauaa

SEQ ID NO: 2055087 - RNA, 15 nt, Staphylococcus aureus subsp. aureus Mu50
uuuuaacagcugcag

SEQ ID NO: 2055088 - RNA, 21 nt, Staphylococcus aureus subsp. aureus Mu50
uuuuacaaagugauuuaaaaa

SEQ ID NO: 2055089 - RNA, 15 nt, Staphylococcus aureus subsp. aureus Mu50
uuuuacaaagugauu

SEQ ID NO: 2055090 - RNA, 13 nt, Staphylococcus aureus subsp. aureus Mu50
uuuuaauuuucag

SEQ ID NO: 2055091 - RNA, 12 nt, Staphylococcus aureus subsp. aureus Mu50
uuuuaaugauuu

SEQ ID NO: 2055092 - RNA, 20 nt, Staphylococcus aureus subsp. aureus Mu50
uuuuaauguauucuucuaau

SEQ ID NO: 2055093 - RNA, 22 nt, Staphylococcus aureus subsp. aureus Mu50
uuuuaaugggcgauaaaaguug

SEQ ID NO: 2055094 - RNA, 14 nt, Staphylococcus aureus subsp. aureus Mu50
uuuuaauuguucau

SEQ ID NO: 2055095 - RNA, 18 nt, Staphylococcus aureus subsp. aureus Mu50
uuuuaauuauuuuaaaaa

SEQ ID NO: 2055096 - RNA, 13 nt, Staphylococcus aureus subsp. aureus Mu50
uuuuaauucuauu

SEQ ID NO: 2055097 - RNA, 23 nt, Staphylococcus aureus subsp. aureus Mu50
uuuuaccuucgcauacuuuuuca

SEQ ID NO: 2055098 - RNA, 14 nt, Staphylococcus aureus subsp. aureus Mu50
uuuuaccuuuaauu

SEQ ID NO: 2055099 - RNA, 17 nt, Staphylococcus aureus subsp. aureus Mu50
uuuuaccuuuaauuaca

SEQ ID NO: 2055100 - RNA, 15 nt, Staphylococcus aureus subsp. aureus Mu50
uuuuaccauaaauug

SEQ ID NO: 2055101 - RNA, 18 nt, Staphylococcus aureus subsp. aureus Mu50
uuuggucaaguuuugguc

SEQ ID NO: 2055102 - RNA, 18 nt, Staphylococcus aureus subsp. aureus Mu50
uuugcuuuauuuucuugu

SEQ ID NO: 2055103 - RNA, 23 nt, Staphylococcus aureus subsp. aureus Mu50
uuugcuuuagcucuuuuuugauu

SEQ ID NO: 2055104 - RNA, 14 nt, Staphylococcus aureus subsp. aureus Mu50
uuuggaaauaucuu

SEQ ID NO: 2055105 - RNA, 15 nt, Staphylococcus aureus subsp. aureus Mu50
uuuggaacauauuca

SEQ ID NO: 2055106 - RNA, 20 nt, Staphylococcus aureus subsp. aureus Mu50
uuugcugguugcuucuuauc

SEQ ID NO: 2055107 - RNA, 17 nt, Staphylococcus aureus subsp. aureus Mu50
uuugcuggcgcaaugau

SEQ ID NO: 2055108 - RNA, 17 nt, Staphylococcus aureus subsp. aureus Mu50
uuugcuguuuaguuaau

SEQ ID NO: 2055109 - RNA, 12 nt, Staphylococcus aureus subsp. aureus Mu50
uuugcuucuuua

SEQ ID NO: 2055110 - RNA, 17 nt, Staphylococcus aureus subsp. aureus Mu50
uuuguauaccuauuccu

SEQ ID NO: 2055111 - RNA, 20 nt, Staphylococcus aureus subsp. aureus Mu50
uuuguauauucuuuuuaacu

SEQ ID NO: 2055112 - RNA, 21 nt, Staphylococcus aureus subsp. aureus Mu50
uuuguaguccuucuuugaaau

SEQ ID NO: 2055113 - RNA, 14 nt, Staphylococcus aureus subsp. aureus Mu50
uuuguauuagcauc

SEQ ID NO: 2055114 - RNA, 13 nt, Staphylococcus aureus subsp. aureus Mu50
uuuguaugaguuc

SEQ ID NO: 2055115 - RNA, 17 nt, Staphylococcus aureus subsp. aureus Mu50
uuuguaugauaaccauu

SEQ ID NO: 2055116 - RNA, 15 nt, Staphylococcus aureus subsp. aureus Mu50
uuuguauuguuugaa

SEQ ID NO: 2055117 - RNA, 20 nt, Staphylococcus aureus subsp. aureus Mu50
uuuguacucuucguuuuaau

SEQ ID NO: 2055118 - RNA, 20 nt, Staphylococcus aureus subsp. aureus Mu50
uuuguaagcucaugaaucag

SEQ ID NO: 2055119 - RNA, 23 nt, Staphylococcus aureus subsp. aureus Mu50
uuuguaaucccauuuuaaaguca

SEQ ID NO: 2055120 - RNA, 22 nt, Staphylococcus aureus subsp. aureus Mu50
uuuguaaagcuuuaguuaaaua

SEQ ID NO: 2055121 - RNA, 20 nt, Staphylococcus aureus subsp. aureus Mu50
uuuguaaauauuuuuuaaaa

SEQ ID NO: 2055122 - RNA, 14 nt, Staphylococcus aureus subsp. aureus Mu50
uuuguaaauuuuua

SEQ ID NO: 2055123 - RNA, 18 nt, Staphylococcus aureus subsp. aureus Mu50
uuuguaaccuaaaaacaa

SEQ ID NO: 2055124 - RNA, 11 nt, Staphylococcus aureus subsp. aureus Mu50
uuugugguaau

SEQ ID NO: 2055125 - RNA, 15 nt, Staphylococcus aureus subsp. aureus Mu50
uuugucuuacuaauu

SEQ ID NO: 2055126 - RNA, 17 nt, Staphylococcus aureus subsp. aureus Mu50
uuugucaguaacuuugu

SEQ ID NO: 2055127 - RNA, 12 nt, Staphylococcus aureus subsp. aureus Mu50
uuuguauuuaug

SEQ ID NO: 2055128 - RNA, 22 nt, Staphylococcus aureus subsp. aureus Mu50
uuuguauuuauguuuucuaguu

SEQ ID NO: 2055129 - RNA, 18 nt, Staphylococcus aureus subsp. aureus Mu50
uuuuauguuuaaacauuu

SEQ ID NO: 2055130 - RNA, 19 nt, Staphylococcus aureus subsp. aureus Mu50
uuuuauguuuaauuugauu

SEQ ID NO: 2055131 - RNA, 21 nt, Staphylococcus aureus subsp. aureus Mu50
uuuuauguucagaaauuuaau

SEQ ID NO: 2055132 - RNA, 23 nt, Staphylococcus aureus subsp. aureus Mu50
uuuuaugucaauagcgguuuaaa

SEQ ID NO: 2055133 - RNA, 20 nt, Staphylococcus aureus subsp. aureus Mu50
uuuuaugucuaguucuugag

SEQ ID NO: 2055134 - RNA, 18 nt, Staphylococcus aureus subsp. aureus Mu50
uuuuauggcgguuugaaa

SEQ ID NO: 2055135 - RNA, 18 nt, Staphylococcus aureus subsp. aureus Mu50
uuuuaugguuuaauuuag

SEQ ID NO: 2055136 - RNA, 16 nt, Staphylococcus aureus subsp. aureus Mu50
uuuuauuaauuaaaaa

SEQ ID NO: 2055137 - RNA, 17 nt, Staphylococcus aureus subsp. aureus Mu50
uuuuauuagaauauuca

SEQ ID NO: 2055138 - RNA, 19 nt, Staphylococcus aureus subsp. aureus Mu50
uuuuauuacuuauuucuuu

SEQ ID NO: 2055139 - RNA, 22 nt, Staphylococcus aureus subsp. aureus Mu50
uuuuauuauacacuuuuugaca

SEQ ID NO: 2055140 - RNA, 13 nt, Staphylococcus aureus subsp. aureus Mu50
uuuuauuuauauu

SEQ ID NO: 2055141 - RNA, 17 nt, Staphylococcus aureus subsp. aureus Mu50
uuuuauuuauacuaaau

SEQ ID NO: 2055142 - RNA, 13 nt, Staphylococcus aureus subsp. aureus Mu50
uuuuauuuuaacu

SEQ ID NO: 2055143 - RNA, 17 nt, Staphylococcus aureus subsp. aureus Mu50
uuuuauuuuaauauuuu

SEQ ID NO: 2055144 - RNA, 18 nt, Staphylococcus aureus subsp. aureus Mu50
uuuuauuugauuauucuu

SEQ ID NO: 2055145 - RNA, 19 nt, Staphylococcus aureus subsp. aureus Mu50
uuuuauuaucuuuguaaau

SEQ ID NO: 2055146 - RNA, 16 nt, Staphylococcus aureus subsp. aureus Mu50
uuuuaucuaaacauuu

SEQ ID NO: 2055147 - RNA, 14 nt, Staphylococcus aureus subsp. aureus Mu50
uuuuaucugaaucu

SEQ ID NO: 2055148 - RNA, 20 nt, Staphylococcus aureus subsp. aureus Mu50
uuuuaugagcuucuuuaaau

SEQ ID NO: 2055149 - RNA, 17 nt, Staphylococcus aureus subsp. aureus Mu50
uuuuaugaauugaguau

SEQ ID NO: 2055150 - RNA, 22 nt, Staphylococcus aureus subsp. aureus Mu50
uuuuaugaauugaguauuaaau

SEQ ID NO: 2055151 - RNA, 19 nt, Staphylococcus aureus subsp. aureus Mu50
uuuuaugauuuucuuuaau

SEQ ID NO: 2055152 - RNA, 15 nt, Staphylococcus aureus subsp. aureus Mu50
uuuuaugcuuuaaau

SEQ ID NO: 2055153 - RNA, 18 nt, Staphylococcus aureus subsp. aureus Mu50
uuuuaucgaaauauuuau

SEQ ID NO: 2055154 - RNA, 21 nt, Staphylococcus aureus subsp. aureus Mu50
uuuuauauuuaaacucucuaa

SEQ ID NO: 2055155 - RNA, 13 nt, Staphylococcus aureus subsp. aureus Mu50
uuuuauauuuuua

SEQ ID NO: 2055156 - RNA, 22 nt, Staphylococcus aureus subsp. aureus Mu50
uuuuauauugcgaaaaauaauu

SEQ ID NO: 2055157 - RNA, 17 nt, Staphylococcus aureus subsp. aureus Mu50
uuuuauauuuaaacucu

SEQ ID NO: 2055158 - RNA, 21 nt, Staphylococcus aureus subsp. aureus Mu50
uuuuauauucaacuuauuauu

SEQ ID NO: 2055159 - RNA, 16 nt, Staphylococcus aureus subsp. aureus Mu50
uuuuauauccaucucc

SEQ ID NO: 2055160 - RNA, 19 nt, Staphylococcus aureus subsp. aureus Mu50
uuuuauagugguaaaaagu

SEQ ID NO: 2055161 - RNA, 15 nt, Staphylococcus aureus subsp. aureus Mu50
uuuuacuaacugaau

SEQ ID NO: 2055162 - RNA, 20 nt, Staphylococcus aureus subsp. aureus Mu50
uuuuacuuucaccauuuacu

SEQ ID NO: 2055163 - RNA, 16 nt, Staphylococcus aureus subsp. aureus Mu50
uuuuacugcacuuuua

SEQ ID NO: 2055164 - RNA, 19 nt, Staphylococcus aureus subsp. aureus Mu50
uuuuacuaggaauauaaaa

SEQ ID NO: 2055165 - RNA, 19 nt, Staphylococcus aureus subsp. aureus Mu50
uuuuagccccagcaaauac

SEQ ID NO: 2055166 - RNA, 23 nt, Staphylococcus aureus subsp. aureus Mu50
uuuuagauuuaguuuuuuuaaag

SEQ ID NO: 2055167 - RNA, 17 nt, Staphylococcus aureus subsp. aureus Mu50
uuuuagauuaucuuuca

SEQ ID NO: 2055168 - RNA, 20 nt, Staphylococcus aureus subsp. aureus Mu50
uuuuagacauaaaaaaagag

SEQ ID NO: 2055169 - RNA, 15 nt, Staphylococcus aureus subsp. aureus Mu50
uuuuacuuuuauaau

SEQ ID NO: 2055170 - RNA, 16 nt, Staphylococcus aureus subsp. aureus Mu50
uuuuagugacaaacau

SEQ ID NO: 2055171 - RNA, 18 nt, Staphylococcus aureus subsp. aureus Mu50
uuuuagguaauaauucag

SEQ ID NO: 2055172 - RNA, 19 nt, Staphylococcus aureus subsp. aureus Mu50
uuuuagguugaauuucuuu

SEQ ID NO: 2055173 - RNA, 22 nt, Staphylococcus aureus subsp. aureus Mu50
uuuuagcuaaacgacauuguuu

SEQ ID NO: 2055174 - RNA, 15 nt, Staphylococcus aureus subsp. aureus Mu50
uuuuagguaauaauu

SEQ ID NO: 2055175 - RNA, 13 nt, Staphylococcus aureus subsp. aureus Mu50
uuuuauaaauuuu

SEQ ID NO: 2055176 - RNA, 13 nt, Staphylococcus aureus subsp. aureus Mu50
uuuuauaguaaua

SEQ ID NO: 2055177 - RNA, 16 nt, Staphylococcus aureus subsp. aureus Mu50
uuuuauaguaauagcu

SEQ ID NO: 2055178 - RNA, 22 nt, Staphylococcus aureus subsp. aureus Mu50
uuuuauagcaaauugauuaaau

SEQ ID NO: 2055179 - RNA, 12 nt, Staphylococcus aureus subsp. aureus Mu50
uuuuauaaauua

SEQ ID NO: 2055180 - RNA, 14 nt, Staphylococcus aureus subsp. aureus Mu50
uuuuauaaucuuuu

SEQ ID NO: 2055181 - RNA, 16 nt, Staphylococcus aureus subsp. aureus Mu50
uuuuauaccaauaauu

SEQ ID NO: 2055182 - RNA, 18 nt, Staphylococcus aureus subsp. aureus Mu50
uuuucgaacuuuuguucu

SEQ ID NO: 2055183 - RNA, 18 nt, Staphylococcus aureus subsp. aureus Mu50
uuuucgaggucaucaaaa

SEQ ID NO: 2055184 - RNA, 21 nt, Staphylococcus aureus subsp. aureus Mu50
uuuucgaggucaucaaaaguu

SEQ ID NO: 2055185 - RNA, 18 nt, Staphylococcus aureus subsp. aureus Mu50
uuuucguauaauuuuaau

SEQ ID NO: 2055186 - RNA, 13 nt, Staphylococcus aureus subsp. aureus Mu50
uuuuccaauaaua

SEQ ID NO: 2055187 - RNA, 19 nt, Staphylococcus aureus subsp. aureus Mu50
uuuuccauucauaaaagca

SEQ ID NO: 2055188 - RNA, 19 nt, Staphylococcus aureus subsp. aureus Mu50
uuuuccuaaaccucuaaau

SEQ ID NO: 2055189 - RNA, 13 nt, Staphylococcus aureus subsp. aureus Mu50
uuuucaaaaauag

SEQ ID NO: 2055190 - RNA, 16 nt, Staphylococcus aureus subsp. aureus Mu50
uuuucaaaacugccaa

SEQ ID NO: 2055191 - RNA, 20 nt, Staphylococcus aureus subsp. aureus Mu50
uuuucaaacauauucauucu

SEQ ID NO: 2055192 - RNA, 22 nt, Staphylococcus aureus subsp. aureus Mu50
uuuucaagaccaaauauuuuau

SEQ ID NO: 2055193 - RNA, 19 nt, Staphylococcus aureus subsp. aureus Mu50
uuuucaacauaauauuucu

SEQ ID NO: 2055194 - RNA, 14 nt, Staphylococcus aureus subsp. aureus Mu50
uuuucaaaugaaaa

SEQ ID NO: 2055195 - RNA, 21 nt, Staphylococcus aureus subsp. aureus Mu50
uuuucaauaauugauucucug

SEQ ID NO: 2055196 - RNA, 19 nt, Staphylococcus aureus subsp. aureus Mu50
uuuucaaguuuaaaauacg

SEQ ID NO: 2055197 - RNA, 15 nt, Staphylococcus aureus subsp. aureus Mu50
uuuucaauauuugau

SEQ ID NO: 2055198 - RNA, 15 nt, Staphylococcus aureus subsp. aureus Mu50
uuuucaugaaaaguu

SEQ ID NO: 2055199 - RNA, 22 nt, Staphylococcus aureus subsp. aureus Mu50
uuuucacuucgccaagccaucu

SEQ ID NO: 2055200 - RNA, 15 nt, Staphylococcus aureus subsp. aureus Mu50
uuuucagaaucagaa

SEQ ID NO: 2055201 - RNA, 22 nt, Staphylococcus aureus subsp. aureus Mu50
uuuucacgaauaucuuaaagaa

SEQ ID NO: 2055202 - RNA, 21 nt, Staphylococcus aureus subsp. aureus Mu50
uuucugagaagaaauauauug

SEQ ID NO: 2055203 - RNA, 22 nt, Staphylococcus aureus subsp. aureus Mu50
uuucugacugugaagcugugcu

SEQ ID NO: 2055204 - RNA, 18 nt, Staphylococcus aureus subsp. aureus Mu50
uuucugacuuuuaaaaaa

SEQ ID NO: 2055205 - RNA, 23 nt, Staphylococcus aureus subsp. aureus Mu50
uuucucuuucaagaccuucuucu

SEQ ID NO: 2055206 - RNA, 21 nt, Staphylococcus aureus subsp. aureus Mu50
uuucugacaacuuaauagaaa

SEQ ID NO: 2055207 - RNA, 14 nt, Staphylococcus aureus subsp. aureus Mu50
uuucuguaccaaau

SEQ ID NO: 2055208 - RNA, 18 nt, Staphylococcus aureus subsp. aureus Mu50
uuucuggccacuaaugca

SEQ ID NO: 2055209 - RNA, 13 nt, Staphylococcus aureus subsp. aureus Mu50
uuucuggcucuuc

SEQ ID NO: 2055210 - RNA, 18 nt, Staphylococcus aureus subsp. aureus Mu50
uuucuggcucuucuuauc

SEQ ID NO: 2055211 - RNA, 17 nt, Staphylococcus aureus subsp. aureus Mu50
uuucuccuuuguauaag

SEQ ID NO: 2055212 - RNA, 16 nt, Staphylococcus aureus subsp. aureus Mu50
uuucucaaugugagau

SEQ ID NO: 2055213 - RNA, 20 nt, Staphylococcus aureus subsp. aureus Mu50
uuucucaaguaacucaagug

SEQ ID NO: 2055214 - RNA, 19 nt, Staphylococcus aureus subsp. aureus Mu50
uuucuaauugaaaucaucu

SEQ ID NO: 2055215 - RNA, 21 nt, Staphylococcus aureus subsp. aureus Mu50
uuucuacaccuacaacuguug

SEQ ID NO: 2055216 - RNA, 16 nt, Staphylococcus aureus subsp. aureus Mu50
uuucuacccguuuuuu

SEQ ID NO: 2055217 - RNA, 18 nt, Staphylococcus aureus subsp. aureus Mu50
uuucuacccguuuuuugg

SEQ ID NO: 2055218 - RNA, 22 nt, Staphylococcus aureus subsp. aureus Mu50
uuucuaggccacuaagaccaug

SEQ ID NO: 2055219 - RNA, 22 nt, Staphylococcus aureus subsp. aureus Mu50
uuucuagcuuguuuguuacaua

SEQ ID NO: 2055220 - RNA, 21 nt, Staphylococcus aureus subsp. aureus Mu50
uuucuagcuauauccaguaaa

SEQ ID NO: 2055221 - RNA, 14 nt, Staphylococcus aureus subsp. aureus Mu50
uuucuauaauauuu

SEQ ID NO: 2055222 - RNA, 16 nt, Staphylococcus aureus subsp. aureus Mu50
uuucuauaauauuuaa

SEQ ID NO: 2055223 - RNA, 23 nt, Staphylococcus aureus subsp. aureus Mu50
uuucuauaauauuuaaccacuuu

SEQ ID NO: 2055224 - RNA, 18 nt, Staphylococcus aureus subsp. aureus Mu50
uuucuaguuuaucuucag

SEQ ID NO: 2055225 - RNA, 14 nt, Staphylococcus aureus subsp. aureus Mu50
uuucuaucaaauaa

SEQ ID NO: 2055226 - RNA, 18 nt, Staphylococcus aureus subsp. aureus Mu50
uuucuauuaauauagaag

SEQ ID NO: 2055227 - RNA, 14 nt, Staphylococcus aureus subsp. aureus Mu50
uuucuauuaauaua

SEQ ID NO: 2055228 - RNA, 12 nt, Staphylococcus aureus subsp. aureus Mu50
uuucuaucaaau

SEQ ID NO: 2055229 - RNA, 23 nt, Staphylococcus aureus subsp. aureus Mu50
uuucuauagaaaaaguauuacuu

SEQ ID NO: 2055230 - RNA, 23 nt, Staphylococcus aureus subsp. aureus Mu50
uuucguuagacucacuucuuaaa

SEQ ID NO: 2055231 - RNA, 20 nt, Staphylococcus aureus subsp. aureus Mu50
uuucuaaaucuaacuggaaa

SEQ ID NO: 2055232 - RNA, 18 nt, Staphylococcus aureus subsp. aureus Mu50
uuucggacgauugaacau

SEQ ID NO: 2055233 - RNA, 19 nt, Staphylococcus aureus subsp. aureus Mu50
uuucgcuuuuuuuauuuuu

SEQ ID NO: 2055234 - RNA, 16 nt, Staphylococcus aureus subsp. aureus Mu50
uuucguauaauuuuaa

SEQ ID NO: 2055235 - RNA, 23 nt, Staphylococcus aureus subsp. aureus Mu50
uuuccuuggacucagugcuaugu

SEQ ID NO: 2055236 - RNA, 18 nt, Staphylococcus aureus subsp. aureus Mu50
uuucgauaccuaaaauac

SEQ ID NO: 2055237 - RNA, 13 nt, Staphylococcus aureus subsp. aureus Mu50
uuucgauauuugu

SEQ ID NO: 2055238 - RNA, 21 nt, Staphylococcus aureus subsp. aureus Mu50
uuuccucgguuuuauuuuuau

SEQ ID NO: 2055239 - RNA, 19 nt, Staphylococcus aureus subsp. aureus Mu50
uuuccucgguuuuauuuuu

SEQ ID NO: 2055240 - RNA, 22 nt, Staphylococcus aureus subsp. aureus Mu50
uuuccucuuuaaagcuaaaugu

SEQ ID NO: 2055241 - RNA, 21 nt, Staphylococcus aureus subsp. aureus Mu50
uuuccauaaauauuuaaaaua

SEQ ID NO: 2055242 - RNA, 22 nt, Staphylococcus aureus subsp. aureus Mu50
uuuccauaaauauuuaaaauau

SEQ ID NO: 2055243 - RNA, 19 nt, Staphylococcus aureus subsp. aureus Mu50
uuuccauaaauaaaaugcu

SEQ ID NO: 2055244 - RNA, 17 nt, Staphylococcus aureus subsp. aureus Mu50
uuucccuacugcuugug

SEQ ID NO: 2055245 - RNA, 13 nt, Staphylococcus aureus subsp. aureus Mu50
uuugaaauauacc

SEQ ID NO: 2055246 - RNA, 18 nt, Staphylococcus aureus subsp. aureus Mu50
uuugaaaauuucaccgcu

SEQ ID NO: 2055247 - RNA, 20 nt, Staphylococcus aureus subsp. aureus Mu50
uuucuuuuuugcuguauaua

SEQ ID NO: 2055248 - RNA, 22 nt, Staphylococcus aureus subsp. aureus Mu50
uuucuuuuuuuauggauuucuu

SEQ ID NO: 2055249 - RNA, 20 nt, Staphylococcus aureus subsp. aureus Mu50
uuucuuuuguuuuuauauua

SEQ ID NO: 2055250 - RNA, 14 nt, Staphylococcus aureus subsp. aureus Mu50
uuucuuuuuuaauu

SEQ ID NO: 2055251 - RNA, 18 nt, Staphylococcus aureus subsp. aureus Mu50
uuucuuuuuuaauucuau

SEQ ID NO: 2055252 - RNA, 16 nt, Staphylococcus aureus subsp. aureus Mu50
uuugaauauuugcuuu

SEQ ID NO: 2055253 - RNA, 16 nt, Staphylococcus aureus subsp. aureus Mu50
uuugaaucuuguugaa

SEQ ID NO: 2055254 - RNA, 12 nt, Staphylococcus aureus subsp. aureus Mu50
uuugaauauacu

SEQ ID NO: 2055255 - RNA, 16 nt, Staphylococcus aureus subsp. aureus Mu50
uuugaauacuuuauuu

SEQ ID NO: 2055256 - RNA, 13 nt, Staphylococcus aureus subsp. aureus Mu50
uuugaauaaaaaa

SEQ ID NO: 2055257 - RNA, 21 nt, Staphylococcus aureus subsp. aureus Mu50
uuugaaguuacuauauuuauu

SEQ ID NO: 2055258 - RNA, 19 nt, Staphylococcus aureus subsp. aureus Mu50
uuugaaauuucgacaucua

SEQ ID NO: 2055259 - RNA, 17 nt, Staphylococcus aureus subsp. aureus Mu50
uuugaagaauguuucau

SEQ ID NO: 2055260 - RNA, 17 nt, Staphylococcus aureus subsp. aureus Mu50
uuugaagaauaaaaaag

SEQ ID NO: 2055261 - RNA, 17 nt, Staphylococcus aureus subsp. aureus Mu50
uuugagcauuuuuauau

SEQ ID NO: 2055262 - RNA, 16 nt, Staphylococcus aureus subsp. aureus Mu50
uuugacuauucucagu

SEQ ID NO: 2055263 - RNA, 19 nt, Staphylococcus aureus subsp. aureus Mu50
uuugacacauuauugaaau

SEQ ID NO: 2055264 - RNA, 15 nt, Staphylococcus aureus subsp. aureus Mu50
uuugaauugacuuac

SEQ ID NO: 2055265 - RNA, 21 nt, Staphylococcus aureus subsp. aureus Mu50
uuugaaugcaaaucaaauaca

SEQ ID NO: 2055266 - RNA, 10 nt, Staphylococcus aureus subsp. aureus Mu50
uuucuuaauu

SEQ ID NO: 2055267 - RNA, 18 nt, Staphylococcus aureus subsp. aureus Mu50
uuucuuaguuugacaucu

SEQ ID NO: 2055268 - RNA, 14 nt, Staphylococcus aureus subsp. aureus Mu50
uuucugugaccaau

SEQ ID NO: 2055269 - RNA, 19 nt, Staphylococcus aureus subsp. aureus Mu50
uuucugugaccaauagaau

SEQ ID NO: 2055270 - RNA, 15 nt, Staphylococcus aureus subsp. aureus Mu50
uuucuucaauugucu

SEQ ID NO: 2055271 - RNA, 20 nt, Staphylococcus aureus subsp. aureus Mu50
uuucuucagaaccuugaaug

SEQ ID NO: 2055272 - RNA, 13 nt, Staphylococcus aureus subsp. aureus Mu50
uuucuuauuuauu

SEQ ID NO: 2055273 - RNA, 14 nt, Staphylococcus aureus subsp. aureus Mu50
uuucuuauuaaaua

SEQ ID NO: 2055274 - RNA, 15 nt, Staphylococcus aureus subsp. aureus Mu50
uuucuucauuaucaa

SEQ ID NO: 2055275 - RNA, 12 nt, Staphylococcus aureus subsp. aureus Mu50
uuucuucauuuu

SEQ ID NO: 2055276 - RNA, 14 nt, Staphylococcus aureus subsp. aureus Mu50
uuucuuucauaauu

SEQ ID NO: 2055277 - RNA, 14 nt, Staphylococcus aureus subsp. aureus Mu50
uuucuuuaagugac

SEQ ID NO: 2055278 - RNA, 18 nt, Staphylococcus aureus subsp. aureus Mu50
uuucuuguucuaaaauaa

SEQ ID NO: 2055279 - RNA, 17 nt, Staphylococcus aureus subsp. aureus Mu50
uuucuuuguguuugcuu

SEQ ID NO: 2055280 - RNA, 16 nt, Staphylococcus aureus subsp. aureus Mu50
uuucuuuucaaaauaa

SEQ ID NO: 2055281 - RNA, 11 nt, Staphylococcus aureus subsp. aureus Mu50
uuucuucuucu

SEQ ID NO: 2055282 - RNA, 15 nt, Staphylococcus aureus subsp. aureus Mu50
uuucuugaucuaaug

SEQ ID NO: 2055283 - RNA, 14 nt, Staphylococcus aureus subsp. aureus Mu50
uuucuuguucuaaa

SEQ ID NO: 2055284 - RNA, 23 nt, Staphylococcus aureus subsp. aureus Mu50
uuucuugccaucaauuucuguaa

SEQ ID NO: 2055285 - RNA, 23 nt, Staphylococcus aureus subsp. aureus Mu50
uuugaguauuugccuuuuuuauu

SEQ ID NO: 2055286 - RNA, 17 nt, Staphylococcus aureus subsp. aureus Mu50
uuugaguauccaauacu

SEQ ID NO: 2055287 - RNA, 17 nt, Staphylococcus aureus subsp. aureus Mu50
uuugauaaauaaaauuu

SEQ ID NO: 2055288 - RNA, 19 nt, Staphylococcus aureus subsp. aureus Mu50
uuugauaacaauuuuaaau

SEQ ID NO: 2055289 - RNA, 12 nt, Staphylococcus aureus subsp. aureus Mu50
uuugauaagaaa

SEQ ID NO: 2055290 - RNA, 23 nt, Staphylococcus aureus subsp. aureus Mu50
uuugauaaaugcgguugaugguu

SEQ ID NO: 2055291 - RNA, 22 nt, Staphylococcus aureus subsp. aureus Mu50
uuugauauaaaaagugaaagua

SEQ ID NO: 2055292 - RNA, 17 nt, Staphylococcus aureus subsp. aureus Mu50
uuugauaucacuauaca

SEQ ID NO: 2055293 - RNA, 16 nt, Staphylococcus aureus subsp. aureus Mu50
uuugauguuuucuaua

SEQ ID NO: 2055294 - RNA, 24 nt, Staphylococcus aureus subsp. aureus Mu50
uuugaugaucauuaguguagaaaa

SEQ ID NO: 2055295 - RNA, 21 nt, Staphylococcus aureus subsp. aureus Mu50
uuugcaauugcaaugaauaac

SEQ ID NO: 2055296 - RNA, 17 nt, Staphylococcus aureus subsp. aureus Mu50
uuugcagauugauauaa

SEQ ID NO: 2055297 - RNA, 21 nt, Staphylococcus aureus subsp. aureus Mu50
uuugcaacauauuuucacaau

SEQ ID NO: 2055298 - RNA, 17 nt, Staphylococcus aureus subsp. aureus Mu50
uuugauuuuacuugaau

SEQ ID NO: 2055299 - RNA, 17 nt, Staphylococcus aureus subsp. aureus Mu50
uuugauuuuauucacuu

SEQ ID NO: 2055300 - RNA, 14 nt, Staphylococcus aureus subsp. aureus Mu50
uuugcgguguggcg

SEQ ID NO: 2055301 - RNA, 20 nt, Staphylococcus aureus subsp. aureus Mu50
uuugcucaaaaaugcuuaua

SEQ ID NO: 2055302 - RNA, 16 nt, Staphylococcus aureus subsp. aureus Mu50
uuugcuagugcuucca

SEQ ID NO: 2055303 - RNA, 18 nt, Staphylococcus aureus subsp. aureus Mu50
uuugcgguuuuuuugauu

SEQ ID NO: 2055304 - RNA, 23 nt, Staphylococcus aureus subsp. aureus Mu50
uuugcauaccuauaaacauaucu

SEQ ID NO: 2055305 - RNA, 19 nt, Staphylococcus aureus subsp. aureus Mu50
uuucagcgauaacguacaa

SEQ ID NO: 2055306 - RNA, 18 nt, Staphylococcus aureus subsp. aureus Mu50
uuucacuuuaacuucuuu

SEQ ID NO: 2055307 - RNA, 17 nt, Staphylococcus aureus subsp. aureus Mu50
uuucacucauauuacuu

SEQ ID NO: 2055308 - RNA, 14 nt, Staphylococcus aureus subsp. aureus Mu50
uuucaguucuuaga

SEQ ID NO: 2055309 - RNA, 16 nt, Staphylococcus aureus subsp. aureus Mu50
uuucauaaaguuuauu

SEQ ID NO: 2055310 - RNA, 22 nt, Staphylococcus aureus subsp. aureus Mu50
uuucauaguuauuaaaucuuuu

SEQ ID NO: 2055311 - RNA, 18 nt, Staphylococcus aureus subsp. aureus Mu50
uuucauagaugcauaaaa

SEQ ID NO: 2055312 - RNA, 23 nt, Staphylococcus aureus subsp. aureus Mu50
uuucauagaugcauaaaaaccua

SEQ ID NO: 2055313 - RNA, 20 nt, Staphylococcus aureus subsp. aureus Mu50
uuucauagaaccauuucuag

SEQ ID NO: 2055314 - RNA, 19 nt, Staphylococcus aureus subsp. aureus Mu50
uuucauaauuaauaacauc

SEQ ID NO: 2055315 - RNA, 15 nt, Staphylococcus aureus subsp. aureus Mu50
uuucaguauacucau

SEQ ID NO: 2055316 - RNA, 14 nt, Staphylococcus aureus subsp. aureus Mu50
uuucaguagaugcu

SEQ ID NO: 2055317 - RNA, 13 nt, Staphylococcus aureus subsp. aureus Mu50
uuucauuuuuuca

SEQ ID NO: 2055318 - RNA, 15 nt, Staphylococcus aureus subsp. aureus Mu50
uuucauuuuuauccc

SEQ ID NO: 2055319 - RNA, 18 nt, Staphylococcus aureus subsp. aureus Mu50
uuucauuuuuucaauguc

SEQ ID NO: 2055320 - RNA, 13 nt, Staphylococcus aureus subsp. aureus Mu50
uuuccacugcaac

SEQ ID NO: 2055321 - RNA, 22 nt, Staphylococcus aureus subsp. aureus Mu50
uuuccaccggacaauguagaua

SEQ ID NO: 2055322 - RNA, 22 nt, Staphylococcus aureus subsp. aureus Mu50
uuucaugugucacaaugaccau

SEQ ID NO: 2055323 - RNA, 11 nt, Staphylococcus aureus subsp. aureus Mu50
uuucaucuuuc

SEQ ID NO: 2055324 - RNA, 20 nt, Staphylococcus aureus subsp. aureus Mu50
uuucaugcacuuuaacauaa

SEQ ID NO: 2055325 - RNA, 22 nt, Staphylococcus aureus subsp. aureus Mu50
uuucauuggauagguaacuaaa

SEQ ID NO: 2055326 - RNA, 16 nt, Staphylococcus aureus subsp. aureus Mu50
uuucaucguucauaua

SEQ ID NO: 2055327 - RNA, 14 nt, Staphylococcus aureus subsp. aureus Mu50
uuucaucaauauca

SEQ ID NO: 2055328 - RNA, 16 nt, Staphylococcus aureus subsp. aureus Mu50
uuucauauggugaacu

SEQ ID NO: 2055329 - RNA, 20 nt, Staphylococcus aureus subsp. aureus Mu50
uuucauaugcaucaacagau

SEQ ID NO: 2055330 - RNA, 18 nt, Staphylococcus aureus subsp. aureus Mu50
uuuauagaaaccaaaaaa

SEQ ID NO: 2055331 - RNA, 13 nt, Staphylococcus aureus subsp. aureus Mu50
uuuauacuuaaua

SEQ ID NO: 2055332 - RNA, 23 nt, Staphylococcus aureus subsp. aureus Mu50
uuuauuaguuauguuagucuuuu

SEQ ID NO: 2055333 - RNA, 14 nt, Staphylococcus aureus subsp. aureus Mu50
uuuauaguucuauu

SEQ ID NO: 2055334 - RNA, 15 nt, Staphylococcus aureus subsp. aureus Mu50
uuuauaguaauagcu

SEQ ID NO: 2055335 - RNA, 14 nt, Staphylococcus aureus subsp. aureus Mu50
uuuauucuucaguu

SEQ ID NO: 2055336 - RNA, 19 nt, Staphylococcus aureus subsp. aureus Mu50
uuuauuuagaauaaacuuu

SEQ ID NO: 2055337 - RNA, 15 nt, Staphylococcus aureus subsp. aureus Mu50
uuuauucuaaauaua

SEQ ID NO: 2055338 - RNA, 12 nt, Staphylococcus aureus subsp. aureus Mu50
uuuauuucuaua

SEQ ID NO: 2055339 - RNA, 16 nt, Staphylococcus aureus subsp. aureus Mu50
uuuauuaucuuuaauu

SEQ ID NO: 2055340 - RNA, 15 nt, Staphylococcus aureus subsp. aureus Mu50
uuuauuauaaaauag

SEQ ID NO: 2055341 - RNA, 15 nt, Staphylococcus aureus subsp. aureus Mu50
uuucaaauaauauaa

SEQ ID NO: 2055342 - RNA, 20 nt, Staphylococcus aureus subsp. aureus Mu50
uuucaaacgugauuuuauca

SEQ ID NO: 2055343 - RNA, 13 nt, Staphylococcus aureus subsp. aureus Mu50
uuuauuuugauua

SEQ ID NO: 2055344 - RNA, 19 nt, Staphylococcus aureus subsp. aureus Mu50
uuucaacgcauauucuauu

SEQ ID NO: 2055345 - RNA, 11 nt, Staphylococcus aureus subsp. aureus Mu50
uuucaacauuu

SEQ ID NO: 2055346 - RNA, 15 nt, Staphylococcus aureus subsp. aureus Mu50
uuucaacauuuuuua

SEQ ID NO: 2055347 - RNA, 13 nt, Staphylococcus aureus subsp. aureus Mu50
uuucaacauuacu

SEQ ID NO: 2055348 - RNA, 15 nt, Staphylococcus aureus subsp. aureus Mu50
uuucaacauauuaua

SEQ ID NO: 2055349 - RNA, 16 nt, Staphylococcus aureus subsp. aureus Mu50
uuucaauccuuuguuu

SEQ ID NO: 2055350 - RNA, 17 nt, Staphylococcus aureus subsp. aureus Mu50
uuucaauauuaaaauac

SEQ ID NO: 2055351 - RNA, 14 nt, Staphylococcus aureus subsp. aureus Mu50
uuucaauuagaaaa

SEQ ID NO: 2055352 - RNA, 23 nt, Staphylococcus aureus subsp. aureus Mu50
uuucaagugcuugguuaaaguua

SEQ ID NO: 2055353 - RNA, 17 nt, Staphylococcus aureus subsp. aureus Mu50
uuucaaguuuaaaauac

SEQ ID NO: 2055354 - RNA, 19 nt, Staphylococcus aureus subsp. aureus Mu50
uuucaaguuuaaaauacga

SEQ ID NO: 2055355 - RNA, 13 nt, Staphylococcus aureus subsp. aureus Mu50
uuucaauaaauuu

SEQ ID NO: 2055356 - RNA, 15 nt, Staphylococcus aureus subsp. aureus Mu50
uuucaauaaauuuua

SEQ ID NO: 2055357 - RNA, 17 nt, Staphylococcus aureus subsp. aureus Mu50
uuucaagaccaaauauu

SEQ ID NO: 2055358 - RNA, 14 nt, Staphylococcus aureus subsp. aureus Mu50
uuucaagaccaaau

SEQ ID NO: 2055359 - RNA, 22 nt, Staphylococcus aureus subsp. aureus Mu50
uuucacuacgucaagcuuugcu

SEQ ID NO: 2055360 - RNA, 21 nt, Staphylococcus aureus subsp. aureus Mu50
uuucacguagcuuuucauuua

SEQ ID NO: 2055361 - RNA, 21 nt, Staphylococcus aureus subsp. aureus Mu50
uuucacgaauaucuuaaagaa

SEQ ID NO: 2055362 - RNA, 12 nt, Staphylococcus aureus subsp. aureus Mu50
uuucaauuugga

SEQ ID NO: 2055363 - RNA, 18 nt, Staphylococcus aureus subsp. aureus Mu50
uuuaaacauccaauuaug

SEQ ID NO: 2055364 - RNA, 22 nt, Staphylococcus aureus subsp. aureus Mu50
uuuaaaauuauuuggcucuaua

SEQ ID NO: 2055365 - RNA, 16 nt, Staphylococcus aureus subsp. aureus Mu50
uuuaaaaucucauaau

SEQ ID NO: 2055366 - RNA, 21 nt, Staphylococcus aureus subsp. aureus Mu50
uuuaaaauaguucuuuaaauu

SEQ ID NO: 2055367 - RNA, 21 nt, Staphylococcus aureus subsp. aureus Mu50
uuuaaaauacgacaccaacau

SEQ ID NO: 2055368 - RNA, 14 nt, Staphylococcus aureus subsp. aureus Mu50
uuuaaaauaauaga

SEQ ID NO: 2055369 - RNA, 16 nt, Staphylococcus aureus subsp. aureus Mu50
uuuaaagaaaaguuua

SEQ ID NO: 2055370 - RNA, 18 nt, Staphylococcus aureus subsp. aureus Mu50
uuuaaagcaucauauaca

SEQ ID NO: 2055371 - RNA, 21 nt, Staphylococcus aureus subsp. aureus Mu50
uuuaaagaacuauuuuaaauu

SEQ ID NO: 2055372 - RNA, 16 nt, Staphylococcus aureus subsp. aureus Mu50
uuuaaacucguaaauu

SEQ ID NO: 2055373 - RNA, 21 nt, Staphylococcus aureus subsp. aureus Mu50
uuuaaaguuguugaaauuucu

SEQ ID NO: 2055374 - RNA, 16 nt, Staphylococcus aureus subsp. aureus Mu50
uuuaaaggcauaauaa

SEQ ID NO: 2055375 - RNA, 22 nt, Staphylococcus aureus subsp. aureus Mu50
uuuaaauaaaugacuucacauu

SEQ ID NO: 2055376 - RNA, 15 nt, Staphylococcus aureus subsp. aureus Mu50
uuuaaauuuucauca

SEQ ID NO: 2055377 - RNA, 13 nt, Staphylococcus aureus subsp. aureus Mu50
uuuaaauuuaaga

SEQ ID NO: 2055378 - RNA, 14 nt, Staphylococcus aureus subsp. aureus Mu50
uuuaacaaaauaua

SEQ ID NO: 2055379 - RNA, 13 nt, Staphylococcus aureus subsp. aureus Mu50
uuuaacaaaauua

SEQ ID NO: 2055380 - RNA, 18 nt, Staphylococcus aureus subsp. aureus Mu50
uuuaacaaaauuaagaag

SEQ ID NO: 2055381 - RNA, 10 nt, Staphylococcus aureus subsp. aureus Mu50
uuuaacauag

SEQ ID NO: 2055382 - RNA, 14 nt, Staphylococcus aureus subsp. aureus Mu50
uuuaacaacacuac

SEQ ID NO: 2055383 - RNA, 21 nt, Staphylococcus aureus subsp. aureus Mu50
uuuaacccacauuaaauauua

SEQ ID NO: 2055384 - RNA, 24 nt, Staphylococcus aureus subsp. aureus Mu50
uuuaacauuuauucuuucucuauu

SEQ ID NO: 2055385 - RNA, 14 nt, Staphylococcus aureus subsp. aureus Mu50
uuuaacauuucuga

SEQ ID NO: 2055386 - RNA, 16 nt, Staphylococcus aureus subsp. aureus Mu50
uuuaacacuucaguua

SEQ ID NO: 2055387 - RNA, 22 nt, Staphylococcus aureus subsp. aureus Mu50
uuuaaauaaucgaaaauuucag

SEQ ID NO: 2055388 - RNA, 18 nt, Staphylococcus aureus subsp. aureus Mu50
uuuaaaucuuuuagcuuu

SEQ ID NO: 2055389 - RNA, 19 nt, Staphylococcus aureus subsp. aureus Mu50
uuuaaaugauuucacuuca

SEQ ID NO: 2055390 - RNA, 23 nt, Staphylococcus aureus subsp. aureus Mu50
uuuaaaugauuucacuucauaaa

SEQ ID NO: 2055391 - RNA, 12 nt, Staphylococcus aureus subsp. aureus Mu50
uuguuuuuauau

SEQ ID NO: 2055392 - RNA, 16 nt, Staphylococcus aureus subsp. aureus Mu50
uuguuuuuaaaaucuc

SEQ ID NO: 2055393 - RNA, 21 nt, Staphylococcus aureus subsp. aureus Mu50
uuuaaaaaguaauuaauuccu

SEQ ID NO: 2055394 - RNA, 18 nt, Staphylococcus aureus subsp. aureus Mu50
uuuaaaaguaagcaccug

SEQ ID NO: 2055395 - RNA, 22 nt, Staphylococcus aureus subsp. aureus Mu50
uuuaaaaggcgaaacauuaaaa

SEQ ID NO: 2055396 - RNA, 18 nt, Staphylococcus aureus subsp. aureus Mu50
uuuaaaaaauuuaaauaa

SEQ ID NO: 2055397 - RNA, 23 nt, Staphylococcus aureus subsp. aureus Mu50
uuuaaaaaacauaccugcauauu

SEQ ID NO: 2055398 - RNA, 20 nt, Staphylococcus aureus subsp. aureus Mu50
uuguuuaucaauuucucuuu

SEQ ID NO: 2055399 - RNA, 13 nt, Staphylococcus aureus subsp. aureus Mu50
uuguuucuaaauu

SEQ ID NO: 2055400 - RNA, 14 nt, Staphylococcus aureus subsp. aureus Mu50
uuguuuaauaacaa

SEQ ID NO: 2055401 - RNA, 15 nt, Staphylococcus aureus subsp. aureus Mu50
uuguuuaagaaugua

SEQ ID NO: 2055402 - RNA, 17 nt, Staphylococcus aureus subsp. aureus Mu50
uuguuuaccuaaaucuu

SEQ ID NO: 2055403 - RNA, 13 nt, Staphylococcus aureus subsp. aureus Mu50
uuguuuagaaaag

SEQ ID NO: 2055404 - RNA, 18 nt, Staphylococcus aureus subsp. aureus Mu50
uuguuaauuuaaagucuu

SEQ ID NO: 2055405 - RNA, 13 nt, Staphylococcus aureus subsp. aureus Mu50
uuguuaauuucaa

SEQ ID NO: 2055406 - RNA, 14 nt, Staphylococcus aureus subsp. aureus Mu50
uuguuacauauugc

SEQ ID NO: 2055407 - RNA, 17 nt, Staphylococcus aureus subsp. aureus Mu50
uuguuaccaaacaauac

SEQ ID NO: 2055408 - RNA, 22 nt, Staphylococcus aureus subsp. aureus Mu50
uuguuaccaaacaauacauaau

SEQ ID NO: 2055409 - RNA, 17 nt, Staphylococcus aureus subsp. aureus Mu50
uuguuaguuuucuuaaa

SEQ ID NO: 2055410 - RNA, 19 nt, Staphylococcus aureus subsp. aureus Mu50
uuguuauaaguaaauaaua

SEQ ID NO: 2055411 - RNA, 17 nt, Staphylococcus aureus subsp. aureus Mu50
uuguucaacuaaauuuu

SEQ ID NO: 2055412 - RNA, 15 nt, Staphylococcus aureus subsp. aureus Mu50
uuguuggggcccaca

SEQ ID NO: 2055413 - RNA, 21 nt, Staphylococcus aureus subsp. aureus Mu50
uuuaguaucuauacaauuaug

SEQ ID NO: 2055414 - RNA, 21 nt, Staphylococcus aureus subsp. aureus Mu50
uuuaguauguuuuauuuucuu

SEQ ID NO: 2055415 - RNA, 22 nt, Staphylococcus aureus subsp. aureus Mu50
uuuaguauugguaccuuuccaa

SEQ ID NO: 2055416 - RNA, 14 nt, Staphylococcus aureus subsp. aureus Mu50
uuuagugacaaaca

SEQ ID NO: 2055417 - RNA, 20 nt, Staphylococcus aureus subsp. aureus Mu50
uuuaguccuucuuuacuaaa

SEQ ID NO: 2055418 - RNA, 18 nt, Staphylococcus aureus subsp. aureus Mu50
uuuagucgguguuuucuu

SEQ ID NO: 2055419 - RNA, 15 nt, Staphylococcus aureus subsp. aureus Mu50
uuuagugaaaaaguu

SEQ ID NO: 2055420 - RNA, 17 nt, Staphylococcus aureus subsp. aureus Mu50
uuuagugaaaagaacac

SEQ ID NO: 2055421 - RNA, 16 nt, Staphylococcus aureus subsp. aureus Mu50
uuuaguuaaauaguaa

SEQ ID NO: 2055422 - RNA, 15 nt, Staphylococcus aureus subsp. aureus Mu50
uuuaguuaauucucc

SEQ ID NO: 2055423 - RNA, 15 nt, Staphylococcus aureus subsp. aureus Mu50
uuuaguuaaauagua

SEQ ID NO: 2055424 - RNA, 18 nt, Staphylococcus aureus subsp. aureus Mu50
uuuaguuauacuacuauu

SEQ ID NO: 2055425 - RNA, 19 nt, Staphylococcus aureus subsp. aureus Mu50
uuuauaaacaauuacaaaa

SEQ ID NO: 2055426 - RNA, 12 nt, Staphylococcus aureus subsp. aureus Mu50
uuuauaaauuaa

SEQ ID NO: 2055427 - RNA, 15 nt, Staphylococcus aureus subsp. aureus Mu50
uuuauaaaucaaaga

SEQ ID NO: 2055428 - RNA, 21 nt, Staphylococcus aureus subsp. aureus Mu50
uuuauaaauuaaaugcaauac

SEQ ID NO: 2055429 - RNA, 21 nt, Staphylococcus aureus subsp. aureus Mu50
uuuaguucacaugaauuuuaa

SEQ ID NO: 2055430 - RNA, 15 nt, Staphylococcus aureus subsp. aureus Mu50
uuuacugcuucaauc

SEQ ID NO: 2055431 - RNA, 14 nt, Staphylococcus aureus subsp. aureus Mu50
uuuacucuaaagga

SEQ ID NO: 2055432 - RNA, 16 nt, Staphylococcus aureus subsp. aureus Mu50
uuuacucuacacucaa

SEQ ID NO: 2055433 - RNA, 16 nt, Staphylococcus aureus subsp. aureus Mu50
uuuacucaaaccaucu

SEQ ID NO: 2055434 - RNA, 17 nt, Staphylococcus aureus subsp. aureus Mu50
uuuacucaaaccaucuu

SEQ ID NO: 2055435 - RNA, 17 nt, Staphylococcus aureus subsp. aureus Mu50
uuuagccccagcaaaua

SEQ ID NO: 2055436 - RNA, 12 nt, Staphylococcus aureus subsp. aureus Mu50
uuuacuuaaucu

SEQ ID NO: 2055437 - RNA, 19 nt, Staphylococcus aureus subsp. aureus Mu50
uuuagcuauguaaaauuau

SEQ ID NO: 2055438 - RNA, 23 nt, Staphylococcus aureus subsp. aureus Mu50
uuuaggacgugccuuaacuucau

SEQ ID NO: 2055439 - RNA, 14 nt, Staphylococcus aureus subsp. aureus Mu50
uuuaauuaaaguua

SEQ ID NO: 2055440 - RNA, 17 nt, Staphylococcus aureus subsp. aureus Mu50
uuuaauuaauuaucaua

SEQ ID NO: 2055441 - RNA, 16 nt, Staphylococcus aureus subsp. aureus Mu50
uuuaauuaaaauacaa

SEQ ID NO: 2055442 - RNA, 11 nt, Staphylococcus aureus subsp. aureus Mu50
uuuaauuauuu

SEQ ID NO: 2055443 - RNA, 17 nt, Staphylococcus aureus subsp. aureus Mu50
uuuaauuauuuuaaaaa

SEQ ID NO: 2055444 - RNA, 16 nt, Staphylococcus aureus subsp. aureus Mu50
uuuaauugaaauagaa

SEQ ID NO: 2055445 - RNA, 14 nt, Staphylococcus aureus subsp. aureus Mu50
uuuaauugcuguaa

SEQ ID NO: 2055446 - RNA, 18 nt, Staphylococcus aureus subsp. aureus Mu50
uuuaauuuacaauuaauu

SEQ ID NO: 2055447 - RNA, 16 nt, Staphylococcus aureus subsp. aureus Mu50
uuuaauugguucuucu

SEQ ID NO: 2055448 - RNA, 22 nt, Staphylococcus aureus subsp. aureus Mu50
uuuaauucugguuuaaugagcu

SEQ ID NO: 2055449 - RNA, 21 nt, Staphylococcus aureus subsp. aureus Mu50
uuuaauuccaaagaaagcuaa

SEQ ID NO: 2055450 - RNA, 18 nt, Staphylococcus aureus subsp. aureus Mu50
uuuaauuuucuaaauaua

SEQ ID NO: 2055451 - RNA, 16 nt, Staphylococcus aureus subsp. aureus Mu50
uuuaauuuucuaaaua

SEQ ID NO: 2055452 - RNA, 17 nt, Staphylococcus aureus subsp. aureus Mu50
uuuaauuuucuaaauau

SEQ ID NO: 2055453 - RNA, 15 nt, Staphylococcus aureus subsp. aureus Mu50
uuuaauuuucagaau

SEQ ID NO: 2055454 - RNA, 12 nt, Staphylococcus aureus subsp. aureus Mu50
uuuaauuuguua

SEQ ID NO: 2055455 - RNA, 14 nt, Staphylococcus aureus subsp. aureus Mu50
uuuaauuuucuaaa

SEQ ID NO: 2055456 - RNA, 23 nt, Staphylococcus aureus subsp. aureus Mu50
uuuaauuucugguaaaaaaauaa

SEQ ID NO: 2055457 - RNA, 18 nt, Staphylococcus aureus subsp. aureus Mu50
uuuaauuuaguacucaau

SEQ ID NO: 2055458 - RNA, 14 nt, Staphylococcus aureus subsp. aureus Mu50
uuuaauuucacuuu

SEQ ID NO: 2055459 - RNA, 17 nt, Staphylococcus aureus subsp. aureus Mu50
uuuaccaauaucaugca

SEQ ID NO: 2055460 - RNA, 15 nt, Staphylococcus aureus subsp. aureus Mu50
uuuaauuuuucuaaa

SEQ ID NO: 2055461 - RNA, 17 nt, Staphylococcus aureus subsp. aureus Mu50
uuuaauuuuucauuaau

SEQ ID NO: 2055462 - RNA, 19 nt, Staphylococcus aureus subsp. aureus Mu50
uuuacaaacuucacaucau

SEQ ID NO: 2055463 - RNA, 20 nt, Staphylococcus aureus subsp. aureus Mu50
uuuacaaacuucacaucaug

SEQ ID NO: 2055464 - RNA, 22 nt, Staphylococcus aureus subsp. aureus Mu50
uuuacaaauguauaaauaauaa

SEQ ID NO: 2055465 - RNA, 22 nt, Staphylococcus aureus subsp. aureus Mu50
uuuaccuucgcauacuuuuuca

SEQ ID NO: 2055466 - RNA, 17 nt, Staphylococcus aureus subsp. aureus Mu50
uuuaccauugugaauaa

SEQ ID NO: 2055467 - RNA, 15 nt, Staphylococcus aureus subsp. aureus Mu50
uugacauauuuuuua

SEQ ID NO: 2055468 - RNA, 18 nt, Staphylococcus aureus subsp. aureus Mu50
uugacauguguuaaacca

SEQ ID NO: 2055469 - RNA, 15 nt, Staphylococcus aureus subsp. aureus Mu50
uugacauuugaccaa

SEQ ID NO: 2055470 - RNA, 19 nt, Staphylococcus aureus subsp. aureus Mu50
uugaccaccugauaaugca

SEQ ID NO: 2055471 - RNA, 21 nt, Staphylococcus aureus subsp. aureus Mu50
uugaauuuaauacuauaguaa

SEQ ID NO: 2055472 - RNA, 17 nt, Staphylococcus aureus subsp. aureus Mu50
uugaauugaaaaauuaa

SEQ ID NO: 2055473 - RNA, 16 nt, Staphylococcus aureus subsp. aureus Mu50
uugaauuuuauuaggu

SEQ ID NO: 2055474 - RNA, 19 nt, Staphylococcus aureus subsp. aureus Mu50
uugacacacccaaauuuag

SEQ ID NO: 2055475 - RNA, 19 nt, Staphylococcus aureus subsp. aureus Mu50
uugacaaguugcugaauaa

SEQ ID NO: 2055476 - RNA, 20 nt, Staphylococcus aureus subsp. aureus Mu50
uugacuaaguuuguuuucuu

SEQ ID NO: 2055477 - RNA, 14 nt, Staphylococcus aureus subsp. aureus Mu50
uugacguucugauc

SEQ ID NO: 2055478 - RNA, 14 nt, Staphylococcus aureus subsp. aureus Mu50
uugacuaaguuugu

SEQ ID NO: 2055479 - RNA, 14 nt, Staphylococcus aureus subsp. aureus Mu50
uugaauguuucucc

SEQ ID NO: 2055480 - RNA, 17 nt, Staphylococcus aureus subsp. aureus Mu50
uugaaugguauaauucc

SEQ ID NO: 2055481 - RNA, 23 nt, Staphylococcus aureus subsp. aureus Mu50
uugaaugaaguaauauauaaaag

SEQ ID NO: 2055482 - RNA, 17 nt, Staphylococcus aureus subsp. aureus Mu50
uugaaucuuguugaacu

SEQ ID NO: 2055483 - RNA, 20 nt, Staphylococcus aureus subsp. aureus Mu50
uugaaucauacgaauuugug

SEQ ID NO: 2055484 - RNA, 17 nt, Staphylococcus aureus subsp. aureus Mu50
uugaaucaguauaauca

SEQ ID NO: 2055485 - RNA, 15 nt, Staphylococcus aureus subsp. aureus Mu50
uugaauauaguccuu

SEQ ID NO: 2055486 - RNA, 18 nt, Staphylococcus aureus subsp. aureus Mu50
uugaauauaguccuuccc

SEQ ID NO: 2055487 - RNA, 11 nt, Staphylococcus aureus subsp. aureus Mu50
uugaauaauca

SEQ ID NO: 2055488 - RNA, 22 nt, Staphylococcus aureus subsp. aureus Mu50
uugaauacuuuuuaacugguug

SEQ ID NO: 2055489 - RNA, 22 nt, Staphylococcus aureus subsp. aureus Mu50
uugaagugaguuuaucuacauu

SEQ ID NO: 2055490 - RNA, 17 nt, Staphylococcus aureus subsp. aureus Mu50
uugaagugauuugccaa

SEQ ID NO: 2055491 - RNA, 18 nt, Staphylococcus aureus subsp. aureus Mu50
uugaagaugcuuuaauua

SEQ ID NO: 2055492 - RNA, 19 nt, Staphylococcus aureus subsp. aureus Mu50
uugaagaauaaaaaaguug

SEQ ID NO: 2055493 - RNA, 15 nt, Staphylococcus aureus subsp. aureus Mu50
uugaagggagcauuu

SEQ ID NO: 2055494 - RNA, 17 nt, Staphylococcus aureus subsp. aureus Mu50
uugaagcuaauucauau

SEQ ID NO: 2055495 - RNA, 21 nt, Staphylococcus aureus subsp. aureus Mu50
uugaaccggaaauuaaaucga

SEQ ID NO: 2055496 - RNA, 19 nt, Staphylococcus aureus subsp. aureus Mu50
uugaacuuuaguauauuca

SEQ ID NO: 2055497 - RNA, 13 nt, Staphylococcus aureus subsp. aureus Mu50
uugaacuucuuuu

SEQ ID NO: 2055498 - RNA, 22 nt, Staphylococcus aureus subsp. aureus Mu50
uucuuuaacaauugauugcucu

SEQ ID NO: 2055499 - RNA, 12 nt, Staphylococcus aureus subsp. aureus Mu50
uucuuuaacaau

SEQ ID NO: 2055500 - RNA, 21 nt, Staphylococcus aureus subsp. aureus Mu50
uucuuuacuucuuucaaaaac

SEQ ID NO: 2055501 - RNA, 15 nt, Staphylococcus aureus subsp. aureus Mu50
uucuuuacuaaagau

SEQ ID NO: 2055502 - RNA, 16 nt, Staphylococcus aureus subsp. aureus Mu50
uucuuuauuagaauga

SEQ ID NO: 2055503 - RNA, 14 nt, Staphylococcus aureus subsp. aureus Mu50
uucuuucaggcuuu

SEQ ID NO: 2055504 - RNA, 12 nt, Staphylococcus aureus subsp. aureus Mu50
uucuuucauaau

SEQ ID NO: 2055505 - RNA, 23 nt, Staphylococcus aureus subsp. aureus Mu50
uucuuugucuguaaagcuaucca

SEQ ID NO: 2055506 - RNA, 17 nt, Staphylococcus aureus subsp. aureus Mu50
uucuuuguguuugcuuu

SEQ ID NO: 2055507 - RNA, 13 nt, Staphylococcus aureus subsp. aureus Mu50
uucuuucauaauu

SEQ ID NO: 2055508 - RNA, 14 nt, Staphylococcus aureus subsp. aureus Mu50
uucuuucauaauua

SEQ ID NO: 2055509 - RNA, 15 nt, Staphylococcus aureus subsp. aureus Mu50
uucuuuuucaucuuu

SEQ ID NO: 2055510 - RNA, 11 nt, Staphylococcus aureus subsp. aureus Mu50
uucuuuuuaac

SEQ ID NO: 2055511 - RNA, 15 nt, Staphylococcus aureus subsp. aureus Mu50
uucuuuuguuuuuau

SEQ ID NO: 2055512 - RNA, 11 nt, Staphylococcus aureus subsp. aureus Mu50
uucuuuuuaaa

SEQ ID NO: 2055513 - RNA, 19 nt, Staphylococcus aureus subsp. aureus Mu50
uucuuuuguaauugaaaug

SEQ ID NO: 2055514 - RNA, 23 nt, Staphylococcus aureus subsp. aureus Mu50
uucuuuuguaauugaaaugauag

SEQ ID NO: 2055515 - RNA, 16 nt, Staphylococcus aureus subsp. aureus Mu50
uugaaaagauaaacaa

SEQ ID NO: 2055516 - RNA, 12 nt, Staphylococcus aureus subsp. aureus Mu50
uugaaaaguuug

SEQ ID NO: 2055517 - RNA, 19 nt, Staphylococcus aureus subsp. aureus Mu50
uugaaaaguaauuaaauac

SEQ ID NO: 2055518 - RNA, 15 nt, Staphylococcus aureus subsp. aureus Mu50
uucuuuuucuauaca

SEQ ID NO: 2055519 - RNA, 18 nt, Staphylococcus aureus subsp. aureus Mu50
uucuuuuuguucggcuuu

SEQ ID NO: 2055520 - RNA, 23 nt, Staphylococcus aureus subsp. aureus Mu50
uucuuuuuuaauucuauuuuuga

SEQ ID NO: 2055521 - RNA, 17 nt, Staphylococcus aureus subsp. aureus Mu50
uugaaauaaucuaguau

SEQ ID NO: 2055522 - RNA, 20 nt, Staphylococcus aureus subsp. aureus Mu50
uugaaacugaguucaauuaa

SEQ ID NO: 2055523 - RNA, 17 nt, Staphylococcus aureus subsp. aureus Mu50
uugaacauauuauaaaa

SEQ ID NO: 2055524 - RNA, 15 nt, Staphylococcus aureus subsp. aureus Mu50
uugaacaauucuuca

SEQ ID NO: 2055525 - RNA, 15 nt, Staphylococcus aureus subsp. aureus Mu50
uugaaauuaauuauc

SEQ ID NO: 2055526 - RNA, 19 nt, Staphylococcus aureus subsp. aureus Mu50
uugaaauuauuauuuaaau

SEQ ID NO: 2055527 - RNA, 16 nt, Staphylococcus aureus subsp. aureus Mu50
uugaaauugacaguuu

SEQ ID NO: 2055528 - RNA, 18 nt, Staphylococcus aureus subsp. aureus Mu50
uugauauauauuuugcaa

SEQ ID NO: 2055529 - RNA, 21 nt, Staphylococcus aureus subsp. aureus Mu50
uugauaagaaaaaguuauauc

SEQ ID NO: 2055530 - RNA, 19 nt, Staphylococcus aureus subsp. aureus Mu50
uugauaugcucucuucaaa

SEQ ID NO: 2055531 - RNA, 21 nt, Staphylococcus aureus subsp. aureus Mu50
uugauaugguuagagaaaaau

SEQ ID NO: 2055532 - RNA, 13 nt, Staphylococcus aureus subsp. aureus Mu50
uugauauuucauc

SEQ ID NO: 2055533 - RNA, 16 nt, Staphylococcus aureus subsp. aureus Mu50
uugauauucuaaaaaa

SEQ ID NO: 2055534 - RNA, 11 nt, Staphylococcus aureus subsp. aureus Mu50
uugauauguuu

SEQ ID NO: 2055535 - RNA, 12 nt, Staphylococcus aureus subsp. aureus Mu50
uugaugaauaaa

SEQ ID NO: 2055536 - RNA, 24 nt, Staphylococcus aureus subsp. aureus Mu50
uugauccaaaguacucaaguaauc

SEQ ID NO: 2055537 - RNA, 17 nt, Staphylococcus aureus subsp. aureus Mu50
uugaucaaaaauguuau

SEQ ID NO: 2055538 - RNA, 17 nt, Staphylococcus aureus subsp. aureus Mu50
uugaucaacuauauaua

SEQ ID NO: 2055539 - RNA, 17 nt, Staphylococcus aureus subsp. aureus Mu50
uugacuuuaauugcucu

SEQ ID NO: 2055540 - RNA, 16 nt, Staphylococcus aureus subsp. aureus Mu50
uugagacguuuuccau

SEQ ID NO: 2055541 - RNA, 18 nt, Staphylococcus aureus subsp. aureus Mu50
uugagacaauucguaaau

SEQ ID NO: 2055542 - RNA, 14 nt, Staphylococcus aureus subsp. aureus Mu50
uugagacaacauug

SEQ ID NO: 2055543 - RNA, 14 nt, Staphylococcus aureus subsp. aureus Mu50
uugagaauauuaag

SEQ ID NO: 2055544 - RNA, 16 nt, Staphylococcus aureus subsp. aureus Mu50
uugauaacaauuuuaa

SEQ ID NO: 2055545 - RNA, 14 nt, Staphylococcus aureus subsp. aureus Mu50
uugauaaaauaaau

SEQ ID NO: 2055546 - RNA, 16 nt, Staphylococcus aureus subsp. aureus Mu50
uugauaaaauaaauaa

SEQ ID NO: 2055547 - RNA, 13 nt, Staphylococcus aureus subsp. aureus Mu50
uugauaaaauaau

SEQ ID NO: 2055548 - RNA, 22 nt, Staphylococcus aureus subsp. aureus Mu50
uugagcaauucuugaaaaguuu

SEQ ID NO: 2055549 - RNA, 19 nt, Staphylococcus aureus subsp. aureus Mu50
uugcacaaagauauguuua

SEQ ID NO: 2055550 - RNA, 19 nt, Staphylococcus aureus subsp. aureus Mu50
uugcaaugcauauugugcc

SEQ ID NO: 2055551 - RNA, 16 nt, Staphylococcus aureus subsp. aureus Mu50
uugcaauugcaaugaa

SEQ ID NO: 2055552 - RNA, 16 nt, Staphylococcus aureus subsp. aureus Mu50
uugcaaucguauguaa

SEQ ID NO: 2055553 - RNA, 18 nt, Staphylococcus aureus subsp. aureus Mu50
uugcaauaauucaucuug

SEQ ID NO: 2055554 - RNA, 13 nt, Staphylococcus aureus subsp. aureus Mu50
uugcaauaaaauu

SEQ ID NO: 2055555 - RNA, 15 nt, Staphylococcus aureus subsp. aureus Mu50
uugcaaaguaacaau

SEQ ID NO: 2055556 - RNA, 19 nt, Staphylococcus aureus subsp. aureus Mu50
uugcaaauuaucauuaaau

SEQ ID NO: 2055557 - RNA, 20 nt, Staphylococcus aureus subsp. aureus Mu50
uugcaaauuaucauuaaauu

SEQ ID NO: 2055558 - RNA, 15 nt, Staphylococcus aureus subsp. aureus Mu50
uugcaacauuaaauu

SEQ ID NO: 2055559 - RNA, 13 nt, Staphylococcus aureus subsp. aureus Mu50
uugauucuaaaua

SEQ ID NO: 2055560 - RNA, 16 nt, Staphylococcus aureus subsp. aureus Mu50
uugauucuacuucacc

SEQ ID NO: 2055561 - RNA, 20 nt, Staphylococcus aureus subsp. aureus Mu50
uugcaaaacgcauuucaugu

SEQ ID NO: 2055562 - RNA, 14 nt, Staphylococcus aureus subsp. aureus Mu50
uugcaaaauacgau

SEQ ID NO: 2055563 - RNA, 17 nt, Staphylococcus aureus subsp. aureus Mu50
uugauuguauuuuucaa

SEQ ID NO: 2055564 - RNA, 20 nt, Staphylococcus aureus subsp. aureus Mu50
uugccaaauuucucuuucaa

SEQ ID NO: 2055565 - RNA, 21 nt, Staphylococcus aureus subsp. aureus Mu50
uugcacaguuucaucuucaac

SEQ ID NO: 2055566 - RNA, 21 nt, Staphylococcus aureus subsp. aureus Mu50
uugcucuaauccaaaauaauc

SEQ ID NO: 2055567 - RNA, 15 nt, Staphylococcus aureus subsp. aureus Mu50
uugcucuuuaacaau

SEQ ID NO: 2055568 - RNA, 14 nt, Staphylococcus aureus subsp. aureus Mu50
uugcugaauaaaau

SEQ ID NO: 2055569 - RNA, 23 nt, Staphylococcus aureus subsp. aureus Mu50
uugcguuuguguguuuuaaaauu

SEQ ID NO: 2055570 - RNA, 12 nt, Staphylococcus aureus subsp. aureus Mu50
uugcuaaaauau

SEQ ID NO: 2055571 - RNA, 22 nt, Staphylococcus aureus subsp. aureus Mu50
uugcuaaaaaaauuaaaauguu

SEQ ID NO: 2055572 - RNA, 22 nt, Staphylococcus aureus subsp. aureus Mu50
uugcucaccuuuagacaauauu

SEQ ID NO: 2055573 - RNA, 18 nt, Staphylococcus aureus subsp. aureus Mu50
uugccuguagaauuucuu

SEQ ID NO: 2055574 - RNA, 12 nt, Staphylococcus aureus subsp. aureus Mu50
uucccacuuauc

SEQ ID NO: 2055575 - RNA, 22 nt, Staphylococcus aureus subsp. aureus Mu50
uuccucuccuucggcucucgcu

SEQ ID NO: 2055576 - RNA, 15 nt, Staphylococcus aureus subsp. aureus Mu50
uuccugcuacaacuu

SEQ ID NO: 2055577 - RNA, 20 nt, Staphylococcus aureus subsp. aureus Mu50
uuccugcuacaacuucuucu

SEQ ID NO: 2055578 - RNA, 16 nt, Staphylococcus aureus subsp. aureus Mu50
uuccuauuaggaucca

SEQ ID NO: 2055579 - RNA, 19 nt, Staphylococcus aureus subsp. aureus Mu50
uuccacuucaucuaaauga

SEQ ID NO: 2055580 - RNA, 15 nt, Staphylococcus aureus subsp. aureus Mu50
uuccaccagccucug

SEQ ID NO: 2055581 - RNA, 20 nt, Staphylococcus aureus subsp. aureus Mu50
uucaggguuuaagauuuuau

SEQ ID NO: 2055582 - RNA, 16 nt, Staphylococcus aureus subsp. aureus Mu50
uuccaauuuaaaauga

SEQ ID NO: 2055583 - RNA, 18 nt, Staphylococcus aureus subsp. aureus Mu50
uuccauauuuuuuaguaa

SEQ ID NO: 2055584 - RNA, 21 nt, Staphylococcus aureus subsp. aureus Mu50
uuccaucauuuguguaaauga

SEQ ID NO: 2055585 - RNA, 13 nt, Staphylococcus aureus subsp. aureus Mu50
uuccaugaauaag

SEQ ID NO: 2055586 - RNA, 22 nt, Staphylococcus aureus subsp. aureus Mu50
uuccauuucgauaccuaaaaua

SEQ ID NO: 2055587 - RNA, 17 nt, Staphylococcus aureus subsp. aureus Mu50
uuccauugauguaugug

SEQ ID NO: 2055588 - RNA, 15 nt, Staphylococcus aureus subsp. aureus Mu50
uuccauucauaaaag

SEQ ID NO: 2055589 - RNA, 18 nt, Staphylococcus aureus subsp. aureus Mu50
uuccaugaguuuacuaaa

SEQ ID NO: 2055590 - RNA, 17 nt, Staphylococcus aureus subsp. aureus Mu50
uuccauaaauaaaaugc

SEQ ID NO: 2055591 - RNA, 19 nt, Staphylococcus aureus subsp. aureus Mu50
uuccauaaauaaaaugcua

SEQ ID NO: 2055592 - RNA, 23 nt, Staphylococcus aureus subsp. aureus Mu50
uucgaacgauauuuuaaaaagua

SEQ ID NO: 2055593 - RNA, 20 nt, Staphylococcus aureus subsp. aureus Mu50
uucgcauacuuuuucagaau

SEQ ID NO: 2055594 - RNA, 17 nt, Staphylococcus aureus subsp. aureus Mu50
uucgaaaagaaauucua

SEQ ID NO: 2055595 - RNA, 20 nt, Staphylococcus aureus subsp. aureus Mu50
uucgaacgauauuuuaaaaa

SEQ ID NO: 2055596 - RNA, 13 nt, Staphylococcus aureus subsp. aureus Mu50
uuccuuuuuuuaa

SEQ ID NO: 2055597 - RNA, 19 nt, Staphylococcus aureus subsp. aureus Mu50
uuccuuuagcaaaaauauu

SEQ ID NO: 2055598 - RNA, 22 nt, Staphylococcus aureus subsp. aureus Mu50
uuccuuguuuuaaacuuauuaa

SEQ ID NO: 2055599 - RNA, 19 nt, Staphylococcus aureus subsp. aureus Mu50
uucgcugcuacaccaccug

SEQ ID NO: 2055600 - RNA, 23 nt, Staphylococcus aureus subsp. aureus Mu50
uucgcuaauaauacgucguaaug

SEQ ID NO: 2055601 - RNA, 17 nt, Staphylococcus aureus subsp. aureus Mu50
uucgcaucguucccugc

SEQ ID NO: 2055602 - RNA, 14 nt, Staphylococcus aureus subsp. aureus Mu50
uucgccuaaauggu

SEQ ID NO: 2055603 - RNA, 15 nt, Staphylococcus aureus subsp. aureus Mu50
uucguucuaaaagga

SEQ ID NO: 2055604 - RNA, 12 nt, Staphylococcus aureus subsp. aureus Mu50
uucuaaauaaac

SEQ ID NO: 2055605 - RNA, 16 nt, Staphylococcus aureus subsp. aureus Mu50
uucuaaaucaauauaa

SEQ ID NO: 2055606 - RNA, 13 nt, Staphylococcus aureus subsp. aureus Mu50
uucuaaaucuugu

SEQ ID NO: 2055607 - RNA, 13 nt, Staphylococcus aureus subsp. aureus Mu50
uucuaaccacuuc

SEQ ID NO: 2055608 - RNA, 19 nt, Staphylococcus aureus subsp. aureus Mu50
uucuaacugcaaagccaug

SEQ ID NO: 2055609 - RNA, 18 nt, Staphylococcus aureus subsp. aureus Mu50
uucguguuccaauuuuau

SEQ ID NO: 2055610 - RNA, 23 nt, Staphylococcus aureus subsp. aureus Mu50
uucguacuaguucgauucaugaa

SEQ ID NO: 2055611 - RNA, 17 nt, Staphylococcus aureus subsp. aureus Mu50
uucguaauguguuaaua

SEQ ID NO: 2055612 - RNA, 13 nt, Staphylococcus aureus subsp. aureus Mu50
uucguaauaaaca

SEQ ID NO: 2055613 - RNA, 19 nt, Staphylococcus aureus subsp. aureus Mu50
uucguaacauuuaaaaaau

SEQ ID NO: 2055614 - RNA, 19 nt, Staphylococcus aureus subsp. aureus Mu50
uucggaauuugcacaaaga

SEQ ID NO: 2055615 - RNA, 16 nt, Staphylococcus aureus subsp. aureus Mu50
uucugauucuucacua

SEQ ID NO: 2055616 - RNA, 13 nt, Staphylococcus aureus subsp. aureus Mu50
uucucuuaaauau

SEQ ID NO: 2055617 - RNA, 23 nt, Staphylococcus aureus subsp. aureus Mu50
uucucuauugauuguaccaguaa

SEQ ID NO: 2055618 - RNA, 13 nt, Staphylococcus aureus subsp. aureus Mu50
uucucuaaucacu

SEQ ID NO: 2055619 - RNA, 21 nt, Staphylococcus aureus subsp. aureus Mu50
uucucuaacgauuucuaguuu

SEQ ID NO: 2055620 - RNA, 12 nt, Staphylococcus aureus subsp. aureus Mu50
uucucguguaaa

SEQ ID NO: 2055621 - RNA, 17 nt, Staphylococcus aureus subsp. aureus Mu50
uucucacugcuguucuu

SEQ ID NO: 2055622 - RNA, 18 nt, Staphylococcus aureus subsp. aureus Mu50
uucuacaggcaaugcaag

SEQ ID NO: 2055623 - RNA, 20 nt, Staphylococcus aureus subsp. aureus Mu50
uucuacaggcaaugcaaguu

SEQ ID NO: 2055624 - RNA, 21 nt, Staphylococcus aureus subsp. aureus Mu50
uucuacaggcaaugcaaguug

SEQ ID NO: 2055625 - RNA, 21 nt, Staphylococcus aureus subsp. aureus Mu50
uucuacccauaauuuaaauga

SEQ ID NO: 2055626 - RNA, 16 nt, Staphylococcus aureus subsp. aureus Mu50
uucuaccaauaauucc

SEQ ID NO: 2055627 - RNA, 14 nt, Staphylococcus aureus subsp. aureus Mu50
uucuacagguaaug

SEQ ID NO: 2055628 - RNA, 17 nt, Staphylococcus aureus subsp. aureus Mu50
uucuacagguaaugcaa

SEQ ID NO: 2055629 - RNA, 18 nt, Staphylococcus aureus subsp. aureus Mu50
uucuacagguaaugcaag

SEQ ID NO: 2055630 - RNA, 19 nt, Staphylococcus aureus subsp. aureus Mu50
uucuacagguaaugcaagu

SEQ ID NO: 2055631 - RNA, 20 nt, Staphylococcus aureus subsp. aureus Mu50
uucuacagguaaugcaaguu

SEQ ID NO: 2055632 - RNA, 21 nt, Staphylococcus aureus subsp. aureus Mu50
uucuacagguaaugcaaguug

SEQ ID NO: 2055633 - RNA, 20 nt, Staphylococcus aureus subsp. aureus Mu50
uucuaaucguuaauaaaccu

SEQ ID NO: 2055634 - RNA, 13 nt, Staphylococcus aureus subsp. aureus Mu50
uucuaaucuaaau

SEQ ID NO: 2055635 - RNA, 14 nt, Staphylococcus aureus subsp. aureus Mu50
uucuaauuuuucac

SEQ ID NO: 2055636 - RNA, 20 nt, Staphylococcus aureus subsp. aureus Mu50
uucuaauugaaaucaucuua

SEQ ID NO: 2055637 - RNA, 16 nt, Staphylococcus aureus subsp. aureus Mu50
uucuaaugcuaauuua

SEQ ID NO: 2055638 - RNA, 17 nt, Staphylococcus aureus subsp. aureus Mu50
uucuaaugcuaauuuaa

SEQ ID NO: 2055639 - RNA, 19 nt, Staphylococcus aureus subsp. aureus Mu50
uucuaaugcugcuucuuca

SEQ ID NO: 2055640 - RNA, 12 nt, Staphylococcus aureus subsp. aureus Mu50
uucuagguaaua

SEQ ID NO: 2055641 - RNA, 20 nt, Staphylococcus aureus subsp. aureus Mu50
uucuauacauuccaaaguac

SEQ ID NO: 2055642 - RNA, 14 nt, Staphylococcus aureus subsp. aureus Mu50
uucuauaauucacu

SEQ ID NO: 2055643 - RNA, 14 nt, Staphylococcus aureus subsp. aureus Mu50
uucuauaauuuuaa

SEQ ID NO: 2055644 - RNA, 14 nt, Staphylococcus aureus subsp. aureus Mu50
uucuagugaaauac

SEQ ID NO: 2055645 - RNA, 18 nt, Staphylococcus aureus subsp. aureus Mu50
uucuaugcucuacgaagu

SEQ ID NO: 2055646 - RNA, 17 nt, Staphylococcus aureus subsp. aureus Mu50
uucuauggcacaaauga

SEQ ID NO: 2055647 - RNA, 13 nt, Staphylococcus aureus subsp. aureus Mu50
uucuauuaagaaa

SEQ ID NO: 2055648 - RNA, 19 nt, Staphylococcus aureus subsp. aureus Mu50
uucuauuaagaaauacuca

SEQ ID NO: 2055649 - RNA, 17 nt, Staphylococcus aureus subsp. aureus Mu50
uucucacaacugcauau

SEQ ID NO: 2055650 - RNA, 14 nt, Staphylococcus aureus subsp. aureus Mu50
uucuauuuuauaau

SEQ ID NO: 2055651 - RNA, 15 nt, Staphylococcus aureus subsp. aureus Mu50
uucuauucaaaaagg

SEQ ID NO: 2055652 - RNA, 18 nt, Staphylococcus aureus subsp. aureus Mu50
uuaucagcgaaauuugua

SEQ ID NO: 2055653 - RNA, 18 nt, Staphylococcus aureus subsp. aureus Mu50
uuaucaucacacucuccc

SEQ ID NO: 2055654 - RNA, 14 nt, Staphylococcus aureus subsp. aureus Mu50
uuaucaucuauuca

SEQ ID NO: 2055655 - RNA, 14 nt, Staphylococcus aureus subsp. aureus Mu50
uuaucauuaaauug

SEQ ID NO: 2055656 - RNA, 20 nt, Staphylococcus aureus subsp. aureus Mu50
uuaucauuuuuaauuuugac

SEQ ID NO: 2055657 - RNA, 21 nt, Staphylococcus aureus subsp. aureus Mu50
uuauccaaggauguuauaaaa

SEQ ID NO: 2055658 - RNA, 22 nt, Staphylococcus aureus subsp. aureus Mu50
uuauccaaaccaauuuuaacuu

SEQ ID NO: 2055659 - RNA, 18 nt, Staphylococcus aureus subsp. aureus Mu50
uuauccaaaacauuuugu

SEQ ID NO: 2055660 - RNA, 15 nt, Staphylococcus aureus subsp. aureus Mu50
uuaucgaagaaacau

SEQ ID NO: 2055661 - RNA, 18 nt, Staphylococcus aureus subsp. aureus Mu50
uuauauuuuucuucaguu

SEQ ID NO: 2055662 - RNA, 14 nt, Staphylococcus aureus subsp. aureus Mu50
uuaucaaauugacc

SEQ ID NO: 2055663 - RNA, 19 nt, Staphylococcus aureus subsp. aureus Mu50
uuaucaagagguaaaucug

SEQ ID NO: 2055664 - RNA, 16 nt, Staphylococcus aureus subsp. aureus Mu50
uuauauuguuaaaauu

SEQ ID NO: 2055665 - RNA, 16 nt, Staphylococcus aureus subsp. aureus Mu50
uuauauuguauuuuau

SEQ ID NO: 2055666 - RNA, 18 nt, Staphylococcus aureus subsp. aureus Mu50
uuauauuguauuuuauuu

SEQ ID NO: 2055667 - RNA, 11 nt, Staphylococcus aureus subsp. aureus Mu50
uuauauuuucu

SEQ ID NO: 2055668 - RNA, 13 nt, Staphylococcus aureus subsp. aureus Mu50
uuauauuuuauua

SEQ ID NO: 2055669 - RNA, 14 nt, Staphylococcus aureus subsp. aureus Mu50
uuauaugcaacuua

SEQ ID NO: 2055670 - RNA, 20 nt, Staphylococcus aureus subsp. aureus Mu50
uuauauuaaucguuaaugua

SEQ ID NO: 2055671 - RNA, 23 nt, Staphylococcus aureus subsp. aureus Mu50
uuauauccaucuccaccauuaau

SEQ ID NO: 2055672 - RNA, 13 nt, Staphylococcus aureus subsp. aureus Mu50
uuauaucaucaac

SEQ ID NO: 2055673 - RNA, 16 nt, Staphylococcus aureus subsp. aureus Mu50
uuauauugcaaaaaua

SEQ ID NO: 2055674 - RNA, 17 nt, Staphylococcus aureus subsp. aureus Mu50
uuauauugcaaaaauaa

SEQ ID NO: 2055675 - RNA, 12 nt, Staphylococcus aureus subsp. aureus Mu50
uuauauuaucau

SEQ ID NO: 2055676 - RNA, 19 nt, Staphylococcus aureus subsp. aureus Mu50
uuauauucaacuuauuauu

SEQ ID NO: 2055677 - RNA, 15 nt, Staphylococcus aureus subsp. aureus Mu50
uuauauauucaauaa

SEQ ID NO: 2055678 - RNA, 16 nt, Staphylococcus aureus subsp. aureus Mu50
uuauauauucaauaau

SEQ ID NO: 2055679 - RNA, 14 nt, Staphylococcus aureus subsp. aureus Mu50
uuauauaucacaua

SEQ ID NO: 2055680 - RNA, 14 nt, Staphylococcus aureus subsp. aureus Mu50
uuauauauaaaauc

SEQ ID NO: 2055681 - RNA, 21 nt, Staphylococcus aureus subsp. aureus Mu50
uuauauagauugccauucaua

SEQ ID NO: 2055682 - RNA, 17 nt, Staphylococcus aureus subsp. aureus Mu50
uuauauauauuaaagua

SEQ ID NO: 2055683 - RNA, 15 nt, Staphylococcus aureus subsp. aureus Mu50
uuauauaaauaggca

SEQ ID NO: 2055684 - RNA, 17 nt, Staphylococcus aureus subsp. aureus Mu50
uuauauaaacaaaaauc

SEQ ID NO: 2055685 - RNA, 13 nt, Staphylococcus aureus subsp. aureus Mu50
uuauauaauucuu

SEQ ID NO: 2055686 - RNA, 16 nt, Staphylococcus aureus subsp. aureus Mu50
uuauagauuuaaagaa

SEQ ID NO: 2055687 - RNA, 18 nt, Staphylococcus aureus subsp. aureus Mu50
uuauagcaaauugauuaa

SEQ ID NO: 2055688 - RNA, 22 nt, Staphylococcus aureus subsp. aureus Mu50
uuauagcaaauugauuaaauaa

SEQ ID NO: 2055689 - RNA, 17 nt, Staphylococcus aureus subsp. aureus Mu50
uuauagucuuaaacaua

SEQ ID NO: 2055690 - RNA, 15 nt, Staphylococcus aureus subsp. aureus Mu50
uuaugagcuuaauaa

SEQ ID NO: 2055691 - RNA, 19 nt, Staphylococcus aureus subsp. aureus Mu50
uuaugacuaacauugguac

SEQ ID NO: 2055692 - RNA, 21 nt, Staphylococcus aureus subsp. aureus Mu50
uuaugauauacgagcuuugcu

SEQ ID NO: 2055693 - RNA, 15 nt, Staphylococcus aureus subsp. aureus Mu50
uuaugaaaacauuau

SEQ ID NO: 2055694 - RNA, 20 nt, Staphylococcus aureus subsp. aureus Mu50
uuaucuucaguaauuucucc

SEQ ID NO: 2055695 - RNA, 23 nt, Staphylococcus aureus subsp. aureus Mu50
uuaucuucaguaauuucuccaag

SEQ ID NO: 2055696 - RNA, 13 nt, Staphylococcus aureus subsp. aureus Mu50
uuaucuuuaagua

SEQ ID NO: 2055697 - RNA, 16 nt, Staphylococcus aureus subsp. aureus Mu50
uuaucuuuaauuuaca

SEQ ID NO: 2055698 - RNA, 15 nt, Staphylococcus aureus subsp. aureus Mu50
uuaucuuuacgauaa

SEQ ID NO: 2055699 - RNA, 16 nt, Staphylococcus aureus subsp. aureus Mu50
uuaucugcaaaaugca

SEQ ID NO: 2055700 - RNA, 20 nt, Staphylococcus aureus subsp. aureus Mu50
uuaucuguagauuagcuuaa

SEQ ID NO: 2055701 - RNA, 16 nt, Staphylococcus aureus subsp. aureus Mu50
uuaucguaaaaaaacg

SEQ ID NO: 2055702 - RNA, 18 nt, Staphylococcus aureus subsp. aureus Mu50
uuaucgaucgguauuuuc

SEQ ID NO: 2055703 - RNA, 17 nt, Staphylococcus aureus subsp. aureus Mu50
uuaucgaagaaacauua

SEQ ID NO: 2055704 - RNA, 15 nt, Staphylococcus aureus subsp. aureus Mu50
uuaucugaaaauauc

SEQ ID NO: 2055705 - RNA, 17 nt, Staphylococcus aureus subsp. aureus Mu50
uuaucugaccaguauac

SEQ ID NO: 2055706 - RNA, 20 nt, Staphylococcus aureus subsp. aureus Mu50
uuaucuaaagcuauaaaaaa

SEQ ID NO: 2055707 - RNA, 22 nt, Staphylococcus aureus subsp. aureus Mu50
uuauuacaaacauuccucuauu

SEQ ID NO: 2055708 - RNA, 21 nt, Staphylococcus aureus subsp. aureus Mu50
uuauuacaaugaaaaaacgag

SEQ ID NO: 2055709 - RNA, 18 nt, Staphylococcus aureus subsp. aureus Mu50
uuauuacauaauuuaucu

SEQ ID NO: 2055710 - RNA, 21 nt, Staphylococcus aureus subsp. aureus Mu50
uuauuaccauaacuuuauaua

SEQ ID NO: 2055711 - RNA, 12 nt, Staphylococcus aureus subsp. aureus Mu50
uuauuaacugua

SEQ ID NO: 2055712 - RNA, 13 nt, Staphylococcus aureus subsp. aureus Mu50
uuauuaacugugu

SEQ ID NO: 2055713 - RNA, 23 nt, Staphylococcus aureus subsp. aureus Mu50
uuauuaauaaauucucuuggaua

SEQ ID NO: 2055714 - RNA, 22 nt, Staphylococcus aureus subsp. aureus Mu50
uuauuaaggggguaauacuaua

SEQ ID NO: 2055715 - RNA, 18 nt, Staphylococcus aureus subsp. aureus Mu50
uuauuaacuuuaauauaa

SEQ ID NO: 2055716 - RNA, 20 nt, Staphylococcus aureus subsp. aureus Mu50
uuauuaaaucuuuuacuaaa

SEQ ID NO: 2055717 - RNA, 13 nt, Staphylococcus aureus subsp. aureus Mu50
uuauuaaauaaca

SEQ ID NO: 2055718 - RNA, 13 nt, Staphylococcus aureus subsp. aureus Mu50
uuauuaaaucuuu

SEQ ID NO: 2055719 - RNA, 18 nt, Staphylococcus aureus subsp. aureus Mu50
uuauuaaaucuuuuacua

SEQ ID NO: 2055720 - RNA, 23 nt, Staphylococcus aureus subsp. aureus Mu50
uuauuaaacacgcgguaaaacga

SEQ ID NO: 2055721 - RNA, 16 nt, Staphylococcus aureus subsp. aureus Mu50
uuauguuuaaacauuu

SEQ ID NO: 2055722 - RNA, 20 nt, Staphylococcus aureus subsp. aureus Mu50
uuauguuauaaauucuaucu

SEQ ID NO: 2055723 - RNA, 18 nt, Staphylococcus aureus subsp. aureus Mu50
uuaugugcuaaucuauuu

SEQ ID NO: 2055724 - RNA, 12 nt, Staphylococcus aureus subsp. aureus Mu50
uuaugugcauca

SEQ ID NO: 2055725 - RNA, 15 nt, Staphylococcus aureus subsp. aureus Mu50
uuaugcaaaauuaau

SEQ ID NO: 2055726 - RNA, 19 nt, Staphylococcus aureus subsp. aureus Mu50
uuaugcauauguaauacaa

SEQ ID NO: 2055727 - RNA, 21 nt, Staphylococcus aureus subsp. aureus Mu50
uuaugcauauguaauacaaaa

SEQ ID NO: 2055728 - RNA, 18 nt, Staphylococcus aureus subsp. aureus Mu50
uuaugccauucauuaagc

SEQ ID NO: 2055729 - RNA, 18 nt, Staphylococcus aureus subsp. aureus Mu50
uuaugcaugcgcaaaagc

SEQ ID NO: 2055730 - RNA, 22 nt, Staphylococcus aureus subsp. aureus Mu50
uuauggcagauccauaaggauu

SEQ ID NO: 2055731 - RNA, 14 nt, Staphylococcus aureus subsp. aureus Mu50
uuauguaaaaaaua

SEQ ID NO: 2055732 - RNA, 12 nt, Staphylococcus aureus subsp. aureus Mu50
uuauguauuuau

SEQ ID NO: 2055733 - RNA, 15 nt, Staphylococcus aureus subsp. aureus Mu50
uuaugucccaaugcu

SEQ ID NO: 2055734 - RNA, 20 nt, Staphylococcus aureus subsp. aureus Mu50
uuauguaucuauacaacagu

SEQ ID NO: 2055735 - RNA, 19 nt, Staphylococcus aureus subsp. aureus Mu50
uucagcauugggacauaaa

SEQ ID NO: 2055736 - RNA, 19 nt, Staphylococcus aureus subsp. aureus Mu50
uucagcuucuaaguaauau

SEQ ID NO: 2055737 - RNA, 20 nt, Staphylococcus aureus subsp. aureus Mu50
uucacuaaaaauauauuuca

SEQ ID NO: 2055738 - RNA, 18 nt, Staphylococcus aureus subsp. aureus Mu50
uucacuaaauucaauaau

SEQ ID NO: 2055739 - RNA, 20 nt, Staphylococcus aureus subsp. aureus Mu50
uucacuaaauucaauaaucu

SEQ ID NO: 2055740 - RNA, 13 nt, Staphylococcus aureus subsp. aureus Mu50
uucacuaauauuu

SEQ ID NO: 2055741 - RNA, 23 nt, Staphylococcus aureus subsp. aureus Mu50
uucacuaauauuucuuagauacu

SEQ ID NO: 2055742 - RNA, 22 nt, Staphylococcus aureus subsp. aureus Mu50
uucagcaccagaacaauucaau

SEQ ID NO: 2055743 - RNA, 22 nt, Staphylococcus aureus subsp. aureus Mu50
uucacaugaauuuuaauauauu

SEQ ID NO: 2055744 - RNA, 18 nt, Staphylococcus aureus subsp. aureus Mu50
uucaccguaaucuuuuaa

SEQ ID NO: 2055745 - RNA, 16 nt, Staphylococcus aureus subsp. aureus Mu50
uucacguaaugaauca

SEQ ID NO: 2055746 - RNA, 24 nt, Staphylococcus aureus subsp. aureus Mu50
uucacgauuucuuuaugauaauaa

SEQ ID NO: 2055747 - RNA, 21 nt, Staphylococcus aureus subsp. aureus Mu50
uucacgaauaucuuaaagaau

SEQ ID NO: 2055748 - RNA, 23 nt, Staphylococcus aureus subsp. aureus Mu50
uucaauacuucuuguucgauaau

SEQ ID NO: 2055749 - RNA, 17 nt, Staphylococcus aureus subsp. aureus Mu50
uucaauagcauaugaua

SEQ ID NO: 2055750 - RNA, 12 nt, Staphylococcus aureus subsp. aureus Mu50
uucaauauuuga

SEQ ID NO: 2055751 - RNA, 12 nt, Staphylococcus aureus subsp. aureus Mu50
uucaauccuuug

SEQ ID NO: 2055752 - RNA, 24 nt, Staphylococcus aureus subsp. aureus Mu50
uucaaucauucacuucaaguuaug

SEQ ID NO: 2055753 - RNA, 17 nt, Staphylococcus aureus subsp. aureus Mu50
uuauuguuuuuaaaauc

SEQ ID NO: 2055754 - RNA, 16 nt, Staphylococcus aureus subsp. aureus Mu50
uuauuuaaaacuugua

SEQ ID NO: 2055755 - RNA, 17 nt, Staphylococcus aureus subsp. aureus Mu50
uuauuguuccaaucuuu

SEQ ID NO: 2055756 - RNA, 15 nt, Staphylococcus aureus subsp. aureus Mu50
uuauugaaaagauaa

SEQ ID NO: 2055757 - RNA, 20 nt, Staphylococcus aureus subsp. aureus Mu50
uuauugaaaagauaaacaag

SEQ ID NO: 2055758 - RNA, 13 nt, Staphylococcus aureus subsp. aureus Mu50
uuauugaaacuaa

SEQ ID NO: 2055759 - RNA, 14 nt, Staphylococcus aureus subsp. aureus Mu50
uuauuauauaauaa

SEQ ID NO: 2055760 - RNA, 22 nt, Staphylococcus aureus subsp. aureus Mu50
uuauucuuuauauuugugaaug

SEQ ID NO: 2055761 - RNA, 18 nt, Staphylococcus aureus subsp. aureus Mu50
uuauucuuaauuuaagua

SEQ ID NO: 2055762 - RNA, 17 nt, Staphylococcus aureus subsp. aureus Mu50
uuauuagauacuucuuu

SEQ ID NO: 2055763 - RNA, 15 nt, Staphylococcus aureus subsp. aureus Mu50
uuauuagaaugaaac

SEQ ID NO: 2055764 - RNA, 20 nt, Staphylococcus aureus subsp. aureus Mu50
uuauuuaaucguaacauauc

SEQ ID NO: 2055765 - RNA, 14 nt, Staphylococcus aureus subsp. aureus Mu50
uuauuuaaaaugcu

SEQ ID NO: 2055766 - RNA, 17 nt, Staphylococcus aureus subsp. aureus Mu50
uuauuugaaugcaaauc

SEQ ID NO: 2055767 - RNA, 19 nt, Staphylococcus aureus subsp. aureus Mu50
uuauuugauaaauaaaauu

SEQ ID NO: 2055768 - RNA, 21 nt, Staphylococcus aureus subsp. aureus Mu50
uuauuugauaaugauagugua

SEQ ID NO: 2055769 - RNA, 19 nt, Staphylococcus aureus subsp. aureus Mu50
uucaaaaaucauaccacgg

SEQ ID NO: 2055770 - RNA, 18 nt, Staphylococcus aureus subsp. aureus Mu50
uucaaaaaaugaauauaa

SEQ ID NO: 2055771 - RNA, 13 nt, Staphylococcus aureus subsp. aureus Mu50
uucaaaaaauauu

SEQ ID NO: 2055772 - RNA, 12 nt, Staphylococcus aureus subsp. aureus Mu50
uucaaaaaauau

SEQ ID NO: 2055773 - RNA, 17 nt, Staphylococcus aureus subsp. aureus Mu50
uuauuuuuuucuuucuu

SEQ ID NO: 2055774 - RNA, 16 nt, Staphylococcus aureus subsp. aureus Mu50
uucaaaaaucauacca

SEQ ID NO: 2055775 - RNA, 19 nt, Staphylococcus aureus subsp. aureus Mu50
uucaaaacguuuaauugca

SEQ ID NO: 2055776 - RNA, 20 nt, Staphylococcus aureus subsp. aureus Mu50
uucaaaacguuuaauugcag

SEQ ID NO: 2055777 - RNA, 20 nt, Staphylococcus aureus subsp. aureus Mu50
uucaaaacuagcaguaauau

SEQ ID NO: 2055778 - RNA, 17 nt, Staphylococcus aureus subsp. aureus Mu50
uucaaaaucuuuaucag

SEQ ID NO: 2055779 - RNA, 22 nt, Staphylococcus aureus subsp. aureus Mu50
uucaaaauaguaaagugaaaua

SEQ ID NO: 2055780 - RNA, 14 nt, Staphylococcus aureus subsp. aureus Mu50
uucaacauauuaua

SEQ ID NO: 2055781 - RNA, 17 nt, Staphylococcus aureus subsp. aureus Mu50
uucaaaauucaauauua

SEQ ID NO: 2055782 - RNA, 19 nt, Staphylococcus aureus subsp. aureus Mu50
uucaaaauucaauauuaau

SEQ ID NO: 2055783 - RNA, 13 nt, Staphylococcus aureus subsp. aureus Mu50
uucaaacagaaau

SEQ ID NO: 2055784 - RNA, 12 nt, Staphylococcus aureus subsp. aureus Mu50
uucaaacauauu

SEQ ID NO: 2055785 - RNA, 21 nt, Staphylococcus aureus subsp. aureus Mu50
uucaaccuuuuaauaguacuu

SEQ ID NO: 2055786 - RNA, 17 nt, Staphylococcus aureus subsp. aureus Mu50
uucaaccaauuauuaaa

SEQ ID NO: 2055787 - RNA, 15 nt, Staphylococcus aureus subsp. aureus Mu50
uucaauaaauaaaca

SEQ ID NO: 2055788 - RNA, 15 nt, Staphylococcus aureus subsp. aureus Mu50
uucaaguuuaaaaua

SEQ ID NO: 2055789 - RNA, 16 nt, Staphylococcus aureus subsp. aureus Mu50
uucaauaacaaugcag

SEQ ID NO: 2055790 - RNA, 11 nt, Staphylococcus aureus subsp. aureus Mu50
uucaagaacaa

SEQ ID NO: 2055791 - RNA, 13 nt, Staphylococcus aureus subsp. aureus Mu50
uuagcaauuucau

SEQ ID NO: 2055792 - RNA, 20 nt, Staphylococcus aureus subsp. aureus Mu50
uuagaacguaauguuacaca

SEQ ID NO: 2055793 - RNA, 23 nt, Staphylococcus aureus subsp. aureus Mu50
uuagaagaacaauaauugaugaa

SEQ ID NO: 2055794 - RNA, 19 nt, Staphylococcus aureus subsp. aureus Mu50
uuagccaauaccgaauaau

SEQ ID NO: 2055795 - RNA, 14 nt, Staphylococcus aureus subsp. aureus Mu50
uuagcaucugcaug

SEQ ID NO: 2055796 - RNA, 19 nt, Staphylococcus aureus subsp. aureus Mu50
uuagcaucuuuaccauaua

SEQ ID NO: 2055797 - RNA, 19 nt, Staphylococcus aureus subsp. aureus Mu50
uuagcauuaaauuccaugu

SEQ ID NO: 2055798 - RNA, 20 nt, Staphylococcus aureus subsp. aureus Mu50
uuaggaaugauagauuuagg

SEQ ID NO: 2055799 - RNA, 16 nt, Staphylococcus aureus subsp. aureus Mu50
uuaggggcuuuuaugc

SEQ ID NO: 2055800 - RNA, 15 nt, Staphylococcus aureus subsp. aureus Mu50
uuaggaaugaauaaa

SEQ ID NO: 2055801 - RNA, 23 nt, Staphylococcus aureus subsp. aureus Mu50
uuagcuuuuguaaagcuuuaguu

SEQ ID NO: 2055802 - RNA, 23 nt, Staphylococcus aureus subsp. aureus Mu50
uuacuccaaaguaacaugugcaa

SEQ ID NO: 2055803 - RNA, 16 nt, Staphylococcus aureus subsp. aureus Mu50
uuacuuucgcuugcaa

SEQ ID NO: 2055804 - RNA, 22 nt, Staphylococcus aureus subsp. aureus Mu50
uuacuuuuccuugauucuuaua

SEQ ID NO: 2055805 - RNA, 12 nt, Staphylococcus aureus subsp. aureus Mu50
uuagaaccauca

SEQ ID NO: 2055806 - RNA, 21 nt, Staphylococcus aureus subsp. aureus Mu50
uuacuugcuuuuucaaauaau

SEQ ID NO: 2055807 - RNA, 22 nt, Staphylococcus aureus subsp. aureus Mu50
uuacuugcuuuuucaaauaaua

SEQ ID NO: 2055808 - RNA, 20 nt, Staphylococcus aureus subsp. aureus Mu50
uuacuaaaugaauugcuugu

SEQ ID NO: 2055809 - RNA, 22 nt, Staphylococcus aureus subsp. aureus Mu50
uuacucacagacuuuuuacuaa

SEQ ID NO: 2055810 - RNA, 12 nt, Staphylococcus aureus subsp. aureus Mu50
uuauacauguac

SEQ ID NO: 2055811 - RNA, 19 nt, Staphylococcus aureus subsp. aureus Mu50
uuauacauguacauuauca

SEQ ID NO: 2055812 - RNA, 16 nt, Staphylococcus aureus subsp. aureus Mu50
uuauacauuagccaca

SEQ ID NO: 2055813 - RNA, 15 nt, Staphylococcus aureus subsp. aureus Mu50
uuauacauaaauauu

SEQ ID NO: 2055814 - RNA, 19 nt, Staphylococcus aureus subsp. aureus Mu50
uuauacagugaaucuaaac

SEQ ID NO: 2055815 - RNA, 23 nt, Staphylococcus aureus subsp. aureus Mu50
uuauacuauaaauacaaauauau

SEQ ID NO: 2055816 - RNA, 22 nt, Staphylococcus aureus subsp. aureus Mu50
uuauacgaaucacaguuauaua

SEQ ID NO: 2055817 - RNA, 19 nt, Staphylococcus aureus subsp. aureus Mu50
uuauacuuuuggucuguug

SEQ ID NO: 2055818 - RNA, 17 nt, Staphylococcus aureus subsp. aureus Mu50
uuauaauggcaguaguu

SEQ ID NO: 2055819 - RNA, 21 nt, Staphylococcus aureus subsp. aureus Mu50
uuauaaguaucgccaucauuc

SEQ ID NO: 2055820 - RNA, 22 nt, Staphylococcus aureus subsp. aureus Mu50
uuauaaguaucgccaucauuca

SEQ ID NO: 2055821 - RNA, 14 nt, Staphylococcus aureus subsp. aureus Mu50
uuauaaguugcaua

SEQ ID NO: 2055822 - RNA, 15 nt, Staphylococcus aureus subsp. aureus Mu50
uuauacagugaaucu

SEQ ID NO: 2055823 - RNA, 13 nt, Staphylococcus aureus subsp. aureus Mu50
uuauaauuguuca

SEQ ID NO: 2055824 - RNA, 23 nt, Staphylococcus aureus subsp. aureus Mu50
uuauaauuucaguaggacauaua

SEQ ID NO: 2055825 - RNA, 23 nt, Staphylococcus aureus subsp. aureus Mu50
uuauaaagauagaaugaauaauu

SEQ ID NO: 2055826 - RNA, 22 nt, Staphylococcus aureus subsp. aureus Mu50
uuauaaagacaccuucaauauc

SEQ ID NO: 2055827 - RNA, 23 nt, Staphylococcus aureus subsp. aureus Mu50
uuauaaaccuaaugcuuuaauaa

SEQ ID NO: 2055828 - RNA, 17 nt, Staphylococcus aureus subsp. aureus Mu50
uuauaaaaugaauaauu

SEQ ID NO: 2055829 - RNA, 13 nt, Staphylococcus aureus subsp. aureus Mu50
uuauaaagcugcg

SEQ ID NO: 2055830 - RNA, 15 nt, Staphylococcus aureus subsp. aureus Mu50
uuauaaaucauagag

SEQ ID NO: 2055831 - RNA, 18 nt, Staphylococcus aureus subsp. aureus Mu50
uuauaaaucauucuuuau

SEQ ID NO: 2055832 - RNA, 21 nt, Staphylococcus aureus subsp. aureus Mu50
uuauaaaugaauuauuuaaaa

SEQ ID NO: 2055833 - RNA, 21 nt, Staphylococcus aureus subsp. aureus Mu50
uuauaagaauuuaaaagagaa

SEQ ID NO: 2055834 - RNA, 16 nt, Staphylococcus aureus subsp. aureus Mu50
uuauaaguaaauaaua

SEQ ID NO: 2055835 - RNA, 12 nt, Staphylococcus aureus subsp. aureus Mu50
uuauaaguacaa

SEQ ID NO: 2055836 - RNA, 17 nt, Staphylococcus aureus subsp. aureus Mu50
uuauaaguaaauaauag

SEQ ID NO: 2055837 - RNA, 19 nt, Staphylococcus aureus subsp. aureus Mu50
uuauaaauucuaucuauaa

SEQ ID NO: 2055838 - RNA, 16 nt, Staphylococcus aureus subsp. aureus Mu50
uuauaacauucuucaa

SEQ ID NO: 2055839 - RNA, 16 nt, Staphylococcus aureus subsp. aureus Mu50
uuauaacaaaaauugc

SEQ ID NO: 2055840 - RNA, 18 nt, Staphylococcus aureus subsp. aureus Mu50
uuauaaauuugguacaua

SEQ ID NO: 2055841 - RNA, 16 nt, Staphylococcus aureus subsp. aureus Mu50
uuagugucacaaagaa

SEQ ID NO: 2055842 - RNA, 16 nt, Staphylococcus aureus subsp. aureus Mu50
uuaguguguuuaaaag

SEQ ID NO: 2055843 - RNA, 15 nt, Staphylococcus aureus subsp. aureus Mu50
uuaguuaaaauucag

SEQ ID NO: 2055844 - RNA, 18 nt, Staphylococcus aureus subsp. aureus Mu50
uuaguuaauuauuuagau

SEQ ID NO: 2055845 - RNA, 15 nt, Staphylococcus aureus subsp. aureus Mu50
uuaguuauacuacua

SEQ ID NO: 2055846 - RNA, 17 nt, Staphylococcus aureus subsp. aureus Mu50
uuagucuuuuuaaguau

SEQ ID NO: 2055847 - RNA, 22 nt, Staphylococcus aureus subsp. aureus Mu50
uuagugacucaguuauauuaag

SEQ ID NO: 2055848 - RNA, 21 nt, Staphylococcus aureus subsp. aureus Mu50
uuagugauaccuuuaauuguu

SEQ ID NO: 2055849 - RNA, 23 nt, Staphylococcus aureus subsp. aureus Mu50
uuagugacaaguaugucaucuuc

SEQ ID NO: 2055850 - RNA, 15 nt, Staphylococcus aureus subsp. aureus Mu50
uuaguguagaaaaua

SEQ ID NO: 2055851 - RNA, 14 nt, Staphylococcus aureus subsp. aureus Mu50
uuaguuuucuuaaa

SEQ ID NO: 2055852 - RNA, 16 nt, Staphylococcus aureus subsp. aureus Mu50
uuaguuugacaucuau

SEQ ID NO: 2055853 - RNA, 21 nt, Staphylococcus aureus subsp. aureus Mu50
uuauaaaaaggccucuugaaa

SEQ ID NO: 2055854 - RNA, 15 nt, Staphylococcus aureus subsp. aureus Mu50
uuauaaaaacagcag

SEQ ID NO: 2055855 - RNA, 20 nt, Staphylococcus aureus subsp. aureus Mu50
uuauaaaaacagcagugaag

SEQ ID NO: 2055856 - RNA, 15 nt, Staphylococcus aureus subsp. aureus Mu50
uuauaaaaaaucagu

SEQ ID NO: 2055857 - RNA, 21 nt, Staphylococcus aureus subsp. aureus Mu50
uuauaaaaaaucaguuuuuaa

SEQ ID NO: 2055858 - RNA, 14 nt, Staphylococcus aureus subsp. aureus Mu50
uuauaaaaagagau

SEQ ID NO: 2055859 - RNA, 13 nt, Staphylococcus aureus subsp. aureus Mu50
uuaguuuuuaaaa

SEQ ID NO: 2055860 - RNA, 14 nt, Staphylococcus aureus subsp. aureus Mu50
uuauaaaaaacggu

SEQ ID NO: 2055861 - RNA, 13 nt, Staphylococcus aureus subsp. aureus Mu50
uuaguaaauauag

SEQ ID NO: 2055862 - RNA, 15 nt, Staphylococcus aureus subsp. aureus Mu50
uuaguaaggaauauu

SEQ ID NO: 2055863 - RNA, 20 nt, Staphylococcus aureus subsp. aureus Mu50
uuaguacauauguuguuucu

SEQ ID NO: 2055864 - RNA, 15 nt, Staphylococcus aureus subsp. aureus Mu50
uuaguacaaaauugu

SEQ ID NO: 2055865 - RNA, 14 nt, Staphylococcus aureus subsp. aureus Mu50
uuaguacaaaauug

SEQ ID NO: 2055866 - RNA, 22 nt, Staphylococcus aureus subsp. aureus Mu50
uuagguaauacaucaucaaguu

SEQ ID NO: 2055867 - RNA, 19 nt, Staphylococcus aureus subsp. aureus Mu50
uuaggucuacgaucaaaau

SEQ ID NO: 2055868 - RNA, 12 nt, Staphylococcus aureus subsp. aureus Mu50
uuagguauauaa

SEQ ID NO: 2055869 - RNA, 14 nt, Staphylococcus aureus subsp. aureus Mu50
uuagguuacuuauu

SEQ ID NO: 2055870 - RNA, 19 nt, Staphylococcus aureus subsp. aureus Mu50
uuaguauggaauaaauggu

SEQ ID NO: 2055871 - RNA, 13 nt, Staphylococcus aureus subsp. aureus Mu50
uuaguauugguac

SEQ ID NO: 2055872 - RNA, 22 nt, Staphylococcus aureus subsp. aureus Mu50
uuagucaauguauauuuaacau

SEQ ID NO: 2055873 - RNA, 16 nt, Staphylococcus aureus subsp. aureus Mu50
uuaguagccacaauuu

SEQ ID NO: 2055874 - RNA, 19 nt, Staphylococcus aureus subsp. aureus Mu50
uuaguaucgauaguucuau

SEQ ID NO: 2055875 - RNA, 17 nt, Staphylococcus aureus subsp. aureus Mu50
uuaguaguuguacuucu

SEQ ID NO: 2055876 - RNA, 20 nt, Staphylococcus aureus subsp. aureus Mu50
uuaguaguuuauaucaaaaa

SEQ ID NO: 2055877 - RNA, 18 nt, Staphylococcus aureus subsp. aureus Mu50
uuaguacuuugauaucua

SEQ ID NO: 2055878 - RNA, 15 nt, Staphylococcus aureus subsp. aureus Mu50
uuaguagucaaaauu

SEQ ID NO: 2055879 - RNA, 14 nt, Staphylococcus aureus subsp. aureus Mu50
uuaguacuaaaccg

SEQ ID NO: 2055880 - RNA, 24 nt, Staphylococcus aureus subsp. aureus Mu50
uuaguacuaaaccgauuaauauaa

SEQ ID NO: 2055881 - RNA, 19 nt, Staphylococcus aureus subsp. aureus Mu50
uuacagguuuuaaaauuaa

SEQ ID NO: 2055882 - RNA, 20 nt, Staphylococcus aureus subsp. aureus Mu50
uuacagguuuuaaaauuaaa

SEQ ID NO: 2055883 - RNA, 22 nt, Staphylococcus aureus subsp. aureus Mu50
uuacaugcaccuuuacaacaua

SEQ ID NO: 2055884 - RNA, 15 nt, Staphylococcus aureus subsp. aureus Mu50
uuacauuaauuuguc

SEQ ID NO: 2055885 - RNA, 20 nt, Staphylococcus aureus subsp. aureus Mu50
uuacauguuacugaugaaca

SEQ ID NO: 2055886 - RNA, 14 nt, Staphylococcus aureus subsp. aureus Mu50
uuacauuuucaaaa

SEQ ID NO: 2055887 - RNA, 19 nt, Staphylococcus aureus subsp. aureus Mu50
uuacauuuuaauaaaauca

SEQ ID NO: 2055888 - RNA, 23 nt, Staphylococcus aureus subsp. aureus Mu50
uuaccacaaccagucagaaagaa

SEQ ID NO: 2055889 - RNA, 15 nt, Staphylococcus aureus subsp. aureus Mu50
uuaccaccauuuuua

SEQ ID NO: 2055890 - RNA, 12 nt, Staphylococcus aureus subsp. aureus Mu50
uuaccaaaauuu

SEQ ID NO: 2055891 - RNA, 11 nt, Staphylococcus aureus subsp. aureus Mu50
uuaccaaaauu

SEQ ID NO: 2055892 - RNA, 16 nt, Staphylococcus aureus subsp. aureus Mu50
uuaccaauaucaugca

SEQ ID NO: 2055893 - RNA, 17 nt, Staphylococcus aureus subsp. aureus Mu50
uuacaauaaagacauau

SEQ ID NO: 2055894 - RNA, 17 nt, Staphylococcus aureus subsp. aureus Mu50
uuaauuuguuuuaaaua

SEQ ID NO: 2055895 - RNA, 23 nt, Staphylococcus aureus subsp. aureus Mu50
uuaauuuuaugucccaaugcuga

SEQ ID NO: 2055896 - RNA, 17 nt, Staphylococcus aureus subsp. aureus Mu50
uuaauuuuauuuaauuc

SEQ ID NO: 2055897 - RNA, 17 nt, Staphylococcus aureus subsp. aureus Mu50
uuacaauauaauuuccu

SEQ ID NO: 2055898 - RNA, 20 nt, Staphylococcus aureus subsp. aureus Mu50
uuacaaugcgcaaugaaaac

SEQ ID NO: 2055899 - RNA, 13 nt, Staphylococcus aureus subsp. aureus Mu50
uuacaaugaaaaa

SEQ ID NO: 2055900 - RNA, 21 nt, Staphylococcus aureus subsp. aureus Mu50
uuacaaugcgguauugcaugu

SEQ ID NO: 2055901 - RNA, 16 nt, Staphylococcus aureus subsp. aureus Mu50
uuacagacaaacauua

SEQ ID NO: 2055902 - RNA, 14 nt, Staphylococcus aureus subsp. aureus Mu50
uuaauguuaaacaa

SEQ ID NO: 2055903 - RNA, 17 nt, Staphylococcus aureus subsp. aureus Mu50
uuaaugugcauuuaucu

SEQ ID NO: 2055904 - RNA, 14 nt, Staphylococcus aureus subsp. aureus Mu50
uuaauguauaaaaa

SEQ ID NO: 2055905 - RNA, 16 nt, Staphylococcus aureus subsp. aureus Mu50
uuaauguauucuucua

SEQ ID NO: 2055906 - RNA, 18 nt, Staphylococcus aureus subsp. aureus Mu50
uuaauguacuuuucuguc

SEQ ID NO: 2055907 - RNA, 23 nt, Staphylococcus aureus subsp. aureus Mu50
uuaaugggcgugccauuaaaauu

SEQ ID NO: 2055908 - RNA, 19 nt, Staphylococcus aureus subsp. aureus Mu50
uuaauggcaacuaagauga

SEQ ID NO: 2055909 - RNA, 20 nt, Staphylococcus aureus subsp. aureus Mu50
uuaaugcuucaaauguaaca

SEQ ID NO: 2055910 - RNA, 20 nt, Staphylococcus aureus subsp. aureus Mu50
uuaaugccugcccuuuaguc

SEQ ID NO: 2055911 - RNA, 21 nt, Staphylococcus aureus subsp. aureus Mu50
uuaaugccauuguuauccaaa

SEQ ID NO: 2055912 - RNA, 17 nt, Staphylococcus aureus subsp. aureus Mu50
uuaaucuauauaaaaac

SEQ ID NO: 2055913 - RNA, 14 nt, Staphylococcus aureus subsp. aureus Mu50
uuaaucuauauaua

SEQ ID NO: 2055914 - RNA, 15 nt, Staphylococcus aureus subsp. aureus Mu50
uuaaugauuuuucau

SEQ ID NO: 2055915 - RNA, 19 nt, Staphylococcus aureus subsp. aureus Mu50
uuaaugauuuuucaucaau

SEQ ID NO: 2055916 - RNA, 19 nt, Staphylococcus aureus subsp. aureus Mu50
uuaaugauucuacagcacu

SEQ ID NO: 2055917 - RNA, 23 nt, Staphylococcus aureus subsp. aureus Mu50
uuaaugauugacgauuuaauuaa

SEQ ID NO: 2055918 - RNA, 12 nt, Staphylococcus aureus subsp. aureus Mu50
uuaauuaucauu

SEQ ID NO: 2055919 - RNA, 19 nt, Staphylococcus aureus subsp. aureus Mu50
uuaauuaucauaaagauaa

SEQ ID NO: 2055920 - RNA, 15 nt, Staphylococcus aureus subsp. aureus Mu50
uuaauuauuucccug

SEQ ID NO: 2055921 - RNA, 20 nt, Staphylococcus aureus subsp. aureus Mu50
uuaauuacgucauaaaauac

SEQ ID NO: 2055922 - RNA, 22 nt, Staphylococcus aureus subsp. aureus Mu50
uuaauuacagcgugauucaucu

SEQ ID NO: 2055923 - RNA, 16 nt, Staphylococcus aureus subsp. aureus Mu50
uuaauuaaaauucucu

SEQ ID NO: 2055924 - RNA, 21 nt, Staphylococcus aureus subsp. aureus Mu50
uuaauuaaaauucucuuuuaa

SEQ ID NO: 2055925 - RNA, 14 nt, Staphylococcus aureus subsp. aureus Mu50
uuaauguuugcuuu

SEQ ID NO: 2055926 - RNA, 19 nt, Staphylococcus aureus subsp. aureus Mu50
uuaauuaaagcaucuucaa

SEQ ID NO: 2055927 - RNA, 20 nt, Staphylococcus aureus subsp. aureus Mu50
uuaauuaaagcaucuucaau

SEQ ID NO: 2055928 - RNA, 23 nt, Staphylococcus aureus subsp. aureus Mu50
uuaauuaaagcaucuucaauauu

SEQ ID NO: 2055929 - RNA, 18 nt, Staphylococcus aureus subsp. aureus Mu50
uuaauuaaguuaaaauaa

SEQ ID NO: 2055930 - RNA, 15 nt, Staphylococcus aureus subsp. aureus Mu50
uuaauuaauaauuua

SEQ ID NO: 2055931 - RNA, 20 nt, Staphylococcus aureus subsp. aureus Mu50
uuaauuaauaauuuaacuaa

SEQ ID NO: 2055932 - RNA, 15 nt, Staphylococcus aureus subsp. aureus Mu50
uuaauuaauguucaa

SEQ ID NO: 2055933 - RNA, 14 nt, Staphylococcus aureus subsp. aureus Mu50
uuaauuaauuauca

SEQ ID NO: 2055934 - RNA, 16 nt, Staphylococcus aureus subsp. aureus Mu50
uuaauucguuuuacua

SEQ ID NO: 2055935 - RNA, 21 nt, Staphylococcus aureus subsp. aureus Mu50
uuaauuauguauuuuuauuua

SEQ ID NO: 2055936 - RNA, 14 nt, Staphylococcus aureus subsp. aureus Mu50
uuaauugcagguaa

SEQ ID NO: 2055937 - RNA, 20 nt, Staphylococcus aureus subsp. aureus Mu50
uuaauugcagguaaacggaa

SEQ ID NO: 2055938 - RNA, 16 nt, Staphylococcus aureus subsp. aureus Mu50
uuaauaacguacauuu

SEQ ID NO: 2055939 - RNA, 17 nt, Staphylococcus aureus subsp. aureus Mu50
uuaauaaccgaaauauu

SEQ ID NO: 2055940 - RNA, 16 nt, Staphylococcus aureus subsp. aureus Mu50
uuaauaaccuuuaaaa

SEQ ID NO: 2055941 - RNA, 19 nt, Staphylococcus aureus subsp. aureus Mu50
uuaauaaccuuuaaaacau

SEQ ID NO: 2055942 - RNA, 23 nt, Staphylococcus aureus subsp. aureus Mu50
uuaauaaccuuuaaaacaucauu

SEQ ID NO: 2055943 - RNA, 21 nt, Staphylococcus aureus subsp. aureus Mu50
uuaauaacauccccaaaaaua

SEQ ID NO: 2055944 - RNA, 20 nt, Staphylococcus aureus subsp. aureus Mu50
uuaauaacaaaauuaaauau

SEQ ID NO: 2055945 - RNA, 19 nt, Staphylococcus aureus subsp. aureus Mu50
uuaauaaccauguaaaauu

SEQ ID NO: 2055946 - RNA, 19 nt, Staphylococcus aureus subsp. aureus Mu50
uuaauaacccauuuucaaa

SEQ ID NO: 2055947 - RNA, 15 nt, Staphylococcus aureus subsp. aureus Mu50
uuaauacgaauuuca

SEQ ID NO: 2055948 - RNA, 20 nt, Staphylococcus aureus subsp. aureus Mu50
uuaauacuauaguaagaaaa

SEQ ID NO: 2055949 - RNA, 19 nt, Staphylococcus aureus subsp. aureus Mu50
uuaaguugaaaaccucuuu

SEQ ID NO: 2055950 - RNA, 23 nt, Staphylococcus aureus subsp. aureus Mu50
uuaagugccuugccaugauuuaa

SEQ ID NO: 2055951 - RNA, 17 nt, Staphylococcus aureus subsp. aureus Mu50
uuaagugggacuuuuua

SEQ ID NO: 2055952 - RNA, 13 nt, Staphylococcus aureus subsp. aureus Mu50
uuaagcuuuaauc

SEQ ID NO: 2055953 - RNA, 12 nt, Staphylococcus aureus subsp. aureus Mu50
uuaagucaucaa

SEQ ID NO: 2055954 - RNA, 12 nt, Staphylococcus aureus subsp. aureus Mu50
uuaauauuuucu

SEQ ID NO: 2055955 - RNA, 13 nt, Staphylococcus aureus subsp. aureus Mu50
uuaauaugcaaug

SEQ ID NO: 2055956 - RNA, 13 nt, Staphylococcus aureus subsp. aureus Mu50
uuaauauaaauau

SEQ ID NO: 2055957 - RNA, 15 nt, Staphylococcus aureus subsp. aureus Mu50
uuaauauaaauauca

SEQ ID NO: 2055958 - RNA, 17 nt, Staphylococcus aureus subsp. aureus Mu50
uuaauaguacuuaauuu

SEQ ID NO: 2055959 - RNA, 20 nt, Staphylococcus aureus subsp. aureus Mu50
uuaauacuaccguuuuuaua

SEQ ID NO: 2055960 - RNA, 23 nt, Staphylococcus aureus subsp. aureus Mu50
uuaauacuuuucucgauuaauuu

SEQ ID NO: 2055961 - RNA, 16 nt, Staphylococcus aureus subsp. aureus Mu50
uuaauccuucuccaaa

SEQ ID NO: 2055962 - RNA, 21 nt, Staphylococcus aureus subsp. aureus Mu50
uuaauccuucuccaaaaauaa

SEQ ID NO: 2055963 - RNA, 18 nt, Staphylococcus aureus subsp. aureus Mu50
uuaaucggaucauuauuu

SEQ ID NO: 2055964 - RNA, 15 nt, Staphylococcus aureus subsp. aureus Mu50
uuaaucaaauuaucu

SEQ ID NO: 2055965 - RNA, 23 nt, Staphylococcus aureus subsp. aureus Mu50
uuaaucaacguauauaaguuaaa

SEQ ID NO: 2055966 - RNA, 16 nt, Staphylococcus aureus subsp. aureus Mu50
uuaaucaauuuaauua

SEQ ID NO: 2055967 - RNA, 15 nt, Staphylococcus aureus subsp. aureus Mu50
uuaacgucauuuuua

SEQ ID NO: 2055968 - RNA, 15 nt, Staphylococcus aureus subsp. aureus Mu50
uuaacccacauuaaa

SEQ ID NO: 2055969 - RNA, 18 nt, Staphylococcus aureus subsp. aureus Mu50
uuaacccacauuaaauau

SEQ ID NO: 2055970 - RNA, 20 nt, Staphylococcus aureus subsp. aureus Mu50
uuaaccaguauaauuuucug

SEQ ID NO: 2055971 - RNA, 19 nt, Staphylococcus aureus subsp. aureus Mu50
uuaaccauacauaugcuau

SEQ ID NO: 2055972 - RNA, 17 nt, Staphylococcus aureus subsp. aureus Mu50
uuaaccauuuaaaaauu

SEQ ID NO: 2055973 - RNA, 19 nt, Staphylococcus aureus subsp. aureus Mu50
ugugcuuuuccauaaauau

SEQ ID NO: 2055974 - RNA, 19 nt, Staphylococcus aureus subsp. aureus Mu50
uuaagcuaucuaaaccuuu

SEQ ID NO: 2055975 - RNA, 19 nt, Staphylococcus aureus subsp. aureus Mu50
uuaagccugauguaccacu

SEQ ID NO: 2055976 - RNA, 21 nt, Staphylococcus aureus subsp. aureus Mu50
uuaagacugauuaauuauuga

SEQ ID NO: 2055977 - RNA, 17 nt, Staphylococcus aureus subsp. aureus Mu50
uuaacuauguuacuuau

SEQ ID NO: 2055978 - RNA, 24 nt, Staphylococcus aureus subsp. aureus Mu50
uuaacuauguuacuuauauauuca

SEQ ID NO: 2055979 - RNA, 14 nt, Staphylococcus aureus subsp. aureus Mu50
uuaacucaaagaaa

SEQ ID NO: 2055980 - RNA, 18 nt, Staphylococcus aureus subsp. aureus Mu50
uuaacguuauucauuugu

SEQ ID NO: 2055981 - RNA, 18 nt, Staphylococcus aureus subsp. aureus Mu50
uuaacuauaaauagaaga

SEQ ID NO: 2055982 - RNA, 13 nt, Staphylococcus aureus subsp. aureus Mu50
uuaagaauguaca

SEQ ID NO: 2055983 - RNA, 19 nt, Staphylococcus aureus subsp. aureus Mu50
uggcauaucgauaaaugua

SEQ ID NO: 2055984 - RNA, 23 nt, Staphylococcus aureus subsp. aureus Mu50
uggcaacggcacauucauaccga

SEQ ID NO: 2055985 - RNA, 20 nt, Staphylococcus aureus subsp. aureus Mu50
uggcaaccuuuugauguuua

SEQ ID NO: 2055986 - RNA, 13 nt, Staphylococcus aureus subsp. aureus Mu50
uggauuuuuuggu

SEQ ID NO: 2055987 - RNA, 18 nt, Staphylococcus aureus subsp. aureus Mu50
uggauuuuaacaagauaa

SEQ ID NO: 2055988 - RNA, 21 nt, Staphylococcus aureus subsp. aureus Mu50
uggauuuuaacaagauaacua

SEQ ID NO: 2055989 - RNA, 17 nt, Staphylococcus aureus subsp. aureus Mu50
uggauuaccguuaaaaa

SEQ ID NO: 2055990 - RNA, 14 nt, Staphylococcus aureus subsp. aureus Mu50
uggauuacagauga

SEQ ID NO: 2055991 - RNA, 22 nt, Staphylococcus aureus subsp. aureus Mu50
uggauucaaaugacauuuuaaa

SEQ ID NO: 2055992 - RNA, 16 nt, Staphylococcus aureus subsp. aureus Mu50
uggauguguuuuaaua

SEQ ID NO: 2055993 - RNA, 14 nt, Staphylococcus aureus subsp. aureus Mu50
uggauguguuuuaa

SEQ ID NO: 2055994 - RNA, 15 nt, Staphylococcus aureus subsp. aureus Mu50
uggcacugcaaucag

SEQ ID NO: 2055995 - RNA, 17 nt, Staphylococcus aureus subsp. aureus Mu50
uggaguauaucagcuug

SEQ ID NO: 2055996 - RNA, 21 nt, Staphylococcus aureus subsp. aureus Mu50
uggaguaaagaucacacgaca

SEQ ID NO: 2055997 - RNA, 24 nt, Staphylococcus aureus subsp. aureus Mu50
uggauagguaacuaaaaugucuuu

SEQ ID NO: 2055998 - RNA, 18 nt, Staphylococcus aureus subsp. aureus Mu50
uggauauuuauuuuaaua

SEQ ID NO: 2055999 - RNA, 13 nt, Staphylococcus aureus subsp. aureus Mu50
uggauaauugcau

SEQ ID NO: 2056000 - RNA, 12 nt, Staphylococcus aureus subsp. aureus Mu50
uggaugcuuuuc

SEQ ID NO: 2056001 - RNA, 18 nt, Staphylococcus aureus subsp. aureus Mu50
uggagguccauaaucuuu

SEQ ID NO: 2056002 - RNA, 17 nt, Staphylococcus aureus subsp. aureus Mu50
uggagcggaagauagga

SEQ ID NO: 2056003 - RNA, 22 nt, Staphylococcus aureus subsp. aureus Mu50
uggagauucucgguuuuuucgg

SEQ ID NO: 2056004 - RNA, 15 nt, Staphylococcus aureus subsp. aureus Mu50
uggagaaccuuuaaa

SEQ ID NO: 2056005 - RNA, 20 nt, Staphylococcus aureus subsp. aureus Mu50
uggacuuauggguucaauau

SEQ ID NO: 2056006 - RNA, 19 nt, Staphylococcus aureus subsp. aureus Mu50
uggacgcggguucaaaucc

SEQ ID NO: 2056007 - RNA, 15 nt, Staphylococcus aureus subsp. aureus Mu50
uggacuaauuuauua

SEQ ID NO: 2056008 - RNA, 21 nt, Staphylococcus aureus subsp. aureus Mu50
uggcgacauuuguaaauauuu

SEQ ID NO: 2056009 - RNA, 18 nt, Staphylococcus aureus subsp. aureus Mu50
uggcgauuccaaucuauu

SEQ ID NO: 2056010 - RNA, 14 nt, Staphylococcus aureus subsp. aureus Mu50
ugggaagguaaaac

SEQ ID NO: 2056011 - RNA, 12 nt, Staphylococcus aureus subsp. aureus Mu50
ugggacauuaau

SEQ ID NO: 2056012 - RNA, 18 nt, Staphylococcus aureus subsp. aureus Mu50
ugggacagaaaacaaagc

SEQ ID NO: 2056013 - RNA, 15 nt, Staphylococcus aureus subsp. aureus Mu50
uggcucuuuuuauuu

SEQ ID NO: 2056014 - RNA, 14 nt, Staphylococcus aureus subsp. aureus Mu50
uggcucuucuuauc

SEQ ID NO: 2056015 - RNA, 15 nt, Staphylococcus aureus subsp. aureus Mu50
uggcugcaucaauau

SEQ ID NO: 2056016 - RNA, 23 nt, Staphylococcus aureus subsp. aureus Mu50
ugggcauuuugacgccagaauaa

SEQ ID NO: 2056017 - RNA, 14 nt, Staphylococcus aureus subsp. aureus Mu50
ugggacuuuuuaua

SEQ ID NO: 2056018 - RNA, 23 nt, Staphylococcus aureus subsp. aureus Mu50
uggggugagggccccaacacaga

SEQ ID NO: 2056019 - RNA, 15 nt, Staphylococcus aureus subsp. aureus Mu50
uggguaauguuuuua

SEQ ID NO: 2056020 - RNA, 17 nt, Staphylococcus aureus subsp. aureus Mu50
ugugauguacuacuuua

SEQ ID NO: 2056021 - RNA, 23 nt, Staphylococcus aureus subsp. aureus Mu50
ugugauuuuuaauaauuugaaua

SEQ ID NO: 2056022 - RNA, 15 nt, Staphylococcus aureus subsp. aureus Mu50
ugugauuuuuugaua

SEQ ID NO: 2056023 - RNA, 14 nt, Staphylococcus aureus subsp. aureus Mu50
ugugcaaaaguuug

SEQ ID NO: 2056024 - RNA, 15 nt, Staphylococcus aureus subsp. aureus Mu50
ugugauuuguuacuu

SEQ ID NO: 2056025 - RNA, 18 nt, Staphylococcus aureus subsp. aureus Mu50
ugugauuuguuacuucua

SEQ ID NO: 2056026 - RNA, 21 nt, Staphylococcus aureus subsp. aureus Mu50
ugugauguguuguuuuaauug

SEQ ID NO: 2056027 - RNA, 20 nt, Staphylococcus aureus subsp. aureus Mu50
ugugccggcuuuuucuuuug

SEQ ID NO: 2056028 - RNA, 19 nt, Staphylococcus aureus subsp. aureus Mu50
ugugcaacgguuugaaaaa

SEQ ID NO: 2056029 - RNA, 23 nt, Staphylococcus aureus subsp. aureus Mu50
ugugcaauuagaauauauguaua

SEQ ID NO: 2056030 - RNA, 15 nt, Staphylococcus aureus subsp. aureus Mu50
ugugauacuuucuaa

SEQ ID NO: 2056031 - RNA, 15 nt, Staphylococcus aureus subsp. aureus Mu50
ugugaauaaaauugu

SEQ ID NO: 2056032 - RNA, 18 nt, Staphylococcus aureus subsp. aureus Mu50
ugugauauaugaaauauu

SEQ ID NO: 2056033 - RNA, 15 nt, Staphylococcus aureus subsp. aureus Mu50
ugugauauauaacca

SEQ ID NO: 2056034 - RNA, 17 nt, Staphylococcus aureus subsp. aureus Mu50
ugucuuuuauauuuuua

SEQ ID NO: 2056035 - RNA, 19 nt, Staphylococcus aureus subsp. aureus Mu50
ugucuuucaaauacacaga

SEQ ID NO: 2056036 - RNA, 17 nt, Staphylococcus aureus subsp. aureus Mu50
ugucucuuuucacgaau

SEQ ID NO: 2056037 - RNA, 15 nt, Staphylococcus aureus subsp. aureus Mu50
ugucgacuuuuagau

SEQ ID NO: 2056038 - RNA, 19 nt, Staphylococcus aureus subsp. aureus Mu50
ugucgaaauuguucuaaua

SEQ ID NO: 2056039 - RNA, 23 nt, Staphylococcus aureus subsp. aureus Mu50
ugucgaaaauagcuauuaaaaua

SEQ ID NO: 2056040 - RNA, 14 nt, Staphylococcus aureus subsp. aureus Mu50
ugucgcuucuucuu

SEQ ID NO: 2056041 - RNA, 18 nt, Staphylococcus aureus subsp. aureus Mu50
ugucggaauugguuuuua

SEQ ID NO: 2056042 - RNA, 19 nt, Staphylococcus aureus subsp. aureus Mu50
uguccgacuugauaaaaaa

SEQ ID NO: 2056043 - RNA, 14 nt, Staphylococcus aureus subsp. aureus Mu50
uguccgauaucuuu

SEQ ID NO: 2056044 - RNA, 22 nt, Staphylococcus aureus subsp. aureus Mu50
uguccucuaaaacauguugaua

SEQ ID NO: 2056045 - RNA, 21 nt, Staphylococcus aureus subsp. aureus Mu50
uguccuaacgcuaauuuuacu

SEQ ID NO: 2056046 - RNA, 16 nt, Staphylococcus aureus subsp. aureus Mu50
ugucaguaacuuuguc

SEQ ID NO: 2056047 - RNA, 19 nt, Staphylococcus aureus subsp. aureus Mu50
uguacucuucguuuuaaua

SEQ ID NO: 2056048 - RNA, 20 nt, Staphylococcus aureus subsp. aureus Mu50
uguacucuucguuuuaauaa

SEQ ID NO: 2056049 - RNA, 21 nt, Staphylococcus aureus subsp. aureus Mu50
uguagcaggcaacuuuuauua

SEQ ID NO: 2056050 - RNA, 17 nt, Staphylococcus aureus subsp. aureus Mu50
uguaucacauucaauau

SEQ ID NO: 2056051 - RNA, 21 nt, Staphylococcus aureus subsp. aureus Mu50
uguaucucugaaaaacuucuu

SEQ ID NO: 2056052 - RNA, 17 nt, Staphylococcus aureus subsp. aureus Mu50
uguauucagucaguaaa

SEQ ID NO: 2056053 - RNA, 19 nt, Staphylococcus aureus subsp. aureus Mu50
uguaugaaaggaguauuuu

SEQ ID NO: 2056054 - RNA, 20 nt, Staphylococcus aureus subsp. aureus Mu50
uguaucucugaaaaacuucu

SEQ ID NO: 2056055 - RNA, 19 nt, Staphylococcus aureus subsp. aureus Mu50
uguauucugaaacuuuaau

SEQ ID NO: 2056056 - RNA, 18 nt, Staphylococcus aureus subsp. aureus Mu50
uguauucauuuuaaauuc

SEQ ID NO: 2056057 - RNA, 16 nt, Staphylococcus aureus subsp. aureus Mu50
uguauugcuauaagaa

SEQ ID NO: 2056058 - RNA, 16 nt, Staphylococcus aureus subsp. aureus Mu50
uguauucuuagauauu

SEQ ID NO: 2056059 - RNA, 19 nt, Staphylococcus aureus subsp. aureus Mu50
uguauucuuggcguauuuu

SEQ ID NO: 2056060 - RNA, 16 nt, Staphylococcus aureus subsp. aureus Mu50
uguauuguauuuuaau

SEQ ID NO: 2056061 - RNA, 12 nt, Staphylococcus aureus subsp. aureus Mu50
uguauuucuuaa

SEQ ID NO: 2056062 - RNA, 24 nt, Staphylococcus aureus subsp. aureus Mu50
uggugaguguuucauaaucucuuu

SEQ ID NO: 2056063 - RNA, 20 nt, Staphylococcus aureus subsp. aureus Mu50
ugguggagaaccuuuaaaag

SEQ ID NO: 2056064 - RNA, 15 nt, Staphylococcus aureus subsp. aureus Mu50
ugguggaugucaugu

SEQ ID NO: 2056065 - RNA, 20 nt, Staphylococcus aureus subsp. aureus Mu50
uggugugccggcuuuuucuu

SEQ ID NO: 2056066 - RNA, 15 nt, Staphylococcus aureus subsp. aureus Mu50
ugguuaacauccugc

SEQ ID NO: 2056067 - RNA, 21 nt, Staphylococcus aureus subsp. aureus Mu50
ugguucagaaaugacaucauc

SEQ ID NO: 2056068 - RNA, 16 nt, Staphylococcus aureus subsp. aureus Mu50
ugguucaaaaaucaua

SEQ ID NO: 2056069 - RNA, 18 nt, Staphylococcus aureus subsp. aureus Mu50
uguaauaauaucaccuuu

SEQ ID NO: 2056070 - RNA, 18 nt, Staphylococcus aureus subsp. aureus Mu50
uguaauaauaaucuuuaa

SEQ ID NO: 2056071 - RNA, 21 nt, Staphylococcus aureus subsp. aureus Mu50
uguaauguuccccugaaaaga

SEQ ID NO: 2056072 - RNA, 14 nt, Staphylococcus aureus subsp. aureus Mu50
uguaaauuacaaaa

SEQ ID NO: 2056073 - RNA, 19 nt, Staphylococcus aureus subsp. aureus Mu50
uguaagcuaucguaaacaa

SEQ ID NO: 2056074 - RNA, 16 nt, Staphylococcus aureus subsp. aureus Mu50
uguacuacuugauucu

SEQ ID NO: 2056075 - RNA, 22 nt, Staphylococcus aureus subsp. aureus Mu50
uguacguuuaauaccuaugaua

SEQ ID NO: 2056076 - RNA, 15 nt, Staphylococcus aureus subsp. aureus Mu50
uguacguuuuuuuaa

SEQ ID NO: 2056077 - RNA, 16 nt, Staphylococcus aureus subsp. aureus Mu50
uguacguuuuuuuaaa

SEQ ID NO: 2056078 - RNA, 16 nt, Staphylococcus aureus subsp. aureus Mu50
uguacauuguaaauau

SEQ ID NO: 2056079 - RNA, 19 nt, Staphylococcus aureus subsp. aureus Mu50
uguacauugguuuuuacua

SEQ ID NO: 2056080 - RNA, 19 nt, Staphylococcus aureus subsp. aureus Mu50
uguacauccacuuuauaau

SEQ ID NO: 2056081 - RNA, 15 nt, Staphylococcus aureus subsp. aureus Mu50
uguacauguauaaaa

SEQ ID NO: 2056082 - RNA, 16 nt, Staphylococcus aureus subsp. aureus Mu50
uguacaguaauauuca

SEQ ID NO: 2056083 - RNA, 14 nt, Staphylococcus aureus subsp. aureus Mu50
uguacauaugugua

SEQ ID NO: 2056084 - RNA, 14 nt, Staphylococcus aureus subsp. aureus Mu50
uguacaucauuaaa

SEQ ID NO: 2056085 - RNA, 14 nt, Staphylococcus aureus subsp. aureus Mu50
uguaauuuaaaaua

SEQ ID NO: 2056086 - RNA, 17 nt, Staphylococcus aureus subsp. aureus Mu50
uguaauuccucuggaac

SEQ ID NO: 2056087 - RNA, 13 nt, Staphylococcus aureus subsp. aureus Mu50
uguaauuaggauu

SEQ ID NO: 2056088 - RNA, 15 nt, Staphylococcus aureus subsp. aureus Mu50
ugguugcuucuuauc

SEQ ID NO: 2056089 - RNA, 14 nt, Staphylococcus aureus subsp. aureus Mu50
ugguucuuuacuaa

SEQ ID NO: 2056090 - RNA, 14 nt, Staphylococcus aureus subsp. aureus Mu50
ugguugaaauuaau

SEQ ID NO: 2056091 - RNA, 11 nt, Staphylococcus aureus subsp. aureus Mu50
ugguucccaau

SEQ ID NO: 2056092 - RNA, 18 nt, Staphylococcus aureus subsp. aureus Mu50
uguaaaugaauuuugacg

SEQ ID NO: 2056093 - RNA, 23 nt, Staphylococcus aureus subsp. aureus Mu50
uguaaaucacgauuuucaaguaa

SEQ ID NO: 2056094 - RNA, 23 nt, Staphylococcus aureus subsp. aureus Mu50
uguaaaugaaaguaccuaaaaua

SEQ ID NO: 2056095 - RNA, 19 nt, Staphylococcus aureus subsp. aureus Mu50
uguaaauauaguaauaaaa

SEQ ID NO: 2056096 - RNA, 14 nt, Staphylococcus aureus subsp. aureus Mu50
uguaaauaugaacu

SEQ ID NO: 2056097 - RNA, 14 nt, Staphylococcus aureus subsp. aureus Mu50
uguaaauauaaaua

SEQ ID NO: 2056098 - RNA, 14 nt, Staphylococcus aureus subsp. aureus Mu50
uguaaauauaguaa

SEQ ID NO: 2056099 - RNA, 16 nt, Staphylococcus aureus subsp. aureus Mu50
uguaaauaguuaguuu

SEQ ID NO: 2056100 - RNA, 21 nt, Staphylococcus aureus subsp. aureus Mu50
uguaaauaaaaauuauauaaa

SEQ ID NO: 2056101 - RNA, 15 nt, Staphylococcus aureus subsp. aureus Mu50
uguaaauaacaguua

SEQ ID NO: 2056102 - RNA, 20 nt, Staphylococcus aureus subsp. aureus Mu50
uguaaagcuuuaguuaaaua

SEQ ID NO: 2056103 - RNA, 22 nt, Staphylococcus aureus subsp. aureus Mu50
uguaaagcuuuaguuaaauagu

SEQ ID NO: 2056104 - RNA, 12 nt, Staphylococcus aureus subsp. aureus Mu50
ugguuuuacugc

SEQ ID NO: 2056105 - RNA, 21 nt, Staphylococcus aureus subsp. aureus Mu50
ugguuucuuaacauaaaauga

SEQ ID NO: 2056106 - RNA, 17 nt, Staphylococcus aureus subsp. aureus Mu50
ugguuuggauaaaauga

SEQ ID NO: 2056107 - RNA, 23 nt, Staphylococcus aureus subsp. aureus Mu50
ugguuuuauuugauuauucuuca

SEQ ID NO: 2056108 - RNA, 20 nt, Staphylococcus aureus subsp. aureus Mu50
uguaaagcaugaauagcuug

SEQ ID NO: 2056109 - RNA, 17 nt, Staphylococcus aureus subsp. aureus Mu50
uguaaagccaccuaaau

SEQ ID NO: 2056110 - RNA, 18 nt, Staphylococcus aureus subsp. aureus Mu50
ugcgauaagcaaaaauuc

SEQ ID NO: 2056111 - RNA, 14 nt, Staphylococcus aureus subsp. aureus Mu50
ugcgaauaauaaua

SEQ ID NO: 2056112 - RNA, 13 nt, Staphylococcus aureus subsp. aureus Mu50
ugccuuuuuguaa

SEQ ID NO: 2056113 - RNA, 23 nt, Staphylococcus aureus subsp. aureus Mu50
ugcgaagaaaccuuuuuucucuu

SEQ ID NO: 2056114 - RNA, 22 nt, Staphylococcus aureus subsp. aureus Mu50
ugcgaacucguuauagauaagu

SEQ ID NO: 2056115 - RNA, 17 nt, Staphylococcus aureus subsp. aureus Mu50
ugccuuuuacauuugua

SEQ ID NO: 2056116 - RNA, 16 nt, Staphylococcus aureus subsp. aureus Mu50
ugccuugucuauugua

SEQ ID NO: 2056117 - RNA, 17 nt, Staphylococcus aureus subsp. aureus Mu50
ugcucaugagcacaaac

SEQ ID NO: 2056118 - RNA, 21 nt, Staphylococcus aureus subsp. aureus Mu50
ugcucaaaaaugcuuauauaa

SEQ ID NO: 2056119 - RNA, 14 nt, Staphylococcus aureus subsp. aureus Mu50
ugcuauguauuuuu

SEQ ID NO: 2056120 - RNA, 19 nt, Staphylococcus aureus subsp. aureus Mu50
ugcuagcuuucuuuuucau

SEQ ID NO: 2056121 - RNA, 18 nt, Staphylococcus aureus subsp. aureus Mu50
ugcuauccuugcuaucaa

SEQ ID NO: 2056122 - RNA, 20 nt, Staphylococcus aureus subsp. aureus Mu50
ugcuacagcacgagacaaua

SEQ ID NO: 2056123 - RNA, 15 nt, Staphylococcus aureus subsp. aureus Mu50
ugcuaauuuuuucau

SEQ ID NO: 2056124 - RNA, 14 nt, Staphylococcus aureus subsp. aureus Mu50
ugcuacaauuuccu

SEQ ID NO: 2056125 - RNA, 17 nt, Staphylococcus aureus subsp. aureus Mu50
ugcuaauucaagaacag

SEQ ID NO: 2056126 - RNA, 21 nt, Staphylococcus aureus subsp. aureus Mu50
ugcuaaaguguagccaaauaa

SEQ ID NO: 2056127 - RNA, 20 nt, Staphylococcus aureus subsp. aureus Mu50
ugcuaaaaaguuagcaaacg

SEQ ID NO: 2056128 - RNA, 16 nt, Staphylococcus aureus subsp. aureus Mu50
ugcuaaaauaucaaaa

SEQ ID NO: 2056129 - RNA, 16 nt, Staphylococcus aureus subsp. aureus Mu50
ugcgcuuauuuuacua

SEQ ID NO: 2056130 - RNA, 19 nt, Staphylococcus aureus subsp. aureus Mu50
ugcguaagguauuucauug

SEQ ID NO: 2056131 - RNA, 21 nt, Staphylococcus aureus subsp. aureus Mu50
ugcguaagguauuucauugau

SEQ ID NO: 2056132 - RNA, 19 nt, Staphylococcus aureus subsp. aureus Mu50
ugcguugguauucaucuuc

SEQ ID NO: 2056133 - RNA, 14 nt, Staphylococcus aureus subsp. aureus Mu50
ugcguuuaauuuac

SEQ ID NO: 2056134 - RNA, 20 nt, Staphylococcus aureus subsp. aureus Mu50
ugcgugcgaagucacuuguc

SEQ ID NO: 2056135 - RNA, 14 nt, Staphylococcus aureus subsp. aureus Mu50
ugcgucguuuauua

SEQ ID NO: 2056136 - RNA, 22 nt, Staphylococcus aureus subsp. aureus Mu50
uggaaugauacgccuaaauauu

SEQ ID NO: 2056137 - RNA, 11 nt, Staphylococcus aureus subsp. aureus Mu50
uggaaugacua

SEQ ID NO: 2056138 - RNA, 19 nt, Staphylococcus aureus subsp. aureus Mu50
uggaauacuugucaaaauu

SEQ ID NO: 2056139 - RNA, 21 nt, Staphylococcus aureus subsp. aureus Mu50
uggacauauacucuaaaaaag

SEQ ID NO: 2056140 - RNA, 22 nt, Staphylococcus aureus subsp. aureus Mu50
uggacaaucuuaucauaaucuu

SEQ ID NO: 2056141 - RNA, 20 nt, Staphylococcus aureus subsp. aureus Mu50
uggaagaaugccuuuuauuu

SEQ ID NO: 2056142 - RNA, 16 nt, Staphylococcus aureus subsp. aureus Mu50
uggaaauuuauuauaa

SEQ ID NO: 2056143 - RNA, 13 nt, Staphylococcus aureus subsp. aureus Mu50
uggaaauuuauua

SEQ ID NO: 2056144 - RNA, 14 nt, Staphylococcus aureus subsp. aureus Mu50
uggaaauuuauuau

SEQ ID NO: 2056145 - RNA, 15 nt, Staphylococcus aureus subsp. aureus Mu50
uggaaauuuauuaua

SEQ ID NO: 2056146 - RNA, 22 nt, Staphylococcus aureus subsp. aureus Mu50
uggaaauuuauuauaaaauaga

SEQ ID NO: 2056147 - RNA, 23 nt, Staphylococcus aureus subsp. aureus Mu50
uggaaauuuauuauaaaauagaa

SEQ ID NO: 2056148 - RNA, 16 nt, Staphylococcus aureus subsp. aureus Mu50
uggaaaguaauaagua

SEQ ID NO: 2056149 - RNA, 13 nt, Staphylococcus aureus subsp. aureus Mu50
uggaaagucagcu

SEQ ID NO: 2056150 - RNA, 15 nt, Staphylococcus aureus subsp. aureus Mu50
uggaaagucagcuua

SEQ ID NO: 2056151 - RNA, 22 nt, Staphylococcus aureus subsp. aureus Mu50
ugcuuuuuuauucuaauacaaa

SEQ ID NO: 2056152 - RNA, 18 nt, Staphylococcus aureus subsp. aureus Mu50
ugcuuuuuuauucuaaua

SEQ ID NO: 2056153 - RNA, 18 nt, Staphylococcus aureus subsp. aureus Mu50
ugcuuuuuauuaugcuuc

SEQ ID NO: 2056154 - RNA, 17 nt, Staphylococcus aureus subsp. aureus Mu50
ugcuuuuucaaaaucuu

SEQ ID NO: 2056155 - RNA, 20 nt, Staphylococcus aureus subsp. aureus Mu50
ugcuuuuuguguaucuguaa

SEQ ID NO: 2056156 - RNA, 13 nt, Staphylococcus aureus subsp. aureus Mu50
ugcuuuucuaucc

SEQ ID NO: 2056157 - RNA, 20 nt, Staphylococcus aureus subsp. aureus Mu50
ugcuuuucuauccauaguaa

SEQ ID NO: 2056158 - RNA, 14 nt, Staphylococcus aureus subsp. aureus Mu50
ugcuuuuccaguau

SEQ ID NO: 2056159 - RNA, 15 nt, Staphylococcus aureus subsp. aureus Mu50
ugcuuuuaauauuau

SEQ ID NO: 2056160 - RNA, 13 nt, Staphylococcus aureus subsp. aureus Mu50
ugcuuuuaauauu

SEQ ID NO: 2056161 - RNA, 17 nt, Staphylococcus aureus subsp. aureus Mu50
ugcuuuggaguuucuuc

SEQ ID NO: 2056162 - RNA, 14 nt, Staphylococcus aureus subsp. aureus Mu50
ugcuuuaacuguac

SEQ ID NO: 2056163 - RNA, 13 nt, Staphylococcus aureus subsp. aureus Mu50
ugcuuuaauauaa

SEQ ID NO: 2056164 - RNA, 20 nt, Staphylococcus aureus subsp. aureus Mu50
ugcuuuaauauaauuauuaa

SEQ ID NO: 2056165 - RNA, 13 nt, Staphylococcus aureus subsp. aureus Mu50
ugcuuuaauaaau

SEQ ID NO: 2056166 - RNA, 14 nt, Staphylococcus aureus subsp. aureus Mu50
ugcuuguuuuaaau

SEQ ID NO: 2056167 - RNA, 12 nt, Staphylococcus aureus subsp. aureus Mu50
ugcuuuaaaucg

SEQ ID NO: 2056168 - RNA, 17 nt, Staphylococcus aureus subsp. aureus Mu50
ugcuuuacguccaaaau

SEQ ID NO: 2056169 - RNA, 16 nt, Staphylococcus aureus subsp. aureus Mu50
ugcuuuaauuaaaguu

SEQ ID NO: 2056170 - RNA, 23 nt, Staphylococcus aureus subsp. aureus Mu50
ugcuuuaauuugauuaaauucuu

SEQ ID NO: 2056171 - RNA, 17 nt, Staphylococcus aureus subsp. aureus Mu50
ugcuuuagcucuuuuuu

SEQ ID NO: 2056172 - RNA, 17 nt, Staphylococcus aureus subsp. aureus Mu50
ugcuuguccucuaaaac

SEQ ID NO: 2056173 - RNA, 12 nt, Staphylococcus aureus subsp. aureus Mu50
ugcuuguuacac

SEQ ID NO: 2056174 - RNA, 13 nt, Staphylococcus aureus subsp. aureus Mu50
ugcuuguaacaag

SEQ ID NO: 2056175 - RNA, 17 nt, Staphylococcus aureus subsp. aureus Mu50
ugcuucauuauauaauu

SEQ ID NO: 2056176 - RNA, 22 nt, Staphylococcus aureus subsp. aureus Mu50
ugcuucauugauaccuuuugcu

SEQ ID NO: 2056177 - RNA, 24 nt, Staphylococcus aureus subsp. aureus Mu50
ugcuucuacccuugcaaauauauc

SEQ ID NO: 2056178 - RNA, 20 nt, Staphylococcus aureus subsp. aureus Mu50
ugcuucgcacaacugcauaa

SEQ ID NO: 2056179 - RNA, 22 nt, Staphylococcus aureus subsp. aureus Mu50
ugcuuccuuuuuguuauaucua

SEQ ID NO: 2056180 - RNA, 15 nt, Staphylococcus aureus subsp. aureus Mu50
ugcuucgaauuuaac

SEQ ID NO: 2056181 - RNA, 15 nt, Staphylococcus aureus subsp. aureus Mu50
ugcuucgcuaauauc

SEQ ID NO: 2056182 - RNA, 17 nt, Staphylococcus aureus subsp. aureus Mu50
ugcuugaccuucaguuu

SEQ ID NO: 2056183 - RNA, 15 nt, Staphylococcus aureus subsp. aureus Mu50
ugcuucuuuuaagua

SEQ ID NO: 2056184 - RNA, 14 nt, Staphylococcus aureus subsp. aureus Mu50
ugcuucuuuccucu

SEQ ID NO: 2056185 - RNA, 22 nt, Staphylococcus aureus subsp. aureus Mu50
ugcuucaaauguaacauuaaaa

SEQ ID NO: 2056186 - RNA, 15 nt, Staphylococcus aureus subsp. aureus Mu50
ugcuuaucaacagcu

SEQ ID NO: 2056187 - RNA, 17 nt, Staphylococcus aureus subsp. aureus Mu50
ugcuuauuuguuuauua

SEQ ID NO: 2056188 - RNA, 16 nt, Staphylococcus aureus subsp. aureus Mu50
ugcuuauguuuuuaac

SEQ ID NO: 2056189 - RNA, 19 nt, Staphylococcus aureus subsp. aureus Mu50
ugcuuaauuuguuuuaaau

SEQ ID NO: 2056190 - RNA, 12 nt, Staphylococcus aureus subsp. aureus Mu50
ugcuuacaauaa

SEQ ID NO: 2056191 - RNA, 18 nt, Staphylococcus aureus subsp. aureus Mu50
ugcuuaauuuguuuuaaa

SEQ ID NO: 2056192 - RNA, 18 nt, Staphylococcus aureus subsp. aureus Mu50
ugcuguuuuuauuauaau

SEQ ID NO: 2056193 - RNA, 17 nt, Staphylococcus aureus subsp. aureus Mu50
ugcugugucuuuugauu

SEQ ID NO: 2056194 - RNA, 13 nt, Staphylococcus aureus subsp. aureus Mu50
ugcuguuacuucu

SEQ ID NO: 2056195 - RNA, 14 nt, Staphylococcus aureus subsp. aureus Mu50
ugcuguuacuucuc

SEQ ID NO: 2056196 - RNA, 13 nt, Staphylococcus aureus subsp. aureus Mu50
ugcuguucuuuuu

SEQ ID NO: 2056197 - RNA, 19 nt, Staphylococcus aureus subsp. aureus Mu50
ugcuguugcaauaaaauca

SEQ ID NO: 2056198 - RNA, 14 nt, Staphylococcus aureus subsp. aureus Mu50
aaaugucauaguau

SEQ ID NO: 2056199 - RNA, 21 nt, Staphylococcus aureus subsp. aureus Mu50
aaauguccgacuugauaaaaa

SEQ ID NO: 2056200 - RNA, 15 nt, Staphylococcus aureus subsp. aureus Mu50
ugcugguaacucuuc

SEQ ID NO: 2056201 - RNA, 19 nt, Staphylococcus aureus subsp. aureus Mu50
ugcuguauauauauguaaa

SEQ ID NO: 2056202 - RNA, 19 nt, Staphylococcus aureus subsp. aureus Mu50
ugcugguugcuucuuauca

SEQ ID NO: 2056203 - RNA, 16 nt, Staphylococcus aureus subsp. aureus Mu50
ugcugcuuucauagaa

SEQ ID NO: 2056204 - RNA, 19 nt, Staphylococcus aureus subsp. aureus Mu50
aaauguaaauaaaaauuau

SEQ ID NO: 2056205 - RNA, 15 nt, Staphylococcus aureus subsp. aureus Mu50
aaauguaacauuaaa

SEQ ID NO: 2056206 - RNA, 23 nt, Staphylococcus aureus subsp. aureus Mu50
aaauguaacauuaaaaauaaaag

SEQ ID NO: 2056207 - RNA, 15 nt, Staphylococcus aureus subsp. aureus Mu50
aaauguacauuguaa

SEQ ID NO: 2056208 - RNA, 21 nt, Staphylococcus aureus subsp. aureus Mu50
aaaugucaguuuugaagaaua

SEQ ID NO: 2056209 - RNA, 16 nt, Staphylococcus aureus subsp. aureus Mu50
aaauguauuaaacauu

SEQ ID NO: 2056210 - RNA, 22 nt, Staphylococcus aureus subsp. aureus Mu50
aaauguauuauucucucauuug

SEQ ID NO: 2056211 - RNA, 15 nt, Staphylococcus aureus subsp. aureus Mu50
aaauguauuuuuacu

SEQ ID NO: 2056212 - RNA, 18 nt, Staphylococcus aureus subsp. aureus Mu50
ugcugccaaaaaguauuc

SEQ ID NO: 2056213 - RNA, 19 nt, Staphylococcus aureus subsp. aureus Mu50
ugcugauaccuaagcugau

SEQ ID NO: 2056214 - RNA, 22 nt, Staphylococcus aureus subsp. aureus Mu50
ugcucuaaacuucuauuaauaa

SEQ ID NO: 2056215 - RNA, 17 nt, Staphylococcus aureus subsp. aureus Mu50
ugcucuaagcauucagu

SEQ ID NO: 2056216 - RNA, 17 nt, Staphylococcus aureus subsp. aureus Mu50
ugcucuaauucaaugau

SEQ ID NO: 2056217 - RNA, 14 nt, Staphylococcus aureus subsp. aureus Mu50
ugcucguauagaaa

SEQ ID NO: 2056218 - RNA, 23 nt, Staphylococcus aureus subsp. aureus Mu50
ugaaaaucuaauccugguauaau

SEQ ID NO: 2056219 - RNA, 16 nt, Staphylococcus aureus subsp. aureus Mu50
ugaaaauagccauauu

SEQ ID NO: 2056220 - RNA, 14 nt, Staphylococcus aureus subsp. aureus Mu50
ugaaacuaaauuaa

SEQ ID NO: 2056221 - RNA, 14 nt, Staphylococcus aureus subsp. aureus Mu50
ugaaauaauauaaa

SEQ ID NO: 2056222 - RNA, 23 nt, Staphylococcus aureus subsp. aureus Mu50
ugaaaggaguauuuuugcguuaa

SEQ ID NO: 2056223 - RNA, 18 nt, Staphylococcus aureus subsp. aureus Mu50
ugaaacugaguucaauua

SEQ ID NO: 2056224 - RNA, 22 nt, Staphylococcus aureus subsp. aureus Mu50
ugaaacugauugggcugauaau

SEQ ID NO: 2056225 - RNA, 21 nt, Staphylococcus aureus subsp. aureus Mu50
ugaaagcaucuugcaagccau

SEQ ID NO: 2056226 - RNA, 15 nt, Staphylococcus aureus subsp. aureus Mu50
ugaaaaaucuucucc

SEQ ID NO: 2056227 - RNA, 23 nt, Staphylococcus aureus subsp. aureus Mu50
ugaaaaauauccuggaauauuaa

SEQ ID NO: 2056228 - RNA, 12 nt, Staphylococcus aureus subsp. aureus Mu50
ugaaaauaauac

SEQ ID NO: 2056229 - RNA, 23 nt, Staphylococcus aureus subsp. aureus Mu50
ugaaaauaagcuuguaacaagca

SEQ ID NO: 2056230 - RNA, 11 nt, Staphylococcus aureus subsp. aureus Mu50
ugaaaaguuga

SEQ ID NO: 2056231 - RNA, 15 nt, Staphylococcus aureus subsp. aureus Mu50
ugaaaagauaaacaa

SEQ ID NO: 2056232 - RNA, 15 nt, Staphylococcus aureus subsp. aureus Mu50
ugaaaaguaaauuga

SEQ ID NO: 2056233 - RNA, 17 nt, Staphylococcus aureus subsp. aureus Mu50
ugaaaaguaauuaaaua

SEQ ID NO: 2056234 - RNA, 11 nt, Staphylococcus aureus subsp. aureus Mu50
ugaaaacuucu

SEQ ID NO: 2056235 - RNA, 15 nt, Staphylococcus aureus subsp. aureus Mu50
ugaaaagaauaaguu

SEQ ID NO: 2056236 - RNA, 18 nt, Staphylococcus aureus subsp. aureus Mu50
ucuuuuuugcuguauaua

SEQ ID NO: 2056237 - RNA, 13 nt, Staphylococcus aureus subsp. aureus Mu50
ucuuuuuuuaaug

SEQ ID NO: 2056238 - RNA, 22 nt, Staphylococcus aureus subsp. aureus Mu50
ucuuuuuuuaauguguaaauuu

SEQ ID NO: 2056239 - RNA, 12 nt, Staphylococcus aureus subsp. aureus Mu50
ucuuuuuuaauu

SEQ ID NO: 2056240 - RNA, 16 nt, Staphylococcus aureus subsp. aureus Mu50
ucuuuuuuacuaaaau

SEQ ID NO: 2056241 - RNA, 18 nt, Staphylococcus aureus subsp. aureus Mu50
ucuuuuuuacuaaaauca

SEQ ID NO: 2056242 - RNA, 12 nt, Staphylococcus aureus subsp. aureus Mu50
ucuuuuuuauua

SEQ ID NO: 2056243 - RNA, 19 nt, Staphylococcus aureus subsp. aureus Mu50
ucuuuuuuauuaaguauau

SEQ ID NO: 2056244 - RNA, 15 nt, Staphylococcus aureus subsp. aureus Mu50
ugaaaaacuucuuaa

SEQ ID NO: 2056245 - RNA, 22 nt, Staphylococcus aureus subsp. aureus Mu50
ugaaaaaauaacuguaaaacau

SEQ ID NO: 2056246 - RNA, 23 nt, Staphylococcus aureus subsp. aureus Mu50
ugaaaaaauaacuguaaaacauu

SEQ ID NO: 2056247 - RNA, 14 nt, Staphylococcus aureus subsp. aureus Mu50
ugaaaaaauaacug

SEQ ID NO: 2056248 - RNA, 17 nt, Staphylococcus aureus subsp. aureus Mu50
ugaaaaaguuucggaaa

SEQ ID NO: 2056249 - RNA, 20 nt, Staphylococcus aureus subsp. aureus Mu50
ugaaaaacuucuuaacuuga

SEQ ID NO: 2056250 - RNA, 15 nt, Staphylococcus aureus subsp. aureus Mu50
ugaacuucucuuagu

SEQ ID NO: 2056251 - RNA, 23 nt, Staphylococcus aureus subsp. aureus Mu50
ugaacuguuucuguaaaaguaua

SEQ ID NO: 2056252 - RNA, 15 nt, Staphylococcus aureus subsp. aureus Mu50
ugaacuuauaagucc

SEQ ID NO: 2056253 - RNA, 19 nt, Staphylococcus aureus subsp. aureus Mu50
ugaagaauacaaauauuaa

SEQ ID NO: 2056254 - RNA, 21 nt, Staphylococcus aureus subsp. aureus Mu50
ugaagaauguuucauaugcau

SEQ ID NO: 2056255 - RNA, 23 nt, Staphylococcus aureus subsp. aureus Mu50
ugaagaaucaggaccaaauagag

SEQ ID NO: 2056256 - RNA, 17 nt, Staphylococcus aureus subsp. aureus Mu50
ugaaggccauuuuuauu

SEQ ID NO: 2056257 - RNA, 24 nt, Staphylococcus aureus subsp. aureus Mu50
ugaaggccauuuuuauuuaacacu

SEQ ID NO: 2056258 - RNA, 18 nt, Staphylococcus aureus subsp. aureus Mu50
ugaaggagauauuuucuu

SEQ ID NO: 2056259 - RNA, 17 nt, Staphylococcus aureus subsp. aureus Mu50
ugaaguaauauauaaaa

SEQ ID NO: 2056260 - RNA, 17 nt, Staphylococcus aureus subsp. aureus Mu50
ugaaguacauuaaaaca

SEQ ID NO: 2056261 - RNA, 17 nt, Staphylococcus aureus subsp. aureus Mu50
ugaauaaaauauaucuu

SEQ ID NO: 2056262 - RNA, 18 nt, Staphylococcus aureus subsp. aureus Mu50
ugaauaaagcuaacauac

SEQ ID NO: 2056263 - RNA, 20 nt, Staphylococcus aureus subsp. aureus Mu50
ugaauaaagcuaacauaccu

SEQ ID NO: 2056264 - RNA, 18 nt, Staphylococcus aureus subsp. aureus Mu50
ugaagucaauaauuuuau

SEQ ID NO: 2056265 - RNA, 22 nt, Staphylococcus aureus subsp. aureus Mu50
ugaacuaaaacgauaauaauaa

SEQ ID NO: 2056266 - RNA, 21 nt, Staphylococcus aureus subsp. aureus Mu50
ugaacgguuguauuucaucau

SEQ ID NO: 2056267 - RNA, 22 nt, Staphylococcus aureus subsp. aureus Mu50
ugaacgguuguauuucaucaug

SEQ ID NO: 2056268 - RNA, 17 nt, Staphylococcus aureus subsp. aureus Mu50
ugaacaguuagugcuug

SEQ ID NO: 2056269 - RNA, 20 nt, Staphylococcus aureus subsp. aureus Mu50
ugaaaucuauugugauauau

SEQ ID NO: 2056270 - RNA, 19 nt, Staphylococcus aureus subsp. aureus Mu50
ugaaaucuauugugauaua

SEQ ID NO: 2056271 - RNA, 15 nt, Staphylococcus aureus subsp. aureus Mu50
ugaaccggaaauuaa

SEQ ID NO: 2056272 - RNA, 21 nt, Staphylococcus aureus subsp. aureus Mu50
ugaacauaccugcauaugugu

SEQ ID NO: 2056273 - RNA, 13 nt, Staphylococcus aureus subsp. aureus Mu50
ugaacauaaaaaa

SEQ ID NO: 2056274 - RNA, 15 nt, Staphylococcus aureus subsp. aureus Mu50
ucuuuuuaucaugau

SEQ ID NO: 2056275 - RNA, 22 nt, Staphylococcus aureus subsp. aureus Mu50
ucuuuuuauuuauaacuuuaaa

SEQ ID NO: 2056276 - RNA, 13 nt, Staphylococcus aureus subsp. aureus Mu50
ucuuuuucuaaau

SEQ ID NO: 2056277 - RNA, 15 nt, Staphylococcus aureus subsp. aureus Mu50
ucuuuuucuaaauaa

SEQ ID NO: 2056278 - RNA, 15 nt, Staphylococcus aureus subsp. aureus Mu50
ucuuuuucuugcaua

SEQ ID NO: 2056279 - RNA, 17 nt, Staphylococcus aureus subsp. aureus Mu50
ucuuuuucuaaauaaac

SEQ ID NO: 2056280 - RNA, 18 nt, Staphylococcus aureus subsp. aureus Mu50
ucuuuuugcguuuuuaaa

SEQ ID NO: 2056281 - RNA, 20 nt, Staphylococcus aureus subsp. aureus Mu50
ucuuuuugauuauauuuauu

SEQ ID NO: 2056282 - RNA, 15 nt, Staphylococcus aureus subsp. aureus Mu50
ucuuuuuguccccag

SEQ ID NO: 2056283 - RNA, 23 nt, Staphylococcus aureus subsp. aureus Mu50
ucuuuuuuaagcuuaucaacgau

SEQ ID NO: 2056284 - RNA, 11 nt, Staphylococcus aureus subsp. aureus Mu50
ucuuuuuguuu

SEQ ID NO: 2056285 - RNA, 19 nt, Staphylococcus aureus subsp. aureus Mu50
ucuuuuuguuguuuuaauu

SEQ ID NO: 2056286 - RNA, 21 nt, Staphylococcus aureus subsp. aureus Mu50
ucuuuugcaaaacgcauuuca

SEQ ID NO: 2056287 - RNA, 15 nt, Staphylococcus aureus subsp. aureus Mu50
ucuuuuguuuuuaua

SEQ ID NO: 2056288 - RNA, 16 nt, Staphylococcus aureus subsp. aureus Mu50
ucuuuugcaagguuuu

SEQ ID NO: 2056289 - RNA, 12 nt, Staphylococcus aureus subsp. aureus Mu50
ucuuuuguaaga

SEQ ID NO: 2056290 - RNA, 21 nt, Staphylococcus aureus subsp. aureus Mu50
ucuuuuguaagacuucccaau

SEQ ID NO: 2056291 - RNA, 13 nt, Staphylococcus aureus subsp. aureus Mu50
ucuuuguauuuau

SEQ ID NO: 2056292 - RNA, 19 nt, Staphylococcus aureus subsp. aureus Mu50
ucuuugucaucuuuugucu

SEQ ID NO: 2056293 - RNA, 18 nt, Staphylococcus aureus subsp. aureus Mu50
ucuuuggucuaaagcuua

SEQ ID NO: 2056294 - RNA, 22 nt, Staphylococcus aureus subsp. aureus Mu50
ucuuuggucuaaagcuuauuaa

SEQ ID NO: 2056295 - RNA, 17 nt, Staphylococcus aureus subsp. aureus Mu50
ucuuuguauaccuauuc

SEQ ID NO: 2056296 - RNA, 13 nt, Staphylococcus aureus subsp. aureus Mu50
ucuuuguaaauuu

SEQ ID NO: 2056297 - RNA, 18 nt, Staphylococcus aureus subsp. aureus Mu50
ucuuuguugcaaugcaua

SEQ ID NO: 2056298 - RNA, 18 nt, Staphylococcus aureus subsp. aureus Mu50
ucuuuguuuuuaauuuuu

SEQ ID NO: 2056299 - RNA, 19 nt, Staphylococcus aureus subsp. aureus Mu50
ucuuuguuuuuaauuuuua

SEQ ID NO: 2056300 - RNA, 22 nt, Staphylococcus aureus subsp. aureus Mu50
ucuuuuaaauucuuauaaaaua

SEQ ID NO: 2056301 - RNA, 18 nt, Staphylococcus aureus subsp. aureus Mu50
ucuuuuaacccacauuaa

SEQ ID NO: 2056302 - RNA, 16 nt, Staphylococcus aureus subsp. aureus Mu50
ucuuuuaaauucuuau

SEQ ID NO: 2056303 - RNA, 12 nt, Staphylococcus aureus subsp. aureus Mu50
ucuuuuaauucu

SEQ ID NO: 2056304 - RNA, 18 nt, Staphylococcus aureus subsp. aureus Mu50
ucuuuuaauagaucuuug

SEQ ID NO: 2056305 - RNA, 15 nt, Staphylococcus aureus subsp. aureus Mu50
ucuuuuauacaugua

SEQ ID NO: 2056306 - RNA, 22 nt, Staphylococcus aureus subsp. aureus Mu50
ucuuuuauauuuuuaucaucuu

SEQ ID NO: 2056307 - RNA, 22 nt, Staphylococcus aureus subsp. aureus Mu50
ucuuuuauggugggaagguaaa

SEQ ID NO: 2056308 - RNA, 20 nt, Staphylococcus aureus subsp. aureus Mu50
ucuuuuccaaaacaaaaaua

SEQ ID NO: 2056309 - RNA, 14 nt, Staphylococcus aureus subsp. aureus Mu50
ucuuuccauaauaa

SEQ ID NO: 2056310 - RNA, 22 nt, Staphylococcus aureus subsp. aureus Mu50
ucuuucgacuucgauaucaaug

SEQ ID NO: 2056311 - RNA, 15 nt, Staphylococcus aureus subsp. aureus Mu50
ucuuuccucacuaga

SEQ ID NO: 2056312 - RNA, 14 nt, Staphylococcus aureus subsp. aureus Mu50
ucuuucgucuugua

SEQ ID NO: 2056313 - RNA, 21 nt, Staphylococcus aureus subsp. aureus Mu50
ucuuucucggcgauaaaaugu

SEQ ID NO: 2056314 - RNA, 17 nt, Staphylococcus aureus subsp. aureus Mu50
ucuuucugaagaacgau

SEQ ID NO: 2056315 - RNA, 15 nt, Staphylococcus aureus subsp. aureus Mu50
ucuuucucuauuaau

SEQ ID NO: 2056316 - RNA, 16 nt, Staphylococcus aureus subsp. aureus Mu50
ucuuugauuaaaucuu

SEQ ID NO: 2056317 - RNA, 20 nt, Staphylococcus aureus subsp. aureus Mu50
ucuuucuuguucuaaaauaa

SEQ ID NO: 2056318 - RNA, 20 nt, Staphylococcus aureus subsp. aureus Mu50
ucuuucuuagugaaucuucu

SEQ ID NO: 2056319 - RNA, 13 nt, Staphylococcus aureus subsp. aureus Mu50
ucuuugacaugug

SEQ ID NO: 2056320 - RNA, 19 nt, Staphylococcus aureus subsp. aureus Mu50
ucuuugaacauauuauaaa

SEQ ID NO: 2056321 - RNA, 17 nt, Staphylococcus aureus subsp. aureus Mu50
ucuuggauguuuucguu

SEQ ID NO: 2056322 - RNA, 17 nt, Staphylococcus aureus subsp. aureus Mu50
ucuuggccaauuaacuu

SEQ ID NO: 2056323 - RNA, 15 nt, Staphylococcus aureus subsp. aureus Mu50
ucuuguaaacuucuu

SEQ ID NO: 2056324 - RNA, 23 nt, Staphylococcus aureus subsp. aureus Mu50
ucuugguauuuuuuaaaugcgua

SEQ ID NO: 2056325 - RNA, 20 nt, Staphylococcus aureus subsp. aureus Mu50
ucuugucauuucaaucauuu

SEQ ID NO: 2056326 - RNA, 16 nt, Staphylococcus aureus subsp. aureus Mu50
ucuuuaagcuuaaaua

SEQ ID NO: 2056327 - RNA, 17 nt, Staphylococcus aureus subsp. aureus Mu50
ucuuuaauauaaauuuu

SEQ ID NO: 2056328 - RNA, 18 nt, Staphylococcus aureus subsp. aureus Mu50
ucuuuaauauaaauuuug

SEQ ID NO: 2056329 - RNA, 19 nt, Staphylococcus aureus subsp. aureus Mu50
ucuuuaagcccuuccccua

SEQ ID NO: 2056330 - RNA, 17 nt, Staphylococcus aureus subsp. aureus Mu50
ucuuuaacuuuaauuaa

SEQ ID NO: 2056331 - RNA, 16 nt, Staphylococcus aureus subsp. aureus Mu50
ucuuguuggauuuuaa

SEQ ID NO: 2056332 - RNA, 17 nt, Staphylococcus aureus subsp. aureus Mu50
ucuuguuucaaacaaag

SEQ ID NO: 2056333 - RNA, 13 nt, Staphylococcus aureus subsp. aureus Mu50
ucuuguucuaaaa

SEQ ID NO: 2056334 - RNA, 15 nt, Staphylococcus aureus subsp. aureus Mu50
ucuuguguuucagcu

SEQ ID NO: 2056335 - RNA, 16 nt, Staphylococcus aureus subsp. aureus Mu50
ucuuuaugauaauuaa

SEQ ID NO: 2056336 - RNA, 22 nt, Staphylococcus aureus subsp. aureus Mu50
ucuuuaugauaauuaauuaaaa

SEQ ID NO: 2056337 - RNA, 17 nt, Staphylococcus aureus subsp. aureus Mu50
ucuuuauuaauaaauuc

SEQ ID NO: 2056338 - RNA, 22 nt, Staphylococcus aureus subsp. aureus Mu50
ucuuucaauuaauuuaaaugcu

SEQ ID NO: 2056339 - RNA, 15 nt, Staphylococcus aureus subsp. aureus Mu50
ucuuucaaaugcuua

SEQ ID NO: 2056340 - RNA, 21 nt, Staphylococcus aureus subsp. aureus Mu50
ucuuuauuugauucuucacca

SEQ ID NO: 2056341 - RNA, 13 nt, Staphylococcus aureus subsp. aureus Mu50
ucuuuauuuaaag

SEQ ID NO: 2056342 - RNA, 16 nt, Staphylococcus aureus subsp. aureus Mu50
ucuuuauuuuaaacau

SEQ ID NO: 2056343 - RNA, 15 nt, Staphylococcus aureus subsp. aureus Mu50
ucuuuacuaaagaua

SEQ ID NO: 2056344 - RNA, 16 nt, Staphylococcus aureus subsp. aureus Mu50
ucuuuacuaaagauag

SEQ ID NO: 2056345 - RNA, 23 nt, Staphylococcus aureus subsp. aureus Mu50
ucuuuacuaaagauagcugcuau

SEQ ID NO: 2056346 - RNA, 16 nt, Staphylococcus aureus subsp. aureus Mu50
ucuuuauaaaaaaauc

SEQ ID NO: 2056347 - RNA, 13 nt, Staphylococcus aureus subsp. aureus Mu50
ucuuuauaacuuu

SEQ ID NO: 2056348 - RNA, 17 nt, Staphylococcus aureus subsp. aureus Mu50
ucuuuagauugaucagc

SEQ ID NO: 2056349 - RNA, 18 nt, Staphylococcus aureus subsp. aureus Mu50
ucuuuagcuauguaaaau

SEQ ID NO: 2056350 - RNA, 16 nt, Staphylococcus aureus subsp. aureus Mu50
ucuuuaccauauaauu

SEQ ID NO: 2056351 - RNA, 20 nt, Staphylococcus aureus subsp. aureus Mu50
ucuuuacgauaaacuaaaaa

SEQ ID NO: 2056352 - RNA, 14 nt, Staphylococcus aureus subsp. aureus Mu50
ucuuuaaugaaagc

SEQ ID NO: 2056353 - RNA, 15 nt, Staphylococcus aureus subsp. aureus Mu50
ucuuuaaugaaagca

SEQ ID NO: 2056354 - RNA, 16 nt, Staphylococcus aureus subsp. aureus Mu50
ucuuuaaugauaagug

SEQ ID NO: 2056355 - RNA, 22 nt, Staphylococcus aureus subsp. aureus Mu50
ucuugcgccuuguucaauucag

SEQ ID NO: 2056356 - RNA, 15 nt, Staphylococcus aureus subsp. aureus Mu50
ucuugcaaguauuuu

SEQ ID NO: 2056357 - RNA, 19 nt, Staphylococcus aureus subsp. aureus Mu50
ucuugauuauauuuuucuu

SEQ ID NO: 2056358 - RNA, 15 nt, Staphylococcus aureus subsp. aureus Mu50
ucuugaugaauuaaa

SEQ ID NO: 2056359 - RNA, 19 nt, Staphylococcus aureus subsp. aureus Mu50
ucuucuuuuuguccccagc

SEQ ID NO: 2056360 - RNA, 16 nt, Staphylococcus aureus subsp. aureus Mu50
ucuucuuuuuuucucc

SEQ ID NO: 2056361 - RNA, 15 nt, Staphylococcus aureus subsp. aureus Mu50
ucuugaauaaauuuu

SEQ ID NO: 2056362 - RNA, 20 nt, Staphylococcus aureus subsp. aureus Mu50
ucuugagcuguuacacuuuu

SEQ ID NO: 2056363 - RNA, 16 nt, Staphylococcus aureus subsp. aureus Mu50
ucuucuaaaucaauau

SEQ ID NO: 2056364 - RNA, 17 nt, Staphylococcus aureus subsp. aureus Mu50
ucuucuaauucugaaau

SEQ ID NO: 2056365 - RNA, 23 nt, Staphylococcus aureus subsp. aureus Mu50
ucuucuauuaaacauuuuugaau

SEQ ID NO: 2056366 - RNA, 23 nt, Staphylococcus aureus subsp. aureus Mu50
ucuucucaacaaaucuauaaaua

SEQ ID NO: 2056367 - RNA, 20 nt, Staphylococcus aureus subsp. aureus Mu50
ucuucuauuaaacauuuuug

SEQ ID NO: 2056368 - RNA, 20 nt, Staphylococcus aureus subsp. aureus Mu50
ucuucuaguaauucuucauc

SEQ ID NO: 2056369 - RNA, 14 nt, Staphylococcus aureus subsp. aureus Mu50
ucuucuucagaaau

SEQ ID NO: 2056370 - RNA, 17 nt, Staphylococcus aureus subsp. aureus Mu50
ucuucugcauagcgcuc

SEQ ID NO: 2056371 - RNA, 19 nt, Staphylococcus aureus subsp. aureus Mu50
ucuucaguuaaaucuuuaa

SEQ ID NO: 2056372 - RNA, 16 nt, Staphylococcus aureus subsp. aureus Mu50
ucuucaguaauuucuc

SEQ ID NO: 2056373 - RNA, 17 nt, Staphylococcus aureus subsp. aureus Mu50
ucuucagguguuuuacc

SEQ ID NO: 2056374 - RNA, 17 nt, Staphylococcus aureus subsp. aureus Mu50
ucuucagaaccuugaau

SEQ ID NO: 2056375 - RNA, 19 nt, Staphylococcus aureus subsp. aureus Mu50
ucuuauuuguuuaauuauc

SEQ ID NO: 2056376 - RNA, 14 nt, Staphylococcus aureus subsp. aureus Mu50
ucuuauuuuuaugc

SEQ ID NO: 2056377 - RNA, 18 nt, Staphylococcus aureus subsp. aureus Mu50
ucuuauuuguaauuucag

SEQ ID NO: 2056378 - RNA, 16 nt, Staphylococcus aureus subsp. aureus Mu50
ucuuauuuguuuaauu

SEQ ID NO: 2056379 - RNA, 13 nt, Staphylococcus aureus subsp. aureus Mu50
ucuucaguuauuu

SEQ ID NO: 2056380 - RNA, 13 nt, Staphylococcus aureus subsp. aureus Mu50
ucuucaucaugac

SEQ ID NO: 2056381 - RNA, 17 nt, Staphylococcus aureus subsp. aureus Mu50
ucuucauuaucaauaga

SEQ ID NO: 2056382 - RNA, 14 nt, Staphylococcus aureus subsp. aureus Mu50
ucuucaugaacagc

SEQ ID NO: 2056383 - RNA, 12 nt, Staphylococcus aureus subsp. aureus Mu50
ucuucaucuucu

SEQ ID NO: 2056384 - RNA, 12 nt, Staphylococcus aureus subsp. aureus Mu50
ucuucaucuuua

SEQ ID NO: 2056385 - RNA, 16 nt, Staphylococcus aureus subsp. aureus Mu50
ucuucaucuucuucaa

SEQ ID NO: 2056386 - RNA, 14 nt, Staphylococcus aureus subsp. aureus Mu50
ucuucauuuaaaag

SEQ ID NO: 2056387 - RNA, 14 nt, Staphylococcus aureus subsp. aureus Mu50
ucuucauuuucauu

SEQ ID NO: 2056388 - RNA, 13 nt, Staphylococcus aureus subsp. aureus Mu50
ucuuauuauuaau

SEQ ID NO: 2056389 - RNA, 14 nt, Staphylococcus aureus subsp. aureus Mu50
ucuuauuaaaaaag

SEQ ID NO: 2056390 - RNA, 22 nt, Staphylococcus aureus subsp. aureus Mu50
ucuuauuaaaaaagaacauaaa

SEQ ID NO: 2056391 - RNA, 20 nt, Staphylococcus aureus subsp. aureus Mu50
ucuuagauuuucacuaauau

SEQ ID NO: 2056392 - RNA, 16 nt, Staphylococcus aureus subsp. aureus Mu50
ucuuagacauuguaaa

SEQ ID NO: 2056393 - RNA, 21 nt, Staphylococcus aureus subsp. aureus Mu50
ucuuagacauuguaaaaugcu

SEQ ID NO: 2056394 - RNA, 20 nt, Staphylococcus aureus subsp. aureus Mu50
ucuuacuucguacaucguug

SEQ ID NO: 2056395 - RNA, 19 nt, Staphylococcus aureus subsp. aureus Mu50
ucuuacugcuguuuuuuau

SEQ ID NO: 2056396 - RNA, 18 nt, Staphylococcus aureus subsp. aureus Mu50
ucuuacugcaauuauuuu

SEQ ID NO: 2056397 - RNA, 20 nt, Staphylococcus aureus subsp. aureus Mu50
ucuuacugcuguucucuauu

SEQ ID NO: 2056398 - RNA, 14 nt, Staphylococcus aureus subsp. aureus Mu50
ucuuaauucuucug

SEQ ID NO: 2056399 - RNA, 14 nt, Staphylococcus aureus subsp. aureus Mu50
ucuuaauguacuuu

SEQ ID NO: 2056400 - RNA, 19 nt, Staphylococcus aureus subsp. aureus Mu50
ucuuaaucagcuauaaaag

SEQ ID NO: 2056401 - RNA, 14 nt, Staphylococcus aureus subsp. aureus Mu50
ucugguaaaaaaau

SEQ ID NO: 2056402 - RNA, 16 nt, Staphylococcus aureus subsp. aureus Mu50
ucuguuugucacuuaa

SEQ ID NO: 2056403 - RNA, 13 nt, Staphylococcus aureus subsp. aureus Mu50
ucuuaaguacaua

SEQ ID NO: 2056404 - RNA, 16 nt, Staphylococcus aureus subsp. aureus Mu50
ucuuaacaacuuuaau

SEQ ID NO: 2056405 - RNA, 14 nt, Staphylococcus aureus subsp. aureus Mu50
ucuuaacaacauga

SEQ ID NO: 2056406 - RNA, 17 nt, Staphylococcus aureus subsp. aureus Mu50
ucuuaaaucaacaucau

SEQ ID NO: 2056407 - RNA, 17 nt, Staphylococcus aureus subsp. aureus Mu50
ucuuaaagauuuuucag

SEQ ID NO: 2056408 - RNA, 13 nt, Staphylococcus aureus subsp. aureus Mu50
ucugcaaaaugca

SEQ ID NO: 2056409 - RNA, 22 nt, Staphylococcus aureus subsp. aureus Mu50
ucugauuucacuucuaaaacua

SEQ ID NO: 2056410 - RNA, 23 nt, Staphylococcus aureus subsp. aureus Mu50
ucugauucucuaacgauuucuag

SEQ ID NO: 2056411 - RNA, 15 nt, Staphylococcus aureus subsp. aureus Mu50
ucugcugcuuucaua

SEQ ID NO: 2056412 - RNA, 14 nt, Staphylococcus aureus subsp. aureus Mu50
ucugcuacuuguug

SEQ ID NO: 2056413 - RNA, 14 nt, Staphylococcus aureus subsp. aureus Mu50
ucucgucuuucguc

SEQ ID NO: 2056414 - RNA, 14 nt, Staphylococcus aureus subsp. aureus Mu50
ucucguaauaaugu

SEQ ID NO: 2056415 - RNA, 15 nt, Staphylococcus aureus subsp. aureus Mu50
ucucuguagauauca

SEQ ID NO: 2056416 - RNA, 14 nt, Staphylococcus aureus subsp. aureus Mu50
ucucuaguaucuga

SEQ ID NO: 2056417 - RNA, 14 nt, Staphylococcus aureus subsp. aureus Mu50
aaaugcuaaaagua

SEQ ID NO: 2056418 - RNA, 16 nt, Staphylococcus aureus subsp. aureus Mu50
ucucuucaaaguagau

SEQ ID NO: 2056419 - RNA, 19 nt, Staphylococcus aureus subsp. aureus Mu50
ucugaaaugauacauuauu

SEQ ID NO: 2056420 - RNA, 14 nt, Staphylococcus aureus subsp. aureus Mu50
ucucuuuucacgaa

SEQ ID NO: 2056421 - RNA, 22 nt, Staphylococcus aureus subsp. aureus Mu50
ucucuuuuugauuauauuuauu

SEQ ID NO: 2056422 - RNA, 15 nt, Staphylococcus aureus subsp. aureus Mu50
ucucuuucuuauuca

SEQ ID NO: 2056423 - RNA, 23 nt, Staphylococcus aureus subsp. aureus Mu50
aaaugcuauauuuagaaugauga

SEQ ID NO: 2056424 - RNA, 17 nt, Staphylococcus aureus subsp. aureus Mu50
aaaugcuacaauuuccu

SEQ ID NO: 2056425 - RNA, 19 nt, Staphylococcus aureus subsp. aureus Mu50
ucugacaacuuaauagaaa

SEQ ID NO: 2056426 - RNA, 13 nt, Staphylococcus aureus subsp. aureus Mu50
ucugaauuuagga

SEQ ID NO: 2056427 - RNA, 12 nt, Staphylococcus aureus subsp. aureus Mu50
ucugaauuuagg

SEQ ID NO: 2056428 - RNA, 23 nt, Staphylococcus aureus subsp. aureus Mu50
ucugaauacacgacgcuaaacaa

SEQ ID NO: 2056429 - RNA, 15 nt, Staphylococcus aureus subsp. aureus Mu50
ucugaucgacuaauu

SEQ ID NO: 2056430 - RNA, 14 nt, Staphylococcus aureus subsp. aureus Mu50
ucugacuuuuaaaa

SEQ ID NO: 2056431 - RNA, 18 nt, Staphylococcus aureus subsp. aureus Mu50
ugacauuugaccaaguau

SEQ ID NO: 2056432 - RNA, 19 nt, Staphylococcus aureus subsp. aureus Mu50
ugaccaauagcaauugaau

SEQ ID NO: 2056433 - RNA, 13 nt, Staphylococcus aureus subsp. aureus Mu50
ugaauaacaagaa

SEQ ID NO: 2056434 - RNA, 21 nt, Staphylococcus aureus subsp. aureus Mu50
ugaauaaauacaauguuauua

SEQ ID NO: 2056435 - RNA, 15 nt, Staphylococcus aureus subsp. aureus Mu50
ugacaucuauuucuu

SEQ ID NO: 2056436 - RNA, 15 nt, Staphylococcus aureus subsp. aureus Mu50
ugaccaccacuuuca

SEQ ID NO: 2056437 - RNA, 17 nt, Staphylococcus aureus subsp. aureus Mu50
ugaccuacuuuuucaau

SEQ ID NO: 2056438 - RNA, 12 nt, Staphylococcus aureus subsp. aureus Mu50
ugaccucagguu

SEQ ID NO: 2056439 - RNA, 18 nt, Staphylococcus aureus subsp. aureus Mu50
ugacgcgugaauuaaaaa

SEQ ID NO: 2056440 - RNA, 21 nt, Staphylococcus aureus subsp. aureus Mu50
ugacgcgugaauuaaaaaaug

SEQ ID NO: 2056441 - RNA, 22 nt, Staphylococcus aureus subsp. aureus Mu50
ugacgauaccuuuaauaauauu

SEQ ID NO: 2056442 - RNA, 16 nt, Staphylococcus aureus subsp. aureus Mu50
ugagagauuauuuaaa

SEQ ID NO: 2056443 - RNA, 17 nt, Staphylococcus aureus subsp. aureus Mu50
ugagacguuuuccauga

SEQ ID NO: 2056444 - RNA, 16 nt, Staphylococcus aureus subsp. aureus Mu50
ugagaaaguaaaaguu

SEQ ID NO: 2056445 - RNA, 15 nt, Staphylococcus aureus subsp. aureus Mu50
ugagaagaaauauau

SEQ ID NO: 2056446 - RNA, 21 nt, Staphylococcus aureus subsp. aureus Mu50
ugacucggggaauuuuuaugc

SEQ ID NO: 2056447 - RNA, 16 nt, Staphylococcus aureus subsp. aureus Mu50
ugacuucuuuauauuu

SEQ ID NO: 2056448 - RNA, 18 nt, Staphylococcus aureus subsp. aureus Mu50
ugacugaaugagaaugug

SEQ ID NO: 2056449 - RNA, 12 nt, Staphylococcus aureus subsp. aureus Mu50
ugacugagaaaa

SEQ ID NO: 2056450 - RNA, 14 nt, Staphylococcus aureus subsp. aureus Mu50
ugacuuauuuuuca

SEQ ID NO: 2056451 - RNA, 18 nt, Staphylococcus aureus subsp. aureus Mu50
ugacuuauuuuucaucau

SEQ ID NO: 2056452 - RNA, 22 nt, Staphylococcus aureus subsp. aureus Mu50
ugacuuaauaucauauucaaaa

SEQ ID NO: 2056453 - RNA, 18 nt, Staphylococcus aureus subsp. aureus Mu50
ugacuagccuucaauauu

SEQ ID NO: 2056454 - RNA, 13 nt, Staphylococcus aureus subsp. aureus Mu50
ugacuagggguuu

SEQ ID NO: 2056455 - RNA, 16 nt, Staphylococcus aureus subsp. aureus Mu50
ugacuagggguuuuua

SEQ ID NO: 2056456 - RNA, 18 nt, Staphylococcus aureus subsp. aureus Mu50
ugacuagggguuuuuaau

SEQ ID NO: 2056457 - RNA, 23 nt, Staphylococcus aureus subsp. aureus Mu50
ugacuauuucgcuuuuuuuauuu

SEQ ID NO: 2056458 - RNA, 12 nt, Staphylococcus aureus subsp. aureus Mu50
ugacuauuuucc

SEQ ID NO: 2056459 - RNA, 16 nt, Staphylococcus aureus subsp. aureus Mu50
ugacgugcuuuuaaau

SEQ ID NO: 2056460 - RNA, 17 nt, Staphylococcus aureus subsp. aureus Mu50
ugauaugcucucuucaa

SEQ ID NO: 2056461 - RNA, 18 nt, Staphylococcus aureus subsp. aureus Mu50
ugauaugcucucuucaaa

SEQ ID NO: 2056462 - RNA, 14 nt, Staphylococcus aureus subsp. aureus Mu50
ugaucauaauucag

SEQ ID NO: 2056463 - RNA, 16 nt, Staphylococcus aureus subsp. aureus Mu50
ugaucagcauuuaagc

SEQ ID NO: 2056464 - RNA, 20 nt, Staphylococcus aureus subsp. aureus Mu50
ugauccuggaaucgaaaaua

SEQ ID NO: 2056465 - RNA, 18 nt, Staphylococcus aureus subsp. aureus Mu50
ugaucgauuguuuauuag

SEQ ID NO: 2056466 - RNA, 14 nt, Staphylococcus aureus subsp. aureus Mu50
ugauauaauagaaa

SEQ ID NO: 2056467 - RNA, 17 nt, Staphylococcus aureus subsp. aureus Mu50
ugauauauguaacauaa

SEQ ID NO: 2056468 - RNA, 15 nt, Staphylococcus aureus subsp. aureus Mu50
ugauauauuacacca

SEQ ID NO: 2056469 - RNA, 19 nt, Staphylococcus aureus subsp. aureus Mu50
ugauauacgacaaucacag

SEQ ID NO: 2056470 - RNA, 15 nt, Staphylococcus aureus subsp. aureus Mu50
ugauaguacauuuau

SEQ ID NO: 2056471 - RNA, 17 nt, Staphylococcus aureus subsp. aureus Mu50
ugauagcuaaugcauua

SEQ ID NO: 2056472 - RNA, 22 nt, Staphylococcus aureus subsp. aureus Mu50
ugauagcuaaacauuuuauacu

SEQ ID NO: 2056473 - RNA, 17 nt, Staphylococcus aureus subsp. aureus Mu50
ugauagcaaugaauuaa

SEQ ID NO: 2056474 - RNA, 20 nt, Staphylococcus aureus subsp. aureus Mu50
ugauagcaaugaauuaauag

SEQ ID NO: 2056475 - RNA, 22 nt, Staphylococcus aureus subsp. aureus Mu50
ugauaauacuguuuaaauaaaa

SEQ ID NO: 2056476 - RNA, 18 nt, Staphylococcus aureus subsp. aureus Mu50
ugauaagugaugugaugu

SEQ ID NO: 2056477 - RNA, 14 nt, Staphylococcus aureus subsp. aureus Mu50
ugauaauaaaaguu

SEQ ID NO: 2056478 - RNA, 18 nt, Staphylococcus aureus subsp. aureus Mu50
ugauacccgcgauacugc

SEQ ID NO: 2056479 - RNA, 17 nt, Staphylococcus aureus subsp. aureus Mu50
ugauagacuaauuaucu

SEQ ID NO: 2056480 - RNA, 17 nt, Staphylococcus aureus subsp. aureus Mu50
ugauacuucaccaucuu

SEQ ID NO: 2056481 - RNA, 19 nt, Staphylococcus aureus subsp. aureus Mu50
ugauacgccuaaauauuua

SEQ ID NO: 2056482 - RNA, 16 nt, Staphylococcus aureus subsp. aureus Mu50
ugauacgcuuuuuaaa

SEQ ID NO: 2056483 - RNA, 17 nt, Staphylococcus aureus subsp. aureus Mu50
ugauacgcuuuuuaaaa

SEQ ID NO: 2056484 - RNA, 17 nt, Staphylococcus aureus subsp. aureus Mu50
ugaguguuuaugaaagu

SEQ ID NO: 2056485 - RNA, 22 nt, Staphylococcus aureus subsp. aureus Mu50
ugaguguguccaucauuugugu

SEQ ID NO: 2056486 - RNA, 18 nt, Staphylococcus aureus subsp. aureus Mu50
ugaguguuucauaaucuc

SEQ ID NO: 2056487 - RNA, 23 nt, Staphylococcus aureus subsp. aureus Mu50
ugagugguuuucuuuauuuuaaa

SEQ ID NO: 2056488 - RNA, 21 nt, Staphylococcus aureus subsp. aureus Mu50
ugagugucaugcuuaauuuau

SEQ ID NO: 2056489 - RNA, 15 nt, Staphylococcus aureus subsp. aureus Mu50
ugauaacuuguaaua

SEQ ID NO: 2056490 - RNA, 15 nt, Staphylococcus aureus subsp. aureus Mu50
ugaguucguaaucuu

SEQ ID NO: 2056491 - RNA, 18 nt, Staphylococcus aureus subsp. aureus Mu50
ugaguuuuuuaaaauaau

SEQ ID NO: 2056492 - RNA, 15 nt, Staphylococcus aureus subsp. aureus Mu50
ugagggauuuuuaua

SEQ ID NO: 2056493 - RNA, 19 nt, Staphylococcus aureus subsp. aureus Mu50
ugaggcguuucagaaguug

SEQ ID NO: 2056494 - RNA, 14 nt, Staphylococcus aureus subsp. aureus Mu50
ugagggccccaaca

SEQ ID NO: 2056495 - RNA, 17 nt, Staphylococcus aureus subsp. aureus Mu50
ugagauaucuuauaaca

SEQ ID NO: 2056496 - RNA, 22 nt, Staphylococcus aureus subsp. aureus Mu50
ugcauugauuucagcaccgaca

SEQ ID NO: 2056497 - RNA, 12 nt, Staphylococcus aureus subsp. aureus Mu50
ugcauuauuaua

SEQ ID NO: 2056498 - RNA, 17 nt, Staphylococcus aureus subsp. aureus Mu50
ugcaucaguuaauaauu

SEQ ID NO: 2056499 - RNA, 22 nt, Staphylococcus aureus subsp. aureus Mu50
ugcauuuagaugauucuuauca

SEQ ID NO: 2056500 - RNA, 19 nt, Staphylococcus aureus subsp. aureus Mu50
ugcauuuagaugauucuua

SEQ ID NO: 2056501 - RNA, 19 nt, Staphylococcus aureus subsp. aureus Mu50
ugcauacgaauuaaaauaa

SEQ ID NO: 2056502 - RNA, 14 nt, Staphylococcus aureus subsp. aureus Mu50
ugcauaaucaauuu

SEQ ID NO: 2056503 - RNA, 21 nt, Staphylococcus aureus subsp. aureus Mu50
ugcauaauuaggauuaacaua

SEQ ID NO: 2056504 - RNA, 16 nt, Staphylococcus aureus subsp. aureus Mu50
ugcauaagaaauacua

SEQ ID NO: 2056505 - RNA, 21 nt, Staphylococcus aureus subsp. aureus Mu50
ugcacauaaaaaaugugaccu

SEQ ID NO: 2056506 - RNA, 11 nt, Staphylococcus aureus subsp. aureus Mu50
ugcacaucaua

SEQ ID NO: 2056507 - RNA, 23 nt, Staphylococcus aureus subsp. aureus Mu50
ugcacaucauaauaaaucuaucu

SEQ ID NO: 2056508 - RNA, 14 nt, Staphylococcus aureus subsp. aureus Mu50
ugcacgugagaaac

SEQ ID NO: 2056509 - RNA, 21 nt, Staphylococcus aureus subsp. aureus Mu50
ugcaccuggucguacuuucaa

SEQ ID NO: 2056510 - RNA, 17 nt, Staphylococcus aureus subsp. aureus Mu50
ugcacuugguucauaau

SEQ ID NO: 2056511 - RNA, 23 nt, Staphylococcus aureus subsp. aureus Mu50
ugcacuugguucauaaugaucaa

SEQ ID NO: 2056512 - RNA, 16 nt, Staphylococcus aureus subsp. aureus Mu50
ugcacuuguaauauua

SEQ ID NO: 2056513 - RNA, 20 nt, Staphylococcus aureus subsp. aureus Mu50
ugcagauucuucaccaacuu

SEQ ID NO: 2056514 - RNA, 20 nt, Staphylococcus aureus subsp. aureus Mu50
ugcagauugauauaaauuau

SEQ ID NO: 2056515 - RNA, 16 nt, Staphylococcus aureus subsp. aureus Mu50
ugcacugcuaauauua

SEQ ID NO: 2056516 - RNA, 19 nt, Staphylococcus aureus subsp. aureus Mu50
ugcacuaugcauaauacca

SEQ ID NO: 2056517 - RNA, 23 nt, Staphylococcus aureus subsp. aureus Mu50
ugcagcaacugcauuacgcuguc

SEQ ID NO: 2056518 - RNA, 14 nt, Staphylococcus aureus subsp. aureus Mu50
ugcaacauuuugag

SEQ ID NO: 2056519 - RNA, 22 nt, Staphylococcus aureus subsp. aureus Mu50
ugcaacagaaccgaaaauaauc

SEQ ID NO: 2056520 - RNA, 20 nt, Staphylococcus aureus subsp. aureus Mu50
ugcaaauuaucauuaaauug

SEQ ID NO: 2056521 - RNA, 14 nt, Staphylococcus aureus subsp. aureus Mu50
ugcaaaugccucuu

SEQ ID NO: 2056522 - RNA, 16 nt, Staphylococcus aureus subsp. aureus Mu50
ugcaaaugccucuuuc

SEQ ID NO: 2056523 - RNA, 20 nt, Staphylococcus aureus subsp. aureus Mu50
ugcaaaucucgucacauaua

SEQ ID NO: 2056524 - RNA, 16 nt, Staphylococcus aureus subsp. aureus Mu50
ugcaaaugaaauucuu

SEQ ID NO: 2056525 - RNA, 16 nt, Staphylococcus aureus subsp. aureus Mu50
ugcaacuuauaauauu

SEQ ID NO: 2056526 - RNA, 14 nt, Staphylococcus aureus subsp. aureus Mu50
ugcaacuuauaaua

SEQ ID NO: 2056527 - RNA, 17 nt, Staphylococcus aureus subsp. aureus Mu50
ugcaacuugaucauuau

SEQ ID NO: 2056528 - RNA, 22 nt, Staphylococcus aureus subsp. aureus Mu50
ugcaauuagaauauauguauaa

SEQ ID NO: 2056529 - RNA, 23 nt, Staphylococcus aureus subsp. aureus Mu50
ugcaauuauuuuucaaauauauc

SEQ ID NO: 2056530 - RNA, 21 nt, Staphylococcus aureus subsp. aureus Mu50
ugcaauuauuucaauuaucaa

SEQ ID NO: 2056531 - RNA, 18 nt, Staphylococcus aureus subsp. aureus Mu50
ugcaauugccuuaucagc

SEQ ID NO: 2056532 - RNA, 17 nt, Staphylococcus aureus subsp. aureus Mu50
ugcaauuucauaguguu

SEQ ID NO: 2056533 - RNA, 20 nt, Staphylococcus aureus subsp. aureus Mu50
ugcaauugccuuaucagcau

SEQ ID NO: 2056534 - RNA, 14 nt, Staphylococcus aureus subsp. aureus Mu50
ugcaauuuguaaua

SEQ ID NO: 2056535 - RNA, 11 nt, Staphylococcus aureus subsp. aureus Mu50
ugcaauuugua

SEQ ID NO: 2056536 - RNA, 21 nt, Staphylococcus aureus subsp. aureus Mu50
ugcaauuuuucacuuauaaca

SEQ ID NO: 2056537 - RNA, 20 nt, Staphylococcus aureus subsp. aureus Mu50
ugcaaucguauguaacaauu

SEQ ID NO: 2056538 - RNA, 19 nt, Staphylococcus aureus subsp. aureus Mu50
ugcaaguuggcggggcccc

SEQ ID NO: 2056539 - RNA, 23 nt, Staphylococcus aureus subsp. aureus Mu50
ugcaauaacaccaauugaauauu

SEQ ID NO: 2056540 - RNA, 14 nt, Staphylococcus aureus subsp. aureus Mu50
ugcaauaauaaaua

SEQ ID NO: 2056541 - RNA, 17 nt, Staphylococcus aureus subsp. aureus Mu50
ugcaagucguucucuua

SEQ ID NO: 2056542 - RNA, 22 nt, Staphylococcus aureus subsp. aureus Mu50
ugcaagucguucucuuaaauau

SEQ ID NO: 2056543 - RNA, 12 nt, Staphylococcus aureus subsp. aureus Mu50
ugcaaguauuuu

SEQ ID NO: 2056544 - RNA, 20 nt, Staphylococcus aureus subsp. aureus Mu50
ugcaaguccaaauaauaucu

SEQ ID NO: 2056545 - RNA, 17 nt, Staphylococcus aureus subsp. aureus Mu50
ugcaaguaauuuaauug

SEQ ID NO: 2056546 - RNA, 16 nt, Staphylococcus aureus subsp. aureus Mu50
ugcaauaauucaucuu

SEQ ID NO: 2056547 - RNA, 23 nt, Staphylococcus aureus subsp. aureus Mu50
ugcaauaccuccccaacuuaaua

SEQ ID NO: 2056548 - RNA, 17 nt, Staphylococcus aureus subsp. aureus Mu50
ugcaauaggaugaaacu

SEQ ID NO: 2056549 - RNA, 14 nt, Staphylococcus aureus subsp. aureus Mu50
ugauuuuaggcaau

SEQ ID NO: 2056550 - RNA, 18 nt, Staphylococcus aureus subsp. aureus Mu50
ugauuuuacuugaauaua

SEQ ID NO: 2056551 - RNA, 12 nt, Staphylococcus aureus subsp. aureus Mu50
ugauuuucuuua

SEQ ID NO: 2056552 - RNA, 14 nt, Staphylococcus aureus subsp. aureus Mu50
ugauuuugaaucac

SEQ ID NO: 2056553 - RNA, 12 nt, Staphylococcus aureus subsp. aureus Mu50
ugauuuuuaaaa

SEQ ID NO: 2056554 - RNA, 24 nt, Staphylococcus aureus subsp. aureus Mu50
ugauuuuucaucaauaucaaauuu

SEQ ID NO: 2056555 - RNA, 12 nt, Staphylococcus aureus subsp. aureus Mu50
ugauuuuucaua

SEQ ID NO: 2056556 - RNA, 20 nt, Staphylococcus aureus subsp. aureus Mu50
ugcaaaaauaauaugaauuu

SEQ ID NO: 2056557 - RNA, 20 nt, Staphylococcus aureus subsp. aureus Mu50
ugcaaagggcgaaauggauu

SEQ ID NO: 2056558 - RNA, 15 nt, Staphylococcus aureus subsp. aureus Mu50
ugcaaaguaacaaua

SEQ ID NO: 2056559 - RNA, 19 nt, Staphylococcus aureus subsp. aureus Mu50
ugcaaauauaucaucucua

SEQ ID NO: 2056560 - RNA, 14 nt, Staphylococcus aureus subsp. aureus Mu50
ugcaaauaaaaaag

SEQ ID NO: 2056561 - RNA, 13 nt, Staphylococcus aureus subsp. aureus Mu50
ugcaaauacgagu

SEQ ID NO: 2056562 - RNA, 22 nt, Staphylococcus aureus subsp. aureus Mu50
ugcaaauacgaguguuuuaauc

SEQ ID NO: 2056563 - RNA, 20 nt, Staphylococcus aureus subsp. aureus Mu50
ugcaaacacaguacaaauaa

SEQ ID NO: 2056564 - RNA, 14 nt, Staphylococcus aureus subsp. aureus Mu50
ugcaaaaugcauua

SEQ ID NO: 2056565 - RNA, 15 nt, Staphylococcus aureus subsp. aureus Mu50
ugcaaacgauauguu

SEQ ID NO: 2056566 - RNA, 19 nt, Staphylococcus aureus subsp. aureus Mu50
ugcaaacuugauucaauau

SEQ ID NO: 2056567 - RNA, 12 nt, Staphylococcus aureus subsp. aureus Mu50
ugcaaaaucaac

SEQ ID NO: 2056568 - RNA, 21 nt, Staphylococcus aureus subsp. aureus Mu50
ugauugcauugauuucagcac

SEQ ID NO: 2056569 - RNA, 18 nt, Staphylococcus aureus subsp. aureus Mu50
ugauugaacaauaauaug

SEQ ID NO: 2056570 - RNA, 14 nt, Staphylococcus aureus subsp. aureus Mu50
ugauucguauucaa

SEQ ID NO: 2056571 - RNA, 13 nt, Staphylococcus aureus subsp. aureus Mu50
ugauugaauguuu

SEQ ID NO: 2056572 - RNA, 14 nt, Staphylococcus aureus subsp. aureus Mu50
ugauuuacgugcau

SEQ ID NO: 2056573 - RNA, 17 nt, Staphylococcus aureus subsp. aureus Mu50
ugauuuagcauacauua

SEQ ID NO: 2056574 - RNA, 19 nt, Staphylococcus aureus subsp. aureus Mu50
ugauuuagcauacauuaag

SEQ ID NO: 2056575 - RNA, 21 nt, Staphylococcus aureus subsp. aureus Mu50
ugauuuacgugcauuguaaua

SEQ ID NO: 2056576 - RNA, 12 nt, Staphylococcus aureus subsp. aureus Mu50
ugauuuaaaaaa

SEQ ID NO: 2056577 - RNA, 21 nt, Staphylococcus aureus subsp. aureus Mu50
ugauuuaauaaugcuauauuu

SEQ ID NO: 2056578 - RNA, 20 nt, Staphylococcus aureus subsp. aureus Mu50
ugauuuaauagcuaaagcuu

SEQ ID NO: 2056579 - RNA, 14 nt, Staphylococcus aureus subsp. aureus Mu50
ugauuuaauguuaa

SEQ ID NO: 2056580 - RNA, 14 nt, Staphylococcus aureus subsp. aureus Mu50
ugaugauaaauuga

SEQ ID NO: 2056581 - RNA, 17 nt, Staphylococcus aureus subsp. aureus Mu50
ugaugaggcaauauuaa

SEQ ID NO: 2056582 - RNA, 11 nt, Staphylococcus aureus subsp. aureus Mu50
ugauucccaaa

SEQ ID NO: 2056583 - RNA, 22 nt, Staphylococcus aureus subsp. aureus Mu50
ucaugugcaagcuuuuuaggaa

SEQ ID NO: 2056584 - RNA, 18 nt, Staphylococcus aureus subsp. aureus Mu50
ucauguuuggcauaauaa

SEQ ID NO: 2056585 - RNA, 14 nt, Staphylococcus aureus subsp. aureus Mu50
ucaguuaaaucuuu

SEQ ID NO: 2056586 - RNA, 16 nt, Staphylococcus aureus subsp. aureus Mu50
ucaguuaaaucuuuaa

SEQ ID NO: 2056587 - RNA, 16 nt, Staphylococcus aureus subsp. aureus Mu50
ucauuagccaaaucuu

SEQ ID NO: 2056588 - RNA, 14 nt, Staphylococcus aureus subsp. aureus Mu50
ucauuauaaaaugg

SEQ ID NO: 2056589 - RNA, 22 nt, Staphylococcus aureus subsp. aureus Mu50
ucauuaguugccccuagcaaaa

SEQ ID NO: 2056590 - RNA, 22 nt, Staphylococcus aureus subsp. aureus Mu50
ucauuauacgugcuuuaaaguu

SEQ ID NO: 2056591 - RNA, 16 nt, Staphylococcus aureus subsp. aureus Mu50
ucauuaucaaauaacc

SEQ ID NO: 2056592 - RNA, 19 nt, Staphylococcus aureus subsp. aureus Mu50
uccaaacacaaauaaaggc

SEQ ID NO: 2056593 - RNA, 22 nt, Staphylococcus aureus subsp. aureus Mu50
ucauuuuuaauuuugacauaaa

SEQ ID NO: 2056594 - RNA, 12 nt, Staphylococcus aureus subsp. aureus Mu50
ucauuuuuaauu

SEQ ID NO: 2056595 - RNA, 23 nt, Staphylococcus aureus subsp. aureus Mu50
ucauuuuuaauugaaugaaaaag

SEQ ID NO: 2056596 - RNA, 17 nt, Staphylococcus aureus subsp. aureus Mu50
ucauuuuuaauuuugac

SEQ ID NO: 2056597 - RNA, 22 nt, Staphylococcus aureus subsp. aureus Mu50
uccaaauugcaaaguaacaaua

SEQ ID NO: 2056598 - RNA, 18 nt, Staphylococcus aureus subsp. aureus Mu50
ucauuugauuuaaaaagu

SEQ ID NO: 2056599 - RNA, 16 nt, Staphylococcus aureus subsp. aureus Mu50
ucauuucuuuguuucg

SEQ ID NO: 2056600 - RNA, 20 nt, Staphylococcus aureus subsp. aureus Mu50
ucauuuggcguucaacauua

SEQ ID NO: 2056601 - RNA, 20 nt, Staphylococcus aureus subsp. aureus Mu50
ucauuugaacaucauuuaau

SEQ ID NO: 2056602 - RNA, 12 nt, Staphylococcus aureus subsp. aureus Mu50
ucauuucugaag

SEQ ID NO: 2056603 - RNA, 17 nt, Staphylococcus aureus subsp. aureus Mu50
ucauuucugaaguuauc

SEQ ID NO: 2056604 - RNA, 19 nt, Staphylococcus aureus subsp. aureus Mu50
ucauuucgauuaauuuaau

SEQ ID NO: 2056605 - RNA, 15 nt, Staphylococcus aureus subsp. aureus Mu50
ucauuguaauaauaa

SEQ ID NO: 2056606 - RNA, 16 nt, Staphylococcus aureus subsp. aureus Mu50
ucauuguauaaaaagu

SEQ ID NO: 2056607 - RNA, 12 nt, Staphylococcus aureus subsp. aureus Mu50
ucauuguauaaa

SEQ ID NO: 2056608 - RNA, 22 nt, Staphylococcus aureus subsp. aureus Mu50
ucauuguguccauaaauauuaa

SEQ ID NO: 2056609 - RNA, 15 nt, Staphylococcus aureus subsp. aureus Mu50
ucauuuaaaauauuu

SEQ ID NO: 2056610 - RNA, 13 nt, Staphylococcus aureus subsp. aureus Mu50
ucauuuaaauauu

SEQ ID NO: 2056611 - RNA, 20 nt, Staphylococcus aureus subsp. aureus Mu50
ucauuuaacauguauuuagu

SEQ ID NO: 2056612 - RNA, 15 nt, Staphylococcus aureus subsp. aureus Mu50
uccacuucaucuaaa

SEQ ID NO: 2056613 - RNA, 19 nt, Staphylococcus aureus subsp. aureus Mu50
uccaauucauuuuauaaau

SEQ ID NO: 2056614 - RNA, 18 nt, Staphylococcus aureus subsp. aureus Mu50
uccaauuaccaaugaaua

SEQ ID NO: 2056615 - RNA, 21 nt, Staphylococcus aureus subsp. aureus Mu50
uccaauuaccaaugaauaaau

SEQ ID NO: 2056616 - RNA, 18 nt, Staphylococcus aureus subsp. aureus Mu50
uccaaucaacuucauaua

SEQ ID NO: 2056617 - RNA, 16 nt, Staphylococcus aureus subsp. aureus Mu50
uccaaucaucauuaaa

SEQ ID NO: 2056618 - RNA, 13 nt, Staphylococcus aureus subsp. aureus Mu50
uccaaugcaauug

SEQ ID NO: 2056619 - RNA, 15 nt, Staphylococcus aureus subsp. aureus Mu50
uccaauguauaaaac

SEQ ID NO: 2056620 - RNA, 11 nt, Staphylococcus aureus subsp. aureus Mu50
uccaaugaauc

SEQ ID NO: 2056621 - RNA, 15 nt, Staphylococcus aureus subsp. aureus Mu50
uccaaucuauuaaug

SEQ ID NO: 2056622 - RNA, 17 nt, Staphylococcus aureus subsp. aureus Mu50
uccaaucuuuuuaauug

SEQ ID NO: 2056623 - RNA, 22 nt, Staphylococcus aureus subsp. aureus Mu50
uccaagcgcuucaggcauaacu

SEQ ID NO: 2056624 - RNA, 22 nt, Staphylococcus aureus subsp. aureus Mu50
uccaaggauguuauaaaaugaa

SEQ ID NO: 2056625 - RNA, 15 nt, Staphylococcus aureus subsp. aureus Mu50
uccaagugacaacau

SEQ ID NO: 2056626 - RNA, 13 nt, Staphylococcus aureus subsp. aureus Mu50
uccaauaaauugu

SEQ ID NO: 2056627 - RNA, 18 nt, Staphylococcus aureus subsp. aureus Mu50
uccaacauguaacaaaau

SEQ ID NO: 2056628 - RNA, 16 nt, Staphylococcus aureus subsp. aureus Mu50
uccaagagaauuaaua

SEQ ID NO: 2056629 - RNA, 20 nt, Staphylococcus aureus subsp. aureus Mu50
uccaagagaauuaauaauuu

SEQ ID NO: 2056630 - RNA, 17 nt, Staphylococcus aureus subsp. aureus Mu50
uccaagagaauuaauaa

SEQ ID NO: 2056631 - RNA, 19 nt, Staphylococcus aureus subsp. aureus Mu50
uccaagagaauuaauaauu

SEQ ID NO: 2056632 - RNA, 16 nt, Staphylococcus aureus subsp. aureus Mu50
uccaguggaaaugaua

SEQ ID NO: 2056633 - RNA, 23 nt, Staphylococcus aureus subsp. aureus Mu50
uccaguccuuuuuuuauguuuaa

SEQ ID NO: 2056634 - RNA, 19 nt, Staphylococcus aureus subsp. aureus Mu50
uccacuuuuugccuggcaa

SEQ ID NO: 2056635 - RNA, 21 nt, Staphylococcus aureus subsp. aureus Mu50
ucccaaugcugaauaaauaac

SEQ ID NO: 2056636 - RNA, 21 nt, Staphylococcus aureus subsp. aureus Mu50
ucccaaagcgaauuaucuuua

SEQ ID NO: 2056637 - RNA, 13 nt, Staphylococcus aureus subsp. aureus Mu50
uccauugcacuau

SEQ ID NO: 2056638 - RNA, 20 nt, Staphylococcus aureus subsp. aureus Mu50
uccauugcacuaugcauaau

SEQ ID NO: 2056639 - RNA, 17 nt, Staphylococcus aureus subsp. aureus Mu50
uccauucaauguuuaau

SEQ ID NO: 2056640 - RNA, 22 nt, Staphylococcus aureus subsp. aureus Mu50
uccauucaauguuuaauuuucu

SEQ ID NO: 2056641 - RNA, 19 nt, Staphylococcus aureus subsp. aureus Mu50
uccauuuucuuuuuuuaug

SEQ ID NO: 2056642 - RNA, 15 nt, Staphylococcus aureus subsp. aureus Mu50
uccauuuaucaacaa

SEQ ID NO: 2056643 - RNA, 14 nt, Staphylococcus aureus subsp. aureus Mu50
uccauuaaguuauc

SEQ ID NO: 2056644 - RNA, 20 nt, Staphylococcus aureus subsp. aureus Mu50
uccauucaaaguauauacua

SEQ ID NO: 2056645 - RNA, 13 nt, Staphylococcus aureus subsp. aureus Mu50
uccauguauuuuu

SEQ ID NO: 2056646 - RNA, 16 nt, Staphylococcus aureus subsp. aureus Mu50
uccaucaucucugcuu

SEQ ID NO: 2056647 - RNA, 15 nt, Staphylococcus aureus subsp. aureus Mu50
uccaucgucaucacu

SEQ ID NO: 2056648 - RNA, 16 nt, Staphylococcus aureus subsp. aureus Mu50
uccgcacugccuuuuu

SEQ ID NO: 2056649 - RNA, 21 nt, Staphylococcus aureus subsp. aureus Mu50
uccgcacugccuuuuuguaau

SEQ ID NO: 2056650 - RNA, 14 nt, Staphylococcus aureus subsp. aureus Mu50
uccgauuuuuuuac

SEQ ID NO: 2056651 - RNA, 13 nt, Staphylococcus aureus subsp. aureus Mu50
uccgaucaugccu

SEQ ID NO: 2056652 - RNA, 15 nt, Staphylococcus aureus subsp. aureus Mu50
uccgauaucuuuuaa

SEQ ID NO: 2056653 - RNA, 15 nt, Staphylococcus aureus subsp. aureus Mu50
uccgaggcuaauuuu

SEQ ID NO: 2056654 - RNA, 15 nt, Staphylococcus aureus subsp. aureus Mu50
aaaucugauucauua

SEQ ID NO: 2056655 - RNA, 22 nt, Staphylococcus aureus subsp. aureus Mu50
aaaucuguacuucuaauuugca

SEQ ID NO: 2056656 - RNA, 21 nt, Staphylococcus aureus subsp. aureus Mu50
aaaucugcuuuauuuuaucau

SEQ ID NO: 2056657 - RNA, 23 nt, Staphylococcus aureus subsp. aureus Mu50
aaaucuguuuaaauuuaaaagaa

SEQ ID NO: 2056658 - RNA, 19 nt, Staphylococcus aureus subsp. aureus Mu50
aaaucuuaaagauuuuuca

SEQ ID NO: 2056659 - RNA, 19 nt, Staphylococcus aureus subsp. aureus Mu50
ucccuucaaaguagacauu

SEQ ID NO: 2056660 - RNA, 19 nt, Staphylococcus aureus subsp. aureus Mu50
ucccuucaaaguuuucauu

SEQ ID NO: 2056661 - RNA, 22 nt, Staphylococcus aureus subsp. aureus Mu50
ucccuuaaauacaauuucuuca

SEQ ID NO: 2056662 - RNA, 11 nt, Staphylococcus aureus subsp. aureus Mu50
ucccuuaauaa

SEQ ID NO: 2056663 - RNA, 17 nt, Staphylococcus aureus subsp. aureus Mu50
ucccuuaaauacaauuu

SEQ ID NO: 2056664 - RNA, 21 nt, Staphylococcus aureus subsp. aureus Mu50
ucccucuaucaaauuaccauu

SEQ ID NO: 2056665 - RNA, 13 nt, Staphylococcus aureus subsp. aureus Mu50
ucccuacugcuug

SEQ ID NO: 2056666 - RNA, 19 nt, Staphylococcus aureus subsp. aureus Mu50
ucccuaggaaauaaaaaau

SEQ ID NO: 2056667 - RNA, 21 nt, Staphylococcus aureus subsp. aureus Mu50
ucccgaaaguuagacuaaaaa

SEQ ID NO: 2056668 - RNA, 14 nt, Staphylococcus aureus subsp. aureus Mu50
ucccauuuuaaagu

SEQ ID NO: 2056669 - RNA, 21 nt, Staphylococcus aureus subsp. aureus Mu50
ucccauuaacacgaacugcau

SEQ ID NO: 2056670 - RNA, 17 nt, Staphylococcus aureus subsp. aureus Mu50
ucccauuggcauuuacg

SEQ ID NO: 2056671 - RNA, 23 nt, Staphylococcus aureus subsp. aureus Mu50
ucccauuaacacgaacugcauag

SEQ ID NO: 2056672 - RNA, 16 nt, Staphylococcus aureus subsp. aureus Mu50
uccccauuuauguguu

SEQ ID NO: 2056673 - RNA, 17 nt, Staphylococcus aureus subsp. aureus Mu50
ucccauaacaaaaacau

SEQ ID NO: 2056674 - RNA, 19 nt, Staphylococcus aureus subsp. aureus Mu50
ucccauacugauuaacaag

SEQ ID NO: 2056675 - RNA, 20 nt, Staphylococcus aureus subsp. aureus Mu50
ucccauaaugacuauaacac

SEQ ID NO: 2056676 - RNA, 21 nt, Staphylococcus aureus subsp. aureus Mu50
ucccagauucauaucuuucaa

SEQ ID NO: 2056677 - RNA, 23 nt, Staphylococcus aureus subsp. aureus Mu50
ucccagauucauaucuuucaauu

SEQ ID NO: 2056678 - RNA, 17 nt, Staphylococcus aureus subsp. aureus Mu50
uccuguguaaaauaaau

SEQ ID NO: 2056679 - RNA, 22 nt, Staphylococcus aureus subsp. aureus Mu50
uccuuaaaccguauagucauua

SEQ ID NO: 2056680 - RNA, 17 nt, Staphylococcus aureus subsp. aureus Mu50
uccuuaaacaaauaaau

SEQ ID NO: 2056681 - RNA, 16 nt, Staphylococcus aureus subsp. aureus Mu50
uccuuagacaaacgac

SEQ ID NO: 2056682 - RNA, 13 nt, Staphylococcus aureus subsp. aureus Mu50
uccuuaccuuuua

SEQ ID NO: 2056683 - RNA, 17 nt, Staphylococcus aureus subsp. aureus Mu50
uccuuccaauaauaaau

SEQ ID NO: 2056684 - RNA, 14 nt, Staphylococcus aureus subsp. aureus Mu50
uccuucaucaauaa

SEQ ID NO: 2056685 - RNA, 14 nt, Staphylococcus aureus subsp. aureus Mu50
uccugcuuauuaau

SEQ ID NO: 2056686 - RNA, 20 nt, Staphylococcus aureus subsp. aureus Mu50
uccugcuacaacuucuucuc

SEQ ID NO: 2056687 - RNA, 16 nt, Staphylococcus aureus subsp. aureus Mu50
uccuccaaagcuaagu

SEQ ID NO: 2056688 - RNA, 18 nt, Staphylococcus aureus subsp. aureus Mu50
uccucauuaugagaccca

SEQ ID NO: 2056689 - RNA, 15 nt, Staphylococcus aureus subsp. aureus Mu50
uccucauuaauaaau

SEQ ID NO: 2056690 - RNA, 17 nt, Staphylococcus aureus subsp. aureus Mu50
uccucauaauuaucaua

SEQ ID NO: 2056691 - RNA, 14 nt, Staphylococcus aureus subsp. aureus Mu50
uccucauaauuauc

SEQ ID NO: 2056692 - RNA, 22 nt, Staphylococcus aureus subsp. aureus Mu50
uccuccgccaucaauauuuaua

SEQ ID NO: 2056693 - RNA, 19 nt, Staphylococcus aureus subsp. aureus Mu50
uccuccuaccgcuaaaauu

SEQ ID NO: 2056694 - RNA, 19 nt, Staphylococcus aureus subsp. aureus Mu50
uccucgguuuuauuuuuau

SEQ ID NO: 2056695 - RNA, 20 nt, Staphylococcus aureus subsp. aureus Mu50
uccucgguuuuauuuuuauc

SEQ ID NO: 2056696 - RNA, 13 nt, Staphylococcus aureus subsp. aureus Mu50
uccugauacaaug

SEQ ID NO: 2056697 - RNA, 22 nt, Staphylococcus aureus subsp. aureus Mu50
uccugcaaaauguuacacaaau

SEQ ID NO: 2056698 - RNA, 23 nt, Staphylococcus aureus subsp. aureus Mu50
uccuagacgaucuuuaaugauaa

SEQ ID NO: 2056699 - RNA, 13 nt, Staphylococcus aureus subsp. aureus Mu50
uccuacugcuguc

SEQ ID NO: 2056700 - RNA, 21 nt, Staphylococcus aureus subsp. aureus Mu50
uccuaaagguaacuuuuuaac

SEQ ID NO: 2056701 - RNA, 16 nt, Staphylococcus aureus subsp. aureus Mu50
uccuaaauuauaaaua

SEQ ID NO: 2056702 - RNA, 14 nt, Staphylococcus aureus subsp. aureus Mu50
uccuacaacuauuc

SEQ ID NO: 2056703 - RNA, 14 nt, Staphylococcus aureus subsp. aureus Mu50
uccuaauaauuugg

SEQ ID NO: 2056704 - RNA, 15 nt, Staphylococcus aureus subsp. aureus Mu50
uccuaagcuaguguu

SEQ ID NO: 2056705 - RNA, 17 nt, Staphylococcus aureus subsp. aureus Mu50
uccuauggcgcaauuuu

SEQ ID NO: 2056706 - RNA, 16 nt, Staphylococcus aureus subsp. aureus Mu50
uccuauuacuacauaa

SEQ ID NO: 2056707 - RNA, 15 nt, Staphylococcus aureus subsp. aureus Mu50
uccuaucuguaccgu

SEQ ID NO: 2056708 - RNA, 14 nt, Staphylococcus aureus subsp. aureus Mu50
uccucaaauauauu

SEQ ID NO: 2056709 - RNA, 23 nt, Staphylococcus aureus subsp. aureus Mu50
uccguugaauuaacaauauuaaa

SEQ ID NO: 2056710 - RNA, 21 nt, Staphylococcus aureus subsp. aureus Mu50
uccggaccuuguaaauuuaaa

SEQ ID NO: 2056711 - RNA, 17 nt, Staphylococcus aureus subsp. aureus Mu50
uccgcuuguucaacuaa

SEQ ID NO: 2056712 - RNA, 15 nt, Staphylococcus aureus subsp. aureus Mu50
ucgcacuauaaaauu

SEQ ID NO: 2056713 - RNA, 22 nt, Staphylococcus aureus subsp. aureus Mu50
ucgcacaacugcauaaaagccu

SEQ ID NO: 2056714 - RNA, 18 nt, Staphylococcus aureus subsp. aureus Mu50
ucgauucauaaaauuuaa

SEQ ID NO: 2056715 - RNA, 15 nt, Staphylococcus aureus subsp. aureus Mu50
ucgauuaauuuucuu

SEQ ID NO: 2056716 - RNA, 16 nt, Staphylococcus aureus subsp. aureus Mu50
ucgauugguaaaucua

SEQ ID NO: 2056717 - RNA, 14 nt, Staphylococcus aureus subsp. aureus Mu50
ucgauuuaacauaa

SEQ ID NO: 2056718 - RNA, 14 nt, Staphylococcus aureus subsp. aureus Mu50
ucgauuuuuuaaug

SEQ ID NO: 2056719 - RNA, 22 nt, Staphylococcus aureus subsp. aureus Mu50
ucgauuuuuuaaugucuaaaaa

SEQ ID NO: 2056720 - RNA, 15 nt, Staphylococcus aureus subsp. aureus Mu50
ucgaucuaaauauau

SEQ ID NO: 2056721 - RNA, 16 nt, Staphylococcus aureus subsp. aureus Mu50
ucgaugacuuugucuu

SEQ ID NO: 2056722 - RNA, 16 nt, Staphylococcus aureus subsp. aureus Mu50
ucgauaugaccauagu

SEQ ID NO: 2056723 - RNA, 13 nt, Staphylococcus aureus subsp. aureus Mu50
ucgauauuucuag

SEQ ID NO: 2056724 - RNA, 15 nt, Staphylococcus aureus subsp. aureus Mu50
ucgauauuuguuucg

SEQ ID NO: 2056725 - RNA, 21 nt, Staphylococcus aureus subsp. aureus Mu50
ucgauauagcauaaaauuucu

SEQ ID NO: 2056726 - RNA, 23 nt, Staphylococcus aureus subsp. aureus Mu50
ucgaguuuguuucuaaauucuuu

SEQ ID NO: 2056727 - RNA, 14 nt, Staphylococcus aureus subsp. aureus Mu50
ucgaguaauacuuu

SEQ ID NO: 2056728 - RNA, 17 nt, Staphylococcus aureus subsp. aureus Mu50
ucgaguagcccuauuuu

SEQ ID NO: 2056729 - RNA, 19 nt, Staphylococcus aureus subsp. aureus Mu50
ucgagcucuucaaauuuac

SEQ ID NO: 2056730 - RNA, 19 nt, Staphylococcus aureus subsp. aureus Mu50
ucgacuacaaguuuauaau

SEQ ID NO: 2056731 - RNA, 20 nt, Staphylococcus aureus subsp. aureus Mu50
ucgacuaauuuuucuuucag

SEQ ID NO: 2056732 - RNA, 22 nt, Staphylococcus aureus subsp. aureus Mu50
ucgacuaauuuuucuuucaggc

SEQ ID NO: 2056733 - RNA, 19 nt, Staphylococcus aureus subsp. aureus Mu50
ucgacaucuagaugaaauu

SEQ ID NO: 2056734 - RNA, 20 nt, Staphylococcus aureus subsp. aureus Mu50
ucgacaucuagaugaaauug

SEQ ID NO: 2056735 - RNA, 21 nt, Staphylococcus aureus subsp. aureus Mu50
ucgaauguauugcuauaagaa

SEQ ID NO: 2056736 - RNA, 23 nt, Staphylococcus aureus subsp. aureus Mu50
ucgaauguuucuucguuagugau

SEQ ID NO: 2056737 - RNA, 20 nt, Staphylococcus aureus subsp. aureus Mu50
ucgacaacugauuuaauauc

SEQ ID NO: 2056738 - RNA, 15 nt, Staphylococcus aureus subsp. aureus Mu50
ucgacaauugcgacc

SEQ ID NO: 2056739 - RNA, 15 nt, Staphylococcus aureus subsp. aureus Mu50
ucgaaguagcuuguu

SEQ ID NO: 2056740 - RNA, 17 nt, Staphylococcus aureus subsp. aureus Mu50
ucgaacgauauuuuaaa

SEQ ID NO: 2056741 - RNA, 17 nt, Staphylococcus aureus subsp. aureus Mu50
ucgaaaugccuucugua

SEQ ID NO: 2056742 - RNA, 19 nt, Staphylococcus aureus subsp. aureus Mu50
ucgaaaauagcuauuaaaa

SEQ ID NO: 2056743 - RNA, 20 nt, Staphylococcus aureus subsp. aureus Mu50
ucgaaaauagcuauuaaaau

SEQ ID NO: 2056744 - RNA, 15 nt, Staphylococcus aureus subsp. aureus Mu50
ucgaaaauuauacaa

SEQ ID NO: 2056745 - RNA, 16 nt, Staphylococcus aureus subsp. aureus Mu50
ucgaaaauuauacaaa

SEQ ID NO: 2056746 - RNA, 23 nt, Staphylococcus aureus subsp. aureus Mu50
ucgaaaauuauacaaauuauaaa

SEQ ID NO: 2056747 - RNA, 15 nt, Staphylococcus aureus subsp. aureus Mu50
ucgaacauaaauaaa

SEQ ID NO: 2056748 - RNA, 12 nt, Staphylococcus aureus subsp. aureus Mu50
ucgaacagaaaa

SEQ ID NO: 2056749 - RNA, 21 nt, Staphylococcus aureus subsp. aureus Mu50
ucgaacaugaaugauauugau

SEQ ID NO: 2056750 - RNA, 16 nt, Staphylococcus aureus subsp. aureus Mu50
ucgaaauucucuuugu

SEQ ID NO: 2056751 - RNA, 12 nt, Staphylococcus aureus subsp. aureus Mu50
uccuuucuuuuu

SEQ ID NO: 2056752 - RNA, 23 nt, Staphylococcus aureus subsp. aureus Mu50
uccuuugauguucacuaaaugug

SEQ ID NO: 2056753 - RNA, 13 nt, Staphylococcus aureus subsp. aureus Mu50
uccuuuuuuuaag

SEQ ID NO: 2056754 - RNA, 20 nt, Staphylococcus aureus subsp. aureus Mu50
ucgaaaaacuguaaaucauc

SEQ ID NO: 2056755 - RNA, 15 nt, Staphylococcus aureus subsp. aureus Mu50
ucgaaaagaaauucu

SEQ ID NO: 2056756 - RNA, 17 nt, Staphylococcus aureus subsp. aureus Mu50
ucgaaaauaaaacaaau

SEQ ID NO: 2056757 - RNA, 20 nt, Staphylococcus aureus subsp. aureus Mu50
ucgaaaagaaauucuacagg

SEQ ID NO: 2056758 - RNA, 23 nt, Staphylococcus aureus subsp. aureus Mu50
ucgaaaagaaauucuacagguaa

SEQ ID NO: 2056759 - RNA, 15 nt, Staphylococcus aureus subsp. aureus Mu50
uccuuuauauucuaa

SEQ ID NO: 2056760 - RNA, 21 nt, Staphylococcus aureus subsp. aureus Mu50
uccuuuauauucuaauauucc

SEQ ID NO: 2056761 - RNA, 15 nt, Staphylococcus aureus subsp. aureus Mu50
uccuuuauauuuagu

SEQ ID NO: 2056762 - RNA, 16 nt, Staphylococcus aureus subsp. aureus Mu50
uccuuguucuauuuga

SEQ ID NO: 2056763 - RNA, 17 nt, Staphylococcus aureus subsp. aureus Mu50
uccuuguucuauuugau

SEQ ID NO: 2056764 - RNA, 22 nt, Staphylococcus aureus subsp. aureus Mu50
uccuucgcuaugaccaugauau

SEQ ID NO: 2056765 - RNA, 20 nt, Staphylococcus aureus subsp. aureus Mu50
uccuucgauaguuuauuaau

SEQ ID NO: 2056766 - RNA, 17 nt, Staphylococcus aureus subsp. aureus Mu50
uccuuccauucggauaa

SEQ ID NO: 2056767 - RNA, 20 nt, Staphylococcus aureus subsp. aureus Mu50
uagucuucggcuuuguaaaa

SEQ ID NO: 2056768 - RNA, 23 nt, Staphylococcus aureus subsp. aureus Mu50
uagucuuuuuauuuuaauauuuu

SEQ ID NO: 2056769 - RNA, 13 nt, Staphylococcus aureus subsp. aureus Mu50
uagucuuuuuaag

SEQ ID NO: 2056770 - RNA, 17 nt, Staphylococcus aureus subsp. aureus Mu50
uagugaaauaccuccug

SEQ ID NO: 2056771 - RNA, 21 nt, Staphylococcus aureus subsp. aureus Mu50
uagugaaaaaguuucggaaaa

SEQ ID NO: 2056772 - RNA, 12 nt, Staphylococcus aureus subsp. aureus Mu50
uagugaaaagaa

SEQ ID NO: 2056773 - RNA, 15 nt, Staphylococcus aureus subsp. aureus Mu50
uagucgguguuuucu

SEQ ID NO: 2056774 - RNA, 21 nt, Staphylococcus aureus subsp. aureus Mu50
uagucggggccccaacacaga

SEQ ID NO: 2056775 - RNA, 23 nt, Staphylococcus aureus subsp. aureus Mu50
uagucuaugaauaauguuuucau

SEQ ID NO: 2056776 - RNA, 19 nt, Staphylococcus aureus subsp. aureus Mu50
uagucucccauaacaccua

SEQ ID NO: 2056777 - RNA, 18 nt, Staphylococcus aureus subsp. aureus Mu50
uaguggugguacuuuuuu

SEQ ID NO: 2056778 - RNA, 21 nt, Staphylococcus aureus subsp. aureus Mu50
uaguuaagauaccuuuuucua

SEQ ID NO: 2056779 - RNA, 12 nt, Staphylococcus aureus subsp. aureus Mu50
uagugcuuguuu

SEQ ID NO: 2056780 - RNA, 22 nt, Staphylococcus aureus subsp. aureus Mu50
uagugauauuuuucgaauuuaa

SEQ ID NO: 2056781 - RNA, 23 nt, Staphylococcus aureus subsp. aureus Mu50
uagugauauuuuucgaauuuaac

SEQ ID NO: 2056782 - RNA, 14 nt, Staphylococcus aureus subsp. aureus Mu50
uagugcuuuuucaa

SEQ ID NO: 2056783 - RNA, 17 nt, Staphylococcus aureus subsp. aureus Mu50
uaguuaugugcuaaucu

SEQ ID NO: 2056784 - RNA, 22 nt, Staphylococcus aureus subsp. aureus Mu50
uaguucuauugcagaagaaaac

SEQ ID NO: 2056785 - RNA, 17 nt, Staphylococcus aureus subsp. aureus Mu50
uaguucuguugauauuu

SEQ ID NO: 2056786 - RNA, 18 nt, Staphylococcus aureus subsp. aureus Mu50
uaguucuggcaaagaauc

SEQ ID NO: 2056787 - RNA, 19 nt, Staphylococcus aureus subsp. aureus Mu50
uaguucuggcaaagaaucc

SEQ ID NO: 2056788 - RNA, 12 nt, Staphylococcus aureus subsp. aureus Mu50
uaguucuguuga

SEQ ID NO: 2056789 - RNA, 16 nt, Staphylococcus aureus subsp. aureus Mu50
uaguuaaguauuuaaa

SEQ ID NO: 2056790 - RNA, 17 nt, Staphylococcus aureus subsp. aureus Mu50
uaguuaauuauuuagau

SEQ ID NO: 2056791 - RNA, 18 nt, Staphylococcus aureus subsp. aureus Mu50
uaguuauacuacuauuga

SEQ ID NO: 2056792 - RNA, 22 nt, Staphylococcus aureus subsp. aureus Mu50
uaguuagggaaauguagauuac

SEQ ID NO: 2056793 - RNA, 19 nt, Staphylococcus aureus subsp. aureus Mu50
uacuuucaaauaaugugaa

SEQ ID NO: 2056794 - RNA, 17 nt, Staphylococcus aureus subsp. aureus Mu50
uacuuucacuuuuuaua

SEQ ID NO: 2056795 - RNA, 18 nt, Staphylococcus aureus subsp. aureus Mu50
uacuuucacuuuuuauau

SEQ ID NO: 2056796 - RNA, 19 nt, Staphylococcus aureus subsp. aureus Mu50
uacuuuauuugauaauauu

SEQ ID NO: 2056797 - RNA, 17 nt, Staphylococcus aureus subsp. aureus Mu50
uacuuuauaaauaucuu

SEQ ID NO: 2056798 - RNA, 16 nt, Staphylococcus aureus subsp. aureus Mu50
uacuuucaaacaaauc

SEQ ID NO: 2056799 - RNA, 16 nt, Staphylococcus aureus subsp. aureus Mu50
uagguuauuauaaaau

SEQ ID NO: 2056800 - RNA, 20 nt, Staphylococcus aureus subsp. aureus Mu50
uaguaagagcucucguguau

SEQ ID NO: 2056801 - RNA, 16 nt, Staphylococcus aureus subsp. aureus Mu50
uagguuuaauuuuaaa

SEQ ID NO: 2056802 - RNA, 21 nt, Staphylococcus aureus subsp. aureus Mu50
uagucgaagaagauuaugaaa

SEQ ID NO: 2056803 - RNA, 18 nt, Staphylococcus aureus subsp. aureus Mu50
uagucaggggccccaaca

SEQ ID NO: 2056804 - RNA, 22 nt, Staphylococcus aureus subsp. aureus Mu50
uagucaggggccccaacacaga

SEQ ID NO: 2056805 - RNA, 14 nt, Staphylococcus aureus subsp. aureus Mu50
uagucauaauuuaa

SEQ ID NO: 2056806 - RNA, 17 nt, Staphylococcus aureus subsp. aureus Mu50
uagucauaauuuaaaag

SEQ ID NO: 2056807 - RNA, 19 nt, Staphylococcus aureus subsp. aureus Mu50
uaguaaugauuaacuuucu

SEQ ID NO: 2056808 - RNA, 18 nt, Staphylococcus aureus subsp. aureus Mu50
uaguaauagcuauauuuu

SEQ ID NO: 2056809 - RNA, 20 nt, Staphylococcus aureus subsp. aureus Mu50
uaguaauaacaucuaaauuu

SEQ ID NO: 2056810 - RNA, 18 nt, Staphylococcus aureus subsp. aureus Mu50
uaguacggcugcuuuaac

SEQ ID NO: 2056811 - RNA, 17 nt, Staphylococcus aureus subsp. aureus Mu50
uaguaauuuuuaaaucu

SEQ ID NO: 2056812 - RNA, 18 nt, Staphylococcus aureus subsp. aureus Mu50
uaguaccaagcuucauua

SEQ ID NO: 2056813 - RNA, 16 nt, Staphylococcus aureus subsp. aureus Mu50
uaguacagucaucuug

SEQ ID NO: 2056814 - RNA, 19 nt, Staphylococcus aureus subsp. aureus Mu50
uaguacacgaauucauuaa

SEQ ID NO: 2056815 - RNA, 20 nt, Staphylococcus aureus subsp. aureus Mu50
uauaaauaaaaauacauaau

SEQ ID NO: 2056816 - RNA, 18 nt, Staphylococcus aureus subsp. aureus Mu50
uauaaaguugacaauaca

SEQ ID NO: 2056817 - RNA, 15 nt, Staphylococcus aureus subsp. aureus Mu50
uauaaaaucauuaau

SEQ ID NO: 2056818 - RNA, 16 nt, Staphylococcus aureus subsp. aureus Mu50
uauaaacauaucuucu

SEQ ID NO: 2056819 - RNA, 18 nt, Staphylococcus aureus subsp. aureus Mu50
uauaaaggaauagcuaca

SEQ ID NO: 2056820 - RNA, 22 nt, Staphylococcus aureus subsp. aureus Mu50
uauaaaggaauagcuacaauua

SEQ ID NO: 2056821 - RNA, 16 nt, Staphylococcus aureus subsp. aureus Mu50
uaguugaucaaaaaga

SEQ ID NO: 2056822 - RNA, 14 nt, Staphylococcus aureus subsp. aureus Mu50
uauaaaauaaaaaa

SEQ ID NO: 2056823 - RNA, 20 nt, Staphylococcus aureus subsp. aureus Mu50
uauaaaaggaagcaucucca

SEQ ID NO: 2056824 - RNA, 13 nt, Staphylococcus aureus subsp. aureus Mu50
uauaaaaguacuu

SEQ ID NO: 2056825 - RNA, 21 nt, Staphylococcus aureus subsp. aureus Mu50
uauaaaauaugagauuaucug

SEQ ID NO: 2056826 - RNA, 19 nt, Staphylococcus aureus subsp. aureus Mu50
uauaacccucguaggcaua

SEQ ID NO: 2056827 - RNA, 13 nt, Staphylococcus aureus subsp. aureus Mu50
uauaaccauaaug

SEQ ID NO: 2056828 - RNA, 16 nt, Staphylococcus aureus subsp. aureus Mu50
uauaacauucuucaaa

SEQ ID NO: 2056829 - RNA, 20 nt, Staphylococcus aureus subsp. aureus Mu50
uauaacauucuucaaaaaau

SEQ ID NO: 2056830 - RNA, 21 nt, Staphylococcus aureus subsp. aureus Mu50
uauaacauucuucaaaaaaua

SEQ ID NO: 2056831 - RNA, 17 nt, Staphylococcus aureus subsp. aureus Mu50
uauaaccgcuacaauua

SEQ ID NO: 2056832 - RNA, 17 nt, Staphylococcus aureus subsp. aureus Mu50
uauaaccuuguucuuua

SEQ ID NO: 2056833 - RNA, 17 nt, Staphylococcus aureus subsp. aureus Mu50
uauaaccuauuaaaucu

SEQ ID NO: 2056834 - RNA, 23 nt, Staphylococcus aureus subsp. aureus Mu50
uauaacccucguaggcauaggcu

SEQ ID NO: 2056835 - RNA, 24 nt, Staphylococcus aureus subsp. aureus Mu50
uauaaccuuguucuuuacuccaaa

SEQ ID NO: 2056836 - RNA, 20 nt, Staphylococcus aureus subsp. aureus Mu50
uauaagaauuguugaucaug

SEQ ID NO: 2056837 - RNA, 17 nt, Staphylococcus aureus subsp. aureus Mu50
uauaagaggauuucuag

SEQ ID NO: 2056838 - RNA, 14 nt, Staphylococcus aureus subsp. aureus Mu50
uauaagcaauuucu

SEQ ID NO: 2056839 - RNA, 22 nt, Staphylococcus aureus subsp. aureus Mu50
uauaagaauuguugaucaugag

SEQ ID NO: 2056840 - RNA, 22 nt, Staphylococcus aureus subsp. aureus Mu50
uauaaaucauucuuuauagaaa

SEQ ID NO: 2056841 - RNA, 19 nt, Staphylococcus aureus subsp. aureus Mu50
uauaaaugaaucgcuuuga

SEQ ID NO: 2056842 - RNA, 12 nt, Staphylococcus aureus subsp. aureus Mu50
uauaacauuaaa

SEQ ID NO: 2056843 - RNA, 14 nt, Staphylococcus aureus subsp. aureus Mu50
uauaacauuaaaau

SEQ ID NO: 2056844 - RNA, 14 nt, Staphylococcus aureus subsp. aureus Mu50
uauaaauacaaaua

SEQ ID NO: 2056845 - RNA, 20 nt, Staphylococcus aureus subsp. aureus Mu50
uauaaauaaccgcacuuucu

SEQ ID NO: 2056846 - RNA, 21 nt, Staphylococcus aureus subsp. aureus Mu50
uauaaauaauaaaugcuauau

SEQ ID NO: 2056847 - RNA, 23 nt, Staphylococcus aureus subsp. aureus Mu50
uauaaauaauaaaugcuauauuu

SEQ ID NO: 2056848 - RNA, 13 nt, Staphylococcus aureus subsp. aureus Mu50
uauaaauaucuuu

SEQ ID NO: 2056849 - RNA, 15 nt, Staphylococcus aureus subsp. aureus Mu50
uauaaaucaaauaua

SEQ ID NO: 2056850 - RNA, 18 nt, Staphylococcus aureus subsp. aureus Mu50
uauaaaucaaauauacuu

SEQ ID NO: 2056851 - RNA, 19 nt, Staphylococcus aureus subsp. aureus Mu50
uauaaaucaaauauacuuu

SEQ ID NO: 2056852 - RNA, 16 nt, Staphylococcus aureus subsp. aureus Mu50
uauaaucuauaaaugg

SEQ ID NO: 2056853 - RNA, 14 nt, Staphylococcus aureus subsp. aureus Mu50
uauaaucuaucuug

SEQ ID NO: 2056854 - RNA, 13 nt, Staphylococcus aureus subsp. aureus Mu50
uauaauuaaacau

SEQ ID NO: 2056855 - RNA, 15 nt, Staphylococcus aureus subsp. aureus Mu50
uauaauguauaaaac

SEQ ID NO: 2056856 - RNA, 21 nt, Staphylococcus aureus subsp. aureus Mu50
uauaauuaaacauuuagauuu

SEQ ID NO: 2056857 - RNA, 21 nt, Staphylococcus aureus subsp. aureus Mu50
uauaauggacgguauuuucaa

SEQ ID NO: 2056858 - RNA, 17 nt, Staphylococcus aureus subsp. aureus Mu50
uauaaugccaaauauag

SEQ ID NO: 2056859 - RNA, 15 nt, Staphylococcus aureus subsp. aureus Mu50
uauaaugauguauuu

SEQ ID NO: 2056860 - RNA, 17 nt, Staphylococcus aureus subsp. aureus Mu50
uauaauuuauaaaaaga

SEQ ID NO: 2056861 - RNA, 10 nt, Staphylococcus aureus subsp. aureus Mu50
uauaauuuaa

SEQ ID NO: 2056862 - RNA, 12 nt, Staphylococcus aureus subsp. aureus Mu50
uauaauuuauuu

SEQ ID NO: 2056863 - RNA, 16 nt, Staphylococcus aureus subsp. aureus Mu50
uauaauugauugucau

SEQ ID NO: 2056864 - RNA, 15 nt, Staphylococcus aureus subsp. aureus Mu50
uauaauuauuaaacu

SEQ ID NO: 2056865 - RNA, 14 nt, Staphylococcus aureus subsp. aureus Mu50
uauaauuauuaaac

SEQ ID NO: 2056866 - RNA, 13 nt, Staphylococcus aureus subsp. aureus Mu50
uauaauuauuaaa

SEQ ID NO: 2056867 - RNA, 16 nt, Staphylococcus aureus subsp. aureus Mu50
uauaauauacacaaaa

SEQ ID NO: 2056868 - RNA, 14 nt, Staphylococcus aureus subsp. aureus Mu50
uauaauagaaauaa

SEQ ID NO: 2056869 - RNA, 13 nt, Staphylococcus aureus subsp. aureus Mu50
uauaauagagaaa

SEQ ID NO: 2056870 - RNA, 21 nt, Staphylococcus aureus subsp. aureus Mu50
uauaauacguguguuuucuuu

SEQ ID NO: 2056871 - RNA, 21 nt, Staphylococcus aureus subsp. aureus Mu50
uauaauacuguauuuuaacgu

SEQ ID NO: 2056872 - RNA, 18 nt, Staphylococcus aureus subsp. aureus Mu50
uauaaguuaaaaauguaa

SEQ ID NO: 2056873 - RNA, 19 nt, Staphylococcus aureus subsp. aureus Mu50
uauaaguaaucauaauaau

SEQ ID NO: 2056874 - RNA, 20 nt, Staphylococcus aureus subsp. aureus Mu50
uauaagggguauauuaaaaa

SEQ ID NO: 2056875 - RNA, 20 nt, Staphylococcus aureus subsp. aureus Mu50
uauaagugauuucuucauua

SEQ ID NO: 2056876 - RNA, 18 nt, Staphylococcus aureus subsp. aureus Mu50
uauaaguugcauauaaaa

SEQ ID NO: 2056877 - RNA, 13 nt, Staphylococcus aureus subsp. aureus Mu50
uauaaguuaaaaa

SEQ ID NO: 2056878 - RNA, 14 nt, Staphylococcus aureus subsp. aureus Mu50
uauaaguacaaaua

SEQ ID NO: 2056879 - RNA, 23 nt, Staphylococcus aureus subsp. aureus Mu50
uauaaguagugauuuuuuacauu

SEQ ID NO: 2056880 - RNA, 14 nt, Staphylococcus aureus subsp. aureus Mu50
uauaaguauaauga

SEQ ID NO: 2056881 - RNA, 21 nt, Staphylococcus aureus subsp. aureus Mu50
uauaaguaucgccaucauuca

SEQ ID NO: 2056882 - RNA, 23 nt, Staphylococcus aureus subsp. aureus Mu50
uauaaguaucgccaucauucacc

SEQ ID NO: 2056883 - RNA, 17 nt, Staphylococcus aureus subsp. aureus Mu50
uauauccgcaucuuuug

SEQ ID NO: 2056884 - RNA, 14 nt, Staphylococcus aureus subsp. aureus Mu50
uauauauucaauaa

SEQ ID NO: 2056885 - RNA, 16 nt, Staphylococcus aureus subsp. aureus Mu50
uauauauucaauaauu

SEQ ID NO: 2056886 - RNA, 21 nt, Staphylococcus aureus subsp. aureus Mu50
uauaucuauuuaucauacuuc

SEQ ID NO: 2056887 - RNA, 19 nt, Staphylococcus aureus subsp. aureus Mu50
uauaucuuaaguacauaaa

SEQ ID NO: 2056888 - RNA, 12 nt, Staphylococcus aureus subsp. aureus Mu50
uauaucuucauu

SEQ ID NO: 2056889 - RNA, 16 nt, Staphylococcus aureus subsp. aureus Mu50
uauaugaauugaguau

SEQ ID NO: 2056890 - RNA, 14 nt, Staphylococcus aureus subsp. aureus Mu50
uauaugaauuuuau

SEQ ID NO: 2056891 - RNA, 18 nt, Staphylococcus aureus subsp. aureus Mu50
uauaugaaauauuuaucu

SEQ ID NO: 2056892 - RNA, 23 nt, Staphylococcus aureus subsp. aureus Mu50
uauauagcgcgcuuauugaaaag

SEQ ID NO: 2056893 - RNA, 16 nt, Staphylococcus aureus subsp. aureus Mu50
uauauagauugccauu

SEQ ID NO: 2056894 - RNA, 11 nt, Staphylococcus aureus subsp. aureus Mu50
uauauaaauua

SEQ ID NO: 2056895 - RNA, 21 nt, Staphylococcus aureus subsp. aureus Mu50
uauauaaaguugacaauacaa

SEQ ID NO: 2056896 - RNA, 22 nt, Staphylococcus aureus subsp. aureus Mu50
uauauaaagaaauaauuuaaag

SEQ ID NO: 2056897 - RNA, 20 nt, Staphylococcus aureus subsp. aureus Mu50
uauauaaagcuuugacauau

SEQ ID NO: 2056898 - RNA, 19 nt, Staphylococcus aureus subsp. aureus Mu50
uauauaaaaucauuaauaa

SEQ ID NO: 2056899 - RNA, 15 nt, Staphylococcus aureus subsp. aureus Mu50
uauauauuaaaacaa

SEQ ID NO: 2056900 - RNA, 16 nt, Staphylococcus aureus subsp. aureus Mu50
uauauauuaaaacaau

SEQ ID NO: 2056901 - RNA, 18 nt, Staphylococcus aureus subsp. aureus Mu50
uauauauccuguuucaua

SEQ ID NO: 2056902 - RNA, 17 nt, Staphylococcus aureus subsp. aureus Mu50
uauauaucacauauuau

SEQ ID NO: 2056903 - RNA, 20 nt, Staphylococcus aureus subsp. aureus Mu50
uauauaguaggguauugaaa

SEQ ID NO: 2056904 - RNA, 15 nt, Staphylococcus aureus subsp. aureus Mu50
uauauaguaaaauaa

SEQ ID NO: 2056905 - RNA, 20 nt, Staphylococcus aureus subsp. aureus Mu50
uauauauaaagaaauaauuu

SEQ ID NO: 2056906 - RNA, 13 nt, Staphylococcus aureus subsp. aureus Mu50
uauauauauauua

SEQ ID NO: 2056907 - RNA, 13 nt, Staphylococcus aureus subsp. aureus Mu50
uauauauauuaaa

SEQ ID NO: 2056908 - RNA, 14 nt, Staphylococcus aureus subsp. aureus Mu50
uauauauauuaaag

SEQ ID NO: 2056909 - RNA, 12 nt, Staphylococcus aureus subsp. aureus Mu50
uauauaucaaau

SEQ ID NO: 2056910 - RNA, 18 nt, Staphylococcus aureus subsp. aureus Mu50
uauaguaauagcuauauu

SEQ ID NO: 2056911 - RNA, 13 nt, Staphylococcus aureus subsp. aureus Mu50
uauaguuuagauu

SEQ ID NO: 2056912 - RNA, 19 nt, Staphylococcus aureus subsp. aureus Mu50
uauaggugcaguuaaauua

SEQ ID NO: 2056913 - RNA, 16 nt, Staphylococcus aureus subsp. aureus Mu50
uauaguaaaauaaaua

SEQ ID NO: 2056914 - RNA, 17 nt, Staphylococcus aureus subsp. aureus Mu50
uauacaacauguguaug

SEQ ID NO: 2056915 - RNA, 16 nt, Staphylococcus aureus subsp. aureus Mu50
uauacacuuacaaaua

SEQ ID NO: 2056916 - RNA, 17 nt, Staphylococcus aureus subsp. aureus Mu50
uauaauuuuaauauuau

SEQ ID NO: 2056917 - RNA, 15 nt, Staphylococcus aureus subsp. aureus Mu50
uauaauuuuaauauu

SEQ ID NO: 2056918 - RNA, 20 nt, Staphylococcus aureus subsp. aureus Mu50
uauaauuucuguuuacgcca

SEQ ID NO: 2056919 - RNA, 15 nt, Staphylococcus aureus subsp. aureus Mu50
uauaugaauuuuaua

SEQ ID NO: 2056920 - RNA, 17 nt, Staphylococcus aureus subsp. aureus Mu50
uauaugauaaauauugu

SEQ ID NO: 2056921 - RNA, 21 nt, Staphylococcus aureus subsp. aureus Mu50
uauauggagcuacccuauuuu

SEQ ID NO: 2056922 - RNA, 22 nt, Staphylococcus aureus subsp. aureus Mu50
uauauuacuaaccuauuaaaaa

SEQ ID NO: 2056923 - RNA, 21 nt, Staphylococcus aureus subsp. aureus Mu50
uauauuaaggucauuuuuaau

SEQ ID NO: 2056924 - RNA, 15 nt, Staphylococcus aureus subsp. aureus Mu50
uauauuaaaguaaaa

SEQ ID NO: 2056925 - RNA, 23 nt, Staphylococcus aureus subsp. aureus Mu50
uauauguaggggagucuuauuuu

SEQ ID NO: 2056926 - RNA, 16 nt, Staphylococcus aureus subsp. aureus Mu50
uauauuaaaaauuuca

SEQ ID NO: 2056927 - RNA, 19 nt, Staphylococcus aureus subsp. aureus Mu50
uauauuaaaaauuucaaua

SEQ ID NO: 2056928 - RNA, 23 nt, Staphylococcus aureus subsp. aureus Mu50
uauauuaaaaauuucaauaaugu

SEQ ID NO: 2056929 - RNA, 12 nt, Staphylococcus aureus subsp. aureus Mu50
uauauuuaaacu

SEQ ID NO: 2056930 - RNA, 17 nt, Staphylococcus aureus subsp. aureus Mu50
uauauuuaaacucucua

SEQ ID NO: 2056931 - RNA, 14 nt, Staphylococcus aureus subsp. aureus Mu50
uauauuaguauaau

SEQ ID NO: 2056932 - RNA, 15 nt, Staphylococcus aureus subsp. aureus Mu50
uauauuuaaaugucu

SEQ ID NO: 2056933 - RNA, 23 nt, Staphylococcus aureus subsp. aureus Mu50
uauauuuaguuaauuauuuagau

SEQ ID NO: 2056934 - RNA, 16 nt, Staphylococcus aureus subsp. aureus Mu50
uauauuuauuuuugau

SEQ ID NO: 2056935 - RNA, 17 nt, Staphylococcus aureus subsp. aureus Mu50
uauauuuauuuuugaua

SEQ ID NO: 2056936 - RNA, 14 nt, Staphylococcus aureus subsp. aureus Mu50
uauauuuaaauugg

SEQ ID NO: 2056937 - RNA, 12 nt, Staphylococcus aureus subsp. aureus Mu50
uauauuuaauuu

SEQ ID NO: 2056938 - RNA, 22 nt, Staphylococcus aureus subsp. aureus Mu50
uauauuuacacagaaugauaua

SEQ ID NO: 2056939 - RNA, 20 nt, Staphylococcus aureus subsp. aureus Mu50
uauauuucucauacuauaag

SEQ ID NO: 2056940 - RNA, 22 nt, Staphylococcus aureus subsp. aureus Mu50
uauauuucgguauuuuaaauuu

SEQ ID NO: 2056941 - RNA, 13 nt, Staphylococcus aureus subsp. aureus Mu50
uauauuugugaau

SEQ ID NO: 2056942 - RNA, 20 nt, Staphylococcus aureus subsp. aureus Mu50
uauauuucgguauuuuaaau

SEQ ID NO: 2056943 - RNA, 20 nt, Staphylococcus aureus subsp. aureus Mu50
uaucacauauuaugauacgc

SEQ ID NO: 2056944 - RNA, 16 nt, Staphylococcus aureus subsp. aureus Mu50
uaucaccuucaaacuu

SEQ ID NO: 2056945 - RNA, 15 nt, Staphylococcus aureus subsp. aureus Mu50
uaucaccuaauugaa

SEQ ID NO: 2056946 - RNA, 15 nt, Staphylococcus aureus subsp. aureus Mu50
uaucaagaaaaaguu

SEQ ID NO: 2056947 - RNA, 16 nt, Staphylococcus aureus subsp. aureus Mu50
uaucaagaaaaaguuu

SEQ ID NO: 2056948 - RNA, 20 nt, Staphylococcus aureus subsp. aureus Mu50
uaucaagaaaaaguuuuucu

SEQ ID NO: 2056949 - RNA, 19 nt, Staphylococcus aureus subsp. aureus Mu50
uaucaagaacuuuaaaaau

SEQ ID NO: 2056950 - RNA, 15 nt, Staphylococcus aureus subsp. aureus Mu50
uauauuuuaugucaa

SEQ ID NO: 2056951 - RNA, 13 nt, Staphylococcus aureus subsp. aureus Mu50
uauauuuuauuag

SEQ ID NO: 2056952 - RNA, 19 nt, Staphylococcus aureus subsp. aureus Mu50
uauauuuuauuagaauauu

SEQ ID NO: 2056953 - RNA, 18 nt, Staphylococcus aureus subsp. aureus Mu50
uaucaacauaaaauuuaa

SEQ ID NO: 2056954 - RNA, 15 nt, Staphylococcus aureus subsp. aureus Mu50
uaucaacauauuuau

SEQ ID NO: 2056955 - RNA, 23 nt, Staphylococcus aureus subsp. aureus Mu50
uaucaagauguuugcaacauauu

SEQ ID NO: 2056956 - RNA, 12 nt, Staphylococcus aureus subsp. aureus Mu50
uaucaauaaauc

SEQ ID NO: 2056957 - RNA, 21 nt, Staphylococcus aureus subsp. aureus Mu50
uaucgcuuuugaaguuggucc

SEQ ID NO: 2056958 - RNA, 16 nt, Staphylococcus aureus subsp. aureus Mu50
uaucguaaacaacauc

SEQ ID NO: 2056959 - RNA, 18 nt, Staphylococcus aureus subsp. aureus Mu50
uaucgccuaaaaauaaaa

SEQ ID NO: 2056960 - RNA, 19 nt, Staphylococcus aureus subsp. aureus Mu50
uaucgccuaaaaauaaaau

SEQ ID NO: 2056961 - RNA, 22 nt, Staphylococcus aureus subsp. aureus Mu50
uaucgauucgauuauuuagaua

SEQ ID NO: 2056962 - RNA, 17 nt, Staphylococcus aureus subsp. aureus Mu50
uaucgauaguucuauau

SEQ ID NO: 2056963 - RNA, 19 nt, Staphylococcus aureus subsp. aureus Mu50
uaucgauauagcauaaaau

SEQ ID NO: 2056964 - RNA, 21 nt, Staphylococcus aureus subsp. aureus Mu50
uaucgaagaaacauuauauaa

SEQ ID NO: 2056965 - RNA, 13 nt, Staphylococcus aureus subsp. aureus Mu50
uaucgauaaaugu

SEQ ID NO: 2056966 - RNA, 16 nt, Staphylococcus aureus subsp. aureus Mu50
uaucgacuuugucauu

SEQ ID NO: 2056967 - RNA, 13 nt, Staphylococcus aureus subsp. aureus Mu50
uauccugauuuaa

SEQ ID NO: 2056968 - RNA, 16 nt, Staphylococcus aureus subsp. aureus Mu50
uauccuguguaaaaua

SEQ ID NO: 2056969 - RNA, 16 nt, Staphylococcus aureus subsp. aureus Mu50
uauccuucucaucauu

SEQ ID NO: 2056970 - RNA, 20 nt, Staphylococcus aureus subsp. aureus Mu50
uauccuguuucauaugguga

SEQ ID NO: 2056971 - RNA, 14 nt, Staphylococcus aureus subsp. aureus Mu50
uauccuuuuugacu

SEQ ID NO: 2056972 - RNA, 15 nt, Staphylococcus aureus subsp. aureus Mu50
uauccuuuuugacuc

SEQ ID NO: 2056973 - RNA, 17 nt, Staphylococcus aureus subsp. aureus Mu50
uauccucgguauuuaau

SEQ ID NO: 2056974 - RNA, 12 nt, Staphylococcus aureus subsp. aureus Mu50
uaucaucaugac

SEQ ID NO: 2056975 - RNA, 15 nt, Staphylococcus aureus subsp. aureus Mu50
uaucauaauuuuguu

SEQ ID NO: 2056976 - RNA, 20 nt, Staphylococcus aureus subsp. aureus Mu50
uaucauaccgacaccuauac

SEQ ID NO: 2056977 - RNA, 15 nt, Staphylococcus aureus subsp. aureus Mu50
uaucauaauauugau

SEQ ID NO: 2056978 - RNA, 22 nt, Staphylococcus aureus subsp. aureus Mu50
uaucauaauauugaugaauaaa

SEQ ID NO: 2056979 - RNA, 23 nt, Staphylococcus aureus subsp. aureus Mu50
uaucauaccgacaccuauacaua

SEQ ID NO: 2056980 - RNA, 14 nt, Staphylococcus aureus subsp. aureus Mu50
uaucauauucaaaa

SEQ ID NO: 2056981 - RNA, 19 nt, Staphylococcus aureus subsp. aureus Mu50
uaucauauucaaaauaacu

SEQ ID NO: 2056982 - RNA, 18 nt, Staphylococcus aureus subsp. aureus Mu50
uaucagcgaaauuuguaa

SEQ ID NO: 2056983 - RNA, 14 nt, Staphylococcus aureus subsp. aureus Mu50
uaucagcuuuuuca

SEQ ID NO: 2056984 - RNA, 17 nt, Staphylococcus aureus subsp. aureus Mu50
uaugcuguguaucauca

SEQ ID NO: 2056985 - RNA, 21 nt, Staphylococcus aureus subsp. aureus Mu50
uaugcuguuggcaaaacaaua

SEQ ID NO: 2056986 - RNA, 17 nt, Staphylococcus aureus subsp. aureus Mu50
uaugcuagaaaguaaug

SEQ ID NO: 2056987 - RNA, 22 nt, Staphylococcus aureus subsp. aureus Mu50
uaugccgauugcucuaauccaa

SEQ ID NO: 2056988 - RNA, 21 nt, Staphylococcus aureus subsp. aureus Mu50
uaugccgccuaauaauaaaau

SEQ ID NO: 2056989 - RNA, 18 nt, Staphylococcus aureus subsp. aureus Mu50
uaugccgccuaauaauaa

SEQ ID NO: 2056990 - RNA, 19 nt, Staphylococcus aureus subsp. aureus Mu50
uaugguauuuauagauuua

SEQ ID NO: 2056991 - RNA, 16 nt, Staphylococcus aureus subsp. aureus Mu50
uaugguaaaacccagu

SEQ ID NO: 2056992 - RNA, 14 nt, Staphylococcus aureus subsp. aureus Mu50
uauggcgguuugaa

SEQ ID NO: 2056993 - RNA, 14 nt, Staphylococcus aureus subsp. aureus Mu50
uauggaaauggugg

SEQ ID NO: 2056994 - RNA, 15 nt, Staphylococcus aureus subsp. aureus Mu50
uauggaaaauguuau

SEQ ID NO: 2056995 - RNA, 16 nt, Staphylococcus aureus subsp. aureus Mu50
uaugcuuuuaauagug

SEQ ID NO: 2056996 - RNA, 22 nt, Staphylococcus aureus subsp. aureus Mu50
uaugcuuuacuugcuuuuucaa

SEQ ID NO: 2056997 - RNA, 13 nt, Staphylococcus aureus subsp. aureus Mu50
uauggauaaaauu

SEQ ID NO: 2056998 - RNA, 19 nt, Staphylococcus aureus subsp. aureus Mu50
uaugauauauguaacauaa

SEQ ID NO: 2056999 - RNA, 17 nt, Staphylococcus aureus subsp. aureus Mu50
uaugaugucauguauug

SEQ ID NO: 2057000 - RNA, 12 nt, Staphylococcus aureus subsp. aureus Mu50
uaugauuuaaaa

SEQ ID NO: 2057001 - RNA, 22 nt, Staphylococcus aureus subsp. aureus Mu50
uaugaugucauguauuguccau

SEQ ID NO: 2057002 - RNA, 15 nt, Staphylococcus aureus subsp. aureus Mu50
uaugauguuaaaaaa

SEQ ID NO: 2057003 - RNA, 16 nt, Staphylococcus aureus subsp. aureus Mu50
uaugauguuaaaaaau

SEQ ID NO: 2057004 - RNA, 17 nt, Staphylococcus aureus subsp. aureus Mu50
uaugauguuaaaaaaua

SEQ ID NO: 2057005 - RNA, 18 nt, Staphylococcus aureus subsp. aureus Mu50
uaugccaaauaacguuaa

SEQ ID NO: 2057006 - RNA, 19 nt, Staphylococcus aureus subsp. aureus Mu50
uaugcaugccagaugcaau

SEQ ID NO: 2057007 - RNA, 23 nt, Staphylococcus aureus subsp. aureus Mu50
uaugcauccuaaaaaggcaagca

SEQ ID NO: 2057008 - RNA, 22 nt, Staphylococcus aureus subsp. aureus Mu50
uaugcauacacuugauuaucau

SEQ ID NO: 2057009 - RNA, 16 nt, Staphylococcus aureus subsp. aureus Mu50
uaugcauagcucuugc

SEQ ID NO: 2057010 - RNA, 23 nt, Staphylococcus aureus subsp. aureus Mu50
uaugauuugccccgccauucaua

SEQ ID NO: 2057011 - RNA, 16 nt, Staphylococcus aureus subsp. aureus Mu50
uaugcaaaauuaauga

SEQ ID NO: 2057012 - RNA, 15 nt, Staphylococcus aureus subsp. aureus Mu50
uaugaauuuuauaaa

SEQ ID NO: 2057013 - RNA, 13 nt, Staphylococcus aureus subsp. aureus Mu50
uaugaauuuuaua

SEQ ID NO: 2057014 - RNA, 12 nt, Staphylococcus aureus subsp. aureus Mu50
uaugacaacaua

SEQ ID NO: 2057015 - RNA, 17 nt, Staphylococcus aureus subsp. aureus Mu50
uaugaauugaguauuaa

SEQ ID NO: 2057016 - RNA, 19 nt, Staphylococcus aureus subsp. aureus Mu50
uaugaauugaguauuaaau

SEQ ID NO: 2057017 - RNA, 22 nt, Staphylococcus aureus subsp. aureus Mu50
uaugaauggcaaucuauauaaa

SEQ ID NO: 2057018 - RNA, 21 nt, Staphylococcus aureus subsp. aureus Mu50
uaugacuuauuuuucaucauu

SEQ ID NO: 2057019 - RNA, 15 nt, Staphylococcus aureus subsp. aureus Mu50
uaugacuuuuuauua

SEQ ID NO: 2057020 - RNA, 19 nt, Staphylococcus aureus subsp. aureus Mu50
uaugacugcaaauacgagu

SEQ ID NO: 2057021 - RNA, 15 nt, Staphylococcus aureus subsp. aureus Mu50
uaugagugauagaaa

SEQ ID NO: 2057022 - RNA, 18 nt, Staphylococcus aureus subsp. aureus Mu50
uaugauagaauacuaaaa

SEQ ID NO: 2057023 - RNA, 22 nt, Staphylococcus aureus subsp. aureus Mu50
uaugauagaauacuaaaagugu

SEQ ID NO: 2057024 - RNA, 23 nt, Staphylococcus aureus subsp. aureus Mu50
uaugauagaauacuaaaaguguu

SEQ ID NO: 2057025 - RNA, 21 nt, Staphylococcus aureus subsp. aureus Mu50
uaugauacgcuuuuuaaaaaa

SEQ ID NO: 2057026 - RNA, 22 nt, Staphylococcus aureus subsp. aureus Mu50
uaugauacgcuuuuuaaaaaau

SEQ ID NO: 2057027 - RNA, 19 nt, Staphylococcus aureus subsp. aureus Mu50
uaugauaauuaauuaaaau

SEQ ID NO: 2057028 - RNA, 20 nt, Staphylococcus aureus subsp. aureus Mu50
uaugauaauuaauuaaaauu

SEQ ID NO: 2057029 - RNA, 22 nt, Staphylococcus aureus subsp. aureus Mu50
uaugauaaccauuaugauuaau

SEQ ID NO: 2057030 - RNA, 15 nt, Staphylococcus aureus subsp. aureus Mu50
uaugauaauaagaau

SEQ ID NO: 2057031 - RNA, 16 nt, Staphylococcus aureus subsp. aureus Mu50
uaugagugauagaaag

SEQ ID NO: 2057032 - RNA, 13 nt, Staphylococcus aureus subsp. aureus Mu50
uaucuaugaaauu

SEQ ID NO: 2057033 - RNA, 15 nt, Staphylococcus aureus subsp. aureus Mu50
uaucuauaugcauau

SEQ ID NO: 2057034 - RNA, 18 nt, Staphylococcus aureus subsp. aureus Mu50
uaucuauaugcauauauu

SEQ ID NO: 2057035 - RNA, 13 nt, Staphylococcus aureus subsp. aureus Mu50
uaucuauaaaaag

SEQ ID NO: 2057036 - RNA, 18 nt, Staphylococcus aureus subsp. aureus Mu50
uaucuauaaaaagaauau

SEQ ID NO: 2057037 - RNA, 17 nt, Staphylococcus aureus subsp. aureus Mu50
uaucuaguguucucauu

SEQ ID NO: 2057038 - RNA, 23 nt, Staphylococcus aureus subsp. aureus Mu50
uaucuaguguucucauuauaaug

SEQ ID NO: 2057039 - RNA, 22 nt, Staphylococcus aureus subsp. aureus Mu50
uaucuacauuaaagaaaauauc

SEQ ID NO: 2057040 - RNA, 22 nt, Staphylococcus aureus subsp. aureus Mu50
uaucuacgccuugaccuacuuu

SEQ ID NO: 2057041 - RNA, 19 nt, Staphylococcus aureus subsp. aureus Mu50
uaucuacucaaauauaaau

SEQ ID NO: 2057042 - RNA, 14 nt, Staphylococcus aureus subsp. aureus Mu50
uaucuagcugcuuc

SEQ ID NO: 2057043 - RNA, 16 nt, Staphylococcus aureus subsp. aureus Mu50
uaucuaaacaauuccc

SEQ ID NO: 2057044 - RNA, 18 nt, Staphylococcus aureus subsp. aureus Mu50
uaucuacaugguuuucac

SEQ ID NO: 2057045 - RNA, 18 nt, Staphylococcus aureus subsp. aureus Mu50
uaucuacaauaaccauuu

SEQ ID NO: 2057046 - RNA, 23 nt, Staphylococcus aureus subsp. aureus Mu50
uaucuacaugguuuucaccagac

SEQ ID NO: 2057047 - RNA, 20 nt, Staphylococcus aureus subsp. aureus Mu50
uaucuaaugggucaaugacu

SEQ ID NO: 2057048 - RNA, 23 nt, Staphylococcus aureus subsp. aureus Mu50
uaucuaaugaucaucuauauuua

SEQ ID NO: 2057049 - RNA, 17 nt, Staphylococcus aureus subsp. aureus Mu50
uaucuaaagcuauaaaa

SEQ ID NO: 2057050 - RNA, 19 nt, Staphylococcus aureus subsp. aureus Mu50
uaucuaaagcuauaaaaaa

SEQ ID NO: 2057051 - RNA, 16 nt, Staphylococcus aureus subsp. aureus Mu50
uaucugaauuuuacug

SEQ ID NO: 2057052 - RNA, 14 nt, Staphylococcus aureus subsp. aureus Mu50
uaucugacauuuaa

SEQ ID NO: 2057053 - RNA, 18 nt, Staphylococcus aureus subsp. aureus Mu50
uaucucaaagauuccugu

SEQ ID NO: 2057054 - RNA, 13 nt, Staphylococcus aureus subsp. aureus Mu50
uaucugaaaauau

SEQ ID NO: 2057055 - RNA, 23 nt, Staphylococcus aureus subsp. aureus Mu50
uaucuccgcuacaauuauaugua

SEQ ID NO: 2057056 - RNA, 17 nt, Staphylococcus aureus subsp. aureus Mu50
uaucuucaguaauuucu

SEQ ID NO: 2057057 - RNA, 22 nt, Staphylococcus aureus subsp. aureus Mu50
uaucuuaaucagcuauaaaagu

SEQ ID NO: 2057058 - RNA, 14 nt, Staphylococcus aureus subsp. aureus Mu50
uaucuuacugcugu

SEQ ID NO: 2057059 - RNA, 14 nt, Staphylococcus aureus subsp. aureus Mu50
uaucuuauauucuu

SEQ ID NO: 2057060 - RNA, 19 nt, Staphylococcus aureus subsp. aureus Mu50
uaucuuaguaagacugcca

SEQ ID NO: 2057061 - RNA, 19 nt, Staphylococcus aureus subsp. aureus Mu50
uaucuuaaagaauuaagua

SEQ ID NO: 2057062 - RNA, 17 nt, Staphylococcus aureus subsp. aureus Mu50
uaucuguugucaucaug

SEQ ID NO: 2057063 - RNA, 16 nt, Staphylococcus aureus subsp. aureus Mu50
uaucuguuguuauaua

SEQ ID NO: 2057064 - RNA, 19 nt, Staphylococcus aureus subsp. aureus Mu50
uaucuguuguuauauaaau

SEQ ID NO: 2057065 - RNA, 19 nt, Staphylococcus aureus subsp. aureus Mu50
uaucuguaccguauuuuaa

SEQ ID NO: 2057066 - RNA, 14 nt, Staphylococcus aureus subsp. aureus Mu50
uaucuuuagacaua

SEQ ID NO: 2057067 - RNA, 22 nt, Staphylococcus aureus subsp. aureus Mu50
uaucuuuacgauaaacuaaaaa

SEQ ID NO: 2057068 - RNA, 19 nt, Staphylococcus aureus subsp. aureus Mu50
uaucuugucauuugaacau

SEQ ID NO: 2057069 - RNA, 15 nt, Staphylococcus aureus subsp. aureus Mu50
uaucuuauuauuaau

SEQ ID NO: 2057070 - RNA, 14 nt, Staphylococcus aureus subsp. aureus Mu50
uaucuucauuuaaa

SEQ ID NO: 2057071 - RNA, 12 nt, Staphylococcus aureus subsp. aureus Mu50
uaucuucuucua

SEQ ID NO: 2057072 - RNA, 14 nt, Staphylococcus aureus subsp. aureus Mu50
uaugaaauaacaau

SEQ ID NO: 2057073 - RNA, 14 nt, Staphylococcus aureus subsp. aureus Mu50
uaugaauagaugau

SEQ ID NO: 2057074 - RNA, 23 nt, Staphylococcus aureus subsp. aureus Mu50
uaugaaaagagaaacaaaacaaa

SEQ ID NO: 2057075 - RNA, 23 nt, Staphylococcus aureus subsp. aureus Mu50
uaucuuuuuacugcacuuuuauu

SEQ ID NO: 2057076 - RNA, 16 nt, Staphylococcus aureus subsp. aureus Mu50
uaucuuuuucuaaguu

SEQ ID NO: 2057077 - RNA, 16 nt, Staphylococcus aureus subsp. aureus Mu50
uaucuuuaucauuauu

SEQ ID NO: 2057078 - RNA, 19 nt, Staphylococcus aureus subsp. aureus Mu50
uaucuuucaaauuaauuaa

SEQ ID NO: 2057079 - RNA, 16 nt, Staphylococcus aureus subsp. aureus Mu50
uauucaaaguuuucau

SEQ ID NO: 2057080 - RNA, 17 nt, Staphylococcus aureus subsp. aureus Mu50
uauucaaaguuuucauu

SEQ ID NO: 2057081 - RNA, 12 nt, Staphylococcus aureus subsp. aureus Mu50
uauucaaaauaa

SEQ ID NO: 2057082 - RNA, 17 nt, Staphylococcus aureus subsp. aureus Mu50
uauucaaaaaauauuua

SEQ ID NO: 2057083 - RNA, 16 nt, Staphylococcus aureus subsp. aureus Mu50
uauuaugccuuugauu

SEQ ID NO: 2057084 - RNA, 17 nt, Staphylococcus aureus subsp. aureus Mu50
uauuaugaauuauuaau

SEQ ID NO: 2057085 - RNA, 22 nt, Staphylococcus aureus subsp. aureus Mu50
uauuaugauugcuuauuuauuu

SEQ ID NO: 2057086 - RNA, 16 nt, Staphylococcus aureus subsp. aureus Mu50
uauuauguguauauua

SEQ ID NO: 2057087 - RNA, 18 nt, Staphylococcus aureus subsp. aureus Mu50
uauuauuuugcuuuaauu

SEQ ID NO: 2057088 - RNA, 13 nt, Staphylococcus aureus subsp. aureus Mu50
uauucccaaaaug

SEQ ID NO: 2057089 - RNA, 23 nt, Staphylococcus aureus subsp. aureus Mu50
uauuccauugauguaugugagua

SEQ ID NO: 2057090 - RNA, 18 nt, Staphylococcus aureus subsp. aureus Mu50
uauucaaauaaacacauc

SEQ ID NO: 2057091 - RNA, 15 nt, Staphylococcus aureus subsp. aureus Mu50
uauucgguuaauauu

SEQ ID NO: 2057092 - RNA, 21 nt, Staphylococcus aureus subsp. aureus Mu50
uauucguaucuaguguucuca

SEQ ID NO: 2057093 - RNA, 22 nt, Staphylococcus aureus subsp. aureus Mu50
uauucuaaaaaauuaaaaauuu

SEQ ID NO: 2057094 - RNA, 20 nt, Staphylococcus aureus subsp. aureus Mu50
uauucuagauucauauuuau

SEQ ID NO: 2057095 - RNA, 16 nt, Staphylococcus aureus subsp. aureus Mu50
uauucuaaauauauuu

SEQ ID NO: 2057096 - RNA, 19 nt, Staphylococcus aureus subsp. aureus Mu50
uauucuaaauauauuuuau

SEQ ID NO: 2057097 - RNA, 13 nt, Staphylococcus aureus subsp. aureus Mu50
uauucuucauuua

SEQ ID NO: 2057098 - RNA, 15 nt, Staphylococcus aureus subsp. aureus Mu50
uauucuuaucauuca

SEQ ID NO: 2057099 - RNA, 17 nt, Staphylococcus aureus subsp. aureus Mu50
uauucuucccaaaaauu

SEQ ID NO: 2057100 - RNA, 15 nt, Staphylococcus aureus subsp. aureus Mu50
uauucuuucucuauu

SEQ ID NO: 2057101 - RNA, 15 nt, Staphylococcus aureus subsp. aureus Mu50
uauugaaaagauaaa

SEQ ID NO: 2057102 - RNA, 18 nt, Staphylococcus aureus subsp. aureus Mu50
uauugaaacuaauaauuu

SEQ ID NO: 2057103 - RNA, 18 nt, Staphylococcus aureus subsp. aureus Mu50
uauugaaaguguaugcau

SEQ ID NO: 2057104 - RNA, 19 nt, Staphylococcus aureus subsp. aureus Mu50
uauugaaaguguaugcaug

SEQ ID NO: 2057105 - RNA, 20 nt, Staphylococcus aureus subsp. aureus Mu50
uauucuuggcguauuuuuug

SEQ ID NO: 2057106 - RNA, 14 nt, Staphylococcus aureus subsp. aureus Mu50
uauucuuuauauuu

SEQ ID NO: 2057107 - RNA, 19 nt, Staphylococcus aureus subsp. aureus Mu50
uauucuuucguuuucauca

SEQ ID NO: 2057108 - RNA, 20 nt, Staphylococcus aureus subsp. aureus Mu50
uauucuuucguuuucaucaa

SEQ ID NO: 2057109 - RNA, 13 nt, Staphylococcus aureus subsp. aureus Mu50
uauucuuucucua

SEQ ID NO: 2057110 - RNA, 12 nt, Staphylococcus aureus subsp. aureus Mu50
uauucuuugauu

SEQ ID NO: 2057111 - RNA, 23 nt, Staphylococcus aureus subsp. aureus Mu50
uauugcaaaaauaauaugaauuu

SEQ ID NO: 2057112 - RNA, 22 nt, Staphylococcus aureus subsp. aureus Mu50
uauugauucuagugaaauaccu

SEQ ID NO: 2057113 - RNA, 15 nt, Staphylococcus aureus subsp. aureus Mu50
uauugcaauaaaauu

SEQ ID NO: 2057114 - RNA, 17 nt, Staphylococcus aureus subsp. aureus Mu50
uauugcauuuagacuug

SEQ ID NO: 2057115 - RNA, 16 nt, Staphylococcus aureus subsp. aureus Mu50
uauugaaauaauauaa

SEQ ID NO: 2057116 - RNA, 16 nt, Staphylococcus aureus subsp. aureus Mu50
uauugaaaugagcuua

SEQ ID NO: 2057117 - RNA, 21 nt, Staphylococcus aureus subsp. aureus Mu50
uauugaacaauuuuugggaag

SEQ ID NO: 2057118 - RNA, 22 nt, Staphylococcus aureus subsp. aureus Mu50
aaauccuaagcaucguaaaaaa

SEQ ID NO: 2057119 - RNA, 16 nt, Staphylococcus aureus subsp. aureus Mu50
aaauccuaauuuuucu

SEQ ID NO: 2057120 - RNA, 14 nt, Staphylococcus aureus subsp. aureus Mu50
uauuguuuuuaaaa

SEQ ID NO: 2057121 - RNA, 20 nt, Staphylococcus aureus subsp. aureus Mu50
uauuguuugaaaauuaacua

SEQ ID NO: 2057122 - RNA, 19 nt, Staphylococcus aureus subsp. aureus Mu50
uauuguuuguuuuuauagu

SEQ ID NO: 2057123 - RNA, 15 nt, Staphylococcus aureus subsp. aureus Mu50
uauuguuuuauauuu

SEQ ID NO: 2057124 - RNA, 22 nt, Staphylococcus aureus subsp. aureus Mu50
uauuuaauacauuuuuauacaa

SEQ ID NO: 2057125 - RNA, 21 nt, Staphylococcus aureus subsp. aureus Mu50
uauuuaacaucaauuacucuu

SEQ ID NO: 2057126 - RNA, 20 nt, Staphylococcus aureus subsp. aureus Mu50
uauuuaacacuucaguuaaa

SEQ ID NO: 2057127 - RNA, 17 nt, Staphylococcus aureus subsp. aureus Mu50
uauuuaacaucaauuac

SEQ ID NO: 2057128 - RNA, 22 nt, Staphylococcus aureus subsp. aureus Mu50
uauuggguggucguaauuuggu

SEQ ID NO: 2057129 - RNA, 23 nt, Staphylococcus aureus subsp. aureus Mu50
uauuguuaaacuagaaaacauaa

SEQ ID NO: 2057130 - RNA, 20 nt, Staphylococcus aureus subsp. aureus Mu50
uaugucaaauugaacuuaua

SEQ ID NO: 2057131 - RNA, 13 nt, Staphylococcus aureus subsp. aureus Mu50
uaugguuagagaa

SEQ ID NO: 2057132 - RNA, 19 nt, Staphylococcus aureus subsp. aureus Mu50
uaugguuuaccuaguuuua

SEQ ID NO: 2057133 - RNA, 22 nt, Staphylococcus aureus subsp. aureus Mu50
uaugucauucuaguagcuagaa

SEQ ID NO: 2057134 - RNA, 21 nt, Staphylococcus aureus subsp. aureus Mu50
uaugucuagacuuauuugaau

SEQ ID NO: 2057135 - RNA, 21 nt, Staphylococcus aureus subsp. aureus Mu50
uaugucccaaugcugaauaaa

SEQ ID NO: 2057136 - RNA, 17 nt, Staphylococcus aureus subsp. aureus Mu50
uaugucauauacuauau

SEQ ID NO: 2057137 - RNA, 18 nt, Staphylococcus aureus subsp. aureus Mu50
uaugucaucuucaauucu

SEQ ID NO: 2057138 - RNA, 16 nt, Staphylococcus aureus subsp. aureus Mu50
uaugucucucuuucuu

SEQ ID NO: 2057139 - RNA, 21 nt, Staphylococcus aureus subsp. aureus Mu50
uaugucucucuuucuuauuca

SEQ ID NO: 2057140 - RNA, 21 nt, Staphylococcus aureus subsp. aureus Mu50
uaugugcaugagacuuauuca

SEQ ID NO: 2057141 - RNA, 17 nt, Staphylococcus aureus subsp. aureus Mu50
uaugugauuaauuucau

SEQ ID NO: 2057142 - RNA, 16 nt, Staphylococcus aureus subsp. aureus Mu50
uauguuguuucuaaug

SEQ ID NO: 2057143 - RNA, 13 nt, Staphylococcus aureus subsp. aureus Mu50
uauguuuauauug

SEQ ID NO: 2057144 - RNA, 15 nt, Staphylococcus aureus subsp. aureus Mu50
uauguuuuauaauaa

SEQ ID NO: 2057145 - RNA, 13 nt, Staphylococcus aureus subsp. aureus Mu50
uauguuuuaucaa

SEQ ID NO: 2057146 - RNA, 15 nt, Staphylococcus aureus subsp. aureus Mu50
uauguuuuauuuucu

SEQ ID NO: 2057147 - RNA, 18 nt, Staphylococcus aureus subsp. aureus Mu50
uauguuugauuuuauuca

SEQ ID NO: 2057148 - RNA, 19 nt, Staphylococcus aureus subsp. aureus Mu50
uauuaaaauuaaauaauga

SEQ ID NO: 2057149 - RNA, 13 nt, Staphylococcus aureus subsp. aureus Mu50
uauuaaaaauccu

SEQ ID NO: 2057150 - RNA, 22 nt, Staphylococcus aureus subsp. aureus Mu50
uauuaaaaaagaacauaaaaaa

SEQ ID NO: 2057151 - RNA, 17 nt, Staphylococcus aureus subsp. aureus Mu50
uauuaaaaaaaaccacg

SEQ ID NO: 2057152 - RNA, 21 nt, Staphylococcus aureus subsp. aureus Mu50
uauuaaaaaaaaccacgcaca

SEQ ID NO: 2057153 - RNA, 18 nt, Staphylococcus aureus subsp. aureus Mu50
uauguuacuuauauauuc

SEQ ID NO: 2057154 - RNA, 20 nt, Staphylococcus aureus subsp. aureus Mu50
uauguguugugauauauagu

SEQ ID NO: 2057155 - RNA, 21 nt, Staphylococcus aureus subsp. aureus Mu50
uauguugaaagugacacugua

SEQ ID NO: 2057156 - RNA, 21 nt, Staphylococcus aureus subsp. aureus Mu50
uauguugucauaccaaauaaa

SEQ ID NO: 2057157 - RNA, 17 nt, Staphylococcus aureus subsp. aureus Mu50
uauuaguuuuuacguuu

SEQ ID NO: 2057158 - RNA, 12 nt, Staphylococcus aureus subsp. aureus Mu50
uauuauaaaaua

SEQ ID NO: 2057159 - RNA, 19 nt, Staphylococcus aureus subsp. aureus Mu50
uauuauaaaauaaauauaa

SEQ ID NO: 2057160 - RNA, 21 nt, Staphylococcus aureus subsp. aureus Mu50
uauuauaaaaacagcagugaa

SEQ ID NO: 2057161 - RNA, 20 nt, Staphylococcus aureus subsp. aureus Mu50
uauuaucuauccauuugguu

SEQ ID NO: 2057162 - RNA, 15 nt, Staphylococcus aureus subsp. aureus Mu50
uauuaucuauccauu

SEQ ID NO: 2057163 - RNA, 14 nt, Staphylococcus aureus subsp. aureus Mu50
uauuaucuuuaauu

SEQ ID NO: 2057164 - RNA, 21 nt, Staphylococcus aureus subsp. aureus Mu50
uauuaucuuuaauuuacaauu

SEQ ID NO: 2057165 - RNA, 23 nt, Staphylococcus aureus subsp. aureus Mu50
uauuauaaguugcauauaaaaac

SEQ ID NO: 2057166 - RNA, 20 nt, Staphylococcus aureus subsp. aureus Mu50
uauuaauuacgucauaaaau

SEQ ID NO: 2057167 - RNA, 14 nt, Staphylococcus aureus subsp. aureus Mu50
uauuaauuuacuca

SEQ ID NO: 2057168 - RNA, 12 nt, Staphylococcus aureus subsp. aureus Mu50
uauuaauuuaau

SEQ ID NO: 2057169 - RNA, 17 nt, Staphylococcus aureus subsp. aureus Mu50
uauuaauuugauaaaug

SEQ ID NO: 2057170 - RNA, 12 nt, Staphylococcus aureus subsp. aureus Mu50
uauuaauuucau

SEQ ID NO: 2057171 - RNA, 21 nt, Staphylococcus aureus subsp. aureus Mu50
uauuaccauaacuuuauauau

SEQ ID NO: 2057172 - RNA, 13 nt, Staphylococcus aureus subsp. aureus Mu50
uauuacauaauuu

SEQ ID NO: 2057173 - RNA, 21 nt, Staphylococcus aureus subsp. aureus Mu50
uauuaaucauaaugaauaauu

SEQ ID NO: 2057174 - RNA, 24 nt, Staphylococcus aureus subsp. aureus Mu50
uauuaaggggguaauacuauauga

SEQ ID NO: 2057175 - RNA, 20 nt, Staphylococcus aureus subsp. aureus Mu50
uauuaauauuagugacauuu

SEQ ID NO: 2057176 - RNA, 21 nt, Staphylococcus aureus subsp. aureus Mu50
uauuaaggcaaagcuucauuu

SEQ ID NO: 2057177 - RNA, 18 nt, Staphylococcus aureus subsp. aureus Mu50
uauuaagcuauacucauu

SEQ ID NO: 2057178 - RNA, 17 nt, Staphylococcus aureus subsp. aureus Mu50
uauuaagaaauacucac

SEQ ID NO: 2057179 - RNA, 13 nt, Staphylococcus aureus subsp. aureus Mu50
uauuaacuuuaau

SEQ ID NO: 2057180 - RNA, 13 nt, Staphylococcus aureus subsp. aureus Mu50
uauuaaauuaugg

SEQ ID NO: 2057181 - RNA, 22 nt, Staphylococcus aureus subsp. aureus Mu50
ucaauacgaaguguuauaaaua

SEQ ID NO: 2057182 - RNA, 20 nt, Staphylococcus aureus subsp. aureus Mu50
ucaauaccauaauuaaauaa

SEQ ID NO: 2057183 - RNA, 24 nt, Staphylococcus aureus subsp. aureus Mu50
ucaauaucuucuucuaaccacuuc

SEQ ID NO: 2057184 - RNA, 14 nt, Staphylococcus aureus subsp. aureus Mu50
ucaauaguuuauaa

SEQ ID NO: 2057185 - RNA, 17 nt, Staphylococcus aureus subsp. aureus Mu50
ucaauagcgguuuaaaa

SEQ ID NO: 2057186 - RNA, 23 nt, Staphylococcus aureus subsp. aureus Mu50
ucaauagcgguuuaaaaaugcug

SEQ ID NO: 2057187 - RNA, 19 nt, Staphylococcus aureus subsp. aureus Mu50
ucaauaaauaaacaacugc

SEQ ID NO: 2057188 - RNA, 11 nt, Staphylococcus aureus subsp. aureus Mu50
ucaauaaauug

SEQ ID NO: 2057189 - RNA, 12 nt, Staphylococcus aureus subsp. aureus Mu50
ucaauaaauugu

SEQ ID NO: 2057190 - RNA, 17 nt, Staphylococcus aureus subsp. aureus Mu50
ucaauaaaaaugguauu

SEQ ID NO: 2057191 - RNA, 18 nt, Staphylococcus aureus subsp. aureus Mu50
ucaacuuuuuaauaauac

SEQ ID NO: 2057192 - RNA, 13 nt, Staphylococcus aureus subsp. aureus Mu50
ucaaguuuaaaau

SEQ ID NO: 2057193 - RNA, 22 nt, Staphylococcus aureus subsp. aureus Mu50
ucaaguuuacgaucauaaauau

SEQ ID NO: 2057194 - RNA, 16 nt, Staphylococcus aureus subsp. aureus Mu50
ucaauaacuauaauca

SEQ ID NO: 2057195 - RNA, 17 nt, Staphylococcus aureus subsp. aureus Mu50
ucaauugaaucuuuguu

SEQ ID NO: 2057196 - RNA, 21 nt, Staphylococcus aureus subsp. aureus Mu50
ucaauuuauaugguuguuuuc

SEQ ID NO: 2057197 - RNA, 22 nt, Staphylococcus aureus subsp. aureus Mu50
ucaauuuaguauaaauaaaaau

SEQ ID NO: 2057198 - RNA, 12 nt, Staphylococcus aureus subsp. aureus Mu50
ucaauuuaaaua

SEQ ID NO: 2057199 - RNA, 13 nt, Staphylococcus aureus subsp. aureus Mu50
ucaauuuaauuaa

SEQ ID NO: 2057200 - RNA, 14 nt, Staphylococcus aureus subsp. aureus Mu50
ucaauuauugaaaa

SEQ ID NO: 2057201 - RNA, 15 nt, Staphylococcus aureus subsp. aureus Mu50
ucaauuauuucaucg

SEQ ID NO: 2057202 - RNA, 12 nt, Staphylococcus aureus subsp. aureus Mu50
ucaauucucuaa

SEQ ID NO: 2057203 - RNA, 20 nt, Staphylococcus aureus subsp. aureus Mu50
ucaauucgcauuaaauaacc

SEQ ID NO: 2057204 - RNA, 15 nt, Staphylococcus aureus subsp. aureus Mu50
ucaauucgcucacau

SEQ ID NO: 2057205 - RNA, 16 nt, Staphylococcus aureus subsp. aureus Mu50
ucaaugugagauauaa

SEQ ID NO: 2057206 - RNA, 17 nt, Staphylococcus aureus subsp. aureus Mu50
ucaauguauauuuaaca

SEQ ID NO: 2057207 - RNA, 15 nt, Staphylococcus aureus subsp. aureus Mu50
ucaauguauauuuaa

SEQ ID NO: 2057208 - RNA, 16 nt, Staphylococcus aureus subsp. aureus Mu50
ucaauguauauuuaac

SEQ ID NO: 2057209 - RNA, 16 nt, Staphylococcus aureus subsp. aureus Mu50
ucaauguaagcaacau

SEQ ID NO: 2057210 - RNA, 17 nt, Staphylococcus aureus subsp. aureus Mu50
ucaauguaagcaacaua

SEQ ID NO: 2057211 - RNA, 23 nt, Staphylococcus aureus subsp. aureus Mu50
ucaauccaagcaaucuuaguaca

SEQ ID NO: 2057212 - RNA, 15 nt, Staphylococcus aureus subsp. aureus Mu50
ucaaucacuccucua

SEQ ID NO: 2057213 - RNA, 19 nt, Staphylococcus aureus subsp. aureus Mu50
ucaaucacuccucuauuuu

SEQ ID NO: 2057214 - RNA, 21 nt, Staphylococcus aureus subsp. aureus Mu50
ucaaucacuccucuauuuuau

SEQ ID NO: 2057215 - RNA, 20 nt, Staphylococcus aureus subsp. aureus Mu50
ucaaugauuuuauaauauua

SEQ ID NO: 2057216 - RNA, 12 nt, Staphylococcus aureus subsp. aureus Mu50
ucaaugauuuuu

SEQ ID NO: 2057217 - RNA, 12 nt, Staphylococcus aureus subsp. aureus Mu50
ucaaugacuaag

SEQ ID NO: 2057218 - RNA, 13 nt, Staphylococcus aureus subsp. aureus Mu50
ucaaugacaucua

SEQ ID NO: 2057219 - RNA, 23 nt, Staphylococcus aureus subsp. aureus Mu50
ucaaugacugagaaaaauauuuc

SEQ ID NO: 2057220 - RNA, 22 nt, Staphylococcus aureus subsp. aureus Mu50
ucacaucacguugugcaauacc

SEQ ID NO: 2057221 - RNA, 16 nt, Staphylococcus aureus subsp. aureus Mu50
ucacauauaaauauuu

SEQ ID NO: 2057222 - RNA, 18 nt, Staphylococcus aureus subsp. aureus Mu50
ucacauaugacuuuauuu

SEQ ID NO: 2057223 - RNA, 13 nt, Staphylococcus aureus subsp. aureus Mu50
ucacauauaaaua

SEQ ID NO: 2057224 - RNA, 14 nt, Staphylococcus aureus subsp. aureus Mu50
ucacauauaaauau

SEQ ID NO: 2057225 - RNA, 22 nt, Staphylococcus aureus subsp. aureus Mu50
ucacauguaccacauuuuccuu

SEQ ID NO: 2057226 - RNA, 15 nt, Staphylococcus aureus subsp. aureus Mu50
ucacaugugaaauaa

SEQ ID NO: 2057227 - RNA, 23 nt, Staphylococcus aureus subsp. aureus Mu50
ucacaugaggaucaacugaaauu

SEQ ID NO: 2057228 - RNA, 23 nt, Staphylococcus aureus subsp. aureus Mu50
ucacaucuuuagcuauguaaaau

SEQ ID NO: 2057229 - RNA, 22 nt, Staphylococcus aureus subsp. aureus Mu50
ucacaugaauuuuaauauauuu

SEQ ID NO: 2057230 - RNA, 20 nt, Staphylococcus aureus subsp. aureus Mu50
ucaccagguuuuuuauuuuc

SEQ ID NO: 2057231 - RNA, 17 nt, Staphylococcus aureus subsp. aureus Mu50
ucaccauacuaaaacau

SEQ ID NO: 2057232 - RNA, 15 nt, Staphylococcus aureus subsp. aureus Mu50
ucacauagaguaauu

SEQ ID NO: 2057233 - RNA, 20 nt, Staphylococcus aureus subsp. aureus Mu50
ucacauacauuuugaaacau

SEQ ID NO: 2057234 - RNA, 22 nt, Staphylococcus aureus subsp. aureus Mu50
ucacauacauuuugaaacaucu

SEQ ID NO: 2057235 - RNA, 13 nt, Staphylococcus aureus subsp. aureus Mu50
ucacauacauuuu

SEQ ID NO: 2057236 - RNA, 16 nt, Staphylococcus aureus subsp. aureus Mu50
ucacauacauuuugaa

SEQ ID NO: 2057237 - RNA, 14 nt, Staphylococcus aureus subsp. aureus Mu50
ucacaguguaauca

SEQ ID NO: 2057238 - RNA, 20 nt, Staphylococcus aureus subsp. aureus Mu50
ucacaguaucuucaguuauu

SEQ ID NO: 2057239 - RNA, 15 nt, Staphylococcus aureus subsp. aureus Mu50
aaaucgauuaauuau

SEQ ID NO: 2057240 - RNA, 13 nt, Staphylococcus aureus subsp. aureus Mu50
ucacaaagaaauu

SEQ ID NO: 2057241 - RNA, 22 nt, Staphylococcus aureus subsp. aureus Mu50
ucaauuucaccuuguaaauuga

SEQ ID NO: 2057242 - RNA, 14 nt, Staphylococcus aureus subsp. aureus Mu50
ucacagcaauaaua

SEQ ID NO: 2057243 - RNA, 15 nt, Staphylococcus aureus subsp. aureus Mu50
ucacagcaauaauaa

SEQ ID NO: 2057244 - RNA, 18 nt, Staphylococcus aureus subsp. aureus Mu50
ucaacaaucuuuuucaug

SEQ ID NO: 2057245 - RNA, 18 nt, Staphylococcus aureus subsp. aureus Mu50
ucaacaacugcgacaugu

SEQ ID NO: 2057246 - RNA, 18 nt, Staphylococcus aureus subsp. aureus Mu50
ucaacaaauuuaacuuuc

SEQ ID NO: 2057247 - RNA, 18 nt, Staphylococcus aureus subsp. aureus Mu50
ucaacaacaaguucuuga

SEQ ID NO: 2057248 - RNA, 19 nt, Staphylococcus aureus subsp. aureus Mu50
ucaacagauacuucaguac

SEQ ID NO: 2057249 - RNA, 16 nt, Staphylococcus aureus subsp. aureus Mu50
ucaacacgauagucau

SEQ ID NO: 2057250 - RNA, 15 nt, Staphylococcus aureus subsp. aureus Mu50
ucaacacuuucuacu

SEQ ID NO: 2057251 - RNA, 15 nt, Staphylococcus aureus subsp. aureus Mu50
ucaacacacuauuau

SEQ ID NO: 2057252 - RNA, 23 nt, Staphylococcus aureus subsp. aureus Mu50
ucaacaccaacaccuaauauuuu

SEQ ID NO: 2057253 - RNA, 15 nt, Staphylococcus aureus subsp. aureus Mu50
ucaacauuaaaaugu

SEQ ID NO: 2057254 - RNA, 18 nt, Staphylococcus aureus subsp. aureus Mu50
ucaacauuacuaauugau

SEQ ID NO: 2057255 - RNA, 20 nt, Staphylococcus aureus subsp. aureus Mu50
ucaacauguuccgcuacaaa

SEQ ID NO: 2057256 - RNA, 22 nt, Staphylococcus aureus subsp. aureus Mu50
ucaacauguuccgcuacaaaac

SEQ ID NO: 2057257 - RNA, 13 nt, Staphylococcus aureus subsp. aureus Mu50
ucaacaucaucuu

SEQ ID NO: 2057258 - RNA, 17 nt, Staphylococcus aureus subsp. aureus Mu50
ucaacaucaucuuuaau

SEQ ID NO: 2057259 - RNA, 19 nt, Staphylococcus aureus subsp. aureus Mu50
ucaacaucaucuuuaauuu

SEQ ID NO: 2057260 - RNA, 16 nt, Staphylococcus aureus subsp. aureus Mu50
ucaacaucaugaacuu

SEQ ID NO: 2057261 - RNA, 16 nt, Staphylococcus aureus subsp. aureus Mu50
ucaacauaaaauuuaa

SEQ ID NO: 2057262 - RNA, 19 nt, Staphylococcus aureus subsp. aureus Mu50
ucaacauaacucaaauauc

SEQ ID NO: 2057263 - RNA, 14 nt, Staphylococcus aureus subsp. aureus Mu50
ucaacaguuucuug

SEQ ID NO: 2057264 - RNA, 17 nt, Staphylococcus aureus subsp. aureus Mu50
ucaacauaaaauuuaaa

SEQ ID NO: 2057265 - RNA, 21 nt, Staphylococcus aureus subsp. aureus Mu50
ucaacuaauuuaaagcaucau

SEQ ID NO: 2057266 - RNA, 22 nt, Staphylococcus aureus subsp. aureus Mu50
ucaacuucgauaugauuaaagc

SEQ ID NO: 2057267 - RNA, 15 nt, Staphylococcus aureus subsp. aureus Mu50
ucaacgccauauuua

SEQ ID NO: 2057268 - RNA, 19 nt, Staphylococcus aureus subsp. aureus Mu50
ucaaccuuuuaauaguacu

SEQ ID NO: 2057269 - RNA, 17 nt, Staphylococcus aureus subsp. aureus Mu50
ucaaccuguucuuuauu

SEQ ID NO: 2057270 - RNA, 21 nt, Staphylococcus aureus subsp. aureus Mu50
ucaaccuguucuuuauuuaaa

SEQ ID NO: 2057271 - RNA, 18 nt, Staphylococcus aureus subsp. aureus Mu50
uauuuaauuuuucuaaau

SEQ ID NO: 2057272 - RNA, 16 nt, Staphylococcus aureus subsp. aureus Mu50
ucaaaacguuuaauug

SEQ ID NO: 2057273 - RNA, 16 nt, Staphylococcus aureus subsp. aureus Mu50
uauuuaauuuugauau

SEQ ID NO: 2057274 - RNA, 19 nt, Staphylococcus aureus subsp. aureus Mu50
uauuuaauuuugauauuuu

SEQ ID NO: 2057275 - RNA, 19 nt, Staphylococcus aureus subsp. aureus Mu50
ucaaaaucggauuaacauu

SEQ ID NO: 2057276 - RNA, 14 nt, Staphylococcus aureus subsp. aureus Mu50
ucaaaauuaugacu

SEQ ID NO: 2057277 - RNA, 23 nt, Staphylococcus aureus subsp. aureus Mu50
ucaaaauuaugacuaacauuggu

SEQ ID NO: 2057278 - RNA, 13 nt, Staphylococcus aureus subsp. aureus Mu50
ucaaaauucaaua

SEQ ID NO: 2057279 - RNA, 21 nt, Staphylococcus aureus subsp. aureus Mu50
ucaaaauguuuaacaauaaua

SEQ ID NO: 2057280 - RNA, 20 nt, Staphylococcus aureus subsp. aureus Mu50
ucaaaauuaaagcuuaauua

SEQ ID NO: 2057281 - RNA, 19 nt, Staphylococcus aureus subsp. aureus Mu50
ucaaacaguccuuauuaua

SEQ ID NO: 2057282 - RNA, 14 nt, Staphylococcus aureus subsp. aureus Mu50
ucaaacagacuuaa

SEQ ID NO: 2057283 - RNA, 13 nt, Staphylococcus aureus subsp. aureus Mu50
ucaaacaauaaag

SEQ ID NO: 2057284 - RNA, 23 nt, Staphylococcus aureus subsp. aureus Mu50
ucaaacaaaucuuuuaaauuuag

SEQ ID NO: 2057285 - RNA, 21 nt, Staphylococcus aureus subsp. aureus Mu50
ucaaaauuucgauuuucacca

SEQ ID NO: 2057286 - RNA, 13 nt, Staphylococcus aureus subsp. aureus Mu50
ucaaaauuuugac

SEQ ID NO: 2057287 - RNA, 18 nt, Staphylococcus aureus subsp. aureus Mu50
ucaaaauuguggcuacua

SEQ ID NO: 2057288 - RNA, 21 nt, Staphylococcus aureus subsp. aureus Mu50
ucaaaccaucuuaucuuuaug

SEQ ID NO: 2057289 - RNA, 13 nt, Staphylococcus aureus subsp. aureus Mu50
ucaacaaacauaa

SEQ ID NO: 2057290 - RNA, 14 nt, Staphylococcus aureus subsp. aureus Mu50
ucaaauugguuuuc

SEQ ID NO: 2057291 - RNA, 19 nt, Staphylococcus aureus subsp. aureus Mu50
ucaaauuuaccaguuugau

SEQ ID NO: 2057292 - RNA, 23 nt, Staphylococcus aureus subsp. aureus Mu50
ucaaauugguuuucaugugucau

SEQ ID NO: 2057293 - RNA, 16 nt, Staphylococcus aureus subsp. aureus Mu50
ucaaauugaacuucuu

SEQ ID NO: 2057294 - RNA, 17 nt, Staphylococcus aureus subsp. aureus Mu50
ucaaauguaacauuaaa

SEQ ID NO: 2057295 - RNA, 21 nt, Staphylococcus aureus subsp. aureus Mu50
ucaaauguaacauuaaaaaua

SEQ ID NO: 2057296 - RNA, 19 nt, Staphylococcus aureus subsp. aureus Mu50
ucaaauucucaauuaauuu

SEQ ID NO: 2057297 - RNA, 20 nt, Staphylococcus aureus subsp. aureus Mu50
ucaaauucaacgucaucaaa

SEQ ID NO: 2057298 - RNA, 22 nt, Staphylococcus aureus subsp. aureus Mu50
ucaaauucaucaguaccaaaga

SEQ ID NO: 2057299 - RNA, 18 nt, Staphylococcus aureus subsp. aureus Mu50
ucaaagcuauauaugaau

SEQ ID NO: 2057300 - RNA, 22 nt, Staphylococcus aureus subsp. aureus Mu50
ucaaauagacaccaaaaaacag

SEQ ID NO: 2057301 - RNA, 17 nt, Staphylococcus aureus subsp. aureus Mu50
ucaaauaggcauaauga

SEQ ID NO: 2057302 - RNA, 14 nt, Staphylococcus aureus subsp. aureus Mu50
ucaaacuuaucgcc

SEQ ID NO: 2057303 - RNA, 15 nt, Staphylococcus aureus subsp. aureus Mu50
ucaaacuuaaaacua

SEQ ID NO: 2057304 - RNA, 16 nt, Staphylococcus aureus subsp. aureus Mu50
ucaaacuuaaaacuau

SEQ ID NO: 2057305 - RNA, 22 nt, Staphylococcus aureus subsp. aureus Mu50
ucaaagccugucggaauugguu

SEQ ID NO: 2057306 - RNA, 21 nt, Staphylococcus aureus subsp. aureus Mu50
ucaaagcgauaaaguaugagu

SEQ ID NO: 2057307 - RNA, 13 nt, Staphylococcus aureus subsp. aureus Mu50
ucacuaucagcuu

SEQ ID NO: 2057308 - RNA, 13 nt, Staphylococcus aureus subsp. aureus Mu50
ucacuauacaauc

SEQ ID NO: 2057309 - RNA, 16 nt, Staphylococcus aureus subsp. aureus Mu50
ucacuaggauguucau

SEQ ID NO: 2057310 - RNA, 18 nt, Staphylococcus aureus subsp. aureus Mu50
ucacuagauaguuuauac

SEQ ID NO: 2057311 - RNA, 19 nt, Staphylococcus aureus subsp. aureus Mu50
ucacuaggauguucaucaa

SEQ ID NO: 2057312 - RNA, 18 nt, Staphylococcus aureus subsp. aureus Mu50
ucacguugugcaauaccu

SEQ ID NO: 2057313 - RNA, 20 nt, Staphylococcus aureus subsp. aureus Mu50
ucacuaaaaauauauuucaa

SEQ ID NO: 2057314 - RNA, 16 nt, Staphylococcus aureus subsp. aureus Mu50
ucacgcuuauucgaac

SEQ ID NO: 2057315 - RNA, 21 nt, Staphylococcus aureus subsp. aureus Mu50
ucacuguauggucuggaauaa

SEQ ID NO: 2057316 - RNA, 16 nt, Staphylococcus aureus subsp. aureus Mu50
ucacuguagauucaaa

SEQ ID NO: 2057317 - RNA, 22 nt, Staphylococcus aureus subsp. aureus Mu50
ucacugcuguuuuuauuauaau

SEQ ID NO: 2057318 - RNA, 22 nt, Staphylococcus aureus subsp. aureus Mu50
ucacugcaaacacaguacaaau

SEQ ID NO: 2057319 - RNA, 17 nt, Staphylococcus aureus subsp. aureus Mu50
ucacugcacuuaugaua

SEQ ID NO: 2057320 - RNA, 15 nt, Staphylococcus aureus subsp. aureus Mu50
ucacuuuaacuucuu

SEQ ID NO: 2057321 - RNA, 17 nt, Staphylococcus aureus subsp. aureus Mu50
ucacuuuauuaaauaac

SEQ ID NO: 2057322 - RNA, 15 nt, Staphylococcus aureus subsp. aureus Mu50
ucagaacuaugaaua

SEQ ID NO: 2057323 - RNA, 16 nt, Staphylococcus aureus subsp. aureus Mu50
ucagaaucaaguaauu

SEQ ID NO: 2057324 - RNA, 19 nt, Staphylococcus aureus subsp. aureus Mu50
ucagaaugaacuucucuua

SEQ ID NO: 2057325 - RNA, 15 nt, Staphylococcus aureus subsp. aureus Mu50
ucagaugauuuaauu

SEQ ID NO: 2057326 - RNA, 21 nt, Staphylococcus aureus subsp. aureus Mu50
ucagaugauuuaauucugguu

SEQ ID NO: 2057327 - RNA, 18 nt, Staphylococcus aureus subsp. aureus Mu50
aaaucgugcccauaugau

SEQ ID NO: 2057328 - RNA, 16 nt, Staphylococcus aureus subsp. aureus Mu50
aaaucuaauuauucau

SEQ ID NO: 2057329 - RNA, 14 nt, Staphylococcus aureus subsp. aureus Mu50
aaaucgguuugauu

SEQ ID NO: 2057330 - RNA, 15 nt, Staphylococcus aureus subsp. aureus Mu50
aaaucgguuugauua

SEQ ID NO: 2057331 - RNA, 22 nt, Staphylococcus aureus subsp. aureus Mu50
aaaucuacaauauuaaaauuaa

SEQ ID NO: 2057332 - RNA, 15 nt, Staphylococcus aureus subsp. aureus Mu50
aaaucuacaauauua

SEQ ID NO: 2057333 - RNA, 18 nt, Staphylococcus aureus subsp. aureus Mu50
aaaucuacaauauuaaaa

SEQ ID NO: 2057334 - RNA, 13 nt, Staphylococcus aureus subsp. aureus Mu50
ucagugcauuuuu

SEQ ID NO: 2057335 - RNA, 23 nt, Staphylococcus aureus subsp. aureus Mu50
ucagugcauuuuuuauuuuacuu

SEQ ID NO: 2057336 - RNA, 18 nt, Staphylococcus aureus subsp. aureus Mu50
ucaguauuuacuuuuccu

SEQ ID NO: 2057337 - RNA, 18 nt, Staphylococcus aureus subsp. aureus Mu50
ucaggcuuuguuuuucac

SEQ ID NO: 2057338 - RNA, 18 nt, Staphylococcus aureus subsp. aureus Mu50
ucaggcuuaauuaauaaa

SEQ ID NO: 2057339 - RNA, 18 nt, Staphylococcus aureus subsp. aureus Mu50
ucaggaccaaauagagaa

SEQ ID NO: 2057340 - RNA, 22 nt, Staphylococcus aureus subsp. aureus Mu50
aaaucucgucacauauaaauau

SEQ ID NO: 2057341 - RNA, 16 nt, Staphylococcus aureus subsp. aureus Mu50
aaaucucauaauaauu

SEQ ID NO: 2057342 - RNA, 13 nt, Staphylococcus aureus subsp. aureus Mu50
aaaucuauauaaa

SEQ ID NO: 2057343 - RNA, 20 nt, Staphylococcus aureus subsp. aureus Mu50
aaaucuauaaauaucaauaa

SEQ ID NO: 2057344 - RNA, 16 nt, Staphylococcus aureus subsp. aureus Mu50
aaaucuaucuacucaa

SEQ ID NO: 2057345 - RNA, 18 nt, Staphylococcus aureus subsp. aureus Mu50
aaaucuaucuacucaaau

SEQ ID NO: 2057346 - RNA, 12 nt, Staphylococcus aureus subsp. aureus Mu50
aaaucuauaaau

SEQ ID NO: 2057347 - RNA, 21 nt, Staphylococcus aureus subsp. aureus Mu50
ucagcauugggacauaaaauu

SEQ ID NO: 2057348 - RNA, 15 nt, Staphylococcus aureus subsp. aureus Mu50
ucagcgucauauguu

SEQ ID NO: 2057349 - RNA, 21 nt, Staphylococcus aureus subsp. aureus Mu50
guggcuacuugaauaccuuuu

SEQ ID NO: 2057350 - RNA, 22 nt, Staphylococcus aureus subsp. aureus Mu50
guggcaccucuuuuguuuagua

SEQ ID NO: 2057351 - RNA, 20 nt, Staphylococcus aureus subsp. aureus Mu50
guggaaaucucggcauuuuu

SEQ ID NO: 2057352 - RNA, 15 nt, Staphylococcus aureus subsp. aureus Mu50
guggaaagucagcuu

SEQ ID NO: 2057353 - RNA, 15 nt, Staphylococcus aureus subsp. aureus Mu50
gugcuguuaucaugg

SEQ ID NO: 2057354 - RNA, 19 nt, Staphylococcus aureus subsp. aureus Mu50
aaauauaccaaccaaaacc

SEQ ID NO: 2057355 - RNA, 19 nt, Staphylococcus aureus subsp. aureus Mu50
aaauauaauguauaaaaca

SEQ ID NO: 2057356 - RNA, 15 nt, Staphylococcus aureus subsp. aureus Mu50
aaauauaccaaccaa

SEQ ID NO: 2057357 - RNA, 20 nt, Staphylococcus aureus subsp. aureus Mu50
aaauauaauagaaauaauca

SEQ ID NO: 2057358 - RNA, 15 nt, Staphylococcus aureus subsp. aureus Mu50
aaauauaaauaaaag

SEQ ID NO: 2057359 - RNA, 12 nt, Staphylococcus aureus subsp. aureus Mu50
aaauauaaauuu

SEQ ID NO: 2057360 - RNA, 21 nt, Staphylococcus aureus subsp. aureus Mu50
aaauauaauacuguauuuuaa

SEQ ID NO: 2057361 - RNA, 18 nt, Staphylococcus aureus subsp. aureus Mu50
guguucgggaauuuuuua

SEQ ID NO: 2057362 - RNA, 15 nt, Staphylococcus aureus subsp. aureus Mu50
guguuaugaauuaga

SEQ ID NO: 2057363 - RNA, 17 nt, Staphylococcus aureus subsp. aureus Mu50
guguuauauuguauuuu

SEQ ID NO: 2057364 - RNA, 21 nt, Staphylococcus aureus subsp. aureus Mu50
aaauauccuggaauauuaaca

SEQ ID NO: 2057365 - RNA, 20 nt, Staphylococcus aureus subsp. aureus Mu50
aaauaucgacaaauuaaaaa

SEQ ID NO: 2057366 - RNA, 15 nt, Staphylococcus aureus subsp. aureus Mu50
aaauaucauaaaugc

SEQ ID NO: 2057367 - RNA, 15 nt, Staphylococcus aureus subsp. aureus Mu50
aaauaucaugcaaaa

SEQ ID NO: 2057368 - RNA, 18 nt, Staphylococcus aureus subsp. aureus Mu50
aaauaucaugcaaaacua

SEQ ID NO: 2057369 - RNA, 19 nt, Staphylococcus aureus subsp. aureus Mu50
aaauaucaugcaaaacuaa

SEQ ID NO: 2057370 - RNA, 15 nt, Staphylococcus aureus subsp. aureus Mu50
aaauauauuuguaua

SEQ ID NO: 2057371 - RNA, 18 nt, Staphylococcus aureus subsp. aureus Mu50
aaauauaucuagccugaa

SEQ ID NO: 2057372 - RNA, 15 nt, Staphylococcus aureus subsp. aureus Mu50
gugugauuuuggaac

SEQ ID NO: 2057373 - RNA, 20 nt, Staphylococcus aureus subsp. aureus Mu50
gugugcaggauaacguucac

SEQ ID NO: 2057374 - RNA, 23 nt, Staphylococcus aureus subsp. aureus Mu50
aaauauauaaggcgcucucuuuu

SEQ ID NO: 2057375 - RNA, 18 nt, Staphylococcus aureus subsp. aureus Mu50
guguggauuuaauuuuua

SEQ ID NO: 2057376 - RNA, 13 nt, Staphylococcus aureus subsp. aureus Mu50
gugguguuuauau

SEQ ID NO: 2057377 - RNA, 22 nt, Staphylococcus aureus subsp. aureus Mu50
guguacguuaaucagugaaaua

SEQ ID NO: 2057378 - RNA, 19 nt, Staphylococcus aureus subsp. aureus Mu50
gugucuaacgcuguuucaa

SEQ ID NO: 2057379 - RNA, 19 nt, Staphylococcus aureus subsp. aureus Mu50
guguagauaaaucgauaaa

SEQ ID NO: 2057380 - RNA, 15 nt, Staphylococcus aureus subsp. aureus Mu50
guucacguuaucaua

SEQ ID NO: 2057381 - RNA, 21 nt, Staphylococcus aureus subsp. aureus Mu50
guuauuuuugcuauuucaaca

SEQ ID NO: 2057382 - RNA, 17 nt, Staphylococcus aureus subsp. aureus Mu50
guuauuguuccaaucuu

SEQ ID NO: 2057383 - RNA, 18 nt, Staphylococcus aureus subsp. aureus Mu50
guuauuuauacagugaau

SEQ ID NO: 2057384 - RNA, 15 nt, Staphylococcus aureus subsp. aureus Mu50
guuaggagagaugua

SEQ ID NO: 2057385 - RNA, 12 nt, Staphylococcus aureus subsp. aureus Mu50
guuaggauaaag

SEQ ID NO: 2057386 - RNA, 15 nt, Staphylococcus aureus subsp. aureus Mu50
guuagggaaauguag

SEQ ID NO: 2057387 - RNA, 19 nt, Staphylococcus aureus subsp. aureus Mu50
guuaggcgacuuaacuuaa

SEQ ID NO: 2057388 - RNA, 23 nt, Staphylococcus aureus subsp. aureus Mu50
guuacuauacaugguacugcuuc

SEQ ID NO: 2057389 - RNA, 21 nt, Staphylococcus aureus subsp. aureus Mu50
guuaccuacuacauucuaugu

SEQ ID NO: 2057390 - RNA, 20 nt, Staphylococcus aureus subsp. aureus Mu50
guuaggggcuuuuaugcaug

SEQ ID NO: 2057391 - RNA, 12 nt, Staphylococcus aureus subsp. aureus Mu50
guuauauuaaac

SEQ ID NO: 2057392 - RNA, 14 nt, Staphylococcus aureus subsp. aureus Mu50
guuauauuaagguc

SEQ ID NO: 2057393 - RNA, 15 nt, Staphylococcus aureus subsp. aureus Mu50
guuauauaaauaggc

SEQ ID NO: 2057394 - RNA, 14 nt, Staphylococcus aureus subsp. aureus Mu50
guuauauauuccuu

SEQ ID NO: 2057395 - RNA, 22 nt, Staphylococcus aureus subsp. aureus Mu50
guuauauuguauuuuauuuauu

SEQ ID NO: 2057396 - RNA, 18 nt, Staphylococcus aureus subsp. aureus Mu50
guuauguaaauaacaguu

SEQ ID NO: 2057397 - RNA, 22 nt, Staphylococcus aureus subsp. aureus Mu50
guuaaaaaauauguauguuuua

SEQ ID NO: 2057398 - RNA, 14 nt, Staphylococcus aureus subsp. aureus Mu50
guuaaaaaauaugu

SEQ ID NO: 2057399 - RNA, 16 nt, Staphylococcus aureus subsp. aureus Mu50
guuaaaaaauauguau

SEQ ID NO: 2057400 - RNA, 16 nt, Staphylococcus aureus subsp. aureus Mu50
guuaaaaccuuuucaa

SEQ ID NO: 2057401 - RNA, 17 nt, Staphylococcus aureus subsp. aureus Mu50
guuaaaauaaugucuua

SEQ ID NO: 2057402 - RNA, 19 nt, Staphylococcus aureus subsp. aureus Mu50
guuaacauuugucauaaua

SEQ ID NO: 2057403 - RNA, 21 nt, Staphylococcus aureus subsp. aureus Mu50
guuaacauuugucauaauaga

SEQ ID NO: 2057404 - RNA, 18 nt, Staphylococcus aureus subsp. aureus Mu50
guuaaccauacauaugcu

SEQ ID NO: 2057405 - RNA, 14 nt, Staphylococcus aureus subsp. aureus Mu50
guuaaccauacaua

SEQ ID NO: 2057406 - RNA, 14 nt, Staphylococcus aureus subsp. aureus Mu50
guuaauguauaaaa

SEQ ID NO: 2057407 - RNA, 16 nt, Staphylococcus aureus subsp. aureus Mu50
guuaaugugcauuuau

SEQ ID NO: 2057408 - RNA, 18 nt, Staphylococcus aureus subsp. aureus Mu50
guuaaugugcauuuaucu

SEQ ID NO: 2057409 - RNA, 16 nt, Staphylococcus aureus subsp. aureus Mu50
guuaaguauuuaaaua

SEQ ID NO: 2057410 - RNA, 18 nt, Staphylococcus aureus subsp. aureus Mu50
guuaaguauuuaaauaac

SEQ ID NO: 2057411 - RNA, 16 nt, Staphylococcus aureus subsp. aureus Mu50
guuaauuauguauuuu

SEQ ID NO: 2057412 - RNA, 15 nt, Staphylococcus aureus subsp. aureus Mu50
guucucgucuuucgu

SEQ ID NO: 2057413 - RNA, 21 nt, Staphylococcus aureus subsp. aureus Mu50
guucuaaccauucguaauaaa

SEQ ID NO: 2057414 - RNA, 17 nt, Staphylococcus aureus subsp. aureus Mu50
guucuccaccaaaugug

SEQ ID NO: 2057415 - RNA, 19 nt, Staphylococcus aureus subsp. aureus Mu50
guucuaguuuuuuuuauau

SEQ ID NO: 2057416 - RNA, 14 nt, Staphylococcus aureus subsp. aureus Mu50
guugcuucuuauca

SEQ ID NO: 2057417 - RNA, 17 nt, Staphylococcus aureus subsp. aureus Mu50
guugguauuaauuuuuc

SEQ ID NO: 2057418 - RNA, 21 nt, Staphylococcus aureus subsp. aureus Mu50
guugcugaauaaaauauaucu

SEQ ID NO: 2057419 - RNA, 13 nt, Staphylococcus aureus subsp. aureus Mu50
guugcucgugcau

SEQ ID NO: 2057420 - RNA, 14 nt, Staphylococcus aureus subsp. aureus Mu50
guuuaauuaaaaua

SEQ ID NO: 2057421 - RNA, 20 nt, Staphylococcus aureus subsp. aureus Mu50
guuuaauuaaaauacaaauu

SEQ ID NO: 2057422 - RNA, 19 nt, Staphylococcus aureus subsp. aureus Mu50
guuuaaucgcauuguuaaa

SEQ ID NO: 2057423 - RNA, 19 nt, Staphylococcus aureus subsp. aureus Mu50
guuuaaauuuaaaagaaaa

SEQ ID NO: 2057424 - RNA, 15 nt, Staphylococcus aureus subsp. aureus Mu50
guuuaacaacacuac

SEQ ID NO: 2057425 - RNA, 20 nt, Staphylococcus aureus subsp. aureus Mu50
guuuaaaugugcaauuagaa

SEQ ID NO: 2057426 - RNA, 15 nt, Staphylococcus aureus subsp. aureus Mu50
guuuaauaaugguuc

SEQ ID NO: 2057427 - RNA, 16 nt, Staphylococcus aureus subsp. aureus Mu50
guuuaauaaugguucu

SEQ ID NO: 2057428 - RNA, 17 nt, Staphylococcus aureus subsp. aureus Mu50
guuuaagauuuuaucuu

SEQ ID NO: 2057429 - RNA, 19 nt, Staphylococcus aureus subsp. aureus Mu50
guuuaucuguaucaaaauc

SEQ ID NO: 2057430 - RNA, 18 nt, Staphylococcus aureus subsp. aureus Mu50
guuuaucugaauuuuacu

SEQ ID NO: 2057431 - RNA, 23 nt, Staphylococcus aureus subsp. aureus Mu50
guuuaucgaucgguauuuucauu

SEQ ID NO: 2057432 - RNA, 15 nt, Staphylococcus aureus subsp. aureus Mu50
guuuaucaauuucuc

SEQ ID NO: 2057433 - RNA, 22 nt, Staphylococcus aureus subsp. aureus Mu50
guuucaaugaguucuaguuuuu

SEQ ID NO: 2057434 - RNA, 23 nt, Staphylococcus aureus subsp. aureus Mu50
guuucaacauuucagcauuugcu

SEQ ID NO: 2057435 - RNA, 15 nt, Staphylococcus aureus subsp. aureus Mu50
guuucaagugcuugg

SEQ ID NO: 2057436 - RNA, 21 nt, Staphylococcus aureus subsp. aureus Mu50
guuucaagcguuucuugaucu

SEQ ID NO: 2057437 - RNA, 17 nt, Staphylococcus aureus subsp. aureus Mu50
aaauaucuaaacaauuc

SEQ ID NO: 2057438 - RNA, 18 nt, Staphylococcus aureus subsp. aureus Mu50
aaauaucuuuuuguuuau

SEQ ID NO: 2057439 - RNA, 16 nt, Staphylococcus aureus subsp. aureus Mu50
aaauaugauguuaaaa

SEQ ID NO: 2057440 - RNA, 18 nt, Staphylococcus aureus subsp. aureus Mu50
aaauaugauguuaaaaaa

SEQ ID NO: 2057441 - RNA, 13 nt, Staphylococcus aureus subsp. aureus Mu50
aaauaugauuuaa

SEQ ID NO: 2057442 - RNA, 18 nt, Staphylococcus aureus subsp. aureus Mu50
aaauaugaauaaugcaau

SEQ ID NO: 2057443 - RNA, 22 nt, Staphylococcus aureus subsp. aureus Mu50
aaauaugacgcgugaauuaaaa

SEQ ID NO: 2057444 - RNA, 16 nt, Staphylococcus aureus subsp. aureus Mu50
aaauaugacacauaca

SEQ ID NO: 2057445 - RNA, 15 nt, Staphylococcus aureus subsp. aureus Mu50
guuucacguaaugaa

SEQ ID NO: 2057446 - RNA, 12 nt, Staphylococcus aureus subsp. aureus Mu50
aaauauucuuau

SEQ ID NO: 2057447 - RNA, 19 nt, Staphylococcus aureus subsp. aureus Mu50
guuucauaugcaucaacag

SEQ ID NO: 2057448 - RNA, 13 nt, Staphylococcus aureus subsp. aureus Mu50
guuuccaaucuau

SEQ ID NO: 2057449 - RNA, 22 nt, Staphylococcus aureus subsp. aureus Mu50
aaauauuaauauaaaauaaagu

SEQ ID NO: 2057450 - RNA, 16 nt, Staphylococcus aureus subsp. aureus Mu50
aaauauuacuaacaac

SEQ ID NO: 2057451 - RNA, 23 nt, Staphylococcus aureus subsp. aureus Mu50
aaauauguaaucagguuuaaaca

SEQ ID NO: 2057452 - RNA, 21 nt, Staphylococcus aureus subsp. aureus Mu50
aaauauguauguuuuaucaau

SEQ ID NO: 2057453 - RNA, 23 nt, Staphylococcus aureus subsp. aureus Mu50
aaauauguauguuuuaucaauau

SEQ ID NO: 2057454 - RNA, 12 nt, Staphylococcus aureus subsp. aureus Mu50
aaauauuaaaaa

SEQ ID NO: 2057455 - RNA, 14 nt, Staphylococcus aureus subsp. aureus Mu50
aaauauuaaauuau

SEQ ID NO: 2057456 - RNA, 15 nt, Staphylococcus aureus subsp. aureus Mu50
aaauauuaaauuaug

SEQ ID NO: 2057457 - RNA, 19 nt, Staphylococcus aureus subsp. aureus Mu50
aaauauggaauuucauaua

SEQ ID NO: 2057458 - RNA, 15 nt, Staphylococcus aureus subsp. aureus Mu50
guuuuauagcauuuc

SEQ ID NO: 2057459 - RNA, 20 nt, Staphylococcus aureus subsp. aureus Mu50
aaaucaguuuuuaaaucaaa

SEQ ID NO: 2057460 - RNA, 17 nt, Staphylococcus aureus subsp. aureus Mu50
aaaucauacgagaaauu

SEQ ID NO: 2057461 - RNA, 21 nt, Staphylococcus aureus subsp. aureus Mu50
aaaucauacgagaaauuagaa

SEQ ID NO: 2057462 - RNA, 18 nt, Staphylococcus aureus subsp. aureus Mu50
aaaucauucauuugcaaa

SEQ ID NO: 2057463 - RNA, 16 nt, Staphylococcus aureus subsp. aureus Mu50
aaauccaaaaucuuua

SEQ ID NO: 2057464 - RNA, 14 nt, Staphylococcus aureus subsp. aureus Mu50
aaaucauucuuuau

SEQ ID NO: 2057465 - RNA, 15 nt, Staphylococcus aureus subsp. aureus Mu50
guuuuauuuauaaac

SEQ ID NO: 2057466 - RNA, 22 nt, Staphylococcus aureus subsp. aureus Mu50
guuuucacuucgccaagccauc

SEQ ID NO: 2057467 - RNA, 17 nt, Staphylococcus aureus subsp. aureus Mu50
guuuucacuguuuuauc

SEQ ID NO: 2057468 - RNA, 22 nt, Staphylococcus aureus subsp. aureus Mu50
guuuucaauucgcauuaaauaa

SEQ ID NO: 2057469 - RNA, 19 nt, Staphylococcus aureus subsp. aureus Mu50
guuuugcaacauuuugagu

SEQ ID NO: 2057470 - RNA, 12 nt, Staphylococcus aureus subsp. aureus Mu50
guuuugcuaacc

SEQ ID NO: 2057471 - RNA, 20 nt, Staphylococcus aureus subsp. aureus Mu50
guuuugagagauuauuuaaa

SEQ ID NO: 2057472 - RNA, 15 nt, Staphylococcus aureus subsp. aureus Mu50
guuuugaagaauaaa

SEQ ID NO: 2057473 - RNA, 14 nt, Staphylococcus aureus subsp. aureus Mu50
guuucugacuuuua

SEQ ID NO: 2057474 - RNA, 19 nt, Staphylococcus aureus subsp. aureus Mu50
guuucugacuuuuaaaaaa

SEQ ID NO: 2057475 - RNA, 16 nt, Staphylococcus aureus subsp. aureus Mu50
guuucuucaauugucu

SEQ ID NO: 2057476 - RNA, 16 nt, Staphylococcus aureus subsp. aureus Mu50
guuucuggcucuucuu

SEQ ID NO: 2057477 - RNA, 13 nt, Staphylococcus aureus subsp. aureus Mu50
guuugaucauaau

SEQ ID NO: 2057478 - RNA, 16 nt, Staphylococcus aureus subsp. aureus Mu50
guuugaucauaauuca

SEQ ID NO: 2057479 - RNA, 14 nt, Staphylococcus aureus subsp. aureus Mu50
guuuguuuucuuuc

SEQ ID NO: 2057480 - RNA, 19 nt, Staphylococcus aureus subsp. aureus Mu50
guuuguuacauauugcauu

SEQ ID NO: 2057481 - RNA, 21 nt, Staphylococcus aureus subsp. aureus Mu50
guuugugguaaugauuuugcu

SEQ ID NO: 2057482 - RNA, 16 nt, Staphylococcus aureus subsp. aureus Mu50
guuuguuucuaaauuc

SEQ ID NO: 2057483 - RNA, 21 nt, Staphylococcus aureus subsp. aureus Mu50
guuucggaaaaagaugaaaaa

SEQ ID NO: 2057484 - RNA, 15 nt, Staphylococcus aureus subsp. aureus Mu50
aaaucaacuuuucua

SEQ ID NO: 2057485 - RNA, 13 nt, Staphylococcus aureus subsp. aureus Mu50
aaaucaauccauc

SEQ ID NO: 2057486 - RNA, 13 nt, Staphylococcus aureus subsp. aureus Mu50
aaaucaauguacu

SEQ ID NO: 2057487 - RNA, 16 nt, Staphylococcus aureus subsp. aureus Mu50
aaaucaauccaucaau

SEQ ID NO: 2057488 - RNA, 14 nt, Staphylococcus aureus subsp. aureus Mu50
guuucuaaauucuu

SEQ ID NO: 2057489 - RNA, 14 nt, Staphylococcus aureus subsp. aureus Mu50
guuucuccaguuuu

SEQ ID NO: 2057490 - RNA, 20 nt, Staphylococcus aureus subsp. aureus Mu50
guuucuccuacuauaaaauc

SEQ ID NO: 2057491 - RNA, 23 nt, Staphylococcus aureus subsp. aureus Mu50
aaaucacgauuuucaaguaauga

SEQ ID NO: 2057492 - RNA, 20 nt, Staphylococcus aureus subsp. aureus Mu50
aaaucaccuuuuuuaacuuu

SEQ ID NO: 2057493 - RNA, 14 nt, Staphylococcus aureus subsp. aureus Mu50
aaaucacgccauaa

SEQ ID NO: 2057494 - RNA, 18 nt, Staphylococcus aureus subsp. aureus Mu50
aaaucaccagauuuuaag

SEQ ID NO: 2057495 - RNA, 14 nt, Staphylococcus aureus subsp. aureus Mu50
aaaucaacaccaac

SEQ ID NO: 2057496 - RNA, 17 nt, Staphylococcus aureus subsp. aureus Mu50
aaaucaaauacaucaau

SEQ ID NO: 2057497 - RNA, 14 nt, Staphylococcus aureus subsp. aureus Mu50
aaaucaaagaggaa

SEQ ID NO: 2057498 - RNA, 11 nt, Staphylococcus aureus subsp. aureus Mu50
aaaucaaagag

SEQ ID NO: 2057499 - RNA, 18 nt, Staphylococcus aureus subsp. aureus Mu50
aaauauuuuuuaaaauga

SEQ ID NO: 2057500 - RNA, 16 nt, Staphylococcus aureus subsp. aureus Mu50
aaauauuuuuaauuau

SEQ ID NO: 2057501 - RNA, 22 nt, Staphylococcus aureus subsp. aureus Mu50
aaauauuuuuaauuauuuuaaa

SEQ ID NO: 2057502 - RNA, 14 nt, Staphylococcus aureus subsp. aureus Mu50
aaauauuuuuucug

SEQ ID NO: 2057503 - RNA, 15 nt, Staphylococcus aureus subsp. aureus Mu50
aaauauuuuuuaaaa

SEQ ID NO: 2057504 - RNA, 11 nt, Staphylococcus aureus subsp. aureus Mu50
guuucccaagc

SEQ ID NO: 2057505 - RNA, 17 nt, Staphylococcus aureus subsp. aureus Mu50
aaauauuugaaaauuuc

SEQ ID NO: 2057506 - RNA, 19 nt, Staphylococcus aureus subsp. aureus Mu50
aaauauuuaaccuuuaaaa

SEQ ID NO: 2057507 - RNA, 14 nt, Staphylococcus aureus subsp. aureus Mu50
aaauauuugaaaau

SEQ ID NO: 2057508 - RNA, 16 nt, Staphylococcus aureus subsp. aureus Mu50
aaauauuugaaaauuu

SEQ ID NO: 2057509 - RNA, 22 nt, Staphylococcus aureus subsp. aureus Mu50
aaauauuucuaaaccauuuuca

SEQ ID NO: 2057510 - RNA, 17 nt, Staphylococcus aureus subsp. aureus Mu50
aaauauucuuuaauaua

SEQ ID NO: 2057511 - RNA, 19 nt, Staphylococcus aureus subsp. aureus Mu50
aaauauugaagaugcuuua

SEQ ID NO: 2057512 - RNA, 17 nt, Staphylococcus aureus subsp. aureus Mu50
aaauauugauauaaaaa

SEQ ID NO: 2057513 - RNA, 17 nt, Staphylococcus aureus subsp. aureus Mu50
aaauauugaauaaucau

SEQ ID NO: 2057514 - RNA, 21 nt, Staphylococcus aureus subsp. aureus Mu50
aaauauugauucuagugaaau

SEQ ID NO: 2057515 - RNA, 17 nt, Staphylococcus aureus subsp. aureus Mu50
aaauauuguaaucacua

SEQ ID NO: 2057516 - RNA, 15 nt, Staphylococcus aureus subsp. aureus Mu50
aaauauuuaaaauau

SEQ ID NO: 2057517 - RNA, 16 nt, Staphylococcus aureus subsp. aureus Mu50
aaauagcguaauuauu

SEQ ID NO: 2057518 - RNA, 20 nt, Staphylococcus aureus subsp. aureus Mu50
aaauagcguaauuauuauaa

SEQ ID NO: 2057519 - RNA, 16 nt, Staphylococcus aureus subsp. aureus Mu50
aaauagcuguuugaua

SEQ ID NO: 2057520 - RNA, 15 nt, Staphylococcus aureus subsp. aureus Mu50
gugaaguaugauaga

SEQ ID NO: 2057521 - RNA, 23 nt, Staphylococcus aureus subsp. aureus Mu50
gugaauauaaguaaucauaauaa

SEQ ID NO: 2057522 - RNA, 20 nt, Staphylococcus aureus subsp. aureus Mu50
gugaaucuuauuuuguuuua

SEQ ID NO: 2057523 - RNA, 23 nt, Staphylococcus aureus subsp. aureus Mu50
gugaaucuuauuuuguuuuaaaa

SEQ ID NO: 2057524 - RNA, 12 nt, Staphylococcus aureus subsp. aureus Mu50
gugaaugguuga

SEQ ID NO: 2057525 - RNA, 21 nt, Staphylococcus aureus subsp. aureus Mu50
gugaauucgaugacuuuuuaa

SEQ ID NO: 2057526 - RNA, 17 nt, Staphylococcus aureus subsp. aureus Mu50
gugaccucagguuguua

SEQ ID NO: 2057527 - RNA, 21 nt, Staphylococcus aureus subsp. aureus Mu50
gugaccaauagaauucauuaa

SEQ ID NO: 2057528 - RNA, 21 nt, Staphylococcus aureus subsp. aureus Mu50
aaauaguucuuuaaauuauau

SEQ ID NO: 2057529 - RNA, 20 nt, Staphylococcus aureus subsp. aureus Mu50
aaauaguucaaauggacuaa

SEQ ID NO: 2057530 - RNA, 19 nt, Staphylococcus aureus subsp. aureus Mu50
aaauaguucuuuaaauuau

SEQ ID NO: 2057531 - RNA, 17 nt, Staphylococcus aureus subsp. aureus Mu50
aaauaguucaaaauacu

SEQ ID NO: 2057532 - RNA, 19 nt, Staphylococcus aureus subsp. aureus Mu50
aaauaguucaaaauacuca

SEQ ID NO: 2057533 - RNA, 14 nt, Staphylococcus aureus subsp. aureus Mu50
aaauaguaagguuu

SEQ ID NO: 2057534 - RNA, 16 nt, Staphylococcus aureus subsp. aureus Mu50
gugauaaauaaugcau

SEQ ID NO: 2057535 - RNA, 15 nt, Staphylococcus aureus subsp. aureus Mu50
gugauaauuaaaaua

SEQ ID NO: 2057536 - RNA, 22 nt, Staphylococcus aureus subsp. aureus Mu50
gugauaauuaaaauaagauaua

SEQ ID NO: 2057537 - RNA, 11 nt, Staphylococcus aureus subsp. aureus Mu50
gugauaaaaau

SEQ ID NO: 2057538 - RNA, 14 nt, Staphylococcus aureus subsp. aureus Mu50
gugagguaaaacua

SEQ ID NO: 2057539 - RNA, 15 nt, Staphylococcus aureus subsp. aureus Mu50
gugaggcccauaaau

SEQ ID NO: 2057540 - RNA, 15 nt, Staphylococcus aureus subsp. aureus Mu50
gugacucaaugaauu

SEQ ID NO: 2057541 - RNA, 21 nt, Staphylococcus aureus subsp. aureus Mu50
gugauuucccacgugccucau

SEQ ID NO: 2057542 - RNA, 22 nt, Staphylococcus aureus subsp. aureus Mu50
gugcaauaauaaauaggaugaa

SEQ ID NO: 2057543 - RNA, 18 nt, Staphylococcus aureus subsp. aureus Mu50
gugcaauaauaaauagga

SEQ ID NO: 2057544 - RNA, 19 nt, Staphylococcus aureus subsp. aureus Mu50
gugaucuuuuuuauauuca

SEQ ID NO: 2057545 - RNA, 20 nt, Staphylococcus aureus subsp. aureus Mu50
gugcaauuaauguaaugaua

SEQ ID NO: 2057546 - RNA, 17 nt, Staphylococcus aureus subsp. aureus Mu50
aaauagccauauucaua

SEQ ID NO: 2057547 - RNA, 22 nt, Staphylococcus aureus subsp. aureus Mu50
aaauagccauauucauauuacu

SEQ ID NO: 2057548 - RNA, 23 nt, Staphylococcus aureus subsp. aureus Mu50
gugaaaguacuuggaaaauacua

SEQ ID NO: 2057549 - RNA, 21 nt, Staphylococcus aureus subsp. aureus Mu50
gugaaaauuuauucaaaucau

SEQ ID NO: 2057550 - RNA, 22 nt, Staphylococcus aureus subsp. aureus Mu50
gugaaaacccugaagauaauag

SEQ ID NO: 2057551 - RNA, 14 nt, Staphylococcus aureus subsp. aureus Mu50
gucuuuugauuuuu

SEQ ID NO: 2057552 - RNA, 22 nt, Staphylococcus aureus subsp. aureus Mu50
gucuuuuuacugacucuuaauu

SEQ ID NO: 2057553 - RNA, 12 nt, Staphylococcus aureus subsp. aureus Mu50
gucuuuuuauuu

SEQ ID NO: 2057554 - RNA, 15 nt, Staphylococcus aureus subsp. aureus Mu50
gucuuguaaacuucu

SEQ ID NO: 2057555 - RNA, 14 nt, Staphylococcus aureus subsp. aureus Mu50
gucuugugauaauu

SEQ ID NO: 2057556 - RNA, 16 nt, Staphylococcus aureus subsp. aureus Mu50
gucuugugauaauucu

SEQ ID NO: 2057557 - RNA, 20 nt, Staphylococcus aureus subsp. aureus Mu50
gucuuguggcacauaaccga

SEQ ID NO: 2057558 - RNA, 13 nt, Staphylococcus aureus subsp. aureus Mu50
gucuuucuaaguu

SEQ ID NO: 2057559 - RNA, 20 nt, Staphylococcus aureus subsp. aureus Mu50
gucuuucucggcgauaaaau

SEQ ID NO: 2057560 - RNA, 19 nt, Staphylococcus aureus subsp. aureus Mu50
gucuuuauguuugauuuua

SEQ ID NO: 2057561 - RNA, 12 nt, Staphylococcus aureus subsp. aureus Mu50
gucuuaaacaua

SEQ ID NO: 2057562 - RNA, 22 nt, Staphylococcus aureus subsp. aureus Mu50
gucuuaacaaauuaaaaaggua

SEQ ID NO: 2057563 - RNA, 13 nt, Staphylococcus aureus subsp. aureus Mu50
gucuuaauucauu

SEQ ID NO: 2057564 - RNA, 18 nt, Staphylococcus aureus subsp. aureus Mu50
gucuuacuuuuaaauuaa

SEQ ID NO: 2057565 - RNA, 16 nt, Staphylococcus aureus subsp. aureus Mu50
gucuugcaauaccucc

SEQ ID NO: 2057566 - RNA, 22 nt, Staphylococcus aureus subsp. aureus Mu50
gucuugauggugguaccacaua

SEQ ID NO: 2057567 - RNA, 14 nt, Staphylococcus aureus subsp. aureus Mu50
gucuucucuaucag

SEQ ID NO: 2057568 - RNA, 21 nt, Staphylococcus aureus subsp. aureus Mu50
gucuccacacuaaauguucug

SEQ ID NO: 2057569 - RNA, 16 nt, Staphylococcus aureus subsp. aureus Mu50
gucguuguaaaacuaa

SEQ ID NO: 2057570 - RNA, 19 nt, Staphylococcus aureus subsp. aureus Mu50
gucugaugucgaaaauagc

SEQ ID NO: 2057571 - RNA, 20 nt, Staphylococcus aureus subsp. aureus Mu50
gucugaauuagauuuuguug

SEQ ID NO: 2057572 - RNA, 23 nt, Staphylococcus aureus subsp. aureus Mu50
gucuguaaauuaucuaaagaaau

SEQ ID NO: 2057573 - RNA, 20 nt, Staphylococcus aureus subsp. aureus Mu50
gucgcuucuucuucagaaau

SEQ ID NO: 2057574 - RNA, 15 nt, Staphylococcus aureus subsp. aureus Mu50
gucgucucaauaucu

SEQ ID NO: 2057575 - RNA, 19 nt, Staphylococcus aureus subsp. aureus Mu50
guccuuuaguguguuuaaa

SEQ ID NO: 2057576 - RNA, 22 nt, Staphylococcus aureus subsp. aureus Mu50
gucgauaaauaugauguuaaaa

SEQ ID NO: 2057577 - RNA, 14 nt, Staphylococcus aureus subsp. aureus Mu50
guccggggccccaa

SEQ ID NO: 2057578 - RNA, 17 nt, Staphylococcus aureus subsp. aureus Mu50
gucccauaaaagacaga

SEQ ID NO: 2057579 - RNA, 17 nt, Staphylococcus aureus subsp. aureus Mu50
guccgcuuuuucauaga

SEQ ID NO: 2057580 - RNA, 19 nt, Staphylococcus aureus subsp. aureus Mu50
gucaauuucuuuaaagucu

SEQ ID NO: 2057581 - RNA, 19 nt, Staphylococcus aureus subsp. aureus Mu50
ggugaaaguacuuggaaaa

SEQ ID NO: 2057582 - RNA, 12 nt, Staphylococcus aureus subsp. aureus Mu50
gucaacugcugc

SEQ ID NO: 2057583 - RNA, 23 nt, Staphylococcus aureus subsp. aureus Mu50
gucaacuuagcuuagucaaugua

SEQ ID NO: 2057584 - RNA, 21 nt, Staphylococcus aureus subsp. aureus Mu50
gucaacuuuuuuaacuuuaac

SEQ ID NO: 2057585 - RNA, 16 nt, Staphylococcus aureus subsp. aureus Mu50
gucaauauuguaggga

SEQ ID NO: 2057586 - RNA, 20 nt, Staphylococcus aureus subsp. aureus Mu50
gucagcauucauagcugcuu

SEQ ID NO: 2057587 - RNA, 14 nt, Staphylococcus aureus subsp. aureus Mu50
gucaggggccccaa

SEQ ID NO: 2057588 - RNA, 16 nt, Staphylococcus aureus subsp. aureus Mu50
gucaggggccccaaca

SEQ ID NO: 2057589 - RNA, 18 nt, Staphylococcus aureus subsp. aureus Mu50
gucaucaccuuguuaaaa

SEQ ID NO: 2057590 - RNA, 21 nt, Staphylococcus aureus subsp. aureus Mu50
gucaucaccuuguuaaaauaa

SEQ ID NO: 2057591 - RNA, 21 nt, Staphylococcus aureus subsp. aureus Mu50
gucaucaaaaguuuguauauu

SEQ ID NO: 2057592 - RNA, 23 nt, Staphylococcus aureus subsp. aureus Mu50
gucaucaaaaguuuguauauucu

SEQ ID NO: 2057593 - RNA, 14 nt, Staphylococcus aureus subsp. aureus Mu50
gucauuuugauuaa

SEQ ID NO: 2057594 - RNA, 13 nt, Staphylococcus aureus subsp. aureus Mu50
gucauuacaaauc

SEQ ID NO: 2057595 - RNA, 20 nt, Staphylococcus aureus subsp. aureus Mu50
gucauguguucaaauaacgc

SEQ ID NO: 2057596 - RNA, 17 nt, Staphylococcus aureus subsp. aureus Mu50
gucaucuggaauaccua

SEQ ID NO: 2057597 - RNA, 16 nt, Staphylococcus aureus subsp. aureus Mu50
gucaucuuucaacgca

SEQ ID NO: 2057598 - RNA, 16 nt, Staphylococcus aureus subsp. aureus Mu50
gucaucuguuaauuca

SEQ ID NO: 2057599 - RNA, 19 nt, Staphylococcus aureus subsp. aureus Mu50
gucaucuugagauuuucaa

SEQ ID NO: 2057600 - RNA, 22 nt, Staphylococcus aureus subsp. aureus Mu50
gucaucuucaauucuuacaccu

SEQ ID NO: 2057601 - RNA, 15 nt, Staphylococcus aureus subsp. aureus Mu50
uacgcccaucaucac

SEQ ID NO: 2057602 - RNA, 17 nt, Staphylococcus aureus subsp. aureus Mu50
uacgcccaucaucacug

SEQ ID NO: 2057603 - RNA, 16 nt, Staphylococcus aureus subsp. aureus Mu50
uacgccuucuuuauaa

SEQ ID NO: 2057604 - RNA, 19 nt, Staphylococcus aureus subsp. aureus Mu50
uacgcauuuuaaauaaaau

SEQ ID NO: 2057605 - RNA, 21 nt, Staphylococcus aureus subsp. aureus Mu50
uacgcauuuuaaauaaaaugc

SEQ ID NO: 2057606 - RNA, 20 nt, Staphylococcus aureus subsp. aureus Mu50
uacgccaccaguuucaagug

SEQ ID NO: 2057607 - RNA, 15 nt, Staphylococcus aureus subsp. aureus Mu50
uacgauaaauaguga

SEQ ID NO: 2057608 - RNA, 20 nt, Staphylococcus aureus subsp. aureus Mu50
uacgauaacuacacuuaaua

SEQ ID NO: 2057609 - RNA, 12 nt, Staphylococcus aureus subsp. aureus Mu50
uacgauuuucaa

SEQ ID NO: 2057610 - RNA, 18 nt, Staphylococcus aureus subsp. aureus Mu50
uaccgucuucucuaucag

SEQ ID NO: 2057611 - RNA, 21 nt, Staphylococcus aureus subsp. aureus Mu50
uacgcuaaacaaugaugggaa

SEQ ID NO: 2057612 - RNA, 17 nt, Staphylococcus aureus subsp. aureus Mu50
uacguaucaagaaaaag

SEQ ID NO: 2057613 - RNA, 21 nt, Staphylococcus aureus subsp. aureus Mu50
uacguaucaagaaaaaguuuu

SEQ ID NO: 2057614 - RNA, 14 nt, Staphylococcus aureus subsp. aureus Mu50
uacuaaauugagaa

SEQ ID NO: 2057615 - RNA, 22 nt, Staphylococcus aureus subsp. aureus Mu50
uacuaaauugagaaguauuaug

SEQ ID NO: 2057616 - RNA, 17 nt, Staphylococcus aureus subsp. aureus Mu50
uacuaaccuauuaaaaa

SEQ ID NO: 2057617 - RNA, 21 nt, Staphylococcus aureus subsp. aureus Mu50
uacuaaccuauuaaaaaaaac

SEQ ID NO: 2057618 - RNA, 13 nt, Staphylococcus aureus subsp. aureus Mu50
uacuaaaugaauu

SEQ ID NO: 2057619 - RNA, 21 nt, Staphylococcus aureus subsp. aureus Mu50
uacuaaauaaguaguucagca

SEQ ID NO: 2057620 - RNA, 14 nt, Staphylococcus aureus subsp. aureus Mu50
uacgucauaaaaua

SEQ ID NO: 2057621 - RNA, 20 nt, Staphylococcus aureus subsp. aureus Mu50
uacuaaaaucacuugguaaa

SEQ ID NO: 2057622 - RNA, 20 nt, Staphylococcus aureus subsp. aureus Mu50
uacuaaucuuuuuuuaauua

SEQ ID NO: 2057623 - RNA, 19 nt, Staphylococcus aureus subsp. aureus Mu50
uacuaaucuuaguuaaaau

SEQ ID NO: 2057624 - RNA, 22 nt, Staphylococcus aureus subsp. aureus Mu50
uacuaccguuuuuauauacuug

SEQ ID NO: 2057625 - RNA, 13 nt, Staphylococcus aureus subsp. aureus Mu50
uacuacauuauua

SEQ ID NO: 2057626 - RNA, 21 nt, Staphylococcus aureus subsp. aureus Mu50
uacuacacuccccuuaucaaa

SEQ ID NO: 2057627 - RNA, 20 nt, Staphylococcus aureus subsp. aureus Mu50
uacuacaaacuugauuaugu

SEQ ID NO: 2057628 - RNA, 14 nt, Staphylococcus aureus subsp. aureus Mu50
uacuaauuucuaua

SEQ ID NO: 2057629 - RNA, 23 nt, Staphylococcus aureus subsp. aureus Mu50
uacuaauuucuauagaaaaagua

SEQ ID NO: 2057630 - RNA, 23 nt, Staphylococcus aureus subsp. aureus Mu50
uacucuuuuucuuucauaauuaa

SEQ ID NO: 2057631 - RNA, 14 nt, Staphylococcus aureus subsp. aureus Mu50
uacucuuuuucuuu

SEQ ID NO: 2057632 - RNA, 21 nt, Staphylococcus aureus subsp. aureus Mu50
uacugaaacaugagcuccucu

SEQ ID NO: 2057633 - RNA, 16 nt, Staphylococcus aureus subsp. aureus Mu50
uacugaauuuuaacua

SEQ ID NO: 2057634 - RNA, 20 nt, Staphylococcus aureus subsp. aureus Mu50
uacugacuagccuucaauau

SEQ ID NO: 2057635 - RNA, 19 nt, Staphylococcus aureus subsp. aureus Mu50
uacugaugaacauaccugc

SEQ ID NO: 2057636 - RNA, 22 nt, Staphylococcus aureus subsp. aureus Mu50
uacugcccaauguguuuaacuu

SEQ ID NO: 2057637 - RNA, 21 nt, Staphylococcus aureus subsp. aureus Mu50
uacugcagcaucauaaucuuu

SEQ ID NO: 2057638 - RNA, 17 nt, Staphylococcus aureus subsp. aureus Mu50
uacugcaauuauuuuuc

SEQ ID NO: 2057639 - RNA, 17 nt, Staphylococcus aureus subsp. aureus Mu50
uacucuggucugugaua

SEQ ID NO: 2057640 - RNA, 14 nt, Staphylococcus aureus subsp. aureus Mu50
uacucuagcggaac

SEQ ID NO: 2057641 - RNA, 12 nt, Staphylococcus aureus subsp. aureus Mu50
uacucugaaaag

SEQ ID NO: 2057642 - RNA, 17 nt, Staphylococcus aureus subsp. aureus Mu50
uacucugauuacauaua

SEQ ID NO: 2057643 - RNA, 14 nt, Staphylococcus aureus subsp. aureus Mu50
uacucuaacuuacc

SEQ ID NO: 2057644 - RNA, 16 nt, Staphylococcus aureus subsp. aureus Mu50
uacuacuuaauuaaua

SEQ ID NO: 2057645 - RNA, 19 nt, Staphylococcus aureus subsp. aureus Mu50
uacuagcauuagcaaauau

SEQ ID NO: 2057646 - RNA, 14 nt, Staphylococcus aureus subsp. aureus Mu50
uacuucauaaguca

SEQ ID NO: 2057647 - RNA, 13 nt, Staphylococcus aureus subsp. aureus Mu50
uacuucaccacau

SEQ ID NO: 2057648 - RNA, 14 nt, Staphylococcus aureus subsp. aureus Mu50
uacuucaauaacaa

SEQ ID NO: 2057649 - RNA, 15 nt, Staphylococcus aureus subsp. aureus Mu50
uacuuauuucuuuuc

SEQ ID NO: 2057650 - RNA, 17 nt, Staphylococcus aureus subsp. aureus Mu50
uacuuauuucuuuucau

SEQ ID NO: 2057651 - RNA, 16 nt, Staphylococcus aureus subsp. aureus Mu50
uacuugcacaccagug

SEQ ID NO: 2057652 - RNA, 17 nt, Staphylococcus aureus subsp. aureus Mu50
uacuugccuucaaauuc

SEQ ID NO: 2057653 - RNA, 14 nt, Staphylococcus aureus subsp. aureus Mu50
uacuuuauaaauau

SEQ ID NO: 2057654 - RNA, 20 nt, Staphylococcus aureus subsp. aureus Mu50
uacuucaguuugguuugcuu

SEQ ID NO: 2057655 - RNA, 18 nt, Staphylococcus aureus subsp. aureus Mu50
uacuugaauuuaauaagu

SEQ ID NO: 2057656 - RNA, 17 nt, Staphylococcus aureus subsp. aureus Mu50
uacuucuuuugcaaaac

SEQ ID NO: 2057657 - RNA, 16 nt, Staphylococcus aureus subsp. aureus Mu50
uacuucuuuggucuaa

SEQ ID NO: 2057658 - RNA, 15 nt, Staphylococcus aureus subsp. aureus Mu50
uacugcugucuuuuu

SEQ ID NO: 2057659 - RNA, 15 nt, Staphylococcus aureus subsp. aureus Mu50
uacugcugcuuuuaa

SEQ ID NO: 2057660 - RNA, 18 nt, Staphylococcus aureus subsp. aureus Mu50
uacugcuucaaucgucac

SEQ ID NO: 2057661 - RNA, 23 nt, Staphylococcus aureus subsp. aureus Mu50
uacugcucuuuauauauaaaauc

SEQ ID NO: 2057662 - RNA, 20 nt, Staphylococcus aureus subsp. aureus Mu50
uacugucucaucuucuaaau

SEQ ID NO: 2057663 - RNA, 16 nt, Staphylococcus aureus subsp. aureus Mu50
uacugugaaaauacca

SEQ ID NO: 2057664 - RNA, 18 nt, Staphylococcus aureus subsp. aureus Mu50
uacuguuuaaauaaaauu

SEQ ID NO: 2057665 - RNA, 21 nt, Staphylococcus aureus subsp. aureus Mu50
uaccgcuaaaauucuuucagc

SEQ ID NO: 2057666 - RNA, 20 nt, Staphylococcus aureus subsp. aureus Mu50
uacccucuuuaguuaauucu

SEQ ID NO: 2057667 - RNA, 20 nt, Staphylococcus aureus subsp. aureus Mu50
uaccccuguugaauauacua

SEQ ID NO: 2057668 - RNA, 18 nt, Staphylococcus aureus subsp. aureus Mu50
uaccauagauuauauuau

SEQ ID NO: 2057669 - RNA, 14 nt, Staphylococcus aureus subsp. aureus Mu50
uaccauauaauucu

SEQ ID NO: 2057670 - RNA, 15 nt, Staphylococcus aureus subsp. aureus Mu50
uaccaucuuuaauac

SEQ ID NO: 2057671 - RNA, 18 nt, Staphylococcus aureus subsp. aureus Mu50
uaccauguuuuuuaagua

SEQ ID NO: 2057672 - RNA, 16 nt, Staphylococcus aureus subsp. aureus Mu50
uaccauugugaauaau

SEQ ID NO: 2057673 - RNA, 18 nt, Staphylococcus aureus subsp. aureus Mu50
uaccauugugaugauaau

SEQ ID NO: 2057674 - RNA, 16 nt, Staphylococcus aureus subsp. aureus Mu50
uacccauaauuuaaau

SEQ ID NO: 2057675 - RNA, 22 nt, Staphylococcus aureus subsp. aureus Mu50
uacccauaauuuaaaugauauu

SEQ ID NO: 2057676 - RNA, 19 nt, Staphylococcus aureus subsp. aureus Mu50
uacccauuuuuuuccaagc

SEQ ID NO: 2057677 - RNA, 17 nt, Staphylococcus aureus subsp. aureus Mu50
uaccccaaguccaauuc

SEQ ID NO: 2057678 - RNA, 20 nt, Staphylococcus aureus subsp. aureus Mu50
uacccacaucuuuuuaaaag

SEQ ID NO: 2057679 - RNA, 12 nt, Staphylococcus aureus subsp. aureus Mu50
uaccauuugcug

SEQ ID NO: 2057680 - RNA, 20 nt, Staphylococcus aureus subsp. aureus Mu50
uaccaccauuuuuagaaaua

SEQ ID NO: 2057681 - RNA, 16 nt, Staphylococcus aureus subsp. aureus Mu50
uaccaccagccccaau

SEQ ID NO: 2057682 - RNA, 14 nt, Staphylococcus aureus subsp. aureus Mu50
uaccaccccaacuu

SEQ ID NO: 2057683 - RNA, 11 nt, Staphylococcus aureus subsp. aureus Mu50
uaccaccccaa

SEQ ID NO: 2057684 - RNA, 19 nt, Staphylococcus aureus subsp. aureus Mu50
uaccacuugaauacuuuuu

SEQ ID NO: 2057685 - RNA, 15 nt, Staphylococcus aureus subsp. aureus Mu50
uacauuaauauaaau

SEQ ID NO: 2057686 - RNA, 16 nt, Staphylococcus aureus subsp. aureus Mu50
uacaucuauauuuguu

SEQ ID NO: 2057687 - RNA, 17 nt, Staphylococcus aureus subsp. aureus Mu50
uacauugauaaaauaau

SEQ ID NO: 2057688 - RNA, 14 nt, Staphylococcus aureus subsp. aureus Mu50
uacauugauaaaau

SEQ ID NO: 2057689 - RNA, 16 nt, Staphylococcus aureus subsp. aureus Mu50
uaccaaauaaauuaaa

SEQ ID NO: 2057690 - RNA, 12 nt, Staphylococcus aureus subsp. aureus Mu50
uaccaaauauau

SEQ ID NO: 2057691 - RNA, 14 nt, Staphylococcus aureus subsp. aureus Mu50
uaccaaauauauuu

SEQ ID NO: 2057692 - RNA, 22 nt, Staphylococcus aureus subsp. aureus Mu50
uaccaaauauauuuuuauuaau

SEQ ID NO: 2057693 - RNA, 22 nt, Staphylococcus aureus subsp. aureus Mu50
uaccaacaagguucuaaaucuu

SEQ ID NO: 2057694 - RNA, 17 nt, Staphylococcus aureus subsp. aureus Mu50
uaccaauugcuucuucg

SEQ ID NO: 2057695 - RNA, 17 nt, Staphylococcus aureus subsp. aureus Mu50
uaccaauuguuucagcu

SEQ ID NO: 2057696 - RNA, 19 nt, Staphylococcus aureus subsp. aureus Mu50
uaccaaccaaaaccaaaug

SEQ ID NO: 2057697 - RNA, 18 nt, Staphylococcus aureus subsp. aureus Mu50
uacauacggcaaauucaa

SEQ ID NO: 2057698 - RNA, 22 nt, Staphylococcus aureus subsp. aureus Mu50
uacauaccgauuuucaaccauc

SEQ ID NO: 2057699 - RNA, 20 nt, Staphylococcus aureus subsp. aureus Mu50
uacauacggcaaauucaacu

SEQ ID NO: 2057700 - RNA, 21 nt, Staphylococcus aureus subsp. aureus Mu50
uacauaccacacuuuaaacaa

SEQ ID NO: 2057701 - RNA, 22 nt, Staphylococcus aureus subsp. aureus Mu50
uacauaccacacuuuaaacaag

SEQ ID NO: 2057702 - RNA, 18 nt, Staphylococcus aureus subsp. aureus Mu50
uacauaacccuaaaauga

SEQ ID NO: 2057703 - RNA, 14 nt, Staphylococcus aureus subsp. aureus Mu50
uacauaaugguuca

SEQ ID NO: 2057704 - RNA, 15 nt, Staphylococcus aureus subsp. aureus Mu50
uacauaauuugaauu

SEQ ID NO: 2057705 - RNA, 15 nt, Staphylococcus aureus subsp. aureus Mu50
uacaucauuaaauau

SEQ ID NO: 2057706 - RNA, 16 nt, Staphylococcus aureus subsp. aureus Mu50
uacaucauuaaauauu

SEQ ID NO: 2057707 - RNA, 21 nt, Staphylococcus aureus subsp. aureus Mu50
uacaucauuaaauauuuagau

SEQ ID NO: 2057708 - RNA, 14 nt, Staphylococcus aureus subsp. aureus Mu50
uacaucguguugcu

SEQ ID NO: 2057709 - RNA, 22 nt, Staphylococcus aureus subsp. aureus Mu50
uacaauuuuccuuccaauaaua

SEQ ID NO: 2057710 - RNA, 15 nt, Staphylococcus aureus subsp. aureus Mu50
uacauaacccuaaaa

SEQ ID NO: 2057711 - RNA, 12 nt, Staphylococcus aureus subsp. aureus Mu50
uacaguaauauu

SEQ ID NO: 2057712 - RNA, 17 nt, Staphylococcus aureus subsp. aureus Mu50
uacaguaaauugauucu

SEQ ID NO: 2057713 - RNA, 15 nt, Staphylococcus aureus subsp. aureus Mu50
uacaauuuuuaaaaa

SEQ ID NO: 2057714 - RNA, 16 nt, Staphylococcus aureus subsp. aureus Mu50
uacaauuuuuaaaaac

SEQ ID NO: 2057715 - RNA, 21 nt, Staphylococcus aureus subsp. aureus Mu50
uacagguuuaauaaauuuaac

SEQ ID NO: 2057716 - RNA, 12 nt, Staphylococcus aureus subsp. aureus Mu50
uaauuugauuaa

SEQ ID NO: 2057717 - RNA, 15 nt, Staphylococcus aureus subsp. aureus Mu50
uaauuugauaaaugc

SEQ ID NO: 2057718 - RNA, 19 nt, Staphylococcus aureus subsp. aureus Mu50
uaauuucaccaguagucac

SEQ ID NO: 2057719 - RNA, 19 nt, Staphylococcus aureus subsp. aureus Mu50
uaauuucaguucuuagauu

SEQ ID NO: 2057720 - RNA, 12 nt, Staphylococcus aureus subsp. aureus Mu50
uaauugcauuac

SEQ ID NO: 2057721 - RNA, 21 nt, Staphylococcus aureus subsp. aureus Mu50
uaauugcauagcuaaauaaau

SEQ ID NO: 2057722 - RNA, 22 nt, Staphylococcus aureus subsp. aureus Mu50
uaauugcauagcuaaauaaauu

SEQ ID NO: 2057723 - RNA, 21 nt, Staphylococcus aureus subsp. aureus Mu50
uaauugagagaaguuucuaua

SEQ ID NO: 2057724 - RNA, 16 nt, Staphylococcus aureus subsp. aureus Mu50
uaauugaugaaagacu

SEQ ID NO: 2057725 - RNA, 22 nt, Staphylococcus aureus subsp. aureus Mu50
uaauugaugaugaugugcuuua

SEQ ID NO: 2057726 - RNA, 12 nt, Staphylococcus aureus subsp. aureus Mu50
uaauuucaauuu

SEQ ID NO: 2057727 - RNA, 12 nt, Staphylococcus aureus subsp. aureus Mu50
uaauuuuucauu

SEQ ID NO: 2057728 - RNA, 20 nt, Staphylococcus aureus subsp. aureus Mu50
uaauuuuuuauuaagacuga

SEQ ID NO: 2057729 - RNA, 14 nt, Staphylococcus aureus subsp. aureus Mu50
uaauuuuucuucuu

SEQ ID NO: 2057730 - RNA, 15 nt, Staphylococcus aureus subsp. aureus Mu50
uaauuuuucuucuuu

SEQ ID NO: 2057731 - RNA, 13 nt, Staphylococcus aureus subsp. aureus Mu50
uaauuuuuugaca

SEQ ID NO: 2057732 - RNA, 17 nt, Staphylococcus aureus subsp. aureus Mu50
uacaaaacauauucagu

SEQ ID NO: 2057733 - RNA, 21 nt, Staphylococcus aureus subsp. aureus Mu50
uacaaaacaccucgauauuau

SEQ ID NO: 2057734 - RNA, 16 nt, Staphylococcus aureus subsp. aureus Mu50
uaauuuugacauaaaa

SEQ ID NO: 2057735 - RNA, 18 nt, Staphylococcus aureus subsp. aureus Mu50
uaauuuugacauaaaaaa

SEQ ID NO: 2057736 - RNA, 16 nt, Staphylococcus aureus subsp. aureus Mu50
uaauuuuuaaaucuac

SEQ ID NO: 2057737 - RNA, 14 nt, Staphylococcus aureus subsp. aureus Mu50
uaauuuucuuuuuu

SEQ ID NO: 2057738 - RNA, 13 nt, Staphylococcus aureus subsp. aureus Mu50
uaauuuucuaaau

SEQ ID NO: 2057739 - RNA, 16 nt, Staphylococcus aureus subsp. aureus Mu50
uaauuuucuaaauaua

SEQ ID NO: 2057740 - RNA, 16 nt, Staphylococcus aureus subsp. aureus Mu50
uaauuuguuuuaaaua

SEQ ID NO: 2057741 - RNA, 17 nt, Staphylococcus aureus subsp. aureus Mu50
uaauuuguuaguuuaag

SEQ ID NO: 2057742 - RNA, 17 nt, Staphylococcus aureus subsp. aureus Mu50
uacaaacaaugcaaguu

SEQ ID NO: 2057743 - RNA, 15 nt, Staphylococcus aureus subsp. aureus Mu50
uacaaaauugucuca

SEQ ID NO: 2057744 - RNA, 19 nt, Staphylococcus aureus subsp. aureus Mu50
uacaaacccuuuaaacaua

SEQ ID NO: 2057745 - RNA, 17 nt, Staphylococcus aureus subsp. aureus Mu50
uacaaacuucacaucau

SEQ ID NO: 2057746 - RNA, 22 nt, Staphylococcus aureus subsp. aureus Mu50
uacaaacauuccucuauuguau

SEQ ID NO: 2057747 - RNA, 17 nt, Staphylococcus aureus subsp. aureus Mu50
uacaaaggauuauuaac

SEQ ID NO: 2057748 - RNA, 20 nt, Staphylococcus aureus subsp. aureus Mu50
uacaaaguuuauacuuaaua

SEQ ID NO: 2057749 - RNA, 19 nt, Staphylococcus aureus subsp. aureus Mu50
uacaaauaacaaacauuaa

SEQ ID NO: 2057750 - RNA, 14 nt, Staphylococcus aureus subsp. aureus Mu50
uacaaaucgauauu

SEQ ID NO: 2057751 - RNA, 20 nt, Staphylococcus aureus subsp. aureus Mu50
uacaaaucaugacauaaaac

SEQ ID NO: 2057752 - RNA, 21 nt, Staphylococcus aureus subsp. aureus Mu50
uacaaaucaugacauaaaacu

SEQ ID NO: 2057753 - RNA, 17 nt, Staphylococcus aureus subsp. aureus Mu50
uacaaauauguaaucag

SEQ ID NO: 2057754 - RNA, 22 nt, Staphylococcus aureus subsp. aureus Mu50
uacaaauauuguggaaaacgug

SEQ ID NO: 2057755 - RNA, 18 nt, Staphylococcus aureus subsp. aureus Mu50
uacaaauguauaaauaau

SEQ ID NO: 2057756 - RNA, 23 nt, Staphylococcus aureus subsp. aureus Mu50
uacaaauguauaaauaauaaaug

SEQ ID NO: 2057757 - RNA, 12 nt, Staphylococcus aureus subsp. aureus Mu50
uacaaauugauu

SEQ ID NO: 2057758 - RNA, 24 nt, Staphylococcus aureus subsp. aureus Mu50
uacaaagucugucugaauuagauu

SEQ ID NO: 2057759 - RNA, 18 nt, Staphylococcus aureus subsp. aureus Mu50
uacaaaucguaaacauaa

SEQ ID NO: 2057760 - RNA, 16 nt, Staphylococcus aureus subsp. aureus Mu50
uacaaauuauaaauuu

SEQ ID NO: 2057761 - RNA, 20 nt, Staphylococcus aureus subsp. aureus Mu50
uacaacucguuuuuccaugu

SEQ ID NO: 2057762 - RNA, 14 nt, Staphylococcus aureus subsp. aureus Mu50
uacaacauacaugc

SEQ ID NO: 2057763 - RNA, 14 nt, Staphylococcus aureus subsp. aureus Mu50
uacaacuaaauaug

SEQ ID NO: 2057764 - RNA, 18 nt, Staphylococcus aureus subsp. aureus Mu50
uacaaauuuuuuuuauua

SEQ ID NO: 2057765 - RNA, 23 nt, Staphylococcus aureus subsp. aureus Mu50
uacaaauuuuuuuuauuaauuaa

SEQ ID NO: 2057766 - RNA, 23 nt, Staphylococcus aureus subsp. aureus Mu50
uacaacugaaucuccuugcucau

SEQ ID NO: 2057767 - RNA, 15 nt, Staphylococcus aureus subsp. aureus Mu50
uacaacuuuuagagu

SEQ ID NO: 2057768 - RNA, 17 nt, Staphylococcus aureus subsp. aureus Mu50
uaauucccuguuaugaa

SEQ ID NO: 2057769 - RNA, 17 nt, Staphylococcus aureus subsp. aureus Mu50
uaauuauuucucuuucc

SEQ ID NO: 2057770 - RNA, 15 nt, Staphylococcus aureus subsp. aureus Mu50
uaauuauuuuaaaaa

SEQ ID NO: 2057771 - RNA, 23 nt, Staphylococcus aureus subsp. aureus Mu50
uaauuccucuggaacuuuaauac

SEQ ID NO: 2057772 - RNA, 22 nt, Staphylococcus aureus subsp. aureus Mu50
uaauucgccaucuuuuuuagcu

SEQ ID NO: 2057773 - RNA, 22 nt, Staphylococcus aureus subsp. aureus Mu50
uaauuccuucuauagcaccauu

SEQ ID NO: 2057774 - RNA, 21 nt, Staphylococcus aureus subsp. aureus Mu50
uaauuccuggugcaauaauaa

SEQ ID NO: 2057775 - RNA, 16 nt, Staphylococcus aureus subsp. aureus Mu50
uaauuaucuucaucau

SEQ ID NO: 2057776 - RNA, 18 nt, Staphylococcus aureus subsp. aureus Mu50
uaauuagauuuaaaaugu

SEQ ID NO: 2057777 - RNA, 14 nt, Staphylococcus aureus subsp. aureus Mu50
uaauuacuuucauu

SEQ ID NO: 2057778 - RNA, 13 nt, Staphylococcus aureus subsp. aureus Mu50
uaauuauguauuu

SEQ ID NO: 2057779 - RNA, 14 nt, Staphylococcus aureus subsp. aureus Mu50
uaauuauuucucuu

SEQ ID NO: 2057780 - RNA, 19 nt, Staphylococcus aureus subsp. aureus Mu50
uaauuacgucauaaaauac

SEQ ID NO: 2057781 - RNA, 16 nt, Staphylococcus aureus subsp. aureus Mu50
uaauuaauuuuguaau

SEQ ID NO: 2057782 - RNA, 13 nt, Staphylococcus aureus subsp. aureus Mu50
uaauuaaaauaca

SEQ ID NO: 2057783 - RNA, 16 nt, Staphylococcus aureus subsp. aureus Mu50
uaauuaaauaaaaaua

SEQ ID NO: 2057784 - RNA, 14 nt, Staphylococcus aureus subsp. aureus Mu50
uaauuaaagauuaa

SEQ ID NO: 2057785 - RNA, 20 nt, Staphylococcus aureus subsp. aureus Mu50
uaaugugcgucacucacuuc

SEQ ID NO: 2057786 - RNA, 22 nt, Staphylococcus aureus subsp. aureus Mu50
uaauguuaaaauaacugcuaau

SEQ ID NO: 2057787 - RNA, 13 nt, Staphylococcus aureus subsp. aureus Mu50
uaauguuaaacac

SEQ ID NO: 2057788 - RNA, 15 nt, Staphylococcus aureus subsp. aureus Mu50
uaauguuacgcugug

SEQ ID NO: 2057789 - RNA, 20 nt, Staphylococcus aureus subsp. aureus Mu50
uaauguuaaaauaacugcua

SEQ ID NO: 2057790 - RNA, 16 nt, Staphylococcus aureus subsp. aureus Mu50
uaauguuaaacacuca

SEQ ID NO: 2057791 - RNA, 19 nt, Staphylococcus aureus subsp. aureus Mu50
uaauguuccccugaaaaga

SEQ ID NO: 2057792 - RNA, 13 nt, Staphylococcus aureus subsp. aureus Mu50
uaauguuuccauu

SEQ ID NO: 2057793 - RNA, 23 nt, Staphylococcus aureus subsp. aureus Mu50
uaauguuuccugauauuucaacu

SEQ ID NO: 2057794 - RNA, 21 nt, Staphylococcus aureus subsp. aureus Mu50
uaaugccugcccuuuagucau

SEQ ID NO: 2057795 - RNA, 22 nt, Staphylococcus aureus subsp. aureus Mu50
uaaugauuuuuauuauugucau

SEQ ID NO: 2057796 - RNA, 14 nt, Staphylococcus aureus subsp. aureus Mu50
uaaugauuuuucau

SEQ ID NO: 2057797 - RNA, 23 nt, Staphylococcus aureus subsp. aureus Mu50
uaaugcaagcgacgauuggaaag

SEQ ID NO: 2057798 - RNA, 13 nt, Staphylococcus aureus subsp. aureus Mu50
uaaugcuauauuu

SEQ ID NO: 2057799 - RNA, 20 nt, Staphylococcus aureus subsp. aureus Mu50
uaauguaaaguugauaaugu

SEQ ID NO: 2057800 - RNA, 17 nt, Staphylococcus aureus subsp. aureus Mu50
uaauguacauguauaaa

SEQ ID NO: 2057801 - RNA, 23 nt, Staphylococcus aureus subsp. aureus Mu50
uaauguacauguauaaaagauau

SEQ ID NO: 2057802 - RNA, 16 nt, Staphylococcus aureus subsp. aureus Mu50
uaauguacuucaauuu

SEQ ID NO: 2057803 - RNA, 21 nt, Staphylococcus aureus subsp. aureus Mu50
uaauguauaaaaagugcauau

SEQ ID NO: 2057804 - RNA, 15 nt, Staphylococcus aureus subsp. aureus Mu50
uaauguauaaaacag

SEQ ID NO: 2057805 - RNA, 13 nt, Staphylococcus aureus subsp. aureus Mu50
uaauguauucuuc

SEQ ID NO: 2057806 - RNA, 17 nt, Staphylococcus aureus subsp. aureus Mu50
uaaugucccguuuaccu

SEQ ID NO: 2057807 - RNA, 21 nt, Staphylococcus aureus subsp. aureus Mu50
uaauguaucauuucagaaaua

SEQ ID NO: 2057808 - RNA, 15 nt, Staphylococcus aureus subsp. aureus Mu50
uaaugucauaucuuu

SEQ ID NO: 2057809 - RNA, 11 nt, Staphylococcus aureus subsp. aureus Mu50
uaaugauuuug

SEQ ID NO: 2057810 - RNA, 14 nt, Staphylococcus aureus subsp. aureus Mu50
uaaugauugucuua

SEQ ID NO: 2057811 - RNA, 15 nt, Staphylococcus aureus subsp. aureus Mu50
uaaugauagcaauga

SEQ ID NO: 2057812 - RNA, 13 nt, Staphylococcus aureus subsp. aureus Mu50
uaaugaucaucua

SEQ ID NO: 2057813 - RNA, 15 nt, Staphylococcus aureus subsp. aureus Mu50
uaaugaucaaguagu

SEQ ID NO: 2057814 - RNA, 14 nt, Staphylococcus aureus subsp. aureus Mu50
uaaugaucaucuau

SEQ ID NO: 2057815 - RNA, 21 nt, Staphylococcus aureus subsp. aureus Mu50
uaaugaucguuagcuaaucgu

SEQ ID NO: 2057816 - RNA, 13 nt, Staphylococcus aureus subsp. aureus Mu50
uaaucgcauucuu

SEQ ID NO: 2057817 - RNA, 23 nt, Staphylococcus aureus subsp. aureus Mu50
uaaucgauugguaaaucuacuac

SEQ ID NO: 2057818 - RNA, 16 nt, Staphylococcus aureus subsp. aureus Mu50
uaauaugaauuuagau

SEQ ID NO: 2057819 - RNA, 21 nt, Staphylococcus aureus subsp. aureus Mu50
uaauaugaauuuagaugcaua

SEQ ID NO: 2057820 - RNA, 19 nt, Staphylococcus aureus subsp. aureus Mu50
uaauaucuuacuacuuaau

SEQ ID NO: 2057821 - RNA, 21 nt, Staphylococcus aureus subsp. aureus Mu50
uaauaucuuacuacuuaauua

SEQ ID NO: 2057822 - RNA, 15 nt, Staphylococcus aureus subsp. aureus Mu50
uaauauauaaaaguc

SEQ ID NO: 2057823 - RNA, 14 nt, Staphylococcus aureus subsp. aureus Mu50
uaauauauaaaagu

SEQ ID NO: 2057824 - RNA, 16 nt, Staphylococcus aureus subsp. aureus Mu50
uaauaucaauaaugcu

SEQ ID NO: 2057825 - RNA, 14 nt, Staphylococcus aureus subsp. aureus Mu50
uaauauauuuggag

SEQ ID NO: 2057826 - RNA, 21 nt, Staphylococcus aureus subsp. aureus Mu50
uaauaucauauucaaaauaac

SEQ ID NO: 2057827 - RNA, 17 nt, Staphylococcus aureus subsp. aureus Mu50
uaauauuucuuaccauu

SEQ ID NO: 2057828 - RNA, 18 nt, Staphylococcus aureus subsp. aureus Mu50
uaauauuucuuaccauuu

SEQ ID NO: 2057829 - RNA, 18 nt, Staphylococcus aureus subsp. aureus Mu50
uaauauuugauaacaaaa

SEQ ID NO: 2057830 - RNA, 20 nt, Staphylococcus aureus subsp. aureus Mu50
uaaucaaaguaucagucauu

SEQ ID NO: 2057831 - RNA, 21 nt, Staphylococcus aureus subsp. aureus Mu50
uaaucaagaauauaagugauu

SEQ ID NO: 2057832 - RNA, 15 nt, Staphylococcus aureus subsp. aureus Mu50
uaaucaagcaaugca

SEQ ID NO: 2057833 - RNA, 20 nt, Staphylococcus aureus subsp. aureus Mu50
uaaucaagucugcauuaauu

SEQ ID NO: 2057834 - RNA, 21 nt, Staphylococcus aureus subsp. aureus Mu50
uaaucaaaccaccaaaaauca

SEQ ID NO: 2057835 - RNA, 17 nt, Staphylococcus aureus subsp. aureus Mu50
uaaucaaaauuaugacu

SEQ ID NO: 2057836 - RNA, 12 nt, Staphylococcus aureus subsp. aureus Mu50
uaauauuuuaaa

SEQ ID NO: 2057837 - RNA, 15 nt, Staphylococcus aureus subsp. aureus Mu50
uaauauuucuuagau

SEQ ID NO: 2057838 - RNA, 19 nt, Staphylococcus aureus subsp. aureus Mu50
uaaucaugaaguugguuua

SEQ ID NO: 2057839 - RNA, 16 nt, Staphylococcus aureus subsp. aureus Mu50
uaaucauguaaugcuu

SEQ ID NO: 2057840 - RNA, 17 nt, Staphylococcus aureus subsp. aureus Mu50
uaaucauguaaugcuua

SEQ ID NO: 2057841 - RNA, 21 nt, Staphylococcus aureus subsp. aureus Mu50
uaaucauguaaugcuuaaaaa

SEQ ID NO: 2057842 - RNA, 21 nt, Staphylococcus aureus subsp. aureus Mu50
uaaucauuguguauuguuuua

SEQ ID NO: 2057843 - RNA, 20 nt, Staphylococcus aureus subsp. aureus Mu50
uaaucauugguuucaucaua

SEQ ID NO: 2057844 - RNA, 20 nt, Staphylococcus aureus subsp. aureus Mu50
uaauccagcgacauguccug

SEQ ID NO: 2057845 - RNA, 16 nt, Staphylococcus aureus subsp. aureus Mu50
uaauccccgaagcaca

SEQ ID NO: 2057846 - RNA, 12 nt, Staphylococcus aureus subsp. aureus Mu50
uaauccauucuu

SEQ ID NO: 2057847 - RNA, 17 nt, Staphylococcus aureus subsp. aureus Mu50
uaaucccauuuuaaagu

SEQ ID NO: 2057848 - RNA, 18 nt, Staphylococcus aureus subsp. aureus Mu50
uaaucaagcaaugcaugc

SEQ ID NO: 2057849 - RNA, 17 nt, Staphylococcus aureus subsp. aureus Mu50
uaaucacauuaauugga

SEQ ID NO: 2057850 - RNA, 13 nt, Staphylococcus aureus subsp. aureus Mu50
uaaucacauuaau

SEQ ID NO: 2057851 - RNA, 14 nt, Staphylococcus aureus subsp. aureus Mu50
uaaucacauuaauu

SEQ ID NO: 2057852 - RNA, 15 nt, Staphylococcus aureus subsp. aureus Mu50
uaaucagaaaagcag

SEQ ID NO: 2057853 - RNA, 22 nt, Staphylococcus aureus subsp. aureus Mu50
uaaucacuuggcgacauuugua

SEQ ID NO: 2057854 - RNA, 18 nt, Staphylococcus aureus subsp. aureus Mu50
uaaucagcuauaaaagua

SEQ ID NO: 2057855 - RNA, 21 nt, Staphylococcus aureus subsp. aureus Mu50
uaaucagcuauaaaaguacuu

SEQ ID NO: 2057856 - RNA, 17 nt, Staphylococcus aureus subsp. aureus Mu50
uaaucauaaugaauaau

SEQ ID NO: 2057857 - RNA, 15 nt, Staphylococcus aureus subsp. aureus Mu50
uaaucagugaaauau

SEQ ID NO: 2057858 - RNA, 12 nt, Staphylococcus aureus subsp. aureus Mu50
uaaucauaaaaa

SEQ ID NO: 2057859 - RNA, 16 nt, Staphylococcus aureus subsp. aureus Mu50
uaauaagcugaaauaa

SEQ ID NO: 2057860 - RNA, 15 nt, Staphylococcus aureus subsp. aureus Mu50
uaauaagagguauag

SEQ ID NO: 2057861 - RNA, 18 nt, Staphylococcus aureus subsp. aureus Mu50
uaauaaccuuuaaaacau

SEQ ID NO: 2057862 - RNA, 19 nt, Staphylococcus aureus subsp. aureus Mu50
uaauaaguugaauauaaaa

SEQ ID NO: 2057863 - RNA, 13 nt, Staphylococcus aureus subsp. aureus Mu50
uaauaauaaucuu

SEQ ID NO: 2057864 - RNA, 17 nt, Staphylococcus aureus subsp. aureus Mu50
uaauaaguugaauauaa

SEQ ID NO: 2057865 - RNA, 16 nt, Staphylococcus aureus subsp. aureus Mu50
uaauaaguaauaauuu

SEQ ID NO: 2057866 - RNA, 13 nt, Staphylococcus aureus subsp. aureus Mu50
uaauaaugacuga

SEQ ID NO: 2057867 - RNA, 19 nt, Staphylococcus aureus subsp. aureus Mu50
uaauaaugaauucuauccu

SEQ ID NO: 2057868 - RNA, 16 nt, Staphylococcus aureus subsp. aureus Mu50
uaauaaucuuuaacau

SEQ ID NO: 2057869 - RNA, 19 nt, Staphylococcus aureus subsp. aureus Mu50
uaauacacuugauaaaacu

SEQ ID NO: 2057870 - RNA, 14 nt, Staphylococcus aureus subsp. aureus Mu50
uaauacaagcaaua

SEQ ID NO: 2057871 - RNA, 19 nt, Staphylococcus aureus subsp. aureus Mu50
uaauacaagucuuuacucu

SEQ ID NO: 2057872 - RNA, 15 nt, Staphylococcus aureus subsp. aureus Mu50
uaauaccauugugau

SEQ ID NO: 2057873 - RNA, 19 nt, Staphylococcus aureus subsp. aureus Mu50
uaauaccaauuuuuagcau

SEQ ID NO: 2057874 - RNA, 16 nt, Staphylococcus aureus subsp. aureus Mu50
uaauacaucuaauaaa

SEQ ID NO: 2057875 - RNA, 18 nt, Staphylococcus aureus subsp. aureus Mu50
uaauacaucuaauaaaua

SEQ ID NO: 2057876 - RNA, 20 nt, Staphylococcus aureus subsp. aureus Mu50
uaauaauggcaauuaaaacu

SEQ ID NO: 2057877 - RNA, 14 nt, Staphylococcus aureus subsp. aureus Mu50
uaauaauuaaacaa

SEQ ID NO: 2057878 - RNA, 18 nt, Staphylococcus aureus subsp. aureus Mu50
uaauaauucauaaaugcu

SEQ ID NO: 2057879 - RNA, 18 nt, Staphylococcus aureus subsp. aureus Mu50
uaauaauuaauaagcauu

SEQ ID NO: 2057880 - RNA, 21 nt, Staphylococcus aureus subsp. aureus Mu50
uaauaauuugguuaacauccu

SEQ ID NO: 2057881 - RNA, 14 nt, Staphylococcus aureus subsp. aureus Mu50
uaauaauuguccau

SEQ ID NO: 2057882 - RNA, 15 nt, Staphylococcus aureus subsp. aureus Mu50
uaauaauuuaacuaa

SEQ ID NO: 2057883 - RNA, 16 nt, Staphylococcus aureus subsp. aureus Mu50
uaauaauuggaaucau

SEQ ID NO: 2057884 - RNA, 14 nt, Staphylococcus aureus subsp. aureus Mu50
uaauagcuauauuu

SEQ ID NO: 2057885 - RNA, 17 nt, Staphylococcus aureus subsp. aureus Mu50
uaauagcuuguacacau

SEQ ID NO: 2057886 - RNA, 21 nt, Staphylococcus aureus subsp. aureus Mu50
uaauaggauaugcuaaacacu

SEQ ID NO: 2057887 - RNA, 21 nt, Staphylococcus aureus subsp. aureus Mu50
uaauagguuauuugauaauga

SEQ ID NO: 2057888 - RNA, 21 nt, Staphylococcus aureus subsp. aureus Mu50
uaauagguuauguuauguaaa

SEQ ID NO: 2057889 - RNA, 16 nt, Staphylococcus aureus subsp. aureus Mu50
uaauauaaauuuugaa

SEQ ID NO: 2057890 - RNA, 15 nt, Staphylococcus aureus subsp. aureus Mu50
uaauauaaaaacaaa

SEQ ID NO: 2057891 - RNA, 20 nt, Staphylococcus aureus subsp. aureus Mu50
uaauauaaaaacaaaagaaa

SEQ ID NO: 2057892 - RNA, 15 nt, Staphylococcus aureus subsp. aureus Mu50
uaauauaauuauuaa

SEQ ID NO: 2057893 - RNA, 13 nt, Staphylococcus aureus subsp. aureus Mu50
uaauauaauuaaa

SEQ ID NO: 2057894 - RNA, 12 nt, Staphylococcus aureus subsp. aureus Mu50
uaauauaauacc

SEQ ID NO: 2057895 - RNA, 15 nt, Staphylococcus aureus subsp. aureus Mu50
uaauauaaguauaau

SEQ ID NO: 2057896 - RNA, 18 nt, Staphylococcus aureus subsp. aureus Mu50
uaauacguguguuuucuu

SEQ ID NO: 2057897 - RNA, 22 nt, Staphylococcus aureus subsp. aureus Mu50
uaauacuguauuuuaacgucau

SEQ ID NO: 2057898 - RNA, 20 nt, Staphylococcus aureus subsp. aureus Mu50
uaauacuguuuaaauaaaau

SEQ ID NO: 2057899 - RNA, 20 nt, Staphylococcus aureus subsp. aureus Mu50
uaauacuaccguuuuuauau

SEQ ID NO: 2057900 - RNA, 23 nt, Staphylococcus aureus subsp. aureus Mu50
uaauaccuucaauugacauuaau

SEQ ID NO: 2057901 - RNA, 22 nt, Staphylococcus aureus subsp. aureus Mu50
uaauacuuuuugaguauccaau

SEQ ID NO: 2057902 - RNA, 21 nt, Staphylococcus aureus subsp. aureus Mu50
uaauacuguuuaaauaaaauu

SEQ ID NO: 2057903 - RNA, 17 nt, Staphylococcus aureus subsp. aureus Mu50
uaauacuuuuugaguau

SEQ ID NO: 2057904 - RNA, 17 nt, Staphylococcus aureus subsp. aureus Mu50
uaauagaacgaaauagu

SEQ ID NO: 2057905 - RNA, 13 nt, Staphylococcus aureus subsp. aureus Mu50
uaauagaaauaau

SEQ ID NO: 2057906 - RNA, 20 nt, Staphylococcus aureus subsp. aureus Mu50
uaauacuuucacuuuuuaua

SEQ ID NO: 2057907 - RNA, 20 nt, Staphylococcus aureus subsp. aureus Mu50
uaacucaaauaucuaaacaa

SEQ ID NO: 2057908 - RNA, 22 nt, Staphylococcus aureus subsp. aureus Mu50
uaacucaaauaucuaaacaauu

SEQ ID NO: 2057909 - RNA, 22 nt, Staphylococcus aureus subsp. aureus Mu50
uaacuauauugugcuaaguuag

SEQ ID NO: 2057910 - RNA, 17 nt, Staphylococcus aureus subsp. aureus Mu50
uaacuaguguaaugucu

SEQ ID NO: 2057911 - RNA, 22 nt, Staphylococcus aureus subsp. aureus Mu50
uaacuauaacaauaguuuucuu

SEQ ID NO: 2057912 - RNA, 18 nt, Staphylococcus aureus subsp. aureus Mu50
uaacucaaagaaacuaua

SEQ ID NO: 2057913 - RNA, 21 nt, Staphylococcus aureus subsp. aureus Mu50
uaacuauguuacuuauauauu

SEQ ID NO: 2057914 - RNA, 14 nt, Staphylococcus aureus subsp. aureus Mu50
uaacuccuccaaag

SEQ ID NO: 2057915 - RNA, 14 nt, Staphylococcus aureus subsp. aureus Mu50
uaacucuucaguac

SEQ ID NO: 2057916 - RNA, 16 nt, Staphylococcus aureus subsp. aureus Mu50
uaacucuuuguauaag

SEQ ID NO: 2057917 - RNA, 21 nt, Staphylococcus aureus subsp. aureus Mu50
uaacuaaaaugucuuugaaaa

SEQ ID NO: 2057918 - RNA, 23 nt, Staphylococcus aureus subsp. aureus Mu50
uaacuaaaaugucuuugaaaaac

SEQ ID NO: 2057919 - RNA, 16 nt, Staphylococcus aureus subsp. aureus Mu50
uaacguugcagagaau

SEQ ID NO: 2057920 - RNA, 17 nt, Staphylococcus aureus subsp. aureus Mu50
uaacuaaaccauugaau

SEQ ID NO: 2057921 - RNA, 15 nt, Staphylococcus aureus subsp. aureus Mu50
uaacuacacuuaaua

SEQ ID NO: 2057922 - RNA, 16 nt, Staphylococcus aureus subsp. aureus Mu50
uaacuagaaugauuaa

SEQ ID NO: 2057923 - RNA, 17 nt, Staphylococcus aureus subsp. aureus Mu50
uaacuagaaugauuaaa

SEQ ID NO: 2057924 - RNA, 15 nt, Staphylococcus aureus subsp. aureus Mu50
uaacguucuguuuug

SEQ ID NO: 2057925 - RNA, 14 nt, Staphylococcus aureus subsp. aureus Mu50
uaacguuauucauu

SEQ ID NO: 2057926 - RNA, 19 nt, Staphylococcus aureus subsp. aureus Mu50
uaacgugaggcccauaaau

SEQ ID NO: 2057927 - RNA, 21 nt, Staphylococcus aureus subsp. aureus Mu50
uaacguguuugcucaaaaaug

SEQ ID NO: 2057928 - RNA, 20 nt, Staphylococcus aureus subsp. aureus Mu50
uaacguacauuuaugauugu

SEQ ID NO: 2057929 - RNA, 14 nt, Staphylococcus aureus subsp. aureus Mu50
uaacuguaaaacau

SEQ ID NO: 2057930 - RNA, 15 nt, Staphylococcus aureus subsp. aureus Mu50
uaacuguaaaacauu

SEQ ID NO: 2057931 - RNA, 15 nt, Staphylococcus aureus subsp. aureus Mu50
uaacuguuuaucaug

SEQ ID NO: 2057932 - RNA, 16 nt, Staphylococcus aureus subsp. aureus Mu50
uaacuguuuauccaua

SEQ ID NO: 2057933 - RNA, 18 nt, Staphylococcus aureus subsp. aureus Mu50
uaacuuaaaauuuaaaua

SEQ ID NO: 2057934 - RNA, 23 nt, Staphylococcus aureus subsp. aureus Mu50
uaacugguugauaaauaaacuca

SEQ ID NO: 2057935 - RNA, 14 nt, Staphylococcus aureus subsp. aureus Mu50
uaacugggauauag

SEQ ID NO: 2057936 - RNA, 20 nt, Staphylococcus aureus subsp. aureus Mu50
uaacuggcaaaucaaacaau

SEQ ID NO: 2057937 - RNA, 16 nt, Staphylococcus aureus subsp. aureus Mu50
uaacuucguuuuaaua

SEQ ID NO: 2057938 - RNA, 16 nt, Staphylococcus aureus subsp. aureus Mu50
uaacuucauaauauau

SEQ ID NO: 2057939 - RNA, 10 nt, Staphylococcus aureus subsp. aureus Mu50
uaacuuccua

SEQ ID NO: 2057940 - RNA, 21 nt, Staphylococcus aureus subsp. aureus Mu50
uaacuuaaaauuuaaauauug

SEQ ID NO: 2057941 - RNA, 14 nt, Staphylococcus aureus subsp. aureus Mu50
uaacuuaauuaaaa

SEQ ID NO: 2057942 - RNA, 23 nt, Staphylococcus aureus subsp. aureus Mu50
uaacuuaauuaaaaaaagauuag

SEQ ID NO: 2057943 - RNA, 19 nt, Staphylococcus aureus subsp. aureus Mu50
uaacugcuaauuuuuucau

SEQ ID NO: 2057944 - RNA, 12 nt, Staphylococcus aureus subsp. aureus Mu50
uaacugauuuug

SEQ ID NO: 2057945 - RNA, 21 nt, Staphylococcus aureus subsp. aureus Mu50
uaacugccauauagauauuag

SEQ ID NO: 2057946 - RNA, 14 nt, Staphylococcus aureus subsp. aureus Mu50
uaacugauaauacu

SEQ ID NO: 2057947 - RNA, 17 nt, Staphylococcus aureus subsp. aureus Mu50
uaacugaauuaaagcau

SEQ ID NO: 2057948 - RNA, 13 nt, Staphylococcus aureus subsp. aureus Mu50
uaacugauaaaag

SEQ ID NO: 2057949 - RNA, 14 nt, Staphylococcus aureus subsp. aureus Mu50
uaagaugacuacaa

SEQ ID NO: 2057950 - RNA, 20 nt, Staphylococcus aureus subsp. aureus Mu50
uaagauauuuccaaauugaa

SEQ ID NO: 2057951 - RNA, 14 nt, Staphylococcus aureus subsp. aureus Mu50
uaagaucaauauca

SEQ ID NO: 2057952 - RNA, 21 nt, Staphylococcus aureus subsp. aureus Mu50
uaagauguauaugaauuuuau

SEQ ID NO: 2057953 - RNA, 15 nt, Staphylococcus aureus subsp. aureus Mu50
uaagauagauaaauc

SEQ ID NO: 2057954 - RNA, 18 nt, Staphylococcus aureus subsp. aureus Mu50
uaagauaacgagugaaaa

SEQ ID NO: 2057955 - RNA, 18 nt, Staphylococcus aureus subsp. aureus Mu50
uaagauaauuuucaauua

SEQ ID NO: 2057956 - RNA, 13 nt, Staphylococcus aureus subsp. aureus Mu50
uaagacgauuuca

SEQ ID NO: 2057957 - RNA, 15 nt, Staphylococcus aureus subsp. aureus Mu50
uaagaauuaacaaca

SEQ ID NO: 2057958 - RNA, 22 nt, Staphylococcus aureus subsp. aureus Mu50
uaagacagcuucucauugaaau

SEQ ID NO: 2057959 - RNA, 16 nt, Staphylococcus aureus subsp. aureus Mu50
uaagacauaugcagug

SEQ ID NO: 2057960 - RNA, 23 nt, Staphylococcus aureus subsp. aureus Mu50
uaagagucuucuuacugcaauua

SEQ ID NO: 2057961 - RNA, 20 nt, Staphylococcus aureus subsp. aureus Mu50
uaagagaacuuuucaaacaa

SEQ ID NO: 2057962 - RNA, 13 nt, Staphylococcus aureus subsp. aureus Mu50
uaacuuucuuuug

SEQ ID NO: 2057963 - RNA, 22 nt, Staphylococcus aureus subsp. aureus Mu50
uaacuuuccgccuucaauccaa

SEQ ID NO: 2057964 - RNA, 16 nt, Staphylococcus aureus subsp. aureus Mu50
uaacuuuuuaaaggac

SEQ ID NO: 2057965 - RNA, 17 nt, Staphylococcus aureus subsp. aureus Mu50
uaagaaaaucauucauu

SEQ ID NO: 2057966 - RNA, 15 nt, Staphylococcus aureus subsp. aureus Mu50
uaagaaaauacuaac

SEQ ID NO: 2057967 - RNA, 17 nt, Staphylococcus aureus subsp. aureus Mu50
uaacuuguaauauaaca

SEQ ID NO: 2057968 - RNA, 16 nt, Staphylococcus aureus subsp. aureus Mu50
uaacuugauaucaucu

SEQ ID NO: 2057969 - RNA, 14 nt, Staphylococcus aureus subsp. aureus Mu50
uaacuuuaccaaua

SEQ ID NO: 2057970 - RNA, 21 nt, Staphylococcus aureus subsp. aureus Mu50
uaacuuuaauauaaguauaau

SEQ ID NO: 2057971 - RNA, 13 nt, Staphylococcus aureus subsp. aureus Mu50
uaacuuucccuac

SEQ ID NO: 2057972 - RNA, 18 nt, Staphylococcus aureus subsp. aureus Mu50
uaacuuuaccaauaucau

SEQ ID NO: 2057973 - RNA, 16 nt, Staphylococcus aureus subsp. aureus Mu50
uaacuuucagcaccag

SEQ ID NO: 2057974 - RNA, 14 nt, Staphylococcus aureus subsp. aureus Mu50
uaagaagcuuucug

SEQ ID NO: 2057975 - RNA, 12 nt, Staphylococcus aureus subsp. aureus Mu50
uaagaauuuaaa

SEQ ID NO: 2057976 - RNA, 13 nt, Staphylococcus aureus subsp. aureus Mu50
uaagaauuuaaaa

SEQ ID NO: 2057977 - RNA, 20 nt, Staphylococcus aureus subsp. aureus Mu50
uaagaauguacaauuuuuua

SEQ ID NO: 2057978 - RNA, 15 nt, Staphylococcus aureus subsp. aureus Mu50
uaagaacgagaauuu

SEQ ID NO: 2057979 - RNA, 14 nt, Staphylococcus aureus subsp. aureus Mu50
uaagaagaaauacu

SEQ ID NO: 2057980 - RNA, 16 nt, Staphylococcus aureus subsp. aureus Mu50
uaagcguuuaaucaca

SEQ ID NO: 2057981 - RNA, 13 nt, Staphylococcus aureus subsp. aureus Mu50
uaagcuuguaauc

SEQ ID NO: 2057982 - RNA, 19 nt, Staphylococcus aureus subsp. aureus Mu50
uaagcuuacgacauacuug

SEQ ID NO: 2057983 - RNA, 17 nt, Staphylococcus aureus subsp. aureus Mu50
uaagcucauuucaauau

SEQ ID NO: 2057984 - RNA, 14 nt, Staphylococcus aureus subsp. aureus Mu50
uaaggaaccugucu

SEQ ID NO: 2057985 - RNA, 13 nt, Staphylococcus aureus subsp. aureus Mu50
uaaggaaaauuau

SEQ ID NO: 2057986 - RNA, 22 nt, Staphylococcus aureus subsp. aureus Mu50
uaagcagagccauaaugagagu

SEQ ID NO: 2057987 - RNA, 17 nt, Staphylococcus aureus subsp. aureus Mu50
uaagcaguaagaugacu

SEQ ID NO: 2057988 - RNA, 22 nt, Staphylococcus aureus subsp. aureus Mu50
uaagcaguaagaugacuacaac

SEQ ID NO: 2057989 - RNA, 15 nt, Staphylococcus aureus subsp. aureus Mu50
uaagcauaauucaac

SEQ ID NO: 2057990 - RNA, 15 nt, Staphylococcus aureus subsp. aureus Mu50
uaagcaguuaauaag

SEQ ID NO: 2057991 - RNA, 21 nt, Staphylococcus aureus subsp. aureus Mu50
uaagcaguuaauaagaaacuu

SEQ ID NO: 2057992 - RNA, 18 nt, Staphylococcus aureus subsp. aureus Mu50
uaagcaucacauaugucc

SEQ ID NO: 2057993 - RNA, 15 nt, Staphylococcus aureus subsp. aureus Mu50
uaagcaauguaacuu

SEQ ID NO: 2057994 - RNA, 14 nt, Staphylococcus aureus subsp. aureus Mu50
uaagcaauuucuac

SEQ ID NO: 2057995 - RNA, 17 nt, Staphylococcus aureus subsp. aureus Mu50
uaagccuuuucaaacau

SEQ ID NO: 2057996 - RNA, 15 nt, Staphylococcus aureus subsp. aureus Mu50
uaagcgcaauuaaaa

SEQ ID NO: 2057997 - RNA, 18 nt, Staphylococcus aureus subsp. aureus Mu50
uaagcgcaauuaaaagua

SEQ ID NO: 2057998 - RNA, 21 nt, Staphylococcus aureus subsp. aureus Mu50
uaagcgcaauggccauuugau

SEQ ID NO: 2057999 - RNA, 20 nt, Staphylococcus aureus subsp. aureus Mu50
uaagcauuaauguucaauuu

SEQ ID NO: 2058000 - RNA, 23 nt, Staphylococcus aureus subsp. aureus Mu50
uaagguaagaccccgaaaagagg

SEQ ID NO: 2058001 - RNA, 18 nt, Staphylococcus aureus subsp. aureus Mu50
uaaguaagauuuaaacau

SEQ ID NO: 2058002 - RNA, 13 nt, Staphylococcus aureus subsp. aureus Mu50
uaaguaaaacugc

SEQ ID NO: 2058003 - RNA, 16 nt, Staphylococcus aureus subsp. aureus Mu50
uaaguaaaacugcaau

SEQ ID NO: 2058004 - RNA, 14 nt, Staphylococcus aureus subsp. aureus Mu50
uaagguucuuuuuu

SEQ ID NO: 2058005 - RNA, 20 nt, Staphylococcus aureus subsp. aureus Mu50
uaagucguucaauuguugau

SEQ ID NO: 2058006 - RNA, 20 nt, Staphylococcus aureus subsp. aureus Mu50
uaagucgccuaacuuuuauu

SEQ ID NO: 2058007 - RNA, 19 nt, Staphylococcus aureus subsp. aureus Mu50
uaaguaucggugauuuaau

SEQ ID NO: 2058008 - RNA, 12 nt, Staphylococcus aureus subsp. aureus Mu50
uaaguauucaua

SEQ ID NO: 2058009 - RNA, 15 nt, Staphylococcus aureus subsp. aureus Mu50
uaaguaguuguuaua

SEQ ID NO: 2058010 - RNA, 20 nt, Staphylococcus aureus subsp. aureus Mu50
uaaguauaaugaugugccuc

SEQ ID NO: 2058011 - RNA, 15 nt, Staphylococcus aureus subsp. aureus Mu50
uaaguacauaaaugc

SEQ ID NO: 2058012 - RNA, 17 nt, Staphylococcus aureus subsp. aureus Mu50
uaaguagaaaauaugac

SEQ ID NO: 2058013 - RNA, 17 nt, Staphylococcus aureus subsp. aureus Mu50
uaaguguaaaugaaagu

SEQ ID NO: 2058014 - RNA, 23 nt, Staphylococcus aureus subsp. aureus Mu50
uaagugaugaccaauauucugga

SEQ ID NO: 2058015 - RNA, 23 nt, Staphylococcus aureus subsp. aureus Mu50
uaagugguugaacgguuguauuu

SEQ ID NO: 2058016 - RNA, 12 nt, Staphylococcus aureus subsp. aureus Mu50
uaaguuaaaaau

SEQ ID NO: 2058017 - RNA, 15 nt, Staphylococcus aureus subsp. aureus Mu50
uaaguuaaaaaugua

SEQ ID NO: 2058018 - RNA, 22 nt, Staphylococcus aureus subsp. aureus Mu50
uaagugguuaucacgugcuucg

SEQ ID NO: 2058019 - RNA, 13 nt, Staphylococcus aureus subsp. aureus Mu50
uaagugauaaaua

SEQ ID NO: 2058020 - RNA, 15 nt, Staphylococcus aureus subsp. aureus Mu50
uaagugacacaccac

SEQ ID NO: 2058021 - RNA, 16 nt, Staphylococcus aureus subsp. aureus Mu50
uaagugacacaccacc

SEQ ID NO: 2058022 - RNA, 17 nt, Staphylococcus aureus subsp. aureus Mu50
uaagucuuuuaaaugau

SEQ ID NO: 2058023 - RNA, 15 nt, Staphylococcus aureus subsp. aureus Mu50
uaaguugauuucuac

SEQ ID NO: 2058024 - RNA, 21 nt, Staphylococcus aureus subsp. aureus Mu50
uaaguuugaaggagauauuuu

SEQ ID NO: 2058025 - RNA, 14 nt, Staphylococcus aureus subsp. aureus Mu50
uaaguugauuucua

SEQ ID NO: 2058026 - RNA, 16 nt, Staphylococcus aureus subsp. aureus Mu50
uaaguugaauauaaaa

SEQ ID NO: 2058027 - RNA, 21 nt, Staphylococcus aureus subsp. aureus Mu50
uaaguuauuuggauauuuauu

SEQ ID NO: 2058028 - RNA, 17 nt, Staphylococcus aureus subsp. aureus Mu50
uaaguuaaaauaaaaug

SEQ ID NO: 2058029 - RNA, 21 nt, Staphylococcus aureus subsp. aureus Mu50
uaauaacauccccaaaaauag

SEQ ID NO: 2058030 - RNA, 11 nt, Staphylococcus aureus subsp. aureus Mu50
uaauaaauugu

SEQ ID NO: 2058031 - RNA, 13 nt, Staphylococcus aureus subsp. aureus Mu50
uaauaaauuuaac

SEQ ID NO: 2058032 - RNA, 21 nt, Staphylococcus aureus subsp. aureus Mu50
uaauaaauuuccaaaguaaua

SEQ ID NO: 2058033 - RNA, 11 nt, Staphylococcus aureus subsp. aureus Mu50
uaauaaauauc

SEQ ID NO: 2058034 - RNA, 21 nt, Staphylococcus aureus subsp. aureus Mu50
uaauaaauaggaugaaaaaga

SEQ ID NO: 2058035 - RNA, 22 nt, Staphylococcus aureus subsp. aureus Mu50
uaauaaauaggaugaaaaagau

SEQ ID NO: 2058036 - RNA, 19 nt, Staphylococcus aureus subsp. aureus Mu50
uaauaaaucgaauugaugg

SEQ ID NO: 2058037 - RNA, 19 nt, Staphylococcus aureus subsp. aureus Mu50
uaauaaagcugauuuuuca

SEQ ID NO: 2058038 - RNA, 22 nt, Staphylococcus aureus subsp. aureus Mu50
uaauaaaaacucuaaaaguugu

SEQ ID NO: 2058039 - RNA, 14 nt, Staphylococcus aureus subsp. aureus Mu50
uaaguuuucaauuc

SEQ ID NO: 2058040 - RNA, 18 nt, Staphylococcus aureus subsp. aureus Mu50
uaaauucaaaucuggcac

SEQ ID NO: 2058041 - RNA, 19 nt, Staphylococcus aureus subsp. aureus Mu50
uaaauucccauguauucuu

SEQ ID NO: 2058042 - RNA, 20 nt, Staphylococcus aureus subsp. aureus Mu50
uaaauucccauguauucuua

SEQ ID NO: 2058043 - RNA, 22 nt, Staphylococcus aureus subsp. aureus Mu50
uaaauuccaagagaauuaauaa

SEQ ID NO: 2058044 - RNA, 14 nt, Staphylococcus aureus subsp. aureus Mu50
uaaauucuaucuau

SEQ ID NO: 2058045 - RNA, 13 nt, Staphylococcus aureus subsp. aureus Mu50
uaaauuaaaugca

SEQ ID NO: 2058046 - RNA, 17 nt, Staphylococcus aureus subsp. aureus Mu50
uaaauguuuuauguauu

SEQ ID NO: 2058047 - RNA, 22 nt, Staphylococcus aureus subsp. aureus Mu50
uaaauguugacucguuauucaa

SEQ ID NO: 2058048 - RNA, 20 nt, Staphylococcus aureus subsp. aureus Mu50
uaaauguuauuaaccaucau

SEQ ID NO: 2058049 - RNA, 14 nt, Staphylococcus aureus subsp. aureus Mu50
uaaauuauuuaauu

SEQ ID NO: 2058050 - RNA, 14 nt, Staphylococcus aureus subsp. aureus Mu50
uaaaucgauaacag

SEQ ID NO: 2058051 - RNA, 20 nt, Staphylococcus aureus subsp. aureus Mu50
uaaaucgaauugauggaaaa

SEQ ID NO: 2058052 - RNA, 15 nt, Staphylococcus aureus subsp. aureus Mu50
uaaaugcuaaaagua

SEQ ID NO: 2058053 - RNA, 21 nt, Staphylococcus aureus subsp. aureus Mu50
uaaaugcuuaauuuguuuuaa

SEQ ID NO: 2058054 - RNA, 20 nt, Staphylococcus aureus subsp. aureus Mu50
uaaaugcuggguaauaaauu

SEQ ID NO: 2058055 - RNA, 22 nt, Staphylococcus aureus subsp. aureus Mu50
uaaaugcuggguaauaaauugu

SEQ ID NO: 2058056 - RNA, 22 nt, Staphylococcus aureus subsp. aureus Mu50
uaaaugcuuaauuuguuuuaaa

SEQ ID NO: 2058057 - RNA, 15 nt, Staphylococcus aureus subsp. aureus Mu50
uaacaauuuauuaaa

SEQ ID NO: 2058058 - RNA, 16 nt, Staphylococcus aureus subsp. aureus Mu50
uaacaauuuauuaaaa

SEQ ID NO: 2058059 - RNA, 22 nt, Staphylococcus aureus subsp. aureus Mu50
uaacaauuuauuaaaacgaagu

SEQ ID NO: 2058060 - RNA, 15 nt, Staphylococcus aureus subsp. aureus Mu50
uaacaauuuuaucug

SEQ ID NO: 2058061 - RNA, 23 nt, Staphylococcus aureus subsp. aureus Mu50
uaacaagcauuuuucaauuauag

SEQ ID NO: 2058062 - RNA, 13 nt, Staphylococcus aureus subsp. aureus Mu50
uaacaaguauaaa

SEQ ID NO: 2058063 - RNA, 17 nt, Staphylococcus aureus subsp. aureus Mu50
uaacaaguacaauaaua

SEQ ID NO: 2058064 - RNA, 20 nt, Staphylococcus aureus subsp. aureus Mu50
uaacaaguacaauaauaccu

SEQ ID NO: 2058065 - RNA, 16 nt, Staphylococcus aureus subsp. aureus Mu50
uaacaaguauaaaugc

SEQ ID NO: 2058066 - RNA, 17 nt, Staphylococcus aureus subsp. aureus Mu50
uaacaccaauugaauau

SEQ ID NO: 2058067 - RNA, 18 nt, Staphylococcus aureus subsp. aureus Mu50
uaacacauucaaauaaau

SEQ ID NO: 2058068 - RNA, 15 nt, Staphylococcus aureus subsp. aureus Mu50
uaaauuuuguuagga

SEQ ID NO: 2058069 - RNA, 14 nt, Staphylococcus aureus subsp. aureus Mu50
uaaauuuuuaagaa

SEQ ID NO: 2058070 - RNA, 22 nt, Staphylococcus aureus subsp. aureus Mu50
uaaauugaguuuuuuaaaauaa

SEQ ID NO: 2058071 - RNA, 21 nt, Staphylococcus aureus subsp. aureus Mu50
uaaauuuucuguuuaauuaaa

SEQ ID NO: 2058072 - RNA, 22 nt, Staphylococcus aureus subsp. aureus Mu50
uaaauuuucuguuuaauuaaaa

SEQ ID NO: 2058073 - RNA, 21 nt, Staphylococcus aureus subsp. aureus Mu50
uaaauuuugcgaaaauaucau

SEQ ID NO: 2058074 - RNA, 15 nt, Staphylococcus aureus subsp. aureus Mu50
uaaauuuuguauaac

SEQ ID NO: 2058075 - RNA, 14 nt, Staphylococcus aureus subsp. aureus Mu50
uaaauuuucaucau

SEQ ID NO: 2058076 - RNA, 21 nt, Staphylococcus aureus subsp. aureus Mu50
uaaauugagcaacucaggaau

SEQ ID NO: 2058077 - RNA, 20 nt, Staphylococcus aureus subsp. aureus Mu50
uaaauucuuuucaagaaauu

SEQ ID NO: 2058078 - RNA, 13 nt, Staphylococcus aureus subsp. aureus Mu50
uaaauugagaagu

SEQ ID NO: 2058079 - RNA, 16 nt, Staphylococcus aureus subsp. aureus Mu50
uaacaaaauuaagaag

SEQ ID NO: 2058080 - RNA, 19 nt, Staphylococcus aureus subsp. aureus Mu50
uaacaagaaguaauguuaa

SEQ ID NO: 2058081 - RNA, 13 nt, Staphylococcus aureus subsp. aureus Mu50
uaacaaacauuaa

SEQ ID NO: 2058082 - RNA, 18 nt, Staphylococcus aureus subsp. aureus Mu50
uaaccuaaguuaauuuau

SEQ ID NO: 2058083 - RNA, 14 nt, Staphylococcus aureus subsp. aureus Mu50
uaaccgaaauauug

SEQ ID NO: 2058084 - RNA, 15 nt, Staphylococcus aureus subsp. aureus Mu50
uaaccgaaauauugu

SEQ ID NO: 2058085 - RNA, 19 nt, Staphylococcus aureus subsp. aureus Mu50
uaaccgucacaaaccauuc

SEQ ID NO: 2058086 - RNA, 17 nt, Staphylococcus aureus subsp. aureus Mu50
uaacgcaguugaaaaag

SEQ ID NO: 2058087 - RNA, 21 nt, Staphylococcus aureus subsp. aureus Mu50
uaacgcucaugaguuucucau

SEQ ID NO: 2058088 - RNA, 16 nt, Staphylococcus aureus subsp. aureus Mu50
uaacguacaauguauu

SEQ ID NO: 2058089 - RNA, 20 nt, Staphylococcus aureus subsp. aureus Mu50
uaaccaguucgaaaauuaua

SEQ ID NO: 2058090 - RNA, 16 nt, Staphylococcus aureus subsp. aureus Mu50
uaaccccuccuggugc

SEQ ID NO: 2058091 - RNA, 16 nt, Staphylococcus aureus subsp. aureus Mu50
uaacccuaaaaugaau

SEQ ID NO: 2058092 - RNA, 21 nt, Staphylococcus aureus subsp. aureus Mu50
uaacccuaaagcuaaugcaag

SEQ ID NO: 2058093 - RNA, 20 nt, Staphylococcus aureus subsp. aureus Mu50
uaacccuaaagcuaaugcaa

SEQ ID NO: 2058094 - RNA, 19 nt, Staphylococcus aureus subsp. aureus Mu50
uaaccaguauaauuuucug

SEQ ID NO: 2058095 - RNA, 22 nt, Staphylococcus aureus subsp. aureus Mu50
uaaccaccaucccauuaaacca

SEQ ID NO: 2058096 - RNA, 21 nt, Staphylococcus aureus subsp. aureus Mu50
uaacauccccaaaaauagauu

SEQ ID NO: 2058097 - RNA, 19 nt, Staphylococcus aureus subsp. aureus Mu50
uaacauccugcuuauuaau

SEQ ID NO: 2058098 - RNA, 21 nt, Staphylococcus aureus subsp. aureus Mu50
uaacauccugcuuauuaauug

SEQ ID NO: 2058099 - RNA, 18 nt, Staphylococcus aureus subsp. aureus Mu50
uaacacgcucuuuucaaa

SEQ ID NO: 2058100 - RNA, 20 nt, Staphylococcus aureus subsp. aureus Mu50
uaacacugccggcgcacuua

SEQ ID NO: 2058101 - RNA, 16 nt, Staphylococcus aureus subsp. aureus Mu50
uaaaucauagaggcac

SEQ ID NO: 2058102 - RNA, 14 nt, Staphylococcus aureus subsp. aureus Mu50
uaaaucauagaggc

SEQ ID NO: 2058103 - RNA, 22 nt, Staphylococcus aureus subsp. aureus Mu50
uaaaucauacgagaaauuagaa

SEQ ID NO: 2058104 - RNA, 16 nt, Staphylococcus aureus subsp. aureus Mu50
uaaaucauacgagaaa

SEQ ID NO: 2058105 - RNA, 16 nt, Staphylococcus aureus subsp. aureus Mu50
uaaaucauuucguuca

SEQ ID NO: 2058106 - RNA, 12 nt, Staphylococcus aureus subsp. aureus Mu50
uaaaucauucuu

SEQ ID NO: 2058107 - RNA, 16 nt, Staphylococcus aureus subsp. aureus Mu50
uaaauaucaugcaaaa

SEQ ID NO: 2058108 - RNA, 12 nt, Staphylococcus aureus subsp. aureus Mu50
uaaauaucaauu

SEQ ID NO: 2058109 - RNA, 17 nt, Staphylococcus aureus subsp. aureus Mu50
uaaauaucaauaauucg

SEQ ID NO: 2058110 - RNA, 17 nt, Staphylococcus aureus subsp. aureus Mu50
uaaauauaguaauaaaa

SEQ ID NO: 2058111 - RNA, 18 nt, Staphylococcus aureus subsp. aureus Mu50
uaaaucacugcuuucaag

SEQ ID NO: 2058112 - RNA, 14 nt, Staphylococcus aureus subsp. aureus Mu50
uaaauauuaaauua

SEQ ID NO: 2058113 - RNA, 16 nt, Staphylococcus aureus subsp. aureus Mu50
uaaauauuaaauuauu

SEQ ID NO: 2058114 - RNA, 18 nt, Staphylococcus aureus subsp. aureus Mu50
uaaauaugguuucuuauu

SEQ ID NO: 2058115 - RNA, 22 nt, Staphylococcus aureus subsp. aureus Mu50
uaaauaugacgcgugaauuaaa

SEQ ID NO: 2058116 - RNA, 20 nt, Staphylococcus aureus subsp. aureus Mu50
uaaauaaccgucacaaacca

SEQ ID NO: 2058117 - RNA, 21 nt, Staphylococcus aureus subsp. aureus Mu50
uaaauaacuucguuuuaauaa

SEQ ID NO: 2058118 - RNA, 17 nt, Staphylococcus aureus subsp. aureus Mu50
uaaauaagaugaaauau

SEQ ID NO: 2058119 - RNA, 19 nt, Staphylococcus aureus subsp. aureus Mu50
uaaauaaaaauacauaauu

SEQ ID NO: 2058120 - RNA, 14 nt, Staphylococcus aureus subsp. aureus Mu50
uaaauaaaaauuau

SEQ ID NO: 2058121 - RNA, 15 nt, Staphylococcus aureus subsp. aureus Mu50
uaaauaaaaauuaua

SEQ ID NO: 2058122 - RNA, 20 nt, Staphylococcus aureus subsp. aureus Mu50
uaaauaaaaauuauauaaau

SEQ ID NO: 2058123 - RNA, 12 nt, Staphylococcus aureus subsp. aureus Mu50
uaaauaaguagu

SEQ ID NO: 2058124 - RNA, 17 nt, Staphylococcus aureus subsp. aureus Mu50
uaaauaagugauaaaua

SEQ ID NO: 2058125 - RNA, 15 nt, Staphylococcus aureus subsp. aureus Mu50
uaaauaauaaguuga

SEQ ID NO: 2058126 - RNA, 20 nt, Staphylococcus aureus subsp. aureus Mu50
uaaauaguuuuucauauuca

SEQ ID NO: 2058127 - RNA, 22 nt, Staphylococcus aureus subsp. aureus Mu50
uaaauauaauagaaauaaucac

SEQ ID NO: 2058128 - RNA, 15 nt, Staphylococcus aureus subsp. aureus Mu50
uaaaguuuauuuaug

SEQ ID NO: 2058129 - RNA, 23 nt, Staphylococcus aureus subsp. aureus Mu50
uaaaguugacaauacaaaucgau

SEQ ID NO: 2058130 - RNA, 16 nt, Staphylococcus aureus subsp. aureus Mu50
uaaaguuauaaauuau

SEQ ID NO: 2058131 - RNA, 20 nt, Staphylococcus aureus subsp. aureus Mu50
uaaaguuauaaauuauauuu

SEQ ID NO: 2058132 - RNA, 18 nt, Staphylococcus aureus subsp. aureus Mu50
uaaaguuacaugcucuuu

SEQ ID NO: 2058133 - RNA, 12 nt, Staphylococcus aureus subsp. aureus Mu50
uaaaguuacaug

SEQ ID NO: 2058134 - RNA, 16 nt, Staphylococcus aureus subsp. aureus Mu50
uaaaguguuucaacau

SEQ ID NO: 2058135 - RNA, 17 nt, Staphylococcus aureus subsp. aureus Mu50
uaaaguguuucaacaua

SEQ ID NO: 2058136 - RNA, 17 nt, Staphylococcus aureus subsp. aureus Mu50
uaaagugcguuuuucga

SEQ ID NO: 2058137 - RNA, 16 nt, Staphylococcus aureus subsp. aureus Mu50
uaaagucaauuuaaau

SEQ ID NO: 2058138 - RNA, 21 nt, Staphylococcus aureus subsp. aureus Mu50
uaaaguauaagguugaagaag

SEQ ID NO: 2058139 - RNA, 16 nt, Staphylococcus aureus subsp. aureus Mu50
uaaaguauguugucau

SEQ ID NO: 2058140 - RNA, 23 nt, Staphylococcus aureus subsp. aureus Mu50
uaaagucuucaucuuuaaagaaa

SEQ ID NO: 2058141 - RNA, 17 nt, Staphylococcus aureus subsp. aureus Mu50
uaaaguacuuacaaaua

SEQ ID NO: 2058142 - RNA, 15 nt, Staphylococcus aureus subsp. aureus Mu50
uaaaguaaauaacac

SEQ ID NO: 2058143 - RNA, 22 nt, Staphylococcus aureus subsp. aureus Mu50
uaaaggaauagcuacaauuaaa

SEQ ID NO: 2058144 - RNA, 18 nt, Staphylococcus aureus subsp. aureus Mu50
uaaagaugucgaaaagua

SEQ ID NO: 2058145 - RNA, 16 nt, Staphylococcus aureus subsp. aureus Mu50
uaaaggaaaucaaucc

SEQ ID NO: 2058146 - RNA, 17 nt, Staphylococcus aureus subsp. aureus Mu50
uaaagcuugcuguucaa

SEQ ID NO: 2058147 - RNA, 15 nt, Staphylococcus aureus subsp. aureus Mu50
uaaacaacuucugaa

SEQ ID NO: 2058148 - RNA, 19 nt, Staphylococcus aureus subsp. aureus Mu50
uaaacaagcaucaugaaau

SEQ ID NO: 2058149 - RNA, 21 nt, Staphylococcus aureus subsp. aureus Mu50
uaaacaacugagucaaaguca

SEQ ID NO: 2058150 - RNA, 23 nt, Staphylococcus aureus subsp. aureus Mu50
uaaacaacugagucaaagucauu

SEQ ID NO: 2058151 - RNA, 21 nt, Staphylococcus aureus subsp. aureus Mu50
uaaacaacugcaauagcuaua

SEQ ID NO: 2058152 - RNA, 15 nt, Staphylococcus aureus subsp. aureus Mu50
uaaacaaauaaaugu

SEQ ID NO: 2058153 - RNA, 22 nt, Staphylococcus aureus subsp. aureus Mu50
uaaacaacaucgauuuaucauu

SEQ ID NO: 2058154 - RNA, 12 nt, Staphylococcus aureus subsp. aureus Mu50
guuuuuccaugu

SEQ ID NO: 2058155 - RNA, 20 nt, Staphylococcus aureus subsp. aureus Mu50
guuuuucaucauuaaaauca

SEQ ID NO: 2058156 - RNA, 12 nt, Staphylococcus aureus subsp. aureus Mu50
guuuuucaucaa

SEQ ID NO: 2058157 - RNA, 18 nt, Staphylococcus aureus subsp. aureus Mu50
uaaaccaacuuucucaag

SEQ ID NO: 2058158 - RNA, 22 nt, Staphylococcus aureus subsp. aureus Mu50
uaaaccaaaucggaauaaaaua

SEQ ID NO: 2058159 - RNA, 20 nt, Staphylococcus aureus subsp. aureus Mu50
uaaacauuuuugaauuuaau

SEQ ID NO: 2058160 - RNA, 13 nt, Staphylococcus aureus subsp. aureus Mu50
uaaacauuuagau

SEQ ID NO: 2058161 - RNA, 11 nt, Staphylococcus aureus subsp. aureus Mu50
uaaacauuuuu

SEQ ID NO: 2058162 - RNA, 23 nt, Staphylococcus aureus subsp. aureus Mu50
uaaaccgcacuucuauauuaaua

SEQ ID NO: 2058163 - RNA, 20 nt, Staphylococcus aureus subsp. aureus Mu50
uaaaccgcacuucuauauua

SEQ ID NO: 2058164 - RNA, 17 nt, Staphylococcus aureus subsp. aureus Mu50
uaaacacuauaaaagcc

SEQ ID NO: 2058165 - RNA, 18 nt, Staphylococcus aureus subsp. aureus Mu50
uaaacacuuuaguauuau

SEQ ID NO: 2058166 - RNA, 23 nt, Staphylococcus aureus subsp. aureus Mu50
uaaacacuauaaaagccaugaua

SEQ ID NO: 2058167 - RNA, 22 nt, Staphylococcus aureus subsp. aureus Mu50
uaaaccuacuaauauauuaauu

SEQ ID NO: 2058168 - RNA, 19 nt, Staphylococcus aureus subsp. aureus Mu50
uaaaccucaacauuaaaau

SEQ ID NO: 2058169 - RNA, 16 nt, Staphylococcus aureus subsp. aureus Mu50
uaaaccuaaugcuuua

SEQ ID NO: 2058170 - RNA, 16 nt, Staphylococcus aureus subsp. aureus Mu50
uaaaccuacaauauag

SEQ ID NO: 2058171 - RNA, 20 nt, Staphylococcus aureus subsp. aureus Mu50
uaaaccguauagucauuaca

SEQ ID NO: 2058172 - RNA, 18 nt, Staphylococcus aureus subsp. aureus Mu50
uaaacggaauaacuuuuu

SEQ ID NO: 2058173 - RNA, 20 nt, Staphylococcus aureus subsp. aureus Mu50
uaaacuagaaaacauaaaua

SEQ ID NO: 2058174 - RNA, 19 nt, Staphylococcus aureus subsp. aureus Mu50
uaaacuaguaauagaauag

SEQ ID NO: 2058175 - RNA, 20 nt, Staphylococcus aureus subsp. aureus Mu50
uaaacucguugcacucuuuu

SEQ ID NO: 2058176 - RNA, 16 nt, Staphylococcus aureus subsp. aureus Mu50
uaaacuauaauaauug

SEQ ID NO: 2058177 - RNA, 15 nt, Staphylococcus aureus subsp. aureus Mu50
uaaacucauaccaaa

SEQ ID NO: 2058178 - RNA, 14 nt, Staphylococcus aureus subsp. aureus Mu50
uaaacuaguaauag

SEQ ID NO: 2058179 - RNA, 14 nt, Staphylococcus aureus subsp. aureus Mu50
uaaacuauaauaau

SEQ ID NO: 2058180 - RNA, 17 nt, Staphylococcus aureus subsp. aureus Mu50
uaaagauagaaugaaua

SEQ ID NO: 2058181 - RNA, 16 nt, Staphylococcus aureus subsp. aureus Mu50
uaaagauaagaugguu

SEQ ID NO: 2058182 - RNA, 13 nt, Staphylococcus aureus subsp. aureus Mu50
uaaagaaugauuu

SEQ ID NO: 2058183 - RNA, 19 nt, Staphylococcus aureus subsp. aureus Mu50
uaaagaaugauuuauaaaa

SEQ ID NO: 2058184 - RNA, 21 nt, Staphylococcus aureus subsp. aureus Mu50
uaaagaaugauuuauaaaaaa

SEQ ID NO: 2058185 - RNA, 15 nt, Staphylococcus aureus subsp. aureus Mu50
uaaagaauuaaguag

SEQ ID NO: 2058186 - RNA, 16 nt, Staphylococcus aureus subsp. aureus Mu50
uaaagaauuaaguagu

SEQ ID NO: 2058187 - RNA, 13 nt, Staphylococcus aureus subsp. aureus Mu50
uaaacuuauuaau

SEQ ID NO: 2058188 - RNA, 19 nt, Staphylococcus aureus subsp. aureus Mu50
uaaacuuauuaauuaauag

SEQ ID NO: 2058189 - RNA, 13 nt, Staphylococcus aureus subsp. aureus Mu50
uaaacuuaagaau

SEQ ID NO: 2058190 - RNA, 21 nt, Staphylococcus aureus subsp. aureus Mu50
gcugcaagucucauaucuauu

SEQ ID NO: 2058191 - RNA, 20 nt, Staphylococcus aureus subsp. aureus Mu50
gcugaaucgaguuugaaaua

SEQ ID NO: 2058192 - RNA, 23 nt, Staphylococcus aureus subsp. aureus Mu50
gcugaacguaaguuuaguucaaa

SEQ ID NO: 2058193 - RNA, 21 nt, Staphylococcus aureus subsp. aureus Mu50
gcugaaauuuuuuagugaaaa

SEQ ID NO: 2058194 - RNA, 15 nt, Staphylococcus aureus subsp. aureus Mu50
gcugcuguacaauuu

SEQ ID NO: 2058195 - RNA, 17 nt, Staphylococcus aureus subsp. aureus Mu50
gcugcuguacaauuucg

SEQ ID NO: 2058196 - RNA, 18 nt, Staphylococcus aureus subsp. aureus Mu50
gcuggacagcuacaauuu

SEQ ID NO: 2058197 - RNA, 23 nt, Staphylococcus aureus subsp. aureus Mu50
gcugcuauccuugcuaucaaacu

SEQ ID NO: 2058198 - RNA, 20 nt, Staphylococcus aureus subsp. aureus Mu50
gcugccuaaucgcacucugc

SEQ ID NO: 2058199 - RNA, 17 nt, Staphylococcus aureus subsp. aureus Mu50
gcucuaauccaaaauaa

SEQ ID NO: 2058200 - RNA, 18 nt, Staphylococcus aureus subsp. aureus Mu50
gcucuaauucaaugauuu

SEQ ID NO: 2058201 - RNA, 22 nt, Staphylococcus aureus subsp. aureus Mu50
gcucuaauucaaugauuuuuaa

SEQ ID NO: 2058202 - RNA, 15 nt, Staphylococcus aureus subsp. aureus Mu50
gcucuauaucaaauu

SEQ ID NO: 2058203 - RNA, 15 nt, Staphylococcus aureus subsp. aureus Mu50
gcucauccucauuaa

SEQ ID NO: 2058204 - RNA, 20 nt, Staphylococcus aureus subsp. aureus Mu50
gcuuuaguaguguauucauu

SEQ ID NO: 2058205 - RNA, 19 nt, Staphylococcus aureus subsp. aureus Mu50
gcuuuagucgguguuuucu

SEQ ID NO: 2058206 - RNA, 16 nt, Staphylococcus aureus subsp. aureus Mu50
gcuuuagcucuuuuuu

SEQ ID NO: 2058207 - RNA, 16 nt, Staphylococcus aureus subsp. aureus Mu50
gcuuuagcaauugaau

SEQ ID NO: 2058208 - RNA, 13 nt, Staphylococcus aureus subsp. aureus Mu50
gcuuguucaacua

SEQ ID NO: 2058209 - RNA, 13 nt, Staphylococcus aureus subsp. aureus Mu50
gcuuuaauuaaag

SEQ ID NO: 2058210 - RNA, 13 nt, Staphylococcus aureus subsp. aureus Mu50
gcuuuaauuuuuu

SEQ ID NO: 2058211 - RNA, 13 nt, Staphylococcus aureus subsp. aureus Mu50
gcuuuaauauaau

SEQ ID NO: 2058212 - RNA, 13 nt, Staphylococcus aureus subsp. aureus Mu50
gcuuucauuaauu

SEQ ID NO: 2058213 - RNA, 13 nt, Staphylococcus aureus subsp. aureus Mu50
gcuuuaugaauca

SEQ ID NO: 2058214 - RNA, 23 nt, Staphylococcus aureus subsp. aureus Mu50
gcuuuauuuucuuguguauuuuu

SEQ ID NO: 2058215 - RNA, 20 nt, Staphylococcus aureus subsp. aureus Mu50
aaaggcgucuuaaauuaggg

SEQ ID NO: 2058216 - RNA, 17 nt, Staphylococcus aureus subsp. aureus Mu50
aaaggcgaaacauuaaa

SEQ ID NO: 2058217 - RNA, 17 nt, Staphylococcus aureus subsp. aureus Mu50
gcuugugugaaauuaga

SEQ ID NO: 2058218 - RNA, 14 nt, Staphylococcus aureus subsp. aureus Mu50
gcuuguaaaauuuu

SEQ ID NO: 2058219 - RNA, 15 nt, Staphylococcus aureus subsp. aureus Mu50
gcuuguaaaauuuuc

SEQ ID NO: 2058220 - RNA, 18 nt, Staphylococcus aureus subsp. aureus Mu50
gcuuguaacaagcauuuu

SEQ ID NO: 2058221 - RNA, 16 nt, Staphylococcus aureus subsp. aureus Mu50
gcuugcuuacaauaau

SEQ ID NO: 2058222 - RNA, 14 nt, Staphylococcus aureus subsp. aureus Mu50
gcuuggacauauac

SEQ ID NO: 2058223 - RNA, 22 nt, Staphylococcus aureus subsp. aureus Mu50
aaaggauuauuaacuuuaauau

SEQ ID NO: 2058224 - RNA, 19 nt, Staphylococcus aureus subsp. aureus Mu50
gcuucuuaucaacaacaag

SEQ ID NO: 2058225 - RNA, 14 nt, Staphylococcus aureus subsp. aureus Mu50
gcuucuucuucaga

SEQ ID NO: 2058226 - RNA, 22 nt, Staphylococcus aureus subsp. aureus Mu50
gcuucuguguuggggcccacac

SEQ ID NO: 2058227 - RNA, 23 nt, Staphylococcus aureus subsp. aureus Mu50
gcuucuguguuggggcccacacc

SEQ ID NO: 2058228 - RNA, 13 nt, Staphylococcus aureus subsp. aureus Mu50
gcuucuuaaauca

SEQ ID NO: 2058229 - RNA, 18 nt, Staphylococcus aureus subsp. aureus Mu50
gcuucgcuagaaccugcu

SEQ ID NO: 2058230 - RNA, 21 nt, Staphylococcus aureus subsp. aureus Mu50
gcuuccaauuuaaaaugauuc

SEQ ID NO: 2058231 - RNA, 18 nt, Staphylococcus aureus subsp. aureus Mu50
gcuuccacuucaucuaaa

SEQ ID NO: 2058232 - RNA, 21 nt, Staphylococcus aureus subsp. aureus Mu50
gcuucauuauauaauucuuca

SEQ ID NO: 2058233 - RNA, 20 nt, Staphylococcus aureus subsp. aureus Mu50
gcuuccucucguaaauuguu

SEQ ID NO: 2058234 - RNA, 17 nt, Staphylococcus aureus subsp. aureus Mu50
gcuuaucaacagcuuca

SEQ ID NO: 2058235 - RNA, 22 nt, Staphylococcus aureus subsp. aureus Mu50
gcuuagcaguucuauugucagc

SEQ ID NO: 2058236 - RNA, 23 nt, Staphylococcus aureus subsp. aureus Mu50
gcuuagggcuuuguuuucugucc

SEQ ID NO: 2058237 - RNA, 22 nt, Staphylococcus aureus subsp. aureus Mu50
gcuuauauaaacaaaaaucuac

SEQ ID NO: 2058238 - RNA, 17 nt, Staphylococcus aureus subsp. aureus Mu50
gcuuauuuuuguauucu

SEQ ID NO: 2058239 - RNA, 13 nt, Staphylococcus aureus subsp. aureus Mu50
gcuuauugaaaag

SEQ ID NO: 2058240 - RNA, 17 nt, Staphylococcus aureus subsp. aureus Mu50
gcuuauugaaaagauaa

SEQ ID NO: 2058241 - RNA, 15 nt, Staphylococcus aureus subsp. aureus Mu50
gcuucaaauguaaca

SEQ ID NO: 2058242 - RNA, 20 nt, Staphylococcus aureus subsp. aureus Mu50
gcuguuaauaaaucauuagu

SEQ ID NO: 2058243 - RNA, 12 nt, Staphylococcus aureus subsp. aureus Mu50
gcugucauaccu

SEQ ID NO: 2058244 - RNA, 15 nt, Staphylococcus aureus subsp. aureus Mu50
gcugucauaccuuuu

SEQ ID NO: 2058245 - RNA, 17 nt, Staphylococcus aureus subsp. aureus Mu50
gcugucauuuucugcuu

SEQ ID NO: 2058246 - RNA, 17 nt, Staphylococcus aureus subsp. aureus Mu50
gcuguccacuauauccu

SEQ ID NO: 2058247 - RNA, 17 nt, Staphylococcus aureus subsp. aureus Mu50
gcuguuacacuuuucuu

SEQ ID NO: 2058248 - RNA, 12 nt, Staphylococcus aureus subsp. aureus Mu50
gcugugucuuuu

SEQ ID NO: 2058249 - RNA, 21 nt, Staphylococcus aureus subsp. aureus Mu50
gcuguguacguuucaauguau

SEQ ID NO: 2058250 - RNA, 16 nt, Staphylococcus aureus subsp. aureus Mu50
gcuuaagaaauuuuuu

SEQ ID NO: 2058251 - RNA, 14 nt, Staphylococcus aureus subsp. aureus Mu50
gcuuaauucuucau

SEQ ID NO: 2058252 - RNA, 16 nt, Staphylococcus aureus subsp. aureus Mu50
gcuuaauuuuauuauu

SEQ ID NO: 2058253 - RNA, 13 nt, Staphylococcus aureus subsp. aureus Mu50
gcuguuugauauu

SEQ ID NO: 2058254 - RNA, 23 nt, Staphylococcus aureus subsp. aureus Mu50
gcuguuuuuauuauaauagagaa

SEQ ID NO: 2058255 - RNA, 20 nt, Staphylococcus aureus subsp. aureus Mu50
gcuguuuuuauuauaauaga

SEQ ID NO: 2058256 - RNA, 21 nt, Staphylococcus aureus subsp. aureus Mu50
gcuguuggcaaaacaauauac

SEQ ID NO: 2058257 - RNA, 16 nt, Staphylococcus aureus subsp. aureus Mu50
aaaggaccacuuagau

SEQ ID NO: 2058258 - RNA, 22 nt, Staphylococcus aureus subsp. aureus Mu50
aaaggaggagauuguuauuaua

SEQ ID NO: 2058259 - RNA, 23 nt, Staphylococcus aureus subsp. aureus Mu50
aaaggaugaugugaauguuuugu

SEQ ID NO: 2058260 - RNA, 20 nt, Staphylococcus aureus subsp. aureus Mu50
aaaggaaauggcuccauuua

SEQ ID NO: 2058261 - RNA, 21 nt, Staphylococcus aureus subsp. aureus Mu50
ggcauuauauuuaguccucuu

SEQ ID NO: 2058262 - RNA, 21 nt, Staphylococcus aureus subsp. aureus Mu50
aaaguauuagauauauuugaa

SEQ ID NO: 2058263 - RNA, 20 nt, Staphylococcus aureus subsp. aureus Mu50
aaagucauacuuaugagcaa

SEQ ID NO: 2058264 - RNA, 18 nt, Staphylococcus aureus subsp. aureus Mu50
aaagucacaguguaauca

SEQ ID NO: 2058265 - RNA, 13 nt, Staphylococcus aureus subsp. aureus Mu50
aaagucaaaaaau

SEQ ID NO: 2058266 - RNA, 16 nt, Staphylococcus aureus subsp. aureus Mu50
aaagucaauuuaaaua

SEQ ID NO: 2058267 - RNA, 23 nt, Staphylococcus aureus subsp. aureus Mu50
ggcaguaauuuucauuguuucag

SEQ ID NO: 2058268 - RNA, 18 nt, Staphylococcus aureus subsp. aureus Mu50
aaaguagaauuauuuaga

SEQ ID NO: 2058269 - RNA, 19 nt, Staphylococcus aureus subsp. aureus Mu50
aaaguagaauuauuuagaa

SEQ ID NO: 2058270 - RNA, 16 nt, Staphylococcus aureus subsp. aureus Mu50
aaaguagacauugaaa

SEQ ID NO: 2058271 - RNA, 13 nt, Staphylococcus aureus subsp. aureus Mu50
aaaguagauauug

SEQ ID NO: 2058272 - RNA, 16 nt, Staphylococcus aureus subsp. aureus Mu50
aaaguauaaaccaaau

SEQ ID NO: 2058273 - RNA, 12 nt, Staphylococcus aureus subsp. aureus Mu50
aaaguauaaggu

SEQ ID NO: 2058274 - RNA, 21 nt, Staphylococcus aureus subsp. aureus Mu50
ggcagacguaucaucaaaguu

SEQ ID NO: 2058275 - RNA, 20 nt, Staphylococcus aureus subsp. aureus Mu50
aaagucguuguugaaauuaa

SEQ ID NO: 2058276 - RNA, 21 nt, Staphylococcus aureus subsp. aureus Mu50
aaagucguuguugaaauuaaa

SEQ ID NO: 2058277 - RNA, 24 nt, Staphylococcus aureus subsp. aureus Mu50
aaagucuuucucggcgauaaaaug

SEQ ID NO: 2058278 - RNA, 19 nt, Staphylococcus aureus subsp. aureus Mu50
aaagugaaaacuucucuau

SEQ ID NO: 2058279 - RNA, 13 nt, Staphylococcus aureus subsp. aureus Mu50
aaagugaauugua

SEQ ID NO: 2058280 - RNA, 15 nt, Staphylococcus aureus subsp. aureus Mu50
aaagugaaaguauua

SEQ ID NO: 2058281 - RNA, 15 nt, Staphylococcus aureus subsp. aureus Mu50
aaagucugucugaau

SEQ ID NO: 2058282 - RNA, 21 nt, Staphylococcus aureus subsp. aureus Mu50
aaagucuguugguuuaucagc

SEQ ID NO: 2058283 - RNA, 14 nt, Staphylococcus aureus subsp. aureus Mu50
aaagugauucccaa

SEQ ID NO: 2058284 - RNA, 18 nt, Staphylococcus aureus subsp. aureus Mu50
ggccccgacuauuuuuga

SEQ ID NO: 2058285 - RNA, 13 nt, Staphylococcus aureus subsp. aureus Mu50
ggauucaaaugac

SEQ ID NO: 2058286 - RNA, 19 nt, Staphylococcus aureus subsp. aureus Mu50
ggauuaaaagcaucuuuaa

SEQ ID NO: 2058287 - RNA, 16 nt, Staphylococcus aureus subsp. aureus Mu50
ggauguuuucguuugc

SEQ ID NO: 2058288 - RNA, 13 nt, Staphylococcus aureus subsp. aureus Mu50
aaaguacuuacaa

SEQ ID NO: 2058289 - RNA, 15 nt, Staphylococcus aureus subsp. aureus Mu50
aaaguacuuacaaau

SEQ ID NO: 2058290 - RNA, 22 nt, Staphylococcus aureus subsp. aureus Mu50
ggauguuauaaaaugaauaauu

SEQ ID NO: 2058291 - RNA, 16 nt, Staphylococcus aureus subsp. aureus Mu50
aaaguaccuaaaauag

SEQ ID NO: 2058292 - RNA, 21 nt, Staphylococcus aureus subsp. aureus Mu50
aaaguaccuaaaauagaaaaa

SEQ ID NO: 2058293 - RNA, 22 nt, Staphylococcus aureus subsp. aureus Mu50
aaaguaccuaaaauagaaaaau

SEQ ID NO: 2058294 - RNA, 19 nt, Staphylococcus aureus subsp. aureus Mu50
aaaguacaaguugaucaaa

SEQ ID NO: 2058295 - RNA, 23 nt, Staphylococcus aureus subsp. aureus Mu50
aaaguacaaguugaucaaaaaug

SEQ ID NO: 2058296 - RNA, 14 nt, Staphylococcus aureus subsp. aureus Mu50
aaaguaauuaaaua

SEQ ID NO: 2058297 - RNA, 13 nt, Staphylococcus aureus subsp. aureus Mu50
aaaguaaugcugu

SEQ ID NO: 2058298 - RNA, 13 nt, Staphylococcus aureus subsp. aureus Mu50
aaaguaaguaaaa

SEQ ID NO: 2058299 - RNA, 16 nt, Staphylococcus aureus subsp. aureus Mu50
aaaguaaguaaaauaa

SEQ ID NO: 2058300 - RNA, 22 nt, Staphylococcus aureus subsp. aureus Mu50
ggaugggccccaacaaagagaa

SEQ ID NO: 2058301 - RNA, 16 nt, Staphylococcus aureus subsp. aureus Mu50
ggauguaauagagaag

SEQ ID NO: 2058302 - RNA, 19 nt, Staphylococcus aureus subsp. aureus Mu50
ggaucauuauuuagaauuc

SEQ ID NO: 2058303 - RNA, 13 nt, Staphylococcus aureus subsp. aureus Mu50
ggauaucuuuguu

SEQ ID NO: 2058304 - RNA, 13 nt, Staphylococcus aureus subsp. aureus Mu50
ggauaagaacgag

SEQ ID NO: 2058305 - RNA, 14 nt, Staphylococcus aureus subsp. aureus Mu50
ggauaauuuuauug

SEQ ID NO: 2058306 - RNA, 15 nt, Staphylococcus aureus subsp. aureus Mu50
ggagcauuucauuag

SEQ ID NO: 2058307 - RNA, 12 nt, Staphylococcus aureus subsp. aureus Mu50
ggauaaagaugu

SEQ ID NO: 2058308 - RNA, 18 nt, Staphylococcus aureus subsp. aureus Mu50
aaagguaacuuuuuaacu

SEQ ID NO: 2058309 - RNA, 12 nt, Staphylococcus aureus subsp. aureus Mu50
aaaggucaucug

SEQ ID NO: 2058310 - RNA, 17 nt, Staphylococcus aureus subsp. aureus Mu50
aaaggucccauuaaaau

SEQ ID NO: 2058311 - RNA, 18 nt, Staphylococcus aureus subsp. aureus Mu50
aaagguauucuauuuuuc

SEQ ID NO: 2058312 - RNA, 21 nt, Staphylococcus aureus subsp. aureus Mu50
aaaguaacauacuauaaaaau

SEQ ID NO: 2058313 - RNA, 17 nt, Staphylococcus aureus subsp. aureus Mu50
ggagcacuaucuuuugc

SEQ ID NO: 2058314 - RNA, 14 nt, Staphylococcus aureus subsp. aureus Mu50
ggagauuagagaag

SEQ ID NO: 2058315 - RNA, 17 nt, Staphylococcus aureus subsp. aureus Mu50
ggaccuuguaaauuuaa

SEQ ID NO: 2058316 - RNA, 15 nt, Staphylococcus aureus subsp. aureus Mu50
aaaggcucauuuguu

SEQ ID NO: 2058317 - RNA, 18 nt, Staphylococcus aureus subsp. aureus Mu50
aaaggcucauuuguuaaa

SEQ ID NO: 2058318 - RNA, 18 nt, Staphylococcus aureus subsp. aureus Mu50
ggaaguuaggcaacuaaa

SEQ ID NO: 2058319 - RNA, 15 nt, Staphylococcus aureus subsp. aureus Mu50
ggaauaacuuuuuaa

SEQ ID NO: 2058320 - RNA, 20 nt, Staphylococcus aureus subsp. aureus Mu50
ggaauacagaugaugcuucg

SEQ ID NO: 2058321 - RNA, 18 nt, Staphylococcus aureus subsp. aureus Mu50
ggaacuacuacauuauua

SEQ ID NO: 2058322 - RNA, 22 nt, Staphylococcus aureus subsp. aureus Mu50
ggaaauuuauuauaaaauagaa

SEQ ID NO: 2058323 - RNA, 13 nt, Staphylococcus aureus subsp. aureus Mu50
ggucugcuguauc

SEQ ID NO: 2058324 - RNA, 20 nt, Staphylococcus aureus subsp. aureus Mu50
ggucgugagccccucccaag

SEQ ID NO: 2058325 - RNA, 18 nt, Staphylococcus aureus subsp. aureus Mu50
ggucauagaaauuuuaaa

SEQ ID NO: 2058326 - RNA, 18 nt, Staphylococcus aureus subsp. aureus Mu50
gguaugauuuuugaacca

SEQ ID NO: 2058327 - RNA, 19 nt, Staphylococcus aureus subsp. aureus Mu50
gguauucaaauaaacacau

SEQ ID NO: 2058328 - RNA, 15 nt, Staphylococcus aureus subsp. aureus Mu50
gguaugacugcaaau

SEQ ID NO: 2058329 - RNA, 18 nt, Staphylococcus aureus subsp. aureus Mu50
gguauuuauagauuuaaa

SEQ ID NO: 2058330 - RNA, 15 nt, Staphylococcus aureus subsp. aureus Mu50
gguauaaaaaaauua

SEQ ID NO: 2058331 - RNA, 18 nt, Staphylococcus aureus subsp. aureus Mu50
gguauaucuucauuuaaa

SEQ ID NO: 2058332 - RNA, 18 nt, Staphylococcus aureus subsp. aureus Mu50
gguauccuucucaucauu

SEQ ID NO: 2058333 - RNA, 19 nt, Staphylococcus aureus subsp. aureus Mu50
gguacacuucaacauauaa

SEQ ID NO: 2058334 - RNA, 22 nt, Staphylococcus aureus subsp. aureus Mu50
gguacaccuacaaauauuucua

SEQ ID NO: 2058335 - RNA, 13 nt, Staphylococcus aureus subsp. aureus Mu50
gguacuuuuuuga

SEQ ID NO: 2058336 - RNA, 15 nt, Staphylococcus aureus subsp. aureus Mu50
gggugagggccccaa

SEQ ID NO: 2058337 - RNA, 19 nt, Staphylococcus aureus subsp. aureus Mu50
gggugagggccccaacaca

SEQ ID NO: 2058338 - RNA, 10 nt, Staphylococcus aureus subsp. aureus Mu50
gguaauaauu

SEQ ID NO: 2058339 - RNA, 12 nt, Staphylococcus aureus subsp. aureus Mu50
gguaauacuuuu

SEQ ID NO: 2058340 - RNA, 13 nt, Staphylococcus aureus subsp. aureus Mu50
gguaacuuuuuaa

SEQ ID NO: 2058341 - RNA, 19 nt, Staphylococcus aureus subsp. aureus Mu50
gguaagaccccgaaaagag

SEQ ID NO: 2058342 - RNA, 11 nt, Staphylococcus aureus subsp. aureus Mu50
gguaaaaaguu

SEQ ID NO: 2058343 - RNA, 18 nt, Staphylococcus aureus subsp. aureus Mu50
gguaaaaaucucaaaauu

SEQ ID NO: 2058344 - RNA, 22 nt, Staphylococcus aureus subsp. aureus Mu50
gguaaaucuguuuaaauuuaaa

SEQ ID NO: 2058345 - RNA, 11 nt, Staphylococcus aureus subsp. aureus Mu50
gggcccacacc

SEQ ID NO: 2058346 - RNA, 13 nt, Staphylococcus aureus subsp. aureus Mu50
gggcccccaacac

SEQ ID NO: 2058347 - RNA, 14 nt, Staphylococcus aureus subsp. aureus Mu50
gggcccccaacaca

SEQ ID NO: 2058348 - RNA, 17 nt, Staphylococcus aureus subsp. aureus Mu50
gggccccaacacagaga

SEQ ID NO: 2058349 - RNA, 12 nt, Staphylococcus aureus subsp. aureus Mu50
ggguaauguuuu

SEQ ID NO: 2058350 - RNA, 12 nt, Staphylococcus aureus subsp. aureus Mu50
gggcuucugcua

SEQ ID NO: 2058351 - RNA, 17 nt, Staphylococcus aureus subsp. aureus Mu50
ggggacuuaaccauuua

SEQ ID NO: 2058352 - RNA, 23 nt, Staphylococcus aureus subsp. aureus Mu50
ggggauuuuuuuauguuugggau

SEQ ID NO: 2058353 - RNA, 18 nt, Staphylococcus aureus subsp. aureus Mu50
ggggccccaacacagaga

SEQ ID NO: 2058354 - RNA, 14 nt, Staphylococcus aureus subsp. aureus Mu50
gggacagaaaacaa

SEQ ID NO: 2058355 - RNA, 21 nt, Staphylococcus aureus subsp. aureus Mu50
gggaauacagcuagcaagaau

SEQ ID NO: 2058356 - RNA, 22 nt, Staphylococcus aureus subsp. aureus Mu50
ggcuuuuuauaccaauaauuac

SEQ ID NO: 2058357 - RNA, 19 nt, Staphylococcus aureus subsp. aureus Mu50
ggcuuuuuguuuugaaugu

SEQ ID NO: 2058358 - RNA, 19 nt, Staphylococcus aureus subsp. aureus Mu50
ggcuuuuuuuauggugugg

SEQ ID NO: 2058359 - RNA, 21 nt, Staphylococcus aureus subsp. aureus Mu50
ggcuuuuuuauuuuauaagaa

SEQ ID NO: 2058360 - RNA, 16 nt, Staphylococcus aureus subsp. aureus Mu50
gggaaauauuugaaaa

SEQ ID NO: 2058361 - RNA, 18 nt, Staphylococcus aureus subsp. aureus Mu50
gggauuuuuuuauguuug

SEQ ID NO: 2058362 - RNA, 22 nt, Staphylococcus aureus subsp. aureus Mu50
ggcuugugaaugguugauuaua

SEQ ID NO: 2058363 - RNA, 17 nt, Staphylococcus aureus subsp. aureus Mu50
ggcuugguuauuuucaa

SEQ ID NO: 2058364 - RNA, 20 nt, Staphylococcus aureus subsp. aureus Mu50
aaauaaccgcacuuucuauu

SEQ ID NO: 2058365 - RNA, 21 nt, Staphylococcus aureus subsp. aureus Mu50
aaauaaauuuugcgaaaauau

SEQ ID NO: 2058366 - RNA, 21 nt, Staphylococcus aureus subsp. aureus Mu50
aaauaacuagauguucacauu

SEQ ID NO: 2058367 - RNA, 19 nt, Staphylococcus aureus subsp. aureus Mu50
aaauaacugcuaauuuuuu

SEQ ID NO: 2058368 - RNA, 18 nt, Staphylococcus aureus subsp. aureus Mu50
aaauaacuguaaaacauu

SEQ ID NO: 2058369 - RNA, 20 nt, Staphylococcus aureus subsp. aureus Mu50
aaauaacuucguuuuaauaa

SEQ ID NO: 2058370 - RNA, 19 nt, Staphylococcus aureus subsp. aureus Mu50
aaauaacguuaauauaauu

SEQ ID NO: 2058371 - RNA, 20 nt, Staphylococcus aureus subsp. aureus Mu50
aaauaacuuuuuaaaggacc

SEQ ID NO: 2058372 - RNA, 14 nt, Staphylococcus aureus subsp. aureus Mu50
ggccuuuuuuauug

SEQ ID NO: 2058373 - RNA, 14 nt, Staphylococcus aureus subsp. aureus Mu50
ggccuuuaaugauu

SEQ ID NO: 2058374 - RNA, 14 nt, Staphylococcus aureus subsp. aureus Mu50
aaauaagaugaaau

SEQ ID NO: 2058375 - RNA, 14 nt, Staphylococcus aureus subsp. aureus Mu50
aaauaauagcaaaa

SEQ ID NO: 2058376 - RNA, 22 nt, Staphylococcus aureus subsp. aureus Mu50
aaauaauaaguugaauauaaaa

SEQ ID NO: 2058377 - RNA, 13 nt, Staphylococcus aureus subsp. aureus Mu50
aaauaauauaaaa

SEQ ID NO: 2058378 - RNA, 14 nt, Staphylococcus aureus subsp. aureus Mu50
aaauaauauaaaac

SEQ ID NO: 2058379 - RNA, 17 nt, Staphylococcus aureus subsp. aureus Mu50
aaauaaugucuuacuuu

SEQ ID NO: 2058380 - RNA, 20 nt, Staphylococcus aureus subsp. aureus Mu50
aaauaaugucuuacuuuuaa

SEQ ID NO: 2058381 - RNA, 16 nt, Staphylococcus aureus subsp. aureus Mu50
aaauaaucucuucaau

SEQ ID NO: 2058382 - RNA, 22 nt, Staphylococcus aureus subsp. aureus Mu50
aaauaaucucuucaauuuauuu

SEQ ID NO: 2058383 - RNA, 15 nt, Staphylococcus aureus subsp. aureus Mu50
aaauacaaacccuuu

SEQ ID NO: 2058384 - RNA, 18 nt, Staphylococcus aureus subsp. aureus Mu50
aaauacaaacccuuuaaa

SEQ ID NO: 2058385 - RNA, 16 nt, Staphylococcus aureus subsp. aureus Mu50
aaauacaaaaauauag

SEQ ID NO: 2058386 - RNA, 19 nt, Staphylococcus aureus subsp. aureus Mu50
aaauaauuaugaaaaguaa

SEQ ID NO: 2058387 - RNA, 13 nt, Staphylococcus aureus subsp. aureus Mu50
aaauaauuaugaa

SEQ ID NO: 2058388 - RNA, 19 nt, Staphylococcus aureus subsp. aureus Mu50
aaauacauccauacuucua

SEQ ID NO: 2058389 - RNA, 14 nt, Staphylococcus aureus subsp. aureus Mu50
aaauacauaauuaa

SEQ ID NO: 2058390 - RNA, 23 nt, Staphylococcus aureus subsp. aureus Mu50
aaauaccagaugaaccaaaaaac

SEQ ID NO: 2058391 - RNA, 22 nt, Staphylococcus aureus subsp. aureus Mu50
aaauacaugugggauaucuucu

SEQ ID NO: 2058392 - RNA, 12 nt, Staphylococcus aureus subsp. aureus Mu50
aaauagaaacua

SEQ ID NO: 2058393 - RNA, 18 nt, Staphylococcus aureus subsp. aureus Mu50
aaauacuugaauuuaaua

SEQ ID NO: 2058394 - RNA, 21 nt, Staphylococcus aureus subsp. aureus Mu50
aaauacuuuuugaugauuuac

SEQ ID NO: 2058395 - RNA, 17 nt, Staphylococcus aureus subsp. aureus Mu50
aaauacuugaauuuaau

SEQ ID NO: 2058396 - RNA, 17 nt, Staphylococcus aureus subsp. aureus Mu50
aaauaccgucuucucua

SEQ ID NO: 2058397 - RNA, 15 nt, Staphylococcus aureus subsp. aureus Mu50
gccuucuauauagua

SEQ ID NO: 2058398 - RNA, 23 nt, Staphylococcus aureus subsp. aureus Mu50
gccuugaccuacuuuuucaauau

SEQ ID NO: 2058399 - RNA, 20 nt, Staphylococcus aureus subsp. aureus Mu50
gccuuuccauuguugauaaa

SEQ ID NO: 2058400 - RNA, 14 nt, Staphylococcus aureus subsp. aureus Mu50
gcgaacguuauuuu

SEQ ID NO: 2058401 - RNA, 19 nt, Staphylococcus aureus subsp. aureus Mu50
gcgaaccgaagcgcaguga

SEQ ID NO: 2058402 - RNA, 15 nt, Staphylococcus aureus subsp. aureus Mu50
gcgaagaaaccuuuu

SEQ ID NO: 2058403 - RNA, 14 nt, Staphylococcus aureus subsp. aureus Mu50
gccuuuugaauaau

SEQ ID NO: 2058404 - RNA, 15 nt, Staphylococcus aureus subsp. aureus Mu50
gccuuuugaauaauu

SEQ ID NO: 2058405 - RNA, 16 nt, Staphylococcus aureus subsp. aureus Mu50
gccuguagaauuucuu

SEQ ID NO: 2058406 - RNA, 12 nt, Staphylococcus aureus subsp. aureus Mu50
gccuuaaaauau

SEQ ID NO: 2058407 - RNA, 14 nt, Staphylococcus aureus subsp. aureus Mu50
gccuuaaaauauuu

SEQ ID NO: 2058408 - RNA, 18 nt, Staphylococcus aureus subsp. aureus Mu50
gccuuaacuucauaauau

SEQ ID NO: 2058409 - RNA, 19 nt, Staphylococcus aureus subsp. aureus Mu50
gccuucaauauuucuugcu

SEQ ID NO: 2058410 - RNA, 21 nt, Staphylococcus aureus subsp. aureus Mu50
gccugcccuuuagucauguuu

SEQ ID NO: 2058411 - RNA, 18 nt, Staphylococcus aureus subsp. aureus Mu50
gccucuaaugauuaaaaa

SEQ ID NO: 2058412 - RNA, 23 nt, Staphylococcus aureus subsp. aureus Mu50
gccucuaaugauuaaaaaucaaa

SEQ ID NO: 2058413 - RNA, 20 nt, Staphylococcus aureus subsp. aureus Mu50
gccuacuguuucacguaaug

SEQ ID NO: 2058414 - RNA, 19 nt, Staphylococcus aureus subsp. aureus Mu50
gccuaauaauaaaauagcu

SEQ ID NO: 2058415 - RNA, 13 nt, Staphylococcus aureus subsp. aureus Mu50
gccuaauaauaaa

SEQ ID NO: 2058416 - RNA, 17 nt, Staphylococcus aureus subsp. aureus Mu50
gccuaauaauaaaauag

SEQ ID NO: 2058417 - RNA, 18 nt, Staphylococcus aureus subsp. aureus Mu50
gccguauuucaaauguaa

SEQ ID NO: 2058418 - RNA, 13 nt, Staphylococcus aureus subsp. aureus Mu50
gcgcaaaagcgca

SEQ ID NO: 2058419 - RNA, 15 nt, Staphylococcus aureus subsp. aureus Mu50
gcgauaaaaguugua

SEQ ID NO: 2058420 - RNA, 23 nt, Staphylococcus aureus subsp. aureus Mu50
gcgacguuuaaaugcccaccaug

SEQ ID NO: 2058421 - RNA, 14 nt, Staphylococcus aureus subsp. aureus Mu50
gcgccauaaucauu

SEQ ID NO: 2058422 - RNA, 14 nt, Staphylococcus aureus subsp. aureus Mu50
gcgcgacguuuaaa

SEQ ID NO: 2058423 - RNA, 20 nt, Staphylococcus aureus subsp. aureus Mu50
gcggaauacagaugaugcuu

SEQ ID NO: 2058424 - RNA, 22 nt, Staphylococcus aureus subsp. aureus Mu50
gcagugaaguuaacuauaacaa

SEQ ID NO: 2058425 - RNA, 17 nt, Staphylococcus aureus subsp. aureus Mu50
gcagucaaacauagaua

SEQ ID NO: 2058426 - RNA, 19 nt, Staphylococcus aureus subsp. aureus Mu50
gcaguauauaucaaauaca

SEQ ID NO: 2058427 - RNA, 22 nt, Staphylococcus aureus subsp. aureus Mu50
gcauaacgagcaguauauauca

SEQ ID NO: 2058428 - RNA, 23 nt, Staphylococcus aureus subsp. aureus Mu50
gcauaaaaaaagaacuacgcauu

SEQ ID NO: 2058429 - RNA, 14 nt, Staphylococcus aureus subsp. aureus Mu50
gcaguuaauaagaa

SEQ ID NO: 2058430 - RNA, 13 nt, Staphylococcus aureus subsp. aureus Mu50
gcagcuuuauaau

SEQ ID NO: 2058431 - RNA, 13 nt, Staphylococcus aureus subsp. aureus Mu50
gcagcuucuuuaa

SEQ ID NO: 2058432 - RNA, 16 nt, Staphylococcus aureus subsp. aureus Mu50
gcagcuugaucuaaau

SEQ ID NO: 2058433 - RNA, 15 nt, Staphylococcus aureus subsp. aureus Mu50
gcaucuaugauugua

SEQ ID NO: 2058434 - RNA, 16 nt, Staphylococcus aureus subsp. aureus Mu50
gcaucaacagauacuu

SEQ ID NO: 2058435 - RNA, 19 nt, Staphylococcus aureus subsp. aureus Mu50
gcauauguaauacaaaaga

SEQ ID NO: 2058436 - RNA, 23 nt, Staphylococcus aureus subsp. aureus Mu50
gcauauucgcuuaaaaacgcuuu

SEQ ID NO: 2058437 - RNA, 16 nt, Staphylococcus aureus subsp. aureus Mu50
gcauaucuuuaucauu

SEQ ID NO: 2058438 - RNA, 19 nt, Staphylococcus aureus subsp. aureus Mu50
gcauaauuaggauuaacau

SEQ ID NO: 2058439 - RNA, 17 nt, Staphylococcus aureus subsp. aureus Mu50
gcauguccugaauguuc

SEQ ID NO: 2058440 - RNA, 17 nt, Staphylococcus aureus subsp. aureus Mu50
gcauuaauguucaauuu

SEQ ID NO: 2058441 - RNA, 13 nt, Staphylococcus aureus subsp. aureus Mu50
gcauuaauuucau

SEQ ID NO: 2058442 - RNA, 13 nt, Staphylococcus aureus subsp. aureus Mu50
gcauuaaugauuc

SEQ ID NO: 2058443 - RNA, 15 nt, Staphylococcus aureus subsp. aureus Mu50
gcaugccagaugcaa

SEQ ID NO: 2058444 - RNA, 22 nt, Staphylococcus aureus subsp. aureus Mu50
gcauuuaaauauaaaccagcug

SEQ ID NO: 2058445 - RNA, 17 nt, Staphylococcus aureus subsp. aureus Mu50
gcauuuguaaacaguau

SEQ ID NO: 2058446 - RNA, 15 nt, Staphylococcus aureus subsp. aureus Mu50
gcauuuuaaauaaaa

SEQ ID NO: 2058447 - RNA, 22 nt, Staphylococcus aureus subsp. aureus Mu50
gccaaauuucucuuucaagacc

SEQ ID NO: 2058448 - RNA, 17 nt, Staphylococcus aureus subsp. aureus Mu50
gccaaauaucaguaaua

SEQ ID NO: 2058449 - RNA, 20 nt, Staphylococcus aureus subsp. aureus Mu50
gccaaauaucaguaauaaua

SEQ ID NO: 2058450 - RNA, 15 nt, Staphylococcus aureus subsp. aureus Mu50
aaagcugauuuuuca

SEQ ID NO: 2058451 - RNA, 21 nt, Staphylococcus aureus subsp. aureus Mu50
gccgagauuauuauguggaaa

SEQ ID NO: 2058452 - RNA, 15 nt, Staphylococcus aureus subsp. aureus Mu50
gccaucuuaccuuua

SEQ ID NO: 2058453 - RNA, 19 nt, Staphylococcus aureus subsp. aureus Mu50
gccauauucauauuacuuc

SEQ ID NO: 2058454 - RNA, 23 nt, Staphylococcus aureus subsp. aureus Mu50
gccauauguuuuagaauaguuac

SEQ ID NO: 2058455 - RNA, 11 nt, Staphylococcus aureus subsp. aureus Mu50
gccaucuuuuu

SEQ ID NO: 2058456 - RNA, 22 nt, Staphylococcus aureus subsp. aureus Mu50
gccaucuuuuuuagcugaacca

SEQ ID NO: 2058457 - RNA, 15 nt, Staphylococcus aureus subsp. aureus Mu50
gccauuaaaauuacg

SEQ ID NO: 2058458 - RNA, 14 nt, Staphylococcus aureus subsp. aureus Mu50
gcccacaccccaac

SEQ ID NO: 2058459 - RNA, 16 nt, Staphylococcus aureus subsp. aureus Mu50
gcccccaacacaaaga

SEQ ID NO: 2058460 - RNA, 22 nt, Staphylococcus aureus subsp. aureus Mu50
gcccauucugcagcgacaucuu

SEQ ID NO: 2058461 - RNA, 20 nt, Staphylococcus aureus subsp. aureus Mu50
gcaacaaacgcugauuuaau

SEQ ID NO: 2058462 - RNA, 12 nt, Staphylococcus aureus subsp. aureus Mu50
gcaacauauuuu

SEQ ID NO: 2058463 - RNA, 16 nt, Staphylococcus aureus subsp. aureus Mu50
gcaacaaaagauguug

SEQ ID NO: 2058464 - RNA, 20 nt, Staphylococcus aureus subsp. aureus Mu50
gcaaauucaacuuuaaucaa

SEQ ID NO: 2058465 - RNA, 19 nt, Staphylococcus aureus subsp. aureus Mu50
gcaaauuauauagaaaacu

SEQ ID NO: 2058466 - RNA, 13 nt, Staphylococcus aureus subsp. aureus Mu50
gcaaauuaucauu

SEQ ID NO: 2058467 - RNA, 14 nt, Staphylococcus aureus subsp. aureus Mu50
gcaaauuaucauua

SEQ ID NO: 2058468 - RNA, 17 nt, Staphylococcus aureus subsp. aureus Mu50
gcaaauugauuaaauaa

SEQ ID NO: 2058469 - RNA, 18 nt, Staphylococcus aureus subsp. aureus Mu50
gcaaauugauuaaauaaa

SEQ ID NO: 2058470 - RNA, 18 nt, Staphylococcus aureus subsp. aureus Mu50
gcaaauuaguaugacuua

SEQ ID NO: 2058471 - RNA, 19 nt, Staphylococcus aureus subsp. aureus Mu50
gcaaagucauuaaauguac

SEQ ID NO: 2058472 - RNA, 12 nt, Staphylococcus aureus subsp. aureus Mu50
gcaaauaaaaaa

SEQ ID NO: 2058473 - RNA, 15 nt, Staphylococcus aureus subsp. aureus Mu50
gcaaauaaaaaaguu

SEQ ID NO: 2058474 - RNA, 13 nt, Staphylococcus aureus subsp. aureus Mu50
gcaaaucaaacaa

SEQ ID NO: 2058475 - RNA, 16 nt, Staphylococcus aureus subsp. aureus Mu50
gcaaauauuauuaaau

SEQ ID NO: 2058476 - RNA, 15 nt, Staphylococcus aureus subsp. aureus Mu50
gcaaauauuauuaaa

SEQ ID NO: 2058477 - RNA, 17 nt, Staphylococcus aureus subsp. aureus Mu50
gcaaacgcacuaucaau

SEQ ID NO: 2058478 - RNA, 15 nt, Staphylococcus aureus subsp. aureus Mu50
gcaaagaauccuuaa

SEQ ID NO: 2058479 - RNA, 13 nt, Staphylococcus aureus subsp. aureus Mu50
gcaaagacucaau

SEQ ID NO: 2058480 - RNA, 18 nt, Staphylococcus aureus subsp. aureus Mu50
gcaaagacucaauuucau

SEQ ID NO: 2058481 - RNA, 20 nt, Staphylococcus aureus subsp. aureus Mu50
gcaaaacuugcgcaugcuuu

SEQ ID NO: 2058482 - RNA, 16 nt, Staphylococcus aureus subsp. aureus Mu50
gcaaaacgcauuucau

SEQ ID NO: 2058483 - RNA, 14 nt, Staphylococcus aureus subsp. aureus Mu50
gcaaaagcgcaggc

SEQ ID NO: 2058484 - RNA, 18 nt, Staphylococcus aureus subsp. aureus Mu50
gcaaaaauauuuaaacua

SEQ ID NO: 2058485 - RNA, 14 nt, Staphylococcus aureus subsp. aureus Mu50
gauuuuuuuguucu

SEQ ID NO: 2058486 - RNA, 16 nt, Staphylococcus aureus subsp. aureus Mu50
gauuuuucauauuuuu

SEQ ID NO: 2058487 - RNA, 13 nt, Staphylococcus aureus subsp. aureus Mu50
gauuuuuaaaaug

SEQ ID NO: 2058488 - RNA, 12 nt, Staphylococcus aureus subsp. aureus Mu50
gauuuuguuuca

SEQ ID NO: 2058489 - RNA, 15 nt, Staphylococcus aureus subsp. aureus Mu50
gauuuugaauaaaaa

SEQ ID NO: 2058490 - RNA, 13 nt, Staphylococcus aureus subsp. aureus Mu50
gauuuuauaucuu

SEQ ID NO: 2058491 - RNA, 15 nt, Staphylococcus aureus subsp. aureus Mu50
gauuuuauaaaguuu

SEQ ID NO: 2058492 - RNA, 11 nt, Staphylococcus aureus subsp. aureus Mu50
gauuuuauaau

SEQ ID NO: 2058493 - RNA, 17 nt, Staphylococcus aureus subsp. aureus Mu50
gauuuuaaaagauaaau

SEQ ID NO: 2058494 - RNA, 19 nt, Staphylococcus aureus subsp. aureus Mu50
gauuuuaagugguuaucac

SEQ ID NO: 2058495 - RNA, 15 nt, Staphylococcus aureus subsp. aureus Mu50
gauuucuaucaaaua

SEQ ID NO: 2058496 - RNA, 20 nt, Staphylococcus aureus subsp. aureus Mu50
gauuucuaauugaaaucauc

SEQ ID NO: 2058497 - RNA, 12 nt, Staphylococcus aureus subsp. aureus Mu50
gauuucuuauuu

SEQ ID NO: 2058498 - RNA, 14 nt, Staphylococcus aureus subsp. aureus Mu50
gauuugcaccuaua

SEQ ID NO: 2058499 - RNA, 15 nt, Staphylococcus aureus subsp. aureus Mu50
gauuucacuucuaaa

SEQ ID NO: 2058500 - RNA, 15 nt, Staphylococcus aureus subsp. aureus Mu50
gauuuauuaaauaua

SEQ ID NO: 2058501 - RNA, 20 nt, Staphylococcus aureus subsp. aureus Mu50
gauuuaguuuuuuuaaaguu

SEQ ID NO: 2058502 - RNA, 21 nt, Staphylococcus aureus subsp. aureus Mu50
gauuuaguuuuuuuaaaguuu

SEQ ID NO: 2058503 - RNA, 22 nt, Staphylococcus aureus subsp. aureus Mu50
gauuucacuugaccacuuuugu

SEQ ID NO: 2058504 - RNA, 20 nt, Staphylococcus aureus subsp. aureus Mu50
gauuucccacgugccucauc

SEQ ID NO: 2058505 - RNA, 14 nt, Staphylococcus aureus subsp. aureus Mu50
gauuuacaccuaua

SEQ ID NO: 2058506 - RNA, 21 nt, Staphylococcus aureus subsp. aureus Mu50
gauuuaccucuugauaaaaua

SEQ ID NO: 2058507 - RNA, 22 nt, Staphylococcus aureus subsp. aureus Mu50
gauuuaacauaaaaaugcucaa

SEQ ID NO: 2058508 - RNA, 22 nt, Staphylococcus aureus subsp. aureus Mu50
gauuuaaaaaauuuaauguuuu

SEQ ID NO: 2058509 - RNA, 20 nt, Staphylococcus aureus subsp. aureus Mu50
gauuguuauuauaaacuaca

SEQ ID NO: 2058510 - RNA, 15 nt, Staphylococcus aureus subsp. aureus Mu50
gauugucuuauaaga

SEQ ID NO: 2058511 - RNA, 16 nt, Staphylococcus aureus subsp. aureus Mu50
gauuguaccaguaaca

SEQ ID NO: 2058512 - RNA, 13 nt, Staphylococcus aureus subsp. aureus Mu50
gauucaaccuuaa

SEQ ID NO: 2058513 - RNA, 16 nt, Staphylococcus aureus subsp. aureus Mu50
gauucaacuuguuucc

SEQ ID NO: 2058514 - RNA, 13 nt, Staphylococcus aureus subsp. aureus Mu50
gauucaaaugaca

SEQ ID NO: 2058515 - RNA, 20 nt, Staphylococcus aureus subsp. aureus Mu50
gauucaggauuguagaaucu

SEQ ID NO: 2058516 - RNA, 17 nt, Staphylococcus aureus subsp. aureus Mu50
gauucauaucuuucaau

SEQ ID NO: 2058517 - RNA, 12 nt, Staphylococcus aureus subsp. aureus Mu50
gauucauauuua

SEQ ID NO: 2058518 - RNA, 15 nt, Staphylococcus aureus subsp. aureus Mu50
gauucauauuuaucg

SEQ ID NO: 2058519 - RNA, 23 nt, Staphylococcus aureus subsp. aureus Mu50
gauucguauucaaaguuuucauu

SEQ ID NO: 2058520 - RNA, 17 nt, Staphylococcus aureus subsp. aureus Mu50
gauucuacagcacugaa

SEQ ID NO: 2058521 - RNA, 14 nt, Staphylococcus aureus subsp. aureus Mu50
gauucggaaaauau

SEQ ID NO: 2058522 - RNA, 18 nt, Staphylococcus aureus subsp. aureus Mu50
gauuccuguaacaagaac

SEQ ID NO: 2058523 - RNA, 21 nt, Staphylococcus aureus subsp. aureus Mu50
gauugaucagcucuuaaauca

SEQ ID NO: 2058524 - RNA, 22 nt, Staphylococcus aureus subsp. aureus Mu50
gauugauauaaauuaucagaau

SEQ ID NO: 2058525 - RNA, 22 nt, Staphylococcus aureus subsp. aureus Mu50
gauuggaaaguuucuccaccug

SEQ ID NO: 2058526 - RNA, 17 nt, Staphylococcus aureus subsp. aureus Mu50
gauucuuauauguuuua

SEQ ID NO: 2058527 - RNA, 19 nt, Staphylococcus aureus subsp. aureus Mu50
gauucuccaguggaaauga

SEQ ID NO: 2058528 - RNA, 19 nt, Staphylococcus aureus subsp. aureus Mu50
gauucuucacuaaaaauau

SEQ ID NO: 2058529 - RNA, 14 nt, Staphylococcus aureus subsp. aureus Mu50
gauugacguggucu

SEQ ID NO: 2058530 - RNA, 21 nt, Staphylococcus aureus subsp. aureus Mu50
gauugacuaaguuuguuuucu

SEQ ID NO: 2058531 - RNA, 16 nt, Staphylococcus aureus subsp. aureus Mu50
gauugaguugaaaaua

SEQ ID NO: 2058532 - RNA, 15 nt, Staphylococcus aureus subsp. aureus Mu50
gauugacgauuuaau

SEQ ID NO: 2058533 - RNA, 13 nt, Staphylococcus aureus subsp. aureus Mu50
gauuaaaaguguu

SEQ ID NO: 2058534 - RNA, 17 nt, Staphylococcus aureus subsp. aureus Mu50
gauuaaaauaugacaca

SEQ ID NO: 2058535 - RNA, 20 nt, Staphylococcus aureus subsp. aureus Mu50
gauuaaauucuuuucaagaa

SEQ ID NO: 2058536 - RNA, 20 nt, Staphylococcus aureus subsp. aureus Mu50
gauuaaaguguuucaacaua

SEQ ID NO: 2058537 - RNA, 15 nt, Staphylococcus aureus subsp. aureus Mu50
gauuaacuuucuaau

SEQ ID NO: 2058538 - RNA, 16 nt, Staphylococcus aureus subsp. aureus Mu50
gauguugguucaucaa

SEQ ID NO: 2058539 - RNA, 16 nt, Staphylococcus aureus subsp. aureus Mu50
gauguucacuaaaugu

SEQ ID NO: 2058540 - RNA, 17 nt, Staphylococcus aureus subsp. aureus Mu50
gauuaaaagcaucuuua

SEQ ID NO: 2058541 - RNA, 17 nt, Staphylococcus aureus subsp. aureus Mu50
gauguuucaaaauaauu

SEQ ID NO: 2058542 - RNA, 22 nt, Staphylococcus aureus subsp. aureus Mu50
gauguguuuuaauaauaucuuu

SEQ ID NO: 2058543 - RNA, 14 nt, Staphylococcus aureus subsp. aureus Mu50
gauguuaaaaaaua

SEQ ID NO: 2058544 - RNA, 14 nt, Staphylococcus aureus subsp. aureus Mu50
gauguuauaaaaug

SEQ ID NO: 2058545 - RNA, 14 nt, Staphylococcus aureus subsp. aureus Mu50
gaugugaauguuuu

SEQ ID NO: 2058546 - RNA, 18 nt, Staphylococcus aureus subsp. aureus Mu50
gaugugaauguuuugugu

SEQ ID NO: 2058547 - RNA, 14 nt, Staphylococcus aureus subsp. aureus Mu50
gaugugacaaauac

SEQ ID NO: 2058548 - RNA, 20 nt, Staphylococcus aureus subsp. aureus Mu50
gaugucgaaaaguauaugaa

SEQ ID NO: 2058549 - RNA, 18 nt, Staphylococcus aureus subsp. aureus Mu50
gauuauuuagauaaaaau

SEQ ID NO: 2058550 - RNA, 20 nt, Staphylococcus aureus subsp. aureus Mu50
gauuauuuagauaaaaauua

SEQ ID NO: 2058551 - RNA, 22 nt, Staphylococcus aureus subsp. aureus Mu50
gauucaaauaaaucaaacuuuu

SEQ ID NO: 2058552 - RNA, 18 nt, Staphylococcus aureus subsp. aureus Mu50
gauuauugguugaaauua

SEQ ID NO: 2058553 - RNA, 22 nt, Staphylococcus aureus subsp. aureus Mu50
gauuauuuaaaacuuguaaauu

SEQ ID NO: 2058554 - RNA, 15 nt, Staphylococcus aureus subsp. aureus Mu50
gauuauuaccauaua

SEQ ID NO: 2058555 - RNA, 13 nt, Staphylococcus aureus subsp. aureus Mu50
gauuauucuucau

SEQ ID NO: 2058556 - RNA, 22 nt, Staphylococcus aureus subsp. aureus Mu50
gauuauucuucauuuauaacau

SEQ ID NO: 2058557 - RNA, 20 nt, Staphylococcus aureus subsp. aureus Mu50
gauuaugacaacauaacaaa

SEQ ID NO: 2058558 - RNA, 15 nt, Staphylococcus aureus subsp. aureus Mu50
gauuauauuuuucuu

SEQ ID NO: 2058559 - RNA, 21 nt, Staphylococcus aureus subsp. aureus Mu50
gauuauauuuagauuuauaac

SEQ ID NO: 2058560 - RNA, 14 nt, Staphylococcus aureus subsp. aureus Mu50
gauuauauuuuucu

SEQ ID NO: 2058561 - RNA, 21 nt, Staphylococcus aureus subsp. aureus Mu50
gauuagugucacaaagaaauu

SEQ ID NO: 2058562 - RNA, 11 nt, Staphylococcus aureus subsp. aureus Mu50
gauuauauaua

SEQ ID NO: 2058563 - RNA, 16 nt, Staphylococcus aureus subsp. aureus Mu50
gauuauaaugauuguc

SEQ ID NO: 2058564 - RNA, 15 nt, Staphylococcus aureus subsp. aureus Mu50
gauuaccguuaaaaa

SEQ ID NO: 2058565 - RNA, 14 nt, Staphylococcus aureus subsp. aureus Mu50
gauuacuuugcuaa

SEQ ID NO: 2058566 - RNA, 20 nt, Staphylococcus aureus subsp. aureus Mu50
gauuaauuauaaguagugau

SEQ ID NO: 2058567 - RNA, 16 nt, Staphylococcus aureus subsp. aureus Mu50
gauuaauuuucuuuuu

SEQ ID NO: 2058568 - RNA, 22 nt, Staphylococcus aureus subsp. aureus Mu50
gauuaauuuaauugaaguaugc

SEQ ID NO: 2058569 - RNA, 22 nt, Staphylococcus aureus subsp. aureus Mu50
gauuaauuaaagauuaaaauau

SEQ ID NO: 2058570 - RNA, 13 nt, Staphylococcus aureus subsp. aureus Mu50
gaugguuuuguuu

SEQ ID NO: 2058571 - RNA, 13 nt, Staphylococcus aureus subsp. aureus Mu50
gaugguugcuuca

SEQ ID NO: 2058572 - RNA, 13 nt, Staphylococcus aureus subsp. aureus Mu50
gauguaauucugu

SEQ ID NO: 2058573 - RNA, 16 nt, Staphylococcus aureus subsp. aureus Mu50
gaugucagacgaauca

SEQ ID NO: 2058574 - RNA, 13 nt, Staphylococcus aureus subsp. aureus Mu50
gaugucauguauu

SEQ ID NO: 2058575 - RNA, 17 nt, Staphylococcus aureus subsp. aureus Mu50
gauguacuauaaauccu

SEQ ID NO: 2058576 - RNA, 17 nt, Staphylococcus aureus subsp. aureus Mu50
gauguaccacucauaau

SEQ ID NO: 2058577 - RNA, 13 nt, Staphylococcus aureus subsp. aureus Mu50
gauggucuuuuaa

SEQ ID NO: 2058578 - RNA, 19 nt, Staphylococcus aureus subsp. aureus Mu50
gaugggccccaacaaagag

SEQ ID NO: 2058579 - RNA, 22 nt, Staphylococcus aureus subsp. aureus Mu50
gauggcuucucuuaguuuuaac

SEQ ID NO: 2058580 - RNA, 19 nt, Staphylococcus aureus subsp. aureus Mu50
gaugggaaaucaguaauau

SEQ ID NO: 2058581 - RNA, 18 nt, Staphylococcus aureus subsp. aureus Mu50
gaugcuuuaauuaaaguu

SEQ ID NO: 2058582 - RNA, 13 nt, Staphylococcus aureus subsp. aureus Mu50
gaugcuuccuuuu

SEQ ID NO: 2058583 - RNA, 16 nt, Staphylococcus aureus subsp. aureus Mu50
aaagccuucuaucucu

SEQ ID NO: 2058584 - RNA, 18 nt, Staphylococcus aureus subsp. aureus Mu50
gaugauuuauaaaaacuu

SEQ ID NO: 2058585 - RNA, 23 nt, Staphylococcus aureus subsp. aureus Mu50
gaugcuaaaaauauugaauaauc

SEQ ID NO: 2058586 - RNA, 19 nt, Staphylococcus aureus subsp. aureus Mu50
gaugaacaaaauaacaugu

SEQ ID NO: 2058587 - RNA, 14 nt, Staphylococcus aureus subsp. aureus Mu50
gaugaaccaaaaaa

SEQ ID NO: 2058588 - RNA, 21 nt, Staphylococcus aureus subsp. aureus Mu50
gaugaauuuuuauuuuuagua

SEQ ID NO: 2058589 - RNA, 14 nt, Staphylococcus aureus subsp. aureus Mu50
gaugaauuaaacug

SEQ ID NO: 2058590 - RNA, 16 nt, Staphylococcus aureus subsp. aureus Mu50
gaucuuuuccauucau

SEQ ID NO: 2058591 - RNA, 17 nt, Staphylococcus aureus subsp. aureus Mu50
gaucuuuuuuauauuca

SEQ ID NO: 2058592 - RNA, 22 nt, Staphylococcus aureus subsp. aureus Mu50
gaugaaaacuuaaaaaugaaau

SEQ ID NO: 2058593 - RNA, 14 nt, Staphylococcus aureus subsp. aureus Mu50
gaugacuguagaaa

SEQ ID NO: 2058594 - RNA, 23 nt, Staphylococcus aureus subsp. aureus Mu50
gaugacuuugucuuuaaugaaag

SEQ ID NO: 2058595 - RNA, 12 nt, Staphylococcus aureus subsp. aureus Mu50
gaugaugcuucg

SEQ ID NO: 2058596 - RNA, 19 nt, Staphylococcus aureus subsp. aureus Mu50
gaugauaaaaauaaaaccg

SEQ ID NO: 2058597 - RNA, 15 nt, Staphylococcus aureus subsp. aureus Mu50
gagauuguaagaauu

SEQ ID NO: 2058598 - RNA, 21 nt, Staphylococcus aureus subsp. aureus Mu50
gagauuguuauuauaaacuac

SEQ ID NO: 2058599 - RNA, 20 nt, Staphylococcus aureus subsp. aureus Mu50
gagauuaucuuuagacauaa

SEQ ID NO: 2058600 - RNA, 14 nt, Staphylococcus aureus subsp. aureus Mu50
gacucaguuauauu

SEQ ID NO: 2058601 - RNA, 20 nt, Staphylococcus aureus subsp. aureus Mu50
gagcaaagcuuuuuugcuuu

SEQ ID NO: 2058602 - RNA, 22 nt, Staphylococcus aureus subsp. aureus Mu50
aaagcacuagccguuauuuuuu

SEQ ID NO: 2058603 - RNA, 13 nt, Staphylococcus aureus subsp. aureus Mu50
aaagcacauguau

SEQ ID NO: 2058604 - RNA, 13 nt, Staphylococcus aureus subsp. aureus Mu50
gagcguaaaguuu

SEQ ID NO: 2058605 - RNA, 23 nt, Staphylococcus aureus subsp. aureus Mu50
gagcuauucauagaccuaugaau

SEQ ID NO: 2058606 - RNA, 16 nt, Staphylococcus aureus subsp. aureus Mu50
gagcucauguuucagu

SEQ ID NO: 2058607 - RNA, 20 nt, Staphylococcus aureus subsp. aureus Mu50
gagcuaauaugucuagacuu

SEQ ID NO: 2058608 - RNA, 20 nt, Staphylococcus aureus subsp. aureus Mu50
gagucaaagucauuuagaua

SEQ ID NO: 2058609 - RNA, 19 nt, Staphylococcus aureus subsp. aureus Mu50
gaguauuacuugaaaauag

SEQ ID NO: 2058610 - RNA, 15 nt, Staphylococcus aureus subsp. aureus Mu50
gagugcacuuguaau

SEQ ID NO: 2058611 - RNA, 17 nt, Staphylococcus aureus subsp. aureus Mu50
gauaacgagugaaaaua

SEQ ID NO: 2058612 - RNA, 20 nt, Staphylococcus aureus subsp. aureus Mu50
gauaacuacacuuaauauau

SEQ ID NO: 2058613 - RNA, 14 nt, Staphylococcus aureus subsp. aureus Mu50
gauaaacuacacac

SEQ ID NO: 2058614 - RNA, 15 nt, Staphylococcus aureus subsp. aureus Mu50
gauaaacuacacacg

SEQ ID NO: 2058615 - RNA, 22 nt, Staphylococcus aureus subsp. aureus Mu50
gauaaaauaauuguucuucaga

SEQ ID NO: 2058616 - RNA, 21 nt, Staphylococcus aureus subsp. aureus Mu50
gauaaacaagccaagauaaau

SEQ ID NO: 2058617 - RNA, 15 nt, Staphylococcus aureus subsp. aureus Mu50
gauaaaaguuguauu

SEQ ID NO: 2058618 - RNA, 14 nt, Staphylococcus aureus subsp. aureus Mu50
gaggcgauaaaaga

SEQ ID NO: 2058619 - RNA, 17 nt, Staphylococcus aureus subsp. aureus Mu50
gauccaaaguacucaag

SEQ ID NO: 2058620 - RNA, 14 nt, Staphylococcus aureus subsp. aureus Mu50
gaucgauacuuuuu

SEQ ID NO: 2058621 - RNA, 17 nt, Staphylococcus aureus subsp. aureus Mu50
gaucauuaguguagaaa

SEQ ID NO: 2058622 - RNA, 14 nt, Staphylococcus aureus subsp. aureus Mu50
gaucauuauuuaga

SEQ ID NO: 2058623 - RNA, 18 nt, Staphylococcus aureus subsp. aureus Mu50
gaucauaaauauuuucug

SEQ ID NO: 2058624 - RNA, 22 nt, Staphylococcus aureus subsp. aureus Mu50
gauauuaauugaaaaaccaagu

SEQ ID NO: 2058625 - RNA, 13 nt, Staphylococcus aureus subsp. aureus Mu50
gauauuacauaua

SEQ ID NO: 2058626 - RNA, 20 nt, Staphylococcus aureus subsp. aureus Mu50
gauauuaauugaaaaaccaa

SEQ ID NO: 2058627 - RNA, 17 nt, Staphylococcus aureus subsp. aureus Mu50
gaucaacugaaauuuuu

SEQ ID NO: 2058628 - RNA, 15 nt, Staphylococcus aureus subsp. aureus Mu50
gauacugccauaugu

SEQ ID NO: 2058629 - RNA, 13 nt, Staphylococcus aureus subsp. aureus Mu50
gauacugaaauuu

SEQ ID NO: 2058630 - RNA, 23 nt, Staphylococcus aureus subsp. aureus Mu50
gauacugaaauuucauaaaguuu

SEQ ID NO: 2058631 - RNA, 15 nt, Staphylococcus aureus subsp. aureus Mu50
gauacugaauuuuaa

SEQ ID NO: 2058632 - RNA, 22 nt, Staphylococcus aureus subsp. aureus Mu50
gauagaaguuuuuugauuagua

SEQ ID NO: 2058633 - RNA, 15 nt, Staphylococcus aureus subsp. aureus Mu50
gauagaauacuaaaa

SEQ ID NO: 2058634 - RNA, 19 nt, Staphylococcus aureus subsp. aureus Mu50
gauagaauacuaaaagugu

SEQ ID NO: 2058635 - RNA, 21 nt, Staphylococcus aureus subsp. aureus Mu50
gauaccuuuaauaauauugaa

SEQ ID NO: 2058636 - RNA, 18 nt, Staphylococcus aureus subsp. aureus Mu50
gauaccuuuaauaucuaa

SEQ ID NO: 2058637 - RNA, 19 nt, Staphylococcus aureus subsp. aureus Mu50
gauaccuuuuucuaccaau

SEQ ID NO: 2058638 - RNA, 20 nt, Staphylococcus aureus subsp. aureus Mu50
gauaagaagagccagaaacc

SEQ ID NO: 2058639 - RNA, 23 nt, Staphylococcus aureus subsp. aureus Mu50
gauaagaauuaacaacaaauaua

SEQ ID NO: 2058640 - RNA, 15 nt, Staphylococcus aureus subsp. aureus Mu50
gauaggauauuuuuu

SEQ ID NO: 2058641 - RNA, 22 nt, Staphylococcus aureus subsp. aureus Mu50
gauaggauuugcaccuauaccu

SEQ ID NO: 2058642 - RNA, 16 nt, Staphylococcus aureus subsp. aureus Mu50
gauaggaaacuuaaau

SEQ ID NO: 2058643 - RNA, 16 nt, Staphylococcus aureus subsp. aureus Mu50
gauagcugcuauccuu

SEQ ID NO: 2058644 - RNA, 19 nt, Staphylococcus aureus subsp. aureus Mu50
gauagauucugauacagaa

SEQ ID NO: 2058645 - RNA, 14 nt, Staphylococcus aureus subsp. aureus Mu50
gauagugaauaaug

SEQ ID NO: 2058646 - RNA, 13 nt, Staphylococcus aureus subsp. aureus Mu50
gauagugaauaau

SEQ ID NO: 2058647 - RNA, 15 nt, Staphylococcus aureus subsp. aureus Mu50
gauauacgaauccuc

SEQ ID NO: 2058648 - RNA, 19 nt, Staphylococcus aureus subsp. aureus Mu50
gauaucuuaaucuaaaaau

SEQ ID NO: 2058649 - RNA, 21 nt, Staphylococcus aureus subsp. aureus Mu50
gauaucuuaaucuaaaaauag

SEQ ID NO: 2058650 - RNA, 12 nt, Staphylococcus aureus subsp. aureus Mu50
gauaucuuuuaa

SEQ ID NO: 2058651 - RNA, 21 nt, Staphylococcus aureus subsp. aureus Mu50
gauaucuuuuccaaaacaaaa

SEQ ID NO: 2058652 - RNA, 16 nt, Staphylococcus aureus subsp. aureus Mu50
cuuuccauuguugaua

SEQ ID NO: 2058653 - RNA, 21 nt, Staphylococcus aureus subsp. aureus Mu50
cuuucuaagauguguugaaac

SEQ ID NO: 2058654 - RNA, 16 nt, Staphylococcus aureus subsp. aureus Mu50
cuuucuuuuucaucuu

SEQ ID NO: 2058655 - RNA, 11 nt, Staphylococcus aureus subsp. aureus Mu50
cuuucuuuucu

SEQ ID NO: 2058656 - RNA, 12 nt, Staphylococcus aureus subsp. aureus Mu50
cuuucuuuucug

SEQ ID NO: 2058657 - RNA, 16 nt, Staphylococcus aureus subsp. aureus Mu50
cuuucuuuucugaaug

SEQ ID NO: 2058658 - RNA, 16 nt, Staphylococcus aureus subsp. aureus Mu50
cuuucucggcgauaaa

SEQ ID NO: 2058659 - RNA, 21 nt, Staphylococcus aureus subsp. aureus Mu50
cuuucucggcgauaaaauguu

SEQ ID NO: 2058660 - RNA, 16 nt, Staphylococcus aureus subsp. aureus Mu50
cuuucucaucuauuua

SEQ ID NO: 2058661 - RNA, 12 nt, Staphylococcus aureus subsp. aureus Mu50
cuuucuauuaau

SEQ ID NO: 2058662 - RNA, 19 nt, Staphylococcus aureus subsp. aureus Mu50
cuuuguuaggaucaaggaa

SEQ ID NO: 2058663 - RNA, 18 nt, Staphylococcus aureus subsp. aureus Mu50
cuuuguuauauuuuuagg

SEQ ID NO: 2058664 - RNA, 13 nt, Staphylococcus aureus subsp. aureus Mu50
cuuuguucugcuu

SEQ ID NO: 2058665 - RNA, 18 nt, Staphylococcus aureus subsp. aureus Mu50
cuuuguucugcuuuuucu

SEQ ID NO: 2058666 - RNA, 19 nt, Staphylococcus aureus subsp. aureus Mu50
cuuuguguuugcuuuuuac

SEQ ID NO: 2058667 - RNA, 14 nt, Staphylococcus aureus subsp. aureus Mu50
cuuuguuggggccc

SEQ ID NO: 2058668 - RNA, 19 nt, Staphylococcus aureus subsp. aureus Mu50
cuuuguuguaagguggacu

SEQ ID NO: 2058669 - RNA, 18 nt, Staphylococcus aureus subsp. aureus Mu50
cuuugucauacuaacuau

SEQ ID NO: 2058670 - RNA, 22 nt, Staphylococcus aureus subsp. aureus Mu50
cuuugucuguaaagcuauccau

SEQ ID NO: 2058671 - RNA, 21 nt, Staphylococcus aureus subsp. aureus Mu50
cuuugucauuuugauuaagug

SEQ ID NO: 2058672 - RNA, 16 nt, Staphylococcus aureus subsp. aureus Mu50
cuuugacauguguuaa

SEQ ID NO: 2058673 - RNA, 19 nt, Staphylococcus aureus subsp. aureus Mu50
cuuugauguucacuaaaug

SEQ ID NO: 2058674 - RNA, 22 nt, Staphylococcus aureus subsp. aureus Mu50
cuuugacguuuugguuguucuu

SEQ ID NO: 2058675 - RNA, 14 nt, Staphylococcus aureus subsp. aureus Mu50
cuuugcucaccuuu

SEQ ID NO: 2058676 - RNA, 14 nt, Staphylococcus aureus subsp. aureus Mu50
cuuuauuacuuuaa

SEQ ID NO: 2058677 - RNA, 19 nt, Staphylococcus aureus subsp. aureus Mu50
cuuuaucaacauaaaauuu

SEQ ID NO: 2058678 - RNA, 22 nt, Staphylococcus aureus subsp. aureus Mu50
cuuuagcauauucgcuuaaaaa

SEQ ID NO: 2058679 - RNA, 14 nt, Staphylococcus aureus subsp. aureus Mu50
cuuuagcaauugaa

SEQ ID NO: 2058680 - RNA, 15 nt, Staphylococcus aureus subsp. aureus Mu50
cuuuagcucuuuuuu

SEQ ID NO: 2058681 - RNA, 21 nt, Staphylococcus aureus subsp. aureus Mu50
cuuuauauauaaagaaauaau

SEQ ID NO: 2058682 - RNA, 14 nt, Staphylococcus aureus subsp. aureus Mu50
cuuuauaugagaaa

SEQ ID NO: 2058683 - RNA, 14 nt, Staphylococcus aureus subsp. aureus Mu50
cuuuauauuuauca

SEQ ID NO: 2058684 - RNA, 13 nt, Staphylococcus aureus subsp. aureus Mu50
cuuucaguuuuug

SEQ ID NO: 2058685 - RNA, 20 nt, Staphylococcus aureus subsp. aureus Mu50
cuuucauaguuauuaaaucu

SEQ ID NO: 2058686 - RNA, 17 nt, Staphylococcus aureus subsp. aureus Mu50
cuuucauaauuaacaca

SEQ ID NO: 2058687 - RNA, 17 nt, Staphylococcus aureus subsp. aureus Mu50
cuuucauacauaacaca

SEQ ID NO: 2058688 - RNA, 20 nt, Staphylococcus aureus subsp. aureus Mu50
cuuucaccauuuacuucaua

SEQ ID NO: 2058689 - RNA, 20 nt, Staphylococcus aureus subsp. aureus Mu50
cuuuauuuacaauguuaucu

SEQ ID NO: 2058690 - RNA, 16 nt, Staphylococcus aureus subsp. aureus Mu50
aaagacaugagauuau

SEQ ID NO: 2058691 - RNA, 20 nt, Staphylococcus aureus subsp. aureus Mu50
cuuuaaugauaaguggauuu

SEQ ID NO: 2058692 - RNA, 12 nt, Staphylococcus aureus subsp. aureus Mu50
cuuuaauaucua

SEQ ID NO: 2058693 - RNA, 14 nt, Staphylococcus aureus subsp. aureus Mu50
cuuuacgauaaaua

SEQ ID NO: 2058694 - RNA, 12 nt, Staphylococcus aureus subsp. aureus Mu50
cuuuaccaucuu

SEQ ID NO: 2058695 - RNA, 15 nt, Staphylococcus aureus subsp. aureus Mu50
cuuuaauuaaaguua

SEQ ID NO: 2058696 - RNA, 14 nt, Staphylococcus aureus subsp. aureus Mu50
gaaaacagguggaa

SEQ ID NO: 2058697 - RNA, 11 nt, Staphylococcus aureus subsp. aureus Mu50
gaaaacaauaa

SEQ ID NO: 2058698 - RNA, 22 nt, Staphylococcus aureus subsp. aureus Mu50
gaaaacauaaauacaaaaauau

SEQ ID NO: 2058699 - RNA, 21 nt, Staphylococcus aureus subsp. aureus Mu50
gaaaauaccucuacauuauau

SEQ ID NO: 2058700 - RNA, 21 nt, Staphylococcus aureus subsp. aureus Mu50
gaaaauaaucgaacagaaaau

SEQ ID NO: 2058701 - RNA, 10 nt, Staphylococcus aureus subsp. aureus Mu50
gaaaauaaua

SEQ ID NO: 2058702 - RNA, 16 nt, Staphylococcus aureus subsp. aureus Mu50
gaaaauaagcuuguaa

SEQ ID NO: 2058703 - RNA, 23 nt, Staphylococcus aureus subsp. aureus Mu50
gaaaauaagcuuguaacaagcau

SEQ ID NO: 2058704 - RNA, 16 nt, Staphylococcus aureus subsp. aureus Mu50
gaaaagaaauucuaca

SEQ ID NO: 2058705 - RNA, 19 nt, Staphylococcus aureus subsp. aureus Mu50
gaaaagaaauucuacaggu

SEQ ID NO: 2058706 - RNA, 19 nt, Staphylococcus aureus subsp. aureus Mu50
cuuuuguuuaguauggaau

SEQ ID NO: 2058707 - RNA, 14 nt, Staphylococcus aureus subsp. aureus Mu50
cuuuuguuaaaaaa

SEQ ID NO: 2058708 - RNA, 20 nt, Staphylococcus aureus subsp. aureus Mu50
cuuuuguguuugcccugcug

SEQ ID NO: 2058709 - RNA, 13 nt, Staphylococcus aureus subsp. aureus Mu50
cuuuuguuaaaaa

SEQ ID NO: 2058710 - RNA, 18 nt, Staphylococcus aureus subsp. aureus Mu50
cuuuuguuuucacuguuu

SEQ ID NO: 2058711 - RNA, 15 nt, Staphylococcus aureus subsp. aureus Mu50
cuuuuuaaaaaauuu

SEQ ID NO: 2058712 - RNA, 15 nt, Staphylococcus aureus subsp. aureus Mu50
cuuuuuaaaaucguu

SEQ ID NO: 2058713 - RNA, 17 nt, Staphylococcus aureus subsp. aureus Mu50
cuuuuucuauacaauga

SEQ ID NO: 2058714 - RNA, 14 nt, Staphylococcus aureus subsp. aureus Mu50
cuuuuucuauacaa

SEQ ID NO: 2058715 - RNA, 17 nt, Staphylococcus aureus subsp. aureus Mu50
cuuuuucuaccaauaau

SEQ ID NO: 2058716 - RNA, 14 nt, Staphylococcus aureus subsp. aureus Mu50
cuuuuuguuuucaa

SEQ ID NO: 2058717 - RNA, 13 nt, Staphylococcus aureus subsp. aureus Mu50
cuuuuuguuuauc

SEQ ID NO: 2058718 - RNA, 14 nt, Staphylococcus aureus subsp. aureus Mu50
cuuuuuuaacuuua

SEQ ID NO: 2058719 - RNA, 19 nt, Staphylococcus aureus subsp. aureus Mu50
cuuuuuuaccagcaugaau

SEQ ID NO: 2058720 - RNA, 21 nt, Staphylococcus aureus subsp. aureus Mu50
cuuuuugacauauuuuuuaaa

SEQ ID NO: 2058721 - RNA, 17 nt, Staphylococcus aureus subsp. aureus Mu50
cuuuuugacucagaauc

SEQ ID NO: 2058722 - RNA, 22 nt, Staphylococcus aureus subsp. aureus Mu50
cuuuuugaaauuucgacaucua

SEQ ID NO: 2058723 - RNA, 13 nt, Staphylococcus aureus subsp. aureus Mu50
cuuuuucuuucau

SEQ ID NO: 2058724 - RNA, 16 nt, Staphylococcus aureus subsp. aureus Mu50
gaaaaaguuauaucau

SEQ ID NO: 2058725 - RNA, 14 nt, Staphylococcus aureus subsp. aureus Mu50
gaaaaagucuuucu

SEQ ID NO: 2058726 - RNA, 17 nt, Staphylococcus aureus subsp. aureus Mu50
gaaaaagcaggcaagcu

SEQ ID NO: 2058727 - RNA, 21 nt, Staphylococcus aureus subsp. aureus Mu50
cuuuuacagaacguucauaua

SEQ ID NO: 2058728 - RNA, 13 nt, Staphylococcus aureus subsp. aureus Mu50
cuuuuaaauuaaa

SEQ ID NO: 2058729 - RNA, 17 nt, Staphylococcus aureus subsp. aureus Mu50
cuuuuacgccuucuuua

SEQ ID NO: 2058730 - RNA, 22 nt, Staphylococcus aureus subsp. aureus Mu50
cuuuuaaaccguguucuuuaau

SEQ ID NO: 2058731 - RNA, 19 nt, Staphylococcus aureus subsp. aureus Mu50
cuuuguuugcuucuguauc

SEQ ID NO: 2058732 - RNA, 21 nt, Staphylococcus aureus subsp. aureus Mu50
cuuuuaaaaucguugcagauu

SEQ ID NO: 2058733 - RNA, 21 nt, Staphylococcus aureus subsp. aureus Mu50
cuuuuacuuucucaucuauuu

SEQ ID NO: 2058734 - RNA, 14 nt, Staphylococcus aureus subsp. aureus Mu50
cuuuuacuaaauga

SEQ ID NO: 2058735 - RNA, 17 nt, Staphylococcus aureus subsp. aureus Mu50
cuuuuauuuaucuuuua

SEQ ID NO: 2058736 - RNA, 12 nt, Staphylococcus aureus subsp. aureus Mu50
cuuuuauuuuca

SEQ ID NO: 2058737 - RNA, 13 nt, Staphylococcus aureus subsp. aureus Mu50
cuuuuauuauuuu

SEQ ID NO: 2058738 - RNA, 12 nt, Staphylococcus aureus subsp. aureus Mu50
cuuuuaugcaug

SEQ ID NO: 2058739 - RNA, 15 nt, Staphylococcus aureus subsp. aureus Mu50
cuuuuaugcaugcgc

SEQ ID NO: 2058740 - RNA, 16 nt, Staphylococcus aureus subsp. aureus Mu50
cuuuuccuugauucuu

SEQ ID NO: 2058741 - RNA, 20 nt, Staphylococcus aureus subsp. aureus Mu50
cuuuucgcaaaucccuucuc

SEQ ID NO: 2058742 - RNA, 18 nt, Staphylococcus aureus subsp. aureus Mu50
cuuuucaucguucauaua

SEQ ID NO: 2058743 - RNA, 12 nt, Staphylococcus aureus subsp. aureus Mu50
cuuuucaaaaua

SEQ ID NO: 2058744 - RNA, 17 nt, Staphylococcus aureus subsp. aureus Mu50
cuuuucaaacauauuca

SEQ ID NO: 2058745 - RNA, 18 nt, Staphylococcus aureus subsp. aureus Mu50
cuuuucugucuguaaauu

SEQ ID NO: 2058746 - RNA, 20 nt, Staphylococcus aureus subsp. aureus Mu50
cuuuucuagcuauauccagu

SEQ ID NO: 2058747 - RNA, 21 nt, Staphylococcus aureus subsp. aureus Mu50
cuuuucucgauuaauuuucuu

SEQ ID NO: 2058748 - RNA, 15 nt, Staphylococcus aureus subsp. aureus Mu50
aaagacuacaaguca

SEQ ID NO: 2058749 - RNA, 19 nt, Staphylococcus aureus subsp. aureus Mu50
aaagacuacaagucauuau

SEQ ID NO: 2058750 - RNA, 20 nt, Staphylococcus aureus subsp. aureus Mu50
aaagacucaauuucauuuga

SEQ ID NO: 2058751 - RNA, 19 nt, Staphylococcus aureus subsp. aureus Mu50
aaagacugacuaauaaaac

SEQ ID NO: 2058752 - RNA, 21 nt, Staphylococcus aureus subsp. aureus Mu50
aaagacuuuccaccauaugug

SEQ ID NO: 2058753 - RNA, 16 nt, Staphylococcus aureus subsp. aureus Mu50
cuuuugcuguaucuuc

SEQ ID NO: 2058754 - RNA, 13 nt, Staphylococcus aureus subsp. aureus Mu50
gaaccuauuuuuu

SEQ ID NO: 2058755 - RNA, 16 nt, Staphylococcus aureus subsp. aureus Mu50
gaaccugcugaaguuu

SEQ ID NO: 2058756 - RNA, 18 nt, Staphylococcus aureus subsp. aureus Mu50
gaaccguaacuauaugaa

SEQ ID NO: 2058757 - RNA, 23 nt, Staphylococcus aureus subsp. aureus Mu50
gaaccaauccaauauacaaugcu

SEQ ID NO: 2058758 - RNA, 15 nt, Staphylococcus aureus subsp. aureus Mu50
gaaccacgcaucaug

SEQ ID NO: 2058759 - RNA, 15 nt, Staphylococcus aureus subsp. aureus Mu50
gaacauguuucuaga

SEQ ID NO: 2058760 - RNA, 15 nt, Staphylococcus aureus subsp. aureus Mu50
gaacauauuauaaaa

SEQ ID NO: 2058761 - RNA, 18 nt, Staphylococcus aureus subsp. aureus Mu50
gaacauauucauaauauc

SEQ ID NO: 2058762 - RNA, 13 nt, Staphylococcus aureus subsp. aureus Mu50
gaacaucaucuau

SEQ ID NO: 2058763 - RNA, 22 nt, Staphylococcus aureus subsp. aureus Mu50
gaacucuuuuaacccacauuaa

SEQ ID NO: 2058764 - RNA, 16 nt, Staphylococcus aureus subsp. aureus Mu50
gaacucugagcacuua

SEQ ID NO: 2058765 - RNA, 20 nt, Staphylococcus aureus subsp. aureus Mu50
gaacucguucguauauuaca

SEQ ID NO: 2058766 - RNA, 18 nt, Staphylococcus aureus subsp. aureus Mu50
gaacuaguacgaaaugca

SEQ ID NO: 2058767 - RNA, 19 nt, Staphylococcus aureus subsp. aureus Mu50
gaacuaguacgaaaugcaa

SEQ ID NO: 2058768 - RNA, 19 nt, Staphylococcus aureus subsp. aureus Mu50
gaacuacgcauuuuaaaua

SEQ ID NO: 2058769 - RNA, 20 nt, Staphylococcus aureus subsp. aureus Mu50
gaacgauauuuuaaaaagua

SEQ ID NO: 2058770 - RNA, 19 nt, Staphylococcus aureus subsp. aureus Mu50
gaacgcuagcauaucuuua

SEQ ID NO: 2058771 - RNA, 15 nt, Staphylococcus aureus subsp. aureus Mu50
gaacuaacauaauuu

SEQ ID NO: 2058772 - RNA, 15 nt, Staphylococcus aureus subsp. aureus Mu50
gaacguuauuuucaa

SEQ ID NO: 2058773 - RNA, 22 nt, Staphylococcus aureus subsp. aureus Mu50
gaacaaucggaagcauauuucu

SEQ ID NO: 2058774 - RNA, 19 nt, Staphylococcus aureus subsp. aureus Mu50
gaacaauaccgccuacugu

SEQ ID NO: 2058775 - RNA, 16 nt, Staphylococcus aureus subsp. aureus Mu50
gaacaagucuugcaau

SEQ ID NO: 2058776 - RNA, 14 nt, Staphylococcus aureus subsp. aureus Mu50
gaacaaaauguagg

SEQ ID NO: 2058777 - RNA, 18 nt, Staphylococcus aureus subsp. aureus Mu50
gaaauuuuuuagugaaaa

SEQ ID NO: 2058778 - RNA, 19 nt, Staphylococcus aureus subsp. aureus Mu50
gaacagcaucuuguucuuc

SEQ ID NO: 2058779 - RNA, 22 nt, Staphylococcus aureus subsp. aureus Mu50
gaacauaccugcauauguguuu

SEQ ID NO: 2058780 - RNA, 19 nt, Staphylococcus aureus subsp. aureus Mu50
gaaaucuuuuguaagacuu

SEQ ID NO: 2058781 - RNA, 14 nt, Staphylococcus aureus subsp. aureus Mu50
gaaauccucuuaua

SEQ ID NO: 2058782 - RNA, 22 nt, Staphylococcus aureus subsp. aureus Mu50
aaagagauacugguuaguaaaa

SEQ ID NO: 2058783 - RNA, 22 nt, Staphylococcus aureus subsp. aureus Mu50
aaagagaaacaaaacaaaaaau

SEQ ID NO: 2058784 - RNA, 21 nt, Staphylococcus aureus subsp. aureus Mu50
gaaaugauacauuauuaaaua

SEQ ID NO: 2058785 - RNA, 13 nt, Staphylococcus aureus subsp. aureus Mu50
gaaaugcaaugag

SEQ ID NO: 2058786 - RNA, 13 nt, Staphylococcus aureus subsp. aureus Mu50
gaaaugauaauuu

SEQ ID NO: 2058787 - RNA, 22 nt, Staphylococcus aureus subsp. aureus Mu50
gaaauuuuucacuucaaacaaa

SEQ ID NO: 2058788 - RNA, 20 nt, Staphylococcus aureus subsp. aureus Mu50
gaaauuuuaaaauaaaucuu

SEQ ID NO: 2058789 - RNA, 20 nt, Staphylococcus aureus subsp. aureus Mu50
gaaauucucuuuguuggggc

SEQ ID NO: 2058790 - RNA, 23 nt, Staphylococcus aureus subsp. aureus Mu50
gaaauucuacagguaaugcaagu

SEQ ID NO: 2058791 - RNA, 21 nt, Staphylococcus aureus subsp. aureus Mu50
gaaauucuacagguaaugcaa

SEQ ID NO: 2058792 - RNA, 22 nt, Staphylococcus aureus subsp. aureus Mu50
aaagagaugggcuaagguuguu

SEQ ID NO: 2058793 - RNA, 21 nt, Staphylococcus aureus subsp. aureus Mu50
gaaauucuacaaacaaugcaa

SEQ ID NO: 2058794 - RNA, 17 nt, Staphylococcus aureus subsp. aureus Mu50
gaaauucuacaggcaau

SEQ ID NO: 2058795 - RNA, 22 nt, Staphylococcus aureus subsp. aureus Mu50
gaaauucuacaggcaaugcaag

SEQ ID NO: 2058796 - RNA, 15 nt, Staphylococcus aureus subsp. aureus Mu50
gaaauucuacaggua

SEQ ID NO: 2058797 - RNA, 16 nt, Staphylococcus aureus subsp. aureus Mu50
gaaauucuacagguaa

SEQ ID NO: 2058798 - RNA, 17 nt, Staphylococcus aureus subsp. aureus Mu50
gaaauucuacagguaau

SEQ ID NO: 2058799 - RNA, 22 nt, Staphylococcus aureus subsp. aureus Mu50
gaaagaugggauuucacuugac

SEQ ID NO: 2058800 - RNA, 13 nt, Staphylococcus aureus subsp. aureus Mu50
gaaacuuguccgu

SEQ ID NO: 2058801 - RNA, 17 nt, Staphylococcus aureus subsp. aureus Mu50
gaaacuuccaacauaua

SEQ ID NO: 2058802 - RNA, 14 nt, Staphylococcus aureus subsp. aureus Mu50
gaaacuuaaauauu

SEQ ID NO: 2058803 - RNA, 19 nt, Staphylococcus aureus subsp. aureus Mu50
gaaacgucuuaauucuucu

SEQ ID NO: 2058804 - RNA, 15 nt, Staphylococcus aureus subsp. aureus Mu50
gaaaauagaaagaaa

SEQ ID NO: 2058805 - RNA, 16 nt, Staphylococcus aureus subsp. aureus Mu50
gaaaaugaguacaaca

SEQ ID NO: 2058806 - RNA, 19 nt, Staphylococcus aureus subsp. aureus Mu50
gaaauaccuccugauugcu

SEQ ID NO: 2058807 - RNA, 13 nt, Staphylococcus aureus subsp. aureus Mu50
gaaauauuuaucu

SEQ ID NO: 2058808 - RNA, 17 nt, Staphylococcus aureus subsp. aureus Mu50
gaaaucaaaaauaauua

SEQ ID NO: 2058809 - RNA, 16 nt, Staphylococcus aureus subsp. aureus Mu50
gaaauccguuaaaauu

SEQ ID NO: 2058810 - RNA, 22 nt, Staphylococcus aureus subsp. aureus Mu50
gaaaguaccuaaaauagaaaaa

SEQ ID NO: 2058811 - RNA, 21 nt, Staphylococcus aureus subsp. aureus Mu50
gaaauaaucuaguaucuauca

SEQ ID NO: 2058812 - RNA, 23 nt, Staphylococcus aureus subsp. aureus Mu50
gaaaguaauaaguaauaauuuau

SEQ ID NO: 2058813 - RNA, 20 nt, Staphylococcus aureus subsp. aureus Mu50
gaaaguaauaaguaauaauu

SEQ ID NO: 2058814 - RNA, 21 nt, Staphylococcus aureus subsp. aureus Mu50
gaaagcuaauaucaauaaugc

SEQ ID NO: 2058815 - RNA, 15 nt, Staphylococcus aureus subsp. aureus Mu50
gacaguaaucaaagu

SEQ ID NO: 2058816 - RNA, 19 nt, Staphylococcus aureus subsp. aureus Mu50
gacauuuaaauauaaccua

SEQ ID NO: 2058817 - RNA, 17 nt, Staphylococcus aureus subsp. aureus Mu50
gacauuguaaaaugcuc

SEQ ID NO: 2058818 - RNA, 16 nt, Staphylococcus aureus subsp. aureus Mu50
gacauugugaaaguuu

SEQ ID NO: 2058819 - RNA, 23 nt, Staphylococcus aureus subsp. aureus Mu50
gacauuuuuggcuuaucaagcac

SEQ ID NO: 2058820 - RNA, 15 nt, Staphylococcus aureus subsp. aureus Mu50
gacauuuucaaguuu

SEQ ID NO: 2058821 - RNA, 17 nt, Staphylococcus aureus subsp. aureus Mu50
gacauguccauaauauc

SEQ ID NO: 2058822 - RNA, 14 nt, Staphylococcus aureus subsp. aureus Mu50
gacaucauuguuuu

SEQ ID NO: 2058823 - RNA, 15 nt, Staphylococcus aureus subsp. aureus Mu50
gacaucauuguuuua

SEQ ID NO: 2058824 - RNA, 21 nt, Staphylococcus aureus subsp. aureus Mu50
gaccauugucaugccuucauu

SEQ ID NO: 2058825 - RNA, 14 nt, Staphylococcus aureus subsp. aureus Mu50
gaccggcauauaau

SEQ ID NO: 2058826 - RNA, 14 nt, Staphylococcus aureus subsp. aureus Mu50
gacguaauuaauag

SEQ ID NO: 2058827 - RNA, 14 nt, Staphylococcus aureus subsp. aureus Mu50
gacuaauaauuguc

SEQ ID NO: 2058828 - RNA, 13 nt, Staphylococcus aureus subsp. aureus Mu50
gacguaucaucaa

SEQ ID NO: 2058829 - RNA, 17 nt, Staphylococcus aureus subsp. aureus Mu50
gacuaugcaaaugaaau

SEQ ID NO: 2058830 - RNA, 11 nt, Staphylococcus aureus subsp. aureus Mu50
gacuauuuuug

SEQ ID NO: 2058831 - RNA, 17 nt, Staphylococcus aureus subsp. aureus Mu50
gacuacaaguuuauaau

SEQ ID NO: 2058832 - RNA, 17 nt, Staphylococcus aureus subsp. aureus Mu50
gacaaucuuaucauaau

SEQ ID NO: 2058833 - RNA, 19 nt, Staphylococcus aureus subsp. aureus Mu50
gacaauuauaauaaaacuu

SEQ ID NO: 2058834 - RNA, 23 nt, Staphylococcus aureus subsp. aureus Mu50
gacaauugcgaccauuaguacua

SEQ ID NO: 2058835 - RNA, 23 nt, Staphylococcus aureus subsp. aureus Mu50
gacaaguauacuugaagaaucag

SEQ ID NO: 2058836 - RNA, 22 nt, Staphylococcus aureus subsp. aureus Mu50
gacaaguugcugaauaaaauau

SEQ ID NO: 2058837 - RNA, 23 nt, Staphylococcus aureus subsp. aureus Mu50
gaauugguuuuuagugaaaagaa

SEQ ID NO: 2058838 - RNA, 16 nt, Staphylococcus aureus subsp. aureus Mu50
gaauuguauuagcaau

SEQ ID NO: 2058839 - RNA, 18 nt, Staphylococcus aureus subsp. aureus Mu50
gaauuuagcaucaaaaau

SEQ ID NO: 2058840 - RNA, 23 nt, Staphylococcus aureus subsp. aureus Mu50
gaauuuagaugcauaaaaaaaga

SEQ ID NO: 2058841 - RNA, 19 nt, Staphylococcus aureus subsp. aureus Mu50
gaauuuacuccuuacaaua

SEQ ID NO: 2058842 - RNA, 20 nt, Staphylococcus aureus subsp. aureus Mu50
gaauuuacuccuuacaauaa

SEQ ID NO: 2058843 - RNA, 21 nt, Staphylococcus aureus subsp. aureus Mu50
gaauuuaggaaugaauaaagc

SEQ ID NO: 2058844 - RNA, 19 nt, Staphylococcus aureus subsp. aureus Mu50
gaauugccagaauucccaa

SEQ ID NO: 2058845 - RNA, 17 nt, Staphylococcus aureus subsp. aureus Mu50
gaauuaaaauaacucgc

SEQ ID NO: 2058846 - RNA, 17 nt, Staphylococcus aureus subsp. aureus Mu50
gaauuaagaaaaguuac

SEQ ID NO: 2058847 - RNA, 15 nt, Staphylococcus aureus subsp. aureus Mu50
gaauuaacaacaaau

SEQ ID NO: 2058848 - RNA, 13 nt, Staphylococcus aureus subsp. aureus Mu50
gaaugccuaauuu

SEQ ID NO: 2058849 - RNA, 21 nt, Staphylococcus aureus subsp. aureus Mu50
gaaugcgauuuccuuuagcaa

SEQ ID NO: 2058850 - RNA, 17 nt, Staphylococcus aureus subsp. aureus Mu50
gaauguuugguaacacu

SEQ ID NO: 2058851 - RNA, 13 nt, Staphylococcus aureus subsp. aureus Mu50
gaauccuucauca

SEQ ID NO: 2058852 - RNA, 15 nt, Staphylococcus aureus subsp. aureus Mu50
gaaucgaaccaaauu

SEQ ID NO: 2058853 - RNA, 21 nt, Staphylococcus aureus subsp. aureus Mu50
gaaugaaaauaagcuuguaac

SEQ ID NO: 2058854 - RNA, 22 nt, Staphylococcus aureus subsp. aureus Mu50
gaaucuuauuuuguuuuaaaaa

SEQ ID NO: 2058855 - RNA, 18 nt, Staphylococcus aureus subsp. aureus Mu50
gaaucaauugcauacgua

SEQ ID NO: 2058856 - RNA, 10 nt, Staphylococcus aureus subsp. aureus Mu50
gaaucaguau

SEQ ID NO: 2058857 - RNA, 14 nt, Staphylococcus aureus subsp. aureus Mu50
gaaucccauaauga

SEQ ID NO: 2058858 - RNA, 23 nt, Staphylococcus aureus subsp. aureus Mu50
gaauauuuauuguuuuuaaaauc

SEQ ID NO: 2058859 - RNA, 22 nt, Staphylococcus aureus subsp. aureus Mu50
gaaucaacaauuuaaacgcacu

SEQ ID NO: 2058860 - RNA, 19 nt, Staphylococcus aureus subsp. aureus Mu50
aaagauuucaguucaucau

SEQ ID NO: 2058861 - RNA, 18 nt, Staphylococcus aureus subsp. aureus Mu50
aaagauuauuauuacaau

SEQ ID NO: 2058862 - RNA, 19 nt, Staphylococcus aureus subsp. aureus Mu50
aaagauuagaugauauuua

SEQ ID NO: 2058863 - RNA, 12 nt, Staphylococcus aureus subsp. aureus Mu50
aaagauuaaaau

SEQ ID NO: 2058864 - RNA, 13 nt, Staphylococcus aureus subsp. aureus Mu50
gaauaaaauauau

SEQ ID NO: 2058865 - RNA, 18 nt, Staphylococcus aureus subsp. aureus Mu50
gaauaccguuauagcuca

SEQ ID NO: 2058866 - RNA, 19 nt, Staphylococcus aureus subsp. aureus Mu50
gaauacaugaguaaaacuc

SEQ ID NO: 2058867 - RNA, 18 nt, Staphylococcus aureus subsp. aureus Mu50
gaauacaugaguaaaacu

SEQ ID NO: 2058868 - RNA, 12 nt, Staphylococcus aureus subsp. aureus Mu50
gaauaauauauu

SEQ ID NO: 2058869 - RNA, 22 nt, Staphylococcus aureus subsp. aureus Mu50
gaagucuugugauaauucuuca

SEQ ID NO: 2058870 - RNA, 14 nt, Staphylococcus aureus subsp. aureus Mu50
aaagauauguuuau

SEQ ID NO: 2058871 - RNA, 16 nt, Staphylococcus aureus subsp. aureus Mu50
aaagauauagaauuca

SEQ ID NO: 2058872 - RNA, 21 nt, Staphylococcus aureus subsp. aureus Mu50
gaaggaauaauuuuaaaaaua

SEQ ID NO: 2058873 - RNA, 19 nt, Staphylococcus aureus subsp. aureus Mu50
gaaggaacguguucuaaaa

SEQ ID NO: 2058874 - RNA, 19 nt, Staphylococcus aureus subsp. aureus Mu50
gaaggaauguauucuaaga

SEQ ID NO: 2058875 - RNA, 20 nt, Staphylococcus aureus subsp. aureus Mu50
gaaggacaggaauaaauuuu

SEQ ID NO: 2058876 - RNA, 17 nt, Staphylococcus aureus subsp. aureus Mu50
gaaggagauauuuucuu

SEQ ID NO: 2058877 - RNA, 15 nt, Staphylococcus aureus subsp. aureus Mu50
gaaggauuuuagauu

SEQ ID NO: 2058878 - RNA, 22 nt, Staphylococcus aureus subsp. aureus Mu50
gaagcgcuuggauuuuuugguu

SEQ ID NO: 2058879 - RNA, 17 nt, Staphylococcus aureus subsp. aureus Mu50
gaagauaggauuuacac

SEQ ID NO: 2058880 - RNA, 17 nt, Staphylococcus aureus subsp. aureus Mu50
gaagauaggauuugcac

SEQ ID NO: 2058881 - RNA, 16 nt, Staphylococcus aureus subsp. aureus Mu50
aaagagguacuagaau

SEQ ID NO: 2058882 - RNA, 19 nt, Staphylococcus aureus subsp. aureus Mu50
aaagagguacuagaauuaa

SEQ ID NO: 2058883 - RNA, 19 nt, Staphylococcus aureus subsp. aureus Mu50
gaagaaacuuaaucaagcu

SEQ ID NO: 2058884 - RNA, 15 nt, Staphylococcus aureus subsp. aureus Mu50
aaagaggcuuuaaaa

SEQ ID NO: 2058885 - RNA, 22 nt, Staphylococcus aureus subsp. aureus Mu50
aaagaggcgccacaacauguuu

SEQ ID NO: 2058886 - RNA, 21 nt, Staphylococcus aureus subsp. aureus Mu50
gaacuuacaagucuaguucga

SEQ ID NO: 2058887 - RNA, 16 nt, Staphylococcus aureus subsp. aureus Mu50
gaacuuaaugcuucaa

SEQ ID NO: 2058888 - RNA, 19 nt, Staphylococcus aureus subsp. aureus Mu50
gaacuucuuuuuuguaucu

SEQ ID NO: 2058889 - RNA, 15 nt, Staphylococcus aureus subsp. aureus Mu50
gaagaaacauuauau

SEQ ID NO: 2058890 - RNA, 14 nt, Staphylococcus aureus subsp. aureus Mu50
gaagaaacauuaua

SEQ ID NO: 2058891 - RNA, 20 nt, Staphylococcus aureus subsp. aureus Mu50
gaacuuuuauuuuuuauaaa

SEQ ID NO: 2058892 - RNA, 19 nt, Staphylococcus aureus subsp. aureus Mu50
cuguaguuucaacuuuuga

SEQ ID NO: 2058893 - RNA, 14 nt, Staphylococcus aureus subsp. aureus Mu50
cuguaguuucuuaa

SEQ ID NO: 2058894 - RNA, 13 nt, Staphylococcus aureus subsp. aureus Mu50
cuguagauaucaa

SEQ ID NO: 2058895 - RNA, 14 nt, Staphylococcus aureus subsp. aureus Mu50
cuguagauaucaaa

SEQ ID NO: 2058896 - RNA, 18 nt, Staphylococcus aureus subsp. aureus Mu50
cuguagcgauaccuuuaa

SEQ ID NO: 2058897 - RNA, 23 nt, Staphylococcus aureus subsp. aureus Mu50
cuguagacaauuguaguaaugaa

SEQ ID NO: 2058898 - RNA, 11 nt, Staphylococcus aureus subsp. aureus Mu50
cuguauauaua

SEQ ID NO: 2058899 - RNA, 20 nt, Staphylococcus aureus subsp. aureus Mu50
cuguaugccgccuaauaaua

SEQ ID NO: 2058900 - RNA, 16 nt, Staphylococcus aureus subsp. aureus Mu50
aaacucuaaaaguugu

SEQ ID NO: 2058901 - RNA, 10 nt, Staphylococcus aureus subsp. aureus Mu50
aaacucucua

SEQ ID NO: 2058902 - RNA, 14 nt, Staphylococcus aureus subsp. aureus Mu50
cuguccgauuuuua

SEQ ID NO: 2058903 - RNA, 13 nt, Staphylococcus aureus subsp. aureus Mu50
cugucauuuucug

SEQ ID NO: 2058904 - RNA, 12 nt, Staphylococcus aureus subsp. aureus Mu50
cugucccaagcu

SEQ ID NO: 2058905 - RNA, 17 nt, Staphylococcus aureus subsp. aureus Mu50
cugucuuuccauaauaa

SEQ ID NO: 2058906 - RNA, 22 nt, Staphylococcus aureus subsp. aureus Mu50
cugugcaugacgauaaugaaau

SEQ ID NO: 2058907 - RNA, 17 nt, Staphylococcus aureus subsp. aureus Mu50
cugugauucauucguac

SEQ ID NO: 2058908 - RNA, 20 nt, Staphylococcus aureus subsp. aureus Mu50
cugugauauuaauugaaaaa

SEQ ID NO: 2058909 - RNA, 15 nt, Staphylococcus aureus subsp. aureus Mu50
cugugauaaaaaucu

SEQ ID NO: 2058910 - RNA, 23 nt, Staphylococcus aureus subsp. aureus Mu50
cuguggcucgaaaauaaaacaaa

SEQ ID NO: 2058911 - RNA, 16 nt, Staphylococcus aureus subsp. aureus Mu50
cugguaauauuuuugu

SEQ ID NO: 2058912 - RNA, 18 nt, Staphylococcus aureus subsp. aureus Mu50
cugguacauaaauaccug

SEQ ID NO: 2058913 - RNA, 19 nt, Staphylococcus aureus subsp. aureus Mu50
cuggguuaccaaguaauga

SEQ ID NO: 2058914 - RNA, 14 nt, Staphylococcus aureus subsp. aureus Mu50
cuggguaauaaauu

SEQ ID NO: 2058915 - RNA, 19 nt, Staphylococcus aureus subsp. aureus Mu50
cuguacauccacuuuauaa

SEQ ID NO: 2058916 - RNA, 21 nt, Staphylococcus aureus subsp. aureus Mu50
cuguaccguuuuuuauaaauc

SEQ ID NO: 2058917 - RNA, 19 nt, Staphylococcus aureus subsp. aureus Mu50
cuguaccaucacuaaagua

SEQ ID NO: 2058918 - RNA, 20 nt, Staphylococcus aureus subsp. aureus Mu50
cuguaaaaccauagauaauu

SEQ ID NO: 2058919 - RNA, 17 nt, Staphylococcus aureus subsp. aureus Mu50
cuguaaaucaucauaac

SEQ ID NO: 2058920 - RNA, 15 nt, Staphylococcus aureus subsp. aureus Mu50
cuguaaccaaaagaa

SEQ ID NO: 2058921 - RNA, 21 nt, Staphylococcus aureus subsp. aureus Mu50
cuguaacauaaacaauaacug

SEQ ID NO: 2058922 - RNA, 23 nt, Staphylococcus aureus subsp. aureus Mu50
cuguaacgaguccauuuucuuuu

SEQ ID NO: 2058923 - RNA, 15 nt, Staphylococcus aureus subsp. aureus Mu50
cugguugauaaauaa

SEQ ID NO: 2058924 - RNA, 23 nt, Staphylococcus aureus subsp. aureus Mu50
cuucgaagucauaugcauacacu

SEQ ID NO: 2058925 - RNA, 20 nt, Staphylococcus aureus subsp. aureus Mu50
cuucgauaguuuauuaauau

SEQ ID NO: 2058926 - RNA, 21 nt, Staphylococcus aureus subsp. aureus Mu50
cuuccuccgccaucaauauuu

SEQ ID NO: 2058927 - RNA, 19 nt, Staphylococcus aureus subsp. aureus Mu50
cuuccucucguaaauuguu

SEQ ID NO: 2058928 - RNA, 14 nt, Staphylococcus aureus subsp. aureus Mu50
cuucccaaggaagu

SEQ ID NO: 2058929 - RNA, 19 nt, Staphylococcus aureus subsp. aureus Mu50
cuucccagucaugucccau

SEQ ID NO: 2058930 - RNA, 22 nt, Staphylococcus aureus subsp. aureus Mu50
cuucccaucuuuuagguaauaa

SEQ ID NO: 2058931 - RNA, 17 nt, Staphylococcus aureus subsp. aureus Mu50
cuuccauucggauaaau

SEQ ID NO: 2058932 - RNA, 10 nt, Staphylococcus aureus subsp. aureus Mu50
aaacuuauaa

SEQ ID NO: 2058933 - RNA, 23 nt, Staphylococcus aureus subsp. aureus Mu50
aaacuuacauuacauauaucaac

SEQ ID NO: 2058934 - RNA, 16 nt, Staphylococcus aureus subsp. aureus Mu50
cuuccaauaauaaauc

SEQ ID NO: 2058935 - RNA, 21 nt, Staphylococcus aureus subsp. aureus Mu50
cuuccaauaaccccugucacu

SEQ ID NO: 2058936 - RNA, 18 nt, Staphylococcus aureus subsp. aureus Mu50
cuuccaaucaacuucaua

SEQ ID NO: 2058937 - RNA, 17 nt, Staphylococcus aureus subsp. aureus Mu50
cuuccaauaauaaauca

SEQ ID NO: 2058938 - RNA, 21 nt, Staphylococcus aureus subsp. aureus Mu50
aaacuuauuaauuaauagaga

SEQ ID NO: 2058939 - RNA, 14 nt, Staphylococcus aureus subsp. aureus Mu50
aaacuuauuugcca

SEQ ID NO: 2058940 - RNA, 24 nt, Staphylococcus aureus subsp. aureus Mu50
cuucaauauucuuaucauucauua

SEQ ID NO: 2058941 - RNA, 17 nt, Staphylococcus aureus subsp. aureus Mu50
cuucaauuuauuuuuau

SEQ ID NO: 2058942 - RNA, 21 nt, Staphylococcus aureus subsp. aureus Mu50
cuucaauuuauuuuuauauga

SEQ ID NO: 2058943 - RNA, 18 nt, Staphylococcus aureus subsp. aureus Mu50
cuucacacuuuuagaauc

SEQ ID NO: 2058944 - RNA, 20 nt, Staphylococcus aureus subsp. aureus Mu50
cuucaaaguuuucauuuuuu

SEQ ID NO: 2058945 - RNA, 19 nt, Staphylococcus aureus subsp. aureus Mu50
cuucaaaguagauauugaa

SEQ ID NO: 2058946 - RNA, 23 nt, Staphylococcus aureus subsp. aureus Mu50
cuucaaaguuuucauuuuuucaa

SEQ ID NO: 2058947 - RNA, 17 nt, Staphylococcus aureus subsp. aureus Mu50
cuuauugaaaagauaaa

SEQ ID NO: 2058948 - RNA, 21 nt, Staphylococcus aureus subsp. aureus Mu50
cuuauugauauaagauucaua

SEQ ID NO: 2058949 - RNA, 21 nt, Staphylococcus aureus subsp. aureus Mu50
cuuauucgcaccacuggccuu

SEQ ID NO: 2058950 - RNA, 13 nt, Staphylococcus aureus subsp. aureus Mu50
cuucaacauaacu

SEQ ID NO: 2058951 - RNA, 22 nt, Staphylococcus aureus subsp. aureus Mu50
cuucagcuaaaaguuucccaag

SEQ ID NO: 2058952 - RNA, 21 nt, Staphylococcus aureus subsp. aureus Mu50
cuucauagucacuuuuaacga

SEQ ID NO: 2058953 - RNA, 15 nt, Staphylococcus aureus subsp. aureus Mu50
cuucauaguucaaau

SEQ ID NO: 2058954 - RNA, 14 nt, Staphylococcus aureus subsp. aureus Mu50
cuuaauuuaaaucu

SEQ ID NO: 2058955 - RNA, 13 nt, Staphylococcus aureus subsp. aureus Mu50
cuuaauuuaaauc

SEQ ID NO: 2058956 - RNA, 17 nt, Staphylococcus aureus subsp. aureus Mu50
cuuaauuuguuuuaaau

SEQ ID NO: 2058957 - RNA, 18 nt, Staphylococcus aureus subsp. aureus Mu50
cuuaauacgauaauaacu

SEQ ID NO: 2058958 - RNA, 14 nt, Staphylococcus aureus subsp. aureus Mu50
cuuaauagaaagag

SEQ ID NO: 2058959 - RNA, 21 nt, Staphylococcus aureus subsp. aureus Mu50
cuuaauucuucaucaauaacu

SEQ ID NO: 2058960 - RNA, 22 nt, Staphylococcus aureus subsp. aureus Mu50
cuuaauaauuaauaagcauuaa

SEQ ID NO: 2058961 - RNA, 17 nt, Staphylococcus aureus subsp. aureus Mu50
cuuaauaagcugaaaua

SEQ ID NO: 2058962 - RNA, 13 nt, Staphylococcus aureus subsp. aureus Mu50
cuuaacuugaaau

SEQ ID NO: 2058963 - RNA, 18 nt, Staphylococcus aureus subsp. aureus Mu50
cuuaagaaauuuuuucua

SEQ ID NO: 2058964 - RNA, 20 nt, Staphylococcus aureus subsp. aureus Mu50
cuuacuaaguaaccaagucu

SEQ ID NO: 2058965 - RNA, 16 nt, Staphylococcus aureus subsp. aureus Mu50
cuuacagacaaacauu

SEQ ID NO: 2058966 - RNA, 13 nt, Staphylococcus aureus subsp. aureus Mu50
cuuaauuuugcaa

SEQ ID NO: 2058967 - RNA, 19 nt, Staphylococcus aureus subsp. aureus Mu50
cuuaauuuugcaacauuaa

SEQ ID NO: 2058968 - RNA, 15 nt, Staphylococcus aureus subsp. aureus Mu50
cuuacaauaaagaca

SEQ ID NO: 2058969 - RNA, 14 nt, Staphylococcus aureus subsp. aureus Mu50
cuuacaauaaagac

SEQ ID NO: 2058970 - RNA, 15 nt, Staphylococcus aureus subsp. aureus Mu50
cuuaugacugcuuuu

SEQ ID NO: 2058971 - RNA, 13 nt, Staphylococcus aureus subsp. aureus Mu50
cuuauuauuuugu

SEQ ID NO: 2058972 - RNA, 13 nt, Staphylococcus aureus subsp. aureus Mu50
cuuaugacugcuu

SEQ ID NO: 2058973 - RNA, 18 nt, Staphylococcus aureus subsp. aureus Mu50
cuuaugauacugauauuu

SEQ ID NO: 2058974 - RNA, 12 nt, Staphylococcus aureus subsp. aureus Mu50
cuuaucagugua

SEQ ID NO: 2058975 - RNA, 14 nt, Staphylococcus aureus subsp. aureus Mu50
cuuaucaucacacu

SEQ ID NO: 2058976 - RNA, 18 nt, Staphylococcus aureus subsp. aureus Mu50
cuuaucauuucaaauaag

SEQ ID NO: 2058977 - RNA, 15 nt, Staphylococcus aureus subsp. aureus Mu50
cuuaucauuucaaau

SEQ ID NO: 2058978 - RNA, 15 nt, Staphylococcus aureus subsp. aureus Mu50
cuuauaaacaaaaga

SEQ ID NO: 2058979 - RNA, 22 nt, Staphylococcus aureus subsp. aureus Mu50
cuuauaaacaaaagaucgauac

SEQ ID NO: 2058980 - RNA, 16 nt, Staphylococcus aureus subsp. aureus Mu50
cuuauacguuacggcu

SEQ ID NO: 2058981 - RNA, 14 nt, Staphylococcus aureus subsp. aureus Mu50
cuuauaauauuaaa

SEQ ID NO: 2058982 - RNA, 21 nt, Staphylococcus aureus subsp. aureus Mu50
cuuauaacauucuucaaaaaa

SEQ ID NO: 2058983 - RNA, 20 nt, Staphylococcus aureus subsp. aureus Mu50
cuuauacacuuacaaauauu

SEQ ID NO: 2058984 - RNA, 20 nt, Staphylococcus aureus subsp. aureus Mu50
cuuagacaaacgacuaacca

SEQ ID NO: 2058985 - RNA, 14 nt, Staphylococcus aureus subsp. aureus Mu50
cuuagaauuuacaa

SEQ ID NO: 2058986 - RNA, 15 nt, Staphylococcus aureus subsp. aureus Mu50
cuuacuuuuaaauua

SEQ ID NO: 2058987 - RNA, 19 nt, Staphylococcus aureus subsp. aureus Mu50
cuuagacgcuguuuuaaau

SEQ ID NO: 2058988 - RNA, 13 nt, Staphylococcus aureus subsp. aureus Mu50
cuuauaaaauaaa

SEQ ID NO: 2058989 - RNA, 19 nt, Staphylococcus aureus subsp. aureus Mu50
cuuaguuugacaucuauuu

SEQ ID NO: 2058990 - RNA, 14 nt, Staphylococcus aureus subsp. aureus Mu50
cuuauaaaaaacaa

SEQ ID NO: 2058991 - RNA, 18 nt, Staphylococcus aureus subsp. aureus Mu50
cuuaaaauaugauuuaaa

SEQ ID NO: 2058992 - RNA, 21 nt, Staphylococcus aureus subsp. aureus Mu50
cuuaaaauaugauuuaaaaua

SEQ ID NO: 2058993 - RNA, 17 nt, Staphylococcus aureus subsp. aureus Mu50
cuuaaaaugauuguuuu

SEQ ID NO: 2058994 - RNA, 14 nt, Staphylococcus aureus subsp. aureus Mu50
cuuaaaauuuaaau

SEQ ID NO: 2058995 - RNA, 18 nt, Staphylococcus aureus subsp. aureus Mu50
cuuaaaauuuaaauauug

SEQ ID NO: 2058996 - RNA, 13 nt, Staphylococcus aureus subsp. aureus Mu50
cuuaaacaaauaa

SEQ ID NO: 2058997 - RNA, 15 nt, Staphylococcus aureus subsp. aureus Mu50
cuuaacucaaagaaa

SEQ ID NO: 2058998 - RNA, 16 nt, Staphylococcus aureus subsp. aureus Mu50
cuuaacucaaagaaac

SEQ ID NO: 2058999 - RNA, 13 nt, Staphylococcus aureus subsp. aureus Mu50
aaacuuaaaacua

SEQ ID NO: 2059000 - RNA, 13 nt, Staphylococcus aureus subsp. aureus Mu50
cuguuugcuuuau

SEQ ID NO: 2059001 - RNA, 16 nt, Staphylococcus aureus subsp. aureus Mu50
cuguugcauuaagugc

SEQ ID NO: 2059002 - RNA, 20 nt, Staphylococcus aureus subsp. aureus Mu50
cuguuggaauaccuuuuucu

SEQ ID NO: 2059003 - RNA, 17 nt, Staphylococcus aureus subsp. aureus Mu50
cuguguaaaauaaauca

SEQ ID NO: 2059004 - RNA, 13 nt, Staphylococcus aureus subsp. aureus Mu50
cuguguaucauca

SEQ ID NO: 2059005 - RNA, 18 nt, Staphylococcus aureus subsp. aureus Mu50
cuguguaaaauaaaucau

SEQ ID NO: 2059006 - RNA, 14 nt, Staphylococcus aureus subsp. aureus Mu50
cuguuaauaaauca

SEQ ID NO: 2059007 - RNA, 15 nt, Staphylococcus aureus subsp. aureus Mu50
cuguguuggggccca

SEQ ID NO: 2059008 - RNA, 16 nt, Staphylococcus aureus subsp. aureus Mu50
cuguguuggggcccac

SEQ ID NO: 2059009 - RNA, 21 nt, Staphylococcus aureus subsp. aureus Mu50
cuguguuggggcccacacccc

SEQ ID NO: 2059010 - RNA, 13 nt, Staphylococcus aureus subsp. aureus Mu50
cuguucuauucca

SEQ ID NO: 2059011 - RNA, 23 nt, Staphylococcus aureus subsp. aureus Mu50
aaacucauaccaaaaacauuaac

SEQ ID NO: 2059012 - RNA, 13 nt, Staphylococcus aureus subsp. aureus Mu50
cugggacauuaau

SEQ ID NO: 2059013 - RNA, 13 nt, Staphylococcus aureus subsp. aureus Mu50
cuggcucuucuua

SEQ ID NO: 2059014 - RNA, 19 nt, Staphylococcus aureus subsp. aureus Mu50
cuggcucuucuuaucuuuu

SEQ ID NO: 2059015 - RNA, 22 nt, Staphylococcus aureus subsp. aureus Mu50
aaacucguugcacucuuuucuc

SEQ ID NO: 2059016 - RNA, 22 nt, Staphylococcus aureus subsp. aureus Mu50
aaacucgcccccguaauaauuu

SEQ ID NO: 2059017 - RNA, 16 nt, Staphylococcus aureus subsp. aureus Mu50
cuggaauaccuaauuc

SEQ ID NO: 2059018 - RNA, 14 nt, Staphylococcus aureus subsp. aureus Mu50
cugcuuuaacugua

SEQ ID NO: 2059019 - RNA, 17 nt, Staphylococcus aureus subsp. aureus Mu50
cugcuucuacccuugca

SEQ ID NO: 2059020 - RNA, 14 nt, Staphylococcus aureus subsp. aureus Mu50
cugcuucugcugua

SEQ ID NO: 2059021 - RNA, 20 nt, Staphylococcus aureus subsp. aureus Mu50
cugcugguaacucuucagua

SEQ ID NO: 2059022 - RNA, 16 nt, Staphylococcus aureus subsp. aureus Mu50
cugcuucgcuaauauc

SEQ ID NO: 2059023 - RNA, 22 nt, Staphylococcus aureus subsp. aureus Mu50
cugcuguucuuuuuauuuacuc

SEQ ID NO: 2059024 - RNA, 18 nt, Staphylococcus aureus subsp. aureus Mu50
aaacuauaauaauuggaa

SEQ ID NO: 2059025 - RNA, 15 nt, Staphylococcus aureus subsp. aureus Mu50
aaacuaucugauuaa

SEQ ID NO: 2059026 - RNA, 14 nt, Staphylococcus aureus subsp. aureus Mu50
aaacuauuuuaaaa

SEQ ID NO: 2059027 - RNA, 22 nt, Staphylococcus aureus subsp. aureus Mu50
aaacuauuaucgaagaaacauu

SEQ ID NO: 2059028 - RNA, 14 nt, Staphylococcus aureus subsp. aureus Mu50
cugcuaauuuuuuc

SEQ ID NO: 2059029 - RNA, 15 nt, Staphylococcus aureus subsp. aureus Mu50
cugcuaauuuuuuca

SEQ ID NO: 2059030 - RNA, 21 nt, Staphylococcus aureus subsp. aureus Mu50
cugcuaauuuuuucaucauuc

SEQ ID NO: 2059031 - RNA, 17 nt, Staphylococcus aureus subsp. aureus Mu50
cugcuaguucagcuucu

SEQ ID NO: 2059032 - RNA, 15 nt, Staphylococcus aureus subsp. aureus Mu50
cugccauuaaacgaa

SEQ ID NO: 2059033 - RNA, 19 nt, Staphylococcus aureus subsp. aureus Mu50
cugcccuuuagucauguuu

SEQ ID NO: 2059034 - RNA, 23 nt, Staphylococcus aureus subsp. aureus Mu50
cugcauauucacgauauaacauu

SEQ ID NO: 2059035 - RNA, 13 nt, Staphylococcus aureus subsp. aureus Mu50
cugcauauaaagu

SEQ ID NO: 2059036 - RNA, 22 nt, Staphylococcus aureus subsp. aureus Mu50
cugcagaguaaccuuucgcagc

SEQ ID NO: 2059037 - RNA, 13 nt, Staphylococcus aureus subsp. aureus Mu50
cugcagcaauuac

SEQ ID NO: 2059038 - RNA, 20 nt, Staphylococcus aureus subsp. aureus Mu50
cugcaacauuugauaaccaa

SEQ ID NO: 2059039 - RNA, 16 nt, Staphylococcus aureus subsp. aureus Mu50
cugcaaaugccucuuu

SEQ ID NO: 2059040 - RNA, 15 nt, Staphylococcus aureus subsp. aureus Mu50
cugauuuuguuucaa

SEQ ID NO: 2059041 - RNA, 20 nt, Staphylococcus aureus subsp. aureus Mu50
cugauacuucaucuguauca

SEQ ID NO: 2059042 - RNA, 14 nt, Staphylococcus aureus subsp. aureus Mu50
cugauaaaugaauu

SEQ ID NO: 2059043 - RNA, 19 nt, Staphylococcus aureus subsp. aureus Mu50
cugacuuuuaaaaaacaua

SEQ ID NO: 2059044 - RNA, 23 nt, Staphylococcus aureus subsp. aureus Mu50
cugaugcuagcuuucuuuuucau

SEQ ID NO: 2059045 - RNA, 22 nt, Staphylococcus aureus subsp. aureus Mu50
cugaugcuucgaauuuaacauc

SEQ ID NO: 2059046 - RNA, 15 nt, Staphylococcus aureus subsp. aureus Mu50
cugauguguuauguu

SEQ ID NO: 2059047 - RNA, 21 nt, Staphylococcus aureus subsp. aureus Mu50
cugauguguuauguuagauga

SEQ ID NO: 2059048 - RNA, 13 nt, Staphylococcus aureus subsp. aureus Mu50
cugauucauuaaa

SEQ ID NO: 2059049 - RNA, 21 nt, Staphylococcus aureus subsp. aureus Mu50
cugaauaaauaacuucguuuu

SEQ ID NO: 2059050 - RNA, 13 nt, Staphylococcus aureus subsp. aureus Mu50
cucuaauuucaca

SEQ ID NO: 2059051 - RNA, 18 nt, Staphylococcus aureus subsp. aureus Mu50
cugaaucugcuaauuuau

SEQ ID NO: 2059052 - RNA, 21 nt, Staphylococcus aureus subsp. aureus Mu50
cugaaucugaagguaauuuaa

SEQ ID NO: 2059053 - RNA, 19 nt, Staphylococcus aureus subsp. aureus Mu50
cugaauuaauauccaaaau

SEQ ID NO: 2059054 - RNA, 19 nt, Staphylococcus aureus subsp. aureus Mu50
cguucgaaguagcuuguuu

SEQ ID NO: 2059055 - RNA, 15 nt, Staphylococcus aureus subsp. aureus Mu50
cguucccauucuuug

SEQ ID NO: 2059056 - RNA, 17 nt, Staphylococcus aureus subsp. aureus Mu50
cguucaauguuauuaaa

SEQ ID NO: 2059057 - RNA, 19 nt, Staphylococcus aureus subsp. aureus Mu50
cguuauaaguacaaauaau

SEQ ID NO: 2059058 - RNA, 15 nt, Staphylococcus aureus subsp. aureus Mu50
cguuauagcucauua

SEQ ID NO: 2059059 - RNA, 15 nt, Staphylococcus aureus subsp. aureus Mu50
cguuauagauaagua

SEQ ID NO: 2059060 - RNA, 22 nt, Staphylococcus aureus subsp. aureus Mu50
cguuacuuuggucaacuuuuuc

SEQ ID NO: 2059061 - RNA, 20 nt, Staphylococcus aureus subsp. aureus Mu50
cguuagugauaccuuuaauu

SEQ ID NO: 2059062 - RNA, 16 nt, Staphylococcus aureus subsp. aureus Mu50
cguuaauguauaaaaa

SEQ ID NO: 2059063 - RNA, 21 nt, Staphylococcus aureus subsp. aureus Mu50
cuaaaaguuguaauuuaaaau

SEQ ID NO: 2059064 - RNA, 22 nt, Staphylococcus aureus subsp. aureus Mu50
cuaaaaguuguaauuuaaaaua

SEQ ID NO: 2059065 - RNA, 17 nt, Staphylococcus aureus subsp. aureus Mu50
cuaaaauucuuucagcu

SEQ ID NO: 2059066 - RNA, 14 nt, Staphylococcus aureus subsp. aureus Mu50
cuaaaauuuccuca

SEQ ID NO: 2059067 - RNA, 15 nt, Staphylococcus aureus subsp. aureus Mu50
cuaaacaaaggggau

SEQ ID NO: 2059068 - RNA, 15 nt, Staphylococcus aureus subsp. aureus Mu50
cuaaaacuuuuucaa

SEQ ID NO: 2059069 - RNA, 21 nt, Staphylococcus aureus subsp. aureus Mu50
cuaaaacggaaauaaccacca

SEQ ID NO: 2059070 - RNA, 13 nt, Staphylococcus aureus subsp. aureus Mu50
cuaaaaaaauuaa

SEQ ID NO: 2059071 - RNA, 12 nt, Staphylococcus aureus subsp. aureus Mu50
cuaaaaaacuaa

SEQ ID NO: 2059072 - RNA, 19 nt, Staphylococcus aureus subsp. aureus Mu50
cguuuugcuaaccaucaua

SEQ ID NO: 2059073 - RNA, 12 nt, Staphylococcus aureus subsp. aureus Mu50
cguuuucaucaa

SEQ ID NO: 2059074 - RNA, 13 nt, Staphylococcus aureus subsp. aureus Mu50
cguuuuguagaua

SEQ ID NO: 2059075 - RNA, 13 nt, Staphylococcus aureus subsp. aureus Mu50
cguuuuuuuaaau

SEQ ID NO: 2059076 - RNA, 20 nt, Staphylococcus aureus subsp. aureus Mu50
cguuuuuugguucuauaauu

SEQ ID NO: 2059077 - RNA, 12 nt, Staphylococcus aureus subsp. aureus Mu50
cguuuguguguu

SEQ ID NO: 2059078 - RNA, 18 nt, Staphylococcus aureus subsp. aureus Mu50
cguuuguguguuuuaaaa

SEQ ID NO: 2059079 - RNA, 18 nt, Staphylococcus aureus subsp. aureus Mu50
cguugcaccuauuuuuug

SEQ ID NO: 2059080 - RNA, 18 nt, Staphylococcus aureus subsp. aureus Mu50
cguugguugugauuuguu

SEQ ID NO: 2059081 - RNA, 20 nt, Staphylococcus aureus subsp. aureus Mu50
cguugugcagcaacugcauu

SEQ ID NO: 2059082 - RNA, 17 nt, Staphylococcus aureus subsp. aureus Mu50
cuaaucguguauuauug

SEQ ID NO: 2059083 - RNA, 14 nt, Staphylococcus aureus subsp. aureus Mu50
cuaaucucagauuu

SEQ ID NO: 2059084 - RNA, 21 nt, Staphylococcus aureus subsp. aureus Mu50
cuaaucguuaauaaaccuaca

SEQ ID NO: 2059085 - RNA, 16 nt, Staphylococcus aureus subsp. aureus Mu50
cuaaucuuaauugucu

SEQ ID NO: 2059086 - RNA, 19 nt, Staphylococcus aureus subsp. aureus Mu50
cuaaucuuaguuaaaauuc

SEQ ID NO: 2059087 - RNA, 15 nt, Staphylococcus aureus subsp. aureus Mu50
cuaaugcuaauuuaa

SEQ ID NO: 2059088 - RNA, 19 nt, Staphylococcus aureus subsp. aureus Mu50
cuaaugcauuauuauaaua

SEQ ID NO: 2059089 - RNA, 14 nt, Staphylococcus aureus subsp. aureus Mu50
cuaaugcuauauua

SEQ ID NO: 2059090 - RNA, 17 nt, Staphylococcus aureus subsp. aureus Mu50
cuaaugcuaauuuaacu

SEQ ID NO: 2059091 - RNA, 13 nt, Staphylococcus aureus subsp. aureus Mu50
cuaaugauuuauu

SEQ ID NO: 2059092 - RNA, 15 nt, Staphylococcus aureus subsp. aureus Mu50
cuaaucuuuuuuuaa

SEQ ID NO: 2059093 - RNA, 15 nt, Staphylococcus aureus subsp. aureus Mu50
cuaauauuucuuaga

SEQ ID NO: 2059094 - RNA, 21 nt, Staphylococcus aureus subsp. aureus Mu50
cuaaucacuuggcguaaaauc

SEQ ID NO: 2059095 - RNA, 19 nt, Staphylococcus aureus subsp. aureus Mu50
cuaaucaugaaguugguuu

SEQ ID NO: 2059096 - RNA, 18 nt, Staphylococcus aureus subsp. aureus Mu50
cuaauauuagauaucuua

SEQ ID NO: 2059097 - RNA, 24 nt, Staphylococcus aureus subsp. aureus Mu50
cuaauauuagauaucuuaaucuaa

SEQ ID NO: 2059098 - RNA, 13 nt, Staphylococcus aureus subsp. aureus Mu50
cuaauaugucuag

SEQ ID NO: 2059099 - RNA, 14 nt, Staphylococcus aureus subsp. aureus Mu50
cuaauaucaauaau

SEQ ID NO: 2059100 - RNA, 21 nt, Staphylococcus aureus subsp. aureus Mu50
cuaauaugucuagacuuauuu

SEQ ID NO: 2059101 - RNA, 15 nt, Staphylococcus aureus subsp. aureus Mu50
cuaauauauuaauuu

SEQ ID NO: 2059102 - RNA, 15 nt, Staphylococcus aureus subsp. aureus Mu50
cuaauaggaucaccu

SEQ ID NO: 2059103 - RNA, 20 nt, Staphylococcus aureus subsp. aureus Mu50
cuaauagcauuuguaaacag

SEQ ID NO: 2059104 - RNA, 18 nt, Staphylococcus aureus subsp. aureus Mu50
cuaauacuuucacuuuuu

SEQ ID NO: 2059105 - RNA, 23 nt, Staphylococcus aureus subsp. aureus Mu50
cuaauacacuugauaaaacuaau

SEQ ID NO: 2059106 - RNA, 14 nt, Staphylococcus aureus subsp. aureus Mu50
cuaauaacaaauag

SEQ ID NO: 2059107 - RNA, 14 nt, Staphylococcus aureus subsp. aureus Mu50
cuacaacuucuucu

SEQ ID NO: 2059108 - RNA, 23 nt, Staphylococcus aureus subsp. aureus Mu50
cuacaaaguuuauacuuaauaua

SEQ ID NO: 2059109 - RNA, 22 nt, Staphylococcus aureus subsp. aureus Mu50
cuaauuucuaauacauacugau

SEQ ID NO: 2059110 - RNA, 12 nt, Staphylococcus aureus subsp. aureus Mu50
cuaauuucacaa

SEQ ID NO: 2059111 - RNA, 12 nt, Staphylococcus aureus subsp. aureus Mu50
cuaauuuuaauu

SEQ ID NO: 2059112 - RNA, 17 nt, Staphylococcus aureus subsp. aureus Mu50
cuaauuugcaaaaucaa

SEQ ID NO: 2059113 - RNA, 18 nt, Staphylococcus aureus subsp. aureus Mu50
cuaauuugcaaaaucaac

SEQ ID NO: 2059114 - RNA, 20 nt, Staphylococcus aureus subsp. aureus Mu50
cuaauuuugugaauuuauuu

SEQ ID NO: 2059115 - RNA, 17 nt, Staphylococcus aureus subsp. aureus Mu50
cuaauuuuaauuuucag

SEQ ID NO: 2059116 - RNA, 18 nt, Staphylococcus aureus subsp. aureus Mu50
cuaaugguuucauaaacu

SEQ ID NO: 2059117 - RNA, 16 nt, Staphylococcus aureus subsp. aureus Mu50
cuaaugcuuuaauaaa

SEQ ID NO: 2059118 - RNA, 19 nt, Staphylococcus aureus subsp. aureus Mu50
cuaauguguggauuuaauu

SEQ ID NO: 2059119 - RNA, 20 nt, Staphylococcus aureus subsp. aureus Mu50
cuaauguuaaaauaacugcu

SEQ ID NO: 2059120 - RNA, 12 nt, Staphylococcus aureus subsp. aureus Mu50
cuaauuauauua

SEQ ID NO: 2059121 - RNA, 13 nt, Staphylococcus aureus subsp. aureus Mu50
cuaauuauauuaa

SEQ ID NO: 2059122 - RNA, 15 nt, Staphylococcus aureus subsp. aureus Mu50
cuaauucaagaacag

SEQ ID NO: 2059123 - RNA, 21 nt, Staphylococcus aureus subsp. aureus Mu50
cuaauugaaggccauuuuuau

SEQ ID NO: 2059124 - RNA, 23 nt, Staphylococcus aureus subsp. aureus Mu50
cuaauugaaggccauuuuuauuu

SEQ ID NO: 2059125 - RNA, 13 nt, Staphylococcus aureus subsp. aureus Mu50
cuaauucuguuuc

SEQ ID NO: 2059126 - RNA, 20 nt, Staphylococcus aureus subsp. aureus Mu50
cuaauucuguuucaaagcug

SEQ ID NO: 2059127 - RNA, 17 nt, Staphylococcus aureus subsp. aureus Mu50
cuaauuuacguacuuca

SEQ ID NO: 2059128 - RNA, 20 nt, Staphylococcus aureus subsp. aureus Mu50
cuaauuuaguaucuauacaa

SEQ ID NO: 2059129 - RNA, 21 nt, Staphylococcus aureus subsp. aureus Mu50
cuaauuuaaaugauuucacuu

SEQ ID NO: 2059130 - RNA, 16 nt, Staphylococcus aureus subsp. aureus Mu50
cuaauugcuuaauauc

SEQ ID NO: 2059131 - RNA, 20 nt, Staphylococcus aureus subsp. aureus Mu50
cuaagcucguuaauuuuauu

SEQ ID NO: 2059132 - RNA, 12 nt, Staphylococcus aureus subsp. aureus Mu50
cuaagcagucug

SEQ ID NO: 2059133 - RNA, 14 nt, Staphylococcus aureus subsp. aureus Mu50
cuaagguuguucua

SEQ ID NO: 2059134 - RNA, 18 nt, Staphylococcus aureus subsp. aureus Mu50
cuaagguuguucuauaca

SEQ ID NO: 2059135 - RNA, 17 nt, Staphylococcus aureus subsp. aureus Mu50
cuaaguaaccaagucua

SEQ ID NO: 2059136 - RNA, 20 nt, Staphylococcus aureus subsp. aureus Mu50
cuaagcugauuaaaauguua

SEQ ID NO: 2059137 - RNA, 16 nt, Staphylococcus aureus subsp. aureus Mu50
cuaaggacuuuaugcc

SEQ ID NO: 2059138 - RNA, 18 nt, Staphylococcus aureus subsp. aureus Mu50
cuaaggacuuuaugcccu

SEQ ID NO: 2059139 - RNA, 15 nt, Staphylococcus aureus subsp. aureus Mu50
cuaaguguuuuauag

SEQ ID NO: 2059140 - RNA, 14 nt, Staphylococcus aureus subsp. aureus Mu50
cuaaguuaaaaccu

SEQ ID NO: 2059141 - RNA, 15 nt, Staphylococcus aureus subsp. aureus Mu50
cuaaguuaauuuauc

SEQ ID NO: 2059142 - RNA, 16 nt, Staphylococcus aureus subsp. aureus Mu50
cuaaguuaauuuaucg

SEQ ID NO: 2059143 - RNA, 13 nt, Staphylococcus aureus subsp. aureus Mu50
cuaaguuugaauc

SEQ ID NO: 2059144 - RNA, 18 nt, Staphylococcus aureus subsp. aureus Mu50
cuaaaccgauuaauauaa

SEQ ID NO: 2059145 - RNA, 19 nt, Staphylococcus aureus subsp. aureus Mu50
cuaaaccgauuaauauaau

SEQ ID NO: 2059146 - RNA, 15 nt, Staphylococcus aureus subsp. aureus Mu50
cuaaaccucuaaaua

SEQ ID NO: 2059147 - RNA, 16 nt, Staphylococcus aureus subsp. aureus Mu50
cuaaaccucuaaauaa

SEQ ID NO: 2059148 - RNA, 15 nt, Staphylococcus aureus subsp. aureus Mu50
cuaaaccauugaaug

SEQ ID NO: 2059149 - RNA, 18 nt, Staphylococcus aureus subsp. aureus Mu50
cuaaaccucuaaauaaaa

SEQ ID NO: 2059150 - RNA, 22 nt, Staphylococcus aureus subsp. aureus Mu50
cuaacguuuuaaagguuaaaua

SEQ ID NO: 2059151 - RNA, 14 nt, Staphylococcus aureus subsp. aureus Mu50
cuaacuauauugug

SEQ ID NO: 2059152 - RNA, 17 nt, Staphylococcus aureus subsp. aureus Mu50
cuaacuaaguauagugu

SEQ ID NO: 2059153 - RNA, 14 nt, Staphylococcus aureus subsp. aureus Mu50
cuaaccuauuaaaa

SEQ ID NO: 2059154 - RNA, 22 nt, Staphylococcus aureus subsp. aureus Mu50
cuaaccuguuugagauauauua

SEQ ID NO: 2059155 - RNA, 16 nt, Staphylococcus aureus subsp. aureus Mu50
cgucucaauaucuucg

SEQ ID NO: 2059156 - RNA, 12 nt, Staphylococcus aureus subsp. aureus Mu50
cgucuuguaaac

SEQ ID NO: 2059157 - RNA, 17 nt, Staphylococcus aureus subsp. aureus Mu50
cgucuuguaaacuucuu

SEQ ID NO: 2059158 - RNA, 13 nt, Staphylococcus aureus subsp. aureus Mu50
cgugauuuuucau

SEQ ID NO: 2059159 - RNA, 17 nt, Staphylococcus aureus subsp. aureus Mu50
cgugccuuaacuucaua

SEQ ID NO: 2059160 - RNA, 15 nt, Staphylococcus aureus subsp. aureus Mu50
cguauuuuaaugauu

SEQ ID NO: 2059161 - RNA, 14 nt, Staphylococcus aureus subsp. aureus Mu50
cguauugaaugaau

SEQ ID NO: 2059162 - RNA, 14 nt, Staphylococcus aureus subsp. aureus Mu50
cguaucuguuuaug

SEQ ID NO: 2059163 - RNA, 16 nt, Staphylococcus aureus subsp. aureus Mu50
cguagcuuuucauuua

SEQ ID NO: 2059164 - RNA, 14 nt, Staphylococcus aureus subsp. aureus Mu50
cguaucaagaaaaa

SEQ ID NO: 2059165 - RNA, 16 nt, Staphylococcus aureus subsp. aureus Mu50
cguaucauuuaaaaua

SEQ ID NO: 2059166 - RNA, 19 nt, Staphylococcus aureus subsp. aureus Mu50
cguauauauauauuaaaac

SEQ ID NO: 2059167 - RNA, 15 nt, Staphylococcus aureus subsp. aureus Mu50
cguaaugauauuacc

SEQ ID NO: 2059168 - RNA, 18 nt, Staphylococcus aureus subsp. aureus Mu50
cguacgguagucucccau

SEQ ID NO: 2059169 - RNA, 20 nt, Staphylococcus aureus subsp. aureus Mu50
cguacguugauguguugcau

SEQ ID NO: 2059170 - RNA, 13 nt, Staphylococcus aureus subsp. aureus Mu50
cuaccaauaauuc

SEQ ID NO: 2059171 - RNA, 14 nt, Staphylococcus aureus subsp. aureus Mu50
cuaccgcuaaaauu

SEQ ID NO: 2059172 - RNA, 19 nt, Staphylococcus aureus subsp. aureus Mu50
cuacccguuuuuugguucu

SEQ ID NO: 2059173 - RNA, 21 nt, Staphylococcus aureus subsp. aureus Mu50
cuaccuacuuguucaauacuu

SEQ ID NO: 2059174 - RNA, 21 nt, Staphylococcus aureus subsp. aureus Mu50
cuacaguaaauugauucuuug

SEQ ID NO: 2059175 - RNA, 15 nt, Staphylococcus aureus subsp. aureus Mu50
cuacaguguaugaug

SEQ ID NO: 2059176 - RNA, 17 nt, Staphylococcus aureus subsp. aureus Mu50
cuacaggcaaugcaagu

SEQ ID NO: 2059177 - RNA, 13 nt, Staphylococcus aureus subsp. aureus Mu50
cuacagcacugaa

SEQ ID NO: 2059178 - RNA, 23 nt, Staphylococcus aureus subsp. aureus Mu50
cuacagcacugaaaucuagaccu

SEQ ID NO: 2059179 - RNA, 16 nt, Staphylococcus aureus subsp. aureus Mu50
cuacaugaaucaacaa

SEQ ID NO: 2059180 - RNA, 16 nt, Staphylococcus aureus subsp. aureus Mu50
cuacauuaaagaaaau

SEQ ID NO: 2059181 - RNA, 20 nt, Staphylococcus aureus subsp. aureus Mu50
cuacauuaaagaaaauaucu

SEQ ID NO: 2059182 - RNA, 23 nt, Staphylococcus aureus subsp. aureus Mu50
cuacauaauuuaucaauuucuau

SEQ ID NO: 2059183 - RNA, 18 nt, Staphylococcus aureus subsp. aureus Mu50
cuacauacaacucguuuu

SEQ ID NO: 2059184 - RNA, 22 nt, Staphylococcus aureus subsp. aureus Mu50
cuacauacaacucguuuuucca

SEQ ID NO: 2059185 - RNA, 16 nt, Staphylococcus aureus subsp. aureus Mu50
cuacaauuuucucauu

SEQ ID NO: 2059186 - RNA, 22 nt, Staphylococcus aureus subsp. aureus Mu50
cuacaauccuauggcgcaauuu

SEQ ID NO: 2059187 - RNA, 21 nt, Staphylococcus aureus subsp. aureus Mu50
cuacaauuauaaaugauuaaa

SEQ ID NO: 2059188 - RNA, 16 nt, Staphylococcus aureus subsp. aureus Mu50
cuacaauauagaaaau

SEQ ID NO: 2059189 - RNA, 13 nt, Staphylococcus aureus subsp. aureus Mu50
cuacaauccuaug

SEQ ID NO: 2059190 - RNA, 15 nt, Staphylococcus aureus subsp. aureus Mu50
cuacagagaaucaau

SEQ ID NO: 2059191 - RNA, 21 nt, Staphylococcus aureus subsp. aureus Mu50
cuacagaauggauaccuaaag

SEQ ID NO: 2059192 - RNA, 14 nt, Staphylococcus aureus subsp. aureus Mu50
cuacacuuaauaua

SEQ ID NO: 2059193 - RNA, 14 nt, Staphylococcus aureus subsp. aureus Mu50
cuagccugaaauag

SEQ ID NO: 2059194 - RNA, 18 nt, Staphylococcus aureus subsp. aureus Mu50
cuagccguuauuuuuuug

SEQ ID NO: 2059195 - RNA, 14 nt, Staphylococcus aureus subsp. aureus Mu50
cuagcauaucuuua

SEQ ID NO: 2059196 - RNA, 17 nt, Staphylococcus aureus subsp. aureus Mu50
cuagaaauccucuuaua

SEQ ID NO: 2059197 - RNA, 12 nt, Staphylococcus aureus subsp. aureus Mu50
cuagaauauaac

SEQ ID NO: 2059198 - RNA, 14 nt, Staphylococcus aureus subsp. aureus Mu50
cuagaaaacauaaa

SEQ ID NO: 2059199 - RNA, 23 nt, Staphylococcus aureus subsp. aureus Mu50
cuacguguguaguagcaccgauu

SEQ ID NO: 2059200 - RNA, 20 nt, Staphylococcus aureus subsp. aureus Mu50
cuacgucauacuaucuacaa

SEQ ID NO: 2059201 - RNA, 16 nt, Staphylococcus aureus subsp. aureus Mu50
cuauaaaauucaccaa

SEQ ID NO: 2059202 - RNA, 14 nt, Staphylococcus aureus subsp. aureus Mu50
cuauaaaauucacc

SEQ ID NO: 2059203 - RNA, 17 nt, Staphylococcus aureus subsp. aureus Mu50
cuauaaaaguacuuuaa

SEQ ID NO: 2059204 - RNA, 11 nt, Staphylococcus aureus subsp. aureus Mu50
cuauaaacaua

SEQ ID NO: 2059205 - RNA, 23 nt, Staphylococcus aureus subsp. aureus Mu50
cuauaaagaaugauuuauaaaaa

SEQ ID NO: 2059206 - RNA, 19 nt, Staphylococcus aureus subsp. aureus Mu50
cuauaaaaauuuauucaaa

SEQ ID NO: 2059207 - RNA, 20 nt, Staphylococcus aureus subsp. aureus Mu50
cuauaaaaauuuauucaaaa

SEQ ID NO: 2059208 - RNA, 16 nt, Staphylococcus aureus subsp. aureus Mu50
cuaguuuuuuuuauau

SEQ ID NO: 2059209 - RNA, 15 nt, Staphylococcus aureus subsp. aureus Mu50
cuaguuguuuuauag

SEQ ID NO: 2059210 - RNA, 22 nt, Staphylococcus aureus subsp. aureus Mu50
cuaguuguuuuauagcauuucu

SEQ ID NO: 2059211 - RNA, 18 nt, Staphylococcus aureus subsp. aureus Mu50
cuauacuccaguuuauaa

SEQ ID NO: 2059212 - RNA, 16 nt, Staphylococcus aureus subsp. aureus Mu50
cuauaaccuauuaaau

SEQ ID NO: 2059213 - RNA, 18 nt, Staphylococcus aureus subsp. aureus Mu50
cuauaacucuaaauauaa

SEQ ID NO: 2059214 - RNA, 19 nt, Staphylococcus aureus subsp. aureus Mu50
cuauaacucuaaauauaau

SEQ ID NO: 2059215 - RNA, 21 nt, Staphylococcus aureus subsp. aureus Mu50
cuauaaauacgucaucuuuau

SEQ ID NO: 2059216 - RNA, 14 nt, Staphylococcus aureus subsp. aureus Mu50
cuaguagcuugaau

SEQ ID NO: 2059217 - RNA, 18 nt, Staphylococcus aureus subsp. aureus Mu50
cuaggaauauaaaacugu

SEQ ID NO: 2059218 - RNA, 22 nt, Staphylococcus aureus subsp. aureus Mu50
cuagucuuuaacuuuaauuaaa

SEQ ID NO: 2059219 - RNA, 17 nt, Staphylococcus aureus subsp. aureus Mu50
cuagucaggggccccaa

SEQ ID NO: 2059220 - RNA, 13 nt, Staphylococcus aureus subsp. aureus Mu50
cuagugcuuccau

SEQ ID NO: 2059221 - RNA, 16 nt, Staphylococcus aureus subsp. aureus Mu50
cuaguucgauuuuuua

SEQ ID NO: 2059222 - RNA, 21 nt, Staphylococcus aureus subsp. aureus Mu50
cuaguucuaaguguugaccau

SEQ ID NO: 2059223 - RNA, 18 nt, Staphylococcus aureus subsp. aureus Mu50
cuaguucagcuucuaagu

SEQ ID NO: 2059224 - RNA, 18 nt, Staphylococcus aureus subsp. aureus Mu50
cucaauucucuaacuuua

SEQ ID NO: 2059225 - RNA, 19 nt, Staphylococcus aureus subsp. aureus Mu50
cucaauuuaguauaaauaa

SEQ ID NO: 2059226 - RNA, 14 nt, Staphylococcus aureus subsp. aureus Mu50
cucaauuuaguaua

SEQ ID NO: 2059227 - RNA, 23 nt, Staphylococcus aureus subsp. aureus Mu50
cucaauuuaguauaaauaaaaau

SEQ ID NO: 2059228 - RNA, 22 nt, Staphylococcus aureus subsp. aureus Mu50
cucaauuaauuuagucauuaca

SEQ ID NO: 2059229 - RNA, 16 nt, Staphylococcus aureus subsp. aureus Mu50
cucaaugcauuuaauu

SEQ ID NO: 2059230 - RNA, 18 nt, Staphylococcus aureus subsp. aureus Mu50
cucaaugcauuuaauuua

SEQ ID NO: 2059231 - RNA, 19 nt, Staphylococcus aureus subsp. aureus Mu50
cucaaagguuuacuauuaa

SEQ ID NO: 2059232 - RNA, 14 nt, Staphylococcus aureus subsp. aureus Mu50
cucaaaacaauuua

SEQ ID NO: 2059233 - RNA, 20 nt, Staphylococcus aureus subsp. aureus Mu50
cucaaaagcuguaguuucaa

SEQ ID NO: 2059234 - RNA, 18 nt, Staphylococcus aureus subsp. aureus Mu50
cucaaagaaacuauagau

SEQ ID NO: 2059235 - RNA, 18 nt, Staphylococcus aureus subsp. aureus Mu50
cuauuaggauccaauuca

SEQ ID NO: 2059236 - RNA, 18 nt, Staphylococcus aureus subsp. aureus Mu50
cuauuaggauccaauuua

SEQ ID NO: 2059237 - RNA, 19 nt, Staphylococcus aureus subsp. aureus Mu50
cuauucauagaccuaugaa

SEQ ID NO: 2059238 - RNA, 19 nt, Staphylococcus aureus subsp. aureus Mu50
cuauggcgcaauuuuuaac

SEQ ID NO: 2059239 - RNA, 23 nt, Staphylococcus aureus subsp. aureus Mu50
cuaugaaauuggaauagauguug

SEQ ID NO: 2059240 - RNA, 19 nt, Staphylococcus aureus subsp. aureus Mu50
cuaugaagaaaucuauaac

SEQ ID NO: 2059241 - RNA, 14 nt, Staphylococcus aureus subsp. aureus Mu50
cuaucuucagauuc

SEQ ID NO: 2059242 - RNA, 21 nt, Staphylococcus aureus subsp. aureus Mu50
cuauagccaaaggcaaaaugu

SEQ ID NO: 2059243 - RNA, 14 nt, Staphylococcus aureus subsp. aureus Mu50
cuaucuauaaacgu

SEQ ID NO: 2059244 - RNA, 24 nt, Staphylococcus aureus subsp. aureus Mu50
cuaucuccgcuacaauuauaugua

SEQ ID NO: 2059245 - RNA, 17 nt, Staphylococcus aureus subsp. aureus Mu50
cuauuggucauuacuaa

SEQ ID NO: 2059246 - RNA, 20 nt, Staphylococcus aureus subsp. aureus Mu50
cuauugcagaagaaaacuau

SEQ ID NO: 2059247 - RNA, 17 nt, Staphylococcus aureus subsp. aureus Mu50
cuauugauauucuaaaa

SEQ ID NO: 2059248 - RNA, 19 nt, Staphylococcus aureus subsp. aureus Mu50
cuauugauauucuaaaaaa

SEQ ID NO: 2059249 - RNA, 21 nt, Staphylococcus aureus subsp. aureus Mu50
cuauugauauucuaaaaaauu

SEQ ID NO: 2059250 - RNA, 21 nt, Staphylococcus aureus subsp. aureus Mu50
cuauuucaacaaacauaaaua

SEQ ID NO: 2059251 - RNA, 22 nt, Staphylococcus aureus subsp. aureus Mu50
cuauuucaacaaacauaaauaa

SEQ ID NO: 2059252 - RNA, 14 nt, Staphylococcus aureus subsp. aureus Mu50
cuauuguaagcuga

SEQ ID NO: 2059253 - RNA, 18 nt, Staphylococcus aureus subsp. aureus Mu50
cuauuuuucgauuuugag

SEQ ID NO: 2059254 - RNA, 19 nt, Staphylococcus aureus subsp. aureus Mu50
cuauuuuucgauuuugaga

SEQ ID NO: 2059255 - RNA, 14 nt, Staphylococcus aureus subsp. aureus Mu50
cuauuuuuaaugua

SEQ ID NO: 2059256 - RNA, 21 nt, Staphylococcus aureus subsp. aureus Mu50
cuauuuguggaaauaaaacaa

SEQ ID NO: 2059257 - RNA, 23 nt, Staphylococcus aureus subsp. aureus Mu50
cuauuuguuaugguauuuauaga

SEQ ID NO: 2059258 - RNA, 16 nt, Staphylococcus aureus subsp. aureus Mu50
cuauuuuauacauaaa

SEQ ID NO: 2059259 - RNA, 13 nt, Staphylococcus aureus subsp. aureus Mu50
cucguuaauuuua

SEQ ID NO: 2059260 - RNA, 17 nt, Staphylococcus aureus subsp. aureus Mu50
cucuaacgauuucuagu

SEQ ID NO: 2059261 - RNA, 16 nt, Staphylococcus aureus subsp. aureus Mu50
cucuaaauauaauaga

SEQ ID NO: 2059262 - RNA, 16 nt, Staphylococcus aureus subsp. aureus Mu50
cucuaaauaaaauuaa

SEQ ID NO: 2059263 - RNA, 16 nt, Staphylococcus aureus subsp. aureus Mu50
cucuaauccaaaauaa

SEQ ID NO: 2059264 - RNA, 22 nt, Staphylococcus aureus subsp. aureus Mu50
cucuaauucaaugauuuuuaaa

SEQ ID NO: 2059265 - RNA, 20 nt, Staphylococcus aureus subsp. aureus Mu50
cucuaacuuuaccaauauca

SEQ ID NO: 2059266 - RNA, 17 nt, Staphylococcus aureus subsp. aureus Mu50
cucuaaaagccaucuua

SEQ ID NO: 2059267 - RNA, 22 nt, Staphylococcus aureus subsp. aureus Mu50
cucuaaacuucuauuaauaauu

SEQ ID NO: 2059268 - RNA, 18 nt, Staphylococcus aureus subsp. aureus Mu50
cucgauuuuuuuauauuu

SEQ ID NO: 2059269 - RNA, 19 nt, Staphylococcus aureus subsp. aureus Mu50
cuccguauuuaccuucuuc

SEQ ID NO: 2059270 - RNA, 14 nt, Staphylococcus aureus subsp. aureus Mu50
cuccguuaauuuaa

SEQ ID NO: 2059271 - RNA, 20 nt, Staphylococcus aureus subsp. aureus Mu50
cuccuaccgcuaaaauucuu

SEQ ID NO: 2059272 - RNA, 14 nt, Staphylococcus aureus subsp. aureus Mu50
cuccccaacuuaau

SEQ ID NO: 2059273 - RNA, 18 nt, Staphylococcus aureus subsp. aureus Mu50
cuccauuauauagucugc

SEQ ID NO: 2059274 - RNA, 17 nt, Staphylococcus aureus subsp. aureus Mu50
cucccauaacaccuacu

SEQ ID NO: 2059275 - RNA, 18 nt, Staphylococcus aureus subsp. aureus Mu50
cucauuagcgaaaacuaa

SEQ ID NO: 2059276 - RNA, 20 nt, Staphylococcus aureus subsp. aureus Mu50
cucauuauaaugauuuuuau

SEQ ID NO: 2059277 - RNA, 20 nt, Staphylococcus aureus subsp. aureus Mu50
cucauuccaggaaggaaugu

SEQ ID NO: 2059278 - RNA, 16 nt, Staphylococcus aureus subsp. aureus Mu50
cucauuaaccuuacau

SEQ ID NO: 2059279 - RNA, 14 nt, Staphylococcus aureus subsp. aureus Mu50
cucauguuucagua

SEQ ID NO: 2059280 - RNA, 14 nt, Staphylococcus aureus subsp. aureus Mu50
cucauuagcgcaag

SEQ ID NO: 2059281 - RNA, 16 nt, Staphylococcus aureus subsp. aureus Mu50
cucauuucaauauuaa

SEQ ID NO: 2059282 - RNA, 23 nt, Staphylococcus aureus subsp. aureus Mu50
cucauuuuuuuaauuauuucccu

SEQ ID NO: 2059283 - RNA, 12 nt, Staphylococcus aureus subsp. aureus Mu50
cuccaaauauug

SEQ ID NO: 2059284 - RNA, 18 nt, Staphylococcus aureus subsp. aureus Mu50
cuccaccaccugcaauuu

SEQ ID NO: 2059285 - RNA, 15 nt, Staphylococcus aureus subsp. aureus Mu50
aaaaaaccaauaauc

SEQ ID NO: 2059286 - RNA, 14 nt, Staphylococcus aureus subsp. aureus Mu50
aaaaaacaguguag

SEQ ID NO: 2059287 - RNA, 16 nt, Staphylococcus aureus subsp. aureus Mu50
aaaaaagaacauaaaa

SEQ ID NO: 2059288 - RNA, 13 nt, Staphylococcus aureus subsp. aureus Mu50
aaaaaauuuaaau

SEQ ID NO: 2059289 - RNA, 13 nt, Staphylococcus aureus subsp. aureus Mu50
aaaaaauuguaua

SEQ ID NO: 2059290 - RNA, 14 nt, Staphylococcus aureus subsp. aureus Mu50
aaaaaauuauuaaa

SEQ ID NO: 2059291 - RNA, 12 nt, Staphylococcus aureus subsp. aureus Mu50
aaaaacaaaaaa

SEQ ID NO: 2059292 - RNA, 16 nt, Staphylococcus aureus subsp. aureus Mu50
aaaaaauuaaaaauuu

SEQ ID NO: 2059293 - RNA, 15 nt, Staphylococcus aureus subsp. aureus Mu50
aaaaagaauuucgaa

SEQ ID NO: 2059294 - RNA, 15 nt, Staphylococcus aureus subsp. aureus Mu50
aaaaagaugaaaaag

SEQ ID NO: 2059295 - RNA, 13 nt, Staphylococcus aureus subsp. aureus Mu50
aaaaagaugaaaa

SEQ ID NO: 2059296 - RNA, 20 nt, Staphylococcus aureus subsp. aureus Mu50
aaaaacuucuuaacuugaaa

SEQ ID NO: 2059297 - RNA, 22 nt, Staphylococcus aureus subsp. aureus Mu50
aaaaaggaugaugugaauguuu

SEQ ID NO: 2059298 - RNA, 20 nt, Staphylococcus aureus subsp. aureus Mu50
aaaaaggaagaacagcacau

SEQ ID NO: 2059299 - RNA, 18 nt, Staphylococcus aureus subsp. aureus Mu50
aaaaagucccgcuuaaaa

SEQ ID NO: 2059300 - RNA, 15 nt, Staphylococcus aureus subsp. aureus Mu50
aaaaaguauuacuuu

SEQ ID NO: 2059301 - RNA, 19 nt, Staphylococcus aureus subsp. aureus Mu50
aaaaagcugauuucuauca

SEQ ID NO: 2059302 - RNA, 23 nt, Staphylococcus aureus subsp. aureus Mu50
aaaaagcggacugaaagaaaagu

SEQ ID NO: 2059303 - RNA, 22 nt, Staphylococcus aureus subsp. aureus Mu50
aaaaacgucgugucugaauaca

SEQ ID NO: 2059304 - RNA, 17 nt, Staphylococcus aureus subsp. aureus Mu50
aaaaaccugaaacaaau

SEQ ID NO: 2059305 - RNA, 18 nt, Staphylococcus aureus subsp. aureus Mu50
aaaaaccguaauuuuaau

SEQ ID NO: 2059306 - RNA, 20 nt, Staphylococcus aureus subsp. aureus Mu50
aaaaacgcuuuuaaaccgug

SEQ ID NO: 2059307 - RNA, 15 nt, Staphylococcus aureus subsp. aureus Mu50
aaaaacgcuuuuaaa

SEQ ID NO: 2059308 - RNA, 18 nt, Staphylococcus aureus subsp. aureus Mu50
aaaaaccgaacaucugaa

SEQ ID NO: 2059309 - RNA, 21 nt, Staphylococcus aureus subsp. aureus Mu50
aaaaaccgaacaucugaaaaa

SEQ ID NO: 2059310 - RNA, 19 nt, Staphylococcus aureus subsp. aureus Mu50
aaaaacuguaaaucaucau

SEQ ID NO: 2059311 - RNA, 22 nt, Staphylococcus aureus subsp. aureus Mu50
aaaaacgguaauuucuauuuau

SEQ ID NO: 2059312 - RNA, 23 nt, Staphylococcus aureus subsp. aureus Mu50
aaaaacgguacagauaagaauau

SEQ ID NO: 2059313 - RNA, 20 nt, Staphylococcus aureus subsp. aureus Mu50
aaaaccgagaaucuccauuu

SEQ ID NO: 2059314 - RNA, 21 nt, Staphylococcus aureus subsp. aureus Mu50
aaaaccgaacaucugaaaaaa

SEQ ID NO: 2059315 - RNA, 21 nt, Staphylococcus aureus subsp. aureus Mu50
aaaaccgcuauaaaauuuuga

SEQ ID NO: 2059316 - RNA, 13 nt, Staphylococcus aureus subsp. aureus Mu50
aaaacaaauuaca

SEQ ID NO: 2059317 - RNA, 19 nt, Staphylococcus aureus subsp. aureus Mu50
aaaacaaauuacacccuuu

SEQ ID NO: 2059318 - RNA, 17 nt, Staphylococcus aureus subsp. aureus Mu50
aaaacaaagguuuguaa

SEQ ID NO: 2059319 - RNA, 16 nt, Staphylococcus aureus subsp. aureus Mu50
aaaacaaaaaaaccga

SEQ ID NO: 2059320 - RNA, 16 nt, Staphylococcus aureus subsp. aureus Mu50
aaaacaaaaaauaucu

SEQ ID NO: 2059321 - RNA, 22 nt, Staphylococcus aureus subsp. aureus Mu50
aaaacaaaaacgguaauuucua

SEQ ID NO: 2059322 - RNA, 18 nt, Staphylococcus aureus subsp. aureus Mu50
aaaacagguggaaguguu

SEQ ID NO: 2059323 - RNA, 19 nt, Staphylococcus aureus subsp. aureus Mu50
aaaacaguguagcacaaga

SEQ ID NO: 2059324 - RNA, 12 nt, Staphylococcus aureus subsp. aureus Mu50
aaaacauaccug

SEQ ID NO: 2059325 - RNA, 21 nt, Staphylococcus aureus subsp. aureus Mu50
aaaaagugcauauuuaauaca

SEQ ID NO: 2059326 - RNA, 13 nt, Staphylococcus aureus subsp. aureus Mu50
aaaaaguuuaaag

SEQ ID NO: 2059327 - RNA, 23 nt, Staphylococcus aureus subsp. aureus Mu50
aaaaagucccgcuuaaaaugauu

SEQ ID NO: 2059328 - RNA, 15 nt, Staphylococcus aureus subsp. aureus Mu50
aaaaagucuuucucg

SEQ ID NO: 2059329 - RNA, 19 nt, Staphylococcus aureus subsp. aureus Mu50
aaaaagugauaauuaaaau

SEQ ID NO: 2059330 - RNA, 14 nt, Staphylococcus aureus subsp. aureus Mu50
aaaaaucaaagagg

SEQ ID NO: 2059331 - RNA, 14 nt, Staphylococcus aureus subsp. aureus Mu50
aaaaauauuuacau

SEQ ID NO: 2059332 - RNA, 13 nt, Staphylococcus aureus subsp. aureus Mu50
aaaaauauuuaaa

SEQ ID NO: 2059333 - RNA, 14 nt, Staphylococcus aureus subsp. aureus Mu50
aaaaauauuuaaac

SEQ ID NO: 2059334 - RNA, 12 nt, Staphylococcus aureus subsp. aureus Mu50
aaaaauauguau

SEQ ID NO: 2059335 - RNA, 17 nt, Staphylococcus aureus subsp. aureus Mu50
aaaaaucacgcuaacau

SEQ ID NO: 2059336 - RNA, 22 nt, Staphylococcus aureus subsp. aureus Mu50
aaaaaucaguuuuuaaaucaaa

SEQ ID NO: 2059337 - RNA, 17 nt, Staphylococcus aureus subsp. aureus Mu50
aaaaaucggcuuucuaa

SEQ ID NO: 2059338 - RNA, 17 nt, Staphylococcus aureus subsp. aureus Mu50
aaaaaugcuguuuuaug

SEQ ID NO: 2059339 - RNA, 21 nt, Staphylococcus aureus subsp. aureus Mu50
aaaaauggcgaaaaagcuaaa

SEQ ID NO: 2059340 - RNA, 12 nt, Staphylococcus aureus subsp. aureus Mu50
aaaaaugaugua

SEQ ID NO: 2059341 - RNA, 22 nt, Staphylococcus aureus subsp. aureus Mu50
aaaaaucuucuccaaucaucau

SEQ ID NO: 2059342 - RNA, 16 nt, Staphylococcus aureus subsp. aureus Mu50
aaaaaucuuuugauag

SEQ ID NO: 2059343 - RNA, 16 nt, Staphylococcus aureus subsp. aureus Mu50
aaaaaugugaccuuau

SEQ ID NO: 2059344 - RNA, 17 nt, Staphylococcus aureus subsp. aureus Mu50
aaaaauguaaauaaaaa

SEQ ID NO: 2059345 - RNA, 20 nt, Staphylococcus aureus subsp. aureus Mu50
aaaaauuccuagcuuuuaug

SEQ ID NO: 2059346 - RNA, 21 nt, Staphylococcus aureus subsp. aureus Mu50
aaaaauugcaaugcuaucaug

SEQ ID NO: 2059347 - RNA, 16 nt, Staphylococcus aureus subsp. aureus Mu50
aaaaauuuauucaaaa

SEQ ID NO: 2059348 - RNA, 19 nt, Staphylococcus aureus subsp. aureus Mu50
aaaaauuguucaauauuua

SEQ ID NO: 2059349 - RNA, 22 nt, Staphylococcus aureus subsp. aureus Mu50
aaaaauuguucaauauuuauca

SEQ ID NO: 2059350 - RNA, 16 nt, Staphylococcus aureus subsp. aureus Mu50
aaaaauuuaaauaaua

SEQ ID NO: 2059351 - RNA, 21 nt, Staphylococcus aureus subsp. aureus Mu50
aaaccauuuucaagaggacaa

SEQ ID NO: 2059352 - RNA, 17 nt, Staphylococcus aureus subsp. aureus Mu50
aaaccauugaaugaauc

SEQ ID NO: 2059353 - RNA, 19 nt, Staphylococcus aureus subsp. aureus Mu50
aaaccauaaguaaaacugc

SEQ ID NO: 2059354 - RNA, 17 nt, Staphylococcus aureus subsp. aureus Mu50
aaaccgaggaaauccuu

SEQ ID NO: 2059355 - RNA, 16 nt, Staphylococcus aureus subsp. aureus Mu50
aaaccguaauuuuaau

SEQ ID NO: 2059356 - RNA, 20 nt, Staphylococcus aureus subsp. aureus Mu50
aaaccguauagucauuacau

SEQ ID NO: 2059357 - RNA, 13 nt, Staphylococcus aureus subsp. aureus Mu50
aaaccaauacgaa

SEQ ID NO: 2059358 - RNA, 20 nt, Staphylococcus aureus subsp. aureus Mu50
aaaccaauaauccgagucau

SEQ ID NO: 2059359 - RNA, 18 nt, Staphylococcus aureus subsp. aureus Mu50
aaacauuuuuagaaucaa

SEQ ID NO: 2059360 - RNA, 13 nt, Staphylococcus aureus subsp. aureus Mu50
aaacauuuuugaa

SEQ ID NO: 2059361 - RNA, 23 nt, Staphylococcus aureus subsp. aureus Mu50
aaacauuuugugacuuuguucau

SEQ ID NO: 2059362 - RNA, 13 nt, Staphylococcus aureus subsp. aureus Mu50
aaacauuuuauac

SEQ ID NO: 2059363 - RNA, 18 nt, Staphylococcus aureus subsp. aureus Mu50
aaaccacgcacaucuaag

SEQ ID NO: 2059364 - RNA, 13 nt, Staphylococcus aureus subsp. aureus Mu50
aaaccaauauuuc

SEQ ID NO: 2059365 - RNA, 14 nt, Staphylococcus aureus subsp. aureus Mu50
aaaccaauuuuaac

SEQ ID NO: 2059366 - RNA, 20 nt, Staphylococcus aureus subsp. aureus Mu50
aaacaucuaaauaguuuuuc

SEQ ID NO: 2059367 - RNA, 15 nt, Staphylococcus aureus subsp. aureus Mu50
aaacaugaacaauca

SEQ ID NO: 2059368 - RNA, 19 nt, Staphylococcus aureus subsp. aureus Mu50
aaacauugcuuaacuuccu

SEQ ID NO: 2059369 - RNA, 20 nt, Staphylococcus aureus subsp. aureus Mu50
aaacauucccuuaauaauaa

SEQ ID NO: 2059370 - RNA, 23 nt, Staphylococcus aureus subsp. aureus Mu50
aaacaugguuuucuuuuuaucau

SEQ ID NO: 2059371 - RNA, 19 nt, Staphylococcus aureus subsp. aureus Mu50
aaacauguacaauuuuuaa

SEQ ID NO: 2059372 - RNA, 22 nt, Staphylococcus aureus subsp. aureus Mu50
aaacauguguaugaucaagcug

SEQ ID NO: 2059373 - RNA, 20 nt, Staphylococcus aureus subsp. aureus Mu50
aaacauggucaaucacuccu

SEQ ID NO: 2059374 - RNA, 18 nt, Staphylococcus aureus subsp. aureus Mu50
aaacauuauuaagugagu

SEQ ID NO: 2059375 - RNA, 16 nt, Staphylococcus aureus subsp. aureus Mu50
aaacauuuauauagau

SEQ ID NO: 2059376 - RNA, 22 nt, Staphylococcus aureus subsp. aureus Mu50
aaacauugcuuaacuuccuuuu

SEQ ID NO: 2059377 - RNA, 13 nt, Staphylococcus aureus subsp. aureus Mu50
aaacaaugcaagu

SEQ ID NO: 2059378 - RNA, 17 nt, Staphylococcus aureus subsp. aureus Mu50
aaacaaucguugaagau

SEQ ID NO: 2059379 - RNA, 16 nt, Staphylococcus aureus subsp. aureus Mu50
aaaauugcuaaaaaaa

SEQ ID NO: 2059380 - RNA, 19 nt, Staphylococcus aureus subsp. aureus Mu50
aaaauugcuaaaaaaauua

SEQ ID NO: 2059381 - RNA, 18 nt, Staphylococcus aureus subsp. aureus Mu50
aaaauugcuauauuagua

SEQ ID NO: 2059382 - RNA, 16 nt, Staphylococcus aureus subsp. aureus Mu50
aaaauuguauagaaug

SEQ ID NO: 2059383 - RNA, 21 nt, Staphylococcus aureus subsp. aureus Mu50
aaaauugguuuggauaaaaug

SEQ ID NO: 2059384 - RNA, 23 nt, Staphylococcus aureus subsp. aureus Mu50
aaaauugguuuggauaaaaugau

SEQ ID NO: 2059385 - RNA, 17 nt, Staphylococcus aureus subsp. aureus Mu50
aaaauuguaagucgaaa

SEQ ID NO: 2059386 - RNA, 13 nt, Staphylococcus aureus subsp. aureus Mu50
aaaauugaacuuu

SEQ ID NO: 2059387 - RNA, 22 nt, Staphylococcus aureus subsp. aureus Mu50
aaacaauuuguaacuauugaaa

SEQ ID NO: 2059388 - RNA, 15 nt, Staphylococcus aureus subsp. aureus Mu50
aaacacaaggaauau

SEQ ID NO: 2059389 - RNA, 19 nt, Staphylococcus aureus subsp. aureus Mu50
aaacacagacguuuuugaa

SEQ ID NO: 2059390 - RNA, 22 nt, Staphylococcus aureus subsp. aureus Mu50
aaacacaguacaaauaacaaac

SEQ ID NO: 2059391 - RNA, 14 nt, Staphylococcus aureus subsp. aureus Mu50
aaacacaguacaaa

SEQ ID NO: 2059392 - RNA, 18 nt, Staphylococcus aureus subsp. aureus Mu50
aaacacucaaaauguuua

SEQ ID NO: 2059393 - RNA, 19 nt, Staphylococcus aureus subsp. aureus Mu50
aaacacccugcuuaucauu

SEQ ID NO: 2059394 - RNA, 18 nt, Staphylococcus aureus subsp. aureus Mu50
aaacacccugcuuaucau

SEQ ID NO: 2059395 - RNA, 15 nt, Staphylococcus aureus subsp. aureus Mu50
aaacauauucauucu

SEQ ID NO: 2059396 - RNA, 13 nt, Staphylococcus aureus subsp. aureus Mu50
aaacauaucuucu

SEQ ID NO: 2059397 - RNA, 18 nt, Staphylococcus aureus subsp. aureus Mu50
aaacauaaauaagcagua

SEQ ID NO: 2059398 - RNA, 14 nt, Staphylococcus aureus subsp. aureus Mu50
aaacauaacaugac

SEQ ID NO: 2059399 - RNA, 17 nt, Staphylococcus aureus subsp. aureus Mu50
aaacauaaugacaucau

SEQ ID NO: 2059400 - RNA, 21 nt, Staphylococcus aureus subsp. aureus Mu50
aaacauaauuaccuuuccauu

SEQ ID NO: 2059401 - RNA, 16 nt, Staphylococcus aureus subsp. aureus Mu50
aaacagcaguaagaua

SEQ ID NO: 2059402 - RNA, 19 nt, Staphylococcus aureus subsp. aureus Mu50
aaacagcaguaagauuauu

SEQ ID NO: 2059403 - RNA, 22 nt, Staphylococcus aureus subsp. aureus Mu50
aaacagaaauugcgaauuguua

SEQ ID NO: 2059404 - RNA, 12 nt, Staphylococcus aureus subsp. aureus Mu50
aaaaagaacaua

SEQ ID NO: 2059405 - RNA, 18 nt, Staphylococcus aureus subsp. aureus Mu50
aaaagcugauuucuauca

SEQ ID NO: 2059406 - RNA, 18 nt, Staphylococcus aureus subsp. aureus Mu50
aaaagcuguaguuucaac

SEQ ID NO: 2059407 - RNA, 14 nt, Staphylococcus aureus subsp. aureus Mu50
aaaaggaaaaacuu

SEQ ID NO: 2059408 - RNA, 20 nt, Staphylococcus aureus subsp. aureus Mu50
aaaaggaaaaacuuuucaug

SEQ ID NO: 2059409 - RNA, 12 nt, Staphylococcus aureus subsp. aureus Mu50
aaaaggaaaaac

SEQ ID NO: 2059410 - RNA, 17 nt, Staphylococcus aureus subsp. aureus Mu50
aaaaacuucuuaacuug

SEQ ID NO: 2059411 - RNA, 21 nt, Staphylococcus aureus subsp. aureus Mu50
aaaaccuuuucaaauuauaac

SEQ ID NO: 2059412 - RNA, 19 nt, Staphylococcus aureus subsp. aureus Mu50
aaaaccuuuucaaauuaua

SEQ ID NO: 2059413 - RNA, 15 nt, Staphylococcus aureus subsp. aureus Mu50
aaaacgauaauaaua

SEQ ID NO: 2059414 - RNA, 13 nt, Staphylococcus aureus subsp. aureus Mu50
aaaacgauaauaa

SEQ ID NO: 2059415 - RNA, 14 nt, Staphylococcus aureus subsp. aureus Mu50
aaaacgagauuaca

SEQ ID NO: 2059416 - RNA, 14 nt, Staphylococcus aureus subsp. aureus Mu50
aaaagcuaaagagu

SEQ ID NO: 2059417 - RNA, 19 nt, Staphylococcus aureus subsp. aureus Mu50
aaaaguuguaauuuaaaau

SEQ ID NO: 2059418 - RNA, 16 nt, Staphylococcus aureus subsp. aureus Mu50
aaaaguuguaauuuaa

SEQ ID NO: 2059419 - RNA, 13 nt, Staphylococcus aureus subsp. aureus Mu50
aaaaguuuaaagu

SEQ ID NO: 2059420 - RNA, 20 nt, Staphylococcus aureus subsp. aureus Mu50
aaaaguuuaagucaguccau

SEQ ID NO: 2059421 - RNA, 19 nt, Staphylococcus aureus subsp. aureus Mu50
aaaaguugaucuacuaaag

SEQ ID NO: 2059422 - RNA, 17 nt, Staphylococcus aureus subsp. aureus Mu50
aaaaguugauuaaaagu

SEQ ID NO: 2059423 - RNA, 23 nt, Staphylococcus aureus subsp. aureus Mu50
aaaauaaaucauacgagaaauua

SEQ ID NO: 2059424 - RNA, 13 nt, Staphylococcus aureus subsp. aureus Mu50
aaaauaaaaaaau

SEQ ID NO: 2059425 - RNA, 19 nt, Staphylococcus aureus subsp. aureus Mu50
aaaauaaccgcuuaauucu

SEQ ID NO: 2059426 - RNA, 21 nt, Staphylococcus aureus subsp. aureus Mu50
aaaaggaugaugugaauguuu

SEQ ID NO: 2059427 - RNA, 19 nt, Staphylococcus aureus subsp. aureus Mu50
aaaaggcgaaacauuaaaa

SEQ ID NO: 2059428 - RNA, 13 nt, Staphylococcus aureus subsp. aureus Mu50
aaaagggcaaaaa

SEQ ID NO: 2059429 - RNA, 16 nt, Staphylococcus aureus subsp. aureus Mu50
aaaagucgauaaauau

SEQ ID NO: 2059430 - RNA, 23 nt, Staphylococcus aureus subsp. aureus Mu50
aaaaggugugggcuuuauuauca

SEQ ID NO: 2059431 - RNA, 22 nt, Staphylococcus aureus subsp. aureus Mu50
aaaaugacuaccuguuggcuuu

SEQ ID NO: 2059432 - RNA, 22 nt, Staphylococcus aureus subsp. aureus Mu50
aaaaugaauauaauaacaauca

SEQ ID NO: 2059433 - RNA, 19 nt, Staphylococcus aureus subsp. aureus Mu50
aaaaugaauguuaagacau

SEQ ID NO: 2059434 - RNA, 18 nt, Staphylococcus aureus subsp. aureus Mu50
aaaaugaauaauugcuaa

SEQ ID NO: 2059435 - RNA, 24 nt, Staphylococcus aureus subsp. aureus Mu50
aaaaugaauaauugcuaaaauauc

SEQ ID NO: 2059436 - RNA, 17 nt, Staphylococcus aureus subsp. aureus Mu50
aaaaugaagaauacaaa

SEQ ID NO: 2059437 - RNA, 13 nt, Staphylococcus aureus subsp. aureus Mu50
aaaaugauaucug

SEQ ID NO: 2059438 - RNA, 14 nt, Staphylococcus aureus subsp. aureus Mu50
aaaaugaguacaac

SEQ ID NO: 2059439 - RNA, 15 nt, Staphylococcus aureus subsp. aureus Mu50
aaaaugaguacaaca

SEQ ID NO: 2059440 - RNA, 17 nt, Staphylococcus aureus subsp. aureus Mu50
aaaaugaguacaacaua

SEQ ID NO: 2059441 - RNA, 15 nt, Staphylococcus aureus subsp. aureus Mu50
aaaaugguuaaaauc

SEQ ID NO: 2059442 - RNA, 23 nt, Staphylococcus aureus subsp. aureus Mu50
aaaauggugauccgccuugauuu

SEQ ID NO: 2059443 - RNA, 15 nt, Staphylococcus aureus subsp. aureus Mu50
aaaauuaaauaauga

SEQ ID NO: 2059444 - RNA, 14 nt, Staphylococcus aureus subsp. aureus Mu50
aaaauuaaaacagc

SEQ ID NO: 2059445 - RNA, 14 nt, Staphylococcus aureus subsp. aureus Mu50
aaaauguuuaacaa

SEQ ID NO: 2059446 - RNA, 15 nt, Staphylococcus aureus subsp. aureus Mu50
aaaaugucauuugaa

SEQ ID NO: 2059447 - RNA, 24 nt, Staphylococcus aureus subsp. aureus Mu50
aaaauguuaggugaaaccauacua

SEQ ID NO: 2059448 - RNA, 15 nt, Staphylococcus aureus subsp. aureus Mu50
aaaauguuacacaaa

SEQ ID NO: 2059449 - RNA, 19 nt, Staphylococcus aureus subsp. aureus Mu50
aaaauguuacacaaauuaa

SEQ ID NO: 2059450 - RNA, 18 nt, Staphylococcus aureus subsp. aureus Mu50
aaaauucuauaauuuuaa

SEQ ID NO: 2059451 - RNA, 15 nt, Staphylococcus aureus subsp. aureus Mu50
aaaauuaacuuaaaa

SEQ ID NO: 2059452 - RNA, 22 nt, Staphylococcus aureus subsp. aureus Mu50
aaaauuacuaacguaaagguga

SEQ ID NO: 2059453 - RNA, 17 nt, Staphylococcus aureus subsp. aureus Mu50
aaaauaucugaaaaacc

SEQ ID NO: 2059454 - RNA, 14 nt, Staphylococcus aureus subsp. aureus Mu50
aaaauaucauuucu

SEQ ID NO: 2059455 - RNA, 17 nt, Staphylococcus aureus subsp. aureus Mu50
aaaauaucuuuuuguuu

SEQ ID NO: 2059456 - RNA, 17 nt, Staphylococcus aureus subsp. aureus Mu50
aaaauaugacacauaca

SEQ ID NO: 2059457 - RNA, 20 nt, Staphylococcus aureus subsp. aureus Mu50
aaaauauguguuaacugaua

SEQ ID NO: 2059458 - RNA, 15 nt, Staphylococcus aureus subsp. aureus Mu50
aaaauaugauuuaaa

SEQ ID NO: 2059459 - RNA, 17 nt, Staphylococcus aureus subsp. aureus Mu50
aaaauaugauuuaaaau

SEQ ID NO: 2059460 - RNA, 14 nt, Staphylococcus aureus subsp. aureus Mu50
aaaauauuuacauu

SEQ ID NO: 2059461 - RNA, 18 nt, Staphylococcus aureus subsp. aureus Mu50
aaaauauuuaaacuagua

SEQ ID NO: 2059462 - RNA, 15 nt, Staphylococcus aureus subsp. aureus Mu50
aaaauacaaauuaca

SEQ ID NO: 2059463 - RNA, 17 nt, Staphylococcus aureus subsp. aureus Mu50
aaaauacauaauuaacu

SEQ ID NO: 2059464 - RNA, 19 nt, Staphylococcus aureus subsp. aureus Mu50
aaaauacauaauuaacuuu

SEQ ID NO: 2059465 - RNA, 13 nt, Staphylococcus aureus subsp. aureus Mu50
aaaauacauaaua

SEQ ID NO: 2059466 - RNA, 18 nt, Staphylococcus aureus subsp. aureus Mu50
aaaauaucaauuuauuau

SEQ ID NO: 2059467 - RNA, 23 nt, Staphylococcus aureus subsp. aureus Mu50
aaaauaucaauuuauuauuaacu

SEQ ID NO: 2059468 - RNA, 21 nt, Staphylococcus aureus subsp. aureus Mu50
aaaaucauccauaaaaauacg

SEQ ID NO: 2059469 - RNA, 21 nt, Staphylococcus aureus subsp. aureus Mu50
aaaaucaucuuaacaacuuua

SEQ ID NO: 2059470 - RNA, 19 nt, Staphylococcus aureus subsp. aureus Mu50
aaaaucauccauaaaaaua

SEQ ID NO: 2059471 - RNA, 14 nt, Staphylococcus aureus subsp. aureus Mu50
aaaaucauaaauaa

SEQ ID NO: 2059472 - RNA, 21 nt, Staphylococcus aureus subsp. aureus Mu50
aaaaucaaagaggcuuuaaaa

SEQ ID NO: 2059473 - RNA, 14 nt, Staphylococcus aureus subsp. aureus Mu50
aaaaucaaagaggc

SEQ ID NO: 2059474 - RNA, 14 nt, Staphylococcus aureus subsp. aureus Mu50
aaagcgccaauaca

SEQ ID NO: 2059475 - RNA, 19 nt, Staphylococcus aureus subsp. aureus Mu50
aaagcaucuucaauauuua

SEQ ID NO: 2059476 - RNA, 14 nt, Staphylococcus aureus subsp. aureus Mu50
aaagcgaauuaucu

SEQ ID NO: 2059477 - RNA, 17 nt, Staphylococcus aureus subsp. aureus Mu50
aaagcgaauuaucuuua

SEQ ID NO: 2059478 - RNA, 14 nt, Staphylococcus aureus subsp. aureus Mu50
aaaggauuauuaac

SEQ ID NO: 2059479 - RNA, 21 nt, Staphylococcus aureus subsp. aureus Mu50
aaaggauuauuaacuuuaaua

SEQ ID NO: 2059480 - RNA, 18 nt, Staphylococcus aureus subsp. aureus Mu50
aaaggaugugacaaauac

SEQ ID NO: 2059481 - RNA, 19 nt, Staphylococcus aureus subsp. aureus Mu50
aaaggauggauacuuaaag

SEQ ID NO: 2059482 - RNA, 21 nt, Staphylococcus aureus subsp. aureus Mu50
aaaggaggagauuguuauuau

SEQ ID NO: 2059483 - RNA, 14 nt, Staphylococcus aureus subsp. aureus Mu50
aaaggacuuaguag

SEQ ID NO: 2059484 - RNA, 16 nt, Staphylococcus aureus subsp. aureus Mu50
aaagcuuauuaaauca

SEQ ID NO: 2059485 - RNA, 16 nt, Staphylococcus aureus subsp. aureus Mu50
aaagcuuuuuugcuuu

SEQ ID NO: 2059486 - RNA, 15 nt, Staphylococcus aureus subsp. aureus Mu50
aaagcuucauauuua

SEQ ID NO: 2059487 - RNA, 17 nt, Staphylococcus aureus subsp. aureus Mu50
aaagcuuuaguuaaaua

SEQ ID NO: 2059488 - RNA, 16 nt, Staphylococcus aureus subsp. aureus Mu50
aaagguaacuuuuuaa

SEQ ID NO: 2059489 - RNA, 13 nt, Staphylococcus aureus subsp. aureus Mu50
aaaguaacauacu

SEQ ID NO: 2059490 - RNA, 23 nt, Staphylococcus aureus subsp. aureus Mu50
aaaggugugggcuuuauuaucau

SEQ ID NO: 2059491 - RNA, 22 nt, Staphylococcus aureus subsp. aureus Mu50
aaagguauaucuucauuuaaaa

SEQ ID NO: 2059492 - RNA, 19 nt, Staphylococcus aureus subsp. aureus Mu50
aaagguauucaaauaaaca

SEQ ID NO: 2059493 - RNA, 21 nt, Staphylococcus aureus subsp. aureus Mu50
aaaggucaaaaaauuaaucaa

SEQ ID NO: 2059494 - RNA, 17 nt, Staphylococcus aureus subsp. aureus Mu50
aaagaauuucgaaaaga

SEQ ID NO: 2059495 - RNA, 20 nt, Staphylococcus aureus subsp. aureus Mu50
aaagaauuucgaaaagaaau

SEQ ID NO: 2059496 - RNA, 21 nt, Staphylococcus aureus subsp. aureus Mu50
aaagaauuucgaaaagaaauu

SEQ ID NO: 2059497 - RNA, 21 nt, Staphylococcus aureus subsp. aureus Mu50
aaagaaccacgcaucauguau

SEQ ID NO: 2059498 - RNA, 22 nt, Staphylococcus aureus subsp. aureus Mu50
aaagaacgucgcgaaaacguug

SEQ ID NO: 2059499 - RNA, 15 nt, Staphylococcus aureus subsp. aureus Mu50
aaagaacuauuuuaa

SEQ ID NO: 2059500 - RNA, 17 nt, Staphylococcus aureus subsp. aureus Mu50
aaagaaaauaucugaaa

SEQ ID NO: 2059501 - RNA, 14 nt, Staphylococcus aureus subsp. aureus Mu50
aaagaaacaugauu

SEQ ID NO: 2059502 - RNA, 16 nt, Staphylococcus aureus subsp. aureus Mu50
aaaccguuauauauua

SEQ ID NO: 2059503 - RNA, 20 nt, Staphylococcus aureus subsp. aureus Mu50
aaaccuaaugcuuuaauaaa

SEQ ID NO: 2059504 - RNA, 12 nt, Staphylococcus aureus subsp. aureus Mu50
aaaccucuaaau

SEQ ID NO: 2059505 - RNA, 12 nt, Staphylococcus aureus subsp. aureus Mu50
aaagauuauuau

SEQ ID NO: 2059506 - RNA, 23 nt, Staphylococcus aureus subsp. aureus Mu50
aaagaugguuuuguuuugcucuu

SEQ ID NO: 2059507 - RNA, 18 nt, Staphylococcus aureus subsp. aureus Mu50
aaagaugucgaaaaguau

SEQ ID NO: 2059508 - RNA, 16 nt, Staphylococcus aureus subsp. aureus Mu50
aaagaucgauacuuuu

SEQ ID NO: 2059509 - RNA, 13 nt, Staphylococcus aureus subsp. aureus Mu50
aaagaccauugua

SEQ ID NO: 2059510 - RNA, 11 nt, Staphylococcus aureus subsp. aureus Mu50
aaagacauuua

SEQ ID NO: 2059511 - RNA, 19 nt, Staphylococcus aureus subsp. aureus Mu50
aaagacauccacagaauua

SEQ ID NO: 2059512 - RNA, 13 nt, Staphylococcus aureus subsp. aureus Mu50
aaagacagcagua

SEQ ID NO: 2059513 - RNA, 12 nt, Staphylococcus aureus subsp. aureus Mu50
aaagacagaaau

SEQ ID NO: 2059514 - RNA, 15 nt, Staphylococcus aureus subsp. aureus Mu50
aaauagauaauauau

SEQ ID NO: 2059515 - RNA, 14 nt, Staphylococcus aureus subsp. aureus Mu50
aaauagauuuagaa

SEQ ID NO: 2059516 - RNA, 19 nt, Staphylococcus aureus subsp. aureus Mu50
aaauagauuuagaaacaau

SEQ ID NO: 2059517 - RNA, 14 nt, Staphylococcus aureus subsp. aureus Mu50
aaauagauugaaaa

SEQ ID NO: 2059518 - RNA, 16 nt, Staphylococcus aureus subsp. aureus Mu50
aaauauaaaauccuaa

SEQ ID NO: 2059519 - RNA, 19 nt, Staphylococcus aureus subsp. aureus Mu50
aaauauaaaauccuaagca

SEQ ID NO: 2059520 - RNA, 23 nt, Staphylococcus aureus subsp. aureus Mu50
aaauaguuuuucauauucacauc

SEQ ID NO: 2059521 - RNA, 20 nt, Staphylococcus aureus subsp. aureus Mu50
aaauaguucuuuaaauuaua

SEQ ID NO: 2059522 - RNA, 19 nt, Staphylococcus aureus subsp. aureus Mu50
aaauauaauagaaauaauc

SEQ ID NO: 2059523 - RNA, 16 nt, Staphylococcus aureus subsp. aureus Mu50
aaauauaaccuaaaaa

SEQ ID NO: 2059524 - RNA, 21 nt, Staphylococcus aureus subsp. aureus Mu50
aaauauacuugccuucaaauu

SEQ ID NO: 2059525 - RNA, 18 nt, Staphylococcus aureus subsp. aureus Mu50
aaauauacuaaauuugaa

SEQ ID NO: 2059526 - RNA, 16 nt, Staphylococcus aureus subsp. aureus Mu50
aaauauaccaaccaaa

SEQ ID NO: 2059527 - RNA, 17 nt, Staphylococcus aureus subsp. aureus Mu50
aaauauaccaaccaaaa

SEQ ID NO: 2059528 - RNA, 18 nt, Staphylococcus aureus subsp. aureus Mu50
aaauauaauguauaaaac

SEQ ID NO: 2059529 - RNA, 23 nt, Staphylococcus aureus subsp. aureus Mu50
aaauauaucuaauacuuucacuu

SEQ ID NO: 2059530 - RNA, 22 nt, Staphylococcus aureus subsp. aureus Mu50
aaauauauaaggcgcucucuuu

SEQ ID NO: 2059531 - RNA, 12 nt, Staphylococcus aureus subsp. aureus Mu50
aaauauauuguc

SEQ ID NO: 2059532 - RNA, 20 nt, Staphylococcus aureus subsp. aureus Mu50
aaauauaucaacguuaauau

SEQ ID NO: 2059533 - RNA, 22 nt, Staphylococcus aureus subsp. aureus Mu50
aaauauauugcacauaaaaaau

SEQ ID NO: 2059534 - RNA, 17 nt, Staphylococcus aureus subsp. aureus Mu50
aaauaucaguaauaaua

SEQ ID NO: 2059535 - RNA, 20 nt, Staphylococcus aureus subsp. aureus Mu50
aaauauccuggaauauuaac

SEQ ID NO: 2059536 - RNA, 19 nt, Staphylococcus aureus subsp. aureus Mu50
aaauaucgacaaauuaaaa

SEQ ID NO: 2059537 - RNA, 20 nt, Staphylococcus aureus subsp. aureus Mu50
aaauaucgagaggguacacu

SEQ ID NO: 2059538 - RNA, 19 nt, Staphylococcus aureus subsp. aureus Mu50
aaauagaaaaauuucaaaa

SEQ ID NO: 2059539 - RNA, 14 nt, Staphylococcus aureus subsp. aureus Mu50
aaauagaaagaaau

SEQ ID NO: 2059540 - RNA, 18 nt, Staphylococcus aureus subsp. aureus Mu50
aaauaccuaccacaauaa

SEQ ID NO: 2059541 - RNA, 19 nt, Staphylococcus aureus subsp. aureus Mu50
aaauacgacaccaacauau

SEQ ID NO: 2059542 - RNA, 16 nt, Staphylococcus aureus subsp. aureus Mu50
aaauacaucggaauuc

SEQ ID NO: 2059543 - RNA, 15 nt, Staphylococcus aureus subsp. aureus Mu50
aaauacaucggaauu

SEQ ID NO: 2059544 - RNA, 17 nt, Staphylococcus aureus subsp. aureus Mu50
aaauacaucaauuucua

SEQ ID NO: 2059545 - RNA, 17 nt, Staphylococcus aureus subsp. aureus Mu50
aaauaccacgacucauu

SEQ ID NO: 2059546 - RNA, 23 nt, Staphylococcus aureus subsp. aureus Mu50
aaauaccacgacucauuagauaa

SEQ ID NO: 2059547 - RNA, 16 nt, Staphylococcus aureus subsp. aureus Mu50
aaauacauaauaaaaa

SEQ ID NO: 2059548 - RNA, 13 nt, Staphylococcus aureus subsp. aureus Mu50
aaauacauaauca

SEQ ID NO: 2059549 - RNA, 16 nt, Staphylococcus aureus subsp. aureus Mu50
aaauacaucaauuucu

SEQ ID NO: 2059550 - RNA, 20 nt, Staphylococcus aureus subsp. aureus Mu50
aaauacaauuucuucauuuu

SEQ ID NO: 2059551 - RNA, 21 nt, Staphylococcus aureus subsp. aureus Mu50
aaauacaaacccuuuaaacau

SEQ ID NO: 2059552 - RNA, 12 nt, Staphylococcus aureus subsp. aureus Mu50
aaauacaaauau

SEQ ID NO: 2059553 - RNA, 19 nt, Staphylococcus aureus subsp. aureus Mu50
aaauacaaagccuuaauau

SEQ ID NO: 2059554 - RNA, 22 nt, Staphylococcus aureus subsp. aureus Mu50
aaauaauuuaaaggcauaauaa

SEQ ID NO: 2059555 - RNA, 18 nt, Staphylococcus aureus subsp. aureus Mu50
aaaguugacaauacaaau

SEQ ID NO: 2059556 - RNA, 15 nt, Staphylococcus aureus subsp. aureus Mu50
aaaguugacaauaca

SEQ ID NO: 2059557 - RNA, 15 nt, Staphylococcus aureus subsp. aureus Mu50
aaaguuucccaagca

SEQ ID NO: 2059558 - RNA, 17 nt, Staphylococcus aureus subsp. aureus Mu50
aaaguuuauuuauguuc

SEQ ID NO: 2059559 - RNA, 20 nt, Staphylococcus aureus subsp. aureus Mu50
aaaguuguauucugaaacuu

SEQ ID NO: 2059560 - RNA, 17 nt, Staphylococcus aureus subsp. aureus Mu50
aaaguuacaugcucuuu

SEQ ID NO: 2059561 - RNA, 20 nt, Staphylococcus aureus subsp. aureus Mu50
aaaguuagacuaaaaaacua

SEQ ID NO: 2059562 - RNA, 17 nt, Staphylococcus aureus subsp. aureus Mu50
aaaguuauaaauuauau

SEQ ID NO: 2059563 - RNA, 18 nt, Staphylococcus aureus subsp. aureus Mu50
aaaguuauaucaucaaca

SEQ ID NO: 2059564 - RNA, 21 nt, Staphylococcus aureus subsp. aureus Mu50
aaaguuaucugcuuuucuauu

SEQ ID NO: 2059565 - RNA, 12 nt, Staphylococcus aureus subsp. aureus Mu50
aaauaaaacaag

SEQ ID NO: 2059566 - RNA, 19 nt, Staphylococcus aureus subsp. aureus Mu50
aaauaaacucaccaaguuc

SEQ ID NO: 2059567 - RNA, 13 nt, Staphylococcus aureus subsp. aureus Mu50
aaauaaaaauaca

SEQ ID NO: 2059568 - RNA, 13 nt, Staphylococcus aureus subsp. aureus Mu50
aaauaaaaaauaa

SEQ ID NO: 2059569 - RNA, 13 nt, Staphylococcus aureus subsp. aureus Mu50
aaauaaaaaaugc

SEQ ID NO: 2059570 - RNA, 11 nt, Staphylococcus aureus subsp. aureus Mu50
aaauaaauaag

SEQ ID NO: 2059571 - RNA, 16 nt, Staphylococcus aureus subsp. aureus Mu50
aaauaaauacaauaga

SEQ ID NO: 2059572 - RNA, 14 nt, Staphylococcus aureus subsp. aureus Mu50
aaauaaauaagcaa

SEQ ID NO: 2059573 - RNA, 17 nt, Staphylococcus aureus subsp. aureus Mu50
aaaguuuuugucuuaau

SEQ ID NO: 2059574 - RNA, 14 nt, Staphylococcus aureus subsp. aureus Mu50
aaaguuuuugucuu

SEQ ID NO: 2059575 - RNA, 15 nt, Staphylococcus aureus subsp. aureus Mu50
aaaguuucuccaccu

SEQ ID NO: 2059576 - RNA, 22 nt, Staphylococcus aureus subsp. aureus Mu50
aaaguuuguauauucuuuuuaa

SEQ ID NO: 2059577 - RNA, 11 nt, Staphylococcus aureus subsp. aureus Mu50
aaaguuuucau

SEQ ID NO: 2059578 - RNA, 16 nt, Staphylococcus aureus subsp. aureus Mu50
aaaguuuguauauucu

SEQ ID NO: 2059579 - RNA, 15 nt, Staphylococcus aureus subsp. aureus Mu50
aaagugguuuuacug

SEQ ID NO: 2059580 - RNA, 15 nt, Staphylococcus aureus subsp. aureus Mu50
aaaguguuucaacau

SEQ ID NO: 2059581 - RNA, 21 nt, Staphylococcus aureus subsp. aureus Mu50
aaagugucuaacgcuguuuca

SEQ ID NO: 2059582 - RNA, 14 nt, Staphylococcus aureus subsp. aureus Mu50
aaagugauuuaaaa

SEQ ID NO: 2059583 - RNA, 16 nt, Staphylococcus aureus subsp. aureus Mu50
aaagugauaauuaaaa

SEQ ID NO: 2059584 - RNA, 22 nt, Staphylococcus aureus subsp. aureus Mu50
aaagugauaauuaaaauaagau

SEQ ID NO: 2059585 - RNA, 13 nt, Staphylococcus aureus subsp. aureus Mu50
aaagugaauauua

SEQ ID NO: 2059586 - RNA, 13 nt, Staphylococcus aureus subsp. aureus Mu50
aaagucuuuaaua

SEQ ID NO: 2059587 - RNA, 14 nt, Staphylococcus aureus subsp. aureus Mu50
aaaguauaugaauc

SEQ ID NO: 2059588 - RNA, 22 nt, Staphylococcus aureus subsp. aureus Mu50
aaagucguuguugaaauuaaau

SEQ ID NO: 2059589 - RNA, 14 nt, Staphylococcus aureus subsp. aureus Mu50
aaagucgucucaau

SEQ ID NO: 2059590 - RNA, 17 nt, Staphylococcus aureus subsp. aureus Mu50
aaagucguuguugaaau

SEQ ID NO: 2059591 - RNA, 14 nt, Staphylococcus aureus subsp. aureus Mu50
aaagucuucaucuu

SEQ ID NO: 2059592 - RNA, 16 nt, Staphylococcus aureus subsp. aureus Mu50
aaaguagaauuauuua

SEQ ID NO: 2059593 - RNA, 22 nt, Staphylococcus aureus subsp. aureus Mu50
aaaguaauaugagugaaaguuu

SEQ ID NO: 2059594 - RNA, 14 nt, Staphylococcus aureus subsp. aureus Mu50
aaaguacuuuaaaa

SEQ ID NO: 2059595 - RNA, 13 nt, Staphylococcus aureus subsp. aureus Mu50
aaaguaauaugag

SEQ ID NO: 2059596 - RNA, 15 nt, Staphylococcus aureus subsp. aureus Mu50
aaaguaaguaaaaua

SEQ ID NO: 2059597 - RNA, 19 nt, Staphylococcus aureus subsp. aureus Mu50
aaauuacuguuaggauaaa

SEQ ID NO: 2059598 - RNA, 16 nt, Staphylococcus aureus subsp. aureus Mu50
aaauuacuugaauauu

SEQ ID NO: 2059599 - RNA, 21 nt, Staphylococcus aureus subsp. aureus Mu50
aaauuagaaccaucauucaua

SEQ ID NO: 2059600 - RNA, 12 nt, Staphylococcus aureus subsp. aureus Mu50
aaauuagaauua

SEQ ID NO: 2059601 - RNA, 17 nt, Staphylococcus aureus subsp. aureus Mu50
aaauuagggugaacagu

SEQ ID NO: 2059602 - RNA, 18 nt, Staphylococcus aureus subsp. aureus Mu50
aaauuagucauccaaaga

SEQ ID NO: 2059603 - RNA, 23 nt, Staphylococcus aureus subsp. aureus Mu50
aaauuagccuaauugagagaagu

SEQ ID NO: 2059604 - RNA, 14 nt, Staphylococcus aureus subsp. aureus Mu50
aaauuagaugaaau

SEQ ID NO: 2059605 - RNA, 23 nt, Staphylococcus aureus subsp. aureus Mu50
aaauuagcaagugaguaacauuu

SEQ ID NO: 2059606 - RNA, 13 nt, Staphylococcus aureus subsp. aureus Mu50
aaauuauuugaua

SEQ ID NO: 2059607 - RNA, 17 nt, Staphylococcus aureus subsp. aureus Mu50
aaauuauuuaauuuuuc

SEQ ID NO: 2059608 - RNA, 19 nt, Staphylococcus aureus subsp. aureus Mu50
aaauuauuuaauuuuucua

SEQ ID NO: 2059609 - RNA, 12 nt, Staphylococcus aureus subsp. aureus Mu50
aaauuauuuaau

SEQ ID NO: 2059610 - RNA, 12 nt, Staphylococcus aureus subsp. aureus Mu50
aaauuauauaaa

SEQ ID NO: 2059611 - RNA, 23 nt, Staphylococcus aureus subsp. aureus Mu50
aaauuagugguuagcuauauuuu

SEQ ID NO: 2059612 - RNA, 14 nt, Staphylococcus aureus subsp. aureus Mu50
aaauuaguuauacu

SEQ ID NO: 2059613 - RNA, 14 nt, Staphylococcus aureus subsp. aureus Mu50
aaauuaguuugaua

SEQ ID NO: 2059614 - RNA, 14 nt, Staphylococcus aureus subsp. aureus Mu50
aaaaagaugaaaaa

SEQ ID NO: 2059615 - RNA, 18 nt, Staphylococcus aureus subsp. aureus Mu50
aaauuaaaaagguacuaa

SEQ ID NO: 2059616 - RNA, 17 nt, Staphylococcus aureus subsp. aureus Mu50
aaauuaaaaaacaauaa

SEQ ID NO: 2059617 - RNA, 15 nt, Staphylococcus aureus subsp. aureus Mu50
aaauuaaaacuuuca

SEQ ID NO: 2059618 - RNA, 19 nt, Staphylococcus aureus subsp. aureus Mu50
aaauuaauaugaacaaaaa

SEQ ID NO: 2059619 - RNA, 21 nt, Staphylococcus aureus subsp. aureus Mu50
aaauuaauaugaacaaaaaau

SEQ ID NO: 2059620 - RNA, 12 nt, Staphylococcus aureus subsp. aureus Mu50
aaauuaauaauu

SEQ ID NO: 2059621 - RNA, 17 nt, Staphylococcus aureus subsp. aureus Mu50
aaauuaauaauuuucca

SEQ ID NO: 2059622 - RNA, 23 nt, Staphylococcus aureus subsp. aureus Mu50
aaaugguuuucuuuuucuauaca

SEQ ID NO: 2059623 - RNA, 19 nt, Staphylococcus aureus subsp. aureus Mu50
aaauggugcgaauaauaau

SEQ ID NO: 2059624 - RNA, 16 nt, Staphylococcus aureus subsp. aureus Mu50
aaauggugaacuaaau

SEQ ID NO: 2059625 - RNA, 12 nt, Staphylococcus aureus subsp. aureus Mu50
aaauguagauua

SEQ ID NO: 2059626 - RNA, 19 nt, Staphylococcus aureus subsp. aureus Mu50
aaaugugcaauuagaauau

SEQ ID NO: 2059627 - RNA, 22 nt, Staphylococcus aureus subsp. aureus Mu50
aaaugugcaauuagaauauaug

SEQ ID NO: 2059628 - RNA, 19 nt, Staphylococcus aureus subsp. aureus Mu50
aaauguuuuauguauuuau

SEQ ID NO: 2059629 - RNA, 20 nt, Staphylococcus aureus subsp. aureus Mu50
aaauguuuaucaauucccug

SEQ ID NO: 2059630 - RNA, 19 nt, Staphylococcus aureus subsp. aureus Mu50
aaaugucaguuuugaagaa

SEQ ID NO: 2059631 - RNA, 14 nt, Staphylococcus aureus subsp. aureus Mu50
aaaugucauuugaa

SEQ ID NO: 2059632 - RNA, 17 nt, Staphylococcus aureus subsp. aureus Mu50
aaaugucguauauguaa

SEQ ID NO: 2059633 - RNA, 23 nt, Staphylococcus aureus subsp. aureus Mu50
aaauggcgaauagcgauuuuaaa

SEQ ID NO: 2059634 - RNA, 12 nt, Staphylococcus aureus subsp. aureus Mu50
aaaugauaagaa

SEQ ID NO: 2059635 - RNA, 20 nt, Staphylococcus aureus subsp. aureus Mu50
aaaugauacauuauuaaaua

SEQ ID NO: 2059636 - RNA, 19 nt, Staphylococcus aureus subsp. aureus Mu50
aaaugcacugagcaacaaa

SEQ ID NO: 2059637 - RNA, 19 nt, Staphylococcus aureus subsp. aureus Mu50
aaaugcagcuguauaacca

SEQ ID NO: 2059638 - RNA, 21 nt, Staphylococcus aureus subsp. aureus Mu50
aaaugcaauuuuucacuuaua

SEQ ID NO: 2059639 - RNA, 19 nt, Staphylococcus aureus subsp. aureus Mu50
aaaugcacgagcaacaucu

SEQ ID NO: 2059640 - RNA, 21 nt, Staphylococcus aureus subsp. aureus Mu50
aaaugcacgagcaacaucuuu

SEQ ID NO: 2059641 - RNA, 14 nt, Staphylococcus aureus subsp. aureus Mu50
aaaugcaauuuuuc

SEQ ID NO: 2059642 - RNA, 22 nt, Staphylococcus aureus subsp. aureus Mu50
aaaugcaauacaccuauuacac

SEQ ID NO: 2059643 - RNA, 15 nt, Staphylococcus aureus subsp. aureus Mu50
aaaucguuaaggaaa

SEQ ID NO: 2059644 - RNA, 23 nt, Staphylococcus aureus subsp. aureus Mu50
aaaucuuuacuuguaauuaauac

SEQ ID NO: 2059645 - RNA, 21 nt, Staphylococcus aureus subsp. aureus Mu50
aaaucuuuaaauguaucacuu

SEQ ID NO: 2059646 - RNA, 21 nt, Staphylococcus aureus subsp. aureus Mu50
aaaucuuguuggauuuuaaca

SEQ ID NO: 2059647 - RNA, 20 nt, Staphylococcus aureus subsp. aureus Mu50
aaaucugcuugugugucauu

SEQ ID NO: 2059648 - RNA, 23 nt, Staphylococcus aureus subsp. aureus Mu50
aaaucuggcacuuaagcuuuaau

SEQ ID NO: 2059649 - RNA, 13 nt, Staphylococcus aureus subsp. aureus Mu50
aaaucuucuauuu

SEQ ID NO: 2059650 - RNA, 16 nt, Staphylococcus aureus subsp. aureus Mu50
aaaucuucuauuuuca

SEQ ID NO: 2059651 - RNA, 18 nt, Staphylococcus aureus subsp. aureus Mu50
aaaugaagguguugaaaa

SEQ ID NO: 2059652 - RNA, 14 nt, Staphylococcus aureus subsp. aureus Mu50
aaaugaauuauuua

SEQ ID NO: 2059653 - RNA, 22 nt, Staphylococcus aureus subsp. aureus Mu50
aaaugaaucgcuuugauuacca

SEQ ID NO: 2059654 - RNA, 19 nt, Staphylococcus aureus subsp. aureus Mu50
aaaugaauugucuuaauau

SEQ ID NO: 2059655 - RNA, 21 nt, Staphylococcus aureus subsp. aureus Mu50
aaaugaauuauuuaaaaugcu

SEQ ID NO: 2059656 - RNA, 15 nt, Staphylococcus aureus subsp. aureus Mu50
aaaugacauuuuaaa

SEQ ID NO: 2059657 - RNA, 24 nt, Staphylococcus aureus subsp. aureus Mu50
aaaugacgugcuuuuaaauguauu

SEQ ID NO: 2059658 - RNA, 21 nt, Staphylococcus aureus subsp. aureus Mu50
aaaugacugaauuaauaucca

SEQ ID NO: 2059659 - RNA, 16 nt, Staphylococcus aureus subsp. aureus Mu50
aaaugagcguuccauu

SEQ ID NO: 2059660 - RNA, 22 nt, Staphylococcus aureus subsp. aureus Mu50
aaaugacgauaccuuuaauaau

SEQ ID NO: 2059661 - RNA, 18 nt, Staphylococcus aureus subsp. aureus Mu50
aaaugacgcucgagcucu

SEQ ID NO: 2059662 - RNA, 15 nt, Staphylococcus aureus subsp. aureus Mu50
aaaugaccuuaauau

SEQ ID NO: 2059663 - RNA, 16 nt, Staphylococcus aureus subsp. aureus Mu50
aaaugaccuuaauaua

SEQ ID NO: 2059664 - RNA, 16 nt, Staphylococcus aureus subsp. aureus Mu50
aaaugacuaccuguug

SEQ ID NO: 2059665 - RNA, 16 nt, Staphylococcus aureus subsp. aureus Mu50
aaauaucuuuuucuaa

SEQ ID NO: 2059666 - RNA, 22 nt, Staphylococcus aureus subsp. aureus Mu50
aaauaugguuucuuauuaaaua

SEQ ID NO: 2059667 - RNA, 17 nt, Staphylococcus aureus subsp. aureus Mu50
aaauauguaaucagguu

SEQ ID NO: 2059668 - RNA, 18 nt, Staphylococcus aureus subsp. aureus Mu50
aaauauuaauauaaaaua

SEQ ID NO: 2059669 - RNA, 15 nt, Staphylococcus aureus subsp. aureus Mu50
aaauauuaaauuauu

SEQ ID NO: 2059670 - RNA, 16 nt, Staphylococcus aureus subsp. aureus Mu50
aaauccacacauuaag

SEQ ID NO: 2059671 - RNA, 15 nt, Staphylococcus aureus subsp. aureus Mu50
aaauccacacauuaa

SEQ ID NO: 2059672 - RNA, 23 nt, Staphylococcus aureus subsp. aureus Mu50
aaaucgaauugguaaaaaucuca

SEQ ID NO: 2059673 - RNA, 15 nt, Staphylococcus aureus subsp. aureus Mu50
aaaucgauaacaguu

SEQ ID NO: 2059674 - RNA, 15 nt, Staphylococcus aureus subsp. aureus Mu50
aaaucggaauaaaau

SEQ ID NO: 2059675 - RNA, 15 nt, Staphylococcus aureus subsp. aureus Mu50
aaaucggauuaacau

SEQ ID NO: 2059676 - RNA, 16 nt, Staphylococcus aureus subsp. aureus Mu50
aaaucggauuaacauu

SEQ ID NO: 2059677 - RNA, 24 nt, Staphylococcus aureus subsp. aureus Mu50
aaauccuuaaauggagauucucgg

SEQ ID NO: 2059678 - RNA, 20 nt, Staphylococcus aureus subsp. aureus Mu50
aaauccguuaaaauuuuaau

SEQ ID NO: 2059679 - RNA, 16 nt, Staphylococcus aureus subsp. aureus Mu50
aaauuguguugaauca

SEQ ID NO: 2059680 - RNA, 15 nt, Staphylococcus aureus subsp. aureus Mu50
aaauuguguuucuuu

SEQ ID NO: 2059681 - RNA, 22 nt, Staphylococcus aureus subsp. aureus Mu50
aaauuguguuucuuuuauuuuc

SEQ ID NO: 2059682 - RNA, 12 nt, Staphylococcus aureus subsp. aureus Mu50
aaauuuaaaaua

SEQ ID NO: 2059683 - RNA, 15 nt, Staphylococcus aureus subsp. aureus Mu50
aaauuuaaaagaaaa

SEQ ID NO: 2059684 - RNA, 16 nt, Staphylococcus aureus subsp. aureus Mu50
aaauuuaaauauugaa

SEQ ID NO: 2059685 - RNA, 17 nt, Staphylococcus aureus subsp. aureus Mu50
aaauuuaagaaugcgaa

SEQ ID NO: 2059686 - RNA, 14 nt, Staphylococcus aureus subsp. aureus Mu50
aaauuuaaaauaau

SEQ ID NO: 2059687 - RNA, 11 nt, Staphylococcus aureus subsp. aureus Mu50
aaauuuaaaua

SEQ ID NO: 2059688 - RNA, 12 nt, Staphylococcus aureus subsp. aureus Mu50
aaauuuauuaua

SEQ ID NO: 2059689 - RNA, 22 nt, Staphylococcus aureus subsp. aureus Mu50
aaauuuauauagucuaugaaua

SEQ ID NO: 2059690 - RNA, 13 nt, Staphylococcus aureus subsp. aureus Mu50
aaauuuauaauac

SEQ ID NO: 2059691 - RNA, 22 nt, Staphylococcus aureus subsp. aureus Mu50
aaauuuauuauaaaauagaagu

SEQ ID NO: 2059692 - RNA, 14 nt, Staphylococcus aureus subsp. aureus Mu50
aaauuuauuauaaa

SEQ ID NO: 2059693 - RNA, 21 nt, Staphylococcus aureus subsp. aureus Mu50
aaauuuacgaaaguagaauua

SEQ ID NO: 2059694 - RNA, 22 nt, Staphylococcus aureus subsp. aureus Mu50
aaauuuacgaaaguagaauuau

SEQ ID NO: 2059695 - RNA, 15 nt, Staphylococcus aureus subsp. aureus Mu50
aaauuucaaaaauag

SEQ ID NO: 2059696 - RNA, 14 nt, Staphylococcus aureus subsp. aureus Mu50
aaauuuauucaaaa

SEQ ID NO: 2059697 - RNA, 17 nt, Staphylococcus aureus subsp. aureus Mu50
aaauuuauuuuuaauuu

SEQ ID NO: 2059698 - RNA, 16 nt, Staphylococcus aureus subsp. aureus Mu50
aaauuucauaaaguuu

SEQ ID NO: 2059699 - RNA, 21 nt, Staphylococcus aureus subsp. aureus Mu50
aaauuucaagguauacacaaa

SEQ ID NO: 2059700 - RNA, 21 nt, Staphylococcus aureus subsp. aureus Mu50
aaauuuccucaccuucauuuu

SEQ ID NO: 2059701 - RNA, 15 nt, Staphylococcus aureus subsp. aureus Mu50
aaauuucgacaucua

SEQ ID NO: 2059702 - RNA, 23 nt, Staphylococcus aureus subsp. aureus Mu50
aaauuucgccucaucuaauuuau

SEQ ID NO: 2059703 - RNA, 19 nt, Staphylococcus aureus subsp. aureus Mu50
aaauuuuaucuaaacauuu

SEQ ID NO: 2059704 - RNA, 18 nt, Staphylococcus aureus subsp. aureus Mu50
aaauuucuguaaccaaaa

SEQ ID NO: 2059705 - RNA, 17 nt, Staphylococcus aureus subsp. aureus Mu50
aaauuugaaauauacca

SEQ ID NO: 2059706 - RNA, 17 nt, Staphylococcus aureus subsp. aureus Mu50
aaauugcuugaaauuau

SEQ ID NO: 2059707 - RNA, 18 nt, Staphylococcus aureus subsp. aureus Mu50
aaauugcuugaaauuauu

SEQ ID NO: 2059708 - RNA, 20 nt, Staphylococcus aureus subsp. aureus Mu50
aaauuggacuuauggguuca

SEQ ID NO: 2059709 - RNA, 15 nt, Staphylococcus aureus subsp. aureus Mu50
aaauugguuuggaua

SEQ ID NO: 2059710 - RNA, 19 nt, Staphylococcus aureus subsp. aureus Mu50
aaauugcuaaaaaaauuaa

SEQ ID NO: 2059711 - RNA, 17 nt, Staphylococcus aureus subsp. aureus Mu50
aaauugccuuucauuuu

SEQ ID NO: 2059712 - RNA, 21 nt, Staphylococcus aureus subsp. aureus Mu50
aaauugcuaaaaaaauuaaaa

SEQ ID NO: 2059713 - RNA, 17 nt, Staphylococcus aureus subsp. aureus Mu50
aaauugcuauauuagua

SEQ ID NO: 2059714 - RNA, 17 nt, Staphylococcus aureus subsp. aureus Mu50
aaauugauuaaauaaau

SEQ ID NO: 2059715 - RNA, 11 nt, Staphylococcus aureus subsp. aureus Mu50
aaauucauuug

SEQ ID NO: 2059716 - RNA, 20 nt, Staphylococcus aureus subsp. aureus Mu50
aaauuccaagagaauuaaua

SEQ ID NO: 2059717 - RNA, 12 nt, Staphylococcus aureus subsp. aureus Mu50
aaauucaucuug

SEQ ID NO: 2059718 - RNA, 16 nt, Staphylococcus aureus subsp. aureus Mu50
aaauugaaauguuuau

SEQ ID NO: 2059719 - RNA, 19 nt, Staphylococcus aureus subsp. aureus Mu50
aaauugaguauauucaaaa

SEQ ID NO: 2059720 - RNA, 14 nt, Staphylococcus aureus subsp. aureus Mu50
aaauugauuaaaua

SEQ ID NO: 2059721 - RNA, 17 nt, Staphylococcus aureus subsp. aureus Mu50
aaauugauauugcaaaa

SEQ ID NO: 2059722 - RNA, 20 nt, Staphylococcus aureus subsp. aureus Mu50
aaauuuuggaccucuugaaa

SEQ ID NO: 2059723 - RNA, 11 nt, Staphylococcus aureus subsp. aureus Mu50
aaauuuuucac

SEQ ID NO: 2059724 - RNA, 14 nt, Staphylococcus aureus subsp. aureus Mu50
aaauuuuucacuuc

SEQ ID NO: 2059725 - RNA, 21 nt, Staphylococcus aureus subsp. aureus Mu50
aaauuuuucacuucaaacaaa

SEQ ID NO: 2059726 - RNA, 23 nt, Staphylococcus aureus subsp. aureus Mu50
aaauuuuucacuucaaacaaagg

SEQ ID NO: 2059727 - RNA, 18 nt, Staphylococcus aureus subsp. aureus Mu50
aacaaaaagguucuccac

SEQ ID NO: 2059728 - RNA, 19 nt, Staphylococcus aureus subsp. aureus Mu50
aacaaaaagguucuccacc

SEQ ID NO: 2059729 - RNA, 19 nt, Staphylococcus aureus subsp. aureus Mu50
aaauuuuuuagugaaaaag

SEQ ID NO: 2059730 - RNA, 20 nt, Staphylococcus aureus subsp. aureus Mu50
aaauuuuuuagugaaaaagu

SEQ ID NO: 2059731 - RNA, 12 nt, Staphylococcus aureus subsp. aureus Mu50
aacaaagaagcu

SEQ ID NO: 2059732 - RNA, 19 nt, Staphylococcus aureus subsp. aureus Mu50
aacaaagucucuaguaucu

SEQ ID NO: 2059733 - RNA, 17 nt, Staphylococcus aureus subsp. aureus Mu50
aacaaagugcaauuauu

SEQ ID NO: 2059734 - RNA, 14 nt, Staphylococcus aureus subsp. aureus Mu50
aacaaacauaaaua

SEQ ID NO: 2059735 - RNA, 18 nt, Staphylococcus aureus subsp. aureus Mu50
aacaaacgcugauuuaau

SEQ ID NO: 2059736 - RNA, 13 nt, Staphylococcus aureus subsp. aureus Mu50
aacaaaauuaaau

SEQ ID NO: 2059737 - RNA, 14 nt, Staphylococcus aureus subsp. aureus Mu50
aacaaaauuaaaua

SEQ ID NO: 2059738 - RNA, 13 nt, Staphylococcus aureus subsp. aureus Mu50
aacaaaauuaaga

SEQ ID NO: 2059739 - RNA, 23 nt, Staphylococcus aureus subsp. aureus Mu50
aacaaaauuaagaagaaauacuu

SEQ ID NO: 2059740 - RNA, 13 nt, Staphylococcus aureus subsp. aureus Mu50
aacaaacauaaau

SEQ ID NO: 2059741 - RNA, 12 nt, Staphylococcus aureus subsp. aureus Mu50
aacaaaagaaag

SEQ ID NO: 2059742 - RNA, 22 nt, Staphylococcus aureus subsp. aureus Mu50
aacaaaacuugagcuauucaua

SEQ ID NO: 2059743 - RNA, 17 nt, Staphylococcus aureus subsp. aureus Mu50
aacaagccuuaaaauau

SEQ ID NO: 2059744 - RNA, 18 nt, Staphylococcus aureus subsp. aureus Mu50
aacaagcuuuuuucaauu

SEQ ID NO: 2059745 - RNA, 18 nt, Staphylococcus aureus subsp. aureus Mu50
aacaagcauuuuucaauu

SEQ ID NO: 2059746 - RNA, 17 nt, Staphylococcus aureus subsp. aureus Mu50
aacaagaaguuuccaac

SEQ ID NO: 2059747 - RNA, 23 nt, Staphylococcus aureus subsp. aureus Mu50
aacaacugcaauagcuauaacuc

SEQ ID NO: 2059748 - RNA, 12 nt, Staphylococcus aureus subsp. aureus Mu50
aacaacuaagau

SEQ ID NO: 2059749 - RNA, 18 nt, Staphylococcus aureus subsp. aureus Mu50
aacaaccugugauaaaaa

SEQ ID NO: 2059750 - RNA, 19 nt, Staphylococcus aureus subsp. aureus Mu50
aacaaauucauauuaacug

SEQ ID NO: 2059751 - RNA, 12 nt, Staphylococcus aureus subsp. aureus Mu50
aacaaauuaaaa

SEQ ID NO: 2059752 - RNA, 15 nt, Staphylococcus aureus subsp. aureus Mu50
aacaaaucuuuuaaa

SEQ ID NO: 2059753 - RNA, 19 nt, Staphylococcus aureus subsp. aureus Mu50
aacaaaugaaaaaguaaaa

SEQ ID NO: 2059754 - RNA, 21 nt, Staphylococcus aureus subsp. aureus Mu50
aacaaauauaauguauaaaac

SEQ ID NO: 2059755 - RNA, 22 nt, Staphylococcus aureus subsp. aureus Mu50
aacaaauauaauguauaaaaca

SEQ ID NO: 2059756 - RNA, 15 nt, Staphylococcus aureus subsp. aureus Mu50
aacaacaaucaaauu

SEQ ID NO: 2059757 - RNA, 15 nt, Staphylococcus aureus subsp. aureus Mu50
aacaacaucacuuua

SEQ ID NO: 2059758 - RNA, 21 nt, Staphylococcus aureus subsp. aureus Mu50
caacuuaaauaucgacaaauu

SEQ ID NO: 2059759 - RNA, 17 nt, Staphylococcus aureus subsp. aureus Mu50
caacugaucauuuucau

SEQ ID NO: 2059760 - RNA, 12 nt, Staphylococcus aureus subsp. aureus Mu50
caacugagaaau

SEQ ID NO: 2059761 - RNA, 13 nt, Staphylococcus aureus subsp. aureus Mu50
caacugagaaauc

SEQ ID NO: 2059762 - RNA, 16 nt, Staphylococcus aureus subsp. aureus Mu50
caacugaaauuuuucc

SEQ ID NO: 2059763 - RNA, 16 nt, Staphylococcus aureus subsp. aureus Mu50
caacuaauaacaaaua

SEQ ID NO: 2059764 - RNA, 22 nt, Staphylococcus aureus subsp. aureus Mu50
caacuaaaggucccauuaaaau

SEQ ID NO: 2059765 - RNA, 12 nt, Staphylococcus aureus subsp. aureus Mu50
caacuaagauau

SEQ ID NO: 2059766 - RNA, 17 nt, Staphylococcus aureus subsp. aureus Mu50
caacgccauauuuauuu

SEQ ID NO: 2059767 - RNA, 14 nt, Staphylococcus aureus subsp. aureus Mu50
caacuaaauuuucu

SEQ ID NO: 2059768 - RNA, 17 nt, Staphylococcus aureus subsp. aureus Mu50
caagaaauguuaaauua

SEQ ID NO: 2059769 - RNA, 19 nt, Staphylococcus aureus subsp. aureus Mu50
caagaaacaauucauuaau

SEQ ID NO: 2059770 - RNA, 12 nt, Staphylococcus aureus subsp. aureus Mu50
caagaaaaaguu

SEQ ID NO: 2059771 - RNA, 20 nt, Staphylococcus aureus subsp. aureus Mu50
caacuuuguuuucaguaacu

SEQ ID NO: 2059772 - RNA, 22 nt, Staphylococcus aureus subsp. aureus Mu50
caacuuuuuaauaauacuucua

SEQ ID NO: 2059773 - RNA, 21 nt, Staphylococcus aureus subsp. aureus Mu50
caacuuuuagaguuuuuauua

SEQ ID NO: 2059774 - RNA, 15 nt, Staphylococcus aureus subsp. aureus Mu50
caacuuuuagaguuu

SEQ ID NO: 2059775 - RNA, 11 nt, Staphylococcus aureus subsp. aureus Mu50
caacuuaauac

SEQ ID NO: 2059776 - RNA, 22 nt, Staphylococcus aureus subsp. aureus Mu50
caacuuaauacgauaauaacua

SEQ ID NO: 2059777 - RNA, 15 nt, Staphylococcus aureus subsp. aureus Mu50
caacuuuacgauaaa

SEQ ID NO: 2059778 - RNA, 18 nt, Staphylococcus aureus subsp. aureus Mu50
caacuuuaagacuuugau

SEQ ID NO: 2059779 - RNA, 16 nt, Staphylococcus aureus subsp. aureus Mu50
caagagguaaaucugu

SEQ ID NO: 2059780 - RNA, 22 nt, Staphylococcus aureus subsp. aureus Mu50
caagagccuuguuggcuuuuuu

SEQ ID NO: 2059781 - RNA, 15 nt, Staphylococcus aureus subsp. aureus Mu50
caagagguuuuauuu

SEQ ID NO: 2059782 - RNA, 13 nt, Staphylococcus aureus subsp. aureus Mu50
caagcaaucuuag

SEQ ID NO: 2059783 - RNA, 18 nt, Staphylococcus aureus subsp. aureus Mu50
caagcuuuucauuuuuau

SEQ ID NO: 2059784 - RNA, 14 nt, Staphylococcus aureus subsp. aureus Mu50
caagcuuuuuucaa

SEQ ID NO: 2059785 - RNA, 20 nt, Staphylococcus aureus subsp. aureus Mu50
caaggaagucaccauauuua

SEQ ID NO: 2059786 - RNA, 13 nt, Staphylococcus aureus subsp. aureus Mu50
caaggaagcauga

SEQ ID NO: 2059787 - RNA, 21 nt, Staphylococcus aureus subsp. aureus Mu50
caagguguucgggaauuuuuu

SEQ ID NO: 2059788 - RNA, 16 nt, Staphylococcus aureus subsp. aureus Mu50
caauaccgaauaauuu

SEQ ID NO: 2059789 - RNA, 17 nt, Staphylococcus aureus subsp. aureus Mu50
caauaccauaauuaaau

SEQ ID NO: 2059790 - RNA, 18 nt, Staphylococcus aureus subsp. aureus Mu50
caauacauuaauauaaau

SEQ ID NO: 2059791 - RNA, 22 nt, Staphylococcus aureus subsp. aureus Mu50
caauagguucauuauuuaaaua

SEQ ID NO: 2059792 - RNA, 15 nt, Staphylococcus aureus subsp. aureus Mu50
caauauaacaucaaa

SEQ ID NO: 2059793 - RNA, 17 nt, Staphylococcus aureus subsp. aureus Mu50
caauagguacaacuaaa

SEQ ID NO: 2059794 - RNA, 19 nt, Staphylococcus aureus subsp. aureus Mu50
caauauuaaucauaaugaa

SEQ ID NO: 2059795 - RNA, 23 nt, Staphylococcus aureus subsp. aureus Mu50
caauauuaaucauaaugaauaau

SEQ ID NO: 2059796 - RNA, 16 nt, Staphylococcus aureus subsp. aureus Mu50
caauaaugugucaaau

SEQ ID NO: 2059797 - RNA, 18 nt, Staphylococcus aureus subsp. aureus Mu50
caauaaugugucaaauag

SEQ ID NO: 2059798 - RNA, 15 nt, Staphylococcus aureus subsp. aureus Mu50
caauaauugaugaaa

SEQ ID NO: 2059799 - RNA, 19 nt, Staphylococcus aureus subsp. aureus Mu50
caauaauccgagucauacu

SEQ ID NO: 2059800 - RNA, 16 nt, Staphylococcus aureus subsp. aureus Mu50
caauaacaccaauuga

SEQ ID NO: 2059801 - RNA, 17 nt, Staphylococcus aureus subsp. aureus Mu50
caauaacaaugcagcug

SEQ ID NO: 2059802 - RNA, 21 nt, Staphylococcus aureus subsp. aureus Mu50
caauaacaggugcuuacuuuu

SEQ ID NO: 2059803 - RNA, 17 nt, Staphylococcus aureus subsp. aureus Mu50
caauaaccccugucacu

SEQ ID NO: 2059804 - RNA, 23 nt, Staphylococcus aureus subsp. aureus Mu50
caaguuggcggggccccaacaca

SEQ ID NO: 2059805 - RNA, 22 nt, Staphylococcus aureus subsp. aureus Mu50
caaguuggggaugggccccaac

SEQ ID NO: 2059806 - RNA, 13 nt, Staphylococcus aureus subsp. aureus Mu50
caaguuuaaaaua

SEQ ID NO: 2059807 - RNA, 19 nt, Staphylococcus aureus subsp. aureus Mu50
caaguugcugaauaaaaua

SEQ ID NO: 2059808 - RNA, 22 nt, Staphylococcus aureus subsp. aureus Mu50
caaguugcugaauaaaauauau

SEQ ID NO: 2059809 - RNA, 15 nt, Staphylococcus aureus subsp. aureus Mu50
caauaaauuuuauau

SEQ ID NO: 2059810 - RNA, 14 nt, Staphylococcus aureus subsp. aureus Mu50
caauaaaucuuucc

SEQ ID NO: 2059811 - RNA, 18 nt, Staphylococcus aureus subsp. aureus Mu50
caauaaauauugauucua

SEQ ID NO: 2059812 - RNA, 13 nt, Staphylococcus aureus subsp. aureus Mu50
caaguaaauguuu

SEQ ID NO: 2059813 - RNA, 21 nt, Staphylococcus aureus subsp. aureus Mu50
caagguuuucgccaauaaaac

SEQ ID NO: 2059814 - RNA, 17 nt, Staphylococcus aureus subsp. aureus Mu50
caaguaaauguuuuaug

SEQ ID NO: 2059815 - RNA, 15 nt, Staphylococcus aureus subsp. aureus Mu50
caaguaaauguuuua

SEQ ID NO: 2059816 - RNA, 18 nt, Staphylococcus aureus subsp. aureus Mu50
caaguaacucaagugauu

SEQ ID NO: 2059817 - RNA, 23 nt, Staphylococcus aureus subsp. aureus Mu50
caaugcauuuaauuuaauuuuag

SEQ ID NO: 2059818 - RNA, 15 nt, Staphylococcus aureus subsp. aureus Mu50
caaugcaauugguag

SEQ ID NO: 2059819 - RNA, 12 nt, Staphylococcus aureus subsp. aureus Mu50
caaucuuuuuaa

SEQ ID NO: 2059820 - RNA, 18 nt, Staphylococcus aureus subsp. aureus Mu50
caaugaauaacaagaaaa

SEQ ID NO: 2059821 - RNA, 20 nt, Staphylococcus aureus subsp. aureus Mu50
caaugaaaacagguggaagu

SEQ ID NO: 2059822 - RNA, 22 nt, Staphylococcus aureus subsp. aureus Mu50
caaugaugggaaaucaguaaua

SEQ ID NO: 2059823 - RNA, 11 nt, Staphylococcus aureus subsp. aureus Mu50
caaugauuaau

SEQ ID NO: 2059824 - RNA, 18 nt, Staphylococcus aureus subsp. aureus Mu50
caaugauuaaaucuucua

SEQ ID NO: 2059825 - RNA, 17 nt, Staphylococcus aureus subsp. aureus Mu50
caaugauaccuuuaaau

SEQ ID NO: 2059826 - RNA, 18 nt, Staphylococcus aureus subsp. aureus Mu50
caauauucuuaucauuca

SEQ ID NO: 2059827 - RNA, 18 nt, Staphylococcus aureus subsp. aureus Mu50
caauauucguaaauccuu

SEQ ID NO: 2059828 - RNA, 16 nt, Staphylococcus aureus subsp. aureus Mu50
caauauucaauaauuc

SEQ ID NO: 2059829 - RNA, 12 nt, Staphylococcus aureus subsp. aureus Mu50
caauauucguaa

SEQ ID NO: 2059830 - RNA, 13 nt, Staphylococcus aureus subsp. aureus Mu50
caacauacaugcc

SEQ ID NO: 2059831 - RNA, 18 nt, Staphylococcus aureus subsp. aureus Mu50
caaccaaaaccaaaugaa

SEQ ID NO: 2059832 - RNA, 13 nt, Staphylococcus aureus subsp. aureus Mu50
caaccaaaaccaa

SEQ ID NO: 2059833 - RNA, 15 nt, Staphylococcus aureus subsp. aureus Mu50
caacauauaaaucau

SEQ ID NO: 2059834 - RNA, 13 nt, Staphylococcus aureus subsp. aureus Mu50
caacauauuuuca

SEQ ID NO: 2059835 - RNA, 15 nt, Staphylococcus aureus subsp. aureus Mu50
caacauuuuuuauag

SEQ ID NO: 2059836 - RNA, 22 nt, Staphylococcus aureus subsp. aureus Mu50
caaccuguucuuuauuuaaagg

SEQ ID NO: 2059837 - RNA, 15 nt, Staphylococcus aureus subsp. aureus Mu50
caacgauguccuuua

SEQ ID NO: 2059838 - RNA, 14 nt, Staphylococcus aureus subsp. aureus Mu50
caacgaugaaacuc

SEQ ID NO: 2059839 - RNA, 14 nt, Staphylococcus aureus subsp. aureus Mu50
caacgauaccaaau

SEQ ID NO: 2059840 - RNA, 22 nt, Staphylococcus aureus subsp. aureus Mu50
caacacugagaauuucuaauua

SEQ ID NO: 2059841 - RNA, 10 nt, Staphylococcus aureus subsp. aureus Mu50
caacacagaa

SEQ ID NO: 2059842 - RNA, 16 nt, Staphylococcus aureus subsp. aureus Mu50
caacacaaagaauuuc

SEQ ID NO: 2059843 - RNA, 16 nt, Staphylococcus aureus subsp. aureus Mu50
caacacagagaaauuc

SEQ ID NO: 2059844 - RNA, 12 nt, Staphylococcus aureus subsp. aureus Mu50
caacaauuuuau

SEQ ID NO: 2059845 - RNA, 12 nt, Staphylococcus aureus subsp. aureus Mu50
caacacaaagaa

SEQ ID NO: 2059846 - RNA, 13 nt, Staphylococcus aureus subsp. aureus Mu50
caacacaaagaau

SEQ ID NO: 2059847 - RNA, 15 nt, Staphylococcus aureus subsp. aureus Mu50
caacaauaaaucuuu

SEQ ID NO: 2059848 - RNA, 13 nt, Staphylococcus aureus subsp. aureus Mu50
caacaaaaagaau

SEQ ID NO: 2059849 - RNA, 12 nt, Staphylococcus aureus subsp. aureus Mu50
caacaaaaagaa

SEQ ID NO: 2059850 - RNA, 15 nt, Staphylococcus aureus subsp. aureus Mu50
caaauuuuuuguaaa

SEQ ID NO: 2059851 - RNA, 22 nt, Staphylococcus aureus subsp. aureus Mu50
caaauuuugaguauuugccuuu

SEQ ID NO: 2059852 - RNA, 14 nt, Staphylococcus aureus subsp. aureus Mu50
caaauuuugaguau

SEQ ID NO: 2059853 - RNA, 13 nt, Staphylococcus aureus subsp. aureus Mu50
caaauuuuauacu

SEQ ID NO: 2059854 - RNA, 18 nt, Staphylococcus aureus subsp. aureus Mu50
caaauugaccgacaaaac

SEQ ID NO: 2059855 - RNA, 19 nt, Staphylococcus aureus subsp. aureus Mu50
caaauugcaaaguaacaau

SEQ ID NO: 2059856 - RNA, 13 nt, Staphylococcus aureus subsp. aureus Mu50
caaauugcaaugg

SEQ ID NO: 2059857 - RNA, 16 nt, Staphylococcus aureus subsp. aureus Mu50
caaauugccuuucauu

SEQ ID NO: 2059858 - RNA, 14 nt, Staphylococcus aureus subsp. aureus Mu50
caaauuaguaugac

SEQ ID NO: 2059859 - RNA, 21 nt, Staphylococcus aureus subsp. aureus Mu50
caaauuagucauccaaagaaa

SEQ ID NO: 2059860 - RNA, 15 nt, Staphylococcus aureus subsp. aureus Mu50
caaauuaucauuaaa

SEQ ID NO: 2059861 - RNA, 12 nt, Staphylococcus aureus subsp. aureus Mu50
caaauuaucugu

SEQ ID NO: 2059862 - RNA, 18 nt, Staphylococcus aureus subsp. aureus Mu50
caaaugcuuaauaaaauc

SEQ ID NO: 2059863 - RNA, 10 nt, Staphylococcus aureus subsp. aureus Mu50
caaaugcuua

SEQ ID NO: 2059864 - RNA, 18 nt, Staphylococcus aureus subsp. aureus Mu50
caaauuaauuaaaccaau

SEQ ID NO: 2059865 - RNA, 16 nt, Staphylococcus aureus subsp. aureus Mu50
caaauuacaaauuauc

SEQ ID NO: 2059866 - RNA, 14 nt, Staphylococcus aureus subsp. aureus Mu50
caaauagagaaaua

SEQ ID NO: 2059867 - RNA, 16 nt, Staphylococcus aureus subsp. aureus Mu50
caaagauauguuuaua

SEQ ID NO: 2059868 - RNA, 16 nt, Staphylococcus aureus subsp. aureus Mu50
caaagcuugauuuaac

SEQ ID NO: 2059869 - RNA, 18 nt, Staphylococcus aureus subsp. aureus Mu50
caaagcuauauaugaauu

SEQ ID NO: 2059870 - RNA, 17 nt, Staphylococcus aureus subsp. aureus Mu50
caaagaggcuuuaaaau

SEQ ID NO: 2059871 - RNA, 18 nt, Staphylococcus aureus subsp. aureus Mu50
caaagaggcuuuaaaauu

SEQ ID NO: 2059872 - RNA, 13 nt, Staphylococcus aureus subsp. aureus Mu50
caaacuauuaaug

SEQ ID NO: 2059873 - RNA, 18 nt, Staphylococcus aureus subsp. aureus Mu50
caaacugccuaauacacu

SEQ ID NO: 2059874 - RNA, 19 nt, Staphylococcus aureus subsp. aureus Mu50
caaauaaugugaaaaaucu

SEQ ID NO: 2059875 - RNA, 20 nt, Staphylococcus aureus subsp. aureus Mu50
caaauaauuuacauuaauuu

SEQ ID NO: 2059876 - RNA, 16 nt, Staphylococcus aureus subsp. aureus Mu50
caaauacauaaucauu

SEQ ID NO: 2059877 - RNA, 15 nt, Staphylococcus aureus subsp. aureus Mu50
caaauacaucaauuu

SEQ ID NO: 2059878 - RNA, 19 nt, Staphylococcus aureus subsp. aureus Mu50
caaauacgaguguuuuaau

SEQ ID NO: 2059879 - RNA, 18 nt, Staphylococcus aureus subsp. aureus Mu50
caaauaaaucaaacuuuu

SEQ ID NO: 2059880 - RNA, 19 nt, Staphylococcus aureus subsp. aureus Mu50
caaauaaaugacauuuaau

SEQ ID NO: 2059881 - RNA, 18 nt, Staphylococcus aureus subsp. aureus Mu50
caaauaaauuaaauuuug

SEQ ID NO: 2059882 - RNA, 18 nt, Staphylococcus aureus subsp. aureus Mu50
caaauaaugaugcauaag

SEQ ID NO: 2059883 - RNA, 13 nt, Staphylococcus aureus subsp. aureus Mu50
caaauaauauaaa

SEQ ID NO: 2059884 - RNA, 12 nt, Staphylococcus aureus subsp. aureus Mu50
caaauaaaaaag

SEQ ID NO: 2059885 - RNA, 19 nt, Staphylococcus aureus subsp. aureus Mu50
caaauaaacacaucuaugu

SEQ ID NO: 2059886 - RNA, 12 nt, Staphylococcus aureus subsp. aureus Mu50
caaaguuuucau

SEQ ID NO: 2059887 - RNA, 19 nt, Staphylococcus aureus subsp. aureus Mu50
caaaguuuauacuuaauau

SEQ ID NO: 2059888 - RNA, 17 nt, Staphylococcus aureus subsp. aureus Mu50
caaagguugcugcagcu

SEQ ID NO: 2059889 - RNA, 19 nt, Staphylococcus aureus subsp. aureus Mu50
caaaguaacaugugcaagu

SEQ ID NO: 2059890 - RNA, 19 nt, Staphylococcus aureus subsp. aureus Mu50
caaaaguuauauaaauuug

SEQ ID NO: 2059891 - RNA, 20 nt, Staphylococcus aureus subsp. aureus Mu50
caaaaguuauauaaauuugu

SEQ ID NO: 2059892 - RNA, 17 nt, Staphylococcus aureus subsp. aureus Mu50
caaaaccgcuauaaaau

SEQ ID NO: 2059893 - RNA, 20 nt, Staphylococcus aureus subsp. aureus Mu50
caaaaccgcuauaaaauuuu

SEQ ID NO: 2059894 - RNA, 22 nt, Staphylococcus aureus subsp. aureus Mu50
caaaaccgcuauaaaauuuuga

SEQ ID NO: 2059895 - RNA, 13 nt, Staphylococcus aureus subsp. aureus Mu50
caaaaugaacaau

SEQ ID NO: 2059896 - RNA, 24 nt, Staphylococcus aureus subsp. aureus Mu50
caaacacaguacaaauaacaaaca

SEQ ID NO: 2059897 - RNA, 17 nt, Staphylococcus aureus subsp. aureus Mu50
caaaauuugaaauauac

SEQ ID NO: 2059898 - RNA, 17 nt, Staphylococcus aureus subsp. aureus Mu50
caaaauugaacuuugua

SEQ ID NO: 2059899 - RNA, 16 nt, Staphylococcus aureus subsp. aureus Mu50
caaaaugguuaaaauc

SEQ ID NO: 2059900 - RNA, 13 nt, Staphylococcus aureus subsp. aureus Mu50
cacggucccaaga

SEQ ID NO: 2059901 - RNA, 14 nt, Staphylococcus aureus subsp. aureus Mu50
aaaauauaugaaua

SEQ ID NO: 2059902 - RNA, 20 nt, Staphylococcus aureus subsp. aureus Mu50
aaaauaucaaaauauaaaau

SEQ ID NO: 2059903 - RNA, 15 nt, Staphylococcus aureus subsp. aureus Mu50
aaaauauagcuauua

SEQ ID NO: 2059904 - RNA, 21 nt, Staphylococcus aureus subsp. aureus Mu50
aaaauauagcuauuacuauaa

SEQ ID NO: 2059905 - RNA, 14 nt, Staphylococcus aureus subsp. aureus Mu50
cacgcugaaauuuu

SEQ ID NO: 2059906 - RNA, 19 nt, Staphylococcus aureus subsp. aureus Mu50
aaaauacucccuucaacau

SEQ ID NO: 2059907 - RNA, 17 nt, Staphylococcus aureus subsp. aureus Mu50
cacgaauaccaagacca

SEQ ID NO: 2059908 - RNA, 16 nt, Staphylococcus aureus subsp. aureus Mu50
caccuuuaucuguaac

SEQ ID NO: 2059909 - RNA, 16 nt, Staphylococcus aureus subsp. aureus Mu50
caccuuuacaacauac

SEQ ID NO: 2059910 - RNA, 13 nt, Staphylococcus aureus subsp. aureus Mu50
caccuuuaucugu

SEQ ID NO: 2059911 - RNA, 21 nt, Staphylococcus aureus subsp. aureus Mu50
cacgcccgacaucauaaauga

SEQ ID NO: 2059912 - RNA, 18 nt, Staphylococcus aureus subsp. aureus Mu50
cacgauaucuagcugcuu

SEQ ID NO: 2059913 - RNA, 20 nt, Staphylococcus aureus subsp. aureus Mu50
cacgauaucuagcugcuucu

SEQ ID NO: 2059914 - RNA, 21 nt, Staphylococcus aureus subsp. aureus Mu50
cacgauaucuagcugcuucug

SEQ ID NO: 2059915 - RNA, 17 nt, Staphylococcus aureus subsp. aureus Mu50
cacgauaucuagcugcu

SEQ ID NO: 2059916 - RNA, 19 nt, Staphylococcus aureus subsp. aureus Mu50
aaaauaacugcuaauuuuu

SEQ ID NO: 2059917 - RNA, 20 nt, Staphylococcus aureus subsp. aureus Mu50
caccugcaauuuguaauaca

SEQ ID NO: 2059918 - RNA, 19 nt, Staphylococcus aureus subsp. aureus Mu50
caccucuaaguucaccuaa

SEQ ID NO: 2059919 - RNA, 17 nt, Staphylococcus aureus subsp. aureus Mu50
caccucuaaguucaccu

SEQ ID NO: 2059920 - RNA, 18 nt, Staphylococcus aureus subsp. aureus Mu50
caccucuaaguucaccua

SEQ ID NO: 2059921 - RNA, 19 nt, Staphylococcus aureus subsp. aureus Mu50
caccauuuacuucauaagu

SEQ ID NO: 2059922 - RNA, 18 nt, Staphylococcus aureus subsp. aureus Mu50
caccauuuacuucauaag

SEQ ID NO: 2059923 - RNA, 18 nt, Staphylococcus aureus subsp. aureus Mu50
aaaaguuauaucaucaac

SEQ ID NO: 2059924 - RNA, 18 nt, Staphylococcus aureus subsp. aureus Mu50
aaaaguuaucugcuuuuc

SEQ ID NO: 2059925 - RNA, 12 nt, Staphylococcus aureus subsp. aureus Mu50
caccagccucug

SEQ ID NO: 2059926 - RNA, 17 nt, Staphylococcus aureus subsp. aureus Mu50
aaaaguuguaauuuaaa

SEQ ID NO: 2059927 - RNA, 18 nt, Staphylococcus aureus subsp. aureus Mu50
aaaaguuguaauuuaaaa

SEQ ID NO: 2059928 - RNA, 21 nt, Staphylococcus aureus subsp. aureus Mu50
aaaaguugauuaaaaguguug

SEQ ID NO: 2059929 - RNA, 13 nt, Staphylococcus aureus subsp. aureus Mu50
aaaaguuucggaa

SEQ ID NO: 2059930 - RNA, 15 nt, Staphylococcus aureus subsp. aureus Mu50
aaaauaaaaaaccaa

SEQ ID NO: 2059931 - RNA, 12 nt, Staphylococcus aureus subsp. aureus Mu50
caccaguuucaa

SEQ ID NO: 2059932 - RNA, 14 nt, Staphylococcus aureus subsp. aureus Mu50
caccaguuucaagu

SEQ ID NO: 2059933 - RNA, 16 nt, Staphylococcus aureus subsp. aureus Mu50
caccauacuaaaacau

SEQ ID NO: 2059934 - RNA, 17 nt, Staphylococcus aureus subsp. aureus Mu50
caccauacuaaaacaug

SEQ ID NO: 2059935 - RNA, 12 nt, Staphylococcus aureus subsp. aureus Mu50
caccauaugugg

SEQ ID NO: 2059936 - RNA, 15 nt, Staphylococcus aureus subsp. aureus Mu50
caccaucccauuaaa

SEQ ID NO: 2059937 - RNA, 21 nt, Staphylococcus aureus subsp. aureus Mu50
caccauguacauugguuuuua

SEQ ID NO: 2059938 - RNA, 18 nt, Staphylococcus aureus subsp. aureus Mu50
caccacuuucaguaauug

SEQ ID NO: 2059939 - RNA, 21 nt, Staphylococcus aureus subsp. aureus Mu50
caccaaugauagugaauaaug

SEQ ID NO: 2059940 - RNA, 12 nt, Staphylococcus aureus subsp. aureus Mu50
cacaugugaaau

SEQ ID NO: 2059941 - RNA, 21 nt, Staphylococcus aureus subsp. aureus Mu50
cacauguacguuuuuuuaaau

SEQ ID NO: 2059942 - RNA, 19 nt, Staphylococcus aureus subsp. aureus Mu50
caccaaguucacuaaauuc

SEQ ID NO: 2059943 - RNA, 18 nt, Staphylococcus aureus subsp. aureus Mu50
cacauuguuuacaaaguu

SEQ ID NO: 2059944 - RNA, 13 nt, Staphylococcus aureus subsp. aureus Mu50
cacaugaauuuua

SEQ ID NO: 2059945 - RNA, 17 nt, Staphylococcus aureus subsp. aureus Mu50
cacaugaggaucaacug

SEQ ID NO: 2059946 - RNA, 13 nt, Staphylococcus aureus subsp. aureus Mu50
cacaucuaugugg

SEQ ID NO: 2059947 - RNA, 22 nt, Staphylococcus aureus subsp. aureus Mu50
caauugaaugaaguaauauaua

SEQ ID NO: 2059948 - RNA, 18 nt, Staphylococcus aureus subsp. aureus Mu50
caauugaaucaaauacau

SEQ ID NO: 2059949 - RNA, 12 nt, Staphylococcus aureus subsp. aureus Mu50
caauucaaugua

SEQ ID NO: 2059950 - RNA, 23 nt, Staphylococcus aureus subsp. aureus Mu50
caauucaauguaucaccuaauug

SEQ ID NO: 2059951 - RNA, 22 nt, Staphylococcus aureus subsp. aureus Mu50
caauuagccccaguauagaagc

SEQ ID NO: 2059952 - RNA, 19 nt, Staphylococcus aureus subsp. aureus Mu50
caauuagaaaauuucucac

SEQ ID NO: 2059953 - RNA, 17 nt, Staphylococcus aureus subsp. aureus Mu50
caauuauaaaugauuaa

SEQ ID NO: 2059954 - RNA, 12 nt, Staphylococcus aureus subsp. aureus Mu50
caauuaguucug

SEQ ID NO: 2059955 - RNA, 16 nt, Staphylococcus aureus subsp. aureus Mu50
caauuauuuuucaaau

SEQ ID NO: 2059956 - RNA, 19 nt, Staphylococcus aureus subsp. aureus Mu50
caauuauugaaaacaaaaa

SEQ ID NO: 2059957 - RNA, 24 nt, Staphylococcus aureus subsp. aureus Mu50
caauuacucuuuuucuuucauaau

SEQ ID NO: 2059958 - RNA, 16 nt, Staphylococcus aureus subsp. aureus Mu50
caauuacucuuuuucu

SEQ ID NO: 2059959 - RNA, 14 nt, Staphylococcus aureus subsp. aureus Mu50
caauuaauuguaaa

SEQ ID NO: 2059960 - RNA, 19 nt, Staphylococcus aureus subsp. aureus Mu50
caauuaaccuugauuuaau

SEQ ID NO: 2059961 - RNA, 22 nt, Staphylococcus aureus subsp. aureus Mu50
caauuaaucggaucauuauuua

SEQ ID NO: 2059962 - RNA, 13 nt, Staphylococcus aureus subsp. aureus Mu50
caauuaauaaaca

SEQ ID NO: 2059963 - RNA, 23 nt, Staphylococcus aureus subsp. aureus Mu50
caauguuuaauuuucuaaauaua

SEQ ID NO: 2059964 - RNA, 13 nt, Staphylococcus aureus subsp. aureus Mu50
caauuaaauguuu

SEQ ID NO: 2059965 - RNA, 15 nt, Staphylococcus aureus subsp. aureus Mu50
caauuaaagugaaua

SEQ ID NO: 2059966 - RNA, 19 nt, Staphylococcus aureus subsp. aureus Mu50
caauuaaaacuauaauaaa

SEQ ID NO: 2059967 - RNA, 13 nt, Staphylococcus aureus subsp. aureus Mu50
caauuaaaaguac

SEQ ID NO: 2059968 - RNA, 16 nt, Staphylococcus aureus subsp. aureus Mu50
caauguuuaauuuucu

SEQ ID NO: 2059969 - RNA, 15 nt, Staphylococcus aureus subsp. aureus Mu50
caauuuuuaaaaacc

SEQ ID NO: 2059970 - RNA, 16 nt, Staphylococcus aureus subsp. aureus Mu50
caauuuuuaaaaaccu

SEQ ID NO: 2059971 - RNA, 23 nt, Staphylococcus aureus subsp. aureus Mu50
caauuuuuaaaaaccuagggaua

SEQ ID NO: 2059972 - RNA, 14 nt, Staphylococcus aureus subsp. aureus Mu50
caauuuuuaacaaa

SEQ ID NO: 2059973 - RNA, 23 nt, Staphylococcus aureus subsp. aureus Mu50
caauuuuaccuucgcauacuuuu

SEQ ID NO: 2059974 - RNA, 21 nt, Staphylococcus aureus subsp. aureus Mu50
caauuuuaucugaaucugcua

SEQ ID NO: 2059975 - RNA, 19 nt, Staphylococcus aureus subsp. aureus Mu50
caauuuaguauaaauaaaa

SEQ ID NO: 2059976 - RNA, 19 nt, Staphylococcus aureus subsp. aureus Mu50
caauuuaaauaaguuacuc

SEQ ID NO: 2059977 - RNA, 16 nt, Staphylococcus aureus subsp. aureus Mu50
caauuguuacuuuaac

SEQ ID NO: 2059978 - RNA, 12 nt, Staphylococcus aureus subsp. aureus Mu50
caauuuaaauaa

SEQ ID NO: 2059979 - RNA, 21 nt, Staphylococcus aureus subsp. aureus Mu50
cacaaagaauuucgaaaagaa

SEQ ID NO: 2059980 - RNA, 21 nt, Staphylococcus aureus subsp. aureus Mu50
caauuuuuucaugauuuacua

SEQ ID NO: 2059981 - RNA, 19 nt, Staphylococcus aureus subsp. aureus Mu50
cacaguggauuacagauga

SEQ ID NO: 2059982 - RNA, 23 nt, Staphylococcus aureus subsp. aureus Mu50
cacagacuuuuuacuaacugaau

SEQ ID NO: 2059983 - RNA, 21 nt, Staphylococcus aureus subsp. aureus Mu50
cacagagaauuucgaaaagaa

SEQ ID NO: 2059984 - RNA, 21 nt, Staphylococcus aureus subsp. aureus Mu50
cacaacaaucacgauuaaugu

SEQ ID NO: 2059985 - RNA, 12 nt, Staphylococcus aureus subsp. aureus Mu50
cacaaaugaaug

SEQ ID NO: 2059986 - RNA, 11 nt, Staphylococcus aureus subsp. aureus Mu50
cacaccccaac

SEQ ID NO: 2059987 - RNA, 14 nt, Staphylococcus aureus subsp. aureus Mu50
cacacccauacucu

SEQ ID NO: 2059988 - RNA, 12 nt, Staphylococcus aureus subsp. aureus Mu50
cacacuaaaugu

SEQ ID NO: 2059989 - RNA, 18 nt, Staphylococcus aureus subsp. aureus Mu50
cacacuaaauguucugga

SEQ ID NO: 2059990 - RNA, 16 nt, Staphylococcus aureus subsp. aureus Mu50
auuucuaugaaaaaaa

SEQ ID NO: 2059991 - RNA, 14 nt, Staphylococcus aureus subsp. aureus Mu50
auuucuaucaaaua

SEQ ID NO: 2059992 - RNA, 15 nt, Staphylococcus aureus subsp. aureus Mu50
auuucuauaucuauu

SEQ ID NO: 2059993 - RNA, 20 nt, Staphylococcus aureus subsp. aureus Mu50
auuucuauaucuauuuauca

SEQ ID NO: 2059994 - RNA, 16 nt, Staphylococcus aureus subsp. aureus Mu50
auuucuaucaaauaau

SEQ ID NO: 2059995 - RNA, 23 nt, Staphylococcus aureus subsp. aureus Mu50
auuucuauaucuauuuaucauac

SEQ ID NO: 2059996 - RNA, 15 nt, Staphylococcus aureus subsp. aureus Mu50
auuucuaucaaauaa

SEQ ID NO: 2059997 - RNA, 17 nt, Staphylococcus aureus subsp. aureus Mu50
auuucuaauacauacug

SEQ ID NO: 2059998 - RNA, 17 nt, Staphylococcus aureus subsp. aureus Mu50
auuucgaaaagaaauuc

SEQ ID NO: 2059999 - RNA, 18 nt, Staphylococcus aureus subsp. aureus Mu50
auuucgaaaagaaauucu

SEQ ID NO: 2060000 - RNA, 14 nt, Staphylococcus aureus subsp. aureus Mu50
auuucgaaaagaaa

SEQ ID NO: 2060001 - RNA, 16 nt, Staphylococcus aureus subsp. aureus Mu50
auuucgaaaagaaauu

SEQ ID NO: 2060002 - RNA, 22 nt, Staphylococcus aureus subsp. aureus Mu50
auuucgaccgcguauuccauug

SEQ ID NO: 2060003 - RNA, 20 nt, Staphylococcus aureus subsp. aureus Mu50
auuucgauaccuaaaauacc

SEQ ID NO: 2060004 - RNA, 18 nt, Staphylococcus aureus subsp. aureus Mu50
auuuccuuuagcaaaaau

SEQ ID NO: 2060005 - RNA, 21 nt, Staphylococcus aureus subsp. aureus Mu50
auuuccucgguuuuauuuuua

SEQ ID NO: 2060006 - RNA, 21 nt, Staphylococcus aureus subsp. aureus Mu50
auuuccucaccuucauuuuca

SEQ ID NO: 2060007 - RNA, 21 nt, Staphylococcus aureus subsp. aureus Mu50
auuuccuauuaggauccaauu

SEQ ID NO: 2060008 - RNA, 13 nt, Staphylococcus aureus subsp. aureus Mu50
auuucaucaauaa

SEQ ID NO: 2060009 - RNA, 17 nt, Staphylococcus aureus subsp. aureus Mu50
auuucauaguguuugua

SEQ ID NO: 2060010 - RNA, 15 nt, Staphylococcus aureus subsp. aureus Mu50
auuucaugauguuaa

SEQ ID NO: 2060011 - RNA, 18 nt, Staphylococcus aureus subsp. aureus Mu50
auuucacuugaccacuuu

SEQ ID NO: 2060012 - RNA, 16 nt, Staphylococcus aureus subsp. aureus Mu50
auuucacuuuaacuuc

SEQ ID NO: 2060013 - RNA, 13 nt, Staphylococcus aureus subsp. aureus Mu50
auuucacuuuaac

SEQ ID NO: 2060014 - RNA, 14 nt, Staphylococcus aureus subsp. aureus Mu50
auuucacuuuaacu

SEQ ID NO: 2060015 - RNA, 15 nt, Staphylococcus aureus subsp. aureus Mu50
auuucacuuuaacuu

SEQ ID NO: 2060016 - RNA, 20 nt, Staphylococcus aureus subsp. aureus Mu50
auuucaaccuuuuaauagua

SEQ ID NO: 2060017 - RNA, 20 nt, Staphylococcus aureus subsp. aureus Mu50
auuucaacuuuuuaauaaua

SEQ ID NO: 2060018 - RNA, 16 nt, Staphylococcus aureus subsp. aureus Mu50
auuucacucuacaauc

SEQ ID NO: 2060019 - RNA, 18 nt, Staphylococcus aureus subsp. aureus Mu50
auuuaggcaugucaaauc

SEQ ID NO: 2060020 - RNA, 14 nt, Staphylococcus aureus subsp. aureus Mu50
auuuaguauaaaua

SEQ ID NO: 2060021 - RNA, 15 nt, Staphylococcus aureus subsp. aureus Mu50
auuuaguauaaauaa

SEQ ID NO: 2060022 - RNA, 18 nt, Staphylococcus aureus subsp. aureus Mu50
auuuaguacucaauguua

SEQ ID NO: 2060023 - RNA, 20 nt, Staphylococcus aureus subsp. aureus Mu50
auuuaguuuuuuuaaaguuu

SEQ ID NO: 2060024 - RNA, 13 nt, Staphylococcus aureus subsp. aureus Mu50
auuuaguuuuuuu

SEQ ID NO: 2060025 - RNA, 16 nt, Staphylococcus aureus subsp. aureus Mu50
auuuaguuuuuuuaaa

SEQ ID NO: 2060026 - RNA, 17 nt, Staphylococcus aureus subsp. aureus Mu50
auuuaguuagcccuauu

SEQ ID NO: 2060027 - RNA, 16 nt, Staphylococcus aureus subsp. aureus Mu50
auuuaguuaaguauuu

SEQ ID NO: 2060028 - RNA, 22 nt, Staphylococcus aureus subsp. aureus Mu50
auuuaguauaaauaaaaauaca

SEQ ID NO: 2060029 - RNA, 19 nt, Staphylococcus aureus subsp. aureus Mu50
auuugcacaaagauauguu

SEQ ID NO: 2060030 - RNA, 21 nt, Staphylococcus aureus subsp. aureus Mu50
auuugauuuggguaauguuuu

SEQ ID NO: 2060031 - RNA, 15 nt, Staphylococcus aureus subsp. aureus Mu50
auuugcaaaaucaac

SEQ ID NO: 2060032 - RNA, 21 nt, Staphylococcus aureus subsp. aureus Mu50
auuugcaaaaucaacccauca

SEQ ID NO: 2060033 - RNA, 16 nt, Staphylococcus aureus subsp. aureus Mu50
auuugauuauucuuca

SEQ ID NO: 2060034 - RNA, 19 nt, Staphylococcus aureus subsp. aureus Mu50
auuugauucauuacauguu

SEQ ID NO: 2060035 - RNA, 21 nt, Staphylococcus aureus subsp. aureus Mu50
auuucuuuaagugacacacca

SEQ ID NO: 2060036 - RNA, 13 nt, Staphylococcus aureus subsp. aureus Mu50
auuucuuuucauu

SEQ ID NO: 2060037 - RNA, 21 nt, Staphylococcus aureus subsp. aureus Mu50
auuucuuuucauuaucauuaa

SEQ ID NO: 2060038 - RNA, 22 nt, Staphylococcus aureus subsp. aureus Mu50
auuugaauugacuuacauuuua

SEQ ID NO: 2060039 - RNA, 15 nt, Staphylococcus aureus subsp. aureus Mu50
auuugaauuaaagug

SEQ ID NO: 2060040 - RNA, 19 nt, Staphylococcus aureus subsp. aureus Mu50
auuugaauugacuuacauu

SEQ ID NO: 2060041 - RNA, 13 nt, Staphylococcus aureus subsp. aureus Mu50
auuucuuuuuaaa

SEQ ID NO: 2060042 - RNA, 18 nt, Staphylococcus aureus subsp. aureus Mu50
auuugaaugccuacagau

SEQ ID NO: 2060043 - RNA, 10 nt, Staphylococcus aureus subsp. aureus Mu50
auuucuuuuu

SEQ ID NO: 2060044 - RNA, 20 nt, Staphylococcus aureus subsp. aureus Mu50
auuugaaugcaaaucaaaua

SEQ ID NO: 2060045 - RNA, 18 nt, Staphylococcus aureus subsp. aureus Mu50
auuugaugguguuaaguu

SEQ ID NO: 2060046 - RNA, 16 nt, Staphylococcus aureus subsp. aureus Mu50
auuugauguucuugaa

SEQ ID NO: 2060047 - RNA, 21 nt, Staphylococcus aureus subsp. aureus Mu50
auuugacacauuauugaaauu

SEQ ID NO: 2060048 - RNA, 21 nt, Staphylococcus aureus subsp. aureus Mu50
auuuggguaauguuuuuacaa

SEQ ID NO: 2060049 - RNA, 21 nt, Staphylococcus aureus subsp. aureus Mu50
auuuguaaucccauuuuaaag

SEQ ID NO: 2060050 - RNA, 24 nt, Staphylococcus aureus subsp. aureus Mu50
auuuguaauuccucuggaacuuua

SEQ ID NO: 2060051 - RNA, 20 nt, Staphylococcus aureus subsp. aureus Mu50
auuugguguacauaguugaa

SEQ ID NO: 2060052 - RNA, 16 nt, Staphylococcus aureus subsp. aureus Mu50
auuugguuaauacguu

SEQ ID NO: 2060053 - RNA, 18 nt, Staphylococcus aureus subsp. aureus Mu50
auuuguaaauauuuuuua

SEQ ID NO: 2060054 - RNA, 23 nt, Staphylococcus aureus subsp. aureus Mu50
auuuguaaauauuuuuuaaaaug

SEQ ID NO: 2060055 - RNA, 17 nt, Staphylococcus aureus subsp. aureus Mu50
auuuguaacuauugaaa

SEQ ID NO: 2060056 - RNA, 20 nt, Staphylococcus aureus subsp. aureus Mu50
auuuguaacuauugaaaaua

SEQ ID NO: 2060057 - RNA, 23 nt, Staphylococcus aureus subsp. aureus Mu50
auuugcugcuaauugauauggau

SEQ ID NO: 2060058 - RNA, 15 nt, Staphylococcus aureus subsp. aureus Mu50
auuuggcguaaugau

SEQ ID NO: 2060059 - RNA, 21 nt, Staphylococcus aureus subsp. aureus Mu50
auuuggauauuuauuuuaaua

SEQ ID NO: 2060060 - RNA, 21 nt, Staphylococcus aureus subsp. aureus Mu50
auuuggauaauuuuuaacagc

SEQ ID NO: 2060061 - RNA, 16 nt, Staphylococcus aureus subsp. aureus Mu50
auuuguguauaaaugu

SEQ ID NO: 2060062 - RNA, 20 nt, Staphylococcus aureus subsp. aureus Mu50
auuuguggaaauaaaacaag

SEQ ID NO: 2060063 - RNA, 21 nt, Staphylococcus aureus subsp. aureus Mu50
auuugugugcgauaagcaaaa

SEQ ID NO: 2060064 - RNA, 19 nt, Staphylococcus aureus subsp. aureus Mu50
auuuguguauaaaugucau

SEQ ID NO: 2060065 - RNA, 13 nt, Staphylococcus aureus subsp. aureus Mu50
auuugucauuucu

SEQ ID NO: 2060066 - RNA, 19 nt, Staphylococcus aureus subsp. aureus Mu50
auuugucaucguauuucua

SEQ ID NO: 2060067 - RNA, 19 nt, Staphylococcus aureus subsp. aureus Mu50
auuuguagcuugaauaaua

SEQ ID NO: 2060068 - RNA, 21 nt, Staphylococcus aureus subsp. aureus Mu50
auuuguagcuugaauaauaua

SEQ ID NO: 2060069 - RNA, 20 nt, Staphylococcus aureus subsp. aureus Mu50
auuuguacaugaacaaauaa

SEQ ID NO: 2060070 - RNA, 17 nt, Staphylococcus aureus subsp. aureus Mu50
auuuguaccaaauaaau

SEQ ID NO: 2060071 - RNA, 14 nt, Staphylococcus aureus subsp. aureus Mu50
auuuuuaucaucau

SEQ ID NO: 2060072 - RNA, 22 nt, Staphylococcus aureus subsp. aureus Mu50
auuuuuauagugucgagauuuu

SEQ ID NO: 2060073 - RNA, 13 nt, Staphylococcus aureus subsp. aureus Mu50
auuuuuauguuaa

SEQ ID NO: 2060074 - RNA, 18 nt, Staphylococcus aureus subsp. aureus Mu50
auuuuuaguuagaaagua

SEQ ID NO: 2060075 - RNA, 15 nt, Staphylococcus aureus subsp. aureus Mu50
auuuuuuaauaauca

SEQ ID NO: 2060076 - RNA, 12 nt, Staphylococcus aureus subsp. aureus Mu50
auuuuuugauau

SEQ ID NO: 2060077 - RNA, 16 nt, Staphylococcus aureus subsp. aureus Mu50
auuuuuguauuuaugu

SEQ ID NO: 2060078 - RNA, 20 nt, Staphylococcus aureus subsp. aureus Mu50
auuuuuggauucaccaauua

SEQ ID NO: 2060079 - RNA, 23 nt, Staphylococcus aureus subsp. aureus Mu50
caaaaaaggaugaugugaauguu

SEQ ID NO: 2060080 - RNA, 19 nt, Staphylococcus aureus subsp. aureus Mu50
auuuuuuuguacuuucuga

SEQ ID NO: 2060081 - RNA, 15 nt, Staphylococcus aureus subsp. aureus Mu50
auuuuuuuauauuuu

SEQ ID NO: 2060082 - RNA, 21 nt, Staphylococcus aureus subsp. aureus Mu50
auuuuuuggagcguaaaguuu

SEQ ID NO: 2060083 - RNA, 18 nt, Staphylococcus aureus subsp. aureus Mu50
auuuuuuuccaagcauca

SEQ ID NO: 2060084 - RNA, 21 nt, Staphylococcus aureus subsp. aureus Mu50
auuuuuuucguaacauuuaaa

SEQ ID NO: 2060085 - RNA, 23 nt, Staphylococcus aureus subsp. aureus Mu50
caaaacaaaaaauaucuuuuugu

SEQ ID NO: 2060086 - RNA, 16 nt, Staphylococcus aureus subsp. aureus Mu50
caaaacaauaugaauu

SEQ ID NO: 2060087 - RNA, 19 nt, Staphylococcus aureus subsp. aureus Mu50
caaaacauauucaguauau

SEQ ID NO: 2060088 - RNA, 17 nt, Staphylococcus aureus subsp. aureus Mu50
caaaaauuguaaaaccu

SEQ ID NO: 2060089 - RNA, 14 nt, Staphylococcus aureus subsp. aureus Mu50
caaaaaugaagaau

SEQ ID NO: 2060090 - RNA, 20 nt, Staphylococcus aureus subsp. aureus Mu50
caaaaauugcuauauuagua

SEQ ID NO: 2060091 - RNA, 13 nt, Staphylococcus aureus subsp. aureus Mu50
caaaaauuguaaa

SEQ ID NO: 2060092 - RNA, 14 nt, Staphylococcus aureus subsp. aureus Mu50
caaaacaaaaaaua

SEQ ID NO: 2060093 - RNA, 18 nt, Staphylococcus aureus subsp. aureus Mu50
caaaaauaauuaaauccg

SEQ ID NO: 2060094 - RNA, 17 nt, Staphylococcus aureus subsp. aureus Mu50
caaaaauagauugaaaa

SEQ ID NO: 2060095 - RNA, 17 nt, Staphylococcus aureus subsp. aureus Mu50
caaaaacaguuacaacu

SEQ ID NO: 2060096 - RNA, 19 nt, Staphylococcus aureus subsp. aureus Mu50
caaaaacaguuacaacuga

SEQ ID NO: 2060097 - RNA, 15 nt, Staphylococcus aureus subsp. aureus Mu50
auuuuccaucacaua

SEQ ID NO: 2060098 - RNA, 17 nt, Staphylococcus aureus subsp. aureus Mu50
auuuucuguccaaaaag

SEQ ID NO: 2060099 - RNA, 21 nt, Staphylococcus aureus subsp. aureus Mu50
auuuucuguuuaauuaaaaua

SEQ ID NO: 2060100 - RNA, 17 nt, Staphylococcus aureus subsp. aureus Mu50
auuuucacuaauauuuc

SEQ ID NO: 2060101 - RNA, 23 nt, Staphylococcus aureus subsp. aureus Mu50
auuuuauugaguaucaugcuuuu

SEQ ID NO: 2060102 - RNA, 13 nt, Staphylococcus aureus subsp. aureus Mu50
auuuuauuuaauu

SEQ ID NO: 2060103 - RNA, 13 nt, Staphylococcus aureus subsp. aureus Mu50
auuuuauuauuaa

SEQ ID NO: 2060104 - RNA, 15 nt, Staphylococcus aureus subsp. aureus Mu50
auuuuauucacuuuu

SEQ ID NO: 2060105 - RNA, 21 nt, Staphylococcus aureus subsp. aureus Mu50
auuuuauuagguaauacuuuu

SEQ ID NO: 2060106 - RNA, 15 nt, Staphylococcus aureus subsp. aureus Mu50
auuuuaugauuugau

SEQ ID NO: 2060107 - RNA, 13 nt, Staphylococcus aureus subsp. aureus Mu50
auuuuaaauuaca

SEQ ID NO: 2060108 - RNA, 18 nt, Staphylococcus aureus subsp. aureus Mu50
auuuuaugauuugauuug

SEQ ID NO: 2060109 - RNA, 14 nt, Staphylococcus aureus subsp. aureus Mu50
auuuuaaacaugaa

SEQ ID NO: 2060110 - RNA, 20 nt, Staphylococcus aureus subsp. aureus Mu50
auuuuaaagaaaaguuuaag

SEQ ID NO: 2060111 - RNA, 21 nt, Staphylococcus aureus subsp. aureus Mu50
auuuuaaacguaucauuuaaa

SEQ ID NO: 2060112 - RNA, 20 nt, Staphylococcus aureus subsp. aureus Mu50
auuuuaaauauugauauaaa

SEQ ID NO: 2060113 - RNA, 12 nt, Staphylococcus aureus subsp. aureus Mu50
auuuuaaaucuu

SEQ ID NO: 2060114 - RNA, 21 nt, Staphylococcus aureus subsp. aureus Mu50
auuuuaaauauugauauaaaa

SEQ ID NO: 2060115 - RNA, 18 nt, Staphylococcus aureus subsp. aureus Mu50
auuuuaaauaaaaugcau

SEQ ID NO: 2060116 - RNA, 20 nt, Staphylococcus aureus subsp. aureus Mu50
auuuuaaaucuaauuauuca

SEQ ID NO: 2060117 - RNA, 20 nt, Staphylococcus aureus subsp. aureus Mu50
auuuuguaagcucaugaauc

SEQ ID NO: 2060118 - RNA, 15 nt, Staphylococcus aureus subsp. aureus Mu50
auuuuguauaaccuu

SEQ ID NO: 2060119 - RNA, 16 nt, Staphylococcus aureus subsp. aureus Mu50
auuuuguauuagcauc

SEQ ID NO: 2060120 - RNA, 21 nt, Staphylococcus aureus subsp. aureus Mu50
auuuugcugccaaaaaguauu

SEQ ID NO: 2060121 - RNA, 17 nt, Staphylococcus aureus subsp. aureus Mu50
auuuuuagacauuaaaa

SEQ ID NO: 2060122 - RNA, 19 nt, Staphylococcus aureus subsp. aureus Mu50
auuuuuagacauuaaaaaa

SEQ ID NO: 2060123 - RNA, 15 nt, Staphylococcus aureus subsp. aureus Mu50
auuuuguauuuuuca

SEQ ID NO: 2060124 - RNA, 17 nt, Staphylococcus aureus subsp. aureus Mu50
auuuuguauuuuucaaa

SEQ ID NO: 2060125 - RNA, 23 nt, Staphylococcus aureus subsp. aureus Mu50
auuuuguauuuuucaaauaaaga

SEQ ID NO: 2060126 - RNA, 21 nt, Staphylococcus aureus subsp. aureus Mu50
auuuuuacaaagugauuuaaa

SEQ ID NO: 2060127 - RNA, 15 nt, Staphylococcus aureus subsp. aureus Mu50
auuuugauauaaaaa

SEQ ID NO: 2060128 - RNA, 18 nt, Staphylococcus aureus subsp. aureus Mu50
auuuugauauuuuucacg

SEQ ID NO: 2060129 - RNA, 20 nt, Staphylococcus aureus subsp. aureus Mu50
auuuugcaauugcaaugaau

SEQ ID NO: 2060130 - RNA, 15 nt, Staphylococcus aureus subsp. aureus Mu50
auuuugaagaagugc

SEQ ID NO: 2060131 - RNA, 11 nt, Staphylococcus aureus subsp. aureus Mu50
auuuugaagaa

SEQ ID NO: 2060132 - RNA, 20 nt, Staphylococcus aureus subsp. aureus Mu50
auuuugacguuuuagacaua

SEQ ID NO: 2060133 - RNA, 21 nt, Staphylococcus aureus subsp. aureus Mu50
auuuugacgccagaauaaauc

SEQ ID NO: 2060134 - RNA, 21 nt, Staphylococcus aureus subsp. aureus Mu50
auuuucuuuuuuuauggauuu

SEQ ID NO: 2060135 - RNA, 17 nt, Staphylococcus aureus subsp. aureus Mu50
auuuucuuuaauaacua

SEQ ID NO: 2060136 - RNA, 17 nt, Staphylococcus aureus subsp. aureus Mu50
auuuucuugccaucaau

SEQ ID NO: 2060137 - RNA, 12 nt, Staphylococcus aureus subsp. aureus Mu50
auucauaauauc

SEQ ID NO: 2060138 - RNA, 20 nt, Staphylococcus aureus subsp. aureus Mu50
auucauaaaugacugaauua

SEQ ID NO: 2060139 - RNA, 15 nt, Staphylococcus aureus subsp. aureus Mu50
auucauaaaauuuaa

SEQ ID NO: 2060140 - RNA, 22 nt, Staphylococcus aureus subsp. aureus Mu50
auucauaauuuguugauaguaa

SEQ ID NO: 2060141 - RNA, 21 nt, Staphylococcus aureus subsp. aureus Mu50
auucauacacugcacaucaua

SEQ ID NO: 2060142 - RNA, 23 nt, Staphylococcus aureus subsp. aureus Mu50
auuccucuggaacuuuaauacca

SEQ ID NO: 2060143 - RNA, 22 nt, Staphylococcus aureus subsp. aureus Mu50
auucgaucguaguuguccauuu

SEQ ID NO: 2060144 - RNA, 18 nt, Staphylococcus aureus subsp. aureus Mu50
auucgaugacuuuuuaau

SEQ ID NO: 2060145 - RNA, 21 nt, Staphylococcus aureus subsp. aureus Mu50
auucgaugcuaaaaauauuga

SEQ ID NO: 2060146 - RNA, 19 nt, Staphylococcus aureus subsp. aureus Mu50
auuccugcaaaauguuaca

SEQ ID NO: 2060147 - RNA, 14 nt, Staphylococcus aureus subsp. aureus Mu50
auuccugauacaau

SEQ ID NO: 2060148 - RNA, 16 nt, Staphylococcus aureus subsp. aureus Mu50
auucgaaaagaaauuc

SEQ ID NO: 2060149 - RNA, 13 nt, Staphylococcus aureus subsp. aureus Mu50
auucggauuauau

SEQ ID NO: 2060150 - RNA, 20 nt, Staphylococcus aureus subsp. aureus Mu50
auucuaaauauauuuuaugu

SEQ ID NO: 2060151 - RNA, 19 nt, Staphylococcus aureus subsp. aureus Mu50
auucuaccaguugauuuaa

SEQ ID NO: 2060152 - RNA, 18 nt, Staphylococcus aureus subsp. aureus Mu50
auucuaaaaaauuaaaaa

SEQ ID NO: 2060153 - RNA, 21 nt, Staphylococcus aureus subsp. aureus Mu50
auucuaaaaaauuaaaaauuu

SEQ ID NO: 2060154 - RNA, 18 nt, Staphylococcus aureus subsp. aureus Mu50
auucuaaauauauuuuau

SEQ ID NO: 2060155 - RNA, 14 nt, Staphylococcus aureus subsp. aureus Mu50
auucuuauaaaaua

SEQ ID NO: 2060156 - RNA, 15 nt, Staphylococcus aureus subsp. aureus Mu50
auucuuagauauuau

SEQ ID NO: 2060157 - RNA, 20 nt, Staphylococcus aureus subsp. aureus Mu50
auucuucaaccauuuguucu

SEQ ID NO: 2060158 - RNA, 12 nt, Staphylococcus aureus subsp. aureus Mu50
auucuucaaaaa

SEQ ID NO: 2060159 - RNA, 14 nt, Staphylococcus aureus subsp. aureus Mu50
auucuucaaaaaau

SEQ ID NO: 2060160 - RNA, 22 nt, Staphylococcus aureus subsp. aureus Mu50
auucuucaauuucauuuuugau

SEQ ID NO: 2060161 - RNA, 18 nt, Staphylococcus aureus subsp. aureus Mu50
auucuucaccaguuugug

SEQ ID NO: 2060162 - RNA, 14 nt, Staphylococcus aureus subsp. aureus Mu50
auucuucaccaacu

SEQ ID NO: 2060163 - RNA, 22 nt, Staphylococcus aureus subsp. aureus Mu50
auucuucacuaaaaauauauuu

SEQ ID NO: 2060164 - RNA, 20 nt, Staphylococcus aureus subsp. aureus Mu50
auucuucaucaugacuauuu

SEQ ID NO: 2060165 - RNA, 22 nt, Staphylococcus aureus subsp. aureus Mu50
auucuucaucaauaacuauaau

SEQ ID NO: 2060166 - RNA, 20 nt, Staphylococcus aureus subsp. aureus Mu50
auucuuucguuuucaucaac

SEQ ID NO: 2060167 - RNA, 18 nt, Staphylococcus aureus subsp. aureus Mu50
auugaaauaauauaaaaa

SEQ ID NO: 2060168 - RNA, 21 nt, Staphylococcus aureus subsp. aureus Mu50
auugaaaucgucuuacugcug

SEQ ID NO: 2060169 - RNA, 22 nt, Staphylococcus aureus subsp. aureus Mu50
auugaaauuauccuacugcugu

SEQ ID NO: 2060170 - RNA, 20 nt, Staphylococcus aureus subsp. aureus Mu50
auugaacaauucuucaucau

SEQ ID NO: 2060171 - RNA, 13 nt, Staphylococcus aureus subsp. aureus Mu50
auugaaauuuuua

SEQ ID NO: 2060172 - RNA, 19 nt, Staphylococcus aureus subsp. aureus Mu50
auucugugagguaaaacua

SEQ ID NO: 2060173 - RNA, 15 nt, Staphylococcus aureus subsp. aureus Mu50
auucuuaauuuaagu

SEQ ID NO: 2060174 - RNA, 17 nt, Staphylococcus aureus subsp. aureus Mu50
auucuauaauuuuaauu

SEQ ID NO: 2060175 - RNA, 16 nt, Staphylococcus aureus subsp. aureus Mu50
auucuagugaaauacc

SEQ ID NO: 2060176 - RNA, 19 nt, Staphylococcus aureus subsp. aureus Mu50
auucuagcaucgauguuau

SEQ ID NO: 2060177 - RNA, 14 nt, Staphylococcus aureus subsp. aureus Mu50
auucucauuuacuu

SEQ ID NO: 2060178 - RNA, 20 nt, Staphylococcus aureus subsp. aureus Mu50
auucuccaguggaaaugaua

SEQ ID NO: 2060179 - RNA, 16 nt, Staphylococcus aureus subsp. aureus Mu50
auugagggauuuuuau

SEQ ID NO: 2060180 - RNA, 14 nt, Staphylococcus aureus subsp. aureus Mu50
auugaguuguugca

SEQ ID NO: 2060181 - RNA, 16 nt, Staphylococcus aureus subsp. aureus Mu50
auugaguugaaaauaa

SEQ ID NO: 2060182 - RNA, 21 nt, Staphylococcus aureus subsp. aureus Mu50
auugagaauauuaagauguau

SEQ ID NO: 2060183 - RNA, 19 nt, Staphylococcus aureus subsp. aureus Mu50
auugacucgaccuuuauau

SEQ ID NO: 2060184 - RNA, 18 nt, Staphylococcus aureus subsp. aureus Mu50
auugacuuacauuuuaau

SEQ ID NO: 2060185 - RNA, 14 nt, Staphylococcus aureus subsp. aureus Mu50
auugaauugaaaaa

SEQ ID NO: 2060186 - RNA, 15 nt, Staphylococcus aureus subsp. aureus Mu50
auugaaugaaaauaa

SEQ ID NO: 2060187 - RNA, 14 nt, Staphylococcus aureus subsp. aureus Mu50
auugaauaaaugaa

SEQ ID NO: 2060188 - RNA, 13 nt, Staphylococcus aureus subsp. aureus Mu50
auugaacuucuuu

SEQ ID NO: 2060189 - RNA, 18 nt, Staphylococcus aureus subsp. aureus Mu50
auugacguggucuacuuc

SEQ ID NO: 2060190 - RNA, 23 nt, Staphylococcus aureus subsp. aureus Mu50
auugacauuaaugauagcaauga

SEQ ID NO: 2060191 - RNA, 21 nt, Staphylococcus aureus subsp. aureus Mu50
auugauuguaccaguaacaau

SEQ ID NO: 2060192 - RNA, 19 nt, Staphylococcus aureus subsp. aureus Mu50
auugauugcucuaagcauu

SEQ ID NO: 2060193 - RNA, 17 nt, Staphylococcus aureus subsp. aureus Mu50
auugauucuacagcauc

SEQ ID NO: 2060194 - RNA, 16 nt, Staphylococcus aureus subsp. aureus Mu50
auugauucuagugaaa

SEQ ID NO: 2060195 - RNA, 15 nt, Staphylococcus aureus subsp. aureus Mu50
auugauaaauuuuua

SEQ ID NO: 2060196 - RNA, 17 nt, Staphylococcus aureus subsp. aureus Mu50
auugauagauagaaauu

SEQ ID NO: 2060197 - RNA, 15 nt, Staphylococcus aureus subsp. aureus Mu50
auugauuaucauaug

SEQ ID NO: 2060198 - RNA, 12 nt, Staphylococcus aureus subsp. aureus Mu50
auugauagucac

SEQ ID NO: 2060199 - RNA, 16 nt, Staphylococcus aureus subsp. aureus Mu50
auugcuuuagaaaguc

SEQ ID NO: 2060200 - RNA, 18 nt, Staphylococcus aureus subsp. aureus Mu50
auugcuuguccucuaaaa

SEQ ID NO: 2060201 - RNA, 21 nt, Staphylococcus aureus subsp. aureus Mu50
auugcuuguccucuaaaacau

SEQ ID NO: 2060202 - RNA, 16 nt, Staphylococcus aureus subsp. aureus Mu50
auugcucuuuaacaau

SEQ ID NO: 2060203 - RNA, 17 nt, Staphylococcus aureus subsp. aureus Mu50
auugcucuaagcauuca

SEQ ID NO: 2060204 - RNA, 22 nt, Staphylococcus aureus subsp. aureus Mu50
auugcuauaagaacuaaugguu

SEQ ID NO: 2060205 - RNA, 17 nt, Staphylococcus aureus subsp. aureus Mu50
aaaaguaaguaaaauaa

SEQ ID NO: 2060206 - RNA, 22 nt, Staphylococcus aureus subsp. aureus Mu50
aaaaguaaaaucuuuaacauuu

SEQ ID NO: 2060207 - RNA, 20 nt, Staphylococcus aureus subsp. aureus Mu50
aaaaguaacauacuauaaaa

SEQ ID NO: 2060208 - RNA, 22 nt, Staphylococcus aureus subsp. aureus Mu50
auugguaggaggcuuuugcuuu

SEQ ID NO: 2060209 - RNA, 19 nt, Staphylococcus aureus subsp. aureus Mu50
auuguauuuuucaagcauu

SEQ ID NO: 2060210 - RNA, 22 nt, Staphylococcus aureus subsp. aureus Mu50
auuguauuguuuucaucaugca

SEQ ID NO: 2060211 - RNA, 17 nt, Staphylococcus aureus subsp. aureus Mu50
auuguauuauccucaaa

SEQ ID NO: 2060212 - RNA, 23 nt, Staphylococcus aureus subsp. aureus Mu50
auuguauuauccucaaauauauu

SEQ ID NO: 2060213 - RNA, 24 nt, Staphylococcus aureus subsp. aureus Mu50
aaaaguacuaacccaacgaugaaa

SEQ ID NO: 2060214 - RNA, 22 nt, Staphylococcus aureus subsp. aureus Mu50
aaaaguacuuuaaaauuguaua

SEQ ID NO: 2060215 - RNA, 18 nt, Staphylococcus aureus subsp. aureus Mu50
auuguauagaauguguau

SEQ ID NO: 2060216 - RNA, 15 nt, Staphylococcus aureus subsp. aureus Mu50
auuguaugaauaaua

SEQ ID NO: 2060217 - RNA, 16 nt, Staphylococcus aureus subsp. aureus Mu50
auuguaucuugucauu

SEQ ID NO: 2060218 - RNA, 18 nt, Staphylococcus aureus subsp. aureus Mu50
auuggauaauuucuucuu

SEQ ID NO: 2060219 - RNA, 21 nt, Staphylococcus aureus subsp. aureus Mu50
auuuaauaaaaaccaauauuu

SEQ ID NO: 2060220 - RNA, 19 nt, Staphylococcus aureus subsp. aureus Mu50
auuuaaucguaacauauca

SEQ ID NO: 2060221 - RNA, 16 nt, Staphylococcus aureus subsp. aureus Mu50
auuuaauguuaaacaa

SEQ ID NO: 2060222 - RNA, 12 nt, Staphylococcus aureus subsp. aureus Mu50
auuuaauguuuu

SEQ ID NO: 2060223 - RNA, 21 nt, Staphylococcus aureus subsp. aureus Mu50
auuuaauguuuuagugacaaa

SEQ ID NO: 2060224 - RNA, 22 nt, Staphylococcus aureus subsp. aureus Mu50
auuuaauggucuaauaucaauu

SEQ ID NO: 2060225 - RNA, 20 nt, Staphylococcus aureus subsp. aureus Mu50
auuuaauggucuaauaucaa

SEQ ID NO: 2060226 - RNA, 14 nt, Staphylococcus aureus subsp. aureus Mu50
auuuaauuccauua

SEQ ID NO: 2060227 - RNA, 18 nt, Staphylococcus aureus subsp. aureus Mu50
auuuaauucugguuuaau

SEQ ID NO: 2060228 - RNA, 14 nt, Staphylococcus aureus subsp. aureus Mu50
auuuaauugaaaua

SEQ ID NO: 2060229 - RNA, 13 nt, Staphylococcus aureus subsp. aureus Mu50
auuuaauuuaauu

SEQ ID NO: 2060230 - RNA, 22 nt, Staphylococcus aureus subsp. aureus Mu50
auuuaagggucacacccauacu

SEQ ID NO: 2060231 - RNA, 23 nt, Staphylococcus aureus subsp. aureus Mu50
auuuaagggucacacccauacuc

SEQ ID NO: 2060232 - RNA, 23 nt, Staphylococcus aureus subsp. aureus Mu50
auuuaagaaugcgaagauuuuua

SEQ ID NO: 2060233 - RNA, 16 nt, Staphylococcus aureus subsp. aureus Mu50
auuuaagaaacgucuu

SEQ ID NO: 2060234 - RNA, 20 nt, Staphylococcus aureus subsp. aureus Mu50
auuuaacucaacuuaaauau

SEQ ID NO: 2060235 - RNA, 16 nt, Staphylococcus aureus subsp. aureus Mu50
auuuaaaauauaaauu

SEQ ID NO: 2060236 - RNA, 19 nt, Staphylococcus aureus subsp. aureus Mu50
auuuaaaauauuauuuuua

SEQ ID NO: 2060237 - RNA, 13 nt, Staphylococcus aureus subsp. aureus Mu50
auuuaaaaugauu

SEQ ID NO: 2060238 - RNA, 16 nt, Staphylococcus aureus subsp. aureus Mu50
auuuaacggaaauaca

SEQ ID NO: 2060239 - RNA, 23 nt, Staphylococcus aureus subsp. aureus Mu50
auuuaacggaaauacaaugaauu

SEQ ID NO: 2060240 - RNA, 16 nt, Staphylococcus aureus subsp. aureus Mu50
auuuaaacauccaauu

SEQ ID NO: 2060241 - RNA, 21 nt, Staphylococcus aureus subsp. aureus Mu50
auuuaacuuucccuacugcuu

SEQ ID NO: 2060242 - RNA, 13 nt, Staphylococcus aureus subsp. aureus Mu50
auuuaaaaaaugc

SEQ ID NO: 2060243 - RNA, 16 nt, Staphylococcus aureus subsp. aureus Mu50
auuguuuuuaaaaucu

SEQ ID NO: 2060244 - RNA, 20 nt, Staphylococcus aureus subsp. aureus Mu50
auuguuuuagcaauuugcug

SEQ ID NO: 2060245 - RNA, 16 nt, Staphylococcus aureus subsp. aureus Mu50
auuguuuuagguugaa

SEQ ID NO: 2060246 - RNA, 21 nt, Staphylococcus aureus subsp. aureus Mu50
auuguuuuagguugaauuucu

SEQ ID NO: 2060247 - RNA, 22 nt, Staphylococcus aureus subsp. aureus Mu50
auuuaaaauaguucuuuaaauu

SEQ ID NO: 2060248 - RNA, 12 nt, Staphylococcus aureus subsp. aureus Mu50
auuuaaaauaua

SEQ ID NO: 2060249 - RNA, 14 nt, Staphylococcus aureus subsp. aureus Mu50
auuuaaaauauaaa

SEQ ID NO: 2060250 - RNA, 13 nt, Staphylococcus aureus subsp. aureus Mu50
auuuaaaagacaa

SEQ ID NO: 2060251 - RNA, 12 nt, Staphylococcus aureus subsp. aureus Mu50
auuuaaaagaga

SEQ ID NO: 2060252 - RNA, 13 nt, Staphylococcus aureus subsp. aureus Mu50
auuuaaaagauua

SEQ ID NO: 2060253 - RNA, 14 nt, Staphylococcus aureus subsp. aureus Mu50
auuuaaaaaucaaa

SEQ ID NO: 2060254 - RNA, 19 nt, Staphylococcus aureus subsp. aureus Mu50
auuuaaaaaucgaauuuuc

SEQ ID NO: 2060255 - RNA, 21 nt, Staphylococcus aureus subsp. aureus Mu50
auuuaaaacaaugauuaaaau

SEQ ID NO: 2060256 - RNA, 18 nt, Staphylococcus aureus subsp. aureus Mu50
auuuaaaaauugaaggaa

SEQ ID NO: 2060257 - RNA, 17 nt, Staphylococcus aureus subsp. aureus Mu50
auugugcuuggugguuu

SEQ ID NO: 2060258 - RNA, 15 nt, Staphylococcus aureus subsp. aureus Mu50
auugucaucauguuc

SEQ ID NO: 2060259 - RNA, 11 nt, Staphylococcus aureus subsp. aureus Mu50
auugucuuaau

SEQ ID NO: 2060260 - RNA, 23 nt, Staphylococcus aureus subsp. aureus Mu50
auugugaaaguuuuugucuuaau

SEQ ID NO: 2060261 - RNA, 19 nt, Staphylococcus aureus subsp. aureus Mu50
auuuacaaauguauaaaua

SEQ ID NO: 2060262 - RNA, 13 nt, Staphylococcus aureus subsp. aureus Mu50
auuuaauuuuucu

SEQ ID NO: 2060263 - RNA, 23 nt, Staphylococcus aureus subsp. aureus Mu50
auuuacaauuaauuacuguaaau

SEQ ID NO: 2060264 - RNA, 18 nt, Staphylococcus aureus subsp. aureus Mu50
auuuacaccuauaccuca

SEQ ID NO: 2060265 - RNA, 21 nt, Staphylococcus aureus subsp. aureus Mu50
auuuacaauguuaucuugcuu

SEQ ID NO: 2060266 - RNA, 18 nt, Staphylococcus aureus subsp. aureus Mu50
auuuacaccuauaccucg

SEQ ID NO: 2060267 - RNA, 19 nt, Staphylococcus aureus subsp. aureus Mu50
auuuaccaguuugaucaua

SEQ ID NO: 2060268 - RNA, 18 nt, Staphylococcus aureus subsp. aureus Mu50
auuuacuccuuacaauaa

SEQ ID NO: 2060269 - RNA, 16 nt, Staphylococcus aureus subsp. aureus Mu50
auuuacgguuauggug

SEQ ID NO: 2060270 - RNA, 20 nt, Staphylococcus aureus subsp. aureus Mu50
auuuaccucuugauaaaaua

SEQ ID NO: 2060271 - RNA, 21 nt, Staphylococcus aureus subsp. aureus Mu50
auuuaccucuugauaaaauaa

SEQ ID NO: 2060272 - RNA, 13 nt, Staphylococcus aureus subsp. aureus Mu50
auuuacuucuucu

SEQ ID NO: 2060273 - RNA, 15 nt, Staphylococcus aureus subsp. aureus Mu50
auuuacuugauuaga

SEQ ID NO: 2060274 - RNA, 22 nt, Staphylococcus aureus subsp. aureus Mu50
auuuacuuuuccuugauucuua

SEQ ID NO: 2060275 - RNA, 21 nt, Staphylococcus aureus subsp. aureus Mu50
auuuacuucuucuucagacca

SEQ ID NO: 2060276 - RNA, 21 nt, Staphylococcus aureus subsp. aureus Mu50
auuuagacaucauuguuuuag

SEQ ID NO: 2060277 - RNA, 18 nt, Staphylococcus aureus subsp. aureus Mu50
auuuagaaacuuccaaca

SEQ ID NO: 2060278 - RNA, 12 nt, Staphylococcus aureus subsp. aureus Mu50
auuuagaauaag

SEQ ID NO: 2060279 - RNA, 20 nt, Staphylococcus aureus subsp. aureus Mu50
auuuagaauaaacuuuaugg

SEQ ID NO: 2060280 - RNA, 18 nt, Staphylococcus aureus subsp. aureus Mu50
auuuagaauaaacuuuau

SEQ ID NO: 2060281 - RNA, 19 nt, Staphylococcus aureus subsp. aureus Mu50
auuuagcaucaaaaauaaa

SEQ ID NO: 2060282 - RNA, 17 nt, Staphylococcus aureus subsp. aureus Mu50
auuuagaugcauaaaaa

SEQ ID NO: 2060283 - RNA, 20 nt, Staphylococcus aureus subsp. aureus Mu50
auuuagauagcggauuuauu

SEQ ID NO: 2060284 - RNA, 16 nt, Staphylococcus aureus subsp. aureus Mu50
auuuagauuuauaacg

SEQ ID NO: 2060285 - RNA, 17 nt, Staphylococcus aureus subsp. aureus Mu50
auuuagauuuauaacga

SEQ ID NO: 2060286 - RNA, 15 nt, Staphylococcus aureus subsp. aureus Mu50
auuuagauucuuuuc

SEQ ID NO: 2060287 - RNA, 18 nt, Staphylococcus aureus subsp. aureus Mu50
auuuagauuggucaaacu

SEQ ID NO: 2060288 - RNA, 15 nt, Staphylococcus aureus subsp. aureus Mu50
augccggucauaaca

SEQ ID NO: 2060289 - RNA, 23 nt, Staphylococcus aureus subsp. aureus Mu50
augcccgauaaaaccaccuacca

SEQ ID NO: 2060290 - RNA, 19 nt, Staphylococcus aureus subsp. aureus Mu50
augccagcuucuaacaaau

SEQ ID NO: 2060291 - RNA, 13 nt, Staphylococcus aureus subsp. aureus Mu50
augcauucaauau

SEQ ID NO: 2060292 - RNA, 18 nt, Staphylococcus aureus subsp. aureus Mu50
augccagaugcaaugaua

SEQ ID NO: 2060293 - RNA, 15 nt, Staphylococcus aureus subsp. aureus Mu50
augcaguaaaaccaa

SEQ ID NO: 2060294 - RNA, 20 nt, Staphylococcus aureus subsp. aureus Mu50
augcaguaaaaccaaaucgu

SEQ ID NO: 2060295 - RNA, 20 nt, Staphylococcus aureus subsp. aureus Mu50
augcauaauaccaauugcuu

SEQ ID NO: 2060296 - RNA, 13 nt, Staphylococcus aureus subsp. aureus Mu50
augcauaaaaaaa

SEQ ID NO: 2060297 - RNA, 14 nt, Staphylococcus aureus subsp. aureus Mu50
augcauaauaccaa

SEQ ID NO: 2060298 - RNA, 24 nt, Staphylococcus aureus subsp. aureus Mu50
augcaugcgcaaaagcgcaggcga

SEQ ID NO: 2060299 - RNA, 21 nt, Staphylococcus aureus subsp. aureus Mu50
augcaugccagaugcaaugau

SEQ ID NO: 2060300 - RNA, 15 nt, Staphylococcus aureus subsp. aureus Mu50
augcauauauauaua

SEQ ID NO: 2060301 - RNA, 13 nt, Staphylococcus aureus subsp. aureus Mu50
augcauauauaua

SEQ ID NO: 2060302 - RNA, 22 nt, Staphylococcus aureus subsp. aureus Mu50
augcauccaaauauuaaaaaca

SEQ ID NO: 2060303 - RNA, 21 nt, Staphylococcus aureus subsp. aureus Mu50
augcaccuuuacaacauacau

SEQ ID NO: 2060304 - RNA, 13 nt, Staphylococcus aureus subsp. aureus Mu50
augcagcuguauu

SEQ ID NO: 2060305 - RNA, 14 nt, Staphylococcus aureus subsp. aureus Mu50
augcacuuuauuaa

SEQ ID NO: 2060306 - RNA, 20 nt, Staphylococcus aureus subsp. aureus Mu50
augcucacuuuuuaaaguaa

SEQ ID NO: 2060307 - RNA, 16 nt, Staphylococcus aureus subsp. aureus Mu50
augcucuuuagguaaa

SEQ ID NO: 2060308 - RNA, 16 nt, Staphylococcus aureus subsp. aureus Mu50
augcuauauuucggua

SEQ ID NO: 2060309 - RNA, 22 nt, Staphylococcus aureus subsp. aureus Mu50
augcuauauuucgguauuuuaa

SEQ ID NO: 2060310 - RNA, 22 nt, Staphylococcus aureus subsp. aureus Mu50
aaaagagaaacaaaacaaaaaa

SEQ ID NO: 2060311 - RNA, 19 nt, Staphylococcus aureus subsp. aureus Mu50
augcuagcuuucuuuuuca

SEQ ID NO: 2060312 - RNA, 18 nt, Staphylococcus aureus subsp. aureus Mu50
augcuagaaaguaaugcu

SEQ ID NO: 2060313 - RNA, 13 nt, Staphylococcus aureus subsp. aureus Mu50
aaaagacaaucuc

SEQ ID NO: 2060314 - RNA, 12 nt, Staphylococcus aureus subsp. aureus Mu50
aaaagacagaaa

SEQ ID NO: 2060315 - RNA, 14 nt, Staphylococcus aureus subsp. aureus Mu50
aaaagacagaaauu

SEQ ID NO: 2060316 - RNA, 23 nt, Staphylococcus aureus subsp. aureus Mu50
augcuagcuuucuuuuucaucuu

SEQ ID NO: 2060317 - RNA, 16 nt, Staphylococcus aureus subsp. aureus Mu50
augcuaauuuaacugc

SEQ ID NO: 2060318 - RNA, 17 nt, Staphylococcus aureus subsp. aureus Mu50
augcuaaaaauauugaa

SEQ ID NO: 2060319 - RNA, 17 nt, Staphylococcus aureus subsp. aureus Mu50
augcgcuuguaacaagc

SEQ ID NO: 2060320 - RNA, 22 nt, Staphylococcus aureus subsp. aureus Mu50
augcgauucucauuuacuugau

SEQ ID NO: 2060321 - RNA, 15 nt, Staphylococcus aureus subsp. aureus Mu50
augcgauugaugcgu

SEQ ID NO: 2060322 - RNA, 24 nt, Staphylococcus aureus subsp. aureus Mu50
augucaaaucggcuauacauugau

SEQ ID NO: 2060323 - RNA, 16 nt, Staphylococcus aureus subsp. aureus Mu50
augucacauaugacuu

SEQ ID NO: 2060324 - RNA, 13 nt, Staphylococcus aureus subsp. aureus Mu50
auguauuguaaug

SEQ ID NO: 2060325 - RNA, 18 nt, Staphylococcus aureus subsp. aureus Mu50
augucaguuuugaagaau

SEQ ID NO: 2060326 - RNA, 17 nt, Staphylococcus aureus subsp. aureus Mu50
augucauguauugucca

SEQ ID NO: 2060327 - RNA, 20 nt, Staphylococcus aureus subsp. aureus Mu50
augucaugucuagauuuuaa

SEQ ID NO: 2060328 - RNA, 23 nt, Staphylococcus aureus subsp. aureus Mu50
augucauaucuuuauuugauucu

SEQ ID NO: 2060329 - RNA, 17 nt, Staphylococcus aureus subsp. aureus Mu50
auguaucaagaucaaca

SEQ ID NO: 2060330 - RNA, 15 nt, Staphylococcus aureus subsp. aureus Mu50
auguauaucuuuauu

SEQ ID NO: 2060331 - RNA, 18 nt, Staphylococcus aureus subsp. aureus Mu50
auguauauggcaucauca

SEQ ID NO: 2060332 - RNA, 21 nt, Staphylococcus aureus subsp. aureus Mu50
aaaagaugguuuuguuuugcu

SEQ ID NO: 2060333 - RNA, 21 nt, Staphylococcus aureus subsp. aureus Mu50
aaaagauuagaugauauuuaa

SEQ ID NO: 2060334 - RNA, 16 nt, Staphylococcus aureus subsp. aureus Mu50
auguaugagucaaauu

SEQ ID NO: 2060335 - RNA, 21 nt, Staphylococcus aureus subsp. aureus Mu50
auguaugcuuguacaaaaaau

SEQ ID NO: 2060336 - RNA, 21 nt, Staphylococcus aureus subsp. aureus Mu50
auguaaugauacaaacccaua

SEQ ID NO: 2060337 - RNA, 12 nt, Staphylococcus aureus subsp. aureus Mu50
auguacuauaaa

SEQ ID NO: 2060338 - RNA, 12 nt, Staphylococcus aureus subsp. aureus Mu50
auguaauuauuu

SEQ ID NO: 2060339 - RNA, 15 nt, Staphylococcus aureus subsp. aureus Mu50
auggucuggaauaaa

SEQ ID NO: 2060340 - RNA, 15 nt, Staphylococcus aureus subsp. aureus Mu50
augguuucauaaacu

SEQ ID NO: 2060341 - RNA, 13 nt, Staphylococcus aureus subsp. aureus Mu50
auguaaaaaauau

SEQ ID NO: 2060342 - RNA, 22 nt, Staphylococcus aureus subsp. aureus Mu50
augguuuuguuuugcucuuuaa

SEQ ID NO: 2060343 - RNA, 19 nt, Staphylococcus aureus subsp. aureus Mu50
augggggauuuuuuuaugu

SEQ ID NO: 2060344 - RNA, 20 nt, Staphylococcus aureus subsp. aureus Mu50
auggucaacuuuuuuaacuu

SEQ ID NO: 2060345 - RNA, 23 nt, Staphylococcus aureus subsp. aureus Mu50
augggucaaugacugagaaaaau

SEQ ID NO: 2060346 - RNA, 21 nt, Staphylococcus aureus subsp. aureus Mu50
auggguauccuucucaucauu

SEQ ID NO: 2060347 - RNA, 23 nt, Staphylococcus aureus subsp. aureus Mu50
auggcuuuuuuugcuguuuaguu

SEQ ID NO: 2060348 - RNA, 18 nt, Staphylococcus aureus subsp. aureus Mu50
auggcuugguuauuuuca

SEQ ID NO: 2060349 - RNA, 22 nt, Staphylococcus aureus subsp. aureus Mu50
auggcuuagguuuaauuuuaaa

SEQ ID NO: 2060350 - RNA, 13 nt, Staphylococcus aureus subsp. aureus Mu50
augcuguacuaua

SEQ ID NO: 2060351 - RNA, 22 nt, Staphylococcus aureus subsp. aureus Mu50
augcuguacuauauucaaugau

SEQ ID NO: 2060352 - RNA, 20 nt, Staphylococcus aureus subsp. aureus Mu50
auggauuuggucaaguuuug

SEQ ID NO: 2060353 - RNA, 14 nt, Staphylococcus aureus subsp. aureus Mu50
auggauuucuuauu

SEQ ID NO: 2060354 - RNA, 18 nt, Staphylococcus aureus subsp. aureus Mu50
auggcgcaauuuuuaaca

SEQ ID NO: 2060355 - RNA, 21 nt, Staphylococcus aureus subsp. aureus Mu50
auggcgcaauuuuuaacaaaa

SEQ ID NO: 2060356 - RNA, 19 nt, Staphylococcus aureus subsp. aureus Mu50
auggcaucuggcaaauugc

SEQ ID NO: 2060357 - RNA, 16 nt, Staphylococcus aureus subsp. aureus Mu50
auucagaugaauaaug

SEQ ID NO: 2060358 - RNA, 22 nt, Staphylococcus aureus subsp. aureus Mu50
auucacucuguaauaaagaaua

SEQ ID NO: 2060359 - RNA, 13 nt, Staphylococcus aureus subsp. aureus Mu50
auucacuguauaa

SEQ ID NO: 2060360 - RNA, 22 nt, Staphylococcus aureus subsp. aureus Mu50
auucacuuuacccucuuuaguu

SEQ ID NO: 2060361 - RNA, 16 nt, Staphylococcus aureus subsp. aureus Mu50
auucacuuuuuuuaau

SEQ ID NO: 2060362 - RNA, 19 nt, Staphylococcus aureus subsp. aureus Mu50
auucacgauauaacauuaa

SEQ ID NO: 2060363 - RNA, 16 nt, Staphylococcus aureus subsp. aureus Mu50
auucacgaacauuacu

SEQ ID NO: 2060364 - RNA, 12 nt, Staphylococcus aureus subsp. aureus Mu50
auucagauuuuc

SEQ ID NO: 2060365 - RNA, 15 nt, Staphylococcus aureus subsp. aureus Mu50
auucaguauauguau

SEQ ID NO: 2060366 - RNA, 17 nt, Staphylococcus aureus subsp. aureus Mu50
auucagucaguaaaaau

SEQ ID NO: 2060367 - RNA, 17 nt, Staphylococcus aureus subsp. aureus Mu50
auucaaccaauuauuaa

SEQ ID NO: 2060368 - RNA, 17 nt, Staphylococcus aureus subsp. aureus Mu50
auucaaccuuaauagga

SEQ ID NO: 2060369 - RNA, 21 nt, Staphylococcus aureus subsp. aureus Mu50
auucaauacgaaguguuauaa

SEQ ID NO: 2060370 - RNA, 17 nt, Staphylococcus aureus subsp. aureus Mu50
auucaauaauuauuaau

SEQ ID NO: 2060371 - RNA, 22 nt, Staphylococcus aureus subsp. aureus Mu50
auucaauaauuauuaauuuaau

SEQ ID NO: 2060372 - RNA, 23 nt, Staphylococcus aureus subsp. aureus Mu50
auucaaugauuaguaaugauuaa

SEQ ID NO: 2060373 - RNA, 15 nt, Staphylococcus aureus subsp. aureus Mu50
auucaaugauuuuua

SEQ ID NO: 2060374 - RNA, 14 nt, Staphylococcus aureus subsp. aureus Mu50
auucaauauuuuuu

SEQ ID NO: 2060375 - RNA, 12 nt, Staphylococcus aureus subsp. aureus Mu50
auuauugaaauu

SEQ ID NO: 2060376 - RNA, 18 nt, Staphylococcus aureus subsp. aureus Mu50
auuauugagaauauuuau

SEQ ID NO: 2060377 - RNA, 23 nt, Staphylococcus aureus subsp. aureus Mu50
auucaaauaaaucaaacuuuuca

SEQ ID NO: 2060378 - RNA, 19 nt, Staphylococcus aureus subsp. aureus Mu50
auucaaauaaaucaaacuu

SEQ ID NO: 2060379 - RNA, 16 nt, Staphylococcus aureus subsp. aureus Mu50
auuauucuuuauauuu

SEQ ID NO: 2060380 - RNA, 22 nt, Staphylococcus aureus subsp. aureus Mu50
auuauugaaaucgauacuaaua

SEQ ID NO: 2060381 - RNA, 14 nt, Staphylococcus aureus subsp. aureus Mu50
auuauucuuugauu

SEQ ID NO: 2060382 - RNA, 19 nt, Staphylococcus aureus subsp. aureus Mu50
auuauucuuugauuaaauc

SEQ ID NO: 2060383 - RNA, 18 nt, Staphylococcus aureus subsp. aureus Mu50
auuauugaaacuaauaau

SEQ ID NO: 2060384 - RNA, 16 nt, Staphylococcus aureus subsp. aureus Mu50
aaaaggcucauuuguu

SEQ ID NO: 2060385 - RNA, 14 nt, Staphylococcus aureus subsp. aureus Mu50
auucaauguuuaau

SEQ ID NO: 2060386 - RNA, 21 nt, Staphylococcus aureus subsp. aureus Mu50
auucaauguaucaccuaauug

SEQ ID NO: 2060387 - RNA, 18 nt, Staphylococcus aureus subsp. aureus Mu50
auucaaugauuuuuaaaa

SEQ ID NO: 2060388 - RNA, 17 nt, Staphylococcus aureus subsp. aureus Mu50
auucaaugauuuuuaaa

SEQ ID NO: 2060389 - RNA, 13 nt, Staphylococcus aureus subsp. aureus Mu50
auucaauuucuca

SEQ ID NO: 2060390 - RNA, 20 nt, Staphylococcus aureus subsp. aureus Mu50
auucaauuucucaccagcuc

SEQ ID NO: 2060391 - RNA, 12 nt, Staphylococcus aureus subsp. aureus Mu50
auuaugauauac

SEQ ID NO: 2060392 - RNA, 15 nt, Staphylococcus aureus subsp. aureus Mu50
auuaugauuaauccu

SEQ ID NO: 2060393 - RNA, 13 nt, Staphylococcus aureus subsp. aureus Mu50
auuaugacaacau

SEQ ID NO: 2060394 - RNA, 15 nt, Staphylococcus aureus subsp. aureus Mu50
auuaugaaaaguaaa

SEQ ID NO: 2060395 - RNA, 15 nt, Staphylococcus aureus subsp. aureus Mu50
auuaugacuaacauu

SEQ ID NO: 2060396 - RNA, 20 nt, Staphylococcus aureus subsp. aureus Mu50
auuaucuuaagucaucaauc

SEQ ID NO: 2060397 - RNA, 22 nt, Staphylococcus aureus subsp. aureus Mu50
auuaucuuuacgauaaacuaaa

SEQ ID NO: 2060398 - RNA, 17 nt, Staphylococcus aureus subsp. aureus Mu50
auuauuccauugaugua

SEQ ID NO: 2060399 - RNA, 15 nt, Staphylococcus aureus subsp. aureus Mu50
auuauuauuuaaauu

SEQ ID NO: 2060400 - RNA, 14 nt, Staphylococcus aureus subsp. aureus Mu50
auuauuauuaaauu

SEQ ID NO: 2060401 - RNA, 15 nt, Staphylococcus aureus subsp. aureus Mu50
auuauuauaauaaau

SEQ ID NO: 2060402 - RNA, 16 nt, Staphylococcus aureus subsp. aureus Mu50
auuauuacaaugaaaa

SEQ ID NO: 2060403 - RNA, 13 nt, Staphylococcus aureus subsp. aureus Mu50
auuauuaccauau

SEQ ID NO: 2060404 - RNA, 17 nt, Staphylococcus aureus subsp. aureus Mu50
auuauuaauuccuucua

SEQ ID NO: 2060405 - RNA, 14 nt, Staphylococcus aureus subsp. aureus Mu50
auuaugcccaacca

SEQ ID NO: 2060406 - RNA, 16 nt, Staphylococcus aureus subsp. aureus Mu50
auuaucuguaauuaau

SEQ ID NO: 2060407 - RNA, 23 nt, Staphylococcus aureus subsp. aureus Mu50
auuauccaaggauguuauaaaau

SEQ ID NO: 2060408 - RNA, 20 nt, Staphylococcus aureus subsp. aureus Mu50
auuaucgaagaaacauuaua

SEQ ID NO: 2060409 - RNA, 14 nt, Staphylococcus aureus subsp. aureus Mu50
auuaucauuaaauu

SEQ ID NO: 2060410 - RNA, 17 nt, Staphylococcus aureus subsp. aureus Mu50
auuaucauuaaauugcu

SEQ ID NO: 2060411 - RNA, 22 nt, Staphylococcus aureus subsp. aureus Mu50
auuaucauuacagauaauuauu

SEQ ID NO: 2060412 - RNA, 19 nt, Staphylococcus aureus subsp. aureus Mu50
auuaucauaugugauuuaa

SEQ ID NO: 2060413 - RNA, 19 nt, Staphylococcus aureus subsp. aureus Mu50
auuaucauauaaaucaaau

SEQ ID NO: 2060414 - RNA, 18 nt, Staphylococcus aureus subsp. aureus Mu50
auuaucauaugaacaaua

SEQ ID NO: 2060415 - RNA, 13 nt, Staphylococcus aureus subsp. aureus Mu50
auuauccuacugc

SEQ ID NO: 2060416 - RNA, 12 nt, Staphylococcus aureus subsp. aureus Mu50
auuauauuucuc

SEQ ID NO: 2060417 - RNA, 13 nt, Staphylococcus aureus subsp. aureus Mu50
auuaucaaagaaa

SEQ ID NO: 2060418 - RNA, 14 nt, Staphylococcus aureus subsp. aureus Mu50
auuaucaacauaau

SEQ ID NO: 2060419 - RNA, 15 nt, Staphylococcus aureus subsp. aureus Mu50
auuaucauaaagaua

SEQ ID NO: 2060420 - RNA, 18 nt, Staphylococcus aureus subsp. aureus Mu50
auuaucaccuucaaacuu

SEQ ID NO: 2060421 - RNA, 17 nt, Staphylococcus aureus subsp. aureus Mu50
auuagcgcaagagauaa

SEQ ID NO: 2060422 - RNA, 21 nt, Staphylococcus aureus subsp. aureus Mu50
auuagcgcaccaauuaucaac

SEQ ID NO: 2060423 - RNA, 14 nt, Staphylococcus aureus subsp. aureus Mu50
auuagcgaaaacua

SEQ ID NO: 2060424 - RNA, 20 nt, Staphylococcus aureus subsp. aureus Mu50
auuagcgaaaacuaaaggga

SEQ ID NO: 2060425 - RNA, 15 nt, Staphylococcus aureus subsp. aureus Mu50
auuaccuuuccauuc

SEQ ID NO: 2060426 - RNA, 22 nt, Staphylococcus aureus subsp. aureus Mu50
auuacccacaucuuuuuaaaag

SEQ ID NO: 2060427 - RNA, 15 nt, Staphylococcus aureus subsp. aureus Mu50
auuagcgaaaaccuc

SEQ ID NO: 2060428 - RNA, 21 nt, Staphylococcus aureus subsp. aureus Mu50
auuacgcugucucauuaaugu

SEQ ID NO: 2060429 - RNA, 23 nt, Staphylococcus aureus subsp. aureus Mu50
auuaggcuuaaauauaaugaucc

SEQ ID NO: 2060430 - RNA, 22 nt, Staphylococcus aureus subsp. aureus Mu50
aaaagcucggcacaccauuuua

SEQ ID NO: 2060431 - RNA, 14 nt, Staphylococcus aureus subsp. aureus Mu50
auuagguaauacuu

SEQ ID NO: 2060432 - RNA, 12 nt, Staphylococcus aureus subsp. aureus Mu50
auuaguaaauau

SEQ ID NO: 2060433 - RNA, 19 nt, Staphylococcus aureus subsp. aureus Mu50
auuagguuucgauucauuu

SEQ ID NO: 2060434 - RNA, 16 nt, Staphylococcus aureus subsp. aureus Mu50
auuaguuuuuaaaauu

SEQ ID NO: 2060435 - RNA, 17 nt, Staphylococcus aureus subsp. aureus Mu50
auuauaaaaacagcagu

SEQ ID NO: 2060436 - RNA, 21 nt, Staphylococcus aureus subsp. aureus Mu50
auuaguuuuuaaaauuaucaa

SEQ ID NO: 2060437 - RNA, 12 nt, Staphylococcus aureus subsp. aureus Mu50
auuauaaaauaa

SEQ ID NO: 2060438 - RNA, 13 nt, Staphylococcus aureus subsp. aureus Mu50
auuauaaaauaaa

SEQ ID NO: 2060439 - RNA, 14 nt, Staphylococcus aureus subsp. aureus Mu50
auuauaaaauaaau

SEQ ID NO: 2060440 - RNA, 13 nt, Staphylococcus aureus subsp. aureus Mu50
auuauaaaugauu

SEQ ID NO: 2060441 - RNA, 14 nt, Staphylococcus aureus subsp. aureus Mu50
auuauaauuguuca

SEQ ID NO: 2060442 - RNA, 21 nt, Staphylococcus aureus subsp. aureus Mu50
auuauaaguugcauauaaaaa

SEQ ID NO: 2060443 - RNA, 15 nt, Staphylococcus aureus subsp. aureus Mu50
auuauacuuuacauu

SEQ ID NO: 2060444 - RNA, 21 nt, Staphylococcus aureus subsp. aureus Mu50
auuauacuuuacauuucucgu

SEQ ID NO: 2060445 - RNA, 17 nt, Staphylococcus aureus subsp. aureus Mu50
auuauacugcucuuuau

SEQ ID NO: 2060446 - RNA, 18 nt, Staphylococcus aureus subsp. aureus Mu50
auuauacgugcuuuaaag

SEQ ID NO: 2060447 - RNA, 15 nt, Staphylococcus aureus subsp. aureus Mu50
auguuuaaacauuuu

SEQ ID NO: 2060448 - RNA, 14 nt, Staphylococcus aureus subsp. aureus Mu50
auguuuaauuuucu

SEQ ID NO: 2060449 - RNA, 14 nt, Staphylococcus aureus subsp. aureus Mu50
auguuuaugacaaa

SEQ ID NO: 2060450 - RNA, 13 nt, Staphylococcus aureus subsp. aureus Mu50
auguuuccauuua

SEQ ID NO: 2060451 - RNA, 12 nt, Staphylococcus aureus subsp. aureus Mu50
auguuuccauuu

SEQ ID NO: 2060452 - RNA, 15 nt, Staphylococcus aureus subsp. aureus Mu50
auguuguuauauaaa

SEQ ID NO: 2060453 - RNA, 17 nt, Staphylococcus aureus subsp. aureus Mu50
auguuguuauauaaaua

SEQ ID NO: 2060454 - RNA, 18 nt, Staphylococcus aureus subsp. aureus Mu50
auguugguucaucaaaca

SEQ ID NO: 2060455 - RNA, 15 nt, Staphylococcus aureus subsp. aureus Mu50
auguugauucguuau

SEQ ID NO: 2060456 - RNA, 20 nt, Staphylococcus aureus subsp. aureus Mu50
augucccguuuaccuuaaau

SEQ ID NO: 2060457 - RNA, 23 nt, Staphylococcus aureus subsp. aureus Mu50
auguccaucuuuuauuaaagaaa

SEQ ID NO: 2060458 - RNA, 15 nt, Staphylococcus aureus subsp. aureus Mu50
auguucaauauuuuc

SEQ ID NO: 2060459 - RNA, 16 nt, Staphylococcus aureus subsp. aureus Mu50
augucgaaaauagcua

SEQ ID NO: 2060460 - RNA, 15 nt, Staphylococcus aureus subsp. aureus Mu50
auguucagaaauuua

SEQ ID NO: 2060461 - RNA, 23 nt, Staphylococcus aureus subsp. aureus Mu50
auuaaauucuuuucaagaaauuc

SEQ ID NO: 2060462 - RNA, 21 nt, Staphylococcus aureus subsp. aureus Mu50
auuaaauucaucuugcaagua

SEQ ID NO: 2060463 - RNA, 16 nt, Staphylococcus aureus subsp. aureus Mu50
auuaaauucaaaucug

SEQ ID NO: 2060464 - RNA, 17 nt, Staphylococcus aureus subsp. aureus Mu50
auuaaauaacacaugca

SEQ ID NO: 2060465 - RNA, 20 nt, Staphylococcus aureus subsp. aureus Mu50
auuaaauuauggagcggaag

SEQ ID NO: 2060466 - RNA, 22 nt, Staphylococcus aureus subsp. aureus Mu50
auuaaauauuuaaccuuuaaaa

SEQ ID NO: 2060467 - RNA, 21 nt, Staphylococcus aureus subsp. aureus Mu50
auuaaacauuuagauuucaug

SEQ ID NO: 2060468 - RNA, 20 nt, Staphylococcus aureus subsp. aureus Mu50
auuaaacauuuagauuucau

SEQ ID NO: 2060469 - RNA, 17 nt, Staphylococcus aureus subsp. aureus Mu50
auuaaacccaauuaacc

SEQ ID NO: 2060470 - RNA, 23 nt, Staphylococcus aureus subsp. aureus Mu50
auuaaaccuacaacgaagaaucc

SEQ ID NO: 2060471 - RNA, 19 nt, Staphylococcus aureus subsp. aureus Mu50
auuaaacucaaaaagccaa

SEQ ID NO: 2060472 - RNA, 19 nt, Staphylococcus aureus subsp. aureus Mu50
auuaaacgcucaacuauau

SEQ ID NO: 2060473 - RNA, 19 nt, Staphylococcus aureus subsp. aureus Mu50
auuaaacuuauaacuuuau

SEQ ID NO: 2060474 - RNA, 17 nt, Staphylococcus aureus subsp. aureus Mu50
auuaaacuuauaacuuu

SEQ ID NO: 2060475 - RNA, 20 nt, Staphylococcus aureus subsp. aureus Mu50
auuaaacuuaagaauacaug

SEQ ID NO: 2060476 - RNA, 17 nt, Staphylococcus aureus subsp. aureus Mu50
auuaaaguguuucaaca

SEQ ID NO: 2060477 - RNA, 15 nt, Staphylococcus aureus subsp. aureus Mu50
auuaaagugaauauu

SEQ ID NO: 2060478 - RNA, 18 nt, Staphylococcus aureus subsp. aureus Mu50
auguuucuucaauugucu

SEQ ID NO: 2060479 - RNA, 21 nt, Staphylococcus aureus subsp. aureus Mu50
auguuuuuaacagcuuuuucu

SEQ ID NO: 2060480 - RNA, 15 nt, Staphylococcus aureus subsp. aureus Mu50
auguuuuuuaaguac

SEQ ID NO: 2060481 - RNA, 16 nt, Staphylococcus aureus subsp. aureus Mu50
auuaaaaaacaauaaa

SEQ ID NO: 2060482 - RNA, 12 nt, Staphylococcus aureus subsp. aureus Mu50
auuaaaaaagaa

SEQ ID NO: 2060483 - RNA, 12 nt, Staphylococcus aureus subsp. aureus Mu50
auuaaaauguua

SEQ ID NO: 2060484 - RNA, 18 nt, Staphylococcus aureus subsp. aureus Mu50
auuaaaauguuaauaaug

SEQ ID NO: 2060485 - RNA, 20 nt, Staphylococcus aureus subsp. aureus Mu50
auuaaaaguguugacuuuau

SEQ ID NO: 2060486 - RNA, 14 nt, Staphylococcus aureus subsp. aureus Mu50
auuaaaaucugcuu

SEQ ID NO: 2060487 - RNA, 15 nt, Staphylococcus aureus subsp. aureus Mu50
auuaaaaucugcuuu

SEQ ID NO: 2060488 - RNA, 12 nt, Staphylococcus aureus subsp. aureus Mu50
auuaaaauagag

SEQ ID NO: 2060489 - RNA, 12 nt, Staphylococcus aureus subsp. aureus Mu50
auuaaaaugaua

SEQ ID NO: 2060490 - RNA, 16 nt, Staphylococcus aureus subsp. aureus Mu50
auuaacaacaaauaua

SEQ ID NO: 2060491 - RNA, 17 nt, Staphylococcus aureus subsp. aureus Mu50
auuaacaacaaauauaa

SEQ ID NO: 2060492 - RNA, 20 nt, Staphylococcus aureus subsp. aureus Mu50
auuaaauuuuguauaaccuu

SEQ ID NO: 2060493 - RNA, 19 nt, Staphylococcus aureus subsp. aureus Mu50
auuaaauuuuguuaggaga

SEQ ID NO: 2060494 - RNA, 19 nt, Staphylococcus aureus subsp. aureus Mu50
auuaacacauucaaauaaa

SEQ ID NO: 2060495 - RNA, 13 nt, Staphylococcus aureus subsp. aureus Mu50
auuaacacauuca

SEQ ID NO: 2060496 - RNA, 16 nt, Staphylococcus aureus subsp. aureus Mu50
auuaaguacuuuuaca

SEQ ID NO: 2060497 - RNA, 17 nt, Staphylococcus aureus subsp. aureus Mu50
auuaaguaauagcaacc

SEQ ID NO: 2060498 - RNA, 15 nt, Staphylococcus aureus subsp. aureus Mu50
auuaaguauaucuuu

SEQ ID NO: 2060499 - RNA, 16 nt, Staphylococcus aureus subsp. aureus Mu50
auuaaggcuuuaguag

SEQ ID NO: 2060500 - RNA, 14 nt, Staphylococcus aureus subsp. aureus Mu50
auuaacauuaucca

SEQ ID NO: 2060501 - RNA, 20 nt, Staphylococcus aureus subsp. aureus Mu50
aaaagcacuagccguuauuu

SEQ ID NO: 2060502 - RNA, 17 nt, Staphylococcus aureus subsp. aureus Mu50
auuaaguacuuuuacaa

SEQ ID NO: 2060503 - RNA, 16 nt, Staphylococcus aureus subsp. aureus Mu50
auuaagugcaauaaca

SEQ ID NO: 2060504 - RNA, 16 nt, Staphylococcus aureus subsp. aureus Mu50
aaaagcagcaguaaga

SEQ ID NO: 2060505 - RNA, 19 nt, Staphylococcus aureus subsp. aureus Mu50
aaaagcagucgaacaauga

SEQ ID NO: 2060506 - RNA, 14 nt, Staphylococcus aureus subsp. aureus Mu50
auuaaucguauuuu

SEQ ID NO: 2060507 - RNA, 18 nt, Staphylococcus aureus subsp. aureus Mu50
auuaaucccuucaaaauu

SEQ ID NO: 2060508 - RNA, 13 nt, Staphylococcus aureus subsp. aureus Mu50
auuaauuugauaa

SEQ ID NO: 2060509 - RNA, 22 nt, Staphylococcus aureus subsp. aureus Mu50
auuaauuuucuuuuuuaauucu

SEQ ID NO: 2060510 - RNA, 19 nt, Staphylococcus aureus subsp. aureus Mu50
auuaauuuuguaauuagga

SEQ ID NO: 2060511 - RNA, 11 nt, Staphylococcus aureus subsp. aureus Mu50
auuaauuuuuc

SEQ ID NO: 2060512 - RNA, 21 nt, Staphylococcus aureus subsp. aureus Mu50
auuaauguucaaaaaaugaau

SEQ ID NO: 2060513 - RNA, 13 nt, Staphylococcus aureus subsp. aureus Mu50
auuaauguuugau

SEQ ID NO: 2060514 - RNA, 17 nt, Staphylococcus aureus subsp. aureus Mu50
auuaauggcaacuaaga

SEQ ID NO: 2060515 - RNA, 21 nt, Staphylococcus aureus subsp. aureus Mu50
auuaauuacuguaaauaugaa

SEQ ID NO: 2060516 - RNA, 19 nt, Staphylococcus aureus subsp. aureus Mu50
auuaauuaaaauucucuuu

SEQ ID NO: 2060517 - RNA, 14 nt, Staphylococcus aureus subsp. aureus Mu50
auuaauuaaagauu

SEQ ID NO: 2060518 - RNA, 21 nt, Staphylococcus aureus subsp. aureus Mu50
auuaauuauugagaauauuua

SEQ ID NO: 2060519 - RNA, 17 nt, Staphylococcus aureus subsp. aureus Mu50
auuaauuaucuuaaguc

SEQ ID NO: 2060520 - RNA, 12 nt, Staphylococcus aureus subsp. aureus Mu50
auuacagaugau

SEQ ID NO: 2060521 - RNA, 15 nt, Staphylococcus aureus subsp. aureus Mu50
auuacagaugaugcu

SEQ ID NO: 2060522 - RNA, 16 nt, Staphylococcus aureus subsp. aureus Mu50
auuaccauaacuuuau

SEQ ID NO: 2060523 - RNA, 13 nt, Staphylococcus aureus subsp. aureus Mu50
auuaccauauaaa

SEQ ID NO: 2060524 - RNA, 15 nt, Staphylococcus aureus subsp. aureus Mu50
auuaccauauaaagc

SEQ ID NO: 2060525 - RNA, 21 nt, Staphylococcus aureus subsp. aureus Mu50
auuacccacaucuuuuuaaaa

SEQ ID NO: 2060526 - RNA, 19 nt, Staphylococcus aureus subsp. aureus Mu50
auuacccacaucuuuuuaa

SEQ ID NO: 2060527 - RNA, 13 nt, Staphylococcus aureus subsp. aureus Mu50
auuaccagcaauu

SEQ ID NO: 2060528 - RNA, 20 nt, Staphylococcus aureus subsp. aureus Mu50
auuacacccuuuaaauuuaa

SEQ ID NO: 2060529 - RNA, 22 nt, Staphylococcus aureus subsp. aureus Mu50
auuacacccuuuaaauuuaacu

SEQ ID NO: 2060530 - RNA, 18 nt, Staphylococcus aureus subsp. aureus Mu50
auuacaaugaaaaaacga

SEQ ID NO: 2060531 - RNA, 15 nt, Staphylococcus aureus subsp. aureus Mu50
auuacaaaaguauga

SEQ ID NO: 2060532 - RNA, 12 nt, Staphylococcus aureus subsp. aureus Mu50
auuaauuuuuca

SEQ ID NO: 2060533 - RNA, 14 nt, Staphylococcus aureus subsp. aureus Mu50
auuaauuuuucaaa

SEQ ID NO: 2060534 - RNA, 16 nt, Staphylococcus aureus subsp. aureus Mu50
auuaauuuuucaaaug

SEQ ID NO: 2060535 - RNA, 13 nt, Staphylococcus aureus subsp. aureus Mu50
auuacaaaucaug

SEQ ID NO: 2060536 - RNA, 18 nt, Staphylococcus aureus subsp. aureus Mu50
auauugcguuuaauuuac

SEQ ID NO: 2060537 - RNA, 14 nt, Staphylococcus aureus subsp. aureus Mu50
auauugcguuuaau

SEQ ID NO: 2060538 - RNA, 16 nt, Staphylococcus aureus subsp. aureus Mu50
auauugcaaaaauaau

SEQ ID NO: 2060539 - RNA, 22 nt, Staphylococcus aureus subsp. aureus Mu50
auauugcaaaaauaauaugaau

SEQ ID NO: 2060540 - RNA, 18 nt, Staphylococcus aureus subsp. aureus Mu50
auauugaacaauucuuca

SEQ ID NO: 2060541 - RNA, 16 nt, Staphylococcus aureus subsp. aureus Mu50
auauugagaauauuaa

SEQ ID NO: 2060542 - RNA, 16 nt, Staphylococcus aureus subsp. aureus Mu50
auauugaauugaaaaa

SEQ ID NO: 2060543 - RNA, 11 nt, Staphylococcus aureus subsp. aureus Mu50
auauugauagc

SEQ ID NO: 2060544 - RNA, 20 nt, Staphylococcus aureus subsp. aureus Mu50
auauuccacgcucacauuaa

SEQ ID NO: 2060545 - RNA, 21 nt, Staphylococcus aureus subsp. aureus Mu50
auauucaccuacaacaccaau

SEQ ID NO: 2060546 - RNA, 16 nt, Staphylococcus aureus subsp. aureus Mu50
auauucaguauaugua

SEQ ID NO: 2060547 - RNA, 19 nt, Staphylococcus aureus subsp. aureus Mu50
auauucaacuuauuauuua

SEQ ID NO: 2060548 - RNA, 16 nt, Staphylococcus aureus subsp. aureus Mu50
auauucaauaauuauu

SEQ ID NO: 2060549 - RNA, 14 nt, Staphylococcus aureus subsp. aureus Mu50
auauucaaugaauu

SEQ ID NO: 2060550 - RNA, 17 nt, Staphylococcus aureus subsp. aureus Mu50
auaugauguuaaaaaau

SEQ ID NO: 2060551 - RNA, 17 nt, Staphylococcus aureus subsp. aureus Mu50
auaugauugcaaauuau

SEQ ID NO: 2060552 - RNA, 20 nt, Staphylococcus aureus subsp. aureus Mu50
auauuucgguauuuuaaauu

SEQ ID NO: 2060553 - RNA, 21 nt, Staphylococcus aureus subsp. aureus Mu50
auauuucgguuagucuuaauc

SEQ ID NO: 2060554 - RNA, 16 nt, Staphylococcus aureus subsp. aureus Mu50
auauuucgguauuuua

SEQ ID NO: 2060555 - RNA, 20 nt, Staphylococcus aureus subsp. aureus Mu50
auauuugcuagucauaauuu

SEQ ID NO: 2060556 - RNA, 14 nt, Staphylococcus aureus subsp. aureus Mu50
auauuuuaguucac

SEQ ID NO: 2060557 - RNA, 17 nt, Staphylococcus aureus subsp. aureus Mu50
auauuuuaaaaaguaau

SEQ ID NO: 2060558 - RNA, 12 nt, Staphylococcus aureus subsp. aureus Mu50
auauuuugauuu

SEQ ID NO: 2060559 - RNA, 14 nt, Staphylococcus aureus subsp. aureus Mu50
auauuuucugcgau

SEQ ID NO: 2060560 - RNA, 11 nt, Staphylococcus aureus subsp. aureus Mu50
auauuuucuua

SEQ ID NO: 2060561 - RNA, 19 nt, Staphylococcus aureus subsp. aureus Mu50
auauuuucuuagaaaauca

SEQ ID NO: 2060562 - RNA, 11 nt, Staphylococcus aureus subsp. aureus Mu50
auauuuucuuc

SEQ ID NO: 2060563 - RNA, 23 nt, Staphylococcus aureus subsp. aureus Mu50
auauuggcuugcuucauuauaua

SEQ ID NO: 2060564 - RNA, 22 nt, Staphylococcus aureus subsp. aureus Mu50
auauuggcaguguuugacugaa

SEQ ID NO: 2060565 - RNA, 15 nt, Staphylococcus aureus subsp. aureus Mu50
auauuguaaucacua

SEQ ID NO: 2060566 - RNA, 13 nt, Staphylococcus aureus subsp. aureus Mu50
auauuguauuuua

SEQ ID NO: 2060567 - RNA, 18 nt, Staphylococcus aureus subsp. aureus Mu50
auauuucaacuuuuuaau

SEQ ID NO: 2060568 - RNA, 14 nt, Staphylococcus aureus subsp. aureus Mu50
auauuuauuuuuga

SEQ ID NO: 2060569 - RNA, 19 nt, Staphylococcus aureus subsp. aureus Mu50
auauuuaacaucaauuacu

SEQ ID NO: 2060570 - RNA, 12 nt, Staphylococcus aureus subsp. aureus Mu50
auauuuaaacua

SEQ ID NO: 2060571 - RNA, 18 nt, Staphylococcus aureus subsp. aureus Mu50
aucaagucugcauuaauu

SEQ ID NO: 2060572 - RNA, 15 nt, Staphylococcus aureus subsp. aureus Mu50
aucaagcugagcuuu

SEQ ID NO: 2060573 - RNA, 18 nt, Staphylococcus aureus subsp. aureus Mu50
aucaagcugagcuuuaau

SEQ ID NO: 2060574 - RNA, 23 nt, Staphylococcus aureus subsp. aureus Mu50
aucaagcugagcuuuaauuuuuu

SEQ ID NO: 2060575 - RNA, 21 nt, Staphylococcus aureus subsp. aureus Mu50
aucaauaccauaauuaaauaa

SEQ ID NO: 2060576 - RNA, 15 nt, Staphylococcus aureus subsp. aureus Mu50
aucaaguugauaaug

SEQ ID NO: 2060577 - RNA, 22 nt, Staphylococcus aureus subsp. aureus Mu50
aucaaucgcuuuagcaauugaa

SEQ ID NO: 2060578 - RNA, 14 nt, Staphylococcus aureus subsp. aureus Mu50
aucaauauugauau

SEQ ID NO: 2060579 - RNA, 19 nt, Staphylococcus aureus subsp. aureus Mu50
aucaauaucacuaucagcu

SEQ ID NO: 2060580 - RNA, 14 nt, Staphylococcus aureus subsp. aureus Mu50
aucaauaguuuaua

SEQ ID NO: 2060581 - RNA, 13 nt, Staphylococcus aureus subsp. aureus Mu50
aucaauauaaccg

SEQ ID NO: 2060582 - RNA, 11 nt, Staphylococcus aureus subsp. aureus Mu50
aucaauauuua

SEQ ID NO: 2060583 - RNA, 21 nt, Staphylococcus aureus subsp. aureus Mu50
aucaacaguuuuauuaucuuu

SEQ ID NO: 2060584 - RNA, 22 nt, Staphylococcus aureus subsp. aureus Mu50
aucaaccuguucuuuauuuaaa

SEQ ID NO: 2060585 - RNA, 14 nt, Staphylococcus aureus subsp. aureus Mu50
aucaaccuguucuu

SEQ ID NO: 2060586 - RNA, 18 nt, Staphylococcus aureus subsp. aureus Mu50
aucaaccuguucuuuauu

SEQ ID NO: 2060587 - RNA, 20 nt, Staphylococcus aureus subsp. aureus Mu50
aucaacgagucauaaauaua

SEQ ID NO: 2060588 - RNA, 20 nt, Staphylococcus aureus subsp. aureus Mu50
aucaacgauguccuuuagug

SEQ ID NO: 2060589 - RNA, 17 nt, Staphylococcus aureus subsp. aureus Mu50
aucaacgccauauuuau

SEQ ID NO: 2060590 - RNA, 13 nt, Staphylococcus aureus subsp. aureus Mu50
aucaacuuuucua

SEQ ID NO: 2060591 - RNA, 14 nt, Staphylococcus aureus subsp. aureus Mu50
aucaagaaauguua

SEQ ID NO: 2060592 - RNA, 19 nt, Staphylococcus aureus subsp. aureus Mu50
aucaagaaauguuaaauua

SEQ ID NO: 2060593 - RNA, 23 nt, Staphylococcus aureus subsp. aureus Mu50
aucaaaauauaaaauccuaagca

SEQ ID NO: 2060594 - RNA, 18 nt, Staphylococcus aureus subsp. aureus Mu50
aucaaaaguuuguauauu

SEQ ID NO: 2060595 - RNA, 15 nt, Staphylococcus aureus subsp. aureus Mu50
aucaaacaacaucac

SEQ ID NO: 2060596 - RNA, 14 nt, Staphylococcus aureus subsp. aureus Mu50
aucaacacacacag

SEQ ID NO: 2060597 - RNA, 23 nt, Staphylococcus aureus subsp. aureus Mu50
aucaacacacacaguuuauaaua

SEQ ID NO: 2060598 - RNA, 12 nt, Staphylococcus aureus subsp. aureus Mu50
aucaacacacac

SEQ ID NO: 2060599 - RNA, 15 nt, Staphylococcus aureus subsp. aureus Mu50
aucaacaauuuaaac

SEQ ID NO: 2060600 - RNA, 17 nt, Staphylococcus aureus subsp. aureus Mu50
aucaacagcuucaaaau

SEQ ID NO: 2060601 - RNA, 14 nt, Staphylococcus aureus subsp. aureus Mu50
aucaacaaauuuaa

SEQ ID NO: 2060602 - RNA, 17 nt, Staphylococcus aureus subsp. aureus Mu50
aucaacaaauuuaacuu

SEQ ID NO: 2060603 - RNA, 19 nt, Staphylococcus aureus subsp. aureus Mu50
aucaauuauugaaaacaaa

SEQ ID NO: 2060604 - RNA, 13 nt, Staphylococcus aureus subsp. aureus Mu50
aucaauuagccaa

SEQ ID NO: 2060605 - RNA, 19 nt, Staphylococcus aureus subsp. aureus Mu50
aucaauuacucuuuuucuu

SEQ ID NO: 2060606 - RNA, 21 nt, Staphylococcus aureus subsp. aureus Mu50
aucaccuauuaggauccaauu

SEQ ID NO: 2060607 - RNA, 14 nt, Staphylococcus aureus subsp. aureus Mu50
aucacgauuuucaa

SEQ ID NO: 2060608 - RNA, 23 nt, Staphylococcus aureus subsp. aureus Mu50
aucacgauuuucaaguaaugaua

SEQ ID NO: 2060609 - RNA, 14 nt, Staphylococcus aureus subsp. aureus Mu50
aucacgugauaaug

SEQ ID NO: 2060610 - RNA, 21 nt, Staphylococcus aureus subsp. aureus Mu50
aucacuuuaggguucauugcu

SEQ ID NO: 2060611 - RNA, 17 nt, Staphylococcus aureus subsp. aureus Mu50
aucacuugguaaaacau

SEQ ID NO: 2060612 - RNA, 13 nt, Staphylococcus aureus subsp. aureus Mu50
aucacuuuuuaaa

SEQ ID NO: 2060613 - RNA, 16 nt, Staphylococcus aureus subsp. aureus Mu50
aucagacuaaaaugaa

SEQ ID NO: 2060614 - RNA, 12 nt, Staphylococcus aureus subsp. aureus Mu50
aucagacuaaaa

SEQ ID NO: 2060615 - RNA, 19 nt, Staphylococcus aureus subsp. aureus Mu50
aucauaauaagauuuuuua

SEQ ID NO: 2060616 - RNA, 16 nt, Staphylococcus aureus subsp. aureus Mu50
aucauagauauaagaa

SEQ ID NO: 2060617 - RNA, 13 nt, Staphylococcus aureus subsp. aureus Mu50
aucauaaaugacg

SEQ ID NO: 2060618 - RNA, 17 nt, Staphylococcus aureus subsp. aureus Mu50
aucauaaauauuuucug

SEQ ID NO: 2060619 - RNA, 24 nt, Staphylococcus aureus subsp. aureus Mu50
aucauaaauauuuucugcgauaua

SEQ ID NO: 2060620 - RNA, 13 nt, Staphylococcus aureus subsp. aureus Mu50
aucauaaaguaaa

SEQ ID NO: 2060621 - RNA, 17 nt, Staphylococcus aureus subsp. aureus Mu50
aucagugugauuuugga

SEQ ID NO: 2060622 - RNA, 16 nt, Staphylococcus aureus subsp. aureus Mu50
aucaguuauuuuaaua

SEQ ID NO: 2060623 - RNA, 14 nt, Staphylococcus aureus subsp. aureus Mu50
aucaguuuuugaau

SEQ ID NO: 2060624 - RNA, 17 nt, Staphylococcus aureus subsp. aureus Mu50
aucaguuuuugaauauu

SEQ ID NO: 2060625 - RNA, 15 nt, Staphylococcus aureus subsp. aureus Mu50
aaaacgauucauuau

SEQ ID NO: 2060626 - RNA, 21 nt, Staphylococcus aureus subsp. aureus Mu50
aaaacgauucauuauaugguu

SEQ ID NO: 2060627 - RNA, 18 nt, Staphylococcus aureus subsp. aureus Mu50
aucauccauaaaaauacg

SEQ ID NO: 2060628 - RNA, 15 nt, Staphylococcus aureus subsp. aureus Mu50
aucauccauaaaaau

SEQ ID NO: 2060629 - RNA, 20 nt, Staphylococcus aureus subsp. aureus Mu50
aucaucgcaaauacauaauc

SEQ ID NO: 2060630 - RNA, 18 nt, Staphylococcus aureus subsp. aureus Mu50
aaaacguugaguauuacu

SEQ ID NO: 2060631 - RNA, 17 nt, Staphylococcus aureus subsp. aureus Mu50
aucaucgccagcauuac

SEQ ID NO: 2060632 - RNA, 19 nt, Staphylococcus aureus subsp. aureus Mu50
aaaacuaaagguauucuau

SEQ ID NO: 2060633 - RNA, 21 nt, Staphylococcus aureus subsp. aureus Mu50
aucauauuugaauacuuuauu

SEQ ID NO: 2060634 - RNA, 12 nt, Staphylococcus aureus subsp. aureus Mu50
aucauaucauac

SEQ ID NO: 2060635 - RNA, 20 nt, Staphylococcus aureus subsp. aureus Mu50
aucaucaacaaucuuuuuca

SEQ ID NO: 2060636 - RNA, 16 nt, Staphylococcus aureus subsp. aureus Mu50
aucaucaaaguuuaau

SEQ ID NO: 2060637 - RNA, 22 nt, Staphylococcus aureus subsp. aureus Mu50
aucaucaaguucaccguaaucu

SEQ ID NO: 2060638 - RNA, 21 nt, Staphylococcus aureus subsp. aureus Mu50
aucaucaccauacuaaaacau

SEQ ID NO: 2060639 - RNA, 23 nt, Staphylococcus aureus subsp. aureus Mu50
auaugaauuuagaugcauaaaaa

SEQ ID NO: 2060640 - RNA, 13 nt, Staphylococcus aureus subsp. aureus Mu50
auaugaauuuuau

SEQ ID NO: 2060641 - RNA, 16 nt, Staphylococcus aureus subsp. aureus Mu50
auaugacacauacacc

SEQ ID NO: 2060642 - RNA, 20 nt, Staphylococcus aureus subsp. aureus Mu50
auaugaaucuagaauauaac

SEQ ID NO: 2060643 - RNA, 21 nt, Staphylococcus aureus subsp. aureus Mu50
auaugacgcgugaauuaaaaa

SEQ ID NO: 2060644 - RNA, 23 nt, Staphylococcus aureus subsp. aureus Mu50
auaugacgcgugaauuaaaaaau

SEQ ID NO: 2060645 - RNA, 16 nt, Staphylococcus aureus subsp. aureus Mu50
auaugacuuuauuucu

SEQ ID NO: 2060646 - RNA, 17 nt, Staphylococcus aureus subsp. aureus Mu50
auaugacuuuauuucua

SEQ ID NO: 2060647 - RNA, 20 nt, Staphylococcus aureus subsp. aureus Mu50
auaugauaaccaaaccauaa

SEQ ID NO: 2060648 - RNA, 17 nt, Staphylococcus aureus subsp. aureus Mu50
auaucuucauuuaaaag

SEQ ID NO: 2060649 - RNA, 15 nt, Staphylococcus aureus subsp. aureus Mu50
auaucuuuauuugau

SEQ ID NO: 2060650 - RNA, 23 nt, Staphylococcus aureus subsp. aureus Mu50
auaucuuaaucuaaaaauagaug

SEQ ID NO: 2060651 - RNA, 18 nt, Staphylococcus aureus subsp. aureus Mu50
auaucuaauucguaauuu

SEQ ID NO: 2060652 - RNA, 14 nt, Staphylococcus aureus subsp. aureus Mu50
auaucuacagagaa

SEQ ID NO: 2060653 - RNA, 17 nt, Staphylococcus aureus subsp. aureus Mu50
auaucuacagagaauca

SEQ ID NO: 2060654 - RNA, 16 nt, Staphylococcus aureus subsp. aureus Mu50
auaucgucguaacucu

SEQ ID NO: 2060655 - RNA, 15 nt, Staphylococcus aureus subsp. aureus Mu50
auaucucaagauauc

SEQ ID NO: 2060656 - RNA, 12 nt, Staphylococcus aureus subsp. aureus Mu50
auaucucaagau

SEQ ID NO: 2060657 - RNA, 17 nt, Staphylococcus aureus subsp. aureus Mu50
auaucgcgcaucaaaaa

SEQ ID NO: 2060658 - RNA, 17 nt, Staphylococcus aureus subsp. aureus Mu50
auaucgcuuuugaaguu

SEQ ID NO: 2060659 - RNA, 17 nt, Staphylococcus aureus subsp. aureus Mu50
auauccuucaaagauuu

SEQ ID NO: 2060660 - RNA, 14 nt, Staphylococcus aureus subsp. aureus Mu50
auauccuucauuag

SEQ ID NO: 2060661 - RNA, 14 nt, Staphylococcus aureus subsp. aureus Mu50
auaucgauaaaugu

SEQ ID NO: 2060662 - RNA, 21 nt, Staphylococcus aureus subsp. aureus Mu50
auaucgaugacuuugucuuua

SEQ ID NO: 2060663 - RNA, 19 nt, Staphylococcus aureus subsp. aureus Mu50
auaucaucaacaaucuuuu

SEQ ID NO: 2060664 - RNA, 18 nt, Staphylococcus aureus subsp. aureus Mu50
auaucaguaauaauacgc

SEQ ID NO: 2060665 - RNA, 16 nt, Staphylococcus aureus subsp. aureus Mu50
auaucauauaaugguu

SEQ ID NO: 2060666 - RNA, 18 nt, Staphylococcus aureus subsp. aureus Mu50
auaucauauucaaaauaa

SEQ ID NO: 2060667 - RNA, 17 nt, Staphylococcus aureus subsp. aureus Mu50
auaucaucucuaugucu

SEQ ID NO: 2060668 - RNA, 20 nt, Staphylococcus aureus subsp. aureus Mu50
auauccauucaauguuuaau

SEQ ID NO: 2060669 - RNA, 17 nt, Staphylococcus aureus subsp. aureus Mu50
auauccauuaugaugua

SEQ ID NO: 2060670 - RNA, 21 nt, Staphylococcus aureus subsp. aureus Mu50
auaucaaaaaauacguuuaau

SEQ ID NO: 2060671 - RNA, 16 nt, Staphylococcus aureus subsp. aureus Mu50
auauauuuauuuuuga

SEQ ID NO: 2060672 - RNA, 15 nt, Staphylococcus aureus subsp. aureus Mu50
auauauugucgacuu

SEQ ID NO: 2060673 - RNA, 21 nt, Staphylococcus aureus subsp. aureus Mu50
auauauuuggaggugaugaga

SEQ ID NO: 2060674 - RNA, 18 nt, Staphylococcus aureus subsp. aureus Mu50
auauauuuguauaugcaa

SEQ ID NO: 2060675 - RNA, 16 nt, Staphylococcus aureus subsp. aureus Mu50
auauacgacaaucaca

SEQ ID NO: 2060676 - RNA, 17 nt, Staphylococcus aureus subsp. aureus Mu50
auauacuaaauuugaaa

SEQ ID NO: 2060677 - RNA, 12 nt, Staphylococcus aureus subsp. aureus Mu50
auauacuugaag

SEQ ID NO: 2060678 - RNA, 11 nt, Staphylococcus aureus subsp. aureus Mu50
auauacuuuuu

SEQ ID NO: 2060679 - RNA, 18 nt, Staphylococcus aureus subsp. aureus Mu50
auauacuugccuucaaau

SEQ ID NO: 2060680 - RNA, 20 nt, Staphylococcus aureus subsp. aureus Mu50
auauagaagauauaacaugu

SEQ ID NO: 2060681 - RNA, 14 nt, Staphylococcus aureus subsp. aureus Mu50
auauagaaggggac

SEQ ID NO: 2060682 - RNA, 22 nt, Staphylococcus aureus subsp. aureus Mu50
auauagaaaacuagaacuuagu

SEQ ID NO: 2060683 - RNA, 19 nt, Staphylococcus aureus subsp. aureus Mu50
auauacuuuuuaaaugauu

SEQ ID NO: 2060684 - RNA, 11 nt, Staphylococcus aureus subsp. aureus Mu50
auauagaaaau

SEQ ID NO: 2060685 - RNA, 12 nt, Staphylococcus aureus subsp. aureus Mu50
auauaucaaaua

SEQ ID NO: 2060686 - RNA, 16 nt, Staphylococcus aureus subsp. aureus Mu50
auauaucaacguuaau

SEQ ID NO: 2060687 - RNA, 21 nt, Staphylococcus aureus subsp. aureus Mu50
auauauccugccaauauauuc

SEQ ID NO: 2060688 - RNA, 17 nt, Staphylococcus aureus subsp. aureus Mu50
auauaugaaauauuuau

SEQ ID NO: 2060689 - RNA, 14 nt, Staphylococcus aureus subsp. aureus Mu50
auauaugaaauauu

SEQ ID NO: 2060690 - RNA, 14 nt, Staphylococcus aureus subsp. aureus Mu50
auauaauagaaaua

SEQ ID NO: 2060691 - RNA, 17 nt, Staphylococcus aureus subsp. aureus Mu50
auauaaaggaauagcua

SEQ ID NO: 2060692 - RNA, 18 nt, Staphylococcus aureus subsp. aureus Mu50
auauaaaggaauagcuac

SEQ ID NO: 2060693 - RNA, 20 nt, Staphylococcus aureus subsp. aureus Mu50
auauaagaauuguugaucau

SEQ ID NO: 2060694 - RNA, 21 nt, Staphylococcus aureus subsp. aureus Mu50
auauaaugcugauaauuuuuc

SEQ ID NO: 2060695 - RNA, 14 nt, Staphylococcus aureus subsp. aureus Mu50
auauaaugguugaa

SEQ ID NO: 2060696 - RNA, 16 nt, Staphylococcus aureus subsp. aureus Mu50
auauaauguauaaaac

SEQ ID NO: 2060697 - RNA, 17 nt, Staphylococcus aureus subsp. aureus Mu50
auauaauguauaaaaca

SEQ ID NO: 2060698 - RNA, 17 nt, Staphylococcus aureus subsp. aureus Mu50
auauaauauacacaaaa

SEQ ID NO: 2060699 - RNA, 19 nt, Staphylococcus aureus subsp. aureus Mu50
auauaccuugauucauuuc

SEQ ID NO: 2060700 - RNA, 15 nt, Staphylococcus aureus subsp. aureus Mu50
auauaauuauuaaac

SEQ ID NO: 2060701 - RNA, 14 nt, Staphylococcus aureus subsp. aureus Mu50
auagcuacaauuaa

SEQ ID NO: 2060702 - RNA, 21 nt, Staphylococcus aureus subsp. aureus Mu50
auagcucaauugaaucuuugu

SEQ ID NO: 2060703 - RNA, 18 nt, Staphylococcus aureus subsp. aureus Mu50
auagcucuucuuuuucuu

SEQ ID NO: 2060704 - RNA, 19 nt, Staphylococcus aureus subsp. aureus Mu50
auagucuucggcuuuguaa

SEQ ID NO: 2060705 - RNA, 19 nt, Staphylococcus aureus subsp. aureus Mu50
auagugcuuguuuauuaca

SEQ ID NO: 2060706 - RNA, 17 nt, Staphylococcus aureus subsp. aureus Mu50
auaguuuuucauauuca

SEQ ID NO: 2060707 - RNA, 13 nt, Staphylococcus aureus subsp. aureus Mu50
auauaaaaacugu

SEQ ID NO: 2060708 - RNA, 16 nt, Staphylococcus aureus subsp. aureus Mu50
auauaaaaaauuauua

SEQ ID NO: 2060709 - RNA, 20 nt, Staphylococcus aureus subsp. aureus Mu50
auauaaaaaauuauuaaaaa

SEQ ID NO: 2060710 - RNA, 21 nt, Staphylococcus aureus subsp. aureus Mu50
auauaaaaagaagaucccuca

SEQ ID NO: 2060711 - RNA, 22 nt, Staphylococcus aureus subsp. aureus Mu50
auauaaaaagucccgcuuaaaa

SEQ ID NO: 2060712 - RNA, 20 nt, Staphylococcus aureus subsp. aureus Mu50
auauaaaaucauuaauaauu

SEQ ID NO: 2060713 - RNA, 21 nt, Staphylococcus aureus subsp. aureus Mu50
auaguuuauuaauauuaguga

SEQ ID NO: 2060714 - RNA, 18 nt, Staphylococcus aureus subsp. aureus Mu50
auaguucuuuaaauuaua

SEQ ID NO: 2060715 - RNA, 20 nt, Staphylococcus aureus subsp. aureus Mu50
auaguucuuuaaauuauaua

SEQ ID NO: 2060716 - RNA, 14 nt, Staphylococcus aureus subsp. aureus Mu50
auaguucuauauaa

SEQ ID NO: 2060717 - RNA, 14 nt, Staphylococcus aureus subsp. aureus Mu50
auaguucuuuaaau

SEQ ID NO: 2060718 - RNA, 16 nt, Staphylococcus aureus subsp. aureus Mu50
auaguucuuuaaauua

SEQ ID NO: 2060719 - RNA, 19 nt, Staphylococcus aureus subsp. aureus Mu50
auagacuuauauuaaucgu

SEQ ID NO: 2060720 - RNA, 14 nt, Staphylococcus aureus subsp. aureus Mu50
auagaaaauuaacu

SEQ ID NO: 2060721 - RNA, 14 nt, Staphylococcus aureus subsp. aureus Mu50
auagagaacagcag

SEQ ID NO: 2060722 - RNA, 17 nt, Staphylococcus aureus subsp. aureus Mu50
auagagaacuugcuuug

SEQ ID NO: 2060723 - RNA, 22 nt, Staphylococcus aureus subsp. aureus Mu50
auagaguaguucggaugagaaa

SEQ ID NO: 2060724 - RNA, 19 nt, Staphylococcus aureus subsp. aureus Mu50
auagagaaagaauaaaugu

SEQ ID NO: 2060725 - RNA, 15 nt, Staphylococcus aureus subsp. aureus Mu50
auagagaaagaauaa

SEQ ID NO: 2060726 - RNA, 22 nt, Staphylococcus aureus subsp. aureus Mu50
auagacuuucuugaugaauuaa

SEQ ID NO: 2060727 - RNA, 14 nt, Staphylococcus aureus subsp. aureus Mu50
auacuuuucucgau

SEQ ID NO: 2060728 - RNA, 18 nt, Staphylococcus aureus subsp. aureus Mu50
auacuuuuggucuguuga

SEQ ID NO: 2060729 - RNA, 16 nt, Staphylococcus aureus subsp. aureus Mu50
auagaaaaauuucaaa

SEQ ID NO: 2060730 - RNA, 20 nt, Staphylococcus aureus subsp. aureus Mu50
auagaaaaugaguacaacau

SEQ ID NO: 2060731 - RNA, 20 nt, Staphylococcus aureus subsp. aureus Mu50
auagaaaagggacagaaaag

SEQ ID NO: 2060732 - RNA, 22 nt, Staphylococcus aureus subsp. aureus Mu50
auagaugacuguagaaaacaug

SEQ ID NO: 2060733 - RNA, 19 nt, Staphylococcus aureus subsp. aureus Mu50
auagcaaaauuauguaaaa

SEQ ID NO: 2060734 - RNA, 21 nt, Staphylococcus aureus subsp. aureus Mu50
auagcaaaauuauguaaaaaa

SEQ ID NO: 2060735 - RNA, 15 nt, Staphylococcus aureus subsp. aureus Mu50
auagauugaaaaaau

SEQ ID NO: 2060736 - RNA, 16 nt, Staphylococcus aureus subsp. aureus Mu50
auagaugaaaauuuaa

SEQ ID NO: 2060737 - RNA, 13 nt, Staphylococcus aureus subsp. aureus Mu50
auagaucuuugua

SEQ ID NO: 2060738 - RNA, 17 nt, Staphylococcus aureus subsp. aureus Mu50
auagaugcauaaaaacc

SEQ ID NO: 2060739 - RNA, 15 nt, Staphylococcus aureus subsp. aureus Mu50
auagauuauauuauc

SEQ ID NO: 2060740 - RNA, 18 nt, Staphylococcus aureus subsp. aureus Mu50
auagcauuccuaauuaua

SEQ ID NO: 2060741 - RNA, 22 nt, Staphylococcus aureus subsp. aureus Mu50
auagcauuucuuuauuagaaug

SEQ ID NO: 2060742 - RNA, 14 nt, Staphylococcus aureus subsp. aureus Mu50
auagcgguguuuug

SEQ ID NO: 2060743 - RNA, 17 nt, Staphylococcus aureus subsp. aureus Mu50
auagcgguguuuugaga

SEQ ID NO: 2060744 - RNA, 22 nt, Staphylococcus aureus subsp. aureus Mu50
auagcgauuuuaaagaaaaguu

SEQ ID NO: 2060745 - RNA, 20 nt, Staphylococcus aureus subsp. aureus Mu50
auagcagguggcauccauau

SEQ ID NO: 2060746 - RNA, 21 nt, Staphylococcus aureus subsp. aureus Mu50
auagcauaaaaagagguuuuc

SEQ ID NO: 2060747 - RNA, 19 nt, Staphylococcus aureus subsp. aureus Mu50
auagcauaaaauuucugcu

SEQ ID NO: 2060748 - RNA, 13 nt, Staphylococcus aureus subsp. aureus Mu50
auagcauuucuuu

SEQ ID NO: 2060749 - RNA, 17 nt, Staphylococcus aureus subsp. aureus Mu50
auagcaauuuucgauau

SEQ ID NO: 2060750 - RNA, 21 nt, Staphylococcus aureus subsp. aureus Mu50
auagcaaauugauuaaauaaa

SEQ ID NO: 2060751 - RNA, 18 nt, Staphylococcus aureus subsp. aureus Mu50
auagcaaccauauuuuua

SEQ ID NO: 2060752 - RNA, 16 nt, Staphylococcus aureus subsp. aureus Mu50
auacuauaugaaaaga

SEQ ID NO: 2060753 - RNA, 14 nt, Staphylococcus aureus subsp. aureus Mu50
auacuauuauucca

SEQ ID NO: 2060754 - RNA, 21 nt, Staphylococcus aureus subsp. aureus Mu50
auacuauaugucuuaucaauu

SEQ ID NO: 2060755 - RNA, 19 nt, Staphylococcus aureus subsp. aureus Mu50
auacucaucuguccgauau

SEQ ID NO: 2060756 - RNA, 16 nt, Staphylococcus aureus subsp. aureus Mu50
auacucuaacuuacca

SEQ ID NO: 2060757 - RNA, 17 nt, Staphylococcus aureus subsp. aureus Mu50
auacucugggcauuuug

SEQ ID NO: 2060758 - RNA, 18 nt, Staphylococcus aureus subsp. aureus Mu50
auacucugggcauuuuga

SEQ ID NO: 2060759 - RNA, 18 nt, Staphylococcus aureus subsp. aureus Mu50
auacugccccaaauguaa

SEQ ID NO: 2060760 - RNA, 16 nt, Staphylococcus aureus subsp. aureus Mu50
auacugccauauguuu

SEQ ID NO: 2060761 - RNA, 14 nt, Staphylococcus aureus subsp. aureus Mu50
auacuuaauuuaaa

SEQ ID NO: 2060762 - RNA, 13 nt, Staphylococcus aureus subsp. aureus Mu50
auacuucuauuuu

SEQ ID NO: 2060763 - RNA, 19 nt, Staphylococcus aureus subsp. aureus Mu50
auacuucuauuuuauaaua

SEQ ID NO: 2060764 - RNA, 19 nt, Staphylococcus aureus subsp. aureus Mu50
auacuucaaacguauguac

SEQ ID NO: 2060765 - RNA, 18 nt, Staphylococcus aureus subsp. aureus Mu50
auacuucaccacauaaaa

SEQ ID NO: 2060766 - RNA, 17 nt, Staphylococcus aureus subsp. aureus Mu50
auacuucaccaucuuua

SEQ ID NO: 2060767 - RNA, 16 nt, Staphylococcus aureus subsp. aureus Mu50
auacuuucaaacaaau

SEQ ID NO: 2060768 - RNA, 16 nt, Staphylococcus aureus subsp. aureus Mu50
auacuugaauuuaaua

SEQ ID NO: 2060769 - RNA, 23 nt, Staphylococcus aureus subsp. aureus Mu50
auacuugaagcaucgauuuauua

SEQ ID NO: 2060770 - RNA, 21 nt, Staphylococcus aureus subsp. aureus Mu50
auacuugaagcaucgauuuau

SEQ ID NO: 2060771 - RNA, 13 nt, Staphylococcus aureus subsp. aureus Mu50
auacuucuuguuc

SEQ ID NO: 2060772 - RNA, 15 nt, Staphylococcus aureus subsp. aureus Mu50
auacaggaaauugaa

SEQ ID NO: 2060773 - RNA, 15 nt, Staphylococcus aureus subsp. aureus Mu50
auaccugcauauuca

SEQ ID NO: 2060774 - RNA, 22 nt, Staphylococcus aureus subsp. aureus Mu50
auaccugguucgauuguaauaa

SEQ ID NO: 2060775 - RNA, 20 nt, Staphylococcus aureus subsp. aureus Mu50
auaccucauccgccaauuaa

SEQ ID NO: 2060776 - RNA, 13 nt, Staphylococcus aureus subsp. aureus Mu50
auacgacaaucac

SEQ ID NO: 2060777 - RNA, 14 nt, Staphylococcus aureus subsp. aureus Mu50
auacgacuugaaau

SEQ ID NO: 2060778 - RNA, 23 nt, Staphylococcus aureus subsp. aureus Mu50
auacgacuugaaaucuuuuguaa

SEQ ID NO: 2060779 - RNA, 21 nt, Staphylococcus aureus subsp. aureus Mu50
auaccuuuuaauuuaguuaua

SEQ ID NO: 2060780 - RNA, 14 nt, Staphylococcus aureus subsp. aureus Mu50
auaccuuuuucuaa

SEQ ID NO: 2060781 - RNA, 14 nt, Staphylococcus aureus subsp. aureus Mu50
auaccuuuaauauc

SEQ ID NO: 2060782 - RNA, 19 nt, Staphylococcus aureus subsp. aureus Mu50
auaccuuugccguauuuca

SEQ ID NO: 2060783 - RNA, 15 nt, Staphylococcus aureus subsp. aureus Mu50
auaccuuuaauaucu

SEQ ID NO: 2060784 - RNA, 18 nt, Staphylococcus aureus subsp. aureus Mu50
auacgccuaaauauuuac

SEQ ID NO: 2060785 - RNA, 22 nt, Staphylococcus aureus subsp. aureus Mu50
auacgcaaucauuguaaaugau

SEQ ID NO: 2060786 - RNA, 16 nt, Staphylococcus aureus subsp. aureus Mu50
auacgauugcaauugc

SEQ ID NO: 2060787 - RNA, 16 nt, Staphylococcus aureus subsp. aureus Mu50
auacgaauuaaaauaa

SEQ ID NO: 2060788 - RNA, 18 nt, Staphylococcus aureus subsp. aureus Mu50
aucgaauugguaaaaauc

SEQ ID NO: 2060789 - RNA, 20 nt, Staphylococcus aureus subsp. aureus Mu50
aucgaauaacuguuuaucau

SEQ ID NO: 2060790 - RNA, 23 nt, Staphylococcus aureus subsp. aureus Mu50
aucgacuaauuuuucuuucaggc

SEQ ID NO: 2060791 - RNA, 15 nt, Staphylococcus aureus subsp. aureus Mu50
aucgccaaucuauug

SEQ ID NO: 2060792 - RNA, 20 nt, Staphylococcus aureus subsp. aureus Mu50
aucgaguuugaaauaaucua

SEQ ID NO: 2060793 - RNA, 18 nt, Staphylococcus aureus subsp. aureus Mu50
aucgauauagcauaaaau

SEQ ID NO: 2060794 - RNA, 19 nt, Staphylococcus aureus subsp. aureus Mu50
aucgauauugagaauauua

SEQ ID NO: 2060795 - RNA, 17 nt, Staphylococcus aureus subsp. aureus Mu50
aucgcauguuuguaaau

SEQ ID NO: 2060796 - RNA, 15 nt, Staphylococcus aureus subsp. aureus Mu50
auccuggaauauuaa

SEQ ID NO: 2060797 - RNA, 21 nt, Staphylococcus aureus subsp. aureus Mu50
auccuguguaaaauaaaucau

SEQ ID NO: 2060798 - RNA, 14 nt, Staphylococcus aureus subsp. aureus Mu50
aucgaacuagacaa

SEQ ID NO: 2060799 - RNA, 21 nt, Staphylococcus aureus subsp. aureus Mu50
auccuuuaaugcuuuagcauu

SEQ ID NO: 2060800 - RNA, 15 nt, Staphylococcus aureus subsp. aureus Mu50
aucgguaauuacuug

SEQ ID NO: 2060801 - RNA, 19 nt, Staphylococcus aureus subsp. aureus Mu50
aucguaaacacuauaaaag

SEQ ID NO: 2060802 - RNA, 15 nt, Staphylococcus aureus subsp. aureus Mu50
aucguaaaaaacaaa

SEQ ID NO: 2060803 - RNA, 16 nt, Staphylococcus aureus subsp. aureus Mu50
aucgcuugcuucuuuc

SEQ ID NO: 2060804 - RNA, 17 nt, Staphylococcus aureus subsp. aureus Mu50
aucggaauaaaauaaau

SEQ ID NO: 2060805 - RNA, 15 nt, Staphylococcus aureus subsp. aureus Mu50
aucggaauaaaauaa

SEQ ID NO: 2060806 - RNA, 15 nt, Staphylococcus aureus subsp. aureus Mu50
aucccuguaaaacca

SEQ ID NO: 2060807 - RNA, 21 nt, Staphylococcus aureus subsp. aureus Mu50
auccgaauucuccguuaauuu

SEQ ID NO: 2060808 - RNA, 17 nt, Staphylococcus aureus subsp. aureus Mu50
auccgccaauuaaaauu

SEQ ID NO: 2060809 - RNA, 17 nt, Staphylococcus aureus subsp. aureus Mu50
auccccgagcaauucuu

SEQ ID NO: 2060810 - RNA, 23 nt, Staphylococcus aureus subsp. aureus Mu50
aucccccgccacuaugugaagug

SEQ ID NO: 2060811 - RNA, 21 nt, Staphylococcus aureus subsp. aureus Mu50
auccauucuaacgguaaauaa

SEQ ID NO: 2060812 - RNA, 15 nt, Staphylococcus aureus subsp. aureus Mu50
auccauugaucuuuu

SEQ ID NO: 2060813 - RNA, 13 nt, Staphylococcus aureus subsp. aureus Mu50
auccauucaaugu

SEQ ID NO: 2060814 - RNA, 16 nt, Staphylococcus aureus subsp. aureus Mu50
auccaccaaauacagu

SEQ ID NO: 2060815 - RNA, 20 nt, Staphylococcus aureus subsp. aureus Mu50
auccacuuuauaauuuuuga

SEQ ID NO: 2060816 - RNA, 23 nt, Staphylococcus aureus subsp. aureus Mu50
auccacuuuauaauuuuugagua

SEQ ID NO: 2060817 - RNA, 22 nt, Staphylococcus aureus subsp. aureus Mu50
aucauuuguguuuuuaauguuu

SEQ ID NO: 2060818 - RNA, 15 nt, Staphylococcus aureus subsp. aureus Mu50
aucauuuucaauacu

SEQ ID NO: 2060819 - RNA, 22 nt, Staphylococcus aureus subsp. aureus Mu50
aucauuuucaacauaauauuuc

SEQ ID NO: 2060820 - RNA, 18 nt, Staphylococcus aureus subsp. aureus Mu50
aucauuuguguuuuuaau

SEQ ID NO: 2060821 - RNA, 20 nt, Staphylococcus aureus subsp. aureus Mu50
aucauuuugccucguccauu

SEQ ID NO: 2060822 - RNA, 14 nt, Staphylococcus aureus subsp. aureus Mu50
auccaaaacauuuu

SEQ ID NO: 2060823 - RNA, 23 nt, Staphylococcus aureus subsp. aureus Mu50
auccaaggauguuauaaaaugaa

SEQ ID NO: 2060824 - RNA, 24 nt, Staphylococcus aureus subsp. aureus Mu50
auccaagcgcuucaggcauaacug

SEQ ID NO: 2060825 - RNA, 20 nt, Staphylococcus aureus subsp. aureus Mu50
auccaagugacaacauuauu

SEQ ID NO: 2060826 - RNA, 13 nt, Staphylococcus aureus subsp. aureus Mu50
auccaauguauaa

SEQ ID NO: 2060827 - RNA, 14 nt, Staphylococcus aureus subsp. aureus Mu50
aaaacuacauuugg

SEQ ID NO: 2060828 - RNA, 14 nt, Staphylococcus aureus subsp. aureus Mu50
aaaacuaaucaaau

SEQ ID NO: 2060829 - RNA, 20 nt, Staphylococcus aureus subsp. aureus Mu50
aaaacuaaucaaauuaguca

SEQ ID NO: 2060830 - RNA, 16 nt, Staphylococcus aureus subsp. aureus Mu50
aaaacuacugauuuau

SEQ ID NO: 2060831 - RNA, 19 nt, Staphylococcus aureus subsp. aureus Mu50
aucauguucuuauaaaaaa

SEQ ID NO: 2060832 - RNA, 16 nt, Staphylococcus aureus subsp. aureus Mu50
aaaacuacauuugguu

SEQ ID NO: 2060833 - RNA, 22 nt, Staphylococcus aureus subsp. aureus Mu50
aucauuaaauugcuugaaauua

SEQ ID NO: 2060834 - RNA, 20 nt, Staphylococcus aureus subsp. aureus Mu50
aucauguucuuauaaaaaac

SEQ ID NO: 2060835 - RNA, 22 nt, Staphylococcus aureus subsp. aureus Mu50
aucauguucuuauaaaaaacaa

SEQ ID NO: 2060836 - RNA, 19 nt, Staphylococcus aureus subsp. aureus Mu50
aucauuaguguagaaaaua

SEQ ID NO: 2060837 - RNA, 20 nt, Staphylococcus aureus subsp. aureus Mu50
aucauuaguguagaaaauag

SEQ ID NO: 2060838 - RNA, 23 nt, Staphylococcus aureus subsp. aureus Mu50
aaaacuuccugcuuuuuuuauaa

SEQ ID NO: 2060839 - RNA, 14 nt, Staphylococcus aureus subsp. aureus Mu50
aucauuagauaaua

SEQ ID NO: 2060840 - RNA, 18 nt, Staphylococcus aureus subsp. aureus Mu50
aaaacuuguuguuauuua

SEQ ID NO: 2060841 - RNA, 22 nt, Staphylococcus aureus subsp. aureus Mu50
aaaacuuguaaucauaccagca

SEQ ID NO: 2060842 - RNA, 19 nt, Staphylococcus aureus subsp. aureus Mu50
aucauuuaaaauauuuuuu

SEQ ID NO: 2060843 - RNA, 19 nt, Staphylococcus aureus subsp. aureus Mu50
aucauuuaaauuaguuaua

SEQ ID NO: 2060844 - RNA, 23 nt, Staphylococcus aureus subsp. aureus Mu50
aucauuuaaauuaguuauacuaa

SEQ ID NO: 2060845 - RNA, 23 nt, Staphylococcus aureus subsp. aureus Mu50
aucauuguguccauaaauauuaa

SEQ ID NO: 2060846 - RNA, 13 nt, Staphylococcus aureus subsp. aureus Mu50
aucauuguggcuu

SEQ ID NO: 2060847 - RNA, 22 nt, Staphylococcus aureus subsp. aureus Mu50
aucauuguguccauaaauauua

SEQ ID NO: 2060848 - RNA, 13 nt, Staphylococcus aureus subsp. aureus Mu50
aucauucaccuug

SEQ ID NO: 2060849 - RNA, 15 nt, Staphylococcus aureus subsp. aureus Mu50
aucauuucaaauaag

SEQ ID NO: 2060850 - RNA, 16 nt, Staphylococcus aureus subsp. aureus Mu50
aucauuucaaauaaga

SEQ ID NO: 2060851 - RNA, 22 nt, Staphylococcus aureus subsp. aureus Mu50
aucauuugugcguuucaaugag

SEQ ID NO: 2060852 - RNA, 16 nt, Staphylococcus aureus subsp. aureus Mu50
aucauuuguguauaaa

SEQ ID NO: 2060853 - RNA, 14 nt, Staphylococcus aureus subsp. aureus Mu50
aucauuucaaauaa

SEQ ID NO: 2060854 - RNA, 19 nt, Staphylococcus aureus subsp. aureus Mu50
aucauuauucgcaucucca

SEQ ID NO: 2060855 - RNA, 22 nt, Staphylococcus aureus subsp. aureus Mu50
aucauuaguuuuuaaaauuauc

SEQ ID NO: 2060856 - RNA, 13 nt, Staphylococcus aureus subsp. aureus Mu50
aucauuauaaaau

SEQ ID NO: 2060857 - RNA, 14 nt, Staphylococcus aureus subsp. aureus Mu50
aucauuauaaaaug

SEQ ID NO: 2060858 - RNA, 20 nt, Staphylococcus aureus subsp. aureus Mu50
aucuuaaagauuuuucagcu

SEQ ID NO: 2060859 - RNA, 14 nt, Staphylococcus aureus subsp. aureus Mu50
aucuguuucuuguu

SEQ ID NO: 2060860 - RNA, 14 nt, Staphylococcus aureus subsp. aureus Mu50
aucuguccauuuau

SEQ ID NO: 2060861 - RNA, 18 nt, Staphylococcus aureus subsp. aureus Mu50
aucugacauuucaucaau

SEQ ID NO: 2060862 - RNA, 13 nt, Staphylococcus aureus subsp. aureus Mu50
aucuuaucaagaa

SEQ ID NO: 2060863 - RNA, 20 nt, Staphylococcus aureus subsp. aureus Mu50
aucuuauaacaaaaauugcu

SEQ ID NO: 2060864 - RNA, 14 nt, Staphylococcus aureus subsp. aureus Mu50
aucuuauuauuaau

SEQ ID NO: 2060865 - RNA, 20 nt, Staphylococcus aureus subsp. aureus Mu50
aucuuacugcugcuuuuaau

SEQ ID NO: 2060866 - RNA, 21 nt, Staphylococcus aureus subsp. aureus Mu50
aucuuagacgcuguuuuaaau

SEQ ID NO: 2060867 - RNA, 20 nt, Staphylococcus aureus subsp. aureus Mu50
aucuuaggugucaucgcuuu

SEQ ID NO: 2060868 - RNA, 16 nt, Staphylococcus aureus subsp. aureus Mu50
aucuuaccuuuauguu

SEQ ID NO: 2060869 - RNA, 19 nt, Staphylococcus aureus subsp. aureus Mu50
aucuuacauugauaaaaua

SEQ ID NO: 2060870 - RNA, 15 nt, Staphylococcus aureus subsp. aureus Mu50
aucuuaaucuaaaaa

SEQ ID NO: 2060871 - RNA, 16 nt, Staphylococcus aureus subsp. aureus Mu50
aucuuaacaacuuuaa

SEQ ID NO: 2060872 - RNA, 18 nt, Staphylococcus aureus subsp. aureus Mu50
aucuuaacaacuuuaauu

SEQ ID NO: 2060873 - RNA, 23 nt, Staphylococcus aureus subsp. aureus Mu50
aucuuaacaacuuuaauuuuuca

SEQ ID NO: 2060874 - RNA, 22 nt, Staphylococcus aureus subsp. aureus Mu50
aucuuaauauugauuaaucuau

SEQ ID NO: 2060875 - RNA, 19 nt, Staphylococcus aureus subsp. aureus Mu50
aucuuaaucagcuauaaaa

SEQ ID NO: 2060876 - RNA, 22 nt, Staphylococcus aureus subsp. aureus Mu50
aucuuaaguacauaaaugcuaa

SEQ ID NO: 2060877 - RNA, 14 nt, Staphylococcus aureus subsp. aureus Mu50
aucuucaguauaga

SEQ ID NO: 2060878 - RNA, 18 nt, Staphylococcus aureus subsp. aureus Mu50
aucuucacgcuuauucga

SEQ ID NO: 2060879 - RNA, 22 nt, Staphylococcus aureus subsp. aureus Mu50
aucuucaacuucgauaugauua

SEQ ID NO: 2060880 - RNA, 16 nt, Staphylococcus aureus subsp. aureus Mu50
aucuucaauauuuaaa

SEQ ID NO: 2060881 - RNA, 15 nt, Staphylococcus aureus subsp. aureus Mu50
aucuauaaaaagaau

SEQ ID NO: 2060882 - RNA, 14 nt, Staphylococcus aureus subsp. aureus Mu50
aucuauauaaaaac

SEQ ID NO: 2060883 - RNA, 19 nt, Staphylococcus aureus subsp. aureus Mu50
aucuauacaauuauggaua

SEQ ID NO: 2060884 - RNA, 23 nt, Staphylococcus aureus subsp. aureus Mu50
aucuauaaaaagaauaugauauu

SEQ ID NO: 2060885 - RNA, 20 nt, Staphylococcus aureus subsp. aureus Mu50
aucuaugcccgugaugggua

SEQ ID NO: 2060886 - RNA, 13 nt, Staphylococcus aureus subsp. aureus Mu50
aucuaucuugugc

SEQ ID NO: 2060887 - RNA, 21 nt, Staphylococcus aureus subsp. aureus Mu50
aucuauaauaccuaauugcuu

SEQ ID NO: 2060888 - RNA, 14 nt, Staphylococcus aureus subsp. aureus Mu50
aucucauaauaauu

SEQ ID NO: 2060889 - RNA, 16 nt, Staphylococcus aureus subsp. aureus Mu50
aucguauucuuuuaau

SEQ ID NO: 2060890 - RNA, 14 nt, Staphylococcus aureus subsp. aureus Mu50
aucuacaauauuaa

SEQ ID NO: 2060891 - RNA, 18 nt, Staphylococcus aureus subsp. aureus Mu50
aucgucaucacuuuuuaa

SEQ ID NO: 2060892 - RNA, 15 nt, Staphylococcus aureus subsp. aureus Mu50
aucuagaugaaauug

SEQ ID NO: 2060893 - RNA, 18 nt, Staphylococcus aureus subsp. aureus Mu50
aucuacagagaaucaauu

SEQ ID NO: 2060894 - RNA, 19 nt, Staphylococcus aureus subsp. aureus Mu50
aucuacaauauuaaaauua

SEQ ID NO: 2060895 - RNA, 11 nt, Staphylococcus aureus subsp. aureus Mu50
aucucugaaaa

SEQ ID NO: 2060896 - RNA, 18 nt, Staphylococcus aureus subsp. aureus Mu50
aucucugcuuuaauauaa

SEQ ID NO: 2060897 - RNA, 17 nt, Staphylococcus aureus subsp. aureus Mu50
aucucuuuuugauuaua

SEQ ID NO: 2060898 - RNA, 19 nt, Staphylococcus aureus subsp. aureus Mu50
aucugaaaauaucacugaa

SEQ ID NO: 2060899 - RNA, 18 nt, Staphylococcus aureus subsp. aureus Mu50
augauauuaccuucaagu

SEQ ID NO: 2060900 - RNA, 15 nt, Staphylococcus aureus subsp. aureus Mu50
augauauuuaacaaa

SEQ ID NO: 2060901 - RNA, 16 nt, Staphylococcus aureus subsp. aureus Mu50
augauauugaaagugu

SEQ ID NO: 2060902 - RNA, 19 nt, Staphylococcus aureus subsp. aureus Mu50
augauagcgugauuuuuca

SEQ ID NO: 2060903 - RNA, 19 nt, Staphylococcus aureus subsp. aureus Mu50
augauagcaaugaauuaau

SEQ ID NO: 2060904 - RNA, 16 nt, Staphylococcus aureus subsp. aureus Mu50
augauagcuaaacauu

SEQ ID NO: 2060905 - RNA, 13 nt, Staphylococcus aureus subsp. aureus Mu50
augauauauguaa

SEQ ID NO: 2060906 - RNA, 16 nt, Staphylococcus aureus subsp. aureus Mu50
augauauccaaagcuu

SEQ ID NO: 2060907 - RNA, 20 nt, Staphylococcus aureus subsp. aureus Mu50
augauagccgcuucauugau

SEQ ID NO: 2060908 - RNA, 21 nt, Staphylococcus aureus subsp. aureus Mu50
augauacgcuuuuuaaaaaau

SEQ ID NO: 2060909 - RNA, 22 nt, Staphylococcus aureus subsp. aureus Mu50
augauacgcuuuuuaaaaaauu

SEQ ID NO: 2060910 - RNA, 16 nt, Staphylococcus aureus subsp. aureus Mu50
augauacucaauaaaa

SEQ ID NO: 2060911 - RNA, 17 nt, Staphylococcus aureus subsp. aureus Mu50
augauacucaauaaaau

SEQ ID NO: 2060912 - RNA, 19 nt, Staphylococcus aureus subsp. aureus Mu50
augauacgcuuuuuaaaaa

SEQ ID NO: 2060913 - RNA, 20 nt, Staphylococcus aureus subsp. aureus Mu50
augauacauuauuaaauaga

SEQ ID NO: 2060914 - RNA, 15 nt, Staphylococcus aureus subsp. aureus Mu50
augauaauuaaugcc

SEQ ID NO: 2060915 - RNA, 16 nt, Staphylococcus aureus subsp. aureus Mu50
augauaauuaauuaaa

SEQ ID NO: 2060916 - RNA, 14 nt, Staphylococcus aureus subsp. aureus Mu50
augauaagaaucau

SEQ ID NO: 2060917 - RNA, 14 nt, Staphylococcus aureus subsp. aureus Mu50
augauaauaagaau

SEQ ID NO: 2060918 - RNA, 16 nt, Staphylococcus aureus subsp. aureus Mu50
augauaauaagaauau

SEQ ID NO: 2060919 - RNA, 17 nt, Staphylococcus aureus subsp. aureus Mu50
augaguugaagcuaauu

SEQ ID NO: 2060920 - RNA, 19 nt, Staphylococcus aureus subsp. aureus Mu50
augauaaccauuaugauua

SEQ ID NO: 2060921 - RNA, 20 nt, Staphylococcus aureus subsp. aureus Mu50
augauaaccaaucaucgcaa

SEQ ID NO: 2060922 - RNA, 14 nt, Staphylococcus aureus subsp. aureus Mu50
augaguuuaaaaau

SEQ ID NO: 2060923 - RNA, 18 nt, Staphylococcus aureus subsp. aureus Mu50
augaguuuacuaaacuuu

SEQ ID NO: 2060924 - RNA, 19 nt, Staphylococcus aureus subsp. aureus Mu50
augauaaaaauaaaaccga

SEQ ID NO: 2060925 - RNA, 16 nt, Staphylococcus aureus subsp. aureus Mu50
augacuuuuuauuagu

SEQ ID NO: 2060926 - RNA, 23 nt, Staphylococcus aureus subsp. aureus Mu50
augacuuuuuauuaguauucaaa

SEQ ID NO: 2060927 - RNA, 15 nt, Staphylococcus aureus subsp. aureus Mu50
augagcgcauaaauu

SEQ ID NO: 2060928 - RNA, 19 nt, Staphylococcus aureus subsp. aureus Mu50
augagcuucuuuaaauaca

SEQ ID NO: 2060929 - RNA, 19 nt, Staphylococcus aureus subsp. aureus Mu50
augagguucaguagaauug

SEQ ID NO: 2060930 - RNA, 15 nt, Staphylococcus aureus subsp. aureus Mu50
augacaguaaucaaa

SEQ ID NO: 2060931 - RNA, 15 nt, Staphylococcus aureus subsp. aureus Mu50
augacauccauacaa

SEQ ID NO: 2060932 - RNA, 18 nt, Staphylococcus aureus subsp. aureus Mu50
augacauuuaauacuuuu

SEQ ID NO: 2060933 - RNA, 14 nt, Staphylococcus aureus subsp. aureus Mu50
augacgugcuuuua

SEQ ID NO: 2060934 - RNA, 16 nt, Staphylococcus aureus subsp. aureus Mu50
augacgugcuuuuaaa

SEQ ID NO: 2060935 - RNA, 21 nt, Staphylococcus aureus subsp. aureus Mu50
augacgugcuuuuaaauguau

SEQ ID NO: 2060936 - RNA, 14 nt, Staphylococcus aureus subsp. aureus Mu50
augacuaacgaaaa

SEQ ID NO: 2060937 - RNA, 15 nt, Staphylococcus aureus subsp. aureus Mu50
augacuuauuuuuca

SEQ ID NO: 2060938 - RNA, 18 nt, Staphylococcus aureus subsp. aureus Mu50
augacuuauuuuucauca

SEQ ID NO: 2060939 - RNA, 19 nt, Staphylococcus aureus subsp. aureus Mu50
augacuuauuuuucaucau

SEQ ID NO: 2060940 - RNA, 20 nt, Staphylococcus aureus subsp. aureus Mu50
augacugagaaaaauauuuc

SEQ ID NO: 2060941 - RNA, 23 nt, Staphylococcus aureus subsp. aureus Mu50
augacugagaaaaauauuucuaa

SEQ ID NO: 2060942 - RNA, 19 nt, Staphylococcus aureus subsp. aureus Mu50
augacuacaacuuaagagu

SEQ ID NO: 2060943 - RNA, 13 nt, Staphylococcus aureus subsp. aureus Mu50
augacucacuaau

SEQ ID NO: 2060944 - RNA, 14 nt, Staphylococcus aureus subsp. aureus Mu50
augacuauuuucca

SEQ ID NO: 2060945 - RNA, 15 nt, Staphylococcus aureus subsp. aureus Mu50
augaauuguuaguuu

SEQ ID NO: 2060946 - RNA, 18 nt, Staphylococcus aureus subsp. aureus Mu50
augaauuguuguacaugu

SEQ ID NO: 2060947 - RNA, 15 nt, Staphylococcus aureus subsp. aureus Mu50
augaauuuuuauuuu

SEQ ID NO: 2060948 - RNA, 19 nt, Staphylococcus aureus subsp. aureus Mu50
augaauuucuaauuuagua

SEQ ID NO: 2060949 - RNA, 22 nt, Staphylococcus aureus subsp. aureus Mu50
augaauuuuaauauauuuggag

SEQ ID NO: 2060950 - RNA, 14 nt, Staphylococcus aureus subsp. aureus Mu50
augaauuuuauaaa

SEQ ID NO: 2060951 - RNA, 22 nt, Staphylococcus aureus subsp. aureus Mu50
augaaguaauauauaaaagucg

SEQ ID NO: 2060952 - RNA, 21 nt, Staphylococcus aureus subsp. aureus Mu50
augaaggcuuuuuguuuugaa

SEQ ID NO: 2060953 - RNA, 19 nt, Staphylococcus aureus subsp. aureus Mu50
augaaucccauaaugacua

SEQ ID NO: 2060954 - RNA, 22 nt, Staphylococcus aureus subsp. aureus Mu50
augaaucagaugauuuaauucu

SEQ ID NO: 2060955 - RNA, 13 nt, Staphylococcus aureus subsp. aureus Mu50
augaaucaauugc

SEQ ID NO: 2060956 - RNA, 22 nt, Staphylococcus aureus subsp. aureus Mu50
augaauccugugacucaaugau

SEQ ID NO: 2060957 - RNA, 15 nt, Staphylococcus aureus subsp. aureus Mu50
augaaucgauauaau

SEQ ID NO: 2060958 - RNA, 18 nt, Staphylococcus aureus subsp. aureus Mu50
augaaucgauauaaugaa

SEQ ID NO: 2060959 - RNA, 17 nt, Staphylococcus aureus subsp. aureus Mu50
augaaucuagaauauaa

SEQ ID NO: 2060960 - RNA, 18 nt, Staphylococcus aureus subsp. aureus Mu50
augaaucuagaauauaac

SEQ ID NO: 2060961 - RNA, 17 nt, Staphylococcus aureus subsp. aureus Mu50
augaaucgcauuuaaau

SEQ ID NO: 2060962 - RNA, 13 nt, Staphylococcus aureus subsp. aureus Mu50
augaaccaaaaaa

SEQ ID NO: 2060963 - RNA, 14 nt, Staphylococcus aureus subsp. aureus Mu50
augaacauaccugc

SEQ ID NO: 2060964 - RNA, 22 nt, Staphylococcus aureus subsp. aureus Mu50
augaaccagcuaaccaaauaau

SEQ ID NO: 2060965 - RNA, 21 nt, Staphylococcus aureus subsp. aureus Mu50
augaaccagcuaaccaaauaa

SEQ ID NO: 2060966 - RNA, 15 nt, Staphylococcus aureus subsp. aureus Mu50
augaacaacaaauug

SEQ ID NO: 2060967 - RNA, 18 nt, Staphylococcus aureus subsp. aureus Mu50
augaaauuucaguaucau

SEQ ID NO: 2060968 - RNA, 19 nt, Staphylococcus aureus subsp. aureus Mu50
augaacaaaaaauaaaaac

SEQ ID NO: 2060969 - RNA, 14 nt, Staphylococcus aureus subsp. aureus Mu50
augaacaaaauaac

SEQ ID NO: 2060970 - RNA, 18 nt, Staphylococcus aureus subsp. aureus Mu50
augaacaaaauaacaugu

SEQ ID NO: 2060971 - RNA, 16 nt, Staphylococcus aureus subsp. aureus Mu50
augaaauuguguugaa

SEQ ID NO: 2060972 - RNA, 21 nt, Staphylococcus aureus subsp. aureus Mu50
augaaauuguguugaaucaac

SEQ ID NO: 2060973 - RNA, 20 nt, Staphylococcus aureus subsp. aureus Mu50
augaaaguaccuaaaauaga

SEQ ID NO: 2060974 - RNA, 22 nt, Staphylococcus aureus subsp. aureus Mu50
augaaaguaccuaaaauagaaa

SEQ ID NO: 2060975 - RNA, 19 nt, Staphylococcus aureus subsp. aureus Mu50
augaaaauauagugguggu

SEQ ID NO: 2060976 - RNA, 23 nt, Staphylococcus aureus subsp. aureus Mu50
augaaaauaccucuacauuauau

SEQ ID NO: 2060977 - RNA, 11 nt, Staphylococcus aureus subsp. aureus Mu50
augaaaaguug

SEQ ID NO: 2060978 - RNA, 22 nt, Staphylococcus aureus subsp. aureus Mu50
augaaauaacaauagugacuuu

SEQ ID NO: 2060979 - RNA, 16 nt, Staphylococcus aureus subsp. aureus Mu50
augaaaacagguggaa

SEQ ID NO: 2060980 - RNA, 19 nt, Staphylococcus aureus subsp. aureus Mu50
aucuuuuccauucauaaaa

SEQ ID NO: 2060981 - RNA, 23 nt, Staphylococcus aureus subsp. aureus Mu50
aucuuuuccauucauaaaagcaa

SEQ ID NO: 2060982 - RNA, 13 nt, Staphylococcus aureus subsp. aureus Mu50
augaaaaaguaaa

SEQ ID NO: 2060983 - RNA, 23 nt, Staphylococcus aureus subsp. aureus Mu50
augaaaaagauucggaaaauaug

SEQ ID NO: 2060984 - RNA, 19 nt, Staphylococcus aureus subsp. aureus Mu50
aucuuuguuauauuuuuag

SEQ ID NO: 2060985 - RNA, 11 nt, Staphylococcus aureus subsp. aureus Mu50
aucuuuuacua

SEQ ID NO: 2060986 - RNA, 18 nt, Staphylococcus aureus subsp. aureus Mu50
aucuuuuacuaaaugaau

SEQ ID NO: 2060987 - RNA, 17 nt, Staphylococcus aureus subsp. aureus Mu50
aucuuuuaauucuuaau

SEQ ID NO: 2060988 - RNA, 13 nt, Staphylococcus aureus subsp. aureus Mu50
aucuuuuauccaa

SEQ ID NO: 2060989 - RNA, 18 nt, Staphylococcus aureus subsp. aureus Mu50
aucuuuuccauucauaaa

SEQ ID NO: 2060990 - RNA, 11 nt, Staphylococcus aureus subsp. aureus Mu50
aucuuuuaugg

SEQ ID NO: 2060991 - RNA, 12 nt, Staphylococcus aureus subsp. aureus Mu50
aucuuuuagcuu

SEQ ID NO: 2060992 - RNA, 19 nt, Staphylococcus aureus subsp. aureus Mu50
aucuuuauuugauucuuca

SEQ ID NO: 2060993 - RNA, 11 nt, Staphylococcus aureus subsp. aureus Mu50
aucuuucaaag

SEQ ID NO: 2060994 - RNA, 17 nt, Staphylococcus aureus subsp. aureus Mu50
aucuuucacaauuguau

SEQ ID NO: 2060995 - RNA, 19 nt, Staphylococcus aureus subsp. aureus Mu50
aucuuuaucaguuuguccu

SEQ ID NO: 2060996 - RNA, 21 nt, Staphylococcus aureus subsp. aureus Mu50
aucuuuaucauuauucgcauc

SEQ ID NO: 2060997 - RNA, 23 nt, Staphylococcus aureus subsp. aureus Mu50
aucuuuguaugcaucaguuaaua

SEQ ID NO: 2060998 - RNA, 20 nt, Staphylococcus aureus subsp. aureus Mu50
aucuuuguaaccuaaaaaca

SEQ ID NO: 2060999 - RNA, 16 nt, Staphylococcus aureus subsp. aureus Mu50
aucuucgacuacaagu

SEQ ID NO: 2061000 - RNA, 21 nt, Staphylococcus aureus subsp. aureus Mu50
aguucaccguaaucuuuuaac

SEQ ID NO: 2061001 - RNA, 22 nt, Staphylococcus aureus subsp. aureus Mu50
aguuaucggcuaaaguuauaaa

SEQ ID NO: 2061002 - RNA, 17 nt, Staphylococcus aureus subsp. aureus Mu50
aguuacucaauauaaaa

SEQ ID NO: 2061003 - RNA, 21 nt, Staphylococcus aureus subsp. aureus Mu50
aguuacuuacgccaaucacaa

SEQ ID NO: 2061004 - RNA, 15 nt, Staphylococcus aureus subsp. aureus Mu50
aguuacuuacgccaa

SEQ ID NO: 2061005 - RNA, 15 nt, Staphylococcus aureus subsp. aureus Mu50
agugucgagauuuua

SEQ ID NO: 2061006 - RNA, 18 nt, Staphylococcus aureus subsp. aureus Mu50
aguuaaugugcauuuauc

SEQ ID NO: 2061007 - RNA, 12 nt, Staphylococcus aureus subsp. aureus Mu50
aguuaauuaugu

SEQ ID NO: 2061008 - RNA, 14 nt, Staphylococcus aureus subsp. aureus Mu50
agugucacaaagaa

SEQ ID NO: 2061009 - RNA, 21 nt, Staphylococcus aureus subsp. aureus Mu50
agugucaugcuuaauuuaugu

SEQ ID NO: 2061010 - RNA, 22 nt, Staphylococcus aureus subsp. aureus Mu50
aguucggaugagaaauguuaac

SEQ ID NO: 2061011 - RNA, 18 nt, Staphylococcus aureus subsp. aureus Mu50
aguucggaugagaaaugu

SEQ ID NO: 2061012 - RNA, 21 nt, Staphylococcus aureus subsp. aureus Mu50
aguugcacauuauaaagcugc

SEQ ID NO: 2061013 - RNA, 14 nt, Staphylococcus aureus subsp. aureus Mu50
aguucuuagauuuu

SEQ ID NO: 2061014 - RNA, 14 nt, Staphylococcus aureus subsp. aureus Mu50
aguuucugagaaga

SEQ ID NO: 2061015 - RNA, 20 nt, Staphylococcus aureus subsp. aureus Mu50
aguuucggaaaaagaugaaa

SEQ ID NO: 2061016 - RNA, 14 nt, Staphylococcus aureus subsp. aureus Mu50
aguuucguuuucaa

SEQ ID NO: 2061017 - RNA, 20 nt, Staphylococcus aureus subsp. aureus Mu50
aguuucuauagaauuuuuca

SEQ ID NO: 2061018 - RNA, 21 nt, Staphylococcus aureus subsp. aureus Mu50
aguuucaucaaguauaaaugu

SEQ ID NO: 2061019 - RNA, 20 nt, Staphylococcus aureus subsp. aureus Mu50
aguuuccauaaauaaaaugc

SEQ ID NO: 2061020 - RNA, 22 nt, Staphylococcus aureus subsp. aureus Mu50
aguuugauaugcucucuucaaa

SEQ ID NO: 2061021 - RNA, 17 nt, Staphylococcus aureus subsp. aureus Mu50
aguuugaaggugauaau

SEQ ID NO: 2061022 - RNA, 18 nt, Staphylococcus aureus subsp. aureus Mu50
aguuuguuggucuuucuu

SEQ ID NO: 2061023 - RNA, 16 nt, Staphylococcus aureus subsp. aureus Mu50
aguuuguuucuaaauu

SEQ ID NO: 2061024 - RNA, 13 nt, Staphylococcus aureus subsp. aureus Mu50
aguuuaacaauac

SEQ ID NO: 2061025 - RNA, 20 nt, Staphylococcus aureus subsp. aureus Mu50
aguuuacgaucauaaauauu

SEQ ID NO: 2061026 - RNA, 22 nt, Staphylococcus aureus subsp. aureus Mu50
aguuguuuuuuguuuucaaaug

SEQ ID NO: 2061027 - RNA, 22 nt, Staphylococcus aureus subsp. aureus Mu50
aguuuaucuucaguaauuucuc

SEQ ID NO: 2061028 - RNA, 13 nt, Staphylococcus aureus subsp. aureus Mu50
aguuuauuaauau

SEQ ID NO: 2061029 - RNA, 19 nt, Staphylococcus aureus subsp. aureus Mu50
aguuucaaucgcauuuugu

SEQ ID NO: 2061030 - RNA, 19 nt, Staphylococcus aureus subsp. aureus Mu50
aguuuacagguugaauaaa

SEQ ID NO: 2061031 - RNA, 23 nt, Staphylococcus aureus subsp. aureus Mu50
aguuuagauucacuguauaaaua

SEQ ID NO: 2061032 - RNA, 18 nt, Staphylococcus aureus subsp. aureus Mu50
aguugucaucuaauuaca

SEQ ID NO: 2061033 - RNA, 17 nt, Staphylococcus aureus subsp. aureus Mu50
aguuguccauuuuaugc

SEQ ID NO: 2061034 - RNA, 23 nt, Staphylococcus aureus subsp. aureus Mu50
aguuguggucuaaccaucucaac

SEQ ID NO: 2061035 - RNA, 14 nt, Staphylococcus aureus subsp. aureus Mu50
aguuguugcuuugg

SEQ ID NO: 2061036 - RNA, 14 nt, Staphylococcus aureus subsp. aureus Mu50
aguuguugaaauuu

SEQ ID NO: 2061037 - RNA, 15 nt, Staphylococcus aureus subsp. aureus Mu50
aguuguugcaacuug

SEQ ID NO: 2061038 - RNA, 14 nt, Staphylococcus aureus subsp. aureus Mu50
aguuguuauauucu

SEQ ID NO: 2061039 - RNA, 16 nt, Staphylococcus aureus subsp. aureus Mu50
agugcucuugcaauag

SEQ ID NO: 2061040 - RNA, 18 nt, Staphylococcus aureus subsp. aureus Mu50
agugcucuugcaauagca

SEQ ID NO: 2061041 - RNA, 17 nt, Staphylococcus aureus subsp. aureus Mu50
agugguaaaaaguuuaa

SEQ ID NO: 2061042 - RNA, 13 nt, Staphylococcus aureus subsp. aureus Mu50
aguggcaaacauu

SEQ ID NO: 2061043 - RNA, 21 nt, Staphylococcus aureus subsp. aureus Mu50
agugcuuauuuguuuauuagu

SEQ ID NO: 2061044 - RNA, 22 nt, Staphylococcus aureus subsp. aureus Mu50
agugcuuccacuucaucuaaau

SEQ ID NO: 2061045 - RNA, 22 nt, Staphylococcus aureus subsp. aureus Mu50
agugcaauaacaccaauugaau

SEQ ID NO: 2061046 - RNA, 21 nt, Staphylococcus aureus subsp. aureus Mu50
agugcaaguaauuuaauuggu

SEQ ID NO: 2061047 - RNA, 18 nt, Staphylococcus aureus subsp. aureus Mu50
agugcaaguccaaauaau

SEQ ID NO: 2061048 - RNA, 13 nt, Staphylococcus aureus subsp. aureus Mu50
agugcaauuauuu

SEQ ID NO: 2061049 - RNA, 21 nt, Staphylococcus aureus subsp. aureus Mu50
agugcauuuuuuauuuuacuu

SEQ ID NO: 2061050 - RNA, 15 nt, Staphylococcus aureus subsp. aureus Mu50
agugaugaccaauau

SEQ ID NO: 2061051 - RNA, 14 nt, Staphylococcus aureus subsp. aureus Mu50
agugauuugccaaa

SEQ ID NO: 2061052 - RNA, 14 nt, Staphylococcus aureus subsp. aureus Mu50
agugauuuaaaaaa

SEQ ID NO: 2061053 - RNA, 22 nt, Staphylococcus aureus subsp. aureus Mu50
agugaaucuaaacuauaauaau

SEQ ID NO: 2061054 - RNA, 21 nt, Staphylococcus aureus subsp. aureus Mu50
agugaaucuucuaauuaagaa

SEQ ID NO: 2061055 - RNA, 14 nt, Staphylococcus aureus subsp. aureus Mu50
aguccggggcccca

SEQ ID NO: 2061056 - RNA, 22 nt, Staphylococcus aureus subsp. aureus Mu50
aguccgcguguacuuuaccauc

SEQ ID NO: 2061057 - RNA, 23 nt, Staphylococcus aureus subsp. aureus Mu50
agucaaaaaaucgaacaaaugaa

SEQ ID NO: 2061058 - RNA, 18 nt, Staphylococcus aureus subsp. aureus Mu50
agucgauaaauaugaugu

SEQ ID NO: 2061059 - RNA, 17 nt, Staphylococcus aureus subsp. aureus Mu50
agucucuaaaacuuuuu

SEQ ID NO: 2061060 - RNA, 18 nt, Staphylococcus aureus subsp. aureus Mu50
agugaaaacuucucuauc

SEQ ID NO: 2061061 - RNA, 19 nt, Staphylococcus aureus subsp. aureus Mu50
agugaaaaaguuucggaaa

SEQ ID NO: 2061062 - RNA, 14 nt, Staphylococcus aureus subsp. aureus Mu50
agugaaaagaacac

SEQ ID NO: 2061063 - RNA, 13 nt, Staphylococcus aureus subsp. aureus Mu50
agucuuuuuuaag

SEQ ID NO: 2061064 - RNA, 18 nt, Staphylococcus aureus subsp. aureus Mu50
agucuuuacucuacacuc

SEQ ID NO: 2061065 - RNA, 22 nt, Staphylococcus aureus subsp. aureus Mu50
agucugcucuuuuuguaugagu

SEQ ID NO: 2061066 - RNA, 16 nt, Staphylococcus aureus subsp. aureus Mu50
agucucuuuugauaaa

SEQ ID NO: 2061067 - RNA, 19 nt, Staphylococcus aureus subsp. aureus Mu50
auacaaacccuuuaaacau

SEQ ID NO: 2061068 - RNA, 17 nt, Staphylococcus aureus subsp. aureus Mu50
auacaacucguuuuucc

SEQ ID NO: 2061069 - RNA, 16 nt, Staphylococcus aureus subsp. aureus Mu50
auacaacuucacuucu

SEQ ID NO: 2061070 - RNA, 13 nt, Staphylococcus aureus subsp. aureus Mu50
auacaauuuuacc

SEQ ID NO: 2061071 - RNA, 15 nt, Staphylococcus aureus subsp. aureus Mu50
auacaagucuuuacu

SEQ ID NO: 2061072 - RNA, 23 nt, Staphylococcus aureus subsp. aureus Mu50
auacacuuuuugacauauuuuuu

SEQ ID NO: 2061073 - RNA, 18 nt, Staphylococcus aureus subsp. aureus Mu50
auacagaaccaacaauaa

SEQ ID NO: 2061074 - RNA, 20 nt, Staphylococcus aureus subsp. aureus Mu50
auacagaacuuuaauaauga

SEQ ID NO: 2061075 - RNA, 18 nt, Staphylococcus aureus subsp. aureus Mu50
auacacuugauaaaacua

SEQ ID NO: 2061076 - RNA, 19 nt, Staphylococcus aureus subsp. aureus Mu50
auacacuugauaaaacuaa

SEQ ID NO: 2061077 - RNA, 21 nt, Staphylococcus aureus subsp. aureus Mu50
auacacgacgcuaaacaaagg

SEQ ID NO: 2061078 - RNA, 16 nt, Staphylococcus aureus subsp. aureus Mu50
auacacuuacaaauau

SEQ ID NO: 2061079 - RNA, 22 nt, Staphylococcus aureus subsp. aureus Mu50
auacacuaucauuaucaaauaa

SEQ ID NO: 2061080 - RNA, 23 nt, Staphylococcus aureus subsp. aureus Mu50
auacacuaucauuaucaaauaac

SEQ ID NO: 2061081 - RNA, 16 nt, Staphylococcus aureus subsp. aureus Mu50
auaauuugugugcgau

SEQ ID NO: 2061082 - RNA, 15 nt, Staphylococcus aureus subsp. aureus Mu50
auaauuuuaaaaaua

SEQ ID NO: 2061083 - RNA, 18 nt, Staphylococcus aureus subsp. aureus Mu50
auaauuuuaaaaauaaaa

SEQ ID NO: 2061084 - RNA, 18 nt, Staphylococcus aureus subsp. aureus Mu50
auaauuuuaauauuaugu

SEQ ID NO: 2061085 - RNA, 16 nt, Staphylococcus aureus subsp. aureus Mu50
auaauuucuucuucug

SEQ ID NO: 2061086 - RNA, 16 nt, Staphylococcus aureus subsp. aureus Mu50
auaauuuguaauuccu

SEQ ID NO: 2061087 - RNA, 20 nt, Staphylococcus aureus subsp. aureus Mu50
auaauuuaucugcaaaaugc

SEQ ID NO: 2061088 - RNA, 21 nt, Staphylococcus aureus subsp. aureus Mu50
auaauuucaguucuuagauuu

SEQ ID NO: 2061089 - RNA, 19 nt, Staphylococcus aureus subsp. aureus Mu50
auacaaacccauauaaaug

SEQ ID NO: 2061090 - RNA, 19 nt, Staphylococcus aureus subsp. aureus Mu50
auacaaaacaccucgauau

SEQ ID NO: 2061091 - RNA, 20 nt, Staphylococcus aureus subsp. aureus Mu50
auaauuuucuguccaaaaag

SEQ ID NO: 2061092 - RNA, 22 nt, Staphylococcus aureus subsp. aureus Mu50
auaauuuuuaacagcgugaaua

SEQ ID NO: 2061093 - RNA, 14 nt, Staphylococcus aureus subsp. aureus Mu50
auaauuuuggauuu

SEQ ID NO: 2061094 - RNA, 22 nt, Staphylococcus aureus subsp. aureus Mu50
auaauuuuuauuuacacacaug

SEQ ID NO: 2061095 - RNA, 22 nt, Staphylococcus aureus subsp. aureus Mu50
auaauuuuguuuugcuucuuua

SEQ ID NO: 2061096 - RNA, 19 nt, Staphylococcus aureus subsp. aureus Mu50
auaauguauaaaacagaau

SEQ ID NO: 2061097 - RNA, 15 nt, Staphylococcus aureus subsp. aureus Mu50
auaauguacauguau

SEQ ID NO: 2061098 - RNA, 20 nt, Staphylococcus aureus subsp. aureus Mu50
auaaugguugaauaacacua

SEQ ID NO: 2061099 - RNA, 13 nt, Staphylococcus aureus subsp. aureus Mu50
auaauuuacauua

SEQ ID NO: 2061100 - RNA, 15 nt, Staphylococcus aureus subsp. aureus Mu50
auaauuuacauuaau

SEQ ID NO: 2061101 - RNA, 16 nt, Staphylococcus aureus subsp. aureus Mu50
auaauuuaauauuuag

SEQ ID NO: 2061102 - RNA, 13 nt, Staphylococcus aureus subsp. aureus Mu50
auaauuuaaaaga

SEQ ID NO: 2061103 - RNA, 20 nt, Staphylococcus aureus subsp. aureus Mu50
auaauugcauagcuaaauaa

SEQ ID NO: 2061104 - RNA, 22 nt, Staphylococcus aureus subsp. aureus Mu50
auaauugcauagcuaaauaaau

SEQ ID NO: 2061105 - RNA, 15 nt, Staphylococcus aureus subsp. aureus Mu50
auaauugcuaaaaua

SEQ ID NO: 2061106 - RNA, 18 nt, Staphylococcus aureus subsp. aureus Mu50
auaauuggaaucaucuuu

SEQ ID NO: 2061107 - RNA, 16 nt, Staphylococcus aureus subsp. aureus Mu50
auaauuguucuucaga

SEQ ID NO: 2061108 - RNA, 19 nt, Staphylococcus aureus subsp. aureus Mu50
auaauuguccaugccuuau

SEQ ID NO: 2061109 - RNA, 13 nt, Staphylococcus aureus subsp. aureus Mu50
auaaucacauuaa

SEQ ID NO: 2061110 - RNA, 13 nt, Staphylococcus aureus subsp. aureus Mu50
auaauauauccug

SEQ ID NO: 2061111 - RNA, 22 nt, Staphylococcus aureus subsp. aureus Mu50
auaauauauccugccaauauau

SEQ ID NO: 2061112 - RNA, 13 nt, Staphylococcus aureus subsp. aureus Mu50
auaauauacacaa

SEQ ID NO: 2061113 - RNA, 14 nt, Staphylococcus aureus subsp. aureus Mu50
auaauauacacaaa

SEQ ID NO: 2061114 - RNA, 13 nt, Staphylococcus aureus subsp. aureus Mu50
auaauauaaaaac

SEQ ID NO: 2061115 - RNA, 17 nt, Staphylococcus aureus subsp. aureus Mu50
auaauauaaaaacaaaa

SEQ ID NO: 2061116 - RNA, 15 nt, Staphylococcus aureus subsp. aureus Mu50
auaauauaaaacgau

SEQ ID NO: 2061117 - RNA, 21 nt, Staphylococcus aureus subsp. aureus Mu50
auaauauaaaacgauaagaau

SEQ ID NO: 2061118 - RNA, 13 nt, Staphylococcus aureus subsp. aureus Mu50
auaauauaaauaa

SEQ ID NO: 2061119 - RNA, 14 nt, Staphylococcus aureus subsp. aureus Mu50
auaaucaguauuua

SEQ ID NO: 2061120 - RNA, 16 nt, Staphylococcus aureus subsp. aureus Mu50
auaaucaguauuuacu

SEQ ID NO: 2061121 - RNA, 21 nt, Staphylococcus aureus subsp. aureus Mu50
auaaucacuuggcgacauuug

SEQ ID NO: 2061122 - RNA, 19 nt, Staphylococcus aureus subsp. aureus Mu50
auaaucgaacauaaauaaa

SEQ ID NO: 2061123 - RNA, 16 nt, Staphylococcus aureus subsp. aureus Mu50
auaaucgaacagaaaa

SEQ ID NO: 2061124 - RNA, 13 nt, Staphylococcus aureus subsp. aureus Mu50
auaaucauccaua

SEQ ID NO: 2061125 - RNA, 16 nt, Staphylococcus aureus subsp. aureus Mu50
auaaucgagguaguac

SEQ ID NO: 2061126 - RNA, 14 nt, Staphylococcus aureus subsp. aureus Mu50
auaaucuucaguau

SEQ ID NO: 2061127 - RNA, 23 nt, Staphylococcus aureus subsp. aureus Mu50
auaaucucuucaauuuauuuuua

SEQ ID NO: 2061128 - RNA, 12 nt, Staphylococcus aureus subsp. aureus Mu50
auaaucucuuua

SEQ ID NO: 2061129 - RNA, 13 nt, Staphylococcus aureus subsp. aureus Mu50
auaaugauugucu

SEQ ID NO: 2061130 - RNA, 21 nt, Staphylococcus aureus subsp. aureus Mu50
auaaugauguauuuuagcuaa

SEQ ID NO: 2061131 - RNA, 15 nt, Staphylococcus aureus subsp. aureus Mu50
auaaugacugacacu

SEQ ID NO: 2061132 - RNA, 14 nt, Staphylococcus aureus subsp. aureus Mu50
auaaugaauaguaa

SEQ ID NO: 2061133 - RNA, 19 nt, Staphylococcus aureus subsp. aureus Mu50
auaaugaauaauuaaaaaa

SEQ ID NO: 2061134 - RNA, 15 nt, Staphylococcus aureus subsp. aureus Mu50
auaaugaauaauuaa

SEQ ID NO: 2061135 - RNA, 17 nt, Staphylococcus aureus subsp. aureus Mu50
auaaucuuuauuaauaa

SEQ ID NO: 2061136 - RNA, 16 nt, Staphylococcus aureus subsp. aureus Mu50
auaaucuuuuuuacua

SEQ ID NO: 2061137 - RNA, 17 nt, Staphylococcus aureus subsp. aureus Mu50
auaaucuuuuuuacuaa

SEQ ID NO: 2061138 - RNA, 19 nt, Staphylococcus aureus subsp. aureus Mu50
auaaucuuuuuuacuaaaa

SEQ ID NO: 2061139 - RNA, 11 nt, Staphylococcus aureus subsp. aureus Mu50
auaagaaucag

SEQ ID NO: 2061140 - RNA, 12 nt, Staphylococcus aureus subsp. aureus Mu50
auaagaauguga

SEQ ID NO: 2061141 - RNA, 15 nt, Staphylococcus aureus subsp. aureus Mu50
auaagaauuguugau

SEQ ID NO: 2061142 - RNA, 15 nt, Staphylococcus aureus subsp. aureus Mu50
auaagaauuuaaaag

SEQ ID NO: 2061143 - RNA, 23 nt, Staphylococcus aureus subsp. aureus Mu50
auaagugauuucuucauuaucaa

SEQ ID NO: 2061144 - RNA, 13 nt, Staphylococcus aureus subsp. aureus Mu50
auaagacaauagu

SEQ ID NO: 2061145 - RNA, 17 nt, Staphylococcus aureus subsp. aureus Mu50
auaaguuaaugugcauu

SEQ ID NO: 2061146 - RNA, 17 nt, Staphylococcus aureus subsp. aureus Mu50
auaaguuacuagcauua

SEQ ID NO: 2061147 - RNA, 13 nt, Staphylococcus aureus subsp. aureus Mu50
auaaguuaaaauu

SEQ ID NO: 2061148 - RNA, 15 nt, Staphylococcus aureus subsp. aureus Mu50
auaaguugaauauaa

SEQ ID NO: 2061149 - RNA, 17 nt, Staphylococcus aureus subsp. aureus Mu50
auaaguugaauauaaaa

SEQ ID NO: 2061150 - RNA, 15 nt, Staphylococcus aureus subsp. aureus Mu50
auaaguucuagauua

SEQ ID NO: 2061151 - RNA, 21 nt, Staphylococcus aureus subsp. aureus Mu50
auaaguucuagauuauuuaaa

SEQ ID NO: 2061152 - RNA, 20 nt, Staphylococcus aureus subsp. aureus Mu50
auaauaauucauaaaugcuu

SEQ ID NO: 2061153 - RNA, 19 nt, Staphylococcus aureus subsp. aureus Mu50
auaauaaucggacugaugg

SEQ ID NO: 2061154 - RNA, 21 nt, Staphylococcus aureus subsp. aureus Mu50
auaauaaguugaauauaaaaa

SEQ ID NO: 2061155 - RNA, 20 nt, Staphylococcus aureus subsp. aureus Mu50
auaauaagagguauagcaag

SEQ ID NO: 2061156 - RNA, 20 nt, Staphylococcus aureus subsp. aureus Mu50
auaauaccuaauugcuuaau

SEQ ID NO: 2061157 - RNA, 22 nt, Staphylococcus aureus subsp. aureus Mu50
auaauaccuaauugcuuaauau

SEQ ID NO: 2061158 - RNA, 13 nt, Staphylococcus aureus subsp. aureus Mu50
auaauaaaucacg

SEQ ID NO: 2061159 - RNA, 14 nt, Staphylococcus aureus subsp. aureus Mu50
auaauaaauaggau

SEQ ID NO: 2061160 - RNA, 19 nt, Staphylococcus aureus subsp. aureus Mu50
auaaguuuuugaauaucua

SEQ ID NO: 2061161 - RNA, 17 nt, Staphylococcus aureus subsp. aureus Mu50
auaauaaaacuugugau

SEQ ID NO: 2061162 - RNA, 12 nt, Staphylococcus aureus subsp. aureus Mu50
auaauaaaauag

SEQ ID NO: 2061163 - RNA, 20 nt, Staphylococcus aureus subsp. aureus Mu50
auaauaaaacuugugauaua

SEQ ID NO: 2061164 - RNA, 23 nt, Staphylococcus aureus subsp. aureus Mu50
auaaaauaccagaugaaccaaaa

SEQ ID NO: 2061165 - RNA, 13 nt, Staphylococcus aureus subsp. aureus Mu50
auaaaauaaauaa

SEQ ID NO: 2061166 - RNA, 13 nt, Staphylococcus aureus subsp. aureus Mu50
auaaaauuaaaac

SEQ ID NO: 2061167 - RNA, 21 nt, Staphylococcus aureus subsp. aureus Mu50
auaaaauuacuugaauauuau

SEQ ID NO: 2061168 - RNA, 17 nt, Staphylococcus aureus subsp. aureus Mu50
auaaaauuagccuaauu

SEQ ID NO: 2061169 - RNA, 13 nt, Staphylococcus aureus subsp. aureus Mu50
auaaaaugcaauu

SEQ ID NO: 2061170 - RNA, 18 nt, Staphylococcus aureus subsp. aureus Mu50
auaaaaugcuacaauuuc

SEQ ID NO: 2061171 - RNA, 17 nt, Staphylococcus aureus subsp. aureus Mu50
auaaaaugcauagcucu

SEQ ID NO: 2061172 - RNA, 22 nt, Staphylococcus aureus subsp. aureus Mu50
auaaaaugcauagcucuucuuu

SEQ ID NO: 2061173 - RNA, 14 nt, Staphylococcus aureus subsp. aureus Mu50
auaaaauucaccaa

SEQ ID NO: 2061174 - RNA, 19 nt, Staphylococcus aureus subsp. aureus Mu50
auaaaauuuaaaacaauga

SEQ ID NO: 2061175 - RNA, 15 nt, Staphylococcus aureus subsp. aureus Mu50
auaaaauuuaaaaca

SEQ ID NO: 2061176 - RNA, 14 nt, Staphylococcus aureus subsp. aureus Mu50
auaaaccagcugau

SEQ ID NO: 2061177 - RNA, 19 nt, Staphylococcus aureus subsp. aureus Mu50
auaaacaauaacuguucuu

SEQ ID NO: 2061178 - RNA, 12 nt, Staphylococcus aureus subsp. aureus Mu50
auaaacaauaaa

SEQ ID NO: 2061179 - RNA, 20 nt, Staphylococcus aureus subsp. aureus Mu50
auaaacaacugcaauagcua

SEQ ID NO: 2061180 - RNA, 13 nt, Staphylococcus aureus subsp. aureus Mu50
auaaaauuuugaa

SEQ ID NO: 2061181 - RNA, 22 nt, Staphylococcus aureus subsp. aureus Mu50
auaaaauuucugcuucuuuuaa

SEQ ID NO: 2061182 - RNA, 16 nt, Staphylococcus aureus subsp. aureus Mu50
auaaaauuuuuuucau

SEQ ID NO: 2061183 - RNA, 15 nt, Staphylococcus aureus subsp. aureus Mu50
auaaaauuuuuuuca

SEQ ID NO: 2061184 - RNA, 16 nt, Staphylococcus aureus subsp. aureus Mu50
auaaagucauaugguu

SEQ ID NO: 2061185 - RNA, 13 nt, Staphylococcus aureus subsp. aureus Mu50
auaaauaaacuca

SEQ ID NO: 2061186 - RNA, 20 nt, Staphylococcus aureus subsp. aureus Mu50
auaaauaacacgauuugguu

SEQ ID NO: 2061187 - RNA, 15 nt, Staphylococcus aureus subsp. aureus Mu50
auaaauacaaaaaua

SEQ ID NO: 2061188 - RNA, 14 nt, Staphylococcus aureus subsp. aureus Mu50
auaaauacaaauau

SEQ ID NO: 2061189 - RNA, 18 nt, Staphylococcus aureus subsp. aureus Mu50
auaaauacaaauauaucu

SEQ ID NO: 2061190 - RNA, 19 nt, Staphylococcus aureus subsp. aureus Mu50
auaaauaagugauaaauaa

SEQ ID NO: 2061191 - RNA, 22 nt, Staphylococcus aureus subsp. aureus Mu50
auaaauaacuucguuuuaauaa

SEQ ID NO: 2061192 - RNA, 22 nt, Staphylococcus aureus subsp. aureus Mu50
auaaauaauaaguugaauauaa

SEQ ID NO: 2061193 - RNA, 21 nt, Staphylococcus aureus subsp. aureus Mu50
auaaauaugauguuaaaaaau

SEQ ID NO: 2061194 - RNA, 20 nt, Staphylococcus aureus subsp. aureus Mu50
auaaauaugauguuaaaaaa

SEQ ID NO: 2061195 - RNA, 21 nt, Staphylococcus aureus subsp. aureus Mu50
auaaaucauucuuuauagaaa

SEQ ID NO: 2061196 - RNA, 17 nt, Staphylococcus aureus subsp. aureus Mu50
auaaauaucaauaauuc

SEQ ID NO: 2061197 - RNA, 22 nt, Staphylococcus aureus subsp. aureus Mu50
auaaauaucaauuguugcaaaa

SEQ ID NO: 2061198 - RNA, 21 nt, Staphylococcus aureus subsp. aureus Mu50
auaaagccaucuaggucacuu

SEQ ID NO: 2061199 - RNA, 19 nt, Staphylococcus aureus subsp. aureus Mu50
auaaaccuaaugcuuuaau

SEQ ID NO: 2061200 - RNA, 21 nt, Staphylococcus aureus subsp. aureus Mu50
auaaaccgauuguuucaccag

SEQ ID NO: 2061201 - RNA, 23 nt, Staphylococcus aureus subsp. aureus Mu50
auaaaccgauuguuucaccagcu

SEQ ID NO: 2061202 - RNA, 15 nt, Staphylococcus aureus subsp. aureus Mu50
auaaccuagguuaaa

SEQ ID NO: 2061203 - RNA, 17 nt, Staphylococcus aureus subsp. aureus Mu50
auaaccgucacaaacca

SEQ ID NO: 2061204 - RNA, 18 nt, Staphylococcus aureus subsp. aureus Mu50
auaacccauuuucaaaac

SEQ ID NO: 2061205 - RNA, 17 nt, Staphylococcus aureus subsp. aureus Mu50
auaaccauaguaauaaa

SEQ ID NO: 2061206 - RNA, 18 nt, Staphylococcus aureus subsp. aureus Mu50
auaaccauaguaauaaaa

SEQ ID NO: 2061207 - RNA, 20 nt, Staphylococcus aureus subsp. aureus Mu50
auaaccauaguaauaaaaug

SEQ ID NO: 2061208 - RNA, 16 nt, Staphylococcus aureus subsp. aureus Mu50
auaacguucuguuuug

SEQ ID NO: 2061209 - RNA, 15 nt, Staphylococcus aureus subsp. aureus Mu50
auaacucuaaauaua

SEQ ID NO: 2061210 - RNA, 20 nt, Staphylococcus aureus subsp. aureus Mu50
auaacugcauguacaucuuu

SEQ ID NO: 2061211 - RNA, 22 nt, Staphylococcus aureus subsp. aureus Mu50
auaacuguauaccucuuagcac

SEQ ID NO: 2061212 - RNA, 14 nt, Staphylococcus aureus subsp. aureus Mu50
auaaccuguaauug

SEQ ID NO: 2061213 - RNA, 19 nt, Staphylococcus aureus subsp. aureus Mu50
auaaccuuuaaaacaucau

SEQ ID NO: 2061214 - RNA, 13 nt, Staphylococcus aureus subsp. aureus Mu50
auaaccuuuaaaa

SEQ ID NO: 2061215 - RNA, 16 nt, Staphylococcus aureus subsp. aureus Mu50
auaacgucauauguuu

SEQ ID NO: 2061216 - RNA, 18 nt, Staphylococcus aureus subsp. aureus Mu50
auaacaaaauuaaauaug

SEQ ID NO: 2061217 - RNA, 22 nt, Staphylococcus aureus subsp. aureus Mu50
auaacaauagugacuuuuauaa

SEQ ID NO: 2061218 - RNA, 18 nt, Staphylococcus aureus subsp. aureus Mu50
auaacaacuacuuaaauu

SEQ ID NO: 2061219 - RNA, 21 nt, Staphylococcus aureus subsp. aureus Mu50
auaacaauuuuaaaucuuuua

SEQ ID NO: 2061220 - RNA, 18 nt, Staphylococcus aureus subsp. aureus Mu50
auaacaauuuuaaaucuu

SEQ ID NO: 2061221 - RNA, 14 nt, Staphylococcus aureus subsp. aureus Mu50
auaacaauuuuaaa

SEQ ID NO: 2061222 - RNA, 16 nt, Staphylococcus aureus subsp. aureus Mu50
auaacaauuuauuaaa

SEQ ID NO: 2061223 - RNA, 18 nt, Staphylococcus aureus subsp. aureus Mu50
auaaaucguguuaauucu

SEQ ID NO: 2061224 - RNA, 15 nt, Staphylococcus aureus subsp. aureus Mu50
auaaaucuaucuacu

SEQ ID NO: 2061225 - RNA, 23 nt, Staphylococcus aureus subsp. aureus Mu50
auaaauuuucuguuuaauuaaaa

SEQ ID NO: 2061226 - RNA, 17 nt, Staphylococcus aureus subsp. aureus Mu50
auaaauuuugaauuaca

SEQ ID NO: 2061227 - RNA, 21 nt, Staphylococcus aureus subsp. aureus Mu50
auaaauuuugaauuacagauu

SEQ ID NO: 2061228 - RNA, 19 nt, Staphylococcus aureus subsp. aureus Mu50
auaaauuuugcgaaaauau

SEQ ID NO: 2061229 - RNA, 21 nt, Staphylococcus aureus subsp. aureus Mu50
auaaauccuaagucuuuuaaa

SEQ ID NO: 2061230 - RNA, 16 nt, Staphylococcus aureus subsp. aureus Mu50
auaaaucgauaaaaug

SEQ ID NO: 2061231 - RNA, 18 nt, Staphylococcus aureus subsp. aureus Mu50
auaacaccuacugauuga

SEQ ID NO: 2061232 - RNA, 18 nt, Staphylococcus aureus subsp. aureus Mu50
auaacaccuuucauuugg

SEQ ID NO: 2061233 - RNA, 17 nt, Staphylococcus aureus subsp. aureus Mu50
auaacaccaauuaaauc

SEQ ID NO: 2061234 - RNA, 17 nt, Staphylococcus aureus subsp. aureus Mu50
auaacagcuacaaauaa

SEQ ID NO: 2061235 - RNA, 18 nt, Staphylococcus aureus subsp. aureus Mu50
auaacagcuacaaauaau

SEQ ID NO: 2061236 - RNA, 19 nt, Staphylococcus aureus subsp. aureus Mu50
auaacaguuaauuauaccg

SEQ ID NO: 2061237 - RNA, 13 nt, Staphylococcus aureus subsp. aureus Mu50
auaacaucuaaau

SEQ ID NO: 2061238 - RNA, 17 nt, Staphylococcus aureus subsp. aureus Mu50
auaacauucuucaaaaa

SEQ ID NO: 2061239 - RNA, 18 nt, Staphylococcus aureus subsp. aureus Mu50
auaacauucuucaaaaaa

SEQ ID NO: 2061240 - RNA, 22 nt, Staphylococcus aureus subsp. aureus Mu50
aggaacagcggaauacagauga

SEQ ID NO: 2061241 - RNA, 23 nt, Staphylococcus aureus subsp. aureus Mu50
aggaacagcggaauacagaugau

SEQ ID NO: 2061242 - RNA, 17 nt, Staphylococcus aureus subsp. aureus Mu50
agcuuuguuagcaucug

SEQ ID NO: 2061243 - RNA, 18 nt, Staphylococcus aureus subsp. aureus Mu50
agcuuugcucauagauga

SEQ ID NO: 2061244 - RNA, 16 nt, Staphylococcus aureus subsp. aureus Mu50
aggaaagccauuaaac

SEQ ID NO: 2061245 - RNA, 18 nt, Staphylococcus aureus subsp. aureus Mu50
aggaaauccgcauaaauu

SEQ ID NO: 2061246 - RNA, 21 nt, Staphylococcus aureus subsp. aureus Mu50
aggagacauuucccauuuauc

SEQ ID NO: 2061247 - RNA, 19 nt, Staphylococcus aureus subsp. aureus Mu50
aggaccacucaauucucua

SEQ ID NO: 2061248 - RNA, 20 nt, Staphylococcus aureus subsp. aureus Mu50
aggaaguucucugcugcuuu

SEQ ID NO: 2061249 - RNA, 18 nt, Staphylococcus aureus subsp. aureus Mu50
aggaagucgcaaucaccu

SEQ ID NO: 2061250 - RNA, 19 nt, Staphylococcus aureus subsp. aureus Mu50
agcuugaucuaaaugaucu

SEQ ID NO: 2061251 - RNA, 22 nt, Staphylococcus aureus subsp. aureus Mu50
agcuugauuuaacaaccucuga

SEQ ID NO: 2061252 - RNA, 20 nt, Staphylococcus aureus subsp. aureus Mu50
agcuucuguguuggggccca

SEQ ID NO: 2061253 - RNA, 18 nt, Staphylococcus aureus subsp. aureus Mu50
agcuugaccgccuaugau

SEQ ID NO: 2061254 - RNA, 17 nt, Staphylococcus aureus subsp. aureus Mu50
agcuuguaaaucacgau

SEQ ID NO: 2061255 - RNA, 14 nt, Staphylococcus aureus subsp. aureus Mu50
agcuuguaauccuu

SEQ ID NO: 2061256 - RNA, 20 nt, Staphylococcus aureus subsp. aureus Mu50
agcuugggacagaaaacaaa

SEQ ID NO: 2061257 - RNA, 20 nt, Staphylococcus aureus subsp. aureus Mu50
agcuuaucaacgauuuuguc

SEQ ID NO: 2061258 - RNA, 21 nt, Staphylococcus aureus subsp. aureus Mu50
agcuuagucaauguauauuua

SEQ ID NO: 2061259 - RNA, 14 nt, Staphylococcus aureus subsp. aureus Mu50
agcuucaguuaaau

SEQ ID NO: 2061260 - RNA, 22 nt, Staphylococcus aureus subsp. aureus Mu50
agcuucaguuaaaucacugcuu

SEQ ID NO: 2061261 - RNA, 13 nt, Staphylococcus aureus subsp. aureus Mu50
agcuucauauuua

SEQ ID NO: 2061262 - RNA, 13 nt, Staphylococcus aureus subsp. aureus Mu50
agcuuaauuuuau

SEQ ID NO: 2061263 - RNA, 15 nt, Staphylococcus aureus subsp. aureus Mu50
agcuucuaaguaaua

SEQ ID NO: 2061264 - RNA, 16 nt, Staphylococcus aureus subsp. aureus Mu50
agcugucauaccuuuu

SEQ ID NO: 2061265 - RNA, 23 nt, Staphylococcus aureus subsp. aureus Mu50
agcugugcugucauuuucugcuu

SEQ ID NO: 2061266 - RNA, 17 nt, Staphylococcus aureus subsp. aureus Mu50
agcugcucgauauaugu

SEQ ID NO: 2061267 - RNA, 12 nt, Staphylococcus aureus subsp. aureus Mu50
aggauuuuagau

SEQ ID NO: 2061268 - RNA, 17 nt, Staphylococcus aureus subsp. aureus Mu50
aggauuuuagauuuagu

SEQ ID NO: 2061269 - RNA, 17 nt, Staphylococcus aureus subsp. aureus Mu50
aggcaacuuuuauuacu

SEQ ID NO: 2061270 - RNA, 22 nt, Staphylococcus aureus subsp. aureus Mu50
aggcacaguggauuacagauga

SEQ ID NO: 2061271 - RNA, 23 nt, Staphylococcus aureus subsp. aureus Mu50
aggcacagcggaauacagaugau

SEQ ID NO: 2061272 - RNA, 19 nt, Staphylococcus aureus subsp. aureus Mu50
aggauuuacaccuauaccu

SEQ ID NO: 2061273 - RNA, 16 nt, Staphylococcus aureus subsp. aureus Mu50
aggcauucuuccaaca

SEQ ID NO: 2061274 - RNA, 18 nt, Staphylococcus aureus subsp. aureus Mu50
aggcccauaaauuacuug

SEQ ID NO: 2061275 - RNA, 13 nt, Staphylococcus aureus subsp. aureus Mu50
aggcgccauaauc

SEQ ID NO: 2061276 - RNA, 19 nt, Staphylococcus aureus subsp. aureus Mu50
aggcgcuguuccaaauuca

SEQ ID NO: 2061277 - RNA, 15 nt, Staphylococcus aureus subsp. aureus Mu50
agguaacuaaaaugu

SEQ ID NO: 2061278 - RNA, 13 nt, Staphylococcus aureus subsp. aureus Mu50
agguaagaaaaau

SEQ ID NO: 2061279 - RNA, 21 nt, Staphylococcus aureus subsp. aureus Mu50
aggguauugaaauaauauaaa

SEQ ID NO: 2061280 - RNA, 20 nt, Staphylococcus aureus subsp. aureus Mu50
agguaaugucccguuuaccu

SEQ ID NO: 2061281 - RNA, 17 nt, Staphylococcus aureus subsp. aureus Mu50
agguaaugcaaguuggc

SEQ ID NO: 2061282 - RNA, 23 nt, Staphylococcus aureus subsp. aureus Mu50
agguaaugcaaguuggcggggcc

SEQ ID NO: 2061283 - RNA, 15 nt, Staphylococcus aureus subsp. aureus Mu50
agguauacacaaauu

SEQ ID NO: 2061284 - RNA, 21 nt, Staphylococcus aureus subsp. aureus Mu50
agguauaggugcaguuaaauu

SEQ ID NO: 2061285 - RNA, 18 nt, Staphylococcus aureus subsp. aureus Mu50
aggucuacgaucaaaauc

SEQ ID NO: 2061286 - RNA, 17 nt, Staphylococcus aureus subsp. aureus Mu50
aggugauugaacaauaa

SEQ ID NO: 2061287 - RNA, 19 nt, Staphylococcus aureus subsp. aureus Mu50
aggugauuauauauauuaa

SEQ ID NO: 2061288 - RNA, 15 nt, Staphylococcus aureus subsp. aureus Mu50
aggugauuauauaua

SEQ ID NO: 2061289 - RNA, 19 nt, Staphylococcus aureus subsp. aureus Mu50
aggugcaguuaaauuaaac

SEQ ID NO: 2061290 - RNA, 22 nt, Staphylococcus aureus subsp. aureus Mu50
agggcauugagauuggaagggc

SEQ ID NO: 2061291 - RNA, 11 nt, Staphylococcus aureus subsp. aureus Mu50
agggccccaac

SEQ ID NO: 2061292 - RNA, 12 nt, Staphylococcus aureus subsp. aureus Mu50
aggggccccaac

SEQ ID NO: 2061293 - RNA, 21 nt, Staphylococcus aureus subsp. aureus Mu50
aggggccccaacacagagaau

SEQ ID NO: 2061294 - RNA, 14 nt, Staphylococcus aureus subsp. aureus Mu50
agggcaaaaaagga

SEQ ID NO: 2061295 - RNA, 13 nt, Staphylococcus aureus subsp. aureus Mu50
aggcuuuaaaauu

SEQ ID NO: 2061296 - RNA, 12 nt, Staphylococcus aureus subsp. aureus Mu50
aguauaaauaaa

SEQ ID NO: 2061297 - RNA, 16 nt, Staphylococcus aureus subsp. aureus Mu50
aguauaaacguccaaa

SEQ ID NO: 2061298 - RNA, 14 nt, Staphylococcus aureus subsp. aureus Mu50
aguauaaauaaaaa

SEQ ID NO: 2061299 - RNA, 20 nt, Staphylococcus aureus subsp. aureus Mu50
aguaguuaauugaaugaaaa

SEQ ID NO: 2061300 - RNA, 17 nt, Staphylococcus aureus subsp. aureus Mu50
aguagcucaaaacaauu

SEQ ID NO: 2061301 - RNA, 19 nt, Staphylococcus aureus subsp. aureus Mu50
aguagauuuauuaaauaua

SEQ ID NO: 2061302 - RNA, 13 nt, Staphylococcus aureus subsp. aureus Mu50
aguagauuuauua

SEQ ID NO: 2061303 - RNA, 21 nt, Staphylococcus aureus subsp. aureus Mu50
aguauagcgcagcaaaugcuu

SEQ ID NO: 2061304 - RNA, 16 nt, Staphylococcus aureus subsp. aureus Mu50
aguauaaucagcaaug

SEQ ID NO: 2061305 - RNA, 21 nt, Staphylococcus aureus subsp. aureus Mu50
aguauaaguagcucaaaacaa

SEQ ID NO: 2061306 - RNA, 15 nt, Staphylococcus aureus subsp. aureus Mu50
aguauaaaugcagcu

SEQ ID NO: 2061307 - RNA, 18 nt, Staphylococcus aureus subsp. aureus Mu50
aguauaagguugaagaag

SEQ ID NO: 2061308 - RNA, 14 nt, Staphylococcus aureus subsp. aureus Mu50
aguauaaaugcagc

SEQ ID NO: 2061309 - RNA, 18 nt, Staphylococcus aureus subsp. aureus Mu50
aguaucugugaauaugcu

SEQ ID NO: 2061310 - RNA, 15 nt, Staphylococcus aureus subsp. aureus Mu50
aguaucgauuuaaca

SEQ ID NO: 2061311 - RNA, 16 nt, Staphylococcus aureus subsp. aureus Mu50
aguauccugauuuaau

SEQ ID NO: 2061312 - RNA, 22 nt, Staphylococcus aureus subsp. aureus Mu50
aguaucauuguguccauaaaua

SEQ ID NO: 2061313 - RNA, 22 nt, Staphylococcus aureus subsp. aureus Mu50
aguaucauguucuuauaaaaaa

SEQ ID NO: 2061314 - RNA, 23 nt, Staphylococcus aureus subsp. aureus Mu50
aguauuauagccuauccauucaa

SEQ ID NO: 2061315 - RNA, 14 nt, Staphylococcus aureus subsp. aureus Mu50
aguauuaaauuuga

SEQ ID NO: 2061316 - RNA, 14 nt, Staphylococcus aureus subsp. aureus Mu50
aguauuaaauuugu

SEQ ID NO: 2061317 - RNA, 22 nt, Staphylococcus aureus subsp. aureus Mu50
aguauuguuuuauauuuaaacu

SEQ ID NO: 2061318 - RNA, 15 nt, Staphylococcus aureus subsp. aureus Mu50
aguauuguuuuauau

SEQ ID NO: 2061319 - RNA, 18 nt, Staphylococcus aureus subsp. aureus Mu50
aguauugccaaauuucuc

SEQ ID NO: 2061320 - RNA, 14 nt, Staphylococcus aureus subsp. aureus Mu50
aguauuaucacaua

SEQ ID NO: 2061321 - RNA, 14 nt, Staphylococcus aureus subsp. aureus Mu50
aguauucaaaaaau

SEQ ID NO: 2061322 - RNA, 14 nt, Staphylococcus aureus subsp. aureus Mu50
aguauucauuuucu

SEQ ID NO: 2061323 - RNA, 16 nt, Staphylococcus aureus subsp. aureus Mu50
aguaauauauaaaagu

SEQ ID NO: 2061324 - RNA, 19 nt, Staphylococcus aureus subsp. aureus Mu50
aguaauccccgaagcacag

SEQ ID NO: 2061325 - RNA, 22 nt, Staphylococcus aureus subsp. aureus Mu50
aguaauccccgaagcacagaaa

SEQ ID NO: 2061326 - RNA, 17 nt, Staphylococcus aureus subsp. aureus Mu50
aguaaucaguuacucua

SEQ ID NO: 2061327 - RNA, 18 nt, Staphylococcus aureus subsp. aureus Mu50
aguaaucguaucuucacu

SEQ ID NO: 2061328 - RNA, 19 nt, Staphylococcus aureus subsp. aureus Mu50
aguaauucuucaucuucuu

SEQ ID NO: 2061329 - RNA, 15 nt, Staphylococcus aureus subsp. aureus Mu50
aguaauucuuaaaaa

SEQ ID NO: 2061330 - RNA, 22 nt, Staphylococcus aureus subsp. aureus Mu50
aguaauuuaauugguucuucuu

SEQ ID NO: 2061331 - RNA, 23 nt, Staphylococcus aureus subsp. aureus Mu50
aguacauuuauuuucaauaaaua

SEQ ID NO: 2061332 - RNA, 12 nt, Staphylococcus aureus subsp. aureus Mu50
aguacaaauaau

SEQ ID NO: 2061333 - RNA, 15 nt, Staphylococcus aureus subsp. aureus Mu50
aguaaguaaaauaaa

SEQ ID NO: 2061334 - RNA, 14 nt, Staphylococcus aureus subsp. aureus Mu50
aguaaguaauaaaa

SEQ ID NO: 2061335 - RNA, 18 nt, Staphylococcus aureus subsp. aureus Mu50
aguaauaauauaaauaaa

SEQ ID NO: 2061336 - RNA, 21 nt, Staphylococcus aureus subsp. aureus Mu50
aguaauaauggcaauuaaaac

SEQ ID NO: 2061337 - RNA, 22 nt, Staphylococcus aureus subsp. aureus Mu50
aguaauaaaauaaaaaaaugau

SEQ ID NO: 2061338 - RNA, 16 nt, Staphylococcus aureus subsp. aureus Mu50
aguaacaauaacaccu

SEQ ID NO: 2061339 - RNA, 22 nt, Staphylococcus aureus subsp. aureus Mu50
aguaaauuaauagagaaagaau

SEQ ID NO: 2061340 - RNA, 22 nt, Staphylococcus aureus subsp. aureus Mu50
aguaaauguuuuauguauuuau

SEQ ID NO: 2061341 - RNA, 21 nt, Staphylococcus aureus subsp. aureus Mu50
agguuguuuuucaucauuaaa

SEQ ID NO: 2061342 - RNA, 14 nt, Staphylococcus aureus subsp. aureus Mu50
aguaaaauaaaaaa

SEQ ID NO: 2061343 - RNA, 17 nt, Staphylococcus aureus subsp. aureus Mu50
aguaaacgagacaucau

SEQ ID NO: 2061344 - RNA, 20 nt, Staphylococcus aureus subsp. aureus Mu50
aguaaaaucuuuaacauuug

SEQ ID NO: 2061345 - RNA, 18 nt, Staphylococcus aureus subsp. aureus Mu50
agguuuguaagacaacaa

SEQ ID NO: 2061346 - RNA, 15 nt, Staphylococcus aureus subsp. aureus Mu50
agguuuauaaaaaau

SEQ ID NO: 2061347 - RNA, 20 nt, Staphylococcus aureus subsp. aureus Mu50
agguuuauaaaaaaucaguu

SEQ ID NO: 2061348 - RNA, 18 nt, Staphylococcus aureus subsp. aureus Mu50
agcuacccuauuuuacaa

SEQ ID NO: 2061349 - RNA, 15 nt, Staphylococcus aureus subsp. aureus Mu50
agcuagaaacaaugc

SEQ ID NO: 2061350 - RNA, 22 nt, Staphylococcus aureus subsp. aureus Mu50
agcuaauguguacuuaaaaaua

SEQ ID NO: 2061351 - RNA, 13 nt, Staphylococcus aureus subsp. aureus Mu50
agcuaaugcaagc

SEQ ID NO: 2061352 - RNA, 21 nt, Staphylococcus aureus subsp. aureus Mu50
agcuaauuucuaauacauacu

SEQ ID NO: 2061353 - RNA, 16 nt, Staphylococcus aureus subsp. aureus Mu50
agcuacaauuuucuca

SEQ ID NO: 2061354 - RNA, 14 nt, Staphylococcus aureus subsp. aureus Mu50
agcguuuuuauuac

SEQ ID NO: 2061355 - RNA, 13 nt, Staphylococcus aureus subsp. aureus Mu50
agcuaaccaaaua

SEQ ID NO: 2061356 - RNA, 18 nt, Staphylococcus aureus subsp. aureus Mu50
agcuaacucuuuguauaa

SEQ ID NO: 2061357 - RNA, 15 nt, Staphylococcus aureus subsp. aureus Mu50
agcguucaauuuuug

SEQ ID NO: 2061358 - RNA, 15 nt, Staphylococcus aureus subsp. aureus Mu50
agcguucgugauaga

SEQ ID NO: 2061359 - RNA, 19 nt, Staphylococcus aureus subsp. aureus Mu50
agcguucucuaauuucaca

SEQ ID NO: 2061360 - RNA, 22 nt, Staphylococcus aureus subsp. aureus Mu50
agcuauucauagaccuaugaau

SEQ ID NO: 2061361 - RNA, 18 nt, Staphylococcus aureus subsp. aureus Mu50
agcuauaaaaguacuuua

SEQ ID NO: 2061362 - RNA, 14 nt, Staphylococcus aureus subsp. aureus Mu50
agcuauauuuuuuu

SEQ ID NO: 2061363 - RNA, 22 nt, Staphylococcus aureus subsp. aureus Mu50
agcuauagaaaugauagggcau

SEQ ID NO: 2061364 - RNA, 16 nt, Staphylococcus aureus subsp. aureus Mu50
agcuauaaaaaaucuu

SEQ ID NO: 2061365 - RNA, 18 nt, Staphylococcus aureus subsp. aureus Mu50
agcuauaaaaaaucuuuu

SEQ ID NO: 2061366 - RNA, 17 nt, Staphylococcus aureus subsp. aureus Mu50
agcuaucuucagauucc

SEQ ID NO: 2061367 - RNA, 22 nt, Staphylococcus aureus subsp. aureus Mu50
agcuaugcuuuuuuuacaauau

SEQ ID NO: 2061368 - RNA, 15 nt, Staphylococcus aureus subsp. aureus Mu50
agcuaucguaaacaa

SEQ ID NO: 2061369 - RNA, 20 nt, Staphylococcus aureus subsp. aureus Mu50
agcucaauugaaucuuuguu

SEQ ID NO: 2061370 - RNA, 19 nt, Staphylococcus aureus subsp. aureus Mu50
agcucaugaaucagaugau

SEQ ID NO: 2061371 - RNA, 22 nt, Staphylococcus aureus subsp. aureus Mu50
agcguccucuugugaaauuaga

SEQ ID NO: 2061372 - RNA, 12 nt, Staphylococcus aureus subsp. aureus Mu50
agcguaaaguuu

SEQ ID NO: 2061373 - RNA, 18 nt, Staphylococcus aureus subsp. aureus Mu50
agcguaauggauuauuau

SEQ ID NO: 2061374 - RNA, 20 nt, Staphylococcus aureus subsp. aureus Mu50
agcgaucuuuuuuauuuaau

SEQ ID NO: 2061375 - RNA, 12 nt, Staphylococcus aureus subsp. aureus Mu50
agcgauuaaaug

SEQ ID NO: 2061376 - RNA, 23 nt, Staphylococcus aureus subsp. aureus Mu50
agccuuaaaauauuuaacuuuuu

SEQ ID NO: 2061377 - RNA, 17 nt, Staphylococcus aureus subsp. aureus Mu50
agcauaccuacagaaug

SEQ ID NO: 2061378 - RNA, 13 nt, Staphylococcus aureus subsp. aureus Mu50
agcaucaucaauu

SEQ ID NO: 2061379 - RNA, 21 nt, Staphylococcus aureus subsp. aureus Mu50
agcaucguaaaaaacaaaaaa

SEQ ID NO: 2061380 - RNA, 17 nt, Staphylococcus aureus subsp. aureus Mu50
agcaucuuuuacugcuu

SEQ ID NO: 2061381 - RNA, 17 nt, Staphylococcus aureus subsp. aureus Mu50
agcaucuacaauauuca

SEQ ID NO: 2061382 - RNA, 19 nt, Staphylococcus aureus subsp. aureus Mu50
agcagcaguugacuguaaa

SEQ ID NO: 2061383 - RNA, 17 nt, Staphylococcus aureus subsp. aureus Mu50
agcacugaaaucuagac

SEQ ID NO: 2061384 - RNA, 17 nt, Staphylococcus aureus subsp. aureus Mu50
agcacuaucuuuugcuu

SEQ ID NO: 2061385 - RNA, 18 nt, Staphylococcus aureus subsp. aureus Mu50
agcacuagccguuauuuu

SEQ ID NO: 2061386 - RNA, 16 nt, Staphylococcus aureus subsp. aureus Mu50
agcaccuuaccuacuu

SEQ ID NO: 2061387 - RNA, 16 nt, Staphylococcus aureus subsp. aureus Mu50
agcaacaucggcacca

SEQ ID NO: 2061388 - RNA, 17 nt, Staphylococcus aureus subsp. aureus Mu50
agcaacgauaccaaaua

SEQ ID NO: 2061389 - RNA, 19 nt, Staphylococcus aureus subsp. aureus Mu50
agcaacgauaccaaauaua

SEQ ID NO: 2061390 - RNA, 15 nt, Staphylococcus aureus subsp. aureus Mu50
agcaacgaugucacu

SEQ ID NO: 2061391 - RNA, 23 nt, Staphylococcus aureus subsp. aureus Mu50
agcaccguaacauauguacuauu

SEQ ID NO: 2061392 - RNA, 13 nt, Staphylococcus aureus subsp. aureus Mu50
agccaucaauauu

SEQ ID NO: 2061393 - RNA, 22 nt, Staphylococcus aureus subsp. aureus Mu50
agccauuauuauuuuuuucuuu

SEQ ID NO: 2061394 - RNA, 17 nt, Staphylococcus aureus subsp. aureus Mu50
agccaagauaaaucauc

SEQ ID NO: 2061395 - RNA, 14 nt, Staphylococcus aureus subsp. aureus Mu50
agccaauaaaaugu

SEQ ID NO: 2061396 - RNA, 16 nt, Staphylococcus aureus subsp. aureus Mu50
agcaugacuguaagua

SEQ ID NO: 2061397 - RNA, 21 nt, Staphylococcus aureus subsp. aureus Mu50
agcaugauaaaguauguuguc

SEQ ID NO: 2061398 - RNA, 16 nt, Staphylococcus aureus subsp. aureus Mu50
agccaccuaaaucucc

SEQ ID NO: 2061399 - RNA, 18 nt, Staphylococcus aureus subsp. aureus Mu50
agccccagcaaauacuuc

SEQ ID NO: 2061400 - RNA, 22 nt, Staphylococcus aureus subsp. aureus Mu50
agccgauaauuugagaaaugaa

SEQ ID NO: 2061401 - RNA, 15 nt, Staphylococcus aureus subsp. aureus Mu50
agcaaaaauauuuaa

SEQ ID NO: 2061402 - RNA, 17 nt, Staphylococcus aureus subsp. aureus Mu50
agcaaaaauauuuaaac

SEQ ID NO: 2061403 - RNA, 22 nt, Staphylococcus aureus subsp. aureus Mu50
agcaaaauuauguaaaaaauau

SEQ ID NO: 2061404 - RNA, 17 nt, Staphylococcus aureus subsp. aureus Mu50
agcaaauauuauuaaau

SEQ ID NO: 2061405 - RNA, 17 nt, Staphylococcus aureus subsp. aureus Mu50
agcaaauacuucaagag

SEQ ID NO: 2061406 - RNA, 19 nt, Staphylococcus aureus subsp. aureus Mu50
agcaaaugcuuaagaaauu

SEQ ID NO: 2061407 - RNA, 16 nt, Staphylococcus aureus subsp. aureus Mu50
agcaaaugcacuguau

SEQ ID NO: 2061408 - RNA, 13 nt, Staphylococcus aureus subsp. aureus Mu50
agcaaauauuucu

SEQ ID NO: 2061409 - RNA, 19 nt, Staphylococcus aureus subsp. aureus Mu50
agauuuuaugcuuuacuug

SEQ ID NO: 2061410 - RNA, 16 nt, Staphylococcus aureus subsp. aureus Mu50
agauuuguauuuugcg

SEQ ID NO: 2061411 - RNA, 13 nt, Staphylococcus aureus subsp. aureus Mu50
agauuugaaauuu

SEQ ID NO: 2061412 - RNA, 15 nt, Staphylococcus aureus subsp. aureus Mu50
agauuugaaauuuau

SEQ ID NO: 2061413 - RNA, 19 nt, Staphylococcus aureus subsp. aureus Mu50
agauuugaaauuuauuaua

SEQ ID NO: 2061414 - RNA, 15 nt, Staphylococcus aureus subsp. aureus Mu50
agauuguauuuaaua

SEQ ID NO: 2061415 - RNA, 14 nt, Staphylococcus aureus subsp. aureus Mu50
agauuguuauuaua

SEQ ID NO: 2061416 - RNA, 22 nt, Staphylococcus aureus subsp. aureus Mu50
agauuuaccucuugauaaaaua

SEQ ID NO: 2061417 - RNA, 23 nt, Staphylococcus aureus subsp. aureus Mu50
agauuuaaacauccaauuauguu

SEQ ID NO: 2061418 - RNA, 22 nt, Staphylococcus aureus subsp. aureus Mu50
agauuuauaacgacguaauccu

SEQ ID NO: 2061419 - RNA, 19 nt, Staphylococcus aureus subsp. aureus Mu50
agauuuauuaaauauaugc

SEQ ID NO: 2061420 - RNA, 20 nt, Staphylococcus aureus subsp. aureus Mu50
agauuuauuaaauauaugcg

SEQ ID NO: 2061421 - RNA, 15 nt, Staphylococcus aureus subsp. aureus Mu50
agauuccuguaacaa

SEQ ID NO: 2061422 - RNA, 14 nt, Staphylococcus aureus subsp. aureus Mu50
agauugagaauuca

SEQ ID NO: 2061423 - RNA, 16 nt, Staphylococcus aureus subsp. aureus Mu50
agauugauauaaauua

SEQ ID NO: 2061424 - RNA, 14 nt, Staphylococcus aureus subsp. aureus Mu50
agauucauauuuau

SEQ ID NO: 2061425 - RNA, 18 nt, Staphylococcus aureus subsp. aureus Mu50
agauucacuguauaaaua

SEQ ID NO: 2061426 - RNA, 24 nt, Staphylococcus aureus subsp. aureus Mu50
agauuaguguagggggcauuauua

SEQ ID NO: 2061427 - RNA, 13 nt, Staphylococcus aureus subsp. aureus Mu50
agauuagagaaga

SEQ ID NO: 2061428 - RNA, 15 nt, Staphylococcus aureus subsp. aureus Mu50
agauucaaauugguu

SEQ ID NO: 2061429 - RNA, 22 nt, Staphylococcus aureus subsp. aureus Mu50
agauggacaguuuuuauauuaa

SEQ ID NO: 2061430 - RNA, 15 nt, Staphylococcus aureus subsp. aureus Mu50
agaugcauaaaaaaa

SEQ ID NO: 2061431 - RNA, 16 nt, Staphylococcus aureus subsp. aureus Mu50
agaugcauaaaaaaag

SEQ ID NO: 2061432 - RNA, 16 nt, Staphylococcus aureus subsp. aureus Mu50
agaugcauaaaaaccu

SEQ ID NO: 2061433 - RNA, 19 nt, Staphylococcus aureus subsp. aureus Mu50
agaugucgaaaaguauaug

SEQ ID NO: 2061434 - RNA, 21 nt, Staphylococcus aureus subsp. aureus Mu50
aaaaccccuguugaacuuuag

SEQ ID NO: 2061435 - RNA, 20 nt, Staphylococcus aureus subsp. aureus Mu50
aaaaccgaggaaauccuuaa

SEQ ID NO: 2061436 - RNA, 15 nt, Staphylococcus aureus subsp. aureus Mu50
aaaaccgagaaucuc

SEQ ID NO: 2061437 - RNA, 18 nt, Staphylococcus aureus subsp. aureus Mu50
aaaaccgaggaaauccuu

SEQ ID NO: 2061438 - RNA, 17 nt, Staphylococcus aureus subsp. aureus Mu50
aaaaccgaacaucugaa

SEQ ID NO: 2061439 - RNA, 18 nt, Staphylococcus aureus subsp. aureus Mu50
aaaaccgaacaucugaaa

SEQ ID NO: 2061440 - RNA, 13 nt, Staphylococcus aureus subsp. aureus Mu50
agaugcauaaaaa

SEQ ID NO: 2061441 - RNA, 16 nt, Staphylococcus aureus subsp. aureus Mu50
agaugaggcgauaaaa

SEQ ID NO: 2061442 - RNA, 19 nt, Staphylococcus aureus subsp. aureus Mu50
agaugaggcgauaaaagaa

SEQ ID NO: 2061443 - RNA, 13 nt, Staphylococcus aureus subsp. aureus Mu50
agaugagaaagua

SEQ ID NO: 2061444 - RNA, 22 nt, Staphylococcus aureus subsp. aureus Mu50
aaaaccgcuauaaaauuuugaa

SEQ ID NO: 2061445 - RNA, 21 nt, Staphylococcus aureus subsp. aureus Mu50
agaugaaugccuaauuuugug

SEQ ID NO: 2061446 - RNA, 16 nt, Staphylococcus aureus subsp. aureus Mu50
agauaaauuaauauga

SEQ ID NO: 2061447 - RNA, 14 nt, Staphylococcus aureus subsp. aureus Mu50
agauaaaucaucau

SEQ ID NO: 2061448 - RNA, 12 nt, Staphylococcus aureus subsp. aureus Mu50
agauaaaucauc

SEQ ID NO: 2061449 - RNA, 15 nt, Staphylococcus aureus subsp. aureus Mu50
agauaaauuaauaug

SEQ ID NO: 2061450 - RNA, 21 nt, Staphylococcus aureus subsp. aureus Mu50
agauaaauaaaaggcauucuu

SEQ ID NO: 2061451 - RNA, 15 nt, Staphylococcus aureus subsp. aureus Mu50
agauaaacaagccaa

SEQ ID NO: 2061452 - RNA, 16 nt, Staphylococcus aureus subsp. aureus Mu50
agaguuaauccucauu

SEQ ID NO: 2061453 - RNA, 17 nt, Staphylococcus aureus subsp. aureus Mu50
agaguaguucggaugag

SEQ ID NO: 2061454 - RNA, 23 nt, Staphylococcus aureus subsp. aureus Mu50
agauaaguaguggauaaucacaa

SEQ ID NO: 2061455 - RNA, 17 nt, Staphylococcus aureus subsp. aureus Mu50
agauagauaaaucaaga

SEQ ID NO: 2061456 - RNA, 13 nt, Staphylococcus aureus subsp. aureus Mu50
agauagaaauuac

SEQ ID NO: 2061457 - RNA, 22 nt, Staphylococcus aureus subsp. aureus Mu50
agauagacuuucuugaugaauu

SEQ ID NO: 2061458 - RNA, 23 nt, Staphylococcus aureus subsp. aureus Mu50
agauacuucaguacgguuauuua

SEQ ID NO: 2061459 - RNA, 16 nt, Staphylococcus aureus subsp. aureus Mu50
agauacuucuuuugca

SEQ ID NO: 2061460 - RNA, 18 nt, Staphylococcus aureus subsp. aureus Mu50
agauacguugauguaauu

SEQ ID NO: 2061461 - RNA, 22 nt, Staphylococcus aureus subsp. aureus Mu50
agauacugcuucuacccuugca

SEQ ID NO: 2061462 - RNA, 15 nt, Staphylococcus aureus subsp. aureus Mu50
agauacugaauuuua

SEQ ID NO: 2061463 - RNA, 17 nt, Staphylococcus aureus subsp. aureus Mu50
agauacugaauuuuaac

SEQ ID NO: 2061464 - RNA, 18 nt, Staphylococcus aureus subsp. aureus Mu50
agauauauaauaccccaa

SEQ ID NO: 2061465 - RNA, 18 nt, Staphylococcus aureus subsp. aureus Mu50
agauaucuuaaucuaaaa

SEQ ID NO: 2061466 - RNA, 16 nt, Staphylococcus aureus subsp. aureus Mu50
agauaucuuauaacaa

SEQ ID NO: 2061467 - RNA, 15 nt, Staphylococcus aureus subsp. aureus Mu50
agauaucauaauauu

SEQ ID NO: 2061468 - RNA, 19 nt, Staphylococcus aureus subsp. aureus Mu50
agauaucauuuuauccaaa

SEQ ID NO: 2061469 - RNA, 22 nt, Staphylococcus aureus subsp. aureus Mu50
agauauguuuauauugcaaaaa

SEQ ID NO: 2061470 - RNA, 21 nt, Staphylococcus aureus subsp. aureus Mu50
agauaucuuauaacaaaaauu

SEQ ID NO: 2061471 - RNA, 14 nt, Staphylococcus aureus subsp. aureus Mu50
agauauugaaugga

SEQ ID NO: 2061472 - RNA, 19 nt, Staphylococcus aureus subsp. aureus Mu50
agaggauaggcaacugcaa

SEQ ID NO: 2061473 - RNA, 22 nt, Staphylococcus aureus subsp. aureus Mu50
agaggaacagcggaauacagau

SEQ ID NO: 2061474 - RNA, 17 nt, Staphylococcus aureus subsp. aureus Mu50
agaggacgcuuuauucu

SEQ ID NO: 2061475 - RNA, 13 nt, Staphylococcus aureus subsp. aureus Mu50
aaaacauuuugug

SEQ ID NO: 2061476 - RNA, 17 nt, Staphylococcus aureus subsp. aureus Mu50
agagguaaaucuguuua

SEQ ID NO: 2061477 - RNA, 17 nt, Staphylococcus aureus subsp. aureus Mu50
agagguacuagaauuaa

SEQ ID NO: 2061478 - RNA, 20 nt, Staphylococcus aureus subsp. aureus Mu50
agaggcugguggaaagucag

SEQ ID NO: 2061479 - RNA, 18 nt, Staphylococcus aureus subsp. aureus Mu50
agacuaaaaugaaugaag

SEQ ID NO: 2061480 - RNA, 21 nt, Staphylococcus aureus subsp. aureus Mu50
agacuaaaaaacuaacuuuau

SEQ ID NO: 2061481 - RNA, 13 nt, Staphylococcus aureus subsp. aureus Mu50
agagaugaaagau

SEQ ID NO: 2061482 - RNA, 16 nt, Staphylococcus aureus subsp. aureus Mu50
agagauguauaaaacu

SEQ ID NO: 2061483 - RNA, 13 nt, Staphylococcus aureus subsp. aureus Mu50
agagaugggcuaa

SEQ ID NO: 2061484 - RNA, 20 nt, Staphylococcus aureus subsp. aureus Mu50
aaaacauucccuuaauaaua

SEQ ID NO: 2061485 - RNA, 19 nt, Staphylococcus aureus subsp. aureus Mu50
aaaacauucccuuaauaau

SEQ ID NO: 2061486 - RNA, 12 nt, Staphylococcus aureus subsp. aureus Mu50
agaccaaauauu

SEQ ID NO: 2061487 - RNA, 20 nt, Staphylococcus aureus subsp. aureus Mu50
agacauaaggucuuggacua

SEQ ID NO: 2061488 - RNA, 22 nt, Staphylococcus aureus subsp. aureus Mu50
agacauacagucaauacaaaga

SEQ ID NO: 2061489 - RNA, 12 nt, Staphylococcus aureus subsp. aureus Mu50
agacauaaauau

SEQ ID NO: 2061490 - RNA, 16 nt, Staphylococcus aureus subsp. aureus Mu50
agacauaaaaaaagag

SEQ ID NO: 2061491 - RNA, 13 nt, Staphylococcus aureus subsp. aureus Mu50
agacauaaaaaaa

SEQ ID NO: 2061492 - RNA, 14 nt, Staphylococcus aureus subsp. aureus Mu50
agacauaaaaaaag

SEQ ID NO: 2061493 - RNA, 17 nt, Staphylococcus aureus subsp. aureus Mu50
agacauuuuaucugaaa

SEQ ID NO: 2061494 - RNA, 21 nt, Staphylococcus aureus subsp. aureus Mu50
agacauugaaaggaacauuuc

SEQ ID NO: 2061495 - RNA, 19 nt, Staphylococcus aureus subsp. aureus Mu50
agacaucaucuauuuuuaa

SEQ ID NO: 2061496 - RNA, 16 nt, Staphylococcus aureus subsp. aureus Mu50
agacaucauuguuuua

SEQ ID NO: 2061497 - RNA, 15 nt, Staphylococcus aureus subsp. aureus Mu50
agacauccacagaau

SEQ ID NO: 2061498 - RNA, 17 nt, Staphylococcus aureus subsp. aureus Mu50
aaaacauaaauacaaaa

SEQ ID NO: 2061499 - RNA, 18 nt, Staphylococcus aureus subsp. aureus Mu50
aaaacauaaauacaaaaa

SEQ ID NO: 2061500 - RNA, 19 nt, Staphylococcus aureus subsp. aureus Mu50
agacguaaguguaaaugaa

SEQ ID NO: 2061501 - RNA, 20 nt, Staphylococcus aureus subsp. aureus Mu50
agacguacaugcuucaauau

SEQ ID NO: 2061502 - RNA, 17 nt, Staphylococcus aureus subsp. aureus Mu50
agaccuucaauaucuuc

SEQ ID NO: 2061503 - RNA, 16 nt, Staphylococcus aureus subsp. aureus Mu50
agaccuucuucucuaa

SEQ ID NO: 2061504 - RNA, 19 nt, Staphylococcus aureus subsp. aureus Mu50
agaauccuaugccaaauaa

SEQ ID NO: 2061505 - RNA, 20 nt, Staphylococcus aureus subsp. aureus Mu50
agaauccuaugccaaauaac

SEQ ID NO: 2061506 - RNA, 15 nt, Staphylococcus aureus subsp. aureus Mu50
agaaugauacuguau

SEQ ID NO: 2061507 - RNA, 18 nt, Staphylococcus aureus subsp. aureus Mu50
agaaugaauaauuccagu

SEQ ID NO: 2061508 - RNA, 18 nt, Staphylococcus aureus subsp. aureus Mu50
agaaugaacuucucuuag

SEQ ID NO: 2061509 - RNA, 19 nt, Staphylococcus aureus subsp. aureus Mu50
agaauucuaaaagaauuau

SEQ ID NO: 2061510 - RNA, 17 nt, Staphylococcus aureus subsp. aureus Mu50
agaaugucgauauuucu

SEQ ID NO: 2061511 - RNA, 13 nt, Staphylococcus aureus subsp. aureus Mu50
agaauuaaagucu

SEQ ID NO: 2061512 - RNA, 12 nt, Staphylococcus aureus subsp. aureus Mu50
agaauuaacaac

SEQ ID NO: 2061513 - RNA, 20 nt, Staphylococcus aureus subsp. aureus Mu50
agaauuuuucauauacuuaa

SEQ ID NO: 2061514 - RNA, 14 nt, Staphylococcus aureus subsp. aureus Mu50
agaauuucaucaaa

SEQ ID NO: 2061515 - RNA, 21 nt, Staphylococcus aureus subsp. aureus Mu50
agacaaugauuugugguaauc

SEQ ID NO: 2061516 - RNA, 16 nt, Staphylococcus aureus subsp. aureus Mu50
agacaaguauacuuga

SEQ ID NO: 2061517 - RNA, 13 nt, Staphylococcus aureus subsp. aureus Mu50
agacaccaaaaaa

SEQ ID NO: 2061518 - RNA, 15 nt, Staphylococcus aureus subsp. aureus Mu50
agacaccuucaauau

SEQ ID NO: 2061519 - RNA, 16 nt, Staphylococcus aureus subsp. aureus Mu50
agacaccuuaucacuu

SEQ ID NO: 2061520 - RNA, 22 nt, Staphylococcus aureus subsp. aureus Mu50
aaaacacccugcuuaucauuac

SEQ ID NO: 2061521 - RNA, 18 nt, Staphylococcus aureus subsp. aureus Mu50
agaaauuagaaccaucau

SEQ ID NO: 2061522 - RNA, 23 nt, Staphylococcus aureus subsp. aureus Mu50
agaaauucuacaggcaaugcaag

SEQ ID NO: 2061523 - RNA, 21 nt, Staphylococcus aureus subsp. aureus Mu50
agaaauucgcaagccuucuau

SEQ ID NO: 2061524 - RNA, 21 nt, Staphylococcus aureus subsp. aureus Mu50
agaaauacuugaauuuaauaa

SEQ ID NO: 2061525 - RNA, 23 nt, Staphylococcus aureus subsp. aureus Mu50
agaaauacuaauuucuauagaaa

SEQ ID NO: 2061526 - RNA, 13 nt, Staphylococcus aureus subsp. aureus Mu50
agaacauaaaaaa

SEQ ID NO: 2061527 - RNA, 15 nt, Staphylococcus aureus subsp. aureus Mu50
agaacaauaauugau

SEQ ID NO: 2061528 - RNA, 14 nt, Staphylococcus aureus subsp. aureus Mu50
agaacaagaauuau

SEQ ID NO: 2061529 - RNA, 13 nt, Staphylococcus aureus subsp. aureus Mu50
agaacaaucaaua

SEQ ID NO: 2061530 - RNA, 15 nt, Staphylococcus aureus subsp. aureus Mu50
agaaccguuuuucau

SEQ ID NO: 2061531 - RNA, 19 nt, Staphylococcus aureus subsp. aureus Mu50
agaacuaacauaauuuuua

SEQ ID NO: 2061532 - RNA, 15 nt, Staphylococcus aureus subsp. aureus Mu50
agaagcugacgaaaa

SEQ ID NO: 2061533 - RNA, 22 nt, Staphylococcus aureus subsp. aureus Mu50
agaaaagcagucgaacaaugau

SEQ ID NO: 2061534 - RNA, 16 nt, Staphylococcus aureus subsp. aureus Mu50
agaaaacuagaacuua

SEQ ID NO: 2061535 - RNA, 20 nt, Staphylococcus aureus subsp. aureus Mu50
agaaaagggcaaaaaaggau

SEQ ID NO: 2061536 - RNA, 16 nt, Staphylococcus aureus subsp. aureus Mu50
agaaaaguaaguaaaa

SEQ ID NO: 2061537 - RNA, 20 nt, Staphylococcus aureus subsp. aureus Mu50
agaaaaguaaguaaaauaaa

SEQ ID NO: 2061538 - RNA, 23 nt, Staphylococcus aureus subsp. aureus Mu50
agaaaaguuacuuacgccaauca

SEQ ID NO: 2061539 - RNA, 11 nt, Staphylococcus aureus subsp. aureus Mu50
agaaacacuuu

SEQ ID NO: 2061540 - RNA, 13 nt, Staphylococcus aureus subsp. aureus Mu50
agaaacauuauau

SEQ ID NO: 2061541 - RNA, 18 nt, Staphylococcus aureus subsp. aureus Mu50
agaaacauuauauaacac

SEQ ID NO: 2061542 - RNA, 18 nt, Staphylococcus aureus subsp. aureus Mu50
acuuuuuauaucaaaauc

SEQ ID NO: 2061543 - RNA, 13 nt, Staphylococcus aureus subsp. aureus Mu50
agaaaaauaugau

SEQ ID NO: 2061544 - RNA, 19 nt, Staphylococcus aureus subsp. aureus Mu50
agaaaaagugauaauuaaa

SEQ ID NO: 2061545 - RNA, 20 nt, Staphylococcus aureus subsp. aureus Mu50
acuuuuggucuguugaaguc

SEQ ID NO: 2061546 - RNA, 17 nt, Staphylococcus aureus subsp. aureus Mu50
acuuuuuaauuccaaag

SEQ ID NO: 2061547 - RNA, 16 nt, Staphylococcus aureus subsp. aureus Mu50
acuuuuguuaaaaaau

SEQ ID NO: 2061548 - RNA, 19 nt, Staphylococcus aureus subsp. aureus Mu50
acuuuuguuaaaaaaugga

SEQ ID NO: 2061549 - RNA, 18 nt, Staphylococcus aureus subsp. aureus Mu50
acuugaucauuauaaaau

SEQ ID NO: 2061550 - RNA, 17 nt, Staphylococcus aureus subsp. aureus Mu50
agaaagugcgguuauuu

SEQ ID NO: 2061551 - RNA, 14 nt, Staphylococcus aureus subsp. aureus Mu50
agaaaguaaaaguu

SEQ ID NO: 2061552 - RNA, 13 nt, Staphylococcus aureus subsp. aureus Mu50
agaaagaaauugu

SEQ ID NO: 2061553 - RNA, 18 nt, Staphylococcus aureus subsp. aureus Mu50
agaaagaccauuguauua

SEQ ID NO: 2061554 - RNA, 18 nt, Staphylococcus aureus subsp. aureus Mu50
agaaagaauaaauguuaa

SEQ ID NO: 2061555 - RNA, 13 nt, Staphylococcus aureus subsp. aureus Mu50
agaaagaauaaau

SEQ ID NO: 2061556 - RNA, 13 nt, Staphylococcus aureus subsp. aureus Mu50
accccuuuauuuu

SEQ ID NO: 2061557 - RNA, 18 nt, Staphylococcus aureus subsp. aureus Mu50
acccaccguuaaaauaua

SEQ ID NO: 2061558 - RNA, 18 nt, Staphylococcus aureus subsp. aureus Mu50
acccacaucuuuuuaaaa

SEQ ID NO: 2061559 - RNA, 12 nt, Staphylococcus aureus subsp. aureus Mu50
acccaccacauu

SEQ ID NO: 2061560 - RNA, 19 nt, Staphylococcus aureus subsp. aureus Mu50
accccauucacuacuuuuu

SEQ ID NO: 2061561 - RNA, 11 nt, Staphylococcus aureus subsp. aureus Mu50
acccaaucauu

SEQ ID NO: 2061562 - RNA, 13 nt, Staphylococcus aureus subsp. aureus Mu50
acccaaaaaauug

SEQ ID NO: 2061563 - RNA, 17 nt, Staphylococcus aureus subsp. aureus Mu50
accauuuuuagaaauag

SEQ ID NO: 2061564 - RNA, 18 nt, Staphylococcus aureus subsp. aureus Mu50
accauuccaaaaauugua

SEQ ID NO: 2061565 - RNA, 14 nt, Staphylococcus aureus subsp. aureus Mu50
accauuaugauuaa

SEQ ID NO: 2061566 - RNA, 20 nt, Staphylococcus aureus subsp. aureus Mu50
accauuaucaagaacuuuaa

SEQ ID NO: 2061567 - RNA, 21 nt, Staphylococcus aureus subsp. aureus Mu50
accauuccaauuucaagugua

SEQ ID NO: 2061568 - RNA, 16 nt, Staphylococcus aureus subsp. aureus Mu50
accauuguauuauccu

SEQ ID NO: 2061569 - RNA, 17 nt, Staphylococcus aureus subsp. aureus Mu50
accauugugaauaauuu

SEQ ID NO: 2061570 - RNA, 19 nt, Staphylococcus aureus subsp. aureus Mu50
accauugcacaguuucauc

SEQ ID NO: 2061571 - RNA, 21 nt, Staphylococcus aureus subsp. aureus Mu50
accauugcacaguuucaucuu

SEQ ID NO: 2061572 - RNA, 14 nt, Staphylococcus aureus subsp. aureus Mu50
accaucauaaaugu

SEQ ID NO: 2061573 - RNA, 22 nt, Staphylococcus aureus subsp. aureus Mu50
accaugaugagauaaaaucaua

SEQ ID NO: 2061574 - RNA, 17 nt, Staphylococcus aureus subsp. aureus Mu50
accaugagaaaccgcuu

SEQ ID NO: 2061575 - RNA, 17 nt, Staphylococcus aureus subsp. aureus Mu50
accauaacaauuuuguu

SEQ ID NO: 2061576 - RNA, 16 nt, Staphylococcus aureus subsp. aureus Mu50
accauaauuaaauaac

SEQ ID NO: 2061577 - RNA, 19 nt, Staphylococcus aureus subsp. aureus Mu50
accacuuuuguuaaaaaau

SEQ ID NO: 2061578 - RNA, 20 nt, Staphylococcus aureus subsp. aureus Mu50
accacuuuccauacaccuuu

SEQ ID NO: 2061579 - RNA, 15 nt, Staphylococcus aureus subsp. aureus Mu50
accacuuuuguuaaa

SEQ ID NO: 2061580 - RNA, 18 nt, Staphylococcus aureus subsp. aureus Mu50
accacuuuuguuaaaaaa

SEQ ID NO: 2061581 - RNA, 21 nt, Staphylococcus aureus subsp. aureus Mu50
accacuuuuguuaaaaaaugg

SEQ ID NO: 2061582 - RNA, 20 nt, Staphylococcus aureus subsp. aureus Mu50
accauacuaaaacaugauac

SEQ ID NO: 2061583 - RNA, 14 nt, Staphylococcus aureus subsp. aureus Mu50
accauacucuaacu

SEQ ID NO: 2061584 - RNA, 20 nt, Staphylococcus aureus subsp. aureus Mu50
acccucauuuuuauaaauuu

SEQ ID NO: 2061585 - RNA, 21 nt, Staphylococcus aureus subsp. aureus Mu50
acccucauuuuuauaaauuuu

SEQ ID NO: 2061586 - RNA, 19 nt, Staphylococcus aureus subsp. aureus Mu50
accgccaacuaauguuaaa

SEQ ID NO: 2061587 - RNA, 19 nt, Staphylococcus aureus subsp. aureus Mu50
accgcacuucuauauuaau

SEQ ID NO: 2061588 - RNA, 17 nt, Staphylococcus aureus subsp. aureus Mu50
accgcacuucuauauua

SEQ ID NO: 2061589 - RNA, 21 nt, Staphylococcus aureus subsp. aureus Mu50
acgccaaauaucaguaauaau

SEQ ID NO: 2061590 - RNA, 18 nt, Staphylococcus aureus subsp. aureus Mu50
acgcauuuuaaauaaaau

SEQ ID NO: 2061591 - RNA, 15 nt, Staphylococcus aureus subsp. aureus Mu50
acgcauuuuaaauaa

SEQ ID NO: 2061592 - RNA, 18 nt, Staphylococcus aureus subsp. aureus Mu50
acgcauuauuaagggggu

SEQ ID NO: 2061593 - RNA, 23 nt, Staphylococcus aureus subsp. aureus Mu50
acgcauacaggaaauugaagcgu

SEQ ID NO: 2061594 - RNA, 15 nt, Staphylococcus aureus subsp. aureus Mu50
acgcaguugaaaaag

SEQ ID NO: 2061595 - RNA, 19 nt, Staphylococcus aureus subsp. aureus Mu50
acgcacguauauacgauug

SEQ ID NO: 2061596 - RNA, 17 nt, Staphylococcus aureus subsp. aureus Mu50
acgcaauuuaauauuau

SEQ ID NO: 2061597 - RNA, 14 nt, Staphylococcus aureus subsp. aureus Mu50
acgauagauuuauc

SEQ ID NO: 2061598 - RNA, 16 nt, Staphylococcus aureus subsp. aureus Mu50
acgauaauuguuaaag

SEQ ID NO: 2061599 - RNA, 15 nt, Staphylococcus aureus subsp. aureus Mu50
acgauaauaauaaga

SEQ ID NO: 2061600 - RNA, 20 nt, Staphylococcus aureus subsp. aureus Mu50
acgauaagcacgauaaaaau

SEQ ID NO: 2061601 - RNA, 18 nt, Staphylococcus aureus subsp. aureus Mu50
acgauaccggcaacuggu

SEQ ID NO: 2061602 - RNA, 18 nt, Staphylococcus aureus subsp. aureus Mu50
acgauaccuuuaauaaua

SEQ ID NO: 2061603 - RNA, 17 nt, Staphylococcus aureus subsp. aureus Mu50
acgauacgacuugaaau

SEQ ID NO: 2061604 - RNA, 21 nt, Staphylococcus aureus subsp. aureus Mu50
acgauacgacuugaaaucuuu

SEQ ID NO: 2061605 - RNA, 19 nt, Staphylococcus aureus subsp. aureus Mu50
acgaagcgggccucaucga

SEQ ID NO: 2061606 - RNA, 13 nt, Staphylococcus aureus subsp. aureus Mu50
acgacuugaaauc

SEQ ID NO: 2061607 - RNA, 15 nt, Staphylococcus aureus subsp. aureus Mu50
acgauugaacaucuc

SEQ ID NO: 2061608 - RNA, 16 nt, Staphylococcus aureus subsp. aureus Mu50
acgauugauuaucaua

SEQ ID NO: 2061609 - RNA, 23 nt, Staphylococcus aureus subsp. aureus Mu50
acgauugauagacauaaccuugc

SEQ ID NO: 2061610 - RNA, 16 nt, Staphylococcus aureus subsp. aureus Mu50
acgauugaacaucucu

SEQ ID NO: 2061611 - RNA, 14 nt, Staphylococcus aureus subsp. aureus Mu50
acgauuaauaaaau

SEQ ID NO: 2061612 - RNA, 19 nt, Staphylococcus aureus subsp. aureus Mu50
acgauuucuaguuuaucuu

SEQ ID NO: 2061613 - RNA, 17 nt, Staphylococcus aureus subsp. aureus Mu50
acgauuuguucaaugau

SEQ ID NO: 2061614 - RNA, 16 nt, Staphylococcus aureus subsp. aureus Mu50
acgauuuuuaaaaugc

SEQ ID NO: 2061615 - RNA, 15 nt, Staphylococcus aureus subsp. aureus Mu50
acgauuuugucuuuu

SEQ ID NO: 2061616 - RNA, 17 nt, Staphylococcus aureus subsp. aureus Mu50
acgcaaaaauacuccuu

SEQ ID NO: 2061617 - RNA, 14 nt, Staphylococcus aureus subsp. aureus Mu50
accugauaauacaa

SEQ ID NO: 2061618 - RNA, 19 nt, Staphylococcus aureus subsp. aureus Mu50
accugggacauuaaucgau

SEQ ID NO: 2061619 - RNA, 18 nt, Staphylococcus aureus subsp. aureus Mu50
accuuacauaggauaucu

SEQ ID NO: 2061620 - RNA, 18 nt, Staphylococcus aureus subsp. aureus Mu50
accuuaauaaugaauucu

SEQ ID NO: 2061621 - RNA, 22 nt, Staphylococcus aureus subsp. aureus Mu50
accuuaauaggauaugcuaaac

SEQ ID NO: 2061622 - RNA, 15 nt, Staphylococcus aureus subsp. aureus Mu50
accuuacccaaaaaa

SEQ ID NO: 2061623 - RNA, 13 nt, Staphylococcus aureus subsp. aureus Mu50
accuucaauaucu

SEQ ID NO: 2061624 - RNA, 20 nt, Staphylococcus aureus subsp. aureus Mu50
accuugauuuaauuuuuaau

SEQ ID NO: 2061625 - RNA, 16 nt, Staphylococcus aureus subsp. aureus Mu50
accuuuaaaacaucau

SEQ ID NO: 2061626 - RNA, 13 nt, Staphylococcus aureus subsp. aureus Mu50
accuuuaauuaca

SEQ ID NO: 2061627 - RNA, 18 nt, Staphylococcus aureus subsp. aureus Mu50
accuuuaucuguaacaaa

SEQ ID NO: 2061628 - RNA, 20 nt, Staphylococcus aureus subsp. aureus Mu50
accuuuaugugcaucauuua

SEQ ID NO: 2061629 - RNA, 23 nt, Staphylococcus aureus subsp. aureus Mu50
accuuuaugugcaucauuuauau

SEQ ID NO: 2061630 - RNA, 20 nt, Staphylococcus aureus subsp. aureus Mu50
acgaaaugaccuuaauauaa

SEQ ID NO: 2061631 - RNA, 13 nt, Staphylococcus aureus subsp. aureus Mu50
accuuuuuucucu

SEQ ID NO: 2061632 - RNA, 12 nt, Staphylococcus aureus subsp. aureus Mu50
accuuuuuuaac

SEQ ID NO: 2061633 - RNA, 15 nt, Staphylococcus aureus subsp. aureus Mu50
acgaaauaguucaaa

SEQ ID NO: 2061634 - RNA, 14 nt, Staphylococcus aureus subsp. aureus Mu50
acgaaauaguucaa

SEQ ID NO: 2061635 - RNA, 18 nt, Staphylococcus aureus subsp. aureus Mu50
accuacuuuuucaauaug

SEQ ID NO: 2061636 - RNA, 19 nt, Staphylococcus aureus subsp. aureus Mu50
accuacuuuuucaauaugu

SEQ ID NO: 2061637 - RNA, 19 nt, Staphylococcus aureus subsp. aureus Mu50
accuagggauaauuuuauu

SEQ ID NO: 2061638 - RNA, 21 nt, Staphylococcus aureus subsp. aureus Mu50
accucugauguguuauguuag

SEQ ID NO: 2061639 - RNA, 16 nt, Staphylococcus aureus subsp. aureus Mu50
accucuacauuauauu

SEQ ID NO: 2061640 - RNA, 23 nt, Staphylococcus aureus subsp. aureus Mu50
accucuaaguucaccuaaaugau

SEQ ID NO: 2061641 - RNA, 12 nt, Staphylococcus aureus subsp. aureus Mu50
acgguacagaua

SEQ ID NO: 2061642 - RNA, 14 nt, Staphylococcus aureus subsp. aureus Mu50
acguaaguuugcua

SEQ ID NO: 2061643 - RNA, 19 nt, Staphylococcus aureus subsp. aureus Mu50
acguaauccuuggaaacga

SEQ ID NO: 2061644 - RNA, 16 nt, Staphylococcus aureus subsp. aureus Mu50
acguaaucuaauacau

SEQ ID NO: 2061645 - RNA, 14 nt, Staphylococcus aureus subsp. aureus Mu50
acguaaugaaucaa

SEQ ID NO: 2061646 - RNA, 14 nt, Staphylococcus aureus subsp. aureus Mu50
acguaaaauaugau

SEQ ID NO: 2061647 - RNA, 13 nt, Staphylococcus aureus subsp. aureus Mu50
acgguuugaaaaa

SEQ ID NO: 2061648 - RNA, 15 nt, Staphylococcus aureus subsp. aureus Mu50
acgcuuuuuaaaaaa

SEQ ID NO: 2061649 - RNA, 13 nt, Staphylococcus aureus subsp. aureus Mu50
acgcuugauaaaa

SEQ ID NO: 2061650 - RNA, 16 nt, Staphylococcus aureus subsp. aureus Mu50
acggaacuacuacauu

SEQ ID NO: 2061651 - RNA, 17 nt, Staphylococcus aureus subsp. aureus Mu50
acgcuucaauuauuuca

SEQ ID NO: 2061652 - RNA, 15 nt, Staphylococcus aureus subsp. aureus Mu50
acgcugaaauuuuuu

SEQ ID NO: 2061653 - RNA, 19 nt, Staphylococcus aureus subsp. aureus Mu50
acgcucaugaguuucucau

SEQ ID NO: 2061654 - RNA, 19 nt, Staphylococcus aureus subsp. aureus Mu50
acgcuagugcgcgauaaau

SEQ ID NO: 2061655 - RNA, 16 nt, Staphylococcus aureus subsp. aureus Mu50
acgccauaagaaaaua

SEQ ID NO: 2061656 - RNA, 15 nt, Staphylococcus aureus subsp. aureus Mu50
acgccauaagaaaau

SEQ ID NO: 2061657 - RNA, 15 nt, Staphylococcus aureus subsp. aureus Mu50
acguuuuuuuaaaua

SEQ ID NO: 2061658 - RNA, 15 nt, Staphylococcus aureus subsp. aureus Mu50
acguuuuuuuauaaa

SEQ ID NO: 2061659 - RNA, 20 nt, Staphylococcus aureus subsp. aureus Mu50
acguuuugguuguucuuuuu

SEQ ID NO: 2061660 - RNA, 19 nt, Staphylococcus aureus subsp. aureus Mu50
acuaaaacaaauucauauu

SEQ ID NO: 2061661 - RNA, 22 nt, Staphylococcus aureus subsp. aureus Mu50
acuaaaaagaagcucccauuaa

SEQ ID NO: 2061662 - RNA, 15 nt, Staphylococcus aureus subsp. aureus Mu50
acuaaaaauauauuu

SEQ ID NO: 2061663 - RNA, 15 nt, Staphylococcus aureus subsp. aureus Mu50
acuaaaccauugaau

SEQ ID NO: 2061664 - RNA, 16 nt, Staphylococcus aureus subsp. aureus Mu50
acuaaacgauaaauua

SEQ ID NO: 2061665 - RNA, 14 nt, Staphylococcus aureus subsp. aureus Mu50
acuaaacuuuucuu

SEQ ID NO: 2061666 - RNA, 17 nt, Staphylococcus aureus subsp. aureus Mu50
acuaaaguaaauaacac

SEQ ID NO: 2061667 - RNA, 18 nt, Staphylococcus aureus subsp. aureus Mu50
acuaaagguauucuauuu

SEQ ID NO: 2061668 - RNA, 17 nt, Staphylococcus aureus subsp. aureus Mu50
acuaaauguucuggaau

SEQ ID NO: 2061669 - RNA, 14 nt, Staphylococcus aureus subsp. aureus Mu50
acuaaauuaaaagu

SEQ ID NO: 2061670 - RNA, 15 nt, Staphylococcus aureus subsp. aureus Mu50
acguugauguaauuc

SEQ ID NO: 2061671 - RNA, 19 nt, Staphylococcus aureus subsp. aureus Mu50
acguuuuaaauaaaugacu

SEQ ID NO: 2061672 - RNA, 20 nt, Staphylococcus aureus subsp. aureus Mu50
acguuuuaaauaaaugacuu

SEQ ID NO: 2061673 - RNA, 16 nt, Staphylococcus aureus subsp. aureus Mu50
acguuugcauauccuu

SEQ ID NO: 2061674 - RNA, 17 nt, Staphylococcus aureus subsp. aureus Mu50
acguuuucacuucgcca

SEQ ID NO: 2061675 - RNA, 17 nt, Staphylococcus aureus subsp. aureus Mu50
acguuuuagacauaaaa

SEQ ID NO: 2061676 - RNA, 21 nt, Staphylococcus aureus subsp. aureus Mu50
acguuuaauaccuaugauaua

SEQ ID NO: 2061677 - RNA, 18 nt, Staphylococcus aureus subsp. aureus Mu50
acguuauucguuaacaau

SEQ ID NO: 2061678 - RNA, 23 nt, Staphylococcus aureus subsp. aureus Mu50
acguucuugguauuuuuuaaaug

SEQ ID NO: 2061679 - RNA, 22 nt, Staphylococcus aureus subsp. aureus Mu50
acguucuugguauuuuuuaaau

SEQ ID NO: 2061680 - RNA, 13 nt, Staphylococcus aureus subsp. aureus Mu50
acguuauuuucaa

SEQ ID NO: 2061681 - RNA, 17 nt, Staphylococcus aureus subsp. aureus Mu50
acguucaaucguuucuu

SEQ ID NO: 2061682 - RNA, 22 nt, Staphylococcus aureus subsp. aureus Mu50
acgugacauuuucaaguuuaaa

SEQ ID NO: 2061683 - RNA, 21 nt, Staphylococcus aureus subsp. aureus Mu50
acgucuuuccauuuaucaaca

SEQ ID NO: 2061684 - RNA, 22 nt, Staphylococcus aureus subsp. aureus Mu50
acgucuuguaucaacauuaaua

SEQ ID NO: 2061685 - RNA, 16 nt, Staphylococcus aureus subsp. aureus Mu50
acgucuuguaucaaca

SEQ ID NO: 2061686 - RNA, 19 nt, Staphylococcus aureus subsp. aureus Mu50
acuauuucgcuuuuuuuau

SEQ ID NO: 2061687 - RNA, 15 nt, Staphylococcus aureus subsp. aureus Mu50
acuauugaaaauaga

SEQ ID NO: 2061688 - RNA, 21 nt, Staphylococcus aureus subsp. aureus Mu50
acuauugauauucuaaaaaau

SEQ ID NO: 2061689 - RNA, 13 nt, Staphylococcus aureus subsp. aureus Mu50
acuauugaaaaua

SEQ ID NO: 2061690 - RNA, 16 nt, Staphylococcus aureus subsp. aureus Mu50
acuauacugaugaaaa

SEQ ID NO: 2061691 - RNA, 21 nt, Staphylococcus aureus subsp. aureus Mu50
acuauacuuuuauagaaaauu

SEQ ID NO: 2061692 - RNA, 18 nt, Staphylococcus aureus subsp. aureus Mu50
acuauaaauacaaauaua

SEQ ID NO: 2061693 - RNA, 14 nt, Staphylococcus aureus subsp. aureus Mu50
acuauaaugaugua

SEQ ID NO: 2061694 - RNA, 20 nt, Staphylococcus aureus subsp. aureus Mu50
acuauaauaauuaacugcgg

SEQ ID NO: 2061695 - RNA, 16 nt, Staphylococcus aureus subsp. aureus Mu50
acuauaauaauuggaa

SEQ ID NO: 2061696 - RNA, 21 nt, Staphylococcus aureus subsp. aureus Mu50
acuauaccuagggaugauaua

SEQ ID NO: 2061697 - RNA, 22 nt, Staphylococcus aureus subsp. aureus Mu50
acuauaugaaaagagaaacaaa

SEQ ID NO: 2061698 - RNA, 17 nt, Staphylococcus aureus subsp. aureus Mu50
acuauaugugucgagua

SEQ ID NO: 2061699 - RNA, 16 nt, Staphylococcus aureus subsp. aureus Mu50
acuauaugaaaagaga

SEQ ID NO: 2061700 - RNA, 12 nt, Staphylococcus aureus subsp. aureus Mu50
acuauauauagu

SEQ ID NO: 2061701 - RNA, 14 nt, Staphylococcus aureus subsp. aureus Mu50
acuauaauaauuaa

SEQ ID NO: 2061702 - RNA, 19 nt, Staphylococcus aureus subsp. aureus Mu50
acuauaaccuauuaaaucu

SEQ ID NO: 2061703 - RNA, 19 nt, Staphylococcus aureus subsp. aureus Mu50
acuagaaaacauaaauaca

SEQ ID NO: 2061704 - RNA, 16 nt, Staphylococcus aureus subsp. aureus Mu50
acuaauaauuuguaau

SEQ ID NO: 2061705 - RNA, 11 nt, Staphylococcus aureus subsp. aureus Mu50
acuaauaauug

SEQ ID NO: 2061706 - RNA, 15 nt, Staphylococcus aureus subsp. aureus Mu50
acuaauauuucuuag

SEQ ID NO: 2061707 - RNA, 18 nt, Staphylococcus aureus subsp. aureus Mu50
acuaauauuucuuagaua

SEQ ID NO: 2061708 - RNA, 20 nt, Staphylococcus aureus subsp. aureus Mu50
acuaaugauaguacauuuau

SEQ ID NO: 2061709 - RNA, 11 nt, Staphylococcus aureus subsp. aureus Mu50
acuaauuaaag

SEQ ID NO: 2061710 - RNA, 21 nt, Staphylococcus aureus subsp. aureus Mu50
acuaauguuaaucaaaauuau

SEQ ID NO: 2061711 - RNA, 21 nt, Staphylococcus aureus subsp. aureus Mu50
acuaaucuuaguuaaaauuca

SEQ ID NO: 2061712 - RNA, 20 nt, Staphylococcus aureus subsp. aureus Mu50
acuaaucuuuuuuuaauuaa

SEQ ID NO: 2061713 - RNA, 16 nt, Staphylococcus aureus subsp. aureus Mu50
acuaaugauaguacau

SEQ ID NO: 2061714 - RNA, 13 nt, Staphylococcus aureus subsp. aureus Mu50
acuaaucguguau

SEQ ID NO: 2061715 - RNA, 22 nt, Staphylococcus aureus subsp. aureus Mu50
acuacacuccccuuaucaaaac

SEQ ID NO: 2061716 - RNA, 15 nt, Staphylococcus aureus subsp. aureus Mu50
acuaauuuagacauc

SEQ ID NO: 2061717 - RNA, 23 nt, Staphylococcus aureus subsp. aureus Mu50
acuacaaacuugauuauguaauu

SEQ ID NO: 2061718 - RNA, 13 nt, Staphylococcus aureus subsp. aureus Mu50
acuacaacuuaag

SEQ ID NO: 2061719 - RNA, 19 nt, Staphylococcus aureus subsp. aureus Mu50
acuaauuuauuaauuuuau

SEQ ID NO: 2061720 - RNA, 18 nt, Staphylococcus aureus subsp. aureus Mu50
acuaauuucuauagaaaa

SEQ ID NO: 2061721 - RNA, 20 nt, Staphylococcus aureus subsp. aureus Mu50
acuaauuucuauagaaaaag

SEQ ID NO: 2061722 - RNA, 18 nt, Staphylococcus aureus subsp. aureus Mu50
acuaauuuaaagcaucau

SEQ ID NO: 2061723 - RNA, 17 nt, Staphylococcus aureus subsp. aureus Mu50
acuaagaccaugagaaa

SEQ ID NO: 2061724 - RNA, 17 nt, Staphylococcus aureus subsp. aureus Mu50
acuaaguauaguguuaa

SEQ ID NO: 2061725 - RNA, 18 nt, Staphylococcus aureus subsp. aureus Mu50
acuaaguuuguuuucuuu

SEQ ID NO: 2061726 - RNA, 20 nt, Staphylococcus aureus subsp. aureus Mu50
acuaacauaauuuuuauuua

SEQ ID NO: 2061727 - RNA, 16 nt, Staphylococcus aureus subsp. aureus Mu50
acuaaauucaauaauc

SEQ ID NO: 2061728 - RNA, 18 nt, Staphylococcus aureus subsp. aureus Mu50
acuaacaaccguuuuaag

SEQ ID NO: 2061729 - RNA, 16 nt, Staphylococcus aureus subsp. aureus Mu50
acuaaccuauuaaaaa

SEQ ID NO: 2061730 - RNA, 22 nt, Staphylococcus aureus subsp. aureus Mu50
acuaacguaaaggugauauuug

SEQ ID NO: 2061731 - RNA, 14 nt, Staphylococcus aureus subsp. aureus Mu50
acuaacguuuuaaa

SEQ ID NO: 2061732 - RNA, 12 nt, Staphylococcus aureus subsp. aureus Mu50
acuuacaaauau

SEQ ID NO: 2061733 - RNA, 15 nt, Staphylococcus aureus subsp. aureus Mu50
acuuaccuuucaaau

SEQ ID NO: 2061734 - RNA, 16 nt, Staphylococcus aureus subsp. aureus Mu50
acuuaaccauuuaaaa

SEQ ID NO: 2061735 - RNA, 15 nt, Staphylococcus aureus subsp. aureus Mu50
acuuaaccauuuaaa

SEQ ID NO: 2061736 - RNA, 18 nt, Staphylococcus aureus subsp. aureus Mu50
acuuaauuaauaauuuaa

SEQ ID NO: 2061737 - RNA, 23 nt, Staphylococcus aureus subsp. aureus Mu50
acuuaaauaucgacaaauuaaaa

SEQ ID NO: 2061738 - RNA, 13 nt, Staphylococcus aureus subsp. aureus Mu50
acuuaaaauuuaa

SEQ ID NO: 2061739 - RNA, 16 nt, Staphylococcus aureus subsp. aureus Mu50
acugucgguucaucua

SEQ ID NO: 2061740 - RNA, 20 nt, Staphylococcus aureus subsp. aureus Mu50
acugucgguucaucuaaaau

SEQ ID NO: 2061741 - RNA, 15 nt, Staphylococcus aureus subsp. aureus Mu50
acugucucaucuucu

SEQ ID NO: 2061742 - RNA, 15 nt, Staphylococcus aureus subsp. aureus Mu50
acuguuggaauaccu

SEQ ID NO: 2061743 - RNA, 21 nt, Staphylococcus aureus subsp. aureus Mu50
acuguucuuucgucuuguaaa

SEQ ID NO: 2061744 - RNA, 18 nt, Staphylococcus aureus subsp. aureus Mu50
acugugauucauucguac

SEQ ID NO: 2061745 - RNA, 23 nt, Staphylococcus aureus subsp. aureus Mu50
acugucucaucuucuaaaucaau

SEQ ID NO: 2061746 - RNA, 15 nt, Staphylococcus aureus subsp. aureus Mu50
acuuaugagcaaagc

SEQ ID NO: 2061747 - RNA, 20 nt, Staphylococcus aureus subsp. aureus Mu50
acuuaugauacugauauuua

SEQ ID NO: 2061748 - RNA, 20 nt, Staphylococcus aureus subsp. aureus Mu50
acuuacugugaaaauaccaa

SEQ ID NO: 2061749 - RNA, 18 nt, Staphylococcus aureus subsp. aureus Mu50
acuuauggguucaauauc

SEQ ID NO: 2061750 - RNA, 14 nt, Staphylococcus aureus subsp. aureus Mu50
acuuauuaauuaau

SEQ ID NO: 2061751 - RNA, 18 nt, Staphylococcus aureus subsp. aureus Mu50
acuuauucuucacuuuca

SEQ ID NO: 2061752 - RNA, 12 nt, Staphylococcus aureus subsp. aureus Mu50
acuucaaacaaa

SEQ ID NO: 2061753 - RNA, 13 nt, Staphylococcus aureus subsp. aureus Mu50
acuucaaacaaag

SEQ ID NO: 2061754 - RNA, 15 nt, Staphylococcus aureus subsp. aureus Mu50
acuucaaacaaaggg

SEQ ID NO: 2061755 - RNA, 16 nt, Staphylococcus aureus subsp. aureus Mu50
acuucaaacaaagggg

SEQ ID NO: 2061756 - RNA, 18 nt, Staphylococcus aureus subsp. aureus Mu50
acuucaaacaaaggggua

SEQ ID NO: 2061757 - RNA, 14 nt, Staphylococcus aureus subsp. aureus Mu50
acuuauuucuuuuc

SEQ ID NO: 2061758 - RNA, 15 nt, Staphylococcus aureus subsp. aureus Mu50
acuuauuugaaugca

SEQ ID NO: 2061759 - RNA, 18 nt, Staphylococcus aureus subsp. aureus Mu50
acuuauuugaaugcaaau

SEQ ID NO: 2061760 - RNA, 22 nt, Staphylococcus aureus subsp. aureus Mu50
acuuauuugccauauacacacu

SEQ ID NO: 2061761 - RNA, 17 nt, Staphylococcus aureus subsp. aureus Mu50
acuucacgcaaaacaau

SEQ ID NO: 2061762 - RNA, 17 nt, Staphylococcus aureus subsp. aureus Mu50
acuucuuguucgauaau

SEQ ID NO: 2061763 - RNA, 15 nt, Staphylococcus aureus subsp. aureus Mu50
acuucuuuauauuua

SEQ ID NO: 2061764 - RNA, 22 nt, Staphylococcus aureus subsp. aureus Mu50
acuucuuuucuuugauaacaau

SEQ ID NO: 2061765 - RNA, 15 nt, Staphylococcus aureus subsp. aureus Mu50
acuucuuuugcaaaa

SEQ ID NO: 2061766 - RNA, 18 nt, Staphylococcus aureus subsp. aureus Mu50
acuucuuuauauuuauca

SEQ ID NO: 2061767 - RNA, 16 nt, Staphylococcus aureus subsp. aureus Mu50
acuucuuucaaaaaca

SEQ ID NO: 2061768 - RNA, 17 nt, Staphylococcus aureus subsp. aureus Mu50
acuugauaaaaaaugaa

SEQ ID NO: 2061769 - RNA, 18 nt, Staphylococcus aureus subsp. aureus Mu50
acuugauaaaaaaugaau

SEQ ID NO: 2061770 - RNA, 13 nt, Staphylococcus aureus subsp. aureus Mu50
acuugaauauuau

SEQ ID NO: 2061771 - RNA, 22 nt, Staphylococcus aureus subsp. aureus Mu50
acuugaccacuuuuguuaaaaa

SEQ ID NO: 2061772 - RNA, 14 nt, Staphylococcus aureus subsp. aureus Mu50
acuucuuuuguuuu

SEQ ID NO: 2061773 - RNA, 22 nt, Staphylococcus aureus subsp. aureus Mu50
acuugaaaauagccauauucau

SEQ ID NO: 2061774 - RNA, 17 nt, Staphylococcus aureus subsp. aureus Mu50
acuucuuuuuuguaucu

SEQ ID NO: 2061775 - RNA, 20 nt, Staphylococcus aureus subsp. aureus Mu50
acuucuuuuguuuuaccauc

SEQ ID NO: 2061776 - RNA, 17 nt, Staphylococcus aureus subsp. aureus Mu50
acuucuaauuugcaaaa

SEQ ID NO: 2061777 - RNA, 22 nt, Staphylococcus aureus subsp. aureus Mu50
acuucuaauuugcaaaaucaac

SEQ ID NO: 2061778 - RNA, 16 nt, Staphylococcus aureus subsp. aureus Mu50
acuucucuaucagucc

SEQ ID NO: 2061779 - RNA, 21 nt, Staphylococcus aureus subsp. aureus Mu50
acuucucucuuauuaaaaaag

SEQ ID NO: 2061780 - RNA, 22 nt, Staphylococcus aureus subsp. aureus Mu50
acuucuauauuaauagaaagug

SEQ ID NO: 2061781 - RNA, 16 nt, Staphylococcus aureus subsp. aureus Mu50
acuucucaauuuagua

SEQ ID NO: 2061782 - RNA, 23 nt, Staphylococcus aureus subsp. aureus Mu50
acuucugauucuucacuaaaaau

SEQ ID NO: 2061783 - RNA, 13 nt, Staphylococcus aureus subsp. aureus Mu50
acuucuuaaaaua

SEQ ID NO: 2061784 - RNA, 19 nt, Staphylococcus aureus subsp. aureus Mu50
acuucuuaaaauaugauuu

SEQ ID NO: 2061785 - RNA, 22 nt, Staphylococcus aureus subsp. aureus Mu50
acuucuuaaaauaugauuuaaa

SEQ ID NO: 2061786 - RNA, 18 nt, Staphylococcus aureus subsp. aureus Mu50
acuucuuaacuugaaaug

SEQ ID NO: 2061787 - RNA, 15 nt, Staphylococcus aureus subsp. aureus Mu50
acuucauuaguugcc

SEQ ID NO: 2061788 - RNA, 21 nt, Staphylococcus aureus subsp. aureus Mu50
acuuccaauacuguugucuug

SEQ ID NO: 2061789 - RNA, 16 nt, Staphylococcus aureus subsp. aureus Mu50
acuucaucacucgcaa

SEQ ID NO: 2061790 - RNA, 18 nt, Staphylococcus aureus subsp. aureus Mu50
acuucauaauauauccug

SEQ ID NO: 2061791 - RNA, 11 nt, Staphylococcus aureus subsp. aureus Mu50
acuucaucuaa

SEQ ID NO: 2061792 - RNA, 11 nt, Staphylococcus aureus subsp. aureus Mu50
acuucccaauc

SEQ ID NO: 2061793 - RNA, 20 nt, Staphylococcus aureus subsp. aureus Mu50
acuucccuuuggaagcaauu

SEQ ID NO: 2061794 - RNA, 17 nt, Staphylococcus aureus subsp. aureus Mu50
acuuccgacugcaccuc

SEQ ID NO: 2061795 - RNA, 16 nt, Staphylococcus aureus subsp. aureus Mu50
acuuccuuuuuuuaag

SEQ ID NO: 2061796 - RNA, 18 nt, Staphylococcus aureus subsp. aureus Mu50
acuuccugcuuuuuuuau

SEQ ID NO: 2061797 - RNA, 16 nt, Staphylococcus aureus subsp. aureus Mu50
acuuccuaaaauuuac

SEQ ID NO: 2061798 - RNA, 18 nt, Staphylococcus aureus subsp. aureus Mu50
acuucgauaugauuaaag

SEQ ID NO: 2061799 - RNA, 17 nt, Staphylococcus aureus subsp. aureus Mu50
acuucgccaagccaucu

SEQ ID NO: 2061800 - RNA, 24 nt, Staphylococcus aureus subsp. aureus Mu50
acucuucaguacgaacaacuaaca

SEQ ID NO: 2061801 - RNA, 17 nt, Staphylococcus aureus subsp. aureus Mu50
acucugauuacauauac

SEQ ID NO: 2061802 - RNA, 19 nt, Staphylococcus aureus subsp. aureus Mu50
acucuaaaaguuguaauuu

SEQ ID NO: 2061803 - RNA, 22 nt, Staphylococcus aureus subsp. aureus Mu50
acucuaaaaguuguaauuuaaa

SEQ ID NO: 2061804 - RNA, 12 nt, Staphylococcus aureus subsp. aureus Mu50
acucuaaaggaa

SEQ ID NO: 2061805 - RNA, 13 nt, Staphylococcus aureus subsp. aureus Mu50
acucgaaaccagc

SEQ ID NO: 2061806 - RNA, 18 nt, Staphylococcus aureus subsp. aureus Mu50
acucccgcaaauauuaaa

SEQ ID NO: 2061807 - RNA, 13 nt, Staphylococcus aureus subsp. aureus Mu50
acuauuuuaaaaa

SEQ ID NO: 2061808 - RNA, 22 nt, Staphylococcus aureus subsp. aureus Mu50
acuauuuguuaugguauuuaua

SEQ ID NO: 2061809 - RNA, 23 nt, Staphylococcus aureus subsp. aureus Mu50
acugcuuuuuuauucuaauacaa

SEQ ID NO: 2061810 - RNA, 16 nt, Staphylococcus aureus subsp. aureus Mu50
acugcgacauguccau

SEQ ID NO: 2061811 - RNA, 14 nt, Staphylococcus aureus subsp. aureus Mu50
acugcauauaaagu

SEQ ID NO: 2061812 - RNA, 16 nt, Staphylococcus aureus subsp. aureus Mu50
acugccaauaaaaugc

SEQ ID NO: 2061813 - RNA, 16 nt, Staphylococcus aureus subsp. aureus Mu50
acugaguuuuaaugaa

SEQ ID NO: 2061814 - RNA, 22 nt, Staphylococcus aureus subsp. aureus Mu50
acugauaaaaggggaaaucauu

SEQ ID NO: 2061815 - RNA, 13 nt, Staphylococcus aureus subsp. aureus Mu50
acugauaauacug

SEQ ID NO: 2061816 - RNA, 16 nt, Staphylococcus aureus subsp. aureus Mu50
acugauauuuagaaua

SEQ ID NO: 2061817 - RNA, 21 nt, Staphylococcus aureus subsp. aureus Mu50
acugcauagguaaccuuaaau

SEQ ID NO: 2061818 - RNA, 21 nt, Staphylococcus aureus subsp. aureus Mu50
acucuuuuucuuucauaauua

SEQ ID NO: 2061819 - RNA, 16 nt, Staphylococcus aureus subsp. aureus Mu50
acucuuuuucuuucau

SEQ ID NO: 2061820 - RNA, 18 nt, Staphylococcus aureus subsp. aureus Mu50
acugaaacuaaauuaaaa

SEQ ID NO: 2061821 - RNA, 15 nt, Staphylococcus aureus subsp. aureus Mu50
aaucgccuacuauaa

SEQ ID NO: 2061822 - RNA, 14 nt, Staphylococcus aureus subsp. aureus Mu50
aaucgccauugucc

SEQ ID NO: 2061823 - RNA, 12 nt, Staphylococcus aureus subsp. aureus Mu50
aaucgaaaauau

SEQ ID NO: 2061824 - RNA, 16 nt, Staphylococcus aureus subsp. aureus Mu50
aaucgaaaauaucaau

SEQ ID NO: 2061825 - RNA, 23 nt, Staphylococcus aureus subsp. aureus Mu50
aauccaucaauaccauaauuaaa

SEQ ID NO: 2061826 - RNA, 22 nt, Staphylococcus aureus subsp. aureus Mu50
aaucccgccgucuccauuauau

SEQ ID NO: 2061827 - RNA, 23 nt, Staphylococcus aureus subsp. aureus Mu50
aaucgcuucgguuaacuguucua

SEQ ID NO: 2061828 - RNA, 16 nt, Staphylococcus aureus subsp. aureus Mu50
aaucggaauaaaauaa

SEQ ID NO: 2061829 - RNA, 18 nt, Staphylococcus aureus subsp. aureus Mu50
aaucggaauaaaauaaau

SEQ ID NO: 2061830 - RNA, 19 nt, Staphylococcus aureus subsp. aureus Mu50
aaucggacagaggagcuca

SEQ ID NO: 2061831 - RNA, 18 nt, Staphylococcus aureus subsp. aureus Mu50
aaucggcuauacauugau

SEQ ID NO: 2061832 - RNA, 19 nt, Staphylococcus aureus subsp. aureus Mu50
aaucguaaacauaaugaca

SEQ ID NO: 2061833 - RNA, 16 nt, Staphylococcus aureus subsp. aureus Mu50
aaucguaggaugcuuc

SEQ ID NO: 2061834 - RNA, 21 nt, Staphylococcus aureus subsp. aureus Mu50
aaucguauuagccaauaaaau

SEQ ID NO: 2061835 - RNA, 17 nt, Staphylococcus aureus subsp. aureus Mu50
aaucuccauuagaacua

SEQ ID NO: 2061836 - RNA, 13 nt, Staphylococcus aureus subsp. aureus Mu50
aaucuauauaaag

SEQ ID NO: 2061837 - RNA, 21 nt, Staphylococcus aureus subsp. aureus Mu50
aaucuauauaaaguugacaau

SEQ ID NO: 2061838 - RNA, 12 nt, Staphylococcus aureus subsp. aureus Mu50
aaucuauauaua

SEQ ID NO: 2061839 - RNA, 23 nt, Staphylococcus aureus subsp. aureus Mu50
aaucuccuugcucaugagcacaa

SEQ ID NO: 2061840 - RNA, 20 nt, Staphylococcus aureus subsp. aureus Mu50
aaucucgucacauauaaaua

SEQ ID NO: 2061841 - RNA, 15 nt, Staphylococcus aureus subsp. aureus Mu50
aaucuaacugugcaa

SEQ ID NO: 2061842 - RNA, 15 nt, Staphylococcus aureus subsp. aureus Mu50
aaucuagaccuucaa

SEQ ID NO: 2061843 - RNA, 14 nt, Staphylococcus aureus subsp. aureus Mu50
aaucuauaaauauc

SEQ ID NO: 2061844 - RNA, 19 nt, Staphylococcus aureus subsp. aureus Mu50
aaucguuguggcuuuuuau

SEQ ID NO: 2061845 - RNA, 12 nt, Staphylococcus aureus subsp. aureus Mu50
aaucguuugcca

SEQ ID NO: 2061846 - RNA, 16 nt, Staphylococcus aureus subsp. aureus Mu50
aaaaauuaaaaaacaa

SEQ ID NO: 2061847 - RNA, 22 nt, Staphylococcus aureus subsp. aureus Mu50
aaaaaugucguauauguaauca

SEQ ID NO: 2061848 - RNA, 17 nt, Staphylococcus aureus subsp. aureus Mu50
aaucauagcauuaagau

SEQ ID NO: 2061849 - RNA, 17 nt, Staphylococcus aureus subsp. aureus Mu50
aaucaguuuuuaaauca

SEQ ID NO: 2061850 - RNA, 15 nt, Staphylococcus aureus subsp. aureus Mu50
aaucaguuuuugaau

SEQ ID NO: 2061851 - RNA, 21 nt, Staphylococcus aureus subsp. aureus Mu50
aaucaguuucaucaaguauaa

SEQ ID NO: 2061852 - RNA, 14 nt, Staphylococcus aureus subsp. aureus Mu50
aaucauaaugaaua

SEQ ID NO: 2061853 - RNA, 23 nt, Staphylococcus aureus subsp. aureus Mu50
aaucauaaugaauaauuaaaaaa

SEQ ID NO: 2061854 - RNA, 20 nt, Staphylococcus aureus subsp. aureus Mu50
aaucauacgagaaauuagaa

SEQ ID NO: 2061855 - RNA, 18 nt, Staphylococcus aureus subsp. aureus Mu50
aaucauaccggcaaauaa

SEQ ID NO: 2061856 - RNA, 23 nt, Staphylococcus aureus subsp. aureus Mu50
aaucauaccggcaaauaacaaug

SEQ ID NO: 2061857 - RNA, 16 nt, Staphylococcus aureus subsp. aureus Mu50
aaucauagcaacaucg

SEQ ID NO: 2061858 - RNA, 16 nt, Staphylococcus aureus subsp. aureus Mu50
aaucagucauucacau

SEQ ID NO: 2061859 - RNA, 16 nt, Staphylococcus aureus subsp. aureus Mu50
aaucagugaaauauca

SEQ ID NO: 2061860 - RNA, 21 nt, Staphylococcus aureus subsp. aureus Mu50
aaucaguauaaucagcaaugu

SEQ ID NO: 2061861 - RNA, 15 nt, Staphylococcus aureus subsp. aureus Mu50
aaucaguauuuacuu

SEQ ID NO: 2061862 - RNA, 22 nt, Staphylococcus aureus subsp. aureus Mu50
aaucagguuuaaacaguuuaau

SEQ ID NO: 2061863 - RNA, 14 nt, Staphylococcus aureus subsp. aureus Mu50
aaucaguaauaaug

SEQ ID NO: 2061864 - RNA, 16 nt, Staphylococcus aureus subsp. aureus Mu50
aaucagcuauaaaagu

SEQ ID NO: 2061865 - RNA, 16 nt, Staphylococcus aureus subsp. aureus Mu50
aauaugaaucuagaau

SEQ ID NO: 2061866 - RNA, 16 nt, Staphylococcus aureus subsp. aureus Mu50
aauaugaauaaugcaa

SEQ ID NO: 2061867 - RNA, 14 nt, Staphylococcus aureus subsp. aureus Mu50
aaaaauuauuaaaa

SEQ ID NO: 2061868 - RNA, 14 nt, Staphylococcus aureus subsp. aureus Mu50
aaucauccauauau

SEQ ID NO: 2061869 - RNA, 16 nt, Staphylococcus aureus subsp. aureus Mu50
aaucauccauaaaaau

SEQ ID NO: 2061870 - RNA, 19 nt, Staphylococcus aureus subsp. aureus Mu50
aaucaucgaacaugaauga

SEQ ID NO: 2061871 - RNA, 17 nt, Staphylococcus aureus subsp. aureus Mu50
aauccaagugacaacau

SEQ ID NO: 2061872 - RNA, 17 nt, Staphylococcus aureus subsp. aureus Mu50
aauccaagcaaucuuag

SEQ ID NO: 2061873 - RNA, 16 nt, Staphylococcus aureus subsp. aureus Mu50
aauccaagcaaucuua

SEQ ID NO: 2061874 - RNA, 21 nt, Staphylococcus aureus subsp. aureus Mu50
aaucauucuuuauagaaacca

SEQ ID NO: 2061875 - RNA, 22 nt, Staphylococcus aureus subsp. aureus Mu50
aaucauucuuuauagaaaccaa

SEQ ID NO: 2061876 - RNA, 18 nt, Staphylococcus aureus subsp. aureus Mu50
aaucauuagcgaaaaccu

SEQ ID NO: 2061877 - RNA, 18 nt, Staphylococcus aureus subsp. aureus Mu50
aaucauuaguuaugugcu

SEQ ID NO: 2061878 - RNA, 23 nt, Staphylococcus aureus subsp. aureus Mu50
aaucauuaguuaugugcuaaucu

SEQ ID NO: 2061879 - RNA, 18 nt, Staphylococcus aureus subsp. aureus Mu50
aaucauuaauaauuaaac

SEQ ID NO: 2061880 - RNA, 13 nt, Staphylococcus aureus subsp. aureus Mu50
aaucauuauagca

SEQ ID NO: 2061881 - RNA, 14 nt, Staphylococcus aureus subsp. aureus Mu50
aaucauucacuuca

SEQ ID NO: 2061882 - RNA, 13 nt, Staphylococcus aureus subsp. aureus Mu50
aauccaguaauca

SEQ ID NO: 2061883 - RNA, 19 nt, Staphylococcus aureus subsp. aureus Mu50
aauccaguaaucaaagauu

SEQ ID NO: 2061884 - RNA, 18 nt, Staphylococcus aureus subsp. aureus Mu50
aauccaauuaaauauuua

SEQ ID NO: 2061885 - RNA, 16 nt, Staphylococcus aureus subsp. aureus Mu50
aaugccggucauaaca

SEQ ID NO: 2061886 - RNA, 15 nt, Staphylococcus aureus subsp. aureus Mu50
aaugccuaauuuugu

SEQ ID NO: 2061887 - RNA, 20 nt, Staphylococcus aureus subsp. aureus Mu50
aaugccugcccuuuagucau

SEQ ID NO: 2061888 - RNA, 17 nt, Staphylococcus aureus subsp. aureus Mu50
aaugcuaaaaguauaaa

SEQ ID NO: 2061889 - RNA, 20 nt, Staphylococcus aureus subsp. aureus Mu50
aaugcuauauuuagaaugau

SEQ ID NO: 2061890 - RNA, 22 nt, Staphylococcus aureus subsp. aureus Mu50
aaugcuauauuuagaaugauga

SEQ ID NO: 2061891 - RNA, 19 nt, Staphylococcus aureus subsp. aureus Mu50
aaugcuaauacuaaucaaa

SEQ ID NO: 2061892 - RNA, 15 nt, Staphylococcus aureus subsp. aureus Mu50
aaugcuacaauuucc

SEQ ID NO: 2061893 - RNA, 18 nt, Staphylococcus aureus subsp. aureus Mu50
aaugggcgauaaaaguug

SEQ ID NO: 2061894 - RNA, 20 nt, Staphylococcus aureus subsp. aureus Mu50
aaugggcgugccauuaaaau

SEQ ID NO: 2061895 - RNA, 16 nt, Staphylococcus aureus subsp. aureus Mu50
aauggaugaauauauu

SEQ ID NO: 2061896 - RNA, 17 nt, Staphylococcus aureus subsp. aureus Mu50
aaugcauuuaauuuaau

SEQ ID NO: 2061897 - RNA, 21 nt, Staphylococcus aureus subsp. aureus Mu50
aaugcauguggacguugaucu

SEQ ID NO: 2061898 - RNA, 13 nt, Staphylococcus aureus subsp. aureus Mu50
aaugcauagcucu

SEQ ID NO: 2061899 - RNA, 19 nt, Staphylococcus aureus subsp. aureus Mu50
aaugcauagcucuucuuuu

SEQ ID NO: 2061900 - RNA, 17 nt, Staphylococcus aureus subsp. aureus Mu50
aaugauugcauugauuu

SEQ ID NO: 2061901 - RNA, 18 nt, Staphylococcus aureus subsp. aureus Mu50
aaugauugacgauuuaau

SEQ ID NO: 2061902 - RNA, 16 nt, Staphylococcus aureus subsp. aureus Mu50
aaugccaaauauagua

SEQ ID NO: 2061903 - RNA, 21 nt, Staphylococcus aureus subsp. aureus Mu50
aaugauuacuuuaagauuauu

SEQ ID NO: 2061904 - RNA, 19 nt, Staphylococcus aureus subsp. aureus Mu50
aaugauggguauuuuguuc

SEQ ID NO: 2061905 - RNA, 21 nt, Staphylococcus aureus subsp. aureus Mu50
aaugaugcauaagauuuugaa

SEQ ID NO: 2061906 - RNA, 23 nt, Staphylococcus aureus subsp. aureus Mu50
aaugaugaguauacuuacugaaa

SEQ ID NO: 2061907 - RNA, 17 nt, Staphylococcus aureus subsp. aureus Mu50
aaugauagugaauaaug

SEQ ID NO: 2061908 - RNA, 12 nt, Staphylococcus aureus subsp. aureus Mu50
aaugauaucuuu

SEQ ID NO: 2061909 - RNA, 17 nt, Staphylococcus aureus subsp. aureus Mu50
aaugauaucuuuuccaa

SEQ ID NO: 2061910 - RNA, 20 nt, Staphylococcus aureus subsp. aureus Mu50
aaugauagcuaaacauuuua

SEQ ID NO: 2061911 - RNA, 20 nt, Staphylococcus aureus subsp. aureus Mu50
aaugaucaucguauagaugu

SEQ ID NO: 2061912 - RNA, 19 nt, Staphylococcus aureus subsp. aureus Mu50
aaugaucguuagcuaaucg

SEQ ID NO: 2061913 - RNA, 14 nt, Staphylococcus aureus subsp. aureus Mu50
aaugaugacaucaa

SEQ ID NO: 2061914 - RNA, 21 nt, Staphylococcus aureus subsp. aureus Mu50
aaugacagcagacuucuuuca

SEQ ID NO: 2061915 - RNA, 12 nt, Staphylococcus aureus subsp. aureus Mu50
aaugaauugcuu

SEQ ID NO: 2061916 - RNA, 17 nt, Staphylococcus aureus subsp. aureus Mu50
aaugaauucuauccuaa

SEQ ID NO: 2061917 - RNA, 15 nt, Staphylococcus aureus subsp. aureus Mu50
aaugaccuggaauau

SEQ ID NO: 2061918 - RNA, 14 nt, Staphylococcus aureus subsp. aureus Mu50
aaugaccuuaauau

SEQ ID NO: 2061919 - RNA, 17 nt, Staphylococcus aureus subsp. aureus Mu50
aaugacauccauacaaa

SEQ ID NO: 2061920 - RNA, 14 nt, Staphylococcus aureus subsp. aureus Mu50
aaugacgagaauua

SEQ ID NO: 2061921 - RNA, 20 nt, Staphylococcus aureus subsp. aureus Mu50
aaugacgugcuuuuaaaugu

SEQ ID NO: 2061922 - RNA, 13 nt, Staphylococcus aureus subsp. aureus Mu50
aaugacuaaaucg

SEQ ID NO: 2061923 - RNA, 20 nt, Staphylococcus aureus subsp. aureus Mu50
aaugacucaagugaaucuaa

SEQ ID NO: 2061924 - RNA, 19 nt, Staphylococcus aureus subsp. aureus Mu50
aaugacuaugcaaaugaaa

SEQ ID NO: 2061925 - RNA, 17 nt, Staphylococcus aureus subsp. aureus Mu50
aaugacuauaacaccaa

SEQ ID NO: 2061926 - RNA, 15 nt, Staphylococcus aureus subsp. aureus Mu50
aaugauagcuaaaca

SEQ ID NO: 2061927 - RNA, 17 nt, Staphylococcus aureus subsp. aureus Mu50
aaugauaccuuuaaauc

SEQ ID NO: 2061928 - RNA, 14 nt, Staphylococcus aureus subsp. aureus Mu50
aaugaguacaacau

SEQ ID NO: 2061929 - RNA, 20 nt, Staphylococcus aureus subsp. aureus Mu50
aaugacuucuuuauauuuau

SEQ ID NO: 2061930 - RNA, 16 nt, Staphylococcus aureus subsp. aureus Mu50
aaugacugagaaaaau

SEQ ID NO: 2061931 - RNA, 23 nt, Staphylococcus aureus subsp. aureus Mu50
aaugagaaugugcuuguaacaag

SEQ ID NO: 2061932 - RNA, 15 nt, Staphylococcus aureus subsp. aureus Mu50
aaugagaaugugcuu

SEQ ID NO: 2061933 - RNA, 14 nt, Staphylococcus aureus subsp. aureus Mu50
aaugaaaaaacgag

SEQ ID NO: 2061934 - RNA, 18 nt, Staphylococcus aureus subsp. aureus Mu50
aaugaaaccguauuauug

SEQ ID NO: 2061935 - RNA, 18 nt, Staphylococcus aureus subsp. aureus Mu50
aaugaaaauaagcuugua

SEQ ID NO: 2061936 - RNA, 18 nt, Staphylococcus aureus subsp. aureus Mu50
aaugaaaacagguggaag

SEQ ID NO: 2061937 - RNA, 13 nt, Staphylococcus aureus subsp. aureus Mu50
aaucuuuguuaua

SEQ ID NO: 2061938 - RNA, 19 nt, Staphylococcus aureus subsp. aureus Mu50
aaucuuuuagcuuuuguaa

SEQ ID NO: 2061939 - RNA, 18 nt, Staphylococcus aureus subsp. aureus Mu50
aaucuuguuggauuuuaa

SEQ ID NO: 2061940 - RNA, 17 nt, Staphylococcus aureus subsp. aureus Mu50
aaucuuguucuaauugu

SEQ ID NO: 2061941 - RNA, 22 nt, Staphylococcus aureus subsp. aureus Mu50
aaucuuguuggauuuuaacaag

SEQ ID NO: 2061942 - RNA, 19 nt, Staphylococcus aureus subsp. aureus Mu50
aaucuuguuuucauuuaaa

SEQ ID NO: 2061943 - RNA, 19 nt, Staphylococcus aureus subsp. aureus Mu50
aaucuuuacuuguaauuaa

SEQ ID NO: 2061944 - RNA, 19 nt, Staphylococcus aureus subsp. aureus Mu50
aaugaauuauuuaaaaugc

SEQ ID NO: 2061945 - RNA, 21 nt, Staphylococcus aureus subsp. aureus Mu50
aaugaauaauugcuaaaauau

SEQ ID NO: 2061946 - RNA, 13 nt, Staphylococcus aureus subsp. aureus Mu50
aaugaauguuaag

SEQ ID NO: 2061947 - RNA, 16 nt, Staphylococcus aureus subsp. aureus Mu50
aaugaaugaagacgaa

SEQ ID NO: 2061948 - RNA, 18 nt, Staphylococcus aureus subsp. aureus Mu50
aaugaaguaauauauaaa

SEQ ID NO: 2061949 - RNA, 21 nt, Staphylococcus aureus subsp. aureus Mu50
aaugaaguaauauauaaaagu

SEQ ID NO: 2061950 - RNA, 16 nt, Staphylococcus aureus subsp. aureus Mu50
aaugaauaaugacaaa

SEQ ID NO: 2061951 - RNA, 19 nt, Staphylococcus aureus subsp. aureus Mu50
aaugaauaguaaucagcuu

SEQ ID NO: 2061952 - RNA, 15 nt, Staphylococcus aureus subsp. aureus Mu50
aaugaauaauuaaaa

SEQ ID NO: 2061953 - RNA, 16 nt, Staphylococcus aureus subsp. aureus Mu50
aaugaauaauuaaaaa

SEQ ID NO: 2061954 - RNA, 20 nt, Staphylococcus aureus subsp. aureus Mu50
aaugaaaugaaguauggaag

SEQ ID NO: 2061955 - RNA, 19 nt, Staphylococcus aureus subsp. aureus Mu50
aaugaaaguaccuaaaaua

SEQ ID NO: 2061956 - RNA, 23 nt, Staphylococcus aureus subsp. aureus Mu50
aaugaaaguaccuaaaauagaaa

SEQ ID NO: 2061957 - RNA, 18 nt, Staphylococcus aureus subsp. aureus Mu50
aaugaaccagcuaaccaa

SEQ ID NO: 2061958 - RNA, 18 nt, Staphylococcus aureus subsp. aureus Mu50
aaugaacuucucuuaguu

SEQ ID NO: 2061959 - RNA, 12 nt, Staphylococcus aureus subsp. aureus Mu50
aaugaagaauac

SEQ ID NO: 2061960 - RNA, 15 nt, Staphylococcus aureus subsp. aureus Mu50
aauucgccaucuuuu

SEQ ID NO: 2061961 - RNA, 21 nt, Staphylococcus aureus subsp. aureus Mu50
aauucgcaagccuucuauaua

SEQ ID NO: 2061962 - RNA, 19 nt, Staphylococcus aureus subsp. aureus Mu50
aauucaaccaauuauuaaa

SEQ ID NO: 2061963 - RNA, 19 nt, Staphylococcus aureus subsp. aureus Mu50
aauucaacgucaucaaaac

SEQ ID NO: 2061964 - RNA, 18 nt, Staphylococcus aureus subsp. aureus Mu50
aauucaacuaugaaauug

SEQ ID NO: 2061965 - RNA, 23 nt, Staphylococcus aureus subsp. aureus Mu50
aauucaacuuuaaucaaaaaaga

SEQ ID NO: 2061966 - RNA, 13 nt, Staphylococcus aureus subsp. aureus Mu50
aauucaagaacag

SEQ ID NO: 2061967 - RNA, 17 nt, Staphylococcus aureus subsp. aureus Mu50
aauucaauauuaaucau

SEQ ID NO: 2061968 - RNA, 15 nt, Staphylococcus aureus subsp. aureus Mu50
aauucaauaaucuua

SEQ ID NO: 2061969 - RNA, 22 nt, Staphylococcus aureus subsp. aureus Mu50
aauucgcucacaugugaaauaa

SEQ ID NO: 2061970 - RNA, 14 nt, Staphylococcus aureus subsp. aureus Mu50
aauucuaaaagaau

SEQ ID NO: 2061971 - RNA, 22 nt, Staphylococcus aureus subsp. aureus Mu50
aauucguuuuacuacugucuca

SEQ ID NO: 2061972 - RNA, 19 nt, Staphylococcus aureus subsp. aureus Mu50
aauucguuuugcuaaccau

SEQ ID NO: 2061973 - RNA, 17 nt, Staphylococcus aureus subsp. aureus Mu50
aauucgucuguuucaua

SEQ ID NO: 2061974 - RNA, 17 nt, Staphylococcus aureus subsp. aureus Mu50
aauucugugagguaaaa

SEQ ID NO: 2061975 - RNA, 21 nt, Staphylococcus aureus subsp. aureus Mu50
aauucuucaauuucauuuuug

SEQ ID NO: 2061976 - RNA, 23 nt, Staphylococcus aureus subsp. aureus Mu50
aauucuucaaauuuaacguguaa

SEQ ID NO: 2061977 - RNA, 16 nt, Staphylococcus aureus subsp. aureus Mu50
aauucuucaucuucuu

SEQ ID NO: 2061978 - RNA, 16 nt, Staphylococcus aureus subsp. aureus Mu50
aauucuucaaauuuaa

SEQ ID NO: 2061979 - RNA, 12 nt, Staphylococcus aureus subsp. aureus Mu50
aauucuucauca

SEQ ID NO: 2061980 - RNA, 18 nt, Staphylococcus aureus subsp. aureus Mu50
aauugaaguacauuaaaa

SEQ ID NO: 2061981 - RNA, 16 nt, Staphylococcus aureus subsp. aureus Mu50
aauucuuguuugauuu

SEQ ID NO: 2061982 - RNA, 18 nt, Staphylococcus aureus subsp. aureus Mu50
aauugaaucuuuguuaua

SEQ ID NO: 2061983 - RNA, 18 nt, Staphylococcus aureus subsp. aureus Mu50
aauugacgcauuaaugau

SEQ ID NO: 2061984 - RNA, 19 nt, Staphylococcus aureus subsp. aureus Mu50
aauugacgcauuaaugauu

SEQ ID NO: 2061985 - RNA, 17 nt, Staphylococcus aureus subsp. aureus Mu50
aauugacucaaagauau

SEQ ID NO: 2061986 - RNA, 22 nt, Staphylococcus aureus subsp. aureus Mu50
aauugacucaaagauauacuua

SEQ ID NO: 2061987 - RNA, 19 nt, Staphylococcus aureus subsp. aureus Mu50
aauugagaaguauuaugau

SEQ ID NO: 2061988 - RNA, 14 nt, Staphylococcus aureus subsp. aureus Mu50
aauugaaugaaaaa

SEQ ID NO: 2061989 - RNA, 19 nt, Staphylococcus aureus subsp. aureus Mu50
aauugacuuacauuuuaau

SEQ ID NO: 2061990 - RNA, 15 nt, Staphylococcus aureus subsp. aureus Mu50
aaaacaaaaaauauc

SEQ ID NO: 2061991 - RNA, 15 nt, Staphylococcus aureus subsp. aureus Mu50
aaaacaaaaaaaccg

SEQ ID NO: 2061992 - RNA, 14 nt, Staphylococcus aureus subsp. aureus Mu50
aauugaguauuaaa

SEQ ID NO: 2061993 - RNA, 16 nt, Staphylococcus aureus subsp. aureus Mu50
aauugaguauuaaauu

SEQ ID NO: 2061994 - RNA, 18 nt, Staphylococcus aureus subsp. aureus Mu50
aauugauuuugaaucaca

SEQ ID NO: 2061995 - RNA, 14 nt, Staphylococcus aureus subsp. aureus Mu50
aauugauucuuugg

SEQ ID NO: 2061996 - RNA, 19 nt, Staphylococcus aureus subsp. aureus Mu50
aauugauuucuaauugaaa

SEQ ID NO: 2061997 - RNA, 13 nt, Staphylococcus aureus subsp. aureus Mu50
aauugauugcucu

SEQ ID NO: 2061998 - RNA, 14 nt, Staphylococcus aureus subsp. aureus Mu50
aauugauugucaua

SEQ ID NO: 2061999 - RNA, 20 nt, Staphylococcus aureus subsp. aureus Mu50
aauugauuguggugaaauaa

SEQ ID NO: 2062000 - RNA, 20 nt, Staphylococcus aureus subsp. aureus Mu50
aauugauucucuguagauau

SEQ ID NO: 2062001 - RNA, 18 nt, Staphylococcus aureus subsp. aureus Mu50
aauugauuacaccacuua

SEQ ID NO: 2062002 - RNA, 22 nt, Staphylococcus aureus subsp. aureus Mu50
aauugauuacaccacuuaggau

SEQ ID NO: 2062003 - RNA, 15 nt, Staphylococcus aureus subsp. aureus Mu50
aaaacaaaaauaauc

SEQ ID NO: 2062004 - RNA, 18 nt, Staphylococcus aureus subsp. aureus Mu50
aauugcaaugaauaacaa

SEQ ID NO: 2062005 - RNA, 15 nt, Staphylococcus aureus subsp. aureus Mu50
aauugcaauggcaac

SEQ ID NO: 2062006 - RNA, 14 nt, Staphylococcus aureus subsp. aureus Mu50
aauuaauuaaaauu

SEQ ID NO: 2062007 - RNA, 16 nt, Staphylococcus aureus subsp. aureus Mu50
aauuacaaaaguauga

SEQ ID NO: 2062008 - RNA, 14 nt, Staphylococcus aureus subsp. aureus Mu50
aauuaauuaucuua

SEQ ID NO: 2062009 - RNA, 18 nt, Staphylococcus aureus subsp. aureus Mu50
aauuaauugcuuucacau

SEQ ID NO: 2062010 - RNA, 22 nt, Staphylococcus aureus subsp. aureus Mu50
aauuaauucgccuaaaugguuu

SEQ ID NO: 2062011 - RNA, 20 nt, Staphylococcus aureus subsp. aureus Mu50
aauuaauuacuuucauugua

SEQ ID NO: 2062012 - RNA, 16 nt, Staphylococcus aureus subsp. aureus Mu50
aauuaccguuuauuuc

SEQ ID NO: 2062013 - RNA, 21 nt, Staphylococcus aureus subsp. aureus Mu50
aauuaccuuuccauucguaua

SEQ ID NO: 2062014 - RNA, 16 nt, Staphylococcus aureus subsp. aureus Mu50
aauuacgacaagaauu

SEQ ID NO: 2062015 - RNA, 21 nt, Staphylococcus aureus subsp. aureus Mu50
aauuacauuacgcucaucacc

SEQ ID NO: 2062016 - RNA, 14 nt, Staphylococcus aureus subsp. aureus Mu50
aauuaccaaugaau

SEQ ID NO: 2062017 - RNA, 17 nt, Staphylococcus aureus subsp. aureus Mu50
aauuaccaaugaauaaa

SEQ ID NO: 2062018 - RNA, 14 nt, Staphylococcus aureus subsp. aureus Mu50
aauuacaacuuuua

SEQ ID NO: 2062019 - RNA, 19 nt, Staphylococcus aureus subsp. aureus Mu50
aauuaauuauuauauaaua

SEQ ID NO: 2062020 - RNA, 14 nt, Staphylococcus aureus subsp. aureus Mu50
aaugguaaguaugg

SEQ ID NO: 2062021 - RNA, 18 nt, Staphylococcus aureus subsp. aureus Mu50
aauggucuaauaucaauu

SEQ ID NO: 2062022 - RNA, 22 nt, Staphylococcus aureus subsp. aureus Mu50
aauguacuuuucugucuguaaa

SEQ ID NO: 2062023 - RNA, 17 nt, Staphylococcus aureus subsp. aureus Mu50
aauguauauuuaacauc

SEQ ID NO: 2062024 - RNA, 24 nt, Staphylococcus aureus subsp. aureus Mu50
aauguaucacauucaauauuugaa

SEQ ID NO: 2062025 - RNA, 13 nt, Staphylococcus aureus subsp. aureus Mu50
aauguaucauuuc

SEQ ID NO: 2062026 - RNA, 16 nt, Staphylococcus aureus subsp. aureus Mu50
aauuaauauccaaaau

SEQ ID NO: 2062027 - RNA, 12 nt, Staphylococcus aureus subsp. aureus Mu50
aauuaauaaaaa

SEQ ID NO: 2062028 - RNA, 15 nt, Staphylococcus aureus subsp. aureus Mu50
aauuaauaauuuuuu

SEQ ID NO: 2062029 - RNA, 23 nt, Staphylococcus aureus subsp. aureus Mu50
aauguauuauucucucauuugua

SEQ ID NO: 2062030 - RNA, 19 nt, Staphylococcus aureus subsp. aureus Mu50
aauguauucagucaguaaa

SEQ ID NO: 2062031 - RNA, 15 nt, Staphylococcus aureus subsp. aureus Mu50
aauguaugauauaaa

SEQ ID NO: 2062032 - RNA, 22 nt, Staphylococcus aureus subsp. aureus Mu50
aauguauucagucaguaaaaau

SEQ ID NO: 2062033 - RNA, 13 nt, Staphylococcus aureus subsp. aureus Mu50
aauuaaguuaaaa

SEQ ID NO: 2062034 - RNA, 15 nt, Staphylococcus aureus subsp. aureus Mu50
aauuaaguuaaaaua

SEQ ID NO: 2062035 - RNA, 16 nt, Staphylococcus aureus subsp. aureus Mu50
aauuaaguuaaaauaa

SEQ ID NO: 2062036 - RNA, 14 nt, Staphylococcus aureus subsp. aureus Mu50
aauuagauuuaaaa

SEQ ID NO: 2062037 - RNA, 19 nt, Staphylococcus aureus subsp. aureus Mu50
aauuagaaaaauaugauug

SEQ ID NO: 2062038 - RNA, 13 nt, Staphylococcus aureus subsp. aureus Mu50
aauuagaaccauc

SEQ ID NO: 2062039 - RNA, 13 nt, Staphylococcus aureus subsp. aureus Mu50
aauuagaaauucu

SEQ ID NO: 2062040 - RNA, 17 nt, Staphylococcus aureus subsp. aureus Mu50
aauuagaugaaauggaa

SEQ ID NO: 2062041 - RNA, 21 nt, Staphylococcus aureus subsp. aureus Mu50
aauuacuugcacaccagugcc

SEQ ID NO: 2062042 - RNA, 21 nt, Staphylococcus aureus subsp. aureus Mu50
aauuacucuuuuucuuucaua

SEQ ID NO: 2062043 - RNA, 19 nt, Staphylococcus aureus subsp. aureus Mu50
aauuacuaaccuaaagaua

SEQ ID NO: 2062044 - RNA, 22 nt, Staphylococcus aureus subsp. aureus Mu50
aauuauggagcggaagauagga

SEQ ID NO: 2062045 - RNA, 15 nt, Staphylococcus aureus subsp. aureus Mu50
aauuauguaaaaaau

SEQ ID NO: 2062046 - RNA, 22 nt, Staphylococcus aureus subsp. aureus Mu50
aauuauuaaagcuaucuucaga

SEQ ID NO: 2062047 - RNA, 16 nt, Staphylococcus aureus subsp. aureus Mu50
aauuauuaauuuaauc

SEQ ID NO: 2062048 - RNA, 14 nt, Staphylococcus aureus subsp. aureus Mu50
aauuauuucaauua

SEQ ID NO: 2062049 - RNA, 23 nt, Staphylococcus aureus subsp. aureus Mu50
aauuauuucccuggaaaaugauu

SEQ ID NO: 2062050 - RNA, 20 nt, Staphylococcus aureus subsp. aureus Mu50
aauuauuucucuuuccacug

SEQ ID NO: 2062051 - RNA, 14 nt, Staphylococcus aureus subsp. aureus Mu50
aauuauuuuaaaaa

SEQ ID NO: 2062052 - RNA, 20 nt, Staphylococcus aureus subsp. aureus Mu50
aauuauuuuaaaaaaugaug

SEQ ID NO: 2062053 - RNA, 16 nt, Staphylococcus aureus subsp. aureus Mu50
aauuauuuuucaaaua

SEQ ID NO: 2062054 - RNA, 18 nt, Staphylococcus aureus subsp. aureus Mu50
aauuauuuuucaaauaua

SEQ ID NO: 2062055 - RNA, 15 nt, Staphylococcus aureus subsp. aureus Mu50
aauuaucuucaucau

SEQ ID NO: 2062056 - RNA, 21 nt, Staphylococcus aureus subsp. aureus Mu50
aauuaguuuuuguuuacagau

SEQ ID NO: 2062057 - RNA, 18 nt, Staphylococcus aureus subsp. aureus Mu50
aauuagucccauuaacac

SEQ ID NO: 2062058 - RNA, 14 nt, Staphylococcus aureus subsp. aureus Mu50
aauuagucccauua

SEQ ID NO: 2062059 - RNA, 19 nt, Staphylococcus aureus subsp. aureus Mu50
aauuagggugaacaguuag

SEQ ID NO: 2062060 - RNA, 17 nt, Staphylococcus aureus subsp. aureus Mu50
aauuaggucauuuuuau

SEQ ID NO: 2062061 - RNA, 16 nt, Staphylococcus aureus subsp. aureus Mu50
aauuaggauuaacaua

SEQ ID NO: 2062062 - RNA, 21 nt, Staphylococcus aureus subsp. aureus Mu50
aauuaggaacuacgucauacu

SEQ ID NO: 2062063 - RNA, 17 nt, Staphylococcus aureus subsp. aureus Mu50
aauuaggauuaacauaa

SEQ ID NO: 2062064 - RNA, 20 nt, Staphylococcus aureus subsp. aureus Mu50
aauuugucauuucuucuuuu

SEQ ID NO: 2062065 - RNA, 15 nt, Staphylococcus aureus subsp. aureus Mu50
aauuuguuuuaaaua

SEQ ID NO: 2062066 - RNA, 21 nt, Staphylococcus aureus subsp. aureus Mu50
aauuuguaacuauugaaaaua

SEQ ID NO: 2062067 - RNA, 14 nt, Staphylococcus aureus subsp. aureus Mu50
aauuuguaauuccu

SEQ ID NO: 2062068 - RNA, 17 nt, Staphylococcus aureus subsp. aureus Mu50
aauuugguuaacauccu

SEQ ID NO: 2062069 - RNA, 16 nt, Staphylococcus aureus subsp. aureus Mu50
aauuuuaacuuauaua

SEQ ID NO: 2062070 - RNA, 14 nt, Staphylococcus aureus subsp. aureus Mu50
aauuuuaaguuaau

SEQ ID NO: 2062071 - RNA, 16 nt, Staphylococcus aureus subsp. aureus Mu50
aauuuuaccauguuuu

SEQ ID NO: 2062072 - RNA, 22 nt, Staphylococcus aureus subsp. aureus Mu50
aauuuuaccuucgcauacuuuu

SEQ ID NO: 2062073 - RNA, 17 nt, Staphylococcus aureus subsp. aureus Mu50
aauuugaggauacauaa

SEQ ID NO: 2062074 - RNA, 15 nt, Staphylococcus aureus subsp. aureus Mu50
aauuugagaaaugaa

SEQ ID NO: 2062075 - RNA, 21 nt, Staphylococcus aureus subsp. aureus Mu50
aauuugagccauuguuauuau

SEQ ID NO: 2062076 - RNA, 14 nt, Staphylococcus aureus subsp. aureus Mu50
aauuucuuuaaagu

SEQ ID NO: 2062077 - RNA, 21 nt, Staphylococcus aureus subsp. aureus Mu50
aauuugaauauacuuaauuua

SEQ ID NO: 2062078 - RNA, 18 nt, Staphylococcus aureus subsp. aureus Mu50
aauuugaauugacuuaca

SEQ ID NO: 2062079 - RNA, 16 nt, Staphylococcus aureus subsp. aureus Mu50
aauuugaaaguaaauu

SEQ ID NO: 2062080 - RNA, 17 nt, Staphylococcus aureus subsp. aureus Mu50
aauuugaaauauaccaa

SEQ ID NO: 2062081 - RNA, 16 nt, Staphylococcus aureus subsp. aureus Mu50
aauuugauuaaauucu

SEQ ID NO: 2062082 - RNA, 16 nt, Staphylococcus aureus subsp. aureus Mu50
aauuugcaaaaucaac

SEQ ID NO: 2062083 - RNA, 16 nt, Staphylococcus aureus subsp. aureus Mu50
aauuuucuguccaaaa

SEQ ID NO: 2062084 - RNA, 21 nt, Staphylococcus aureus subsp. aureus Mu50
aauuuucuguuuaauuaaaau

SEQ ID NO: 2062085 - RNA, 15 nt, Staphylococcus aureus subsp. aureus Mu50
aauuuuuauuuuuag

SEQ ID NO: 2062086 - RNA, 16 nt, Staphylococcus aureus subsp. aureus Mu50
aauuuuuauuuuuagu

SEQ ID NO: 2062087 - RNA, 13 nt, Staphylococcus aureus subsp. aureus Mu50
aauuuuucaaagc

SEQ ID NO: 2062088 - RNA, 18 nt, Staphylococcus aureus subsp. aureus Mu50
aauuuuuaugcauuauag

SEQ ID NO: 2062089 - RNA, 19 nt, Staphylococcus aureus subsp. aureus Mu50
aauuuuuaaaucuacaaua

SEQ ID NO: 2062090 - RNA, 17 nt, Staphylococcus aureus subsp. aureus Mu50
aauuuuuaacaaaauau

SEQ ID NO: 2062091 - RNA, 23 nt, Staphylococcus aureus subsp. aureus Mu50
aauuuuuaguuagggaaauguag

SEQ ID NO: 2062092 - RNA, 17 nt, Staphylococcus aureus subsp. aureus Mu50
aauuuuucuaaaugauu

SEQ ID NO: 2062093 - RNA, 13 nt, Staphylococcus aureus subsp. aureus Mu50
aauuuuucauaua

SEQ ID NO: 2062094 - RNA, 13 nt, Staphylococcus aureus subsp. aureus Mu50
aauuuuucauuaa

SEQ ID NO: 2062095 - RNA, 11 nt, Staphylococcus aureus subsp. aureus Mu50
aauuuucagaa

SEQ ID NO: 2062096 - RNA, 16 nt, Staphylococcus aureus subsp. aureus Mu50
aauuuucaauuagaaa

SEQ ID NO: 2062097 - RNA, 20 nt, Staphylococcus aureus subsp. aureus Mu50
aauuuuacuaguguauauaa

SEQ ID NO: 2062098 - RNA, 22 nt, Staphylococcus aureus subsp. aureus Mu50
aauuuuaauuaauuaucauaaa

SEQ ID NO: 2062099 - RNA, 12 nt, Staphylococcus aureus subsp. aureus Mu50
aauuuuauacua

SEQ ID NO: 2062100 - RNA, 19 nt, Staphylococcus aureus subsp. aureus Mu50
aauuuuauauagacaguag

SEQ ID NO: 2062101 - RNA, 22 nt, Staphylococcus aureus subsp. aureus Mu50
aauuuuaugucccaaugcugaa

SEQ ID NO: 2062102 - RNA, 22 nt, Staphylococcus aureus subsp. aureus Mu50
aauuuuaucuaaagcuauaaaa

SEQ ID NO: 2062103 - RNA, 16 nt, Staphylococcus aureus subsp. aureus Mu50
aauuuauuauaaaaua

SEQ ID NO: 2062104 - RNA, 21 nt, Staphylococcus aureus subsp. aureus Mu50
aauuuauuaauuuuauuuaau

SEQ ID NO: 2062105 - RNA, 12 nt, Staphylococcus aureus subsp. aureus Mu50
aauuuauuauaa

SEQ ID NO: 2062106 - RNA, 22 nt, Staphylococcus aureus subsp. aureus Mu50
aauuuauuaaaacgaaguuauu

SEQ ID NO: 2062107 - RNA, 13 nt, Staphylococcus aureus subsp. aureus Mu50
aauuuaugguaaa

SEQ ID NO: 2062108 - RNA, 14 nt, Staphylococcus aureus subsp. aureus Mu50
aauuucaauaaugu

SEQ ID NO: 2062109 - RNA, 15 nt, Staphylococcus aureus subsp. aureus Mu50
aauuucaaaauagua

SEQ ID NO: 2062110 - RNA, 21 nt, Staphylococcus aureus subsp. aureus Mu50
aauuucaagguauacacaaau

SEQ ID NO: 2062111 - RNA, 13 nt, Staphylococcus aureus subsp. aureus Mu50
aauuuauuuugua

SEQ ID NO: 2062112 - RNA, 12 nt, Staphylococcus aureus subsp. aureus Mu50
aauuucaaaaau

SEQ ID NO: 2062113 - RNA, 14 nt, Staphylococcus aureus subsp. aureus Mu50
aauuuaucuuaauc

SEQ ID NO: 2062114 - RNA, 15 nt, Staphylococcus aureus subsp. aureus Mu50
aauuuaucugcaaaa

SEQ ID NO: 2062115 - RNA, 19 nt, Staphylococcus aureus subsp. aureus Mu50
aauuuagcaucaaaaauaa

SEQ ID NO: 2062116 - RNA, 16 nt, Staphylococcus aureus subsp. aureus Mu50
aauuuagaugcauaaa

SEQ ID NO: 2062117 - RNA, 17 nt, Staphylococcus aureus subsp. aureus Mu50
aauuuagauauuauaaa

SEQ ID NO: 2062118 - RNA, 15 nt, Staphylococcus aureus subsp. aureus Mu50
aauuuagcaaauauu

SEQ ID NO: 2062119 - RNA, 18 nt, Staphylococcus aureus subsp. aureus Mu50
aauuuaucaauuucuauu

SEQ ID NO: 2062120 - RNA, 15 nt, Staphylococcus aureus subsp. aureus Mu50
aauuuaucaauuucu

SEQ ID NO: 2062121 - RNA, 22 nt, Staphylococcus aureus subsp. aureus Mu50
aauugcuauauuaguauaauuu

SEQ ID NO: 2062122 - RNA, 16 nt, Staphylococcus aureus subsp. aureus Mu50
aauuuaaaggcauaau

SEQ ID NO: 2062123 - RNA, 22 nt, Staphylococcus aureus subsp. aureus Mu50
aauuuaaagcaucauauacaua

SEQ ID NO: 2062124 - RNA, 11 nt, Staphylococcus aureus subsp. aureus Mu50
aauuuaaauaa

SEQ ID NO: 2062125 - RNA, 15 nt, Staphylococcus aureus subsp. aureus Mu50
aauugcuaaaaaaau

SEQ ID NO: 2062126 - RNA, 19 nt, Staphylococcus aureus subsp. aureus Mu50
aauugcuaaaaaaauuaaa

SEQ ID NO: 2062127 - RNA, 19 nt, Staphylococcus aureus subsp. aureus Mu50
aauuuaaaugcuuaauuug

SEQ ID NO: 2062128 - RNA, 17 nt, Staphylococcus aureus subsp. aureus Mu50
aauuuaacguguaauga

SEQ ID NO: 2062129 - RNA, 10 nt, Staphylococcus aureus subsp. aureus Mu50
aauuuaaaug

SEQ ID NO: 2062130 - RNA, 21 nt, Staphylococcus aureus subsp. aureus Mu50
aauuuacucaaaccaucuuau

SEQ ID NO: 2062131 - RNA, 14 nt, Staphylococcus aureus subsp. aureus Mu50
aauuuccuaaaaac

SEQ ID NO: 2062132 - RNA, 13 nt, Staphylococcus aureus subsp. aureus Mu50
aauuucgcacaau

SEQ ID NO: 2062133 - RNA, 17 nt, Staphylococcus aureus subsp. aureus Mu50
aauuucgaaaagaaauu

SEQ ID NO: 2062134 - RNA, 23 nt, Staphylococcus aureus subsp. aureus Mu50
aauuucgacaucuagaugaaauu

SEQ ID NO: 2062135 - RNA, 14 nt, Staphylococcus aureus subsp. aureus Mu50
aauuucgcaguagc

SEQ ID NO: 2062136 - RNA, 14 nt, Staphylococcus aureus subsp. aureus Mu50
aauuucuaugaaaa

SEQ ID NO: 2062137 - RNA, 17 nt, Staphylococcus aureus subsp. aureus Mu50
aauuucuccaaguacac

SEQ ID NO: 2062138 - RNA, 12 nt, Staphylococcus aureus subsp. aureus Mu50
aauuucuauuua

SEQ ID NO: 2062139 - RNA, 23 nt, Staphylococcus aureus subsp. aureus Mu50
aauuucuauuuauugagauagaa

SEQ ID NO: 2062140 - RNA, 23 nt, Staphylococcus aureus subsp. aureus Mu50
aauuucuguuuacgccauaagaa

SEQ ID NO: 2062141 - RNA, 17 nt, Staphylococcus aureus subsp. aureus Mu50
aauuucugcuucuuuua

SEQ ID NO: 2062142 - RNA, 16 nt, Staphylococcus aureus subsp. aureus Mu50
aauuuccaaaguaaua

SEQ ID NO: 2062143 - RNA, 16 nt, Staphylococcus aureus subsp. aureus Mu50
aauuuccaauaucuuc

SEQ ID NO: 2062144 - RNA, 19 nt, Staphylococcus aureus subsp. aureus Mu50
aauuucauuugaaauaguu

SEQ ID NO: 2062145 - RNA, 20 nt, Staphylococcus aureus subsp. aureus Mu50
aauuucauaguuaucgauuu

SEQ ID NO: 2062146 - RNA, 21 nt, Staphylococcus aureus subsp. aureus Mu50
aauuucaguaggacauauaaa

SEQ ID NO: 2062147 - RNA, 19 nt, Staphylococcus aureus subsp. aureus Mu50
aauuucaguaccauguuuu

SEQ ID NO: 2062148 - RNA, 21 nt, Staphylococcus aureus subsp. aureus Mu50
aauuucacuuuaacuucuuuu

SEQ ID NO: 2062149 - RNA, 19 nt, Staphylococcus aureus subsp. aureus Mu50
aauuucacgcugaaauuuu

SEQ ID NO: 2062150 - RNA, 23 nt, Staphylococcus aureus subsp. aureus Mu50
aauuucaauuuggaaauaucuua

SEQ ID NO: 2062151 - RNA, 17 nt, Staphylococcus aureus subsp. aureus Mu50
aauuucaccuuguaaau

SEQ ID NO: 2062152 - RNA, 23 nt, Staphylococcus aureus subsp. aureus Mu50
accacgacucauuagauaaaaua

SEQ ID NO: 2062153 - RNA, 20 nt, Staphylococcus aureus subsp. aureus Mu50
accaccugugacaaaugccu

SEQ ID NO: 2062154 - RNA, 11 nt, Staphylococcus aureus subsp. aureus Mu50
accaccccaac

SEQ ID NO: 2062155 - RNA, 14 nt, Staphylococcus aureus subsp. aureus Mu50
accacuucuucacc

SEQ ID NO: 2062156 - RNA, 16 nt, Staphylococcus aureus subsp. aureus Mu50
accacuugaauacuuu

SEQ ID NO: 2062157 - RNA, 21 nt, Staphylococcus aureus subsp. aureus Mu50
accacuugaauacuuuuuaac

SEQ ID NO: 2062158 - RNA, 14 nt, Staphylococcus aureus subsp. aureus Mu50
accacauccccuuu

SEQ ID NO: 2062159 - RNA, 16 nt, Staphylococcus aureus subsp. aureus Mu50
accacauaaaaauaau

SEQ ID NO: 2062160 - RNA, 23 nt, Staphylococcus aureus subsp. aureus Mu50
accaccaccugugacaaaugccu

SEQ ID NO: 2062161 - RNA, 14 nt, Staphylococcus aureus subsp. aureus Mu50
accacaaccaguca

SEQ ID NO: 2062162 - RNA, 18 nt, Staphylococcus aureus subsp. aureus Mu50
accaauuuuaacuuauau

SEQ ID NO: 2062163 - RNA, 13 nt, Staphylococcus aureus subsp. aureus Mu50
accacacagcauu

SEQ ID NO: 2062164 - RNA, 14 nt, Staphylococcus aureus subsp. aureus Mu50
accaauugaauauu

SEQ ID NO: 2062165 - RNA, 19 nt, Staphylococcus aureus subsp. aureus Mu50
accaauugcugauauaaua

SEQ ID NO: 2062166 - RNA, 11 nt, Staphylococcus aureus subsp. aureus Mu50
accaauaauua

SEQ ID NO: 2062167 - RNA, 23 nt, Staphylococcus aureus subsp. aureus Mu50
accaaggguuucuggcucuucuu

SEQ ID NO: 2062168 - RNA, 13 nt, Staphylococcus aureus subsp. aureus Mu50
accaaguaaugau

SEQ ID NO: 2062169 - RNA, 23 nt, Staphylococcus aureus subsp. aureus Mu50
acauuucccauuuaucuaacaau

SEQ ID NO: 2062170 - RNA, 15 nt, Staphylococcus aureus subsp. aureus Mu50
acauccccaaaaaua

SEQ ID NO: 2062171 - RNA, 18 nt, Staphylococcus aureus subsp. aureus Mu50
acaucgaucuaaauauau

SEQ ID NO: 2062172 - RNA, 21 nt, Staphylococcus aureus subsp. aureus Mu50
acaucgaucuaaauauauuag

SEQ ID NO: 2062173 - RNA, 12 nt, Staphylococcus aureus subsp. aureus Mu50
acaucuuuuguu

SEQ ID NO: 2062174 - RNA, 17 nt, Staphylococcus aureus subsp. aureus Mu50
acaucuuuuguuguuuu

SEQ ID NO: 2062175 - RNA, 13 nt, Staphylococcus aureus subsp. aureus Mu50
acaucuuuuugau

SEQ ID NO: 2062176 - RNA, 15 nt, Staphylococcus aureus subsp. aureus Mu50
acaucuuuuugauaa

SEQ ID NO: 2062177 - RNA, 14 nt, Staphylococcus aureus subsp. aureus Mu50
acaugaacaaucag

SEQ ID NO: 2062178 - RNA, 20 nt, Staphylococcus aureus subsp. aureus Mu50
acaugaacaaucagauaagu

SEQ ID NO: 2062179 - RNA, 15 nt, Staphylococcus aureus subsp. aureus Mu50
acauggucaaucacu

SEQ ID NO: 2062180 - RNA, 19 nt, Staphylococcus aureus subsp. aureus Mu50
acauguuuggaugaacaaa

SEQ ID NO: 2062181 - RNA, 20 nt, Staphylococcus aureus subsp. aureus Mu50
acauguuuggaugaacaaaa

SEQ ID NO: 2062182 - RNA, 19 nt, Staphylococcus aureus subsp. aureus Mu50
acaugcuuggacauauacu

SEQ ID NO: 2062183 - RNA, 17 nt, Staphylococcus aureus subsp. aureus Mu50
acaugauacugaaauuu

SEQ ID NO: 2062184 - RNA, 18 nt, Staphylococcus aureus subsp. aureus Mu50
acaugauacugaaauuuc

SEQ ID NO: 2062185 - RNA, 15 nt, Staphylococcus aureus subsp. aureus Mu50
acaugauacugaaau

SEQ ID NO: 2062186 - RNA, 19 nt, Staphylococcus aureus subsp. aureus Mu50
acaugauucaugauauguu

SEQ ID NO: 2062187 - RNA, 14 nt, Staphylococcus aureus subsp. aureus Mu50
acaugccaauggaa

SEQ ID NO: 2062188 - RNA, 19 nt, Staphylococcus aureus subsp. aureus Mu50
acaugcaccuuuacaacau

SEQ ID NO: 2062189 - RNA, 19 nt, Staphylococcus aureus subsp. aureus Mu50
acaugcacuuuauuaaaaa

SEQ ID NO: 2062190 - RNA, 23 nt, Staphylococcus aureus subsp. aureus Mu50
acaugcacuuuauuaaaaauccu

SEQ ID NO: 2062191 - RNA, 12 nt, Staphylococcus aureus subsp. aureus Mu50
acauuauuuaua

SEQ ID NO: 2062192 - RNA, 16 nt, Staphylococcus aureus subsp. aureus Mu50
acauuauuuauauuua

SEQ ID NO: 2062193 - RNA, 15 nt, Staphylococcus aureus subsp. aureus Mu50
acauuaaaaugauau

SEQ ID NO: 2062194 - RNA, 12 nt, Staphylococcus aureus subsp. aureus Mu50
acauuaaauuau

SEQ ID NO: 2062195 - RNA, 15 nt, Staphylococcus aureus subsp. aureus Mu50
acauuaaauuauuag

SEQ ID NO: 2062196 - RNA, 20 nt, Staphylococcus aureus subsp. aureus Mu50
acauucagugcaaugauagc

SEQ ID NO: 2062197 - RNA, 20 nt, Staphylococcus aureus subsp. aureus Mu50
acauucauaccgaagaaacu

SEQ ID NO: 2062198 - RNA, 22 nt, Staphylococcus aureus subsp. aureus Mu50
acauucaaauaaaugacauuua

SEQ ID NO: 2062199 - RNA, 22 nt, Staphylococcus aureus subsp. aureus Mu50
acauucauaccgaagaaacuaa

SEQ ID NO: 2062200 - RNA, 13 nt, Staphylococcus aureus subsp. aureus Mu50
acauuccucuauu

SEQ ID NO: 2062201 - RNA, 19 nt, Staphylococcus aureus subsp. aureus Mu50
acauucccuuaauaauaag

SEQ ID NO: 2062202 - RNA, 19 nt, Staphylococcus aureus subsp. aureus Mu50
acauugccacuuuuguguu

SEQ ID NO: 2062203 - RNA, 12 nt, Staphylococcus aureus subsp. aureus Mu50
acauucuaugua

SEQ ID NO: 2062204 - RNA, 17 nt, Staphylococcus aureus subsp. aureus Mu50
acauuucagcauuugcu

SEQ ID NO: 2062205 - RNA, 16 nt, Staphylococcus aureus subsp. aureus Mu50
acauugguuuuuacua

SEQ ID NO: 2062206 - RNA, 20 nt, Staphylococcus aureus subsp. aureus Mu50
acauuuauucuuucucuauu

SEQ ID NO: 2062207 - RNA, 21 nt, Staphylococcus aureus subsp. aureus Mu50
acauuuauucuuucucuauua

SEQ ID NO: 2062208 - RNA, 21 nt, Staphylococcus aureus subsp. aureus Mu50
acauaccacacuuuaaacaag

SEQ ID NO: 2062209 - RNA, 19 nt, Staphylococcus aureus subsp. aureus Mu50
acauaccaguggaaauuau

SEQ ID NO: 2062210 - RNA, 22 nt, Staphylococcus aureus subsp. aureus Mu50
acauaccaguggaaauuaugua

SEQ ID NO: 2062211 - RNA, 16 nt, Staphylococcus aureus subsp. aureus Mu50
acauacaccuucagau

SEQ ID NO: 2062212 - RNA, 16 nt, Staphylococcus aureus subsp. aureus Mu50
acauacagucaauaca

SEQ ID NO: 2062213 - RNA, 18 nt, Staphylococcus aureus subsp. aureus Mu50
acauaauuuuuauuuaca

SEQ ID NO: 2062214 - RNA, 22 nt, Staphylococcus aureus subsp. aureus Mu50
acauaauuuuuauuuacacaca

SEQ ID NO: 2062215 - RNA, 16 nt, Staphylococcus aureus subsp. aureus Mu50
acauaauuuuuauuua

SEQ ID NO: 2062216 - RNA, 20 nt, Staphylococcus aureus subsp. aureus Mu50
acauaauuuaucaauuucua

SEQ ID NO: 2062217 - RNA, 16 nt, Staphylococcus aureus subsp. aureus Mu50
acauaauuuaucugca

SEQ ID NO: 2062218 - RNA, 16 nt, Staphylococcus aureus subsp. aureus Mu50
acaggccacacuugag

SEQ ID NO: 2062219 - RNA, 15 nt, Staphylococcus aureus subsp. aureus Mu50
acauacugauuaaac

SEQ ID NO: 2062220 - RNA, 22 nt, Staphylococcus aureus subsp. aureus Mu50
acauagaauaacgucauauguu

SEQ ID NO: 2062221 - RNA, 17 nt, Staphylococcus aureus subsp. aureus Mu50
acauagacacuuaacuu

SEQ ID NO: 2062222 - RNA, 14 nt, Staphylococcus aureus subsp. aureus Mu50
acauacuauaaaaa

SEQ ID NO: 2062223 - RNA, 16 nt, Staphylococcus aureus subsp. aureus Mu50
acauacuauaaaaauu

SEQ ID NO: 2062224 - RNA, 14 nt, Staphylococcus aureus subsp. aureus Mu50
acauacugauuaaa

SEQ ID NO: 2062225 - RNA, 22 nt, Staphylococcus aureus subsp. aureus Mu50
acauagguauaaucauuuaaac

SEQ ID NO: 2062226 - RNA, 22 nt, Staphylococcus aureus subsp. aureus Mu50
acauaguuucuucuauuauauu

SEQ ID NO: 2062227 - RNA, 16 nt, Staphylococcus aureus subsp. aureus Mu50
acauauaaaucauuuc

SEQ ID NO: 2062228 - RNA, 18 nt, Staphylococcus aureus subsp. aureus Mu50
acauauaaaaaauuauua

SEQ ID NO: 2062229 - RNA, 19 nt, Staphylococcus aureus subsp. aureus Mu50
acauauaaaaaauuauuaa

SEQ ID NO: 2062230 - RNA, 15 nt, Staphylococcus aureus subsp. aureus Mu50
acauauuuauacuga

SEQ ID NO: 2062231 - RNA, 18 nt, Staphylococcus aureus subsp. aureus Mu50
acauauucaguauaugua

SEQ ID NO: 2062232 - RNA, 18 nt, Staphylococcus aureus subsp. aureus Mu50
acauauuaugauacgcuu

SEQ ID NO: 2062233 - RNA, 19 nt, Staphylococcus aureus subsp. aureus Mu50
acauauguacuauuaucua

SEQ ID NO: 2062234 - RNA, 20 nt, Staphylococcus aureus subsp. aureus Mu50
acauauguguaugauagaau

SEQ ID NO: 2062235 - RNA, 19 nt, Staphylococcus aureus subsp. aureus Mu50
acauauguguaugauagaa

SEQ ID NO: 2062236 - RNA, 14 nt, Staphylococcus aureus subsp. aureus Mu50
acaucacuugcugu

SEQ ID NO: 2062237 - RNA, 18 nt, Staphylococcus aureus subsp. aureus Mu50
acaucaaauagacaccaa

SEQ ID NO: 2062238 - RNA, 19 nt, Staphylococcus aureus subsp. aureus Mu50
acaucaaauagacaccaaa

SEQ ID NO: 2062239 - RNA, 15 nt, Staphylococcus aureus subsp. aureus Mu50
acauauuuuuuaaau

SEQ ID NO: 2062240 - RNA, 15 nt, Staphylococcus aureus subsp. aureus Mu50
acaucagauauaagu

SEQ ID NO: 2062241 - RNA, 15 nt, Staphylococcus aureus subsp. aureus Mu50
acaucauaauaaauc

SEQ ID NO: 2062242 - RNA, 13 nt, Staphylococcus aureus subsp. aureus Mu50
acaucaucaaguu

SEQ ID NO: 2062243 - RNA, 23 nt, Staphylococcus aureus subsp. aureus Mu50
acaucaguaaaaacgaaauuguu

SEQ ID NO: 2062244 - RNA, 21 nt, Staphylococcus aureus subsp. aureus Mu50
acauccacuuuauaauuuuug

SEQ ID NO: 2062245 - RNA, 17 nt, Staphylococcus aureus subsp. aureus Mu50
acagaaccgaaaauaau

SEQ ID NO: 2062246 - RNA, 12 nt, Staphylococcus aureus subsp. aureus Mu50
acagaaaacaaa

SEQ ID NO: 2062247 - RNA, 22 nt, Staphylococcus aureus subsp. aureus Mu50
acagaaaaucguuauaaguaca

SEQ ID NO: 2062248 - RNA, 11 nt, Staphylococcus aureus subsp. aureus Mu50
acagaaaaggg

SEQ ID NO: 2062249 - RNA, 21 nt, Staphylococcus aureus subsp. aureus Mu50
acacuucguauugaaugaauu

SEQ ID NO: 2062250 - RNA, 22 nt, Staphylococcus aureus subsp. aureus Mu50
acacuuggcuuaggaugaaaau

SEQ ID NO: 2062251 - RNA, 13 nt, Staphylococcus aureus subsp. aureus Mu50
acacuugauaaaa

SEQ ID NO: 2062252 - RNA, 13 nt, Staphylococcus aureus subsp. aureus Mu50
acagacaaacauu

SEQ ID NO: 2062253 - RNA, 16 nt, Staphylococcus aureus subsp. aureus Mu50
acagaauuucaucaaa

SEQ ID NO: 2062254 - RNA, 14 nt, Staphylococcus aureus subsp. aureus Mu50
acagacaaacauua

SEQ ID NO: 2062255 - RNA, 14 nt, Staphylococcus aureus subsp. aureus Mu50
acagaauuucauca

SEQ ID NO: 2062256 - RNA, 13 nt, Staphylococcus aureus subsp. aureus Mu50
acagacuuuuuac

SEQ ID NO: 2062257 - RNA, 23 nt, Staphylococcus aureus subsp. aureus Mu50
acacguucuugguauuuuuuaaa

SEQ ID NO: 2062258 - RNA, 21 nt, Staphylococcus aureus subsp. aureus Mu50
acacguguauuguauuuuaau

SEQ ID NO: 2062259 - RNA, 21 nt, Staphylococcus aureus subsp. aureus Mu50
acacuacgcugaugaaugauu

SEQ ID NO: 2062260 - RNA, 22 nt, Staphylococcus aureus subsp. aureus Mu50
acacuaucauuaucaaauaacc

SEQ ID NO: 2062261 - RNA, 16 nt, Staphylococcus aureus subsp. aureus Mu50
acacuaucguuuuuau

SEQ ID NO: 2062262 - RNA, 20 nt, Staphylococcus aureus subsp. aureus Mu50
acaccauuguuauagcguuu

SEQ ID NO: 2062263 - RNA, 15 nt, Staphylococcus aureus subsp. aureus Mu50
acacuuaauauauuc

SEQ ID NO: 2062264 - RNA, 17 nt, Staphylococcus aureus subsp. aureus Mu50
acacugcacaucauaau

SEQ ID NO: 2062265 - RNA, 16 nt, Staphylococcus aureus subsp. aureus Mu50
acagaugaugcuucuc

SEQ ID NO: 2062266 - RNA, 16 nt, Staphylococcus aureus subsp. aureus Mu50
acagaugaugcuucgc

SEQ ID NO: 2062267 - RNA, 23 nt, Staphylococcus aureus subsp. aureus Mu50
acagaucucaauccaauuaaaua

SEQ ID NO: 2062268 - RNA, 22 nt, Staphylococcus aureus subsp. aureus Mu50
acagagaauuucgaaaagaaau

SEQ ID NO: 2062269 - RNA, 17 nt, Staphylococcus aureus subsp. aureus Mu50
acagauaaguaauaaua

SEQ ID NO: 2062270 - RNA, 22 nt, Staphylococcus aureus subsp. aureus Mu50
acagcgugauucaucuauuauu

SEQ ID NO: 2062271 - RNA, 22 nt, Staphylococcus aureus subsp. aureus Mu50
acagcguauuuuaaugauuuuu

SEQ ID NO: 2062272 - RNA, 13 nt, Staphylococcus aureus subsp. aureus Mu50
acagcuucauuaa

SEQ ID NO: 2062273 - RNA, 16 nt, Staphylococcus aureus subsp. aureus Mu50
acagccgaggcaauau

SEQ ID NO: 2062274 - RNA, 22 nt, Staphylococcus aureus subsp. aureus Mu50
acagccgaggcaauauugaaca

SEQ ID NO: 2062275 - RNA, 17 nt, Staphylococcus aureus subsp. aureus Mu50
acagcggaauacagaug

SEQ ID NO: 2062276 - RNA, 13 nt, Staphylococcus aureus subsp. aureus Mu50
acacauaaauuaa

SEQ ID NO: 2062277 - RNA, 16 nt, Staphylococcus aureus subsp. aureus Mu50
acacaugcacuuuauu

SEQ ID NO: 2062278 - RNA, 20 nt, Staphylococcus aureus subsp. aureus Mu50
acacaucgaucuaaauauau

SEQ ID NO: 2062279 - RNA, 21 nt, Staphylococcus aureus subsp. aureus Mu50
acacagguaaauuuaaaauaa

SEQ ID NO: 2062280 - RNA, 22 nt, Staphylococcus aureus subsp. aureus Mu50
acacaguaauucuuaaaaagca

SEQ ID NO: 2062281 - RNA, 22 nt, Staphylococcus aureus subsp. aureus Mu50
acacagagaauuucgaaaagaa

SEQ ID NO: 2062282 - RNA, 22 nt, Staphylococcus aureus subsp. aureus Mu50
acacagagaaauucgaaaagaa

SEQ ID NO: 2062283 - RNA, 23 nt, Staphylococcus aureus subsp. aureus Mu50
acacagaagcugacgaaaaguca

SEQ ID NO: 2062284 - RNA, 18 nt, Staphylococcus aureus subsp. aureus Mu50
acacacuaaggaaaauua

SEQ ID NO: 2062285 - RNA, 14 nt, Staphylococcus aureus subsp. aureus Mu50
acacacuaaaagcu

SEQ ID NO: 2062286 - RNA, 18 nt, Staphylococcus aureus subsp. aureus Mu50
acaauuuaaaaagcagua

SEQ ID NO: 2062287 - RNA, 12 nt, Staphylococcus aureus subsp. aureus Mu50
acacaccaccac

SEQ ID NO: 2062288 - RNA, 15 nt, Staphylococcus aureus subsp. aureus Mu50
acacacccaaauuua

SEQ ID NO: 2062289 - RNA, 19 nt, Staphylococcus aureus subsp. aureus Mu50
acacacaugauaauuuuua

SEQ ID NO: 2062290 - RNA, 20 nt, Staphylococcus aureus subsp. aureus Mu50
acacacaugauaauuuuuag

SEQ ID NO: 2062291 - RNA, 18 nt, Staphylococcus aureus subsp. aureus Mu50
acacaaugcccuuaaagc

SEQ ID NO: 2062292 - RNA, 14 nt, Staphylococcus aureus subsp. aureus Mu50
acaauuuaaaaagc

SEQ ID NO: 2062293 - RNA, 22 nt, Staphylococcus aureus subsp. aureus Mu50
acaauuguauaaugugcgucac

SEQ ID NO: 2062294 - RNA, 14 nt, Staphylococcus aureus subsp. aureus Mu50
acaauuguaguaau

SEQ ID NO: 2062295 - RNA, 13 nt, Staphylococcus aureus subsp. aureus Mu50
acaauuaauuacu

SEQ ID NO: 2062296 - RNA, 16 nt, Staphylococcus aureus subsp. aureus Mu50
acaauuaaagugaaua

SEQ ID NO: 2062297 - RNA, 19 nt, Staphylococcus aureus subsp. aureus Mu50
acaauauaauuuccuaaaa

SEQ ID NO: 2062298 - RNA, 15 nt, Staphylococcus aureus subsp. aureus Mu50
acaauauuaaaauua

SEQ ID NO: 2062299 - RNA, 21 nt, Staphylococcus aureus subsp. aureus Mu50
acaauggaugccgcucuuuuu

SEQ ID NO: 2062300 - RNA, 13 nt, Staphylococcus aureus subsp. aureus Mu50
acaauguauuacc

SEQ ID NO: 2062301 - RNA, 22 nt, Staphylococcus aureus subsp. aureus Mu50
acaagucuuuacucuacacuca

SEQ ID NO: 2062302 - RNA, 23 nt, Staphylococcus aureus subsp. aureus Mu50
acaagucuaguucgaacacacac

SEQ ID NO: 2062303 - RNA, 20 nt, Staphylococcus aureus subsp. aureus Mu50
acaagucuuauuuguuuaau

SEQ ID NO: 2062304 - RNA, 16 nt, Staphylococcus aureus subsp. aureus Mu50
acaagucauuauccaa

SEQ ID NO: 2062305 - RNA, 22 nt, Staphylococcus aureus subsp. aureus Mu50
acaagccuuaaaauauuuaacu

SEQ ID NO: 2062306 - RNA, 14 nt, Staphylococcus aureus subsp. aureus Mu50
acaaguauaaaugc

SEQ ID NO: 2062307 - RNA, 18 nt, Staphylococcus aureus subsp. aureus Mu50
acaaguauacuugaagaa

SEQ ID NO: 2062308 - RNA, 20 nt, Staphylococcus aureus subsp. aureus Mu50
acaaguauaaaugcagcugu

SEQ ID NO: 2062309 - RNA, 17 nt, Staphylococcus aureus subsp. aureus Mu50
acaauauaauauacaca

SEQ ID NO: 2062310 - RNA, 17 nt, Staphylococcus aureus subsp. aureus Mu50
acaauaacuguucuuuc

SEQ ID NO: 2062311 - RNA, 14 nt, Staphylococcus aureus subsp. aureus Mu50
acaauaaccauuuc

SEQ ID NO: 2062312 - RNA, 14 nt, Staphylococcus aureus subsp. aureus Mu50
acaauaacaccugu

SEQ ID NO: 2062313 - RNA, 17 nt, Staphylococcus aureus subsp. aureus Mu50
acaacuuuaauuuuuca

SEQ ID NO: 2062314 - RNA, 13 nt, Staphylococcus aureus subsp. aureus Mu50
acaacuucuucuc

SEQ ID NO: 2062315 - RNA, 15 nt, Staphylococcus aureus subsp. aureus Mu50
acaacuuuauuauac

SEQ ID NO: 2062316 - RNA, 21 nt, Staphylococcus aureus subsp. aureus Mu50
acaacuuuguuuucaguaacu

SEQ ID NO: 2062317 - RNA, 13 nt, Staphylococcus aureus subsp. aureus Mu50
acaacuauuccca

SEQ ID NO: 2062318 - RNA, 16 nt, Staphylococcus aureus subsp. aureus Mu50
acaacucguuuuucca

SEQ ID NO: 2062319 - RNA, 17 nt, Staphylococcus aureus subsp. aureus Mu50
acaacucguuuuuccau

SEQ ID NO: 2062320 - RNA, 15 nt, Staphylococcus aureus subsp. aureus Mu50
aauuuuuuucauaau

SEQ ID NO: 2062321 - RNA, 21 nt, Staphylococcus aureus subsp. aureus Mu50
aauuuuucuucuuuuuuaucu

SEQ ID NO: 2062322 - RNA, 16 nt, Staphylococcus aureus subsp. aureus Mu50
aauuuuuuauuaagac

SEQ ID NO: 2062323 - RNA, 15 nt, Staphylococcus aureus subsp. aureus Mu50
aauuuuuuauuaaga

SEQ ID NO: 2062324 - RNA, 17 nt, Staphylococcus aureus subsp. aureus Mu50
aauuuuuugugccucuu

SEQ ID NO: 2062325 - RNA, 14 nt, Staphylococcus aureus subsp. aureus Mu50
aagccuacuuuguc

SEQ ID NO: 2062326 - RNA, 14 nt, Staphylococcus aureus subsp. aureus Mu50
aagccuucuauaua

SEQ ID NO: 2062327 - RNA, 22 nt, Staphylococcus aureus subsp. aureus Mu50
aagcgaucauuagcaauuucau

SEQ ID NO: 2062328 - RNA, 13 nt, Staphylococcus aureus subsp. aureus Mu50
aagcgauuuccau

SEQ ID NO: 2062329 - RNA, 23 nt, Staphylococcus aureus subsp. aureus Mu50
aagcgcaugcuugaacuuuuauu

SEQ ID NO: 2062330 - RNA, 19 nt, Staphylococcus aureus subsp. aureus Mu50
aagcgccugucucauuagc

SEQ ID NO: 2062331 - RNA, 16 nt, Staphylococcus aureus subsp. aureus Mu50
aagcuauauaugaauu

SEQ ID NO: 2062332 - RNA, 19 nt, Staphylococcus aureus subsp. aureus Mu50
aagcuauaaaaaaucuuuu

SEQ ID NO: 2062333 - RNA, 17 nt, Staphylococcus aureus subsp. aureus Mu50
aagcuaucguaaacaac

SEQ ID NO: 2062334 - RNA, 17 nt, Staphylococcus aureus subsp. aureus Mu50
aagcuaucuucagauuc

SEQ ID NO: 2062335 - RNA, 14 nt, Staphylococcus aureus subsp. aureus Mu50
aagcuauaaaaaau

SEQ ID NO: 2062336 - RNA, 22 nt, Staphylococcus aureus subsp. aureus Mu50
aaggaaauggcuccauuuaauu

SEQ ID NO: 2062337 - RNA, 15 nt, Staphylococcus aureus subsp. aureus Mu50
aagcuugcuguucaa

SEQ ID NO: 2062338 - RNA, 20 nt, Staphylococcus aureus subsp. aureus Mu50
aagcuugcuguucaacaucu

SEQ ID NO: 2062339 - RNA, 13 nt, Staphylococcus aureus subsp. aureus Mu50
aagcucccauuaa

SEQ ID NO: 2062340 - RNA, 20 nt, Staphylococcus aureus subsp. aureus Mu50
aagcucaugaaucagaugau

SEQ ID NO: 2062341 - RNA, 17 nt, Staphylococcus aureus subsp. aureus Mu50
aaggacaggaauaaauu

SEQ ID NO: 2062342 - RNA, 15 nt, Staphylococcus aureus subsp. aureus Mu50
aaggaugaguuuaaa

SEQ ID NO: 2062343 - RNA, 11 nt, Staphylococcus aureus subsp. aureus Mu50
aaggaagaaca

SEQ ID NO: 2062344 - RNA, 21 nt, Staphylococcus aureus subsp. aureus Mu50
aaggaagucaccauauuuaac

SEQ ID NO: 2062345 - RNA, 23 nt, Staphylococcus aureus subsp. aureus Mu50
aaggaauaauuuuaaaaauaaaa

SEQ ID NO: 2062346 - RNA, 22 nt, Staphylococcus aureus subsp. aureus Mu50
aaggaauguauucuaagaguug

SEQ ID NO: 2062347 - RNA, 22 nt, Staphylococcus aureus subsp. aureus Mu50
aaggaaucguaaagcuguuggu

SEQ ID NO: 2062348 - RNA, 13 nt, Staphylococcus aureus subsp. aureus Mu50
aaggaagcaugag

SEQ ID NO: 2062349 - RNA, 14 nt, Staphylococcus aureus subsp. aureus Mu50
aaggcucauuuguu

SEQ ID NO: 2062350 - RNA, 14 nt, Staphylococcus aureus subsp. aureus Mu50
aaggccauuuuuau

SEQ ID NO: 2062351 - RNA, 22 nt, Staphylococcus aureus subsp. aureus Mu50
aaggauguacuauaaauccuaa

SEQ ID NO: 2062352 - RNA, 20 nt, Staphylococcus aureus subsp. aureus Mu50
aaggaugaugugaauguuuu

SEQ ID NO: 2062353 - RNA, 23 nt, Staphylococcus aureus subsp. aureus Mu50
aaguucaucguuaucuuuaagua

SEQ ID NO: 2062354 - RNA, 15 nt, Staphylococcus aureus subsp. aureus Mu50
aaguugacaauacaa

SEQ ID NO: 2062355 - RNA, 15 nt, Staphylococcus aureus subsp. aureus Mu50
aaguugaauauaaaa

SEQ ID NO: 2062356 - RNA, 17 nt, Staphylococcus aureus subsp. aureus Mu50
aaguuaaugugcauuua

SEQ ID NO: 2062357 - RNA, 15 nt, Staphylococcus aureus subsp. aureus Mu50
aaguuaaucagaaaa

SEQ ID NO: 2062358 - RNA, 13 nt, Staphylococcus aureus subsp. aureus Mu50
aaguuaagucgcc

SEQ ID NO: 2062359 - RNA, 18 nt, Staphylococcus aureus subsp. aureus Mu50
aaguuaagucgccuaacu

SEQ ID NO: 2062360 - RNA, 19 nt, Staphylococcus aureus subsp. aureus Mu50
aaguuaucugcuuuucuau

SEQ ID NO: 2062361 - RNA, 20 nt, Staphylococcus aureus subsp. aureus Mu50
aaguguuucaacauauuaua

SEQ ID NO: 2062362 - RNA, 16 nt, Staphylococcus aureus subsp. aureus Mu50
aaguguugaggcguuu

SEQ ID NO: 2062363 - RNA, 15 nt, Staphylococcus aureus subsp. aureus Mu50
aaguguuucaacaua

SEQ ID NO: 2062364 - RNA, 14 nt, Staphylococcus aureus subsp. aureus Mu50
aaguuaaaauaaaa

SEQ ID NO: 2062365 - RNA, 18 nt, Staphylococcus aureus subsp. aureus Mu50
aaguuaacuauaacaaua

SEQ ID NO: 2062366 - RNA, 12 nt, Staphylococcus aureus subsp. aureus Mu50
aaguuaaaaccu

SEQ ID NO: 2062367 - RNA, 23 nt, Staphylococcus aureus subsp. aureus Mu50
aaguuaaaaccuuuucaaauuau

SEQ ID NO: 2062368 - RNA, 23 nt, Staphylococcus aureus subsp. aureus Mu50
aagugacuuaauaucauauucaa

SEQ ID NO: 2062369 - RNA, 22 nt, Staphylococcus aureus subsp. aureus Mu50
aagugcgggggauuauuuauau

SEQ ID NO: 2062370 - RNA, 23 nt, Staphylococcus aureus subsp. aureus Mu50
aagugcgguuuaaucuauauaua

SEQ ID NO: 2062371 - RNA, 16 nt, Staphylococcus aureus subsp. aureus Mu50
aagucucuugucauuu

SEQ ID NO: 2062372 - RNA, 17 nt, Staphylococcus aureus subsp. aureus Mu50
aagucucuugucauuuc

SEQ ID NO: 2062373 - RNA, 15 nt, Staphylococcus aureus subsp. aureus Mu50
aagucucuuuccuca

SEQ ID NO: 2062374 - RNA, 17 nt, Staphylococcus aureus subsp. aureus Mu50
aagugaaaucauuuaaa

SEQ ID NO: 2062375 - RNA, 19 nt, Staphylococcus aureus subsp. aureus Mu50
aagucuaguucgaacacac

SEQ ID NO: 2062376 - RNA, 17 nt, Staphylococcus aureus subsp. aureus Mu50
aagucguucaauuguug

SEQ ID NO: 2062377 - RNA, 15 nt, Staphylococcus aureus subsp. aureus Mu50
aagucauuaaaugua

SEQ ID NO: 2062378 - RNA, 22 nt, Staphylococcus aureus subsp. aureus Mu50
aagucauuaaauguacauugua

SEQ ID NO: 2062379 - RNA, 12 nt, Staphylococcus aureus subsp. aureus Mu50
aagucgaaagua

SEQ ID NO: 2062380 - RNA, 17 nt, Staphylococcus aureus subsp. aureus Mu50
aaguccggcugaaggga

SEQ ID NO: 2062381 - RNA, 21 nt, Staphylococcus aureus subsp. aureus Mu50
aaguauaugaaucgauauaau

SEQ ID NO: 2062382 - RNA, 18 nt, Staphylococcus aureus subsp. aureus Mu50
aaguauagcuuuuaucca

SEQ ID NO: 2062383 - RNA, 18 nt, Staphylococcus aureus subsp. aureus Mu50
aaguauaagguugaagaa

SEQ ID NO: 2062384 - RNA, 15 nt, Staphylococcus aureus subsp. aureus Mu50
aaguauaauuaaacu

SEQ ID NO: 2062385 - RNA, 19 nt, Staphylococcus aureus subsp. aureus Mu50
aaguauaaguagcucaaaa

SEQ ID NO: 2062386 - RNA, 17 nt, Staphylococcus aureus subsp. aureus Mu50
aaguauacuaaacuuuu

SEQ ID NO: 2062387 - RNA, 19 nt, Staphylococcus aureus subsp. aureus Mu50
aaguauggcgaaauguuuu

SEQ ID NO: 2062388 - RNA, 16 nt, Staphylococcus aureus subsp. aureus Mu50
aaguaucggugauuua

SEQ ID NO: 2062389 - RNA, 17 nt, Staphylococcus aureus subsp. aureus Mu50
aaguaucggugauuuaa

SEQ ID NO: 2062390 - RNA, 16 nt, Staphylococcus aureus subsp. aureus Mu50
aaguauauaauugauu

SEQ ID NO: 2062391 - RNA, 12 nt, Staphylococcus aureus subsp. aureus Mu50
aaguaucuguga

SEQ ID NO: 2062392 - RNA, 19 nt, Staphylococcus aureus subsp. aureus Mu50
aaguaucugugaauaugcu

SEQ ID NO: 2062393 - RNA, 20 nt, Staphylococcus aureus subsp. aureus Mu50
aaguaucugugaauaugcuu

SEQ ID NO: 2062394 - RNA, 19 nt, Staphylococcus aureus subsp. aureus Mu50
aaguagucuacaguaaauu

SEQ ID NO: 2062395 - RNA, 14 nt, Staphylococcus aureus subsp. aureus Mu50
aaguaguuguuaua

SEQ ID NO: 2062396 - RNA, 18 nt, Staphylococcus aureus subsp. aureus Mu50
aaguaguuguuauauucu

SEQ ID NO: 2062397 - RNA, 21 nt, Staphylococcus aureus subsp. aureus Mu50
aaguagucgaagaagauuaug

SEQ ID NO: 2062398 - RNA, 23 nt, Staphylococcus aureus subsp. aureus Mu50
aaguagcucaaaacaauuuaaaa

SEQ ID NO: 2062399 - RNA, 15 nt, Staphylococcus aureus subsp. aureus Mu50
aagucaauaauuuua

SEQ ID NO: 2062400 - RNA, 13 nt, Staphylococcus aureus subsp. aureus Mu50
aagucaauuuaaa

SEQ ID NO: 2062401 - RNA, 18 nt, Staphylococcus aureus subsp. aureus Mu50
aagucacuugucaugccg

SEQ ID NO: 2062402 - RNA, 16 nt, Staphylococcus aureus subsp. aureus Mu50
aaguauuuaaauaaca

SEQ ID NO: 2062403 - RNA, 21 nt, Staphylococcus aureus subsp. aureus Mu50
aaguaucugugaauaugcuuu

SEQ ID NO: 2062404 - RNA, 15 nt, Staphylococcus aureus subsp. aureus Mu50
aaguauguugucaua

SEQ ID NO: 2062405 - RNA, 17 nt, Staphylococcus aureus subsp. aureus Mu50
aaguauuagauauauuu

SEQ ID NO: 2062406 - RNA, 14 nt, Staphylococcus aureus subsp. aureus Mu50
aaguauuaugauug

SEQ ID NO: 2062407 - RNA, 17 nt, Staphylococcus aureus subsp. aureus Mu50
aaguauugccaaauuuc

SEQ ID NO: 2062408 - RNA, 17 nt, Staphylococcus aureus subsp. aureus Mu50
aaguauuaugauugcuu

SEQ ID NO: 2062409 - RNA, 23 nt, Staphylococcus aureus subsp. aureus Mu50
aaguauuaugauugcuuauuuau

SEQ ID NO: 2062410 - RNA, 14 nt, Staphylococcus aureus subsp. aureus Mu50
aaguaaaauaaaaa

SEQ ID NO: 2062411 - RNA, 16 nt, Staphylococcus aureus subsp. aureus Mu50
aagggguauguuuguu

SEQ ID NO: 2062412 - RNA, 15 nt, Staphylococcus aureus subsp. aureus Mu50
aaggggguaauacua

SEQ ID NO: 2062413 - RNA, 14 nt, Staphylococcus aureus subsp. aureus Mu50
aaguacgcaauuua

SEQ ID NO: 2062414 - RNA, 22 nt, Staphylococcus aureus subsp. aureus Mu50
aaguacgacgguauaaaaaaau

SEQ ID NO: 2062415 - RNA, 17 nt, Staphylococcus aureus subsp. aureus Mu50
aaguacuucggugcuug

SEQ ID NO: 2062416 - RNA, 20 nt, Staphylococcus aureus subsp. aureus Mu50
aaguacuuuaaaauuguaua

SEQ ID NO: 2062417 - RNA, 14 nt, Staphylococcus aureus subsp. aureus Mu50
aaguacuuacaaau

SEQ ID NO: 2062418 - RNA, 16 nt, Staphylococcus aureus subsp. aureus Mu50
aaguacuuacaaauau

SEQ ID NO: 2062419 - RNA, 13 nt, Staphylococcus aureus subsp. aureus Mu50
aaguacuuuacca

SEQ ID NO: 2062420 - RNA, 16 nt, Staphylococcus aureus subsp. aureus Mu50
aaguagacauugaaag

SEQ ID NO: 2062421 - RNA, 14 nt, Staphylococcus aureus subsp. aureus Mu50
aaguacaaauaaua

SEQ ID NO: 2062422 - RNA, 19 nt, Staphylococcus aureus subsp. aureus Mu50
aaguaauguuaaacacuca

SEQ ID NO: 2062423 - RNA, 24 nt, Staphylococcus aureus subsp. aureus Mu50
aaguaaugcuguacuauauucaau

SEQ ID NO: 2062424 - RNA, 23 nt, Staphylococcus aureus subsp. aureus Mu50
aaguaauggauugauaauagcuu

SEQ ID NO: 2062425 - RNA, 13 nt, Staphylococcus aureus subsp. aureus Mu50
aaguaauuuaauu

SEQ ID NO: 2062426 - RNA, 13 nt, Staphylococcus aureus subsp. aureus Mu50
aaguaauuaaaua

SEQ ID NO: 2062427 - RNA, 15 nt, Staphylococcus aureus subsp. aureus Mu50
aaguaauuaaauacu

SEQ ID NO: 2062428 - RNA, 18 nt, Staphylococcus aureus subsp. aureus Mu50
aaguaccuaaaauagaaa

SEQ ID NO: 2062429 - RNA, 19 nt, Staphylococcus aureus subsp. aureus Mu50
aaguaccuaaaauagaaaa

SEQ ID NO: 2062430 - RNA, 21 nt, Staphylococcus aureus subsp. aureus Mu50
aaguaccuaaaauagaaaaau

SEQ ID NO: 2062431 - RNA, 21 nt, Staphylococcus aureus subsp. aureus Mu50
aaguacauaaaugcuaaaagu

SEQ ID NO: 2062432 - RNA, 18 nt, Staphylococcus aureus subsp. aureus Mu50
aaguacacgaauaccaag

SEQ ID NO: 2062433 - RNA, 14 nt, Staphylococcus aureus subsp. aureus Mu50
aaguacauaaaugc

SEQ ID NO: 2062434 - RNA, 12 nt, Staphylococcus aureus subsp. aureus Mu50
aauauccaaaau

SEQ ID NO: 2062435 - RNA, 13 nt, Staphylococcus aureus subsp. aureus Mu50
aauaucaauuuuu

SEQ ID NO: 2062436 - RNA, 16 nt, Staphylococcus aureus subsp. aureus Mu50
aauaucauaaaugcau

SEQ ID NO: 2062437 - RNA, 20 nt, Staphylococcus aureus subsp. aureus Mu50
aauaucaucauuuaaauauu

SEQ ID NO: 2062438 - RNA, 22 nt, Staphylococcus aureus subsp. aureus Mu50
aauaucaucauuuaaauauuuc

SEQ ID NO: 2062439 - RNA, 17 nt, Staphylococcus aureus subsp. aureus Mu50
aauaucauaaaugcaua

SEQ ID NO: 2062440 - RNA, 23 nt, Staphylococcus aureus subsp. aureus Mu50
aauaucauauucaaaauaacuua

SEQ ID NO: 2062441 - RNA, 15 nt, Staphylococcus aureus subsp. aureus Mu50
aauaucauauuugaa

SEQ ID NO: 2062442 - RNA, 14 nt, Staphylococcus aureus subsp. aureus Mu50
aauaucgacaaauu

SEQ ID NO: 2062443 - RNA, 22 nt, Staphylococcus aureus subsp. aureus Mu50
aauaucgacaaauuaaaaaaca

SEQ ID NO: 2062444 - RNA, 20 nt, Staphylococcus aureus subsp. aureus Mu50
aauaucuaaagauuucaguu

SEQ ID NO: 2062445 - RNA, 16 nt, Staphylococcus aureus subsp. aureus Mu50
aauaucugaaaaacca

SEQ ID NO: 2062446 - RNA, 22 nt, Staphylococcus aureus subsp. aureus Mu50
aauaucuguugcauuaagugca

SEQ ID NO: 2062447 - RNA, 17 nt, Staphylococcus aureus subsp. aureus Mu50
aauaucuuaaagaauua

SEQ ID NO: 2062448 - RNA, 13 nt, Staphylococcus aureus subsp. aureus Mu50
aauaucuucagcu

SEQ ID NO: 2062449 - RNA, 23 nt, Staphylococcus aureus subsp. aureus Mu50
aauaucuuacugcuguuuuuuau

SEQ ID NO: 2062450 - RNA, 13 nt, Staphylococcus aureus subsp. aureus Mu50
aauaucuucuuua

SEQ ID NO: 2062451 - RNA, 17 nt, Staphylococcus aureus subsp. aureus Mu50
aauauaauuauuaaacu

SEQ ID NO: 2062452 - RNA, 20 nt, Staphylococcus aureus subsp. aureus Mu50
aauauaccaaccaaaaccaa

SEQ ID NO: 2062453 - RNA, 15 nt, Staphylococcus aureus subsp. aureus Mu50
aauauaccaaccaaa

SEQ ID NO: 2062454 - RNA, 18 nt, Staphylococcus aureus subsp. aureus Mu50
aauauacuaaauuugaaa

SEQ ID NO: 2062455 - RNA, 18 nt, Staphylococcus aureus subsp. aureus Mu50
aauauagcuauuacuaua

SEQ ID NO: 2062456 - RNA, 22 nt, Staphylococcus aureus subsp. aureus Mu50
aauauagcuauuacuauaaaaa

SEQ ID NO: 2062457 - RNA, 16 nt, Staphylococcus aureus subsp. aureus Mu50
aauauagcugugauuu

SEQ ID NO: 2062458 - RNA, 11 nt, Staphylococcus aureus subsp. aureus Mu50
aauauacuuuu

SEQ ID NO: 2062459 - RNA, 23 nt, Staphylococcus aureus subsp. aureus Mu50
aauauacuuuuuaaaugauuuaa

SEQ ID NO: 2062460 - RNA, 17 nt, Staphylococcus aureus subsp. aureus Mu50
aauauagaaaaugagua

SEQ ID NO: 2062461 - RNA, 21 nt, Staphylococcus aureus subsp. aureus Mu50
aauauagaagugcgguuuaau

SEQ ID NO: 2062462 - RNA, 19 nt, Staphylococcus aureus subsp. aureus Mu50
aauauagauuugaauuaaa

SEQ ID NO: 2062463 - RNA, 21 nt, Staphylococcus aureus subsp. aureus Mu50
aauauagauuugaauuaaagu

SEQ ID NO: 2062464 - RNA, 15 nt, Staphylococcus aureus subsp. aureus Mu50
aauauagauuuugua

SEQ ID NO: 2062465 - RNA, 17 nt, Staphylococcus aureus subsp. aureus Mu50
aauauaacgacacuuuu

SEQ ID NO: 2062466 - RNA, 17 nt, Staphylococcus aureus subsp. aureus Mu50
aauauaacaucaaauag

SEQ ID NO: 2062467 - RNA, 18 nt, Staphylococcus aureus subsp. aureus Mu50
aauauaacaucaaauaga

SEQ ID NO: 2062468 - RNA, 23 nt, Staphylococcus aureus subsp. aureus Mu50
aauauaacuucuauuaagaaaua

SEQ ID NO: 2062469 - RNA, 20 nt, Staphylococcus aureus subsp. aureus Mu50
aauauaauacuguauuuuaa

SEQ ID NO: 2062470 - RNA, 18 nt, Staphylococcus aureus subsp. aureus Mu50
aauauaauagaaauaauc

SEQ ID NO: 2062471 - RNA, 13 nt, Staphylococcus aureus subsp. aureus Mu50
aauauaaugaucc

SEQ ID NO: 2062472 - RNA, 23 nt, Staphylococcus aureus subsp. aureus Mu50
aauauaauuaaacauuuagauuu

SEQ ID NO: 2062473 - RNA, 13 nt, Staphylococcus aureus subsp. aureus Mu50
aauauaauuuuuu

SEQ ID NO: 2062474 - RNA, 15 nt, Staphylococcus aureus subsp. aureus Mu50
aauauaauuauuaaa

SEQ ID NO: 2062475 - RNA, 14 nt, Staphylococcus aureus subsp. aureus Mu50
aauauaauguauaa

SEQ ID NO: 2062476 - RNA, 16 nt, Staphylococcus aureus subsp. aureus Mu50
aauauauccugccaau

SEQ ID NO: 2062477 - RNA, 21 nt, Staphylococcus aureus subsp. aureus Mu50
aauauauccugccaauauauu

SEQ ID NO: 2062478 - RNA, 23 nt, Staphylococcus aureus subsp. aureus Mu50
aauauauccugccaauauauuca

SEQ ID NO: 2062479 - RNA, 16 nt, Staphylococcus aureus subsp. aureus Mu50
aauauaucaucucuau

SEQ ID NO: 2062480 - RNA, 23 nt, Staphylococcus aureus subsp. aureus Mu50
aauauauagcgcgcuuauugaaa

SEQ ID NO: 2062481 - RNA, 22 nt, Staphylococcus aureus subsp. aureus Mu50
aauauauaaggcgcucucuuuu

SEQ ID NO: 2062482 - RNA, 15 nt, Staphylococcus aureus subsp. aureus Mu50
aauauaguuaaaguu

SEQ ID NO: 2062483 - RNA, 18 nt, Staphylococcus aureus subsp. aureus Mu50
aauauaguaauuguuaua

SEQ ID NO: 2062484 - RNA, 14 nt, Staphylococcus aureus subsp. aureus Mu50
aauaucaaaauaua

SEQ ID NO: 2062485 - RNA, 20 nt, Staphylococcus aureus subsp. aureus Mu50
aauauauugucgacuuuuag

SEQ ID NO: 2062486 - RNA, 20 nt, Staphylococcus aureus subsp. aureus Mu50
aauauaugaauaagucuaau

SEQ ID NO: 2062487 - RNA, 16 nt, Staphylococcus aureus subsp. aureus Mu50
aauauauuaauuuuac

SEQ ID NO: 2062488 - RNA, 16 nt, Staphylococcus aureus subsp. aureus Mu50
aauauauguauaacau

SEQ ID NO: 2062489 - RNA, 13 nt, Staphylococcus aureus subsp. aureus Mu50
aauauauuaacaa

SEQ ID NO: 2062490 - RNA, 19 nt, Staphylococcus aureus subsp. aureus Mu50
aauaguuuucuucacugcu

SEQ ID NO: 2062491 - RNA, 14 nt, Staphylococcus aureus subsp. aureus Mu50
aauauaaaaaagau

SEQ ID NO: 2062492 - RNA, 14 nt, Staphylococcus aureus subsp. aureus Mu50
aauaguuuuucaua

SEQ ID NO: 2062493 - RNA, 13 nt, Staphylococcus aureus subsp. aureus Mu50
aauauaaaaaaga

SEQ ID NO: 2062494 - RNA, 13 nt, Staphylococcus aureus subsp. aureus Mu50
aauauaaauaaaa

SEQ ID NO: 2062495 - RNA, 18 nt, Staphylococcus aureus subsp. aureus Mu50
aauauaaaaggaagcauc

SEQ ID NO: 2062496 - RNA, 19 nt, Staphylococcus aureus subsp. aureus Mu50
aauauaaaacgauaagaau

SEQ ID NO: 2062497 - RNA, 14 nt, Staphylococcus aureus subsp. aureus Mu50
aauauaaauuuuga

SEQ ID NO: 2062498 - RNA, 14 nt, Staphylococcus aureus subsp. aureus Mu50
aauauaacaucaaa

SEQ ID NO: 2062499 - RNA, 15 nt, Staphylococcus aureus subsp. aureus Mu50
aauauaaauuuugaa

SEQ ID NO: 2062500 - RNA, 18 nt, Staphylococcus aureus subsp. aureus Mu50
aauauaacaaguauaaau

SEQ ID NO: 2062501 - RNA, 18 nt, Staphylococcus aureus subsp. aureus Mu50
aauaggauaugcuaaaca

SEQ ID NO: 2062502 - RNA, 15 nt, Staphylococcus aureus subsp. aureus Mu50
aauaggcaggaauga

SEQ ID NO: 2062503 - RNA, 20 nt, Staphylococcus aureus subsp. aureus Mu50
aauaggcaggaaugauauac

SEQ ID NO: 2062504 - RNA, 19 nt, Staphylococcus aureus subsp. aureus Mu50
aauagcuuucguuucuuuu

SEQ ID NO: 2062505 - RNA, 21 nt, Staphylococcus aureus subsp. aureus Mu50
aauagcuuucguuucuuuuau

SEQ ID NO: 2062506 - RNA, 17 nt, Staphylococcus aureus subsp. aureus Mu50
aauaguaaagugaaaua

SEQ ID NO: 2062507 - RNA, 13 nt, Staphylococcus aureus subsp. aureus Mu50
aauaguaaaguga

SEQ ID NO: 2062508 - RNA, 16 nt, Staphylococcus aureus subsp. aureus Mu50
aauagguuauuugaua

SEQ ID NO: 2062509 - RNA, 19 nt, Staphylococcus aureus subsp. aureus Mu50
aauagguacaacuaaauau

SEQ ID NO: 2062510 - RNA, 18 nt, Staphylococcus aureus subsp. aureus Mu50
aauaccucuacauuauau

SEQ ID NO: 2062511 - RNA, 23 nt, Staphylococcus aureus subsp. aureus Mu50
aauaccuaugauauaugcugcaa

SEQ ID NO: 2062512 - RNA, 15 nt, Staphylococcus aureus subsp. aureus Mu50
aauagacuuauauua

SEQ ID NO: 2062513 - RNA, 22 nt, Staphylococcus aureus subsp. aureus Mu50
aauagacugccaauaaaaugca

SEQ ID NO: 2062514 - RNA, 16 nt, Staphylococcus aureus subsp. aureus Mu50
aauagauugaaaaaau

SEQ ID NO: 2062515 - RNA, 22 nt, Staphylococcus aureus subsp. aureus Mu50
aauagcuauauuuuuguauuua

SEQ ID NO: 2062516 - RNA, 21 nt, Staphylococcus aureus subsp. aureus Mu50
aauagcuacaauuaaagugaa

SEQ ID NO: 2062517 - RNA, 20 nt, Staphylococcus aureus subsp. aureus Mu50
aauagcgucaucuggaauac

SEQ ID NO: 2062518 - RNA, 12 nt, Staphylococcus aureus subsp. aureus Mu50
aauagcugcaau

SEQ ID NO: 2062519 - RNA, 17 nt, Staphylococcus aureus subsp. aureus Mu50
aauagcuauuaaaauag

SEQ ID NO: 2062520 - RNA, 17 nt, Staphylococcus aureus subsp. aureus Mu50
aauagcgguuuaaaaau

SEQ ID NO: 2062521 - RNA, 21 nt, Staphylococcus aureus subsp. aureus Mu50
aauagcgauuuuaaagaaaag

SEQ ID NO: 2062522 - RNA, 15 nt, Staphylococcus aureus subsp. aureus Mu50
aauagcgauuuuaaa

SEQ ID NO: 2062523 - RNA, 20 nt, Staphylococcus aureus subsp. aureus Mu50
aauagcgauuuuaaagaaaa

SEQ ID NO: 2062524 - RNA, 16 nt, Staphylococcus aureus subsp. aureus Mu50
aauaccccaaauagug

SEQ ID NO: 2062525 - RNA, 21 nt, Staphylococcus aureus subsp. aureus Mu50
aaaaauggugauccgccuuga

SEQ ID NO: 2062526 - RNA, 21 nt, Staphylococcus aureus subsp. aureus Mu50
aaaaaugcuuauauaaacaaa

SEQ ID NO: 2062527 - RNA, 18 nt, Staphylococcus aureus subsp. aureus Mu50
aaaaauguaaauaaaaau

SEQ ID NO: 2062528 - RNA, 15 nt, Staphylococcus aureus subsp. aureus Mu50
aaaaaugaauauaau

SEQ ID NO: 2062529 - RNA, 21 nt, Staphylococcus aureus subsp. aureus Mu50
aaaaaugccgagauuauuaug

SEQ ID NO: 2062530 - RNA, 18 nt, Staphylococcus aureus subsp. aureus Mu50
aaaaaugcgcuuccaauu

SEQ ID NO: 2062531 - RNA, 22 nt, Staphylococcus aureus subsp. aureus Mu50
aaaaauggaaccacgucuuaau

SEQ ID NO: 2062532 - RNA, 19 nt, Staphylococcus aureus subsp. aureus Mu50
aaaaaugcgcuuccaauuu

SEQ ID NO: 2062533 - RNA, 19 nt, Staphylococcus aureus subsp. aureus Mu50
aaaaaugcugguaaauguu

SEQ ID NO: 2062534 - RNA, 15 nt, Staphylococcus aureus subsp. aureus Mu50
aauacacuugauaaa

SEQ ID NO: 2062535 - RNA, 21 nt, Staphylococcus aureus subsp. aureus Mu50
aauacaauuucuucauuuuca

SEQ ID NO: 2062536 - RNA, 11 nt, Staphylococcus aureus subsp. aureus Mu50
aauacagauga

SEQ ID NO: 2062537 - RNA, 12 nt, Staphylococcus aureus subsp. aureus Mu50
aauacagaugau

SEQ ID NO: 2062538 - RNA, 15 nt, Staphylococcus aureus subsp. aureus Mu50
aauacagaugaugcu

SEQ ID NO: 2062539 - RNA, 20 nt, Staphylococcus aureus subsp. aureus Mu50
aauacaugugggauaucuuc

SEQ ID NO: 2062540 - RNA, 17 nt, Staphylococcus aureus subsp. aureus Mu50
aauacauuaauauaaau

SEQ ID NO: 2062541 - RNA, 17 nt, Staphylococcus aureus subsp. aureus Mu50
aauacauuauguucuuc

SEQ ID NO: 2062542 - RNA, 20 nt, Staphylococcus aureus subsp. aureus Mu50
aauaccacgacucauuagau

SEQ ID NO: 2062543 - RNA, 14 nt, Staphylococcus aureus subsp. aureus Mu50
aauaccaauugcuu

SEQ ID NO: 2062544 - RNA, 13 nt, Staphylococcus aureus subsp. aureus Mu50
aauaccaauugcu

SEQ ID NO: 2062545 - RNA, 15 nt, Staphylococcus aureus subsp. aureus Mu50
aauacauuuuuauac

SEQ ID NO: 2062546 - RNA, 16 nt, Staphylococcus aureus subsp. aureus Mu50
aauacauuuuuauaca

SEQ ID NO: 2062547 - RNA, 21 nt, Staphylococcus aureus subsp. aureus Mu50
aauacauuuuuauacaacuuc

SEQ ID NO: 2062548 - RNA, 22 nt, Staphylococcus aureus subsp. aureus Mu50
aauaauaggauaccacaucgca

SEQ ID NO: 2062549 - RNA, 14 nt, Staphylococcus aureus subsp. aureus Mu50
aauaauagcaaaau

SEQ ID NO: 2062550 - RNA, 23 nt, Staphylococcus aureus subsp. aureus Mu50
aaaaauagcguaauuauuauaau

SEQ ID NO: 2062551 - RNA, 14 nt, Staphylococcus aureus subsp. aureus Mu50
aauaaugacaaauu

SEQ ID NO: 2062552 - RNA, 19 nt, Staphylococcus aureus subsp. aureus Mu50
aauaaugacgagaauuaaa

SEQ ID NO: 2062553 - RNA, 20 nt, Staphylococcus aureus subsp. aureus Mu50
aauaaugacgagaauuaaag

SEQ ID NO: 2062554 - RNA, 23 nt, Staphylococcus aureus subsp. aureus Mu50
aauaaugggaauuguauuagcaa

SEQ ID NO: 2062555 - RNA, 18 nt, Staphylococcus aureus subsp. aureus Mu50
aauaauuuuuuuccuuuc

SEQ ID NO: 2062556 - RNA, 23 nt, Staphylococcus aureus subsp. aureus Mu50
aauaauuuuuuuccuuucuuuuu

SEQ ID NO: 2062557 - RNA, 14 nt, Staphylococcus aureus subsp. aureus Mu50
aauacaaaaauaua

SEQ ID NO: 2062558 - RNA, 20 nt, Staphylococcus aureus subsp. aureus Mu50
aaaaaucuuuugauagcuaa

SEQ ID NO: 2062559 - RNA, 22 nt, Staphylococcus aureus subsp. aureus Mu50
aauaauuucaguucuuagauuu

SEQ ID NO: 2062560 - RNA, 16 nt, Staphylococcus aureus subsp. aureus Mu50
aauaauuuuaaaaaua

SEQ ID NO: 2062561 - RNA, 18 nt, Staphylococcus aureus subsp. aureus Mu50
aaaaaucuucuccaauca

SEQ ID NO: 2062562 - RNA, 19 nt, Staphylococcus aureus subsp. aureus Mu50
aaaaaugaagaauacaaau

SEQ ID NO: 2062563 - RNA, 17 nt, Staphylococcus aureus subsp. aureus Mu50
aaaaaucgaauuuucaa

SEQ ID NO: 2062564 - RNA, 20 nt, Staphylococcus aureus subsp. aureus Mu50
aauaaugucuuacuuuuaaa

SEQ ID NO: 2062565 - RNA, 20 nt, Staphylococcus aureus subsp. aureus Mu50
aaaaauccucacaaauuuga

SEQ ID NO: 2062566 - RNA, 20 nt, Staphylococcus aureus subsp. aureus Mu50
aaaaauccggaacauuaaaa

SEQ ID NO: 2062567 - RNA, 14 nt, Staphylococcus aureus subsp. aureus Mu50
aaaaaguuucggaa

SEQ ID NO: 2062568 - RNA, 11 nt, Staphylococcus aureus subsp. aureus Mu50
aaaaauaaaaa

SEQ ID NO: 2062569 - RNA, 12 nt, Staphylococcus aureus subsp. aureus Mu50
aaaaauaaacca

SEQ ID NO: 2062570 - RNA, 19 nt, Staphylococcus aureus subsp. aureus Mu50
aauaagcgcaauuaaaagu

SEQ ID NO: 2062571 - RNA, 13 nt, Staphylococcus aureus subsp. aureus Mu50
aauaagcauuaau

SEQ ID NO: 2062572 - RNA, 17 nt, Staphylococcus aureus subsp. aureus Mu50
aauaagcguaaaaucau

SEQ ID NO: 2062573 - RNA, 20 nt, Staphylococcus aureus subsp. aureus Mu50
aauaagcgcaauuaaaagua

SEQ ID NO: 2062574 - RNA, 19 nt, Staphylococcus aureus subsp. aureus Mu50
aaaaaguuauaucaucaac

SEQ ID NO: 2062575 - RNA, 19 nt, Staphylococcus aureus subsp. aureus Mu50
aauaagcuuguaacaagca

SEQ ID NO: 2062576 - RNA, 15 nt, Staphylococcus aureus subsp. aureus Mu50
aauaaguaauaauuu

SEQ ID NO: 2062577 - RNA, 17 nt, Staphylococcus aureus subsp. aureus Mu50
aauaaguaauaauuuau

SEQ ID NO: 2062578 - RNA, 11 nt, Staphylococcus aureus subsp. aureus Mu50
aauaaguaugg

SEQ ID NO: 2062579 - RNA, 13 nt, Staphylococcus aureus subsp. aureus Mu50
aauaagugauaaa

SEQ ID NO: 2062580 - RNA, 14 nt, Staphylococcus aureus subsp. aureus Mu50
aauaauaaucuuua

SEQ ID NO: 2062581 - RNA, 14 nt, Staphylococcus aureus subsp. aureus Mu50
aauaauaaugggaa

SEQ ID NO: 2062582 - RNA, 13 nt, Staphylococcus aureus subsp. aureus Mu50
aauaauaaaauag

SEQ ID NO: 2062583 - RNA, 20 nt, Staphylococcus aureus subsp. aureus Mu50
aauaagugguuguucccauu

SEQ ID NO: 2062584 - RNA, 13 nt, Staphylococcus aureus subsp. aureus Mu50
aauaaguuaccuu

SEQ ID NO: 2062585 - RNA, 19 nt, Staphylococcus aureus subsp. aureus Mu50
aauaaguugucaucuaauu

SEQ ID NO: 2062586 - RNA, 13 nt, Staphylococcus aureus subsp. aureus Mu50
aauaaguugucau

SEQ ID NO: 2062587 - RNA, 14 nt, Staphylococcus aureus subsp. aureus Mu50
aauaaguugucauc

SEQ ID NO: 2062588 - RNA, 19 nt, Staphylococcus aureus subsp. aureus Mu50
aauaaguugaauauaaaaa

SEQ ID NO: 2062589 - RNA, 22 nt, Staphylococcus aureus subsp. aureus Mu50
aauaaguugaauauaaaaaaga

SEQ ID NO: 2062590 - RNA, 23 nt, Staphylococcus aureus subsp. aureus Mu50
aauaaguugaauauaaaaaagau

SEQ ID NO: 2062591 - RNA, 23 nt, Staphylococcus aureus subsp. aureus Mu50
aauaacugaguuuuaaugaacuc

SEQ ID NO: 2062592 - RNA, 19 nt, Staphylococcus aureus subsp. aureus Mu50
aauaacuggcaaaucaaac

SEQ ID NO: 2062593 - RNA, 17 nt, Staphylococcus aureus subsp. aureus Mu50
aauaaccauuucaucau

SEQ ID NO: 2062594 - RNA, 12 nt, Staphylococcus aureus subsp. aureus Mu50
aauaagauuauu

SEQ ID NO: 2062595 - RNA, 15 nt, Staphylococcus aureus subsp. aureus Mu50
aauaagaugaaauau

SEQ ID NO: 2062596 - RNA, 19 nt, Staphylococcus aureus subsp. aureus Mu50
aauaagaauguguuaauca

SEQ ID NO: 2062597 - RNA, 15 nt, Staphylococcus aureus subsp. aureus Mu50
aauaacuguucuuuc

SEQ ID NO: 2062598 - RNA, 18 nt, Staphylococcus aureus subsp. aureus Mu50
aaguuuaaucguauuagc

SEQ ID NO: 2062599 - RNA, 14 nt, Staphylococcus aureus subsp. aureus Mu50
aaguuuaaaauacg

SEQ ID NO: 2062600 - RNA, 16 nt, Staphylococcus aureus subsp. aureus Mu50
aaguuguugaaauuuc

SEQ ID NO: 2062601 - RNA, 14 nt, Staphylococcus aureus subsp. aureus Mu50
aaguugauuaaaag

SEQ ID NO: 2062602 - RNA, 14 nt, Staphylococcus aureus subsp. aureus Mu50
aaguuggugugcaa

SEQ ID NO: 2062603 - RNA, 23 nt, Staphylococcus aureus subsp. aureus Mu50
aaguuuaaucguauuagccaaua

SEQ ID NO: 2062604 - RNA, 20 nt, Staphylococcus aureus subsp. aureus Mu50
aauaaaucaguaguuuuaaa

SEQ ID NO: 2062605 - RNA, 13 nt, Staphylococcus aureus subsp. aureus Mu50
aauaaaucauacg

SEQ ID NO: 2062606 - RNA, 13 nt, Staphylococcus aureus subsp. aureus Mu50
aauaaauguuaaa

SEQ ID NO: 2062607 - RNA, 15 nt, Staphylococcus aureus subsp. aureus Mu50
aauaacaucuaaauu

SEQ ID NO: 2062608 - RNA, 17 nt, Staphylococcus aureus subsp. aureus Mu50
aauaaaugacauuuaau

SEQ ID NO: 2062609 - RNA, 14 nt, Staphylococcus aureus subsp. aureus Mu50
aagagaauuuuaau

SEQ ID NO: 2062610 - RNA, 20 nt, Staphylococcus aureus subsp. aureus Mu50
aagagcaagugucaaauacg

SEQ ID NO: 2062611 - RNA, 14 nt, Staphylococcus aureus subsp. aureus Mu50
aagagcaauuaaag

SEQ ID NO: 2062612 - RNA, 17 nt, Staphylococcus aureus subsp. aureus Mu50
aagagcaauuaaaguca

SEQ ID NO: 2062613 - RNA, 15 nt, Staphylococcus aureus subsp. aureus Mu50
aagagauaagaaaau

SEQ ID NO: 2062614 - RNA, 22 nt, Staphylococcus aureus subsp. aureus Mu50
aagauaagaugguuugaguaaa

SEQ ID NO: 2062615 - RNA, 21 nt, Staphylococcus aureus subsp. aureus Mu50
aagauaacuagcaaaugcacu

SEQ ID NO: 2062616 - RNA, 23 nt, Staphylococcus aureus subsp. aureus Mu50
aagauaaauaaaaggcauucuuc

SEQ ID NO: 2062617 - RNA, 15 nt, Staphylococcus aureus subsp. aureus Mu50
aagauaaacaagcca

SEQ ID NO: 2062618 - RNA, 20 nt, Staphylococcus aureus subsp. aureus Mu50
aagauaaacaagccaagaua

SEQ ID NO: 2062619 - RNA, 21 nt, Staphylococcus aureus subsp. aureus Mu50
aagauacguugauguaauucu

SEQ ID NO: 2062620 - RNA, 15 nt, Staphylococcus aureus subsp. aureus Mu50
aagauaccuuuuucu

SEQ ID NO: 2062621 - RNA, 20 nt, Staphylococcus aureus subsp. aureus Mu50
aagauagguuuauuucugac

SEQ ID NO: 2062622 - RNA, 23 nt, Staphylococcus aureus subsp. aureus Mu50
aagauaggauuugcaccuauacc

SEQ ID NO: 2062623 - RNA, 16 nt, Staphylococcus aureus subsp. aureus Mu50
aagauaggauuuacac

SEQ ID NO: 2062624 - RNA, 15 nt, Staphylococcus aureus subsp. aureus Mu50
aagauaucuggauua

SEQ ID NO: 2062625 - RNA, 17 nt, Staphylococcus aureus subsp. aureus Mu50
aagaaugcgaagauuuu

SEQ ID NO: 2062626 - RNA, 20 nt, Staphylococcus aureus subsp. aureus Mu50
aagaaugccuuuuauuuauc

SEQ ID NO: 2062627 - RNA, 17 nt, Staphylococcus aureus subsp. aureus Mu50
aagaauuguugaucaug

SEQ ID NO: 2062628 - RNA, 12 nt, Staphylococcus aureus subsp. aureus Mu50
aagaauuuaaaa

SEQ ID NO: 2062629 - RNA, 20 nt, Staphylococcus aureus subsp. aureus Mu50
aagaaauacuugaauuuaau

SEQ ID NO: 2062630 - RNA, 17 nt, Staphylococcus aureus subsp. aureus Mu50
aagaaauaauuuaaagg

SEQ ID NO: 2062631 - RNA, 14 nt, Staphylococcus aureus subsp. aureus Mu50
aagaaaucaccaga

SEQ ID NO: 2062632 - RNA, 20 nt, Staphylococcus aureus subsp. aureus Mu50
aagaaaucaccagauuuuaa

SEQ ID NO: 2062633 - RNA, 17 nt, Staphylococcus aureus subsp. aureus Mu50
aagaccccgaaaagagg

SEQ ID NO: 2062634 - RNA, 20 nt, Staphylococcus aureus subsp. aureus Mu50
aagaccauuuuauauuuuag

SEQ ID NO: 2062635 - RNA, 15 nt, Staphylococcus aureus subsp. aureus Mu50
aagacgcagagccga

SEQ ID NO: 2062636 - RNA, 23 nt, Staphylococcus aureus subsp. aureus Mu50
aagaccuucuucucuaaucacuu

SEQ ID NO: 2062637 - RNA, 22 nt, Staphylococcus aureus subsp. aureus Mu50
aagacgauuuauuaguuuuuac

SEQ ID NO: 2062638 - RNA, 22 nt, Staphylococcus aureus subsp. aureus Mu50
aagacuucguugcacuuuaaua

SEQ ID NO: 2062639 - RNA, 23 nt, Staphylococcus aureus subsp. aureus Mu50
aacucgcgagaccuauaagucuc

SEQ ID NO: 2062640 - RNA, 21 nt, Staphylococcus aureus subsp. aureus Mu50
aacucguugcacucuuuucuc

SEQ ID NO: 2062641 - RNA, 22 nt, Staphylococcus aureus subsp. aureus Mu50
aacucuaaaagccaucuuaccu

SEQ ID NO: 2062642 - RNA, 18 nt, Staphylococcus aureus subsp. aureus Mu50
aacucuaaaaguuguaau

SEQ ID NO: 2062643 - RNA, 15 nt, Staphylococcus aureus subsp. aureus Mu50
aacucucuaaaaagc

SEQ ID NO: 2062644 - RNA, 22 nt, Staphylococcus aureus subsp. aureus Mu50
aacucuaaauauaauagaaaua

SEQ ID NO: 2062645 - RNA, 17 nt, Staphylococcus aureus subsp. aureus Mu50
aacucugauauugaucu

SEQ ID NO: 2062646 - RNA, 14 nt, Staphylococcus aureus subsp. aureus Mu50
aacuauugaaaaua

SEQ ID NO: 2062647 - RNA, 18 nt, Staphylococcus aureus subsp. aureus Mu50
aacuauguuacuuauaua

SEQ ID NO: 2062648 - RNA, 19 nt, Staphylococcus aureus subsp. aureus Mu50
aacuauuaauggcaccaua

SEQ ID NO: 2062649 - RNA, 22 nt, Staphylococcus aureus subsp. aureus Mu50
aacuaucgauacuaaacgauaa

SEQ ID NO: 2062650 - RNA, 15 nt, Staphylococcus aureus subsp. aureus Mu50
aacuaucgauacuaa

SEQ ID NO: 2062651 - RNA, 20 nt, Staphylococcus aureus subsp. aureus Mu50
aacuauauauaguugaucaa

SEQ ID NO: 2062652 - RNA, 16 nt, Staphylococcus aureus subsp. aureus Mu50
aacucauacaaauuuu

SEQ ID NO: 2062653 - RNA, 14 nt, Staphylococcus aureus subsp. aureus Mu50
aacucauaccaaaa

SEQ ID NO: 2062654 - RNA, 17 nt, Staphylococcus aureus subsp. aureus Mu50
aacucauccauugaucu

SEQ ID NO: 2062655 - RNA, 22 nt, Staphylococcus aureus subsp. aureus Mu50
aacucaugcauaagaaauacua

SEQ ID NO: 2062656 - RNA, 21 nt, Staphylococcus aureus subsp. aureus Mu50
aacucaugcauaagaaauacu

SEQ ID NO: 2062657 - RNA, 16 nt, Staphylococcus aureus subsp. aureus Mu50
aacuuuuauugccaua

SEQ ID NO: 2062658 - RNA, 22 nt, Staphylococcus aureus subsp. aureus Mu50
aacuuuucagcaguugcacaaa

SEQ ID NO: 2062659 - RNA, 23 nt, Staphylococcus aureus subsp. aureus Mu50
aacuuuugggaagcgucuuuuuu

SEQ ID NO: 2062660 - RNA, 19 nt, Staphylococcus aureus subsp. aureus Mu50
aacuuugucuguauuauua

SEQ ID NO: 2062661 - RNA, 23 nt, Staphylococcus aureus subsp. aureus Mu50
aacuuugucuguauuauuauaau

SEQ ID NO: 2062662 - RNA, 13 nt, Staphylococcus aureus subsp. aureus Mu50
aacuuuuacuuuc

SEQ ID NO: 2062663 - RNA, 14 nt, Staphylococcus aureus subsp. aureus Mu50
aagaaacauuauau

SEQ ID NO: 2062664 - RNA, 15 nt, Staphylococcus aureus subsp. aureus Mu50
aagaaaauacuaaca

SEQ ID NO: 2062665 - RNA, 23 nt, Staphylococcus aureus subsp. aureus Mu50
aacuuucagcaccagaacaauuc

SEQ ID NO: 2062666 - RNA, 16 nt, Staphylococcus aureus subsp. aureus Mu50
aacuucugauucuuca

SEQ ID NO: 2062667 - RNA, 18 nt, Staphylococcus aureus subsp. aureus Mu50
aacuucugauucuucacu

SEQ ID NO: 2062668 - RNA, 13 nt, Staphylococcus aureus subsp. aureus Mu50
aacuuuaauacua

SEQ ID NO: 2062669 - RNA, 20 nt, Staphylococcus aureus subsp. aureus Mu50
aacuuuaauauaaguauaau

SEQ ID NO: 2062670 - RNA, 15 nt, Staphylococcus aureus subsp. aureus Mu50
aacuuuaauauaagu

SEQ ID NO: 2062671 - RNA, 16 nt, Staphylococcus aureus subsp. aureus Mu50
aacuuuagacauaaaa

SEQ ID NO: 2062672 - RNA, 16 nt, Staphylococcus aureus subsp. aureus Mu50
aacuuuacgauaaaua

SEQ ID NO: 2062673 - RNA, 23 nt, Staphylococcus aureus subsp. aureus Mu50
aacugugcaugacgauaaugaaa

SEQ ID NO: 2062674 - RNA, 20 nt, Staphylococcus aureus subsp. aureus Mu50
aacugugauauuaauugaaa

SEQ ID NO: 2062675 - RNA, 23 nt, Staphylococcus aureus subsp. aureus Mu50
aacugugauauuaauugaaaaac

SEQ ID NO: 2062676 - RNA, 23 nt, Staphylococcus aureus subsp. aureus Mu50
aacuguaugccgccuaauaauaa

SEQ ID NO: 2062677 - RNA, 23 nt, Staphylococcus aureus subsp. aureus Mu50
aacuguaacgugaggcccauaaa

SEQ ID NO: 2062678 - RNA, 13 nt, Staphylococcus aureus subsp. aureus Mu50
aacuguaaaacau

SEQ ID NO: 2062679 - RNA, 22 nt, Staphylococcus aureus subsp. aureus Mu50
aacugccaaaaugguuaaaauc

SEQ ID NO: 2062680 - RNA, 16 nt, Staphylococcus aureus subsp. aureus Mu50
aacuucauaauauauc

SEQ ID NO: 2062681 - RNA, 22 nt, Staphylococcus aureus subsp. aureus Mu50
aacuguucuaaccauucguaau

SEQ ID NO: 2062682 - RNA, 18 nt, Staphylococcus aureus subsp. aureus Mu50
aacuucuauuaagaaaua

SEQ ID NO: 2062683 - RNA, 17 nt, Staphylococcus aureus subsp. aureus Mu50
aacuuccaacauauaaa

SEQ ID NO: 2062684 - RNA, 21 nt, Staphylococcus aureus subsp. aureus Mu50
aacgaagucagucaauucaaa

SEQ ID NO: 2062685 - RNA, 21 nt, Staphylococcus aureus subsp. aureus Mu50
aacgaaucgccuacuauaaau

SEQ ID NO: 2062686 - RNA, 18 nt, Staphylococcus aureus subsp. aureus Mu50
aacgacacuuuuuaguga

SEQ ID NO: 2062687 - RNA, 15 nt, Staphylococcus aureus subsp. aureus Mu50
aacgacauuguuuag

SEQ ID NO: 2062688 - RNA, 22 nt, Staphylococcus aureus subsp. aureus Mu50
aacgagcuggugagaaauugaa

SEQ ID NO: 2062689 - RNA, 21 nt, Staphylococcus aureus subsp. aureus Mu50
aacgauaacaauuuauuaaaa

SEQ ID NO: 2062690 - RNA, 18 nt, Staphylococcus aureus subsp. aureus Mu50
aacgauaagaauuaacaa

SEQ ID NO: 2062691 - RNA, 18 nt, Staphylococcus aureus subsp. aureus Mu50
aacgcacuaucaaugaca

SEQ ID NO: 2062692 - RNA, 18 nt, Staphylococcus aureus subsp. aureus Mu50
aacgcacuauuuuuauaa

SEQ ID NO: 2062693 - RNA, 17 nt, Staphylococcus aureus subsp. aureus Mu50
aacgauaaauuaacuua

SEQ ID NO: 2062694 - RNA, 18 nt, Staphylococcus aureus subsp. aureus Mu50
aacgauagacauugagau

SEQ ID NO: 2062695 - RNA, 13 nt, Staphylococcus aureus subsp. aureus Mu50
aacgcauuucaug

SEQ ID NO: 2062696 - RNA, 13 nt, Staphylococcus aureus subsp. aureus Mu50
aaccuaaauucca

SEQ ID NO: 2062697 - RNA, 16 nt, Staphylococcus aureus subsp. aureus Mu50
aaccuaaguuaauuua

SEQ ID NO: 2062698 - RNA, 23 nt, Staphylococcus aureus subsp. aureus Mu50
aaccuaaucuaccauguuuugua

SEQ ID NO: 2062699 - RNA, 12 nt, Staphylococcus aureus subsp. aureus Mu50
aaccuacaauau

SEQ ID NO: 2062700 - RNA, 23 nt, Staphylococcus aureus subsp. aureus Mu50
aaccucugauguguuauguuaga

SEQ ID NO: 2062701 - RNA, 18 nt, Staphylococcus aureus subsp. aureus Mu50
aaccucuaaauaaaauua

SEQ ID NO: 2062702 - RNA, 22 nt, Staphylococcus aureus subsp. aureus Mu50
aaccucuguuuuguugguguuu

SEQ ID NO: 2062703 - RNA, 20 nt, Staphylococcus aureus subsp. aureus Mu50
aaccuguucuuuauuuaaag

SEQ ID NO: 2062704 - RNA, 11 nt, Staphylococcus aureus subsp. aureus Mu50
aaccuuuaaaa

SEQ ID NO: 2062705 - RNA, 13 nt, Staphylococcus aureus subsp. aureus Mu50
aaccuuuaaaagu

SEQ ID NO: 2062706 - RNA, 20 nt, Staphylococcus aureus subsp. aureus Mu50
aaccuugauuuaauuuuuaa

SEQ ID NO: 2062707 - RNA, 13 nt, Staphylococcus aureus subsp. aureus Mu50
aaccuugauuuaa

SEQ ID NO: 2062708 - RNA, 16 nt, Staphylococcus aureus subsp. aureus Mu50
aaccuuuucaaauuau

SEQ ID NO: 2062709 - RNA, 17 nt, Staphylococcus aureus subsp. aureus Mu50
aacgaaauuguuaucua

SEQ ID NO: 2062710 - RNA, 22 nt, Staphylococcus aureus subsp. aureus Mu50
aaccagcuuacugcuuuuuuau

SEQ ID NO: 2062711 - RNA, 20 nt, Staphylococcus aureus subsp. aureus Mu50
aaccagcuaaccaaauaauu

SEQ ID NO: 2062712 - RNA, 16 nt, Staphylococcus aureus subsp. aureus Mu50
aaccagcuaaccaaau

SEQ ID NO: 2062713 - RNA, 18 nt, Staphylococcus aureus subsp. aureus Mu50
aaccagcuaaccaaauaa

SEQ ID NO: 2062714 - RNA, 18 nt, Staphylococcus aureus subsp. aureus Mu50
aaccagcuaacaaaagug

SEQ ID NO: 2062715 - RNA, 20 nt, Staphylococcus aureus subsp. aureus Mu50
aacccauuuucaaaacuagc

SEQ ID NO: 2062716 - RNA, 17 nt, Staphylococcus aureus subsp. aureus Mu50
aaccaguucgaaaauua

SEQ ID NO: 2062717 - RNA, 21 nt, Staphylococcus aureus subsp. aureus Mu50
aaccaguucgaaaauuauaca

SEQ ID NO: 2062718 - RNA, 18 nt, Staphylococcus aureus subsp. aureus Mu50
aacccauuuucaaaacua

SEQ ID NO: 2062719 - RNA, 21 nt, Staphylococcus aureus subsp. aureus Mu50
aaccauacucuaacuuaccau

SEQ ID NO: 2062720 - RNA, 21 nt, Staphylococcus aureus subsp. aureus Mu50
aaccauagauaauugcuauaa

SEQ ID NO: 2062721 - RNA, 20 nt, Staphylococcus aureus subsp. aureus Mu50
aacaugcuuggacauauacu

SEQ ID NO: 2062722 - RNA, 19 nt, Staphylococcus aureus subsp. aureus Mu50
aacaucuaaauaguuuuuc

SEQ ID NO: 2062723 - RNA, 14 nt, Staphylococcus aureus subsp. aureus Mu50
aacaucugaaaaaa

SEQ ID NO: 2062724 - RNA, 16 nt, Staphylococcus aureus subsp. aureus Mu50
aacauggucaaucacu

SEQ ID NO: 2062725 - RNA, 16 nt, Staphylococcus aureus subsp. aureus Mu50
aacauuuguccgauuu

SEQ ID NO: 2062726 - RNA, 22 nt, Staphylococcus aureus subsp. aureus Mu50
aacauuuugauacguaaacacu

SEQ ID NO: 2062727 - RNA, 18 nt, Staphylococcus aureus subsp. aureus Mu50
aacauuuuugaauuuaau

SEQ ID NO: 2062728 - RNA, 16 nt, Staphylococcus aureus subsp. aureus Mu50
aacauuuuuagaauca

SEQ ID NO: 2062729 - RNA, 18 nt, Staphylococcus aureus subsp. aureus Mu50
aaccaaaccauaaguaaa

SEQ ID NO: 2062730 - RNA, 19 nt, Staphylococcus aureus subsp. aureus Mu50
aaccaaaagaaauucgcuu

SEQ ID NO: 2062731 - RNA, 18 nt, Staphylococcus aureus subsp. aureus Mu50
aaccaaaaccaaaugaac

SEQ ID NO: 2062732 - RNA, 20 nt, Staphylococcus aureus subsp. aureus Mu50
aacauuuuugugcaaaaguu

SEQ ID NO: 2062733 - RNA, 13 nt, Staphylococcus aureus subsp. aureus Mu50
aacaguuagugcu

SEQ ID NO: 2062734 - RNA, 18 nt, Staphylococcus aureus subsp. aureus Mu50
aacagucccaaccccuuu

SEQ ID NO: 2062735 - RNA, 15 nt, Staphylococcus aureus subsp. aureus Mu50
aacauaacucaaaua

SEQ ID NO: 2062736 - RNA, 19 nt, Staphylococcus aureus subsp. aureus Mu50
aacaguuuuauuaucuuug

SEQ ID NO: 2062737 - RNA, 12 nt, Staphylococcus aureus subsp. aureus Mu50
aacaguuuuaaa

SEQ ID NO: 2062738 - RNA, 18 nt, Staphylococcus aureus subsp. aureus Mu50
aacauauaaaaaauuauu

SEQ ID NO: 2062739 - RNA, 23 nt, Staphylococcus aureus subsp. aureus Mu50
aacauagauacaaaguacaguua

SEQ ID NO: 2062740 - RNA, 18 nt, Staphylococcus aureus subsp. aureus Mu50
aacauagacacuuaacuu

SEQ ID NO: 2062741 - RNA, 19 nt, Staphylococcus aureus subsp. aureus Mu50
aacaucaauuacucuuuuu

SEQ ID NO: 2062742 - RNA, 14 nt, Staphylococcus aureus subsp. aureus Mu50
aacaucacuugcug

SEQ ID NO: 2062743 - RNA, 16 nt, Staphylococcus aureus subsp. aureus Mu50
aacaucauaaucgcca

SEQ ID NO: 2062744 - RNA, 21 nt, Staphylococcus aureus subsp. aureus Mu50
aacaucacuuuaggguucauu

SEQ ID NO: 2062745 - RNA, 23 nt, Staphylococcus aureus subsp. aureus Mu50
aacaagguguucgggaauuuuuu

SEQ ID NO: 2062746 - RNA, 20 nt, Staphylococcus aureus subsp. aureus Mu50
aacagcuuuuucuacaccua

SEQ ID NO: 2062747 - RNA, 15 nt, Staphylococcus aureus subsp. aureus Mu50
aacagcuucaaaauc

SEQ ID NO: 2062748 - RNA, 20 nt, Staphylococcus aureus subsp. aureus Mu50
cgcgacguuuaaaugcccac

SEQ ID NO: 2062749 - RNA, 14 nt, Staphylococcus aureus subsp. aureus Mu50
cgcuucuucuucag

SEQ ID NO: 2062750 - RNA, 15 nt, Staphylococcus aureus subsp. aureus Mu50
cgcuucuucuucaga

SEQ ID NO: 2062751 - RNA, 20 nt, Staphylococcus aureus subsp. aureus Mu50
cgcuucauagucacuuuuaa

SEQ ID NO: 2062752 - RNA, 22 nt, Staphylococcus aureus subsp. aureus Mu50
cgcuuagauaaauuaauaugaa

SEQ ID NO: 2062753 - RNA, 21 nt, Staphylococcus aureus subsp. aureus Mu50
cgcuuagauaaauuaauauga

SEQ ID NO: 2062754 - RNA, 17 nt, Staphylococcus aureus subsp. aureus Mu50
cgcuguuucaagcguuu

SEQ ID NO: 2062755 - RNA, 14 nt, Staphylococcus aureus subsp. aureus Mu50
cgcuuaauucuuca

SEQ ID NO: 2062756 - RNA, 23 nt, Staphylococcus aureus subsp. aureus Mu50
cgcuuaacccuaaagcuaaugca

SEQ ID NO: 2062757 - RNA, 22 nt, Staphylococcus aureus subsp. aureus Mu50
cgcuguaauaccuuuacuuuca

SEQ ID NO: 2062758 - RNA, 14 nt, Staphylococcus aureus subsp. aureus Mu50
cgcugcuacaccac

SEQ ID NO: 2062759 - RNA, 19 nt, Staphylococcus aureus subsp. aureus Mu50
cgcgugccaacaucuucaa

SEQ ID NO: 2062760 - RNA, 22 nt, Staphylococcus aureus subsp. aureus Mu50
cgcuauauguaaagcuaauuuu

SEQ ID NO: 2062761 - RNA, 16 nt, Staphylococcus aureus subsp. aureus Mu50
cgcuccaagauuauga

SEQ ID NO: 2062762 - RNA, 13 nt, Staphylococcus aureus subsp. aureus Mu50
cgcucucuuuuua

SEQ ID NO: 2062763 - RNA, 16 nt, Staphylococcus aureus subsp. aureus Mu50
cgcucuggauuuuucu

SEQ ID NO: 2062764 - RNA, 15 nt, Staphylococcus aureus subsp. aureus Mu50
cgauuguuucaccag

SEQ ID NO: 2062765 - RNA, 14 nt, Staphylococcus aureus subsp. aureus Mu50
cgauuaauuuucuu

SEQ ID NO: 2062766 - RNA, 16 nt, Staphylococcus aureus subsp. aureus Mu50
cgaucuaaauauauua

SEQ ID NO: 2062767 - RNA, 19 nt, Staphylococcus aureus subsp. aureus Mu50
cgaucuuuuuuauuuaauu

SEQ ID NO: 2062768 - RNA, 17 nt, Staphylococcus aureus subsp. aureus Mu50
cgaucuuuaaugauaag

SEQ ID NO: 2062769 - RNA, 18 nt, Staphylococcus aureus subsp. aureus Mu50
cgaucauaaauauuuucu

SEQ ID NO: 2062770 - RNA, 19 nt, Staphylococcus aureus subsp. aureus Mu50
cgauaagauagcuauauuu

SEQ ID NO: 2062771 - RNA, 14 nt, Staphylococcus aureus subsp. aureus Mu50
cgauaaguucaucg

SEQ ID NO: 2062772 - RNA, 13 nt, Staphylococcus aureus subsp. aureus Mu50
cgauaauaacuag

SEQ ID NO: 2062773 - RNA, 14 nt, Staphylococcus aureus subsp. aureus Mu50
cgauaauaauaaga

SEQ ID NO: 2062774 - RNA, 17 nt, Staphylococcus aureus subsp. aureus Mu50
cgauacgacuugaaauc

SEQ ID NO: 2062775 - RNA, 20 nt, Staphylococcus aureus subsp. aureus Mu50
cgauacgacuugaaaucuuu

SEQ ID NO: 2062776 - RNA, 15 nt, Staphylococcus aureus subsp. aureus Mu50
cgauaccuaaaauac

SEQ ID NO: 2062777 - RNA, 14 nt, Staphylococcus aureus subsp. aureus Mu50
cgcaaugaaaacag

SEQ ID NO: 2062778 - RNA, 19 nt, Staphylococcus aureus subsp. aureus Mu50
cgcaaugauaucuuuucca

SEQ ID NO: 2062779 - RNA, 13 nt, Staphylococcus aureus subsp. aureus Mu50
cgcauacaggaaa

SEQ ID NO: 2062780 - RNA, 20 nt, Staphylococcus aureus subsp. aureus Mu50
cgcauaacgagcaguauaua

SEQ ID NO: 2062781 - RNA, 18 nt, Staphylococcus aureus subsp. aureus Mu50
cgccauaaucuucauuaa

SEQ ID NO: 2062782 - RNA, 15 nt, Staphylococcus aureus subsp. aureus Mu50
cgcuuggauuuuuug

SEQ ID NO: 2062783 - RNA, 13 nt, Staphylococcus aureus subsp. aureus Mu50
cggcccauaauag

SEQ ID NO: 2062784 - RNA, 23 nt, Staphylococcus aureus subsp. aureus Mu50
ccaguacuuucgaguaauacuuu

SEQ ID NO: 2062785 - RNA, 18 nt, Staphylococcus aureus subsp. aureus Mu50
ccagucauuguauaaaaa

SEQ ID NO: 2062786 - RNA, 18 nt, Staphylococcus aureus subsp. aureus Mu50
ccauaguaauaaaaugau

SEQ ID NO: 2062787 - RNA, 19 nt, Staphylococcus aureus subsp. aureus Mu50
ccauacuaaaacaugauac

SEQ ID NO: 2062788 - RNA, 19 nt, Staphylococcus aureus subsp. aureus Mu50
ccauacauaugcuauauuu

SEQ ID NO: 2062789 - RNA, 23 nt, Staphylococcus aureus subsp. aureus Mu50
ccauacauaugcuauauuuaguu

SEQ ID NO: 2062790 - RNA, 16 nt, Staphylococcus aureus subsp. aureus Mu50
ccauacccauauuaaa

SEQ ID NO: 2062791 - RNA, 15 nt, Staphylococcus aureus subsp. aureus Mu50
ccaguuuucaauuua

SEQ ID NO: 2062792 - RNA, 20 nt, Staphylococcus aureus subsp. aureus Mu50
ccauugcgcuucgucuuuau

SEQ ID NO: 2062793 - RNA, 14 nt, Staphylococcus aureus subsp. aureus Mu50
ccauucugcagcga

SEQ ID NO: 2062794 - RNA, 16 nt, Staphylococcus aureus subsp. aureus Mu50
ccauuugcaacaauau

SEQ ID NO: 2062795 - RNA, 19 nt, Staphylococcus aureus subsp. aureus Mu50
ccauuacaaugcgcaauga

SEQ ID NO: 2062796 - RNA, 23 nt, Staphylococcus aureus subsp. aureus Mu50
ccauucgaaagccaauuaauaaa

SEQ ID NO: 2062797 - RNA, 19 nt, Staphylococcus aureus subsp. aureus Mu50
ccauguauaucuaauacuu

SEQ ID NO: 2062798 - RNA, 19 nt, Staphylococcus aureus subsp. aureus Mu50
ccaugugccuuugcuuuuu

SEQ ID NO: 2062799 - RNA, 22 nt, Staphylococcus aureus subsp. aureus Mu50
ccaucuuuguaaccuaaaaaca

SEQ ID NO: 2062800 - RNA, 23 nt, Staphylococcus aureus subsp. aureus Mu50
ccaucuuuguaaccuaaaaacaa

SEQ ID NO: 2062801 - RNA, 20 nt, Staphylococcus aureus subsp. aureus Mu50
ccaucuuuuagguaauaauu

SEQ ID NO: 2062802 - RNA, 20 nt, Staphylococcus aureus subsp. aureus Mu50
ccaucguagcgcuuagauaa

SEQ ID NO: 2062803 - RNA, 19 nt, Staphylococcus aureus subsp. aureus Mu50
ccaugcccgauaaaaccac

SEQ ID NO: 2062804 - RNA, 17 nt, Staphylococcus aureus subsp. aureus Mu50
aaacaaugauuaaaauu

SEQ ID NO: 2062805 - RNA, 17 nt, Staphylococcus aureus subsp. aureus Mu50
ccauaugugguggcuau

SEQ ID NO: 2062806 - RNA, 15 nt, Staphylococcus aureus subsp. aureus Mu50
ccaucauuuguguuu

SEQ ID NO: 2062807 - RNA, 22 nt, Staphylococcus aureus subsp. aureus Mu50
cccagcuugaccgccuaugaua

SEQ ID NO: 2062808 - RNA, 17 nt, Staphylococcus aureus subsp. aureus Mu50
aaacaauuacaaaauca

SEQ ID NO: 2062809 - RNA, 12 nt, Staphylococcus aureus subsp. aureus Mu50
cccauaacaccu

SEQ ID NO: 2062810 - RNA, 21 nt, Staphylococcus aureus subsp. aureus Mu50
cccauaacaccuacugauuga

SEQ ID NO: 2062811 - RNA, 13 nt, Staphylococcus aureus subsp. aureus Mu50
aaacaauuuaaaa

SEQ ID NO: 2062812 - RNA, 20 nt, Staphylococcus aureus subsp. aureus Mu50
aaacacagacguuuuugaau

SEQ ID NO: 2062813 - RNA, 18 nt, Staphylococcus aureus subsp. aureus Mu50
aaacacaguacaaauaac

SEQ ID NO: 2062814 - RNA, 11 nt, Staphylococcus aureus subsp. aureus Mu50
ccccaacacag

SEQ ID NO: 2062815 - RNA, 19 nt, Staphylococcus aureus subsp. aureus Mu50
cccauuuuuaaaauuauga

SEQ ID NO: 2062816 - RNA, 16 nt, Staphylococcus aureus subsp. aureus Mu50
ccccaacacagagaau

SEQ ID NO: 2062817 - RNA, 23 nt, Staphylococcus aureus subsp. aureus Mu50
ccccaacacugagaauuucuaau

SEQ ID NO: 2062818 - RNA, 21 nt, Staphylococcus aureus subsp. aureus Mu50
cccaucuuuuagguaauaauu

SEQ ID NO: 2062819 - RNA, 21 nt, Staphylococcus aureus subsp. aureus Mu50
cccuccuggugcugcaccaag

SEQ ID NO: 2062820 - RNA, 15 nt, Staphylococcus aureus subsp. aureus Mu50
cccuaaagcuaaugc

SEQ ID NO: 2062821 - RNA, 19 nt, Staphylococcus aureus subsp. aureus Mu50
cccuagguuuauauaucac

SEQ ID NO: 2062822 - RNA, 21 nt, Staphylococcus aureus subsp. aureus Mu50
cccuacugcaccgauaucaua

SEQ ID NO: 2062823 - RNA, 23 nt, Staphylococcus aureus subsp. aureus Mu50
cccuagcaaaaauacuuuuugau

SEQ ID NO: 2062824 - RNA, 23 nt, Staphylococcus aureus subsp. aureus Mu50
aaacauuuauauagauugccauu

SEQ ID NO: 2062825 - RNA, 21 nt, Staphylococcus aureus subsp. aureus Mu50
aaacauucccuuaauaauaag

SEQ ID NO: 2062826 - RNA, 21 nt, Staphylococcus aureus subsp. aureus Mu50
ccgacuuuugauuuugaauaa

SEQ ID NO: 2062827 - RNA, 20 nt, Staphylococcus aureus subsp. aureus Mu50
ccgacuugauaaaaaaugaa

SEQ ID NO: 2062828 - RNA, 21 nt, Staphylococcus aureus subsp. aureus Mu50
aaacaucauuucugaaguuau

SEQ ID NO: 2062829 - RNA, 15 nt, Staphylococcus aureus subsp. aureus Mu50
aaacauaaugacauc

SEQ ID NO: 2062830 - RNA, 21 nt, Staphylococcus aureus subsp. aureus Mu50
ccgaaaauugcuaaaaaaauu

SEQ ID NO: 2062831 - RNA, 16 nt, Staphylococcus aureus subsp. aureus Mu50
ccgaaaauagacugac

SEQ ID NO: 2062832 - RNA, 14 nt, Staphylococcus aureus subsp. aureus Mu50
ccgaauaauuuuga

SEQ ID NO: 2062833 - RNA, 23 nt, Staphylococcus aureus subsp. aureus Mu50
aaacauuaaucuauauaaaaacu

SEQ ID NO: 2062834 - RNA, 16 nt, Staphylococcus aureus subsp. aureus Mu50
aaacauuaaaauaauu

SEQ ID NO: 2062835 - RNA, 18 nt, Staphylococcus aureus subsp. aureus Mu50
aaacauuaaaauaauuaa

SEQ ID NO: 2062836 - RNA, 21 nt, Staphylococcus aureus subsp. aureus Mu50
aaacauguacaauuuuuaaaa

SEQ ID NO: 2062837 - RNA, 15 nt, Staphylococcus aureus subsp. aureus Mu50
ccgaagcgcagugac

SEQ ID NO: 2062838 - RNA, 19 nt, Staphylococcus aureus subsp. aureus Mu50
cccuuuuugucucucaaca

SEQ ID NO: 2062839 - RNA, 13 nt, Staphylococcus aureus subsp. aureus Mu50
cccuguaaaacca

SEQ ID NO: 2062840 - RNA, 14 nt, Staphylococcus aureus subsp. aureus Mu50
aaacagcaaauaaa

SEQ ID NO: 2062841 - RNA, 17 nt, Staphylococcus aureus subsp. aureus Mu50
aaacagcaguaagauau

SEQ ID NO: 2062842 - RNA, 15 nt, Staphylococcus aureus subsp. aureus Mu50
ccgcacuucuauauu

SEQ ID NO: 2062843 - RNA, 18 nt, Staphylococcus aureus subsp. aureus Mu50
ccgcacuucuauauuaau

SEQ ID NO: 2062844 - RNA, 14 nt, Staphylococcus aureus subsp. aureus Mu50
ccgcagaccacauc

SEQ ID NO: 2062845 - RNA, 16 nt, Staphylococcus aureus subsp. aureus Mu50
ccgauuuugauauaaa

SEQ ID NO: 2062846 - RNA, 20 nt, Staphylococcus aureus subsp. aureus Mu50
ccgccaacuaauguuaaaau

SEQ ID NO: 2062847 - RNA, 14 nt, Staphylococcus aureus subsp. aureus Mu50
ccgccuaauaauaa

SEQ ID NO: 2062848 - RNA, 17 nt, Staphylococcus aureus subsp. aureus Mu50
aaacgacauuguuuagu

SEQ ID NO: 2062849 - RNA, 21 nt, Staphylococcus aureus subsp. aureus Mu50
aaacgauaagaauuaacaaca

SEQ ID NO: 2062850 - RNA, 15 nt, Staphylococcus aureus subsp. aureus Mu50
aaacgauaauaauaa

SEQ ID NO: 2062851 - RNA, 13 nt, Staphylococcus aureus subsp. aureus Mu50
aaacgauacugcu

SEQ ID NO: 2062852 - RNA, 20 nt, Staphylococcus aureus subsp. aureus Mu50
ccgucgaauauaauuuuuug

SEQ ID NO: 2062853 - RNA, 22 nt, Staphylococcus aureus subsp. aureus Mu50
ccguuuuuuauaaaucauucuu

SEQ ID NO: 2062854 - RNA, 15 nt, Staphylococcus aureus subsp. aureus Mu50
ccuaaacgaucaacu

SEQ ID NO: 2062855 - RNA, 21 nt, Staphylococcus aureus subsp. aureus Mu50
ccuaaaccucuaaauaaaauu

SEQ ID NO: 2062856 - RNA, 17 nt, Staphylococcus aureus subsp. aureus Mu50
ccguuuuucaucaaucc

SEQ ID NO: 2062857 - RNA, 21 nt, Staphylococcus aureus subsp. aureus Mu50
ccguuugaagucuguuuagaa

SEQ ID NO: 2062858 - RNA, 12 nt, Staphylococcus aureus subsp. aureus Mu50
ccuaaccuguuu

SEQ ID NO: 2062859 - RNA, 21 nt, Staphylococcus aureus subsp. aureus Mu50
ccuaaagguaacuuuuuaacu

SEQ ID NO: 2062860 - RNA, 19 nt, Staphylococcus aureus subsp. aureus Mu50
ccuaaagguaacuuuuuaa

SEQ ID NO: 2062861 - RNA, 12 nt, Staphylococcus aureus subsp. aureus Mu50
ccuaaaucuccu

SEQ ID NO: 2062862 - RNA, 14 nt, Staphylococcus aureus subsp. aureus Mu50
ccuaaaugauuaau

SEQ ID NO: 2062863 - RNA, 21 nt, Staphylococcus aureus subsp. aureus Mu50
ccuaauacacuugauaaaacu

SEQ ID NO: 2062864 - RNA, 18 nt, Staphylococcus aureus subsp. aureus Mu50
ccuaaguuaauuuaucgu

SEQ ID NO: 2062865 - RNA, 21 nt, Staphylococcus aureus subsp. aureus Mu50
ccguguuuugauuuauuaucu

SEQ ID NO: 2062866 - RNA, 13 nt, Staphylococcus aureus subsp. aureus Mu50
ccguuauuuuuuu

SEQ ID NO: 2062867 - RNA, 12 nt, Staphylococcus aureus subsp. aureus Mu50
ccguuauuuuca

SEQ ID NO: 2062868 - RNA, 18 nt, Staphylococcus aureus subsp. aureus Mu50
ccuccuggugcugcacca

SEQ ID NO: 2062869 - RNA, 18 nt, Staphylococcus aureus subsp. aureus Mu50
ccucaauuaguucuggca

SEQ ID NO: 2062870 - RNA, 18 nt, Staphylococcus aureus subsp. aureus Mu50
ccuauuuguggaaauaaa

SEQ ID NO: 2062871 - RNA, 20 nt, Staphylococcus aureus subsp. aureus Mu50
ccuauuuguggaaauaaaac

SEQ ID NO: 2062872 - RNA, 13 nt, Staphylococcus aureus subsp. aureus Mu50
ccuauauguaggg

SEQ ID NO: 2062873 - RNA, 17 nt, Staphylococcus aureus subsp. aureus Mu50
ccuaggaaauaaaaaau

SEQ ID NO: 2062874 - RNA, 21 nt, Staphylococcus aureus subsp. aureus Mu50
ccuaggaaauaaaaaauaacc

SEQ ID NO: 2062875 - RNA, 16 nt, Staphylococcus aureus subsp. aureus Mu50
ccuagguuuauauauc

SEQ ID NO: 2062876 - RNA, 18 nt, Staphylococcus aureus subsp. aureus Mu50
ccuagguuuauauaucac

SEQ ID NO: 2062877 - RNA, 14 nt, Staphylococcus aureus subsp. aureus Mu50
ccuauaagucucuu

SEQ ID NO: 2062878 - RNA, 16 nt, Staphylococcus aureus subsp. aureus Mu50
ccuacguguguaguag

SEQ ID NO: 2062879 - RNA, 21 nt, Staphylococcus aureus subsp. aureus Mu50
ccuagcaaaaauacuuuuuga

SEQ ID NO: 2062880 - RNA, 16 nt, Staphylococcus aureus subsp. aureus Mu50
ccuagcaaaaauacuu

SEQ ID NO: 2062881 - RNA, 15 nt, Staphylococcus aureus subsp. aureus Mu50
ccuagauaccaaacu

SEQ ID NO: 2062882 - RNA, 12 nt, Staphylococcus aureus subsp. aureus Mu50
ccuacugcuguc

SEQ ID NO: 2062883 - RNA, 16 nt, Staphylococcus aureus subsp. aureus Mu50
ccuaauuauauuaaug

SEQ ID NO: 2062884 - RNA, 20 nt, Staphylococcus aureus subsp. aureus Mu50
ccuaauggucgugcuugcgg

SEQ ID NO: 2062885 - RNA, 14 nt, Staphylococcus aureus subsp. aureus Mu50
ccuaauauuuuaaa

SEQ ID NO: 2062886 - RNA, 17 nt, Staphylococcus aureus subsp. aureus Mu50
ccuaaucuaccauguuu

SEQ ID NO: 2062887 - RNA, 14 nt, Staphylococcus aureus subsp. aureus Mu50
ccuacaacaccaau

SEQ ID NO: 2062888 - RNA, 18 nt, Staphylococcus aureus subsp. aureus Mu50
ccuacaaauauguaauca

SEQ ID NO: 2062889 - RNA, 19 nt, Staphylococcus aureus subsp. aureus Mu50
ccuacaacaccaauugaaa

SEQ ID NO: 2062890 - RNA, 20 nt, Staphylococcus aureus subsp. aureus Mu50
ccuacaacaccaauugaaau

SEQ ID NO: 2062891 - RNA, 23 nt, Staphylococcus aureus subsp. aureus Mu50
aaaccgugagggacgucaucaug

SEQ ID NO: 2062892 - RNA, 17 nt, Staphylococcus aureus subsp. aureus Mu50
aaaccuaaugcuuuaau

SEQ ID NO: 2062893 - RNA, 20 nt, Staphylococcus aureus subsp. aureus Mu50
cgacaauuauaauaaaacuu

SEQ ID NO: 2062894 - RNA, 18 nt, Staphylococcus aureus subsp. aureus Mu50
cgacaaaacuuguaauca

SEQ ID NO: 2062895 - RNA, 15 nt, Staphylococcus aureus subsp. aureus Mu50
cgaauuucauaguua

SEQ ID NO: 2062896 - RNA, 17 nt, Staphylococcus aureus subsp. aureus Mu50
cgaauucuccguuaauu

SEQ ID NO: 2062897 - RNA, 20 nt, Staphylococcus aureus subsp. aureus Mu50
cgacaucuagaugaaauugu

SEQ ID NO: 2062898 - RNA, 10 nt, Staphylococcus aureus subsp. aureus Mu50
cgacaucuag

SEQ ID NO: 2062899 - RNA, 15 nt, Staphylococcus aureus subsp. aureus Mu50
cgacaggggcuuaac

SEQ ID NO: 2062900 - RNA, 14 nt, Staphylococcus aureus subsp. aureus Mu50
cgaauucauuaacg

SEQ ID NO: 2062901 - RNA, 15 nt, Staphylococcus aureus subsp. aureus Mu50
cgaauuaaaauaacu

SEQ ID NO: 2062902 - RNA, 14 nt, Staphylococcus aureus subsp. aureus Mu50
cgaauuaaaauaac

SEQ ID NO: 2062903 - RNA, 18 nt, Staphylococcus aureus subsp. aureus Mu50
cgaauuaagaaaaguuac

SEQ ID NO: 2062904 - RNA, 22 nt, Staphylococcus aureus subsp. aureus Mu50
cgaauguuccuuguuuuaaacu

SEQ ID NO: 2062905 - RNA, 17 nt, Staphylococcus aureus subsp. aureus Mu50
cgaauaucuuaaagaau

SEQ ID NO: 2062906 - RNA, 16 nt, Staphylococcus aureus subsp. aureus Mu50
cgaauaacuguuuauc

SEQ ID NO: 2062907 - RNA, 20 nt, Staphylococcus aureus subsp. aureus Mu50
cgaauaacguuggaaacuuc

SEQ ID NO: 2062908 - RNA, 16 nt, Staphylococcus aureus subsp. aureus Mu50
cgaagaaacauuauau

SEQ ID NO: 2062909 - RNA, 21 nt, Staphylococcus aureus subsp. aureus Mu50
cgaccagucgcauauuuugau

SEQ ID NO: 2062910 - RNA, 23 nt, Staphylococcus aureus subsp. aureus Mu50
cgacgguauaaaaaaauuaacua

SEQ ID NO: 2062911 - RNA, 15 nt, Staphylococcus aureus subsp. aureus Mu50
ccuugcuaucaaacu

SEQ ID NO: 2062912 - RNA, 21 nt, Staphylococcus aureus subsp. aureus Mu50
ccuugaccuacuuuuucaaua

SEQ ID NO: 2062913 - RNA, 16 nt, Staphylococcus aureus subsp. aureus Mu50
ccuugaaugauauuaa

SEQ ID NO: 2062914 - RNA, 21 nt, Staphylococcus aureus subsp. aureus Mu50
ccuuguuuaaguuuuucaggg

SEQ ID NO: 2062915 - RNA, 18 nt, Staphylococcus aureus subsp. aureus Mu50
ccuuguuggcuuuuuuaa

SEQ ID NO: 2062916 - RNA, 20 nt, Staphylococcus aureus subsp. aureus Mu50
ccuuuauuuugauagacuaa

SEQ ID NO: 2062917 - RNA, 14 nt, Staphylococcus aureus subsp. aureus Mu50
ccuuuauuuuuaug

SEQ ID NO: 2062918 - RNA, 18 nt, Staphylococcus aureus subsp. aureus Mu50
ccuuuauauuuaguuagc

SEQ ID NO: 2062919 - RNA, 19 nt, Staphylococcus aureus subsp. aureus Mu50
ccuuuaugugcaucauuua

SEQ ID NO: 2062920 - RNA, 19 nt, Staphylococcus aureus subsp. aureus Mu50
ccuuuaauuguuaaaucac

SEQ ID NO: 2062921 - RNA, 20 nt, Staphylococcus aureus subsp. aureus Mu50
ccuuuaauuguuaaaucacc

SEQ ID NO: 2062922 - RNA, 18 nt, Staphylococcus aureus subsp. aureus Mu50
ccuuuaauuacacuacgc

SEQ ID NO: 2062923 - RNA, 18 nt, Staphylococcus aureus subsp. aureus Mu50
ccuuuaaaacaucauuca

SEQ ID NO: 2062924 - RNA, 20 nt, Staphylococcus aureus subsp. aureus Mu50
ccuuuaaaucuacuuuguuc

SEQ ID NO: 2062925 - RNA, 13 nt, Staphylococcus aureus subsp. aureus Mu50
ccuuuaauaauau

SEQ ID NO: 2062926 - RNA, 17 nt, Staphylococcus aureus subsp. aureus Mu50
ccuuuaauaauauugaa

SEQ ID NO: 2062927 - RNA, 17 nt, Staphylococcus aureus subsp. aureus Mu50
ccuuugcuuaaaccuua

SEQ ID NO: 2062928 - RNA, 22 nt, Staphylococcus aureus subsp. aureus Mu50
ccuuuugauguuuaugacaaag

SEQ ID NO: 2062929 - RNA, 14 nt, Staphylococcus aureus subsp. aureus Mu50
ccuuuugaauaauu

SEQ ID NO: 2062930 - RNA, 21 nt, Staphylococcus aureus subsp. aureus Mu50
ccuucuguacguuuuaaauaa

SEQ ID NO: 2062931 - RNA, 17 nt, Staphylococcus aureus subsp. aureus Mu50
ccuucuugagcaucacu

SEQ ID NO: 2062932 - RNA, 17 nt, Staphylococcus aureus subsp. aureus Mu50
ccuucuuugaaaucaau

SEQ ID NO: 2062933 - RNA, 18 nt, Staphylococcus aureus subsp. aureus Mu50
ccuucuuugaaaucaaug

SEQ ID NO: 2062934 - RNA, 15 nt, Staphylococcus aureus subsp. aureus Mu50
ccuuaauaucaugca

SEQ ID NO: 2062935 - RNA, 15 nt, Staphylococcus aureus subsp. aureus Mu50
ccuguacauccacuu

SEQ ID NO: 2062936 - RNA, 18 nt, Staphylococcus aureus subsp. aureus Mu50
ccuucaauguucaauuca

SEQ ID NO: 2062937 - RNA, 16 nt, Staphylococcus aureus subsp. aureus Mu50
ccuggaauauuaacac

SEQ ID NO: 2062938 - RNA, 14 nt, Staphylococcus aureus subsp. aureus Mu50
ccuggaauauuaac

SEQ ID NO: 2062939 - RNA, 22 nt, Staphylococcus aureus subsp. aureus Mu50
cauucuuccaacacccauauaa

SEQ ID NO: 2062940 - RNA, 19 nt, Staphylococcus aureus subsp. aureus Mu50
cauucuugaauaaauuuua

SEQ ID NO: 2062941 - RNA, 18 nt, Staphylococcus aureus subsp. aureus Mu50
cauucuguguaaauauaa

SEQ ID NO: 2062942 - RNA, 20 nt, Staphylococcus aureus subsp. aureus Mu50
cauucuguguaaauauaaau

SEQ ID NO: 2062943 - RNA, 20 nt, Staphylococcus aureus subsp. aureus Mu50
cauucuuuaauauaaauuuu

SEQ ID NO: 2062944 - RNA, 21 nt, Staphylococcus aureus subsp. aureus Mu50
cauugaaaucgucuuacugcu

SEQ ID NO: 2062945 - RNA, 19 nt, Staphylococcus aureus subsp. aureus Mu50
cauugaaaggaacauuuca

SEQ ID NO: 2062946 - RNA, 18 nt, Staphylococcus aureus subsp. aureus Mu50
cauugaccaccuuuaucu

SEQ ID NO: 2062947 - RNA, 22 nt, Staphylococcus aureus subsp. aureus Mu50
cauugaccaccuuuaucuguaa

SEQ ID NO: 2062948 - RNA, 21 nt, Staphylococcus aureus subsp. aureus Mu50
cauugacacacccaaauuuag

SEQ ID NO: 2062949 - RNA, 21 nt, Staphylococcus aureus subsp. aureus Mu50
cauugagauuaucuuuagaca

SEQ ID NO: 2062950 - RNA, 14 nt, Staphylococcus aureus subsp. aureus Mu50
cauucaucgucuca

SEQ ID NO: 2062951 - RNA, 13 nt, Staphylococcus aureus subsp. aureus Mu50
cauuccaaaaauu

SEQ ID NO: 2062952 - RNA, 24 nt, Staphylococcus aureus subsp. aureus Mu50
cauucaauguuuaauuuucuaaau

SEQ ID NO: 2062953 - RNA, 15 nt, Staphylococcus aureus subsp. aureus Mu50
cauuauguucuucac

SEQ ID NO: 2062954 - RNA, 17 nt, Staphylococcus aureus subsp. aureus Mu50
cauuauuaagugaguuu

SEQ ID NO: 2062955 - RNA, 13 nt, Staphylococcus aureus subsp. aureus Mu50
cauuaauuuuuca

SEQ ID NO: 2062956 - RNA, 21 nt, Staphylococcus aureus subsp. aureus Mu50
cauuaaucuauauaaaaacug

SEQ ID NO: 2062957 - RNA, 21 nt, Staphylococcus aureus subsp. aureus Mu50
cauuaauuggauuaaauacgc

SEQ ID NO: 2062958 - RNA, 20 nt, Staphylococcus aureus subsp. aureus Mu50
cauuauaugguucguccauu

SEQ ID NO: 2062959 - RNA, 15 nt, Staphylococcus aureus subsp. aureus Mu50
cauuaucaagaacuu

SEQ ID NO: 2062960 - RNA, 13 nt, Staphylococcus aureus subsp. aureus Mu50
cauuaaauugcuu

SEQ ID NO: 2062961 - RNA, 14 nt, Staphylococcus aureus subsp. aureus Mu50
cauuaaauguacau

SEQ ID NO: 2062962 - RNA, 17 nt, Staphylococcus aureus subsp. aureus Mu50
cauuaaaaacgauucau

SEQ ID NO: 2062963 - RNA, 22 nt, Staphylococcus aureus subsp. aureus Mu50
cauuaaaaggaugugacaaaua

SEQ ID NO: 2062964 - RNA, 18 nt, Staphylococcus aureus subsp. aureus Mu50
cauuaaaaauaaaagcaa

SEQ ID NO: 2062965 - RNA, 23 nt, Staphylococcus aureus subsp. aureus Mu50
cauuaaaaggaugugacaaauac

SEQ ID NO: 2062966 - RNA, 20 nt, Staphylococcus aureus subsp. aureus Mu50
cauuaaauauuauuuugcaa

SEQ ID NO: 2062967 - RNA, 19 nt, Staphylococcus aureus subsp. aureus Mu50
cauuaaaauguguuuucaa

SEQ ID NO: 2062968 - RNA, 13 nt, Staphylococcus aureus subsp. aureus Mu50
cauuaaaaugaua

SEQ ID NO: 2062969 - RNA, 18 nt, Staphylococcus aureus subsp. aureus Mu50
cauguugauaaaaaggau

SEQ ID NO: 2062970 - RNA, 18 nt, Staphylococcus aureus subsp. aureus Mu50
cauguucuuauaaaaaac

SEQ ID NO: 2062971 - RNA, 16 nt, Staphylococcus aureus subsp. aureus Mu50
cauguuggcaauuguu

SEQ ID NO: 2062972 - RNA, 20 nt, Staphylococcus aureus subsp. aureus Mu50
cauguuugauucuaaauaau

SEQ ID NO: 2062973 - RNA, 15 nt, Staphylococcus aureus subsp. aureus Mu50
cauguuuuuuaagua

SEQ ID NO: 2062974 - RNA, 21 nt, Staphylococcus aureus subsp. aureus Mu50
cauguuuggaugaacaaaaua

SEQ ID NO: 2062975 - RNA, 19 nt, Staphylococcus aureus subsp. aureus Mu50
cauguauauggcaucauca

SEQ ID NO: 2062976 - RNA, 14 nt, Staphylococcus aureus subsp. aureus Mu50
caugucaauuuuuu

SEQ ID NO: 2062977 - RNA, 20 nt, Staphylococcus aureus subsp. aureus Mu50
cauguauucuuagauauuau

SEQ ID NO: 2062978 - RNA, 15 nt, Staphylococcus aureus subsp. aureus Mu50
cauguauuggccaaa

SEQ ID NO: 2062979 - RNA, 12 nt, Staphylococcus aureus subsp. aureus Mu50
cauguucauaau

SEQ ID NO: 2062980 - RNA, 14 nt, Staphylococcus aureus subsp. aureus Mu50
cauguucauaauau

SEQ ID NO: 2062981 - RNA, 15 nt, Staphylococcus aureus subsp. aureus Mu50
cauguucauaauaua

SEQ ID NO: 2062982 - RNA, 16 nt, Staphylococcus aureus subsp. aureus Mu50
cauguucauaauauaa

SEQ ID NO: 2062983 - RNA, 21 nt, Staphylococcus aureus subsp. aureus Mu50
caugucaauuuuuucaugauu

SEQ ID NO: 2062984 - RNA, 22 nt, Staphylococcus aureus subsp. aureus Mu50
cauguaacaaaauacccugcuu

SEQ ID NO: 2062985 - RNA, 20 nt, Staphylococcus aureus subsp. aureus Mu50
cauguaaauaguuaguuuau

SEQ ID NO: 2062986 - RNA, 15 nt, Staphylococcus aureus subsp. aureus Mu50
cauguaacaaaauac

SEQ ID NO: 2062987 - RNA, 20 nt, Staphylococcus aureus subsp. aureus Mu50
caugaugauaaauugaguuu

SEQ ID NO: 2062988 - RNA, 14 nt, Staphylococcus aureus subsp. aureus Mu50
caugauucaugaua

SEQ ID NO: 2062989 - RNA, 17 nt, Staphylococcus aureus subsp. aureus Mu50
caugauucaugauaugu

SEQ ID NO: 2062990 - RNA, 17 nt, Staphylococcus aureus subsp. aureus Mu50
caugauacugaaauuuc

SEQ ID NO: 2062991 - RNA, 12 nt, Staphylococcus aureus subsp. aureus Mu50
caugaugauaaa

SEQ ID NO: 2062992 - RNA, 12 nt, Staphylococcus aureus subsp. aureus Mu50
caugauuuacua

SEQ ID NO: 2062993 - RNA, 14 nt, Staphylococcus aureus subsp. aureus Mu50
caugauuucuucuc

SEQ ID NO: 2062994 - RNA, 23 nt, Staphylococcus aureus subsp. aureus Mu50
caugcgcaaaagcgcaggcgaac

SEQ ID NO: 2062995 - RNA, 18 nt, Staphylococcus aureus subsp. aureus Mu50
caugccuuaugucauaua

SEQ ID NO: 2062996 - RNA, 23 nt, Staphylococcus aureus subsp. aureus Mu50
caugacgaacgauagauucugau

SEQ ID NO: 2062997 - RNA, 21 nt, Staphylococcus aureus subsp. aureus Mu50
caugagaaugccguaacccau

SEQ ID NO: 2062998 - RNA, 20 nt, Staphylococcus aureus subsp. aureus Mu50
caugacauaaaacuuacauu

SEQ ID NO: 2062999 - RNA, 15 nt, Staphylococcus aureus subsp. aureus Mu50
caugacauucauuua

SEQ ID NO: 2063000 - RNA, 23 nt, Staphylococcus aureus subsp. aureus Mu50
caugaaugucagucguuguaaaa

SEQ ID NO: 2063001 - RNA, 21 nt, Staphylococcus aureus subsp. aureus Mu50
caugaaucgcauuuaaauaua

SEQ ID NO: 2063002 - RNA, 15 nt, Staphylococcus aureus subsp. aureus Mu50
caugaauaaauacaa

SEQ ID NO: 2063003 - RNA, 14 nt, Staphylococcus aureus subsp. aureus Mu50
caucuuuuauggug

SEQ ID NO: 2063004 - RNA, 17 nt, Staphylococcus aureus subsp. aureus Mu50
caucuuuugguuuaucu

SEQ ID NO: 2063005 - RNA, 19 nt, Staphylococcus aureus subsp. aureus Mu50
caucuuuugguuuaucugu

SEQ ID NO: 2063006 - RNA, 13 nt, Staphylococcus aureus subsp. aureus Mu50
caucuuuuuaaaa

SEQ ID NO: 2063007 - RNA, 18 nt, Staphylococcus aureus subsp. aureus Mu50
caucguuaucuuuaagua

SEQ ID NO: 2063008 - RNA, 23 nt, Staphylococcus aureus subsp. aureus Mu50
caucuucuggauagguaucacua

SEQ ID NO: 2063009 - RNA, 15 nt, Staphylococcus aureus subsp. aureus Mu50
caucuucuucaaaac

SEQ ID NO: 2063010 - RNA, 14 nt, Staphylococcus aureus subsp. aureus Mu50
caucuuuauuuaca

SEQ ID NO: 2063011 - RNA, 18 nt, Staphylococcus aureus subsp. aureus Mu50
caucuuuaagcuuaaaua

SEQ ID NO: 2063012 - RNA, 13 nt, Staphylococcus aureus subsp. aureus Mu50
caucaugcauaau

SEQ ID NO: 2063013 - RNA, 15 nt, Staphylococcus aureus subsp. aureus Mu50
caucaugacuauuuc

SEQ ID NO: 2063014 - RNA, 17 nt, Staphylococcus aureus subsp. aureus Mu50
caucauuuguguuuuua

SEQ ID NO: 2063015 - RNA, 17 nt, Staphylococcus aureus subsp. aureus Mu50
caucauuuucaauacuu

SEQ ID NO: 2063016 - RNA, 20 nt, Staphylococcus aureus subsp. aureus Mu50
caucauuuguguaaaugaau

SEQ ID NO: 2063017 - RNA, 21 nt, Staphylococcus aureus subsp. aureus Mu50
caucauuuguguaaaugaauu

SEQ ID NO: 2063018 - RNA, 15 nt, Staphylococcus aureus subsp. aureus Mu50
caucauuucugaagu

SEQ ID NO: 2063019 - RNA, 18 nt, Staphylococcus aureus subsp. aureus Mu50
caucauuucugaaguuau

SEQ ID NO: 2063020 - RNA, 21 nt, Staphylococcus aureus subsp. aureus Mu50
caucauuuaauugaugucaca

SEQ ID NO: 2063021 - RNA, 18 nt, Staphylococcus aureus subsp. aureus Mu50
caucaugugcuuuguuua

SEQ ID NO: 2063022 - RNA, 14 nt, Staphylococcus aureus subsp. aureus Mu50
caucauguuuaucu

SEQ ID NO: 2063023 - RNA, 15 nt, Staphylococcus aureus subsp. aureus Mu50
caucauuaaauauuu

SEQ ID NO: 2063024 - RNA, 19 nt, Staphylococcus aureus subsp. aureus Mu50
cauccauaaaaauacgaca

SEQ ID NO: 2063025 - RNA, 21 nt, Staphylococcus aureus subsp. aureus Mu50
cauccauauaugccgauugcu

SEQ ID NO: 2063026 - RNA, 16 nt, Staphylococcus aureus subsp. aureus Mu50
caucgaacaugaauga

SEQ ID NO: 2063027 - RNA, 18 nt, Staphylococcus aureus subsp. aureus Mu50
caucaauaaauauugauu

SEQ ID NO: 2063028 - RNA, 19 nt, Staphylococcus aureus subsp. aureus Mu50
caucacuguagauucaaau

SEQ ID NO: 2063029 - RNA, 20 nt, Staphylococcus aureus subsp. aureus Mu50
caucacuugcuguugcaaua

SEQ ID NO: 2063030 - RNA, 13 nt, Staphylococcus aureus subsp. aureus Mu50
caucacuugcugu

SEQ ID NO: 2063031 - RNA, 21 nt, Staphylococcus aureus subsp. aureus Mu50
cauaucggcccauaauagcua

SEQ ID NO: 2063032 - RNA, 20 nt, Staphylococcus aureus subsp. aureus Mu50
cauauauuuuguuaauaagc

SEQ ID NO: 2063033 - RNA, 22 nt, Staphylococcus aureus subsp. aureus Mu50
caucaaguauaaauguuauugc

SEQ ID NO: 2063034 - RNA, 19 nt, Staphylococcus aureus subsp. aureus Mu50
caucaaauagacaccaaaa

SEQ ID NO: 2063035 - RNA, 11 nt, Staphylococcus aureus subsp. aureus Mu50
cauauuuugau

SEQ ID NO: 2063036 - RNA, 16 nt, Staphylococcus aureus subsp. aureus Mu50
cauagcucuucuuuuu

SEQ ID NO: 2063037 - RNA, 16 nt, Staphylococcus aureus subsp. aureus Mu50
cauagcauuaagauga

SEQ ID NO: 2063038 - RNA, 22 nt, Staphylococcus aureus subsp. aureus Mu50
cauagcauuaagaugauugucu

SEQ ID NO: 2063039 - RNA, 13 nt, Staphylococcus aureus subsp. aureus Mu50
cauauaaauguug

SEQ ID NO: 2063040 - RNA, 22 nt, Staphylococcus aureus subsp. aureus Mu50
cauauaaaucaaauauacuuuu

SEQ ID NO: 2063041 - RNA, 17 nt, Staphylococcus aureus subsp. aureus Mu50
cauauaaauauuuuuaa

SEQ ID NO: 2063042 - RNA, 23 nt, Staphylococcus aureus subsp. aureus Mu50
cauauaaauauuuuuaauuauuu

SEQ ID NO: 2063043 - RNA, 19 nt, Staphylococcus aureus subsp. aureus Mu50
cauauaaagcugcgauaua

SEQ ID NO: 2063044 - RNA, 17 nt, Staphylococcus aureus subsp. aureus Mu50
cauauaaaaaauuauua

SEQ ID NO: 2063045 - RNA, 21 nt, Staphylococcus aureus subsp. aureus Mu50
cauauaagccccaccaugauu

SEQ ID NO: 2063046 - RNA, 18 nt, Staphylococcus aureus subsp. aureus Mu50
cauauaugauaaauauug

SEQ ID NO: 2063047 - RNA, 14 nt, Staphylococcus aureus subsp. aureus Mu50
cauauaucaacaug

SEQ ID NO: 2063048 - RNA, 13 nt, Staphylococcus aureus subsp. aureus Mu50
cauagguaaccuu

SEQ ID NO: 2063049 - RNA, 15 nt, Staphylococcus aureus subsp. aureus Mu50
cauaggcgcuuuuuu

SEQ ID NO: 2063050 - RNA, 12 nt, Staphylococcus aureus subsp. aureus Mu50
cauagaaauuuu

SEQ ID NO: 2063051 - RNA, 14 nt, Staphylococcus aureus subsp. aureus Mu50
cauagauacaaagu

SEQ ID NO: 2063052 - RNA, 13 nt, Staphylococcus aureus subsp. aureus Mu50
cauagauuauauu

SEQ ID NO: 2063053 - RNA, 17 nt, Staphylococcus aureus subsp. aureus Mu50
cauagaugcauaaaaac

SEQ ID NO: 2063054 - RNA, 22 nt, Staphylococcus aureus subsp. aureus Mu50
cauacuugucguauucuucaau

SEQ ID NO: 2063055 - RNA, 22 nt, Staphylococcus aureus subsp. aureus Mu50
cauacuuuuagcaacaguauuu

SEQ ID NO: 2063056 - RNA, 13 nt, Staphylococcus aureus subsp. aureus Mu50
cauacuucaauaa

SEQ ID NO: 2063057 - RNA, 17 nt, Staphylococcus aureus subsp. aureus Mu50
cauacuucuauuuuaua

SEQ ID NO: 2063058 - RNA, 16 nt, Staphylococcus aureus subsp. aureus Mu50
cauacuucuauuuuau

SEQ ID NO: 2063059 - RNA, 22 nt, Staphylococcus aureus subsp. aureus Mu50
ccagcaugaaucgcauuuaaau

SEQ ID NO: 2063060 - RNA, 15 nt, Staphylococcus aureus subsp. aureus Mu50
ccagaugaauuuuua

SEQ ID NO: 2063061 - RNA, 19 nt, Staphylococcus aureus subsp. aureus Mu50
ccacuucuucaccugcguc

SEQ ID NO: 2063062 - RNA, 21 nt, Staphylococcus aureus subsp. aureus Mu50
ccacuugaauacuuuuuaacu

SEQ ID NO: 2063063 - RNA, 13 nt, Staphylococcus aureus subsp. aureus Mu50
ccacuucaucuaa

SEQ ID NO: 2063064 - RNA, 21 nt, Staphylococcus aureus subsp. aureus Mu50
ccaauuaucaacauaauauuu

SEQ ID NO: 2063065 - RNA, 21 nt, Staphylococcus aureus subsp. aureus Mu50
ccaauuaauuguaaagcauga

SEQ ID NO: 2063066 - RNA, 14 nt, Staphylococcus aureus subsp. aureus Mu50
ccaauuaauaaaca

SEQ ID NO: 2063067 - RNA, 13 nt, Staphylococcus aureus subsp. aureus Mu50
ccaauaaacaacu

SEQ ID NO: 2063068 - RNA, 10 nt, Staphylococcus aureus subsp. aureus Mu50
ccaauaaucc

SEQ ID NO: 2063069 - RNA, 14 nt, Staphylococcus aureus subsp. aureus Mu50
ccaccuuuaucugu

SEQ ID NO: 2063070 - RNA, 21 nt, Staphylococcus aureus subsp. aureus Mu50
ccaccguuaaaauauaugaau

SEQ ID NO: 2063071 - RNA, 22 nt, Staphylococcus aureus subsp. aureus Mu50
ccaaauuucucuuucaagaccu

SEQ ID NO: 2063072 - RNA, 23 nt, Staphylococcus aureus subsp. aureus Mu50
ccaaauuucucuuucaagaccuu

SEQ ID NO: 2063073 - RNA, 22 nt, Staphylococcus aureus subsp. aureus Mu50
ccaacacaaagaauuucgaaaa

SEQ ID NO: 2063074 - RNA, 18 nt, Staphylococcus aureus subsp. aureus Mu50
ccaacacccauauaauuu

SEQ ID NO: 2063075 - RNA, 19 nt, Staphylococcus aureus subsp. aureus Mu50
ccaaccccuuuauuuugau

SEQ ID NO: 2063076 - RNA, 18 nt, Staphylococcus aureus subsp. aureus Mu50
ccaaaucuuuaauaaccu

SEQ ID NO: 2063077 - RNA, 13 nt, Staphylococcus aureus subsp. aureus Mu50
ccaaauaauaucu

SEQ ID NO: 2063078 - RNA, 15 nt, Staphylococcus aureus subsp. aureus Mu50
ccaaauaaauuaaau

SEQ ID NO: 2063079 - RNA, 20 nt, Staphylococcus aureus subsp. aureus Mu50
ccaaauaaauuaaauuuugu

SEQ ID NO: 2063080 - RNA, 21 nt, Staphylococcus aureus subsp. aureus Mu50
ccaaauaacguuaauauaauu

SEQ ID NO: 2063081 - RNA, 20 nt, Staphylococcus aureus subsp. aureus Mu50
ccaaagaaaucaccagauuu

SEQ ID NO: 2063082 - RNA, 13 nt, Staphylococcus aureus subsp. aureus Mu50
ccaacuuuuuuaa

SEQ ID NO: 2063083 - RNA, 17 nt, Staphylococcus aureus subsp. aureus Mu50
ccaagaacguguuugaa

SEQ ID NO: 2063084 - RNA, 20 nt, Staphylococcus aureus subsp. aureus Mu50
ccaaagaaacggaaaugacu

SEQ ID NO: 2063085 - RNA, 12 nt, Staphylococcus aureus subsp. aureus Mu50
ccaaaaaguauu

SEQ ID NO: 2063086 - RNA, 15 nt, Staphylococcus aureus subsp. aureus Mu50
ccaaaaauuguucaa

SEQ ID NO: 2063087 - RNA, 22 nt, Staphylococcus aureus subsp. aureus Mu50
ccaaaaauagauugaaaaaaua

SEQ ID NO: 2063088 - RNA, 22 nt, Staphylococcus aureus subsp. aureus Mu50
ccaaaaaucauccauaaaaaua

SEQ ID NO: 2063089 - RNA, 21 nt, Staphylococcus aureus subsp. aureus Mu50
ccaaaaguuauauaaauuugu

SEQ ID NO: 2063090 - RNA, 16 nt, Staphylococcus aureus subsp. aureus Mu50
cauuuuuucauuauua

SEQ ID NO: 2063091 - RNA, 20 nt, Staphylococcus aureus subsp. aureus Mu50
cauuuuuuuccaagcaucau

SEQ ID NO: 2063092 - RNA, 21 nt, Staphylococcus aureus subsp. aureus Mu50
cauuuuuaauuuugacauaaa

SEQ ID NO: 2063093 - RNA, 23 nt, Staphylococcus aureus subsp. aureus Mu50
cauuuuuauacaacuucacuucu

SEQ ID NO: 2063094 - RNA, 11 nt, Staphylococcus aureus subsp. aureus Mu50
cauuuuuaaaa

SEQ ID NO: 2063095 - RNA, 20 nt, Staphylococcus aureus subsp. aureus Mu50
cauuuugagucguagauacu

SEQ ID NO: 2063096 - RNA, 18 nt, Staphylococcus aureus subsp. aureus Mu50
cauugaugucaauuucac

SEQ ID NO: 2063097 - RNA, 20 nt, Staphylococcus aureus subsp. aureus Mu50
caguaagacgauuucaauga

SEQ ID NO: 2063098 - RNA, 11 nt, Staphylococcus aureus subsp. aureus Mu50
caguaauaaug

SEQ ID NO: 2063099 - RNA, 19 nt, Staphylococcus aureus subsp. aureus Mu50
caguaaguaauaaaauaaa

SEQ ID NO: 2063100 - RNA, 19 nt, Staphylococcus aureus subsp. aureus Mu50
caguaaucaugcauucuau

SEQ ID NO: 2063101 - RNA, 15 nt, Staphylococcus aureus subsp. aureus Mu50
caguaaucaaaguau

SEQ ID NO: 2063102 - RNA, 16 nt, Staphylococcus aureus subsp. aureus Mu50
cagguuuaauaaauuu

SEQ ID NO: 2063103 - RNA, 17 nt, Staphylococcus aureus subsp. aureus Mu50
cagguuguuaggggcuu

SEQ ID NO: 2063104 - RNA, 23 nt, Staphylococcus aureus subsp. aureus Mu50
caguaaaaagauaagaagagcca

SEQ ID NO: 2063105 - RNA, 15 nt, Staphylococcus aureus subsp. aureus Mu50
cagguuuuaugaauu

SEQ ID NO: 2063106 - RNA, 16 nt, Staphylococcus aureus subsp. aureus Mu50
aaacaacuucugaaac

SEQ ID NO: 2063107 - RNA, 19 nt, Staphylococcus aureus subsp. aureus Mu50
aaacaaauuaguuugauau

SEQ ID NO: 2063108 - RNA, 21 nt, Staphylococcus aureus subsp. aureus Mu50
aaacaaagcucaauaaauuau

SEQ ID NO: 2063109 - RNA, 19 nt, Staphylococcus aureus subsp. aureus Mu50
aaacaaagguuuguaagac

SEQ ID NO: 2063110 - RNA, 21 nt, Staphylococcus aureus subsp. aureus Mu50
aaacaacaaucaaauuacaaa

SEQ ID NO: 2063111 - RNA, 20 nt, Staphylococcus aureus subsp. aureus Mu50
aaacaacaucgauuuaucau

SEQ ID NO: 2063112 - RNA, 21 nt, Staphylococcus aureus subsp. aureus Mu50
caggucgcccuugccugugcu

SEQ ID NO: 2063113 - RNA, 13 nt, Staphylococcus aureus subsp. aureus Mu50
caggugauugacg

SEQ ID NO: 2063114 - RNA, 14 nt, Staphylococcus aureus subsp. aureus Mu50
caguacgaacaacu

SEQ ID NO: 2063115 - RNA, 15 nt, Staphylococcus aureus subsp. aureus Mu50
caguaggauaauuuc

SEQ ID NO: 2063116 - RNA, 18 nt, Staphylococcus aureus subsp. aureus Mu50
caguaguuaauugaauga

SEQ ID NO: 2063117 - RNA, 20 nt, Staphylococcus aureus subsp. aureus Mu50
caguauaaccauguauaucu

SEQ ID NO: 2063118 - RNA, 16 nt, Staphylococcus aureus subsp. aureus Mu50
caguaguuuuaaaagu

SEQ ID NO: 2063119 - RNA, 17 nt, Staphylococcus aureus subsp. aureus Mu50
caguauauaucaaauac

SEQ ID NO: 2063120 - RNA, 18 nt, Staphylococcus aureus subsp. aureus Mu50
caguauauaucaaauaca

SEQ ID NO: 2063121 - RNA, 15 nt, Staphylococcus aureus subsp. aureus Mu50
caguaucgauuuaac

SEQ ID NO: 2063122 - RNA, 17 nt, Staphylococcus aureus subsp. aureus Mu50
caguccauuauugggcu

SEQ ID NO: 2063123 - RNA, 15 nt, Staphylococcus aureus subsp. aureus Mu50
cagucaguaaaaaua

SEQ ID NO: 2063124 - RNA, 18 nt, Staphylococcus aureus subsp. aureus Mu50
cagucauuugauuuaaaa

SEQ ID NO: 2063125 - RNA, 17 nt, Staphylococcus aureus subsp. aureus Mu50
cagucauuugauuuaaa

SEQ ID NO: 2063126 - RNA, 17 nt, Staphylococcus aureus subsp. aureus Mu50
caguaucucuuuucuau

SEQ ID NO: 2063127 - RNA, 14 nt, Staphylococcus aureus subsp. aureus Mu50
caguauuuacuuuu

SEQ ID NO: 2063128 - RNA, 18 nt, Staphylococcus aureus subsp. aureus Mu50
caguauguggauacaaac

SEQ ID NO: 2063129 - RNA, 15 nt, Staphylococcus aureus subsp. aureus Mu50
cagugaaguuaacua

SEQ ID NO: 2063130 - RNA, 18 nt, Staphylococcus aureus subsp. aureus Mu50
cagugaaguuaacuauaa

SEQ ID NO: 2063131 - RNA, 16 nt, Staphylococcus aureus subsp. aureus Mu50
aaaauuuuuaaaaaaa

SEQ ID NO: 2063132 - RNA, 17 nt, Staphylococcus aureus subsp. aureus Mu50
aaaauuuuuaaaaaaau

SEQ ID NO: 2063133 - RNA, 23 nt, Staphylococcus aureus subsp. aureus Mu50
aaaauuuucuugguuugagaauc

SEQ ID NO: 2063134 - RNA, 18 nt, Staphylococcus aureus subsp. aureus Mu50
aaaauuucccuuuauacu

SEQ ID NO: 2063135 - RNA, 12 nt, Staphylococcus aureus subsp. aureus Mu50
aaaauuucugcu

SEQ ID NO: 2063136 - RNA, 13 nt, Staphylococcus aureus subsp. aureus Mu50
caggaauagaugu

SEQ ID NO: 2063137 - RNA, 22 nt, Staphylococcus aureus subsp. aureus Mu50
aaaauuugaaauauaccaacca

SEQ ID NO: 2063138 - RNA, 22 nt, Staphylococcus aureus subsp. aureus Mu50
caggagcgagccauuauuauuu

SEQ ID NO: 2063139 - RNA, 14 nt, Staphylococcus aureus subsp. aureus Mu50
cagcuuuuucauuc

SEQ ID NO: 2063140 - RNA, 12 nt, Staphylococcus aureus subsp. aureus Mu50
cagcuuuuucua

SEQ ID NO: 2063141 - RNA, 20 nt, Staphylococcus aureus subsp. aureus Mu50
cagcuugaccgccuaugaua

SEQ ID NO: 2063142 - RNA, 14 nt, Staphylococcus aureus subsp. aureus Mu50
cagcuguauuuaau

SEQ ID NO: 2063143 - RNA, 19 nt, Staphylococcus aureus subsp. aureus Mu50
cagcuaaugucaugaaaau

SEQ ID NO: 2063144 - RNA, 13 nt, Staphylococcus aureus subsp. aureus Mu50
cagcuaauugucg

SEQ ID NO: 2063145 - RNA, 17 nt, Staphylococcus aureus subsp. aureus Mu50
cagcuacaaauaaugag

SEQ ID NO: 2063146 - RNA, 21 nt, Staphylococcus aureus subsp. aureus Mu50
aaaauugauauugcaaaacuu

SEQ ID NO: 2063147 - RNA, 23 nt, Staphylococcus aureus subsp. aureus Mu50
aaaauugugccauuugcaacaau

SEQ ID NO: 2063148 - RNA, 17 nt, Staphylococcus aureus subsp. aureus Mu50
aaaauugcuauauuagu

SEQ ID NO: 2063149 - RNA, 20 nt, Staphylococcus aureus subsp. aureus Mu50
aaaauugguuuggauaaaau

SEQ ID NO: 2063150 - RNA, 22 nt, Staphylococcus aureus subsp. aureus Mu50
aaaauugguuuggauaaaauga

SEQ ID NO: 2063151 - RNA, 18 nt, Staphylococcus aureus subsp. aureus Mu50
aaaauuuauucaaaucau

SEQ ID NO: 2063152 - RNA, 23 nt, Staphylococcus aureus subsp. aureus Mu50
aaaauuuaaauaauaauucauaa

SEQ ID NO: 2063153 - RNA, 19 nt, Staphylococcus aureus subsp. aureus Mu50
aaaauuuacaaauguauaa

SEQ ID NO: 2063154 - RNA, 18 nt, Staphylococcus aureus subsp. aureus Mu50
cacuuucaaugacaucua

SEQ ID NO: 2063155 - RNA, 12 nt, Staphylococcus aureus subsp. aureus Mu50
cacuuucuacuc

SEQ ID NO: 2063156 - RNA, 20 nt, Staphylococcus aureus subsp. aureus Mu50
cacuuuuugacauauuuuuu

SEQ ID NO: 2063157 - RNA, 18 nt, Staphylococcus aureus subsp. aureus Mu50
cacuuuuguuaaaaaaug

SEQ ID NO: 2063158 - RNA, 20 nt, Staphylococcus aureus subsp. aureus Mu50
cacuuuuuuuaaaucuucua

SEQ ID NO: 2063159 - RNA, 15 nt, Staphylococcus aureus subsp. aureus Mu50
cagaaauuuaauauu

SEQ ID NO: 2063160 - RNA, 15 nt, Staphylococcus aureus subsp. aureus Mu50
cagaauuucaucaaa

SEQ ID NO: 2063161 - RNA, 16 nt, Staphylococcus aureus subsp. aureus Mu50
aaaaucaacuuuucua

SEQ ID NO: 2063162 - RNA, 16 nt, Staphylococcus aureus subsp. aureus Mu50
cagagaauuucgaaaa

SEQ ID NO: 2063163 - RNA, 23 nt, Staphylococcus aureus subsp. aureus Mu50
cagagaauuucgaaaagaaauuc

SEQ ID NO: 2063164 - RNA, 20 nt, Staphylococcus aureus subsp. aureus Mu50
cagagaauuucgaaaagaaa

SEQ ID NO: 2063165 - RNA, 20 nt, Staphylococcus aureus subsp. aureus Mu50
cagagaaauucgaaaagaaa

SEQ ID NO: 2063166 - RNA, 23 nt, Staphylococcus aureus subsp. aureus Mu50
cagagaaauucgaaaagaaauuc

SEQ ID NO: 2063167 - RNA, 15 nt, Staphylococcus aureus subsp. aureus Mu50
cagagccauaaugag

SEQ ID NO: 2063168 - RNA, 19 nt, Staphylococcus aureus subsp. aureus Mu50
cagaggagcucauguuuca

SEQ ID NO: 2063169 - RNA, 16 nt, Staphylococcus aureus subsp. aureus Mu50
aaaaucaucauuauac

SEQ ID NO: 2063170 - RNA, 18 nt, Staphylococcus aureus subsp. aureus Mu50
aaaaucaucuuaacaacu

SEQ ID NO: 2063171 - RNA, 23 nt, Staphylococcus aureus subsp. aureus Mu50
cagauguugguucaucaaacaac

SEQ ID NO: 2063172 - RNA, 18 nt, Staphylococcus aureus subsp. aureus Mu50
cagauguugguucaucaa

SEQ ID NO: 2063173 - RNA, 14 nt, Staphylococcus aureus subsp. aureus Mu50
cagauguugguuca

SEQ ID NO: 2063174 - RNA, 20 nt, Staphylococcus aureus subsp. aureus Mu50
aaaaugaauaauugcuaaaa

SEQ ID NO: 2063175 - RNA, 12 nt, Staphylococcus aureus subsp. aureus Mu50
aaaaucuuuacu

SEQ ID NO: 2063176 - RNA, 17 nt, Staphylococcus aureus subsp. aureus Mu50
aaaaucuuuaacauuug

SEQ ID NO: 2063177 - RNA, 21 nt, Staphylococcus aureus subsp. aureus Mu50
cagaucucaauccaauuaaau

SEQ ID NO: 2063178 - RNA, 14 nt, Staphylococcus aureus subsp. aureus Mu50
cagaugaauaaugu

SEQ ID NO: 2063179 - RNA, 22 nt, Staphylococcus aureus subsp. aureus Mu50
cagaugaauaauguuuccauuu

SEQ ID NO: 2063180 - RNA, 21 nt, Staphylococcus aureus subsp. aureus Mu50
cagauaaguaauaauauaaau

SEQ ID NO: 2063181 - RNA, 16 nt, Staphylococcus aureus subsp. aureus Mu50
cagauaagaauauuua

SEQ ID NO: 2063182 - RNA, 18 nt, Staphylococcus aureus subsp. aureus Mu50
cagauaagaauauuuaag

SEQ ID NO: 2063183 - RNA, 17 nt, Staphylococcus aureus subsp. aureus Mu50
aaaauggcaucuggcaa

SEQ ID NO: 2063184 - RNA, 16 nt, Staphylococcus aureus subsp. aureus Mu50
aaaaugacgauacgua

SEQ ID NO: 2063185 - RNA, 19 nt, Staphylococcus aureus subsp. aureus Mu50
aaaaugacgugcuuuuaaa

SEQ ID NO: 2063186 - RNA, 23 nt, Staphylococcus aureus subsp. aureus Mu50
cagcaugaaucgcauuuaaauau

SEQ ID NO: 2063187 - RNA, 20 nt, Staphylococcus aureus subsp. aureus Mu50
cagcauuaaucguauuuuua

SEQ ID NO: 2063188 - RNA, 17 nt, Staphylococcus aureus subsp. aureus Mu50
cagccagcuuagcauag

SEQ ID NO: 2063189 - RNA, 19 nt, Staphylococcus aureus subsp. aureus Mu50
cagcagugaaguuaacuau

SEQ ID NO: 2063190 - RNA, 18 nt, Staphylococcus aureus subsp. aureus Mu50
cagcaguaagauuauuuu

SEQ ID NO: 2063191 - RNA, 14 nt, Staphylococcus aureus subsp. aureus Mu50
cagcaguaagauau

SEQ ID NO: 2063192 - RNA, 14 nt, Staphylococcus aureus subsp. aureus Mu50
cagcgaaauuugua

SEQ ID NO: 2063193 - RNA, 15 nt, Staphylococcus aureus subsp. aureus Mu50
cagcgaaauuuguaa

SEQ ID NO: 2063194 - RNA, 14 nt, Staphylococcus aureus subsp. aureus Mu50
uuuuuuauucuaau

SEQ ID NO: 2063195 - RNA, 12 nt, Staphylococcus aureus subsp. aureus Mu50
uuuuuuauuaau

SEQ ID NO: 2063196 - RNA, 12 nt, Staphylococcus aureus subsp. aureus Mu50
uuuuuuaaauac

SEQ ID NO: 2063197 - RNA, 16 nt, Staphylococcus aureus subsp. aureus Mu50
uuuuuuacauucguuu

SEQ ID NO: 2063198 - RNA, 11 nt, Staphylococcus aureus subsp. aureus Mu50
uuuuuuaauuu

SEQ ID NO: 2063199 - RNA, 21 nt, Staphylococcus aureus subsp. aureus Mu50
uuuuuguccccagcccuuuuc

SEQ ID NO: 2063200 - RNA, 22 nt, Staphylococcus aureus subsp. aureus Mu50
uuuuuguuuucaaaugaaaaua

SEQ ID NO: 2063201 - RNA, 15 nt, Staphylococcus aureus subsp. aureus Mu50
uuuuuggcuuaucaa

SEQ ID NO: 2063202 - RNA, 19 nt, Staphylococcus aureus subsp. aureus Mu50
uuuuuggagcguaaaguuu

SEQ ID NO: 2063203 - RNA, 20 nt, Staphylococcus aureus subsp. aureus Mu50
uuuuugaaauuucgacaucu

SEQ ID NO: 2063204 - RNA, 17 nt, Staphylococcus aureus subsp. aureus Mu50
uuuuugagcacuuaaua

SEQ ID NO: 2063205 - RNA, 17 nt, Staphylococcus aureus subsp. aureus Mu50
uuuuugacauauuuuuu

SEQ ID NO: 2063206 - RNA, 16 nt, Staphylococcus aureus subsp. aureus Mu50
uuuuugaauaucuaau

SEQ ID NO: 2063207 - RNA, 17 nt, Staphylococcus aureus subsp. aureus Mu50
uuuuugaauaucuaaug

SEQ ID NO: 2063208 - RNA, 14 nt, Staphylococcus aureus subsp. aureus Mu50
uuuuugaauuuaau

SEQ ID NO: 2063209 - RNA, 23 nt, Staphylococcus aureus subsp. aureus Mu50
uuuugauauaaaaagugaaagua

SEQ ID NO: 2063210 - RNA, 23 nt, Staphylococcus aureus subsp. aureus Mu50
uuuugaugugaaaauuuauucaa

SEQ ID NO: 2063211 - RNA, 9 nt, Staphylococcus aureus subsp. aureus Mu50
uuuugauug

SEQ ID NO: 2063212 - RNA, 20 nt, Staphylococcus aureus subsp. aureus Mu50
uuuugauuguuuaaacaugu

SEQ ID NO: 2063213 - RNA, 17 nt, Staphylococcus aureus subsp. aureus Mu50
uuuuucgaaguggcaaa

SEQ ID NO: 2063214 - RNA, 15 nt, Staphylococcus aureus subsp. aureus Mu50
uuuuucguaacauuu

SEQ ID NO: 2063215 - RNA, 13 nt, Staphylococcus aureus subsp. aureus Mu50
uuuuucguuguuc

SEQ ID NO: 2063216 - RNA, 14 nt, Staphylococcus aureus subsp. aureus Mu50
uuuuucuaaauaaa

SEQ ID NO: 2063217 - RNA, 23 nt, Staphylococcus aureus subsp. aureus Mu50
uuuuauaguaauagcuauauuuu

SEQ ID NO: 2063218 - RNA, 16 nt, Staphylococcus aureus subsp. aureus Mu50
uuuuauaaguuaaaaa

SEQ ID NO: 2063219 - RNA, 14 nt, Staphylococcus aureus subsp. aureus Mu50
uuuuauaaauuuug

SEQ ID NO: 2063220 - RNA, 14 nt, Staphylococcus aureus subsp. aureus Mu50
uuuuagcuuuugua

SEQ ID NO: 2063221 - RNA, 15 nt, Staphylococcus aureus subsp. aureus Mu50
uuuuagcuuguuguu

SEQ ID NO: 2063222 - RNA, 21 nt, Staphylococcus aureus subsp. aureus Mu50
uuuuagccccagcaaauacuu

SEQ ID NO: 2063223 - RNA, 15 nt, Staphylococcus aureus subsp. aureus Mu50
uuuuagcuauagaaa

SEQ ID NO: 2063224 - RNA, 20 nt, Staphylococcus aureus subsp. aureus Mu50
uuuuaggaugcauauauaua

SEQ ID NO: 2063225 - RNA, 23 nt, Staphylococcus aureus subsp. aureus Mu50
uuuuaguuagaaaguauuuauuu

SEQ ID NO: 2063226 - RNA, 23 nt, Staphylococcus aureus subsp. aureus Mu50
uuuuaguuagggaaauguagauu

SEQ ID NO: 2063227 - RNA, 21 nt, Staphylococcus aureus subsp. aureus Mu50
uuuuagugacaaacauuuguu

SEQ ID NO: 2063228 - RNA, 14 nt, Staphylococcus aureus subsp. aureus Mu50
uuuuagugacucag

SEQ ID NO: 2063229 - RNA, 24 nt, Staphylococcus aureus subsp. aureus Mu50
uuuuaugcauuauagaugacugua

SEQ ID NO: 2063230 - RNA, 15 nt, Staphylococcus aureus subsp. aureus Mu50
uuuuaugauuuucuu

SEQ ID NO: 2063231 - RNA, 23 nt, Staphylococcus aureus subsp. aureus Mu50
uuuuaugcacaaaaaaaucuccu

SEQ ID NO: 2063232 - RNA, 15 nt, Staphylococcus aureus subsp. aureus Mu50
uuuuaugauuugauu

SEQ ID NO: 2063233 - RNA, 21 nt, Staphylococcus aureus subsp. aureus Mu50
uuuuaugaauugaguauuaaa

SEQ ID NO: 2063234 - RNA, 18 nt, Staphylococcus aureus subsp. aureus Mu50
uuuuaugacguaauuaau

SEQ ID NO: 2063235 - RNA, 17 nt, Staphylococcus aureus subsp. aureus Mu50
uuuuaucugaaaauauc

SEQ ID NO: 2063236 - RNA, 18 nt, Staphylococcus aureus subsp. aureus Mu50
uuuuaucugaaaauauca

SEQ ID NO: 2063237 - RNA, 13 nt, Staphylococcus aureus subsp. aureus Mu50
uuuuaucugaauc

SEQ ID NO: 2063238 - RNA, 21 nt, Staphylococcus aureus subsp. aureus Mu50
uuuuaucuaucgguaauuuuu

SEQ ID NO: 2063239 - RNA, 19 nt, Staphylococcus aureus subsp. aureus Mu50
uuuuaucaucuauucaacu

SEQ ID NO: 2063240 - RNA, 14 nt, Staphylococcus aureus subsp. aureus Mu50
uuuuauauuuauuu

SEQ ID NO: 2063241 - RNA, 18 nt, Staphylococcus aureus subsp. aureus Mu50
uuuuauaugcaacuuaua

SEQ ID NO: 2063242 - RNA, 18 nt, Staphylococcus aureus subsp. aureus Mu50
uuuuaucaauauuaguuu

SEQ ID NO: 2063243 - RNA, 19 nt, Staphylococcus aureus subsp. aureus Mu50
uuuuaaugggcgauaaaag

SEQ ID NO: 2063244 - RNA, 11 nt, Staphylococcus aureus subsp. aureus Mu50
uuuuaauuauu

SEQ ID NO: 2063245 - RNA, 13 nt, Staphylococcus aureus subsp. aureus Mu50
uuuuaauuguuca

SEQ ID NO: 2063246 - RNA, 19 nt, Staphylococcus aureus subsp. aureus Mu50
uuuuaauuguuuaauaaca

SEQ ID NO: 2063247 - RNA, 16 nt, Staphylococcus aureus subsp. aureus Mu50
uuuuacauuuucaaaa

SEQ ID NO: 2063248 - RNA, 20 nt, Staphylococcus aureus subsp. aureus Mu50
uuuuaccauugugaauaauu

SEQ ID NO: 2063249 - RNA, 21 nt, Staphylococcus aureus subsp. aureus Mu50
uuuuaccauugugaauaauuu

SEQ ID NO: 2063250 - RNA, 23 nt, Staphylococcus aureus subsp. aureus Mu50
uuuuacaaaauauggaauuucau

SEQ ID NO: 2063251 - RNA, 20 nt, Staphylococcus aureus subsp. aureus Mu50
uuuuacagucaacugcugcu

SEQ ID NO: 2063252 - RNA, 21 nt, Staphylococcus aureus subsp. aureus Mu50
uuuuacguaaucuaauacaua

SEQ ID NO: 2063253 - RNA, 16 nt, Staphylococcus aureus subsp. aureus Mu50
uuuuacuaaaucauuu

SEQ ID NO: 2063254 - RNA, 21 nt, Staphylococcus aureus subsp. aureus Mu50
uuuuacuaggaauauaaaacu

SEQ ID NO: 2063255 - RNA, 18 nt, Staphylococcus aureus subsp. aureus Mu50
uuuuaccucugauaaaug

SEQ ID NO: 2063256 - RNA, 13 nt, Staphylococcus aureus subsp. aureus Mu50
uuuuagaaaagga

SEQ ID NO: 2063257 - RNA, 15 nt, Staphylococcus aureus subsp. aureus Mu50
uuuuagauuugaaau

SEQ ID NO: 2063258 - RNA, 19 nt, Staphylococcus aureus subsp. aureus Mu50
uuuucuguccaaaaagguu

SEQ ID NO: 2063259 - RNA, 20 nt, Staphylococcus aureus subsp. aureus Mu50
uuuucuuaguuugacaucua

SEQ ID NO: 2063260 - RNA, 19 nt, Staphylococcus aureus subsp. aureus Mu50
uuuucuccaacgucauaac

SEQ ID NO: 2063261 - RNA, 14 nt, Staphylococcus aureus subsp. aureus Mu50
uuuucuauucaaaa

SEQ ID NO: 2063262 - RNA, 13 nt, Staphylococcus aureus subsp. aureus Mu50
uuuucuuauuuau

SEQ ID NO: 2063263 - RNA, 17 nt, Staphylococcus aureus subsp. aureus Mu50
uuuucuuauaaaaaucu

SEQ ID NO: 2063264 - RNA, 13 nt, Staphylococcus aureus subsp. aureus Mu50
uuuugauauaaaa

SEQ ID NO: 2063265 - RNA, 19 nt, Staphylococcus aureus subsp. aureus Mu50
uuuugaaucauacgaauuu

SEQ ID NO: 2063266 - RNA, 14 nt, Staphylococcus aureus subsp. aureus Mu50
uuuugaaccuaaau

SEQ ID NO: 2063267 - RNA, 22 nt, Staphylococcus aureus subsp. aureus Mu50
uuuugaaacaucuaaauaguuu

SEQ ID NO: 2063268 - RNA, 14 nt, Staphylococcus aureus subsp. aureus Mu50
uuuucuuuuuuaau

SEQ ID NO: 2063269 - RNA, 14 nt, Staphylococcus aureus subsp. aureus Mu50
uuuucuaaacaacu

SEQ ID NO: 2063270 - RNA, 14 nt, Staphylococcus aureus subsp. aureus Mu50
uuuucuaauuguuu

SEQ ID NO: 2063271 - RNA, 13 nt, Staphylococcus aureus subsp. aureus Mu50
uuuucuauucaaa

SEQ ID NO: 2063272 - RNA, 18 nt, Staphylococcus aureus subsp. aureus Mu50
uuuucuauaauauuuaac

SEQ ID NO: 2063273 - RNA, 14 nt, Staphylococcus aureus subsp. aureus Mu50
uuuuauguuuuaau

SEQ ID NO: 2063274 - RNA, 13 nt, Staphylococcus aureus subsp. aureus Mu50
uuuuauguuaaau

SEQ ID NO: 2063275 - RNA, 22 nt, Staphylococcus aureus subsp. aureus Mu50
uuuuauuaucagcccaaucagu

SEQ ID NO: 2063276 - RNA, 16 nt, Staphylococcus aureus subsp. aureus Mu50
uuuuauuaucuuuaau

SEQ ID NO: 2063277 - RNA, 15 nt, Staphylococcus aureus subsp. aureus Mu50
uuuuauguuuuaauu

SEQ ID NO: 2063278 - RNA, 13 nt, Staphylococcus aureus subsp. aureus Mu50
uuuuauuaauuaa

SEQ ID NO: 2063279 - RNA, 16 nt, Staphylococcus aureus subsp. aureus Mu50
uuuuauuguuuuggcu

SEQ ID NO: 2063280 - RNA, 13 nt, Staphylococcus aureus subsp. aureus Mu50
uuuuauucuaaua

SEQ ID NO: 2063281 - RNA, 20 nt, Staphylococcus aureus subsp. aureus Mu50
uuuuauucacuuuuuuuaau

SEQ ID NO: 2063282 - RNA, 21 nt, Staphylococcus aureus subsp. aureus Mu50
uuuuauucacuuuuuuuaauu

SEQ ID NO: 2063283 - RNA, 11 nt, Staphylococcus aureus subsp. aureus Mu50
uuuuauuuauc

SEQ ID NO: 2063284 - RNA, 16 nt, Staphylococcus aureus subsp. aureus Mu50
uuuuauuuacacacau

SEQ ID NO: 2063285 - RNA, 15 nt, Staphylococcus aureus subsp. aureus Mu50
uuuucaauaaauuuu

SEQ ID NO: 2063286 - RNA, 22 nt, Staphylococcus aureus subsp. aureus Mu50
uuuucaauucgcucacauguga

SEQ ID NO: 2063287 - RNA, 12 nt, Staphylococcus aureus subsp. aureus Mu50
uuuucaacugua

SEQ ID NO: 2063288 - RNA, 16 nt, Staphylococcus aureus subsp. aureus Mu50
uuuucaaaaauagucg

SEQ ID NO: 2063289 - RNA, 20 nt, Staphylococcus aureus subsp. aureus Mu50
uuuuauuuuuuucacuaauu

SEQ ID NO: 2063290 - RNA, 14 nt, Staphylococcus aureus subsp. aureus Mu50
uuuucauuucuuug

SEQ ID NO: 2063291 - RNA, 15 nt, Staphylococcus aureus subsp. aureus Mu50
uuuucauuucuuugu

SEQ ID NO: 2063292 - RNA, 19 nt, Staphylococcus aureus subsp. aureus Mu50
uuuuccauaaauauuuaaa

SEQ ID NO: 2063293 - RNA, 19 nt, Staphylococcus aureus subsp. aureus Mu50
uuuggauuucuuuuuaaaa

SEQ ID NO: 2063294 - RNA, 17 nt, Staphylococcus aureus subsp. aureus Mu50
uuuggaugcuuuucuau

SEQ ID NO: 2063295 - RNA, 24 nt, Staphylococcus aureus subsp. aureus Mu50
uuuggcacauaaaucaauguacua

SEQ ID NO: 2063296 - RNA, 21 nt, Staphylococcus aureus subsp. aureus Mu50
uuuggauuucuuuuuaaaauc

SEQ ID NO: 2063297 - RNA, 17 nt, Staphylococcus aureus subsp. aureus Mu50
uuugcuuaaaccuuaau

SEQ ID NO: 2063298 - RNA, 19 nt, Staphylococcus aureus subsp. aureus Mu50
uuugcuuuggcuauuuuau

SEQ ID NO: 2063299 - RNA, 16 nt, Staphylococcus aureus subsp. aureus Mu50
uuugcuuuuuguaaug

SEQ ID NO: 2063300 - RNA, 17 nt, Staphylococcus aureus subsp. aureus Mu50
uuuggaaaccguuuaga

SEQ ID NO: 2063301 - RNA, 20 nt, Staphylococcus aureus subsp. aureus Mu50
uuugcguuuguguguuuuaa

SEQ ID NO: 2063302 - RNA, 18 nt, Staphylococcus aureus subsp. aureus Mu50
uuugcuaaccaucauaaa

SEQ ID NO: 2063303 - RNA, 22 nt, Staphylococcus aureus subsp. aureus Mu50
uuugcucuaaacuucuauuaau

SEQ ID NO: 2063304 - RNA, 16 nt, Staphylococcus aureus subsp. aureus Mu50
uuuguauuuuucaaau

SEQ ID NO: 2063305 - RNA, 16 nt, Staphylococcus aureus subsp. aureus Mu50
uuuguaugauaaccau

SEQ ID NO: 2063306 - RNA, 19 nt, Staphylococcus aureus subsp. aureus Mu50
uuuguauaccuauuccuau

SEQ ID NO: 2063307 - RNA, 15 nt, Staphylococcus aureus subsp. aureus Mu50
uuuguaaccuaaaaa

SEQ ID NO: 2063308 - RNA, 19 nt, Staphylococcus aureus subsp. aureus Mu50
uuuguaauacaagcaauac

SEQ ID NO: 2063309 - RNA, 13 nt, Staphylococcus aureus subsp. aureus Mu50
uuuguaauacauc

SEQ ID NO: 2063310 - RNA, 20 nt, Staphylococcus aureus subsp. aureus Mu50
uuuguaaucccauuuuaaag

SEQ ID NO: 2063311 - RNA, 13 nt, Staphylococcus aureus subsp. aureus Mu50
uuuguaauuagga

SEQ ID NO: 2063312 - RNA, 21 nt, Staphylococcus aureus subsp. aureus Mu50
uuugguggagaaccauuuuau

SEQ ID NO: 2063313 - RNA, 20 nt, Staphylococcus aureus subsp. aureus Mu50
uuugguaagcuaauuucuaa

SEQ ID NO: 2063314 - RNA, 15 nt, Staphylococcus aureus subsp. aureus Mu50
uuugguuugcuuuaa

SEQ ID NO: 2063315 - RNA, 22 nt, Staphylococcus aureus subsp. aureus Mu50
uuugguucaaucauucacuuca

SEQ ID NO: 2063316 - RNA, 16 nt, Staphylococcus aureus subsp. aureus Mu50
uuugguucuucuaucu

SEQ ID NO: 2063317 - RNA, 19 nt, Staphylococcus aureus subsp. aureus Mu50
uuugguguuuaacuaaacc

SEQ ID NO: 2063318 - RNA, 24 nt, Staphylococcus aureus subsp. aureus Mu50
uuuuaaggcagcuaaaaaguauac

SEQ ID NO: 2063319 - RNA, 23 nt, Staphylococcus aureus subsp. aureus Mu50
uuuuaacuuuaacaucugaaucu

SEQ ID NO: 2063320 - RNA, 23 nt, Staphylococcus aureus subsp. aureus Mu50
uuuuaagugaugaccaauauucu

SEQ ID NO: 2063321 - RNA, 20 nt, Staphylococcus aureus subsp. aureus Mu50
uuuuaauauugaaaugagcu

SEQ ID NO: 2063322 - RNA, 21 nt, Staphylococcus aureus subsp. aureus Mu50
uuuuaacuauguuacuuauau

SEQ ID NO: 2063323 - RNA, 15 nt, Staphylococcus aureus subsp. aureus Mu50
uuuuaacaaaauaua

SEQ ID NO: 2063324 - RNA, 17 nt, Staphylococcus aureus subsp. aureus Mu50
uuuuaacaaaauauacu

SEQ ID NO: 2063325 - RNA, 21 nt, Staphylococcus aureus subsp. aureus Mu50
uuuuaacaaaauauacuaaau

SEQ ID NO: 2063326 - RNA, 22 nt, Staphylococcus aureus subsp. aureus Mu50
uuuuaaauuacuauauuuaaau

SEQ ID NO: 2063327 - RNA, 21 nt, Staphylococcus aureus subsp. aureus Mu50
uuuuaaauucuuauaaaauaa

SEQ ID NO: 2063328 - RNA, 21 nt, Staphylococcus aureus subsp. aureus Mu50
uuuuaaauuuaguaucucauu

SEQ ID NO: 2063329 - RNA, 13 nt, Staphylococcus aureus subsp. aureus Mu50
uuuuaaaucuuuu

SEQ ID NO: 2063330 - RNA, 22 nt, Staphylococcus aureus subsp. aureus Mu50
uuuuaaacaugaacaaucagau

SEQ ID NO: 2063331 - RNA, 23 nt, Staphylococcus aureus subsp. aureus Mu50
uuuuaaacucauccauugaucuu

SEQ ID NO: 2063332 - RNA, 16 nt, Staphylococcus aureus subsp. aureus Mu50
uuuuaaagguuaaaua

SEQ ID NO: 2063333 - RNA, 20 nt, Staphylococcus aureus subsp. aureus Mu50
uuuuaaaguuuaaauauuca

SEQ ID NO: 2063334 - RNA, 22 nt, Staphylococcus aureus subsp. aureus Mu50
uuuuaaagguuaaauauuuaau

SEQ ID NO: 2063335 - RNA, 12 nt, Staphylococcus aureus subsp. aureus Mu50
uuuuaaaguuua

SEQ ID NO: 2063336 - RNA, 14 nt, Staphylococcus aureus subsp. aureus Mu50
uuuuaaaguuuaaa

SEQ ID NO: 2063337 - RNA, 16 nt, Staphylococcus aureus subsp. aureus Mu50
uuuuaaaaauacagcu

SEQ ID NO: 2063338 - RNA, 15 nt, Staphylococcus aureus subsp. aureus Mu50
uuuuaaaaaaugaug

SEQ ID NO: 2063339 - RNA, 15 nt, Staphylococcus aureus subsp. aureus Mu50
uuuuaaaaaacauac

SEQ ID NO: 2063340 - RNA, 17 nt, Staphylococcus aureus subsp. aureus Mu50
uuuuaaaaaauuuaaau

SEQ ID NO: 2063341 - RNA, 17 nt, Staphylococcus aureus subsp. aureus Mu50
uuuguucaaucacuaua

SEQ ID NO: 2063342 - RNA, 16 nt, Staphylococcus aureus subsp. aureus Mu50
uuuguuauaucuaauu

SEQ ID NO: 2063343 - RNA, 15 nt, Staphylococcus aureus subsp. aureus Mu50
uuuguugguguuuag

SEQ ID NO: 2063344 - RNA, 13 nt, Staphylococcus aureus subsp. aureus Mu50
uuuguuucuaaau

SEQ ID NO: 2063345 - RNA, 12 nt, Staphylococcus aureus subsp. aureus Mu50
uuuguuuuaaau

SEQ ID NO: 2063346 - RNA, 14 nt, Staphylococcus aureus subsp. aureus Mu50
uuuguuuuaaaaaa

SEQ ID NO: 2063347 - RNA, 16 nt, Staphylococcus aureus subsp. aureus Mu50
uuuguuuuaaauacuu

SEQ ID NO: 2063348 - RNA, 15 nt, Staphylococcus aureus subsp. aureus Mu50
uuugucucucaacau

SEQ ID NO: 2063349 - RNA, 13 nt, Staphylococcus aureus subsp. aureus Mu50
uuugucauuucuu

SEQ ID NO: 2063350 - RNA, 16 nt, Staphylococcus aureus subsp. aureus Mu50
uuuguguaucuguaac

SEQ ID NO: 2063351 - RNA, 21 nt, Staphylococcus aureus subsp. aureus Mu50
uuugugaauuuauuuuguagu

SEQ ID NO: 2063352 - RNA, 15 nt, Staphylococcus aureus subsp. aureus Mu50
uuuacuaaacuuuug

SEQ ID NO: 2063353 - RNA, 16 nt, Staphylococcus aureus subsp. aureus Mu50
uuuacagguugaauaa

SEQ ID NO: 2063354 - RNA, 18 nt, Staphylococcus aureus subsp. aureus Mu50
uuuacaccuauaccucgu

SEQ ID NO: 2063355 - RNA, 19 nt, Staphylococcus aureus subsp. aureus Mu50
uuuacagaacguucauaua

SEQ ID NO: 2063356 - RNA, 18 nt, Staphylococcus aureus subsp. aureus Mu50
uuuacgauaaacuaaaaa

SEQ ID NO: 2063357 - RNA, 13 nt, Staphylococcus aureus subsp. aureus Mu50
uuuacgauaaaua

SEQ ID NO: 2063358 - RNA, 22 nt, Staphylococcus aureus subsp. aureus Mu50
uuuacuaggaauauaaaacugu

SEQ ID NO: 2063359 - RNA, 15 nt, Staphylococcus aureus subsp. aureus Mu50
uuuacuauuaaagga

SEQ ID NO: 2063360 - RNA, 18 nt, Staphylococcus aureus subsp. aureus Mu50
uuuacugcuucgacauug

SEQ ID NO: 2063361 - RNA, 13 nt, Staphylococcus aureus subsp. aureus Mu50
uuuacuucauaag

SEQ ID NO: 2063362 - RNA, 17 nt, Staphylococcus aureus subsp. aureus Mu50
uuuacuuacuuuucuaa

SEQ ID NO: 2063363 - RNA, 21 nt, Staphylococcus aureus subsp. aureus Mu50
uuuacuugcuuuuucaaauaa

SEQ ID NO: 2063364 - RNA, 19 nt, Staphylococcus aureus subsp. aureus Mu50
uuuagucauuacaaaucau

SEQ ID NO: 2063365 - RNA, 18 nt, Staphylococcus aureus subsp. aureus Mu50
uuuaguaucucauuuuuu

SEQ ID NO: 2063366 - RNA, 13 nt, Staphylococcus aureus subsp. aureus Mu50
uuuaguuaaauag

SEQ ID NO: 2063367 - RNA, 22 nt, Staphylococcus aureus subsp. aureus Mu50
uuuaguuagcccuauucaacua

SEQ ID NO: 2063368 - RNA, 21 nt, Staphylococcus aureus subsp. aureus Mu50
uuuaguucaaagcgauaaagu

SEQ ID NO: 2063369 - RNA, 21 nt, Staphylococcus aureus subsp. aureus Mu50
uuuaguucaccauuucguguu

SEQ ID NO: 2063370 - RNA, 14 nt, Staphylococcus aureus subsp. aureus Mu50
uuuauaaaaacuua

SEQ ID NO: 2063371 - RNA, 13 nt, Staphylococcus aureus subsp. aureus Mu50
uuuauaaaaagag

SEQ ID NO: 2063372 - RNA, 17 nt, Staphylococcus aureus subsp. aureus Mu50
uuuauaaaaaaaucccu

SEQ ID NO: 2063373 - RNA, 22 nt, Staphylococcus aureus subsp. aureus Mu50
uuuagguucuucaucuuuuaug

SEQ ID NO: 2063374 - RNA, 19 nt, Staphylococcus aureus subsp. aureus Mu50
uuuaguacauauguuguuu

SEQ ID NO: 2063375 - RNA, 14 nt, Staphylococcus aureus subsp. aureus Mu50
uuuaguauaaauaa

SEQ ID NO: 2063376 - RNA, 15 nt, Staphylococcus aureus subsp. aureus Mu50
uuuaguauaaauaaa

SEQ ID NO: 2063377 - RNA, 12 nt, Staphylococcus aureus subsp. aureus Mu50
uuuagacaucau

SEQ ID NO: 2063378 - RNA, 14 nt, Staphylococcus aureus subsp. aureus Mu50
uuuagacauaaaaa

SEQ ID NO: 2063379 - RNA, 22 nt, Staphylococcus aureus subsp. aureus Mu50
uuuagaaucaaccguuuuauug

SEQ ID NO: 2063380 - RNA, 18 nt, Staphylococcus aureus subsp. aureus Mu50
uuuagaauaagaaauaaa

SEQ ID NO: 2063381 - RNA, 22 nt, Staphylococcus aureus subsp. aureus Mu50
uuuagcauacauuaagcuaugc

SEQ ID NO: 2063382 - RNA, 19 nt, Staphylococcus aureus subsp. aureus Mu50
uuuagauuucaugauguua

SEQ ID NO: 2063383 - RNA, 21 nt, Staphylococcus aureus subsp. aureus Mu50
uuuagcaacaguauuugccuu

SEQ ID NO: 2063384 - RNA, 17 nt, Staphylococcus aureus subsp. aureus Mu50
uuuagaugcauaaaaaa

SEQ ID NO: 2063385 - RNA, 17 nt, Staphylococcus aureus subsp. aureus Mu50
uuuagauucuuuucuga

SEQ ID NO: 2063386 - RNA, 14 nt, Staphylococcus aureus subsp. aureus Mu50
uuuagauuuaguuu

SEQ ID NO: 2063387 - RNA, 13 nt, Staphylococcus aureus subsp. aureus Mu50
uuuagauuuauaa

SEQ ID NO: 2063388 - RNA, 16 nt, Staphylococcus aureus subsp. aureus Mu50
uuuauaauucuaaguc

SEQ ID NO: 2063389 - RNA, 18 nt, Staphylococcus aureus subsp. aureus Mu50
uuuauacauguacauuau

SEQ ID NO: 2063390 - RNA, 17 nt, Staphylococcus aureus subsp. aureus Mu50
uuuauacuauaaauaca

SEQ ID NO: 2063391 - RNA, 14 nt, Staphylococcus aureus subsp. aureus Mu50
uuuauagaaaauua

SEQ ID NO: 2063392 - RNA, 18 nt, Staphylococcus aureus subsp. aureus Mu50
uuuauaaacaauaaaaaa

SEQ ID NO: 2063393 - RNA, 23 nt, Staphylococcus aureus subsp. aureus Mu50
uuuauaaaugaauuauuuaaaau

SEQ ID NO: 2063394 - RNA, 10 nt, Staphylococcus aureus subsp. aureus Mu50
uuuauaagcu

SEQ ID NO: 2063395 - RNA, 12 nt, Staphylococcus aureus subsp. aureus Mu50
uuuauaaguauu

SEQ ID NO: 2063396 - RNA, 22 nt, Staphylococcus aureus subsp. aureus Mu50
uuuauaagaacaugauacugaa

SEQ ID NO: 2063397 - RNA, 22 nt, Staphylococcus aureus subsp. aureus Mu50
uuuauaagccuuuucaaacaua

SEQ ID NO: 2063398 - RNA, 14 nt, Staphylococcus aureus subsp. aureus Mu50
uuuauaaauuauag

SEQ ID NO: 2063399 - RNA, 15 nt, Staphylococcus aureus subsp. aureus Mu50
uuuauaaauuaaaug

SEQ ID NO: 2063400 - RNA, 19 nt, Staphylococcus aureus subsp. aureus Mu50
uuuaucagcgaaauuugua

SEQ ID NO: 2063401 - RNA, 16 nt, Staphylococcus aureus subsp. aureus Mu50
uuuaucaacaaauuua

SEQ ID NO: 2063402 - RNA, 12 nt, Staphylococcus aureus subsp. aureus Mu50
uuuauauuuuau

SEQ ID NO: 2063403 - RNA, 13 nt, Staphylococcus aureus subsp. aureus Mu50
uuuaucaauuucu

SEQ ID NO: 2063404 - RNA, 19 nt, Staphylococcus aureus subsp. aureus Mu50
uuuaucaacauaaaauuua

SEQ ID NO: 2063405 - RNA, 15 nt, Staphylococcus aureus subsp. aureus Mu50
uuuaucaauuucucu

SEQ ID NO: 2063406 - RNA, 12 nt, Staphylococcus aureus subsp. aureus Mu50
uuuaucaauaaa

SEQ ID NO: 2063407 - RNA, 16 nt, Staphylococcus aureus subsp. aureus Mu50
uuuaucaacaaauuuu

SEQ ID NO: 2063408 - RNA, 21 nt, Staphylococcus aureus subsp. aureus Mu50
uuuauauauaaaaucauuaau

SEQ ID NO: 2063409 - RNA, 14 nt, Staphylococcus aureus subsp. aureus Mu50
uuuauaucaaaaaa

SEQ ID NO: 2063410 - RNA, 17 nt, Staphylococcus aureus subsp. aureus Mu50
uuuauaucuuucugaag

SEQ ID NO: 2063411 - RNA, 22 nt, Staphylococcus aureus subsp. aureus Mu50
uuuauaucuuaaguacauaaau

SEQ ID NO: 2063412 - RNA, 13 nt, Staphylococcus aureus subsp. aureus Mu50
uuuauauccaucu

SEQ ID NO: 2063413 - RNA, 16 nt, Staphylococcus aureus subsp. aureus Mu50
uuuauaucaaaaaaua

SEQ ID NO: 2063414 - RNA, 17 nt, Staphylococcus aureus subsp. aureus Mu50
uuuauauuuuuaucauc

SEQ ID NO: 2063415 - RNA, 23 nt, Staphylococcus aureus subsp. aureus Mu50
uuuauauuuuaguucacaugaau

SEQ ID NO: 2063416 - RNA, 13 nt, Staphylococcus aureus subsp. aureus Mu50
uuuauauuuauuu

SEQ ID NO: 2063417 - RNA, 14 nt, Staphylococcus aureus subsp. aureus Mu50
uuuauauuuaucag

SEQ ID NO: 2063418 - RNA, 13 nt, Staphylococcus aureus subsp. aureus Mu50
uuuauauucuaau

SEQ ID NO: 2063419 - RNA, 16 nt, Staphylococcus aureus subsp. aureus Mu50
uuuauauuaaauacua

SEQ ID NO: 2063420 - RNA, 21 nt, Staphylococcus aureus subsp. aureus Mu50
uuuauauuaaauacuauauau

SEQ ID NO: 2063421 - RNA, 21 nt, Staphylococcus aureus subsp. aureus Mu50
uuuaucuuauuauuaauuccu

SEQ ID NO: 2063422 - RNA, 19 nt, Staphylococcus aureus subsp. aureus Mu50
uuuaucugaauuuuacuga

SEQ ID NO: 2063423 - RNA, 23 nt, Staphylococcus aureus subsp. aureus Mu50
uuuaucuucaguaauuucuccaa

SEQ ID NO: 2063424 - RNA, 19 nt, Staphylococcus aureus subsp. aureus Mu50
uuuaucuacauuaaagaaa

SEQ ID NO: 2063425 - RNA, 16 nt, Staphylococcus aureus subsp. aureus Mu50
uuuaucuauaugcaua

SEQ ID NO: 2063426 - RNA, 16 nt, Staphylococcus aureus subsp. aureus Mu50
uuuaucgaaauauuua

SEQ ID NO: 2063427 - RNA, 15 nt, Staphylococcus aureus subsp. aureus Mu50
uuuaucgccaauuaa

SEQ ID NO: 2063428 - RNA, 13 nt, Staphylococcus aureus subsp. aureus Mu50
uuuaucauuauuu

SEQ ID NO: 2063429 - RNA, 19 nt, Staphylococcus aureus subsp. aureus Mu50
uuuaucaugaugauaaauu

SEQ ID NO: 2063430 - RNA, 20 nt, Staphylococcus aureus subsp. aureus Mu50
uuuaucauuauuugauaaau

SEQ ID NO: 2063431 - RNA, 12 nt, Staphylococcus aureus subsp. aureus Mu50
uuuauccaaacc

SEQ ID NO: 2063432 - RNA, 22 nt, Staphylococcus aureus subsp. aureus Mu50
uuuaucaucaugacuauuucgc

SEQ ID NO: 2063433 - RNA, 19 nt, Staphylococcus aureus subsp. aureus Mu50
uuuauccaaaccaauuuua

SEQ ID NO: 2063434 - RNA, 17 nt, Staphylococcus aureus subsp. aureus Mu50
uuuauguuugauuuuau

SEQ ID NO: 2063435 - RNA, 18 nt, Staphylococcus aureus subsp. aureus Mu50
uuuauguuuuaauuucuu

SEQ ID NO: 2063436 - RNA, 23 nt, Staphylococcus aureus subsp. aureus Mu50
uuuaugguguagcugaggauuuu

SEQ ID NO: 2063437 - RNA, 17 nt, Staphylococcus aureus subsp. aureus Mu50
uuuauggcgguuugaaa

SEQ ID NO: 2063438 - RNA, 21 nt, Staphylococcus aureus subsp. aureus Mu50
uuuauuaauggcaacuaagau

SEQ ID NO: 2063439 - RNA, 17 nt, Staphylococcus aureus subsp. aureus Mu50
uuuauuaauauuaguga

SEQ ID NO: 2063440 - RNA, 13 nt, Staphylococcus aureus subsp. aureus Mu50
uuuauuaaauaua

SEQ ID NO: 2063441 - RNA, 18 nt, Staphylococcus aureus subsp. aureus Mu50
uuuauuaauaaauucucu

SEQ ID NO: 2063442 - RNA, 20 nt, Staphylococcus aureus subsp. aureus Mu50
uuuaugauaauaagaauauu

SEQ ID NO: 2063443 - RNA, 17 nt, Staphylococcus aureus subsp. aureus Mu50
uuuaugauaauaagaau

SEQ ID NO: 2063444 - RNA, 17 nt, Staphylococcus aureus subsp. aureus Mu50
uuuaugaagugaaauca

SEQ ID NO: 2063445 - RNA, 16 nt, Staphylococcus aureus subsp. aureus Mu50
uuuaugacaaaguucu

SEQ ID NO: 2063446 - RNA, 19 nt, Staphylococcus aureus subsp. aureus Mu50
uuuaugcaugcgcaaaagc

SEQ ID NO: 2063447 - RNA, 16 nt, Staphylococcus aureus subsp. aureus Mu50
uuuauggagugauaua

SEQ ID NO: 2063448 - RNA, 17 nt, Staphylococcus aureus subsp. aureus Mu50
uuucauuuaauccuucu

SEQ ID NO: 2063449 - RNA, 17 nt, Staphylococcus aureus subsp. aureus Mu50
uuucauuuacuucuucu

SEQ ID NO: 2063450 - RNA, 20 nt, Staphylococcus aureus subsp. aureus Mu50
uuucauuguaacucaauaug

SEQ ID NO: 2063451 - RNA, 14 nt, Staphylococcus aureus subsp. aureus Mu50
uuucauuguaauaa

SEQ ID NO: 2063452 - RNA, 13 nt, Staphylococcus aureus subsp. aureus Mu50
uuuccaauuuguu

SEQ ID NO: 2063453 - RNA, 13 nt, Staphylococcus aureus subsp. aureus Mu50
uuuccaauaucuu

SEQ ID NO: 2063454 - RNA, 15 nt, Staphylococcus aureus subsp. aureus Mu50
uuuccaauaucuucu

SEQ ID NO: 2063455 - RNA, 18 nt, Staphylococcus aureus subsp. aureus Mu50
uuuccaaauugcaaagua

SEQ ID NO: 2063456 - RNA, 20 nt, Staphylococcus aureus subsp. aureus Mu50
uuucauguuugauucuaaau

SEQ ID NO: 2063457 - RNA, 22 nt, Staphylococcus aureus subsp. aureus Mu50
uuucauguuugauucuaaauaa

SEQ ID NO: 2063458 - RNA, 16 nt, Staphylococcus aureus subsp. aureus Mu50
uuucauuaauuuuuca

SEQ ID NO: 2063459 - RNA, 15 nt, Staphylococcus aureus subsp. aureus Mu50
uuucaugaaaaguug

SEQ ID NO: 2063460 - RNA, 18 nt, Staphylococcus aureus subsp. aureus Mu50
uuucaucuuucaaaugcu

SEQ ID NO: 2063461 - RNA, 13 nt, Staphylococcus aureus subsp. aureus Mu50
uuucaucaauauc

SEQ ID NO: 2063462 - RNA, 19 nt, Staphylococcus aureus subsp. aureus Mu50
uuucaucaugugcuuuguu

SEQ ID NO: 2063463 - RNA, 20 nt, Staphylococcus aureus subsp. aureus Mu50
uuucaucaugugcuuuguuu

SEQ ID NO: 2063464 - RNA, 15 nt, Staphylococcus aureus subsp. aureus Mu50
uuucaucauuaguuu

SEQ ID NO: 2063465 - RNA, 16 nt, Staphylococcus aureus subsp. aureus Mu50
uuucagcaguugcaca

SEQ ID NO: 2063466 - RNA, 18 nt, Staphylococcus aureus subsp. aureus Mu50
uuucagccacugucaugu

SEQ ID NO: 2063467 - RNA, 17 nt, Staphylococcus aureus subsp. aureus Mu50
uuucacuugaccacuuu

SEQ ID NO: 2063468 - RNA, 19 nt, Staphylococcus aureus subsp. aureus Mu50
uuucaggcuuuguuuuuca

SEQ ID NO: 2063469 - RNA, 18 nt, Staphylococcus aureus subsp. aureus Mu50
uuucauagaaccauuucu

SEQ ID NO: 2063470 - RNA, 23 nt, Staphylococcus aureus subsp. aureus Mu50
uuucauauaaauagcuucuuaaa

SEQ ID NO: 2063471 - RNA, 19 nt, Staphylococcus aureus subsp. aureus Mu50
uuucauauucacaucuuua

SEQ ID NO: 2063472 - RNA, 19 nt, Staphylococcus aureus subsp. aureus Mu50
uuucauaugcaucaacaga

SEQ ID NO: 2063473 - RNA, 18 nt, Staphylococcus aureus subsp. aureus Mu50
uuucauaauuaauaacau

SEQ ID NO: 2063474 - RNA, 23 nt, Staphylococcus aureus subsp. aureus Mu50
uuucauaauuaacacauucaaau

SEQ ID NO: 2063475 - RNA, 13 nt, Staphylococcus aureus subsp. aureus Mu50
uuucaauaaauaa

SEQ ID NO: 2063476 - RNA, 16 nt, Staphylococcus aureus subsp. aureus Mu50
uuucaacauaauauuu

SEQ ID NO: 2063477 - RNA, 15 nt, Staphylococcus aureus subsp. aureus Mu50
uuucaacauaauauu

SEQ ID NO: 2063478 - RNA, 18 nt, Staphylococcus aureus subsp. aureus Mu50
uuucaacgcauauucuau

SEQ ID NO: 2063479 - RNA, 23 nt, Staphylococcus aureus subsp. aureus Mu50
uuucaacuuuugaggagauagua

SEQ ID NO: 2063480 - RNA, 21 nt, Staphylococcus aureus subsp. aureus Mu50
uuucacgauuuuuaaaaugcu

SEQ ID NO: 2063481 - RNA, 14 nt, Staphylococcus aureus subsp. aureus Mu50
uuucaauuaaaugu

SEQ ID NO: 2063482 - RNA, 20 nt, Staphylococcus aureus subsp. aureus Mu50
uuucaauuaauuuaaaugcu

SEQ ID NO: 2063483 - RNA, 12 nt, Staphylococcus aureus subsp. aureus Mu50
uuuauucuuccc

SEQ ID NO: 2063484 - RNA, 21 nt, Staphylococcus aureus subsp. aureus Mu50
uuuauugagcuuuguuugaaa

SEQ ID NO: 2063485 - RNA, 19 nt, Staphylococcus aureus subsp. aureus Mu50
uuuauugaggauaauuauu

SEQ ID NO: 2063486 - RNA, 14 nt, Staphylococcus aureus subsp. aureus Mu50
uuuauuuauucuaa

SEQ ID NO: 2063487 - RNA, 22 nt, Staphylococcus aureus subsp. aureus Mu50
uuuauuuauaaaauaaaaugca

SEQ ID NO: 2063488 - RNA, 13 nt, Staphylococcus aureus subsp. aureus Mu50
uuuauuuaacacu

SEQ ID NO: 2063489 - RNA, 12 nt, Staphylococcus aureus subsp. aureus Mu50
uuuauuaucagc

SEQ ID NO: 2063490 - RNA, 19 nt, Staphylococcus aureus subsp. aureus Mu50
uuuauuaguauucaaaaaa

SEQ ID NO: 2063491 - RNA, 21 nt, Staphylococcus aureus subsp. aureus Mu50
uuuauuacuuuaauuuaguga

SEQ ID NO: 2063492 - RNA, 14 nt, Staphylococcus aureus subsp. aureus Mu50
uuuauuagaaugaa

SEQ ID NO: 2063493 - RNA, 15 nt, Staphylococcus aureus subsp. aureus Mu50
uuuauucgcuuguuc

SEQ ID NO: 2063494 - RNA, 16 nt, Staphylococcus aureus subsp. aureus Mu50
uuuauucuaaguuaaa

SEQ ID NO: 2063495 - RNA, 15 nt, Staphylococcus aureus subsp. aureus Mu50
uuuauucaaaucaua

SEQ ID NO: 2063496 - RNA, 19 nt, Staphylococcus aureus subsp. aureus Mu50
uuuauuuucaauaaauaaa

SEQ ID NO: 2063497 - RNA, 16 nt, Staphylococcus aureus subsp. aureus Mu50
uuuauuugucuuugaa

SEQ ID NO: 2063498 - RNA, 16 nt, Staphylococcus aureus subsp. aureus Mu50
uuuauuuuaauauuuu

SEQ ID NO: 2063499 - RNA, 14 nt, Staphylococcus aureus subsp. aureus Mu50
uuuauuuuauaaga

SEQ ID NO: 2063500 - RNA, 22 nt, Staphylococcus aureus subsp. aureus Mu50
uuuauuuuuggauucaccaauu

SEQ ID NO: 2063501 - RNA, 11 nt, Staphylococcus aureus subsp. aureus Mu50
uuuauuuuuuu

SEQ ID NO: 2063502 - RNA, 24 nt, Staphylococcus aureus subsp. aureus Mu50
uuucaaaacuagcaguaauauguu

SEQ ID NO: 2063503 - RNA, 14 nt, Staphylococcus aureus subsp. aureus Mu50
uuucaaaacugcca

SEQ ID NO: 2063504 - RNA, 23 nt, Staphylococcus aureus subsp. aureus Mu50
uuucaaauuaauuaaaccaauac

SEQ ID NO: 2063505 - RNA, 23 nt, Staphylococcus aureus subsp. aureus Mu50
uuucaaagcugucaacuugucua

SEQ ID NO: 2063506 - RNA, 22 nt, Staphylococcus aureus subsp. aureus Mu50
uuucaaauaauauaaaacgaua

SEQ ID NO: 2063507 - RNA, 14 nt, Staphylococcus aureus subsp. aureus Mu50
uuucaaauaagaau

SEQ ID NO: 2063508 - RNA, 13 nt, Staphylococcus aureus subsp. aureus Mu50
uuucaaacauauu

SEQ ID NO: 2063509 - RNA, 14 nt, Staphylococcus aureus subsp. aureus Mu50
uuucuggcucuucu

SEQ ID NO: 2063510 - RNA, 15 nt, Staphylococcus aureus subsp. aureus Mu50
uuucuggcucuucuu

SEQ ID NO: 2063511 - RNA, 19 nt, Staphylococcus aureus subsp. aureus Mu50
uuucuguuuaauuaaaaua

SEQ ID NO: 2063512 - RNA, 22 nt, Staphylococcus aureus subsp. aureus Mu50
uuucuucagaaccuugaaugau

SEQ ID NO: 2063513 - RNA, 13 nt, Staphylococcus aureus subsp. aureus Mu50
uuucuuauguaua

SEQ ID NO: 2063514 - RNA, 16 nt, Staphylococcus aureus subsp. aureus Mu50
uuucuuauuuguaauu

SEQ ID NO: 2063515 - RNA, 14 nt, Staphylococcus aureus subsp. aureus Mu50
uuucuuagauacuc

SEQ ID NO: 2063516 - RNA, 15 nt, Staphylococcus aureus subsp. aureus Mu50
uuucuuaacauaaaa

SEQ ID NO: 2063517 - RNA, 17 nt, Staphylococcus aureus subsp. aureus Mu50
uuucuuguguauuuuua

SEQ ID NO: 2063518 - RNA, 23 nt, Staphylococcus aureus subsp. aureus Mu50
uuucuugaugaauuaaacugauc

SEQ ID NO: 2063519 - RNA, 15 nt, Staphylococcus aureus subsp. aureus Mu50
uuucuuuauuuuaaa

SEQ ID NO: 2063520 - RNA, 16 nt, Staphylococcus aureus subsp. aureus Mu50
uuucuucuuuuuccca

SEQ ID NO: 2063521 - RNA, 21 nt, Staphylococcus aureus subsp. aureus Mu50
uuucuucauuuucauuguaug

SEQ ID NO: 2063522 - RNA, 19 nt, Staphylococcus aureus subsp. aureus Mu50
uuucuucauaguucaaauu

SEQ ID NO: 2063523 - RNA, 15 nt, Staphylococcus aureus subsp. aureus Mu50
uuugaacauauuaua

SEQ ID NO: 2063524 - RNA, 23 nt, Staphylococcus aureus subsp. aureus Mu50
uuugaacaacaucuuuuguuguu

SEQ ID NO: 2063525 - RNA, 16 nt, Staphylococcus aureus subsp. aureus Mu50
uuugaaccuaaauucc

SEQ ID NO: 2063526 - RNA, 20 nt, Staphylococcus aureus subsp. aureus Mu50
uuugaaggagauauuuucuu

SEQ ID NO: 2063527 - RNA, 14 nt, Staphylococcus aureus subsp. aureus Mu50
uuucuuucuuuucu

SEQ ID NO: 2063528 - RNA, 22 nt, Staphylococcus aureus subsp. aureus Mu50
uuucuuugauaacaauuuuaaa

SEQ ID NO: 2063529 - RNA, 16 nt, Staphylococcus aureus subsp. aureus Mu50
uuugaauauacuuaau

SEQ ID NO: 2063530 - RNA, 12 nt, Staphylococcus aureus subsp. aureus Mu50
uuugaaugcaaa

SEQ ID NO: 2063531 - RNA, 22 nt, Staphylococcus aureus subsp. aureus Mu50
uuugaaugcaaaucaaauacau

SEQ ID NO: 2063532 - RNA, 17 nt, Staphylococcus aureus subsp. aureus Mu50
uuugacaaauccuaauu

SEQ ID NO: 2063533 - RNA, 12 nt, Staphylococcus aureus subsp. aureus Mu50
uuugaauuuuau

SEQ ID NO: 2063534 - RNA, 17 nt, Staphylococcus aureus subsp. aureus Mu50
uuugaauugacuuacau

SEQ ID NO: 2063535 - RNA, 12 nt, Staphylococcus aureus subsp. aureus Mu50
uuugaauuggga

SEQ ID NO: 2063536 - RNA, 19 nt, Staphylococcus aureus subsp. aureus Mu50
uuugacauauuuuuuaaau

SEQ ID NO: 2063537 - RNA, 16 nt, Staphylococcus aureus subsp. aureus Mu50
uuugacaucuauuucu

SEQ ID NO: 2063538 - RNA, 14 nt, Staphylococcus aureus subsp. aureus Mu50
uuugagagauuauu

SEQ ID NO: 2063539 - RNA, 14 nt, Staphylococcus aureus subsp. aureus Mu50
uuugagaaaugaaa

SEQ ID NO: 2063540 - RNA, 14 nt, Staphylococcus aureus subsp. aureus Mu50
uuugaguaaauuaa

SEQ ID NO: 2063541 - RNA, 15 nt, Staphylococcus aureus subsp. aureus Mu50
uuugaguaaauuaau

SEQ ID NO: 2063542 - RNA, 21 nt, Staphylococcus aureus subsp. aureus Mu50
uuugagguguggaguaaagau

SEQ ID NO: 2063543 - RNA, 18 nt, Staphylococcus aureus subsp. aureus Mu50
uuugaguauccaauacua

SEQ ID NO: 2063544 - RNA, 19 nt, Staphylococcus aureus subsp. aureus Mu50
uuugauaagugaugugaug

SEQ ID NO: 2063545 - RNA, 17 nt, Staphylococcus aureus subsp. aureus Mu50
uuugauaguaauaguua

SEQ ID NO: 2063546 - RNA, 23 nt, Staphylococcus aureus subsp. aureus Mu50
uuugauauaaaaagugaaaguau

SEQ ID NO: 2063547 - RNA, 16 nt, Staphylococcus aureus subsp. aureus Mu50
uuugauuuugaauaaa

SEQ ID NO: 2063548 - RNA, 13 nt, Staphylococcus aureus subsp. aureus Mu50
uuugauuuugaau

SEQ ID NO: 2063549 - RNA, 20 nt, Staphylococcus aureus subsp. aureus Mu50
uuugauuuggguaauguuuu

SEQ ID NO: 2063550 - RNA, 13 nt, Staphylococcus aureus subsp. aureus Mu50
uuugauuguuuaa

SEQ ID NO: 2063551 - RNA, 12 nt, Staphylococcus aureus subsp. aureus Mu50
uuugauugauau

SEQ ID NO: 2063552 - RNA, 16 nt, Staphylococcus aureus subsp. aureus Mu50
uuugauucuaaauaau

SEQ ID NO: 2063553 - RNA, 17 nt, Staphylococcus aureus subsp. aureus Mu50
uuugauuaguaaauaua

SEQ ID NO: 2063554 - RNA, 16 nt, Staphylococcus aureus subsp. aureus Mu50
uuugauuauauuuauu

SEQ ID NO: 2063555 - RNA, 17 nt, Staphylococcus aureus subsp. aureus Mu50
uuugaucaacuauauau

SEQ ID NO: 2063556 - RNA, 20 nt, Staphylococcus aureus subsp. aureus Mu50
uuugauccaaaguacucaag

SEQ ID NO: 2063557 - RNA, 16 nt, Staphylococcus aureus subsp. aureus Mu50
uuugauguucacuaaa

SEQ ID NO: 2063558 - RNA, 15 nt, Staphylococcus aureus subsp. aureus Mu50
uuugauguuuucuau

SEQ ID NO: 2063559 - RNA, 23 nt, Staphylococcus aureus subsp. aureus Mu50
uuugauguuuucuauaauauuua

SEQ ID NO: 2063560 - RNA, 21 nt, Staphylococcus aureus subsp. aureus Mu50
uuugccagucauuguauaaaa

SEQ ID NO: 2063561 - RNA, 18 nt, Staphylococcus aureus subsp. aureus Mu50
uuugcaccuauaccucgu

SEQ ID NO: 2063562 - RNA, 20 nt, Staphylococcus aureus subsp. aureus Mu50
uuugcaauugcaaugaauaa

SEQ ID NO: 2063563 - RNA, 17 nt, Staphylococcus aureus subsp. aureus Mu50
uuugcacaaagauaugu

SEQ ID NO: 2063564 - RNA, 14 nt, Staphylococcus aureus subsp. aureus Mu50
uuugcaaucaucug

SEQ ID NO: 2063565 - RNA, 19 nt, Staphylococcus aureus subsp. aureus Mu50
uuugcaacauauuuucaca

SEQ ID NO: 2063566 - RNA, 16 nt, Staphylococcus aureus subsp. aureus Mu50
uuugcauacauaucuu

SEQ ID NO: 2063567 - RNA, 18 nt, Staphylococcus aureus subsp. aureus Mu50
uuuccuacacuguuuuau

SEQ ID NO: 2063568 - RNA, 11 nt, Staphylococcus aureus subsp. aureus Mu50
uuuccucuuua

SEQ ID NO: 2063569 - RNA, 18 nt, Staphylococcus aureus subsp. aureus Mu50
uuucgaacgcuugaaaaa

SEQ ID NO: 2063570 - RNA, 22 nt, Staphylococcus aureus subsp. aureus Mu50
uuucgaaaagaaauucuacagg

SEQ ID NO: 2063571 - RNA, 21 nt, Staphylococcus aureus subsp. aureus Mu50
uuucgacaucuagaugaaauu

SEQ ID NO: 2063572 - RNA, 21 nt, Staphylococcus aureus subsp. aureus Mu50
uuucgaacuuuuguucuaagu

SEQ ID NO: 2063573 - RNA, 21 nt, Staphylococcus aureus subsp. aureus Mu50
uuucgaguaugguugauuaca

SEQ ID NO: 2063574 - RNA, 20 nt, Staphylococcus aureus subsp. aureus Mu50
uuucgaccgcguauuccauu

SEQ ID NO: 2063575 - RNA, 22 nt, Staphylococcus aureus subsp. aureus Mu50
uuucgacguaccaauuagcaug

SEQ ID NO: 2063576 - RNA, 20 nt, Staphylococcus aureus subsp. aureus Mu50
uuuccauaaauaaaaugcua

SEQ ID NO: 2063577 - RNA, 23 nt, Staphylococcus aureus subsp. aureus Mu50
uuucccuacugcuugugugaaau

SEQ ID NO: 2063578 - RNA, 14 nt, Staphylococcus aureus subsp. aureus Mu50
uuucccauuuaucu

SEQ ID NO: 2063579 - RNA, 23 nt, Staphylococcus aureus subsp. aureus Mu50
uuucuaaaugauuuauucuaaau

SEQ ID NO: 2063580 - RNA, 19 nt, Staphylococcus aureus subsp. aureus Mu50
uuucuaaauucuuuuuguu

SEQ ID NO: 2063581 - RNA, 15 nt, Staphylococcus aureus subsp. aureus Mu50
uuucuaaugcucauu

SEQ ID NO: 2063582 - RNA, 23 nt, Staphylococcus aureus subsp. aureus Mu50
uuucuaauugaaaucaucuuaug

SEQ ID NO: 2063583 - RNA, 15 nt, Staphylococcus aureus subsp. aureus Mu50
uuucuaaguuuguug

SEQ ID NO: 2063584 - RNA, 17 nt, Staphylococcus aureus subsp. aureus Mu50
uuucuacuguauaagug

SEQ ID NO: 2063585 - RNA, 19 nt, Staphylococcus aureus subsp. aureus Mu50
uuucuacuguauaagugcu

SEQ ID NO: 2063586 - RNA, 17 nt, Staphylococcus aureus subsp. aureus Mu50
uuucuaggccacuaaga

SEQ ID NO: 2063587 - RNA, 21 nt, Staphylococcus aureus subsp. aureus Mu50
uuucuacucugauuacauaua

SEQ ID NO: 2063588 - RNA, 12 nt, Staphylococcus aureus subsp. aureus Mu50
uuucuagcaugu

SEQ ID NO: 2063589 - RNA, 19 nt, Staphylococcus aureus subsp. aureus Mu50
uuucggcuagauuuuaaac

SEQ ID NO: 2063590 - RNA, 17 nt, Staphylococcus aureus subsp. aureus Mu50
uuucguguuccaauuuu

SEQ ID NO: 2063591 - RNA, 19 nt, Staphylococcus aureus subsp. aureus Mu50
uuucguguuccaauuuuau

SEQ ID NO: 2063592 - RNA, 21 nt, Staphylococcus aureus subsp. aureus Mu50
uuucgucuuguaaacuucuuu

SEQ ID NO: 2063593 - RNA, 14 nt, Staphylococcus aureus subsp. aureus Mu50
uuucgucagauuca

SEQ ID NO: 2063594 - RNA, 19 nt, Staphylococcus aureus subsp. aureus Mu50
uuucguaacauuuaaaaaa

SEQ ID NO: 2063595 - RNA, 19 nt, Staphylococcus aureus subsp. aureus Mu50
uuucucgauuaauuuucuu

SEQ ID NO: 2063596 - RNA, 14 nt, Staphylococcus aureus subsp. aureus Mu50
uuucucacugcugu

SEQ ID NO: 2063597 - RNA, 14 nt, Staphylococcus aureus subsp. aureus Mu50
uuucuauucaaaaa

SEQ ID NO: 2063598 - RNA, 18 nt, Staphylococcus aureus subsp. aureus Mu50
uuucuaguuuucaugaaa

SEQ ID NO: 2063599 - RNA, 18 nt, Staphylococcus aureus subsp. aureus Mu50
uuucuauagaauuuuuca

SEQ ID NO: 2063600 - RNA, 22 nt, Staphylococcus aureus subsp. aureus Mu50
uuucugacuuuuaaaaaacaua

SEQ ID NO: 2063601 - RNA, 16 nt, Staphylococcus aureus subsp. aureus Mu50
uuucugagaagaaaua

SEQ ID NO: 2063602 - RNA, 19 nt, Staphylococcus aureus subsp. aureus Mu50
uuucugagaagaaauauau

SEQ ID NO: 2063603 - RNA, 22 nt, Staphylococcus aureus subsp. aureus Mu50
uuucugaucgacuaauuuuucu

SEQ ID NO: 2063604 - RNA, 21 nt, Staphylococcus aureus subsp. aureus Mu50
uugcgauauacgaauccucau

SEQ ID NO: 2063605 - RNA, 14 nt, Staphylococcus aureus subsp. aureus Mu50
uugccuuucauuuu

SEQ ID NO: 2063606 - RNA, 21 nt, Staphylococcus aureus subsp. aureus Mu50
uugcuaaaauaucaaaauaua

SEQ ID NO: 2063607 - RNA, 23 nt, Staphylococcus aureus subsp. aureus Mu50
uugcuauuucaacaaacauaaau

SEQ ID NO: 2063608 - RNA, 22 nt, Staphylococcus aureus subsp. aureus Mu50
uugcuaaacgcuaaaauuuccu

SEQ ID NO: 2063609 - RNA, 20 nt, Staphylococcus aureus subsp. aureus Mu50
uugcuaaaguguagccaaau

SEQ ID NO: 2063610 - RNA, 18 nt, Staphylococcus aureus subsp. aureus Mu50
uugcuaaaaaaauuaaaa

SEQ ID NO: 2063611 - RNA, 18 nt, Staphylococcus aureus subsp. aureus Mu50
uugcagauuuugcaaucu

SEQ ID NO: 2063612 - RNA, 22 nt, Staphylococcus aureus subsp. aureus Mu50
uugcacgucuuguaucaacauu

SEQ ID NO: 2063613 - RNA, 16 nt, Staphylococcus aureus subsp. aureus Mu50
uugcacuaugcauaau

SEQ ID NO: 2063614 - RNA, 17 nt, Staphylococcus aureus subsp. aureus Mu50
uugcacuaugcauaaua

SEQ ID NO: 2063615 - RNA, 21 nt, Staphylococcus aureus subsp. aureus Mu50
uugccaaaaguuauauaaauu

SEQ ID NO: 2063616 - RNA, 22 nt, Staphylococcus aureus subsp. aureus Mu50
uugcauauccuucaaagauuuu

SEQ ID NO: 2063617 - RNA, 15 nt, Staphylococcus aureus subsp. aureus Mu50
uugccaaauuucucu

SEQ ID NO: 2063618 - RNA, 22 nt, Staphylococcus aureus subsp. aureus Mu50
uugccaaaaguuauauaaauuu

SEQ ID NO: 2063619 - RNA, 21 nt, Staphylococcus aureus subsp. aureus Mu50
uugguauaagaggauuucuag

SEQ ID NO: 2063620 - RNA, 20 nt, Staphylococcus aureus subsp. aureus Mu50
uugguauacaguuuuacuau

SEQ ID NO: 2063621 - RNA, 23 nt, Staphylococcus aureus subsp. aureus Mu50
uugguauacaguuuuacuauaau

SEQ ID NO: 2063622 - RNA, 16 nt, Staphylococcus aureus subsp. aureus Mu50
uuggucaaguaaaugu

SEQ ID NO: 2063623 - RNA, 22 nt, Staphylococcus aureus subsp. aureus Mu50
uuggucaccuacagauaaagcu

SEQ ID NO: 2063624 - RNA, 16 nt, Staphylococcus aureus subsp. aureus Mu50
uuggucaaguuuuggu

SEQ ID NO: 2063625 - RNA, 16 nt, Staphylococcus aureus subsp. aureus Mu50
uugguguuuagucuuu

SEQ ID NO: 2063626 - RNA, 18 nt, Staphylococcus aureus subsp. aureus Mu50
uugguagcauuuuagauu

SEQ ID NO: 2063627 - RNA, 18 nt, Staphylococcus aureus subsp. aureus Mu50
uuggcguauuuuuuguuc

SEQ ID NO: 2063628 - RNA, 14 nt, Staphylococcus aureus subsp. aureus Mu50
uugggauauagaaa

SEQ ID NO: 2063629 - RNA, 14 nt, Staphylococcus aureus subsp. aureus Mu50
uuggauaaaaugau

SEQ ID NO: 2063630 - RNA, 18 nt, Staphylococcus aureus subsp. aureus Mu50
uuggcagugaucuuuuuu

SEQ ID NO: 2063631 - RNA, 14 nt, Staphylococcus aureus subsp. aureus Mu50
uugcuuauguuuuu

SEQ ID NO: 2063632 - RNA, 14 nt, Staphylococcus aureus subsp. aureus Mu50
uuggaaaaauugug

SEQ ID NO: 2063633 - RNA, 18 nt, Staphylococcus aureus subsp. aureus Mu50
uugcugccaaaaaguauu

SEQ ID NO: 2063634 - RNA, 22 nt, Staphylococcus aureus subsp. aureus Mu50
uugcuuaaaccuuaauaaugaa

SEQ ID NO: 2063635 - RNA, 13 nt, Staphylococcus aureus subsp. aureus Mu50
uugcuuaacuucc

SEQ ID NO: 2063636 - RNA, 15 nt, Staphylococcus aureus subsp. aureus Mu50
uugcuuuagcucuuu

SEQ ID NO: 2063637 - RNA, 15 nt, Staphylococcus aureus subsp. aureus Mu50
uuuaaaacaaugauu

SEQ ID NO: 2063638 - RNA, 22 nt, Staphylococcus aureus subsp. aureus Mu50
uuuaaaacaaugauuaaaauua

SEQ ID NO: 2063639 - RNA, 23 nt, Staphylococcus aureus subsp. aureus Mu50
uuguuuuuuauaagaacaugaua

SEQ ID NO: 2063640 - RNA, 21 nt, Staphylococcus aureus subsp. aureus Mu50
uuguuuuucacuguuaaaguc

SEQ ID NO: 2063641 - RNA, 21 nt, Staphylococcus aureus subsp. aureus Mu50
uuguuuagaagcuucugcaug

SEQ ID NO: 2063642 - RNA, 19 nt, Staphylococcus aureus subsp. aureus Mu50
uuguuuagaagcuucugca

SEQ ID NO: 2063643 - RNA, 23 nt, Staphylococcus aureus subsp. aureus Mu50
uuguuuuccaauaauaaaccuaa

SEQ ID NO: 2063644 - RNA, 20 nt, Staphylococcus aureus subsp. aureus Mu50
uuguuuugaauguuucuccu

SEQ ID NO: 2063645 - RNA, 19 nt, Staphylococcus aureus subsp. aureus Mu50
uuguuuugacaaauccuaa

SEQ ID NO: 2063646 - RNA, 16 nt, Staphylococcus aureus subsp. aureus Mu50
uuguuuuccaauaaua

SEQ ID NO: 2063647 - RNA, 12 nt, Staphylococcus aureus subsp. aureus Mu50
uuguuuucacug

SEQ ID NO: 2063648 - RNA, 22 nt, Staphylococcus aureus subsp. aureus Mu50
uuguuuucaucaugcauaauca

SEQ ID NO: 2063649 - RNA, 21 nt, Staphylococcus aureus subsp. aureus Mu50
uuguucuccgaucaugccuuc

SEQ ID NO: 2063650 - RNA, 14 nt, Staphylococcus aureus subsp. aureus Mu50
uuguucuaauuguu

SEQ ID NO: 2063651 - RNA, 22 nt, Staphylococcus aureus subsp. aureus Mu50
uuguucuccgaucaugccuuca

SEQ ID NO: 2063652 - RNA, 23 nt, Staphylococcus aureus subsp. aureus Mu50
uuguuggucuaucgccuaaaaau

SEQ ID NO: 2063653 - RNA, 14 nt, Staphylococcus aureus subsp. aureus Mu50
uuguugguuuugca

SEQ ID NO: 2063654 - RNA, 17 nt, Staphylococcus aureus subsp. aureus Mu50
uuguuuaaguuuuucag

SEQ ID NO: 2063655 - RNA, 19 nt, Staphylococcus aureus subsp. aureus Mu50
uuuaacagcgugaauauaa

SEQ ID NO: 2063656 - RNA, 16 nt, Staphylococcus aureus subsp. aureus Mu50
uuuaaaucuauauaaa

SEQ ID NO: 2063657 - RNA, 20 nt, Staphylococcus aureus subsp. aureus Mu50
uuuaaaucuguacuucuaau

SEQ ID NO: 2063658 - RNA, 18 nt, Staphylococcus aureus subsp. aureus Mu50
uuuaaaucuuguucuaau

SEQ ID NO: 2063659 - RNA, 19 nt, Staphylococcus aureus subsp. aureus Mu50
uuuaaaucuuguucuaauu

SEQ ID NO: 2063660 - RNA, 24 nt, Staphylococcus aureus subsp. aureus Mu50
uuuaacaagauaacuagcaaaugc

SEQ ID NO: 2063661 - RNA, 18 nt, Staphylococcus aureus subsp. aureus Mu50
uuuaaauaaaugacuuca

SEQ ID NO: 2063662 - RNA, 23 nt, Staphylococcus aureus subsp. aureus Mu50
uuuaaauaauaauucauaaaugc

SEQ ID NO: 2063663 - RNA, 18 nt, Staphylococcus aureus subsp. aureus Mu50
uuuaaaaucucauaauaa

SEQ ID NO: 2063664 - RNA, 15 nt, Staphylococcus aureus subsp. aureus Mu50
uuuaaauaaaugacu

SEQ ID NO: 2063665 - RNA, 13 nt, Staphylococcus aureus subsp. aureus Mu50
uuuaaaagagaau

SEQ ID NO: 2063666 - RNA, 13 nt, Staphylococcus aureus subsp. aureus Mu50
uuuaaaauauuau

SEQ ID NO: 2063667 - RNA, 15 nt, Staphylococcus aureus subsp. aureus Mu50
uuuaacggaaauaca

SEQ ID NO: 2063668 - RNA, 16 nt, Staphylococcus aureus subsp. aureus Mu50
uuuaacccacauuaaa

SEQ ID NO: 2063669 - RNA, 22 nt, Staphylococcus aureus subsp. aureus Mu50
uuuaacuuauauacguugauua

SEQ ID NO: 2063670 - RNA, 18 nt, Staphylococcus aureus subsp. aureus Mu50
uuuaacugguugauaaau

SEQ ID NO: 2063671 - RNA, 18 nt, Staphylococcus aureus subsp. aureus Mu50
uuuaacguuauucauuug

SEQ ID NO: 2063672 - RNA, 13 nt, Staphylococcus aureus subsp. aureus Mu50
uuuaacuaaacca

SEQ ID NO: 2063673 - RNA, 21 nt, Staphylococcus aureus subsp. aureus Mu50
uuuaacuauguuacuuauaua

SEQ ID NO: 2063674 - RNA, 16 nt, Staphylococcus aureus subsp. aureus Mu50
uuuaauaaaucguguu

SEQ ID NO: 2063675 - RNA, 20 nt, Staphylococcus aureus subsp. aureus Mu50
uuuaauaacguacauuuaug

SEQ ID NO: 2063676 - RNA, 19 nt, Staphylococcus aureus subsp. aureus Mu50
uuuaauaaccuuuaaaaca

SEQ ID NO: 2063677 - RNA, 14 nt, Staphylococcus aureus subsp. aureus Mu50
uuuaauaacaaaau

SEQ ID NO: 2063678 - RNA, 19 nt, Staphylococcus aureus subsp. aureus Mu50
uuuaagugaugaccaauau

SEQ ID NO: 2063679 - RNA, 14 nt, Staphylococcus aureus subsp. aureus Mu50
uuuaaguuuauaau

SEQ ID NO: 2063680 - RNA, 17 nt, Staphylococcus aureus subsp. aureus Mu50
uuuaauaaaaucaucuu

SEQ ID NO: 2063681 - RNA, 23 nt, Staphylococcus aureus subsp. aureus Mu50
uuuaauaaaaaccaauauuucug

SEQ ID NO: 2063682 - RNA, 17 nt, Staphylococcus aureus subsp. aureus Mu50
uuuaaguuuauaaucag

SEQ ID NO: 2063683 - RNA, 21 nt, Staphylococcus aureus subsp. aureus Mu50
uuuaauaaaaaccaauauuuc

SEQ ID NO: 2063684 - RNA, 22 nt, Staphylococcus aureus subsp. aureus Mu50
uuuaauucuauuuuugauuuaa

SEQ ID NO: 2063685 - RNA, 17 nt, Staphylococcus aureus subsp. aureus Mu50
uuuaauucaggaaaugc

SEQ ID NO: 2063686 - RNA, 19 nt, Staphylococcus aureus subsp. aureus Mu50
uuuaauucaggaaaugcau

SEQ ID NO: 2063687 - RNA, 14 nt, Staphylococcus aureus subsp. aureus Mu50
uuuaauuccaaaga

SEQ ID NO: 2063688 - RNA, 16 nt, Staphylococcus aureus subsp. aureus Mu50
uuuaauuauuuucucg

SEQ ID NO: 2063689 - RNA, 17 nt, Staphylococcus aureus subsp. aureus Mu50
uuuaauuagaaauucuc

SEQ ID NO: 2063690 - RNA, 14 nt, Staphylococcus aureus subsp. aureus Mu50
uuuaauuaauuauu

SEQ ID NO: 2063691 - RNA, 15 nt, Staphylococcus aureus subsp. aureus Mu50
uuuaauuaauuauua

SEQ ID NO: 2063692 - RNA, 15 nt, Staphylococcus aureus subsp. aureus Mu50
uuuaauuauuucccu

SEQ ID NO: 2063693 - RNA, 21 nt, Staphylococcus aureus subsp. aureus Mu50
uuuaauuauuucccuggaaaa

SEQ ID NO: 2063694 - RNA, 21 nt, Staphylococcus aureus subsp. aureus Mu50
uuuaauaauguaucauuucag

SEQ ID NO: 2063695 - RNA, 17 nt, Staphylococcus aureus subsp. aureus Mu50
uuuaauaccuaugauau

SEQ ID NO: 2063696 - RNA, 19 nt, Staphylococcus aureus subsp. aureus Mu50
uuuaauuaaguuaaaauaa

SEQ ID NO: 2063697 - RNA, 16 nt, Staphylococcus aureus subsp. aureus Mu50
uuuaauuaauuaucau

SEQ ID NO: 2063698 - RNA, 13 nt, Staphylococcus aureus subsp. aureus Mu50
uuuaauuguuuaa

SEQ ID NO: 2063699 - RNA, 21 nt, Staphylococcus aureus subsp. aureus Mu50
uuuaauuguuuaauaacaaaa

SEQ ID NO: 2063700 - RNA, 19 nt, Staphylococcus aureus subsp. aureus Mu50
uuuaauugguucuucuuuc

SEQ ID NO: 2063701 - RNA, 14 nt, Staphylococcus aureus subsp. aureus Mu50
uuuaauugguucuu

SEQ ID NO: 2063702 - RNA, 19 nt, Staphylococcus aureus subsp. aureus Mu50
uuuaauuuugacauaaaaa

SEQ ID NO: 2063703 - RNA, 23 nt, Staphylococcus aureus subsp. aureus Mu50
uuuaauuuugacauaaaaaauaa

SEQ ID NO: 2063704 - RNA, 20 nt, Staphylococcus aureus subsp. aureus Mu50
uuuaauuugauuaaauucuu

SEQ ID NO: 2063705 - RNA, 16 nt, Staphylococcus aureus subsp. aureus Mu50
uuuaauuuacaauuaa

SEQ ID NO: 2063706 - RNA, 21 nt, Staphylococcus aureus subsp. aureus Mu50
uuuaauuuaguuauaauuucu

SEQ ID NO: 2063707 - RNA, 18 nt, Staphylococcus aureus subsp. aureus Mu50
uuguaaucccauuuuaaa

SEQ ID NO: 2063708 - RNA, 21 nt, Staphylococcus aureus subsp. aureus Mu50
uuguaaucccauuuuaaaguc

SEQ ID NO: 2063709 - RNA, 12 nt, Staphylococcus aureus subsp. aureus Mu50
uugguuaaaguu

SEQ ID NO: 2063710 - RNA, 15 nt, Staphylococcus aureus subsp. aureus Mu50
uugguugaacuguuu

SEQ ID NO: 2063711 - RNA, 22 nt, Staphylococcus aureus subsp. aureus Mu50
uuguaagucgcucuagacauua

SEQ ID NO: 2063712 - RNA, 16 nt, Staphylococcus aureus subsp. aureus Mu50
uuguacuucuuugguc

SEQ ID NO: 2063713 - RNA, 19 nt, Staphylococcus aureus subsp. aureus Mu50
uuguacaucauuaaauauu

SEQ ID NO: 2063714 - RNA, 19 nt, Staphylococcus aureus subsp. aureus Mu50
uuguacacauccucauaau

SEQ ID NO: 2063715 - RNA, 20 nt, Staphylococcus aureus subsp. aureus Mu50
uuguacacauccucauaauu

SEQ ID NO: 2063716 - RNA, 16 nt, Staphylococcus aureus subsp. aureus Mu50
uuguaauugaaaugau

SEQ ID NO: 2063717 - RNA, 16 nt, Staphylococcus aureus subsp. aureus Mu50
uuguaauccuuguucu

SEQ ID NO: 2063718 - RNA, 21 nt, Staphylococcus aureus subsp. aureus Mu50
uuguaccaaauaaauuaaauu

SEQ ID NO: 2063719 - RNA, 23 nt, Staphylococcus aureus subsp. aureus Mu50
uuguacaguaauauucaacuugu

SEQ ID NO: 2063720 - RNA, 14 nt, Staphylococcus aureus subsp. aureus Mu50
uuguccaugccuua

SEQ ID NO: 2063721 - RNA, 16 nt, Staphylococcus aureus subsp. aureus Mu50
uugucauuuugauuaa

SEQ ID NO: 2063722 - RNA, 23 nt, Staphylococcus aureus subsp. aureus Mu50
uugucaugccgucgauagauguu

SEQ ID NO: 2063723 - RNA, 11 nt, Staphylococcus aureus subsp. aureus Mu50
uugucaugccu

SEQ ID NO: 2063724 - RNA, 19 nt, Staphylococcus aureus subsp. aureus Mu50
uugucacgauagauuuauc

SEQ ID NO: 2063725 - RNA, 16 nt, Staphylococcus aureus subsp. aureus Mu50
uuguaucaacauuaau

SEQ ID NO: 2063726 - RNA, 20 nt, Staphylococcus aureus subsp. aureus Mu50
uuguauagauuguauuuaau

SEQ ID NO: 2063727 - RNA, 21 nt, Staphylococcus aureus subsp. aureus Mu50
uugucggacgauauauacaaa

SEQ ID NO: 2063728 - RNA, 16 nt, Staphylococcus aureus subsp. aureus Mu50
uugucucaauaauguu

SEQ ID NO: 2063729 - RNA, 13 nt, Staphylococcus aureus subsp. aureus Mu50
uugugauuuuuug

SEQ ID NO: 2063730 - RNA, 20 nt, Staphylococcus aureus subsp. aureus Mu50
uugucuccacacuaaauguu

SEQ ID NO: 2063731 - RNA, 17 nt, Staphylococcus aureus subsp. aureus Mu50
uugugauuuuuaauaau

SEQ ID NO: 2063732 - RNA, 23 nt, Staphylococcus aureus subsp. aureus Mu50
uuguggcguaguuugaauuggga

SEQ ID NO: 2063733 - RNA, 13 nt, Staphylococcus aureus subsp. aureus Mu50
uuguguuugcuuu

SEQ ID NO: 2063734 - RNA, 19 nt, Staphylococcus aureus subsp. aureus Mu50
uuguucaguuaaaucugua

SEQ ID NO: 2063735 - RNA, 13 nt, Staphylococcus aureus subsp. aureus Mu50
uuguuagcaucug

SEQ ID NO: 2063736 - RNA, 23 nt, Staphylococcus aureus subsp. aureus Mu50
uuguuaauucaacggaacuacua

SEQ ID NO: 2063737 - RNA, 19 nt, Staphylococcus aureus subsp. aureus Mu50
uucuacaggcaaugcaagu

SEQ ID NO: 2063738 - RNA, 23 nt, Staphylococcus aureus subsp. aureus Mu50
uucuacaguuggagguccauaau

SEQ ID NO: 2063739 - RNA, 21 nt, Staphylococcus aureus subsp. aureus Mu50
uucuacagcacugaaaucuag

SEQ ID NO: 2063740 - RNA, 13 nt, Staphylococcus aureus subsp. aureus Mu50
uucuaauuguuuu

SEQ ID NO: 2063741 - RNA, 22 nt, Staphylococcus aureus subsp. aureus Mu50
uucuacaacuucauuaguugcc

SEQ ID NO: 2063742 - RNA, 23 nt, Staphylococcus aureus subsp. aureus Mu50
uucuaaagcgauuuccaucauuu

SEQ ID NO: 2063743 - RNA, 13 nt, Staphylococcus aureus subsp. aureus Mu50
uucuaauuuuuca

SEQ ID NO: 2063744 - RNA, 13 nt, Staphylococcus aureus subsp. aureus Mu50
uucuaauuugcaa

SEQ ID NO: 2063745 - RNA, 19 nt, Staphylococcus aureus subsp. aureus Mu50
uucuaauuguuguaauucu

SEQ ID NO: 2063746 - RNA, 14 nt, Staphylococcus aureus subsp. aureus Mu50
uucuaauucugaaa

SEQ ID NO: 2063747 - RNA, 17 nt, Staphylococcus aureus subsp. aureus Mu50
uucuaaaagaauuauuc

SEQ ID NO: 2063748 - RNA, 22 nt, Staphylococcus aureus subsp. aureus Mu50
uucuaaaagaauuauucaagua

SEQ ID NO: 2063749 - RNA, 17 nt, Staphylococcus aureus subsp. aureus Mu50
uucuauauaauuuauuu

SEQ ID NO: 2063750 - RNA, 13 nt, Staphylococcus aureus subsp. aureus Mu50
uucuauagaaaaa

SEQ ID NO: 2063751 - RNA, 17 nt, Staphylococcus aureus subsp. aureus Mu50
uucuauauaguaaaaua

SEQ ID NO: 2063752 - RNA, 18 nt, Staphylococcus aureus subsp. aureus Mu50
uucuauauaguaaaauaa

SEQ ID NO: 2063753 - RNA, 13 nt, Staphylococcus aureus subsp. aureus Mu50
uucuaucuucaca

SEQ ID NO: 2063754 - RNA, 23 nt, Staphylococcus aureus subsp. aureus Mu50
uucuaucacacgcauacaggaaa

SEQ ID NO: 2063755 - RNA, 13 nt, Staphylococcus aureus subsp. aureus Mu50
uucuaucaaauaa

SEQ ID NO: 2063756 - RNA, 20 nt, Staphylococcus aureus subsp. aureus Mu50
uucuauuuuugauuuaauaa

SEQ ID NO: 2063757 - RNA, 16 nt, Staphylococcus aureus subsp. aureus Mu50
uucuauuuucauagau

SEQ ID NO: 2063758 - RNA, 19 nt, Staphylococcus aureus subsp. aureus Mu50
uucuauuaaacauuuuuga

SEQ ID NO: 2063759 - RNA, 13 nt, Staphylococcus aureus subsp. aureus Mu50
uucuauuaauaau

SEQ ID NO: 2063760 - RNA, 12 nt, Staphylococcus aureus subsp. aureus Mu50
uucuauucaaaa

SEQ ID NO: 2063761 - RNA, 15 nt, Staphylococcus aureus subsp. aureus Mu50
uucguauguuucuuu

SEQ ID NO: 2063762 - RNA, 20 nt, Staphylococcus aureus subsp. aureus Mu50
uucguauguuucuuuauuau

SEQ ID NO: 2063763 - RNA, 21 nt, Staphylococcus aureus subsp. aureus Mu50
uucguauauuacaucuauauu

SEQ ID NO: 2063764 - RNA, 19 nt, Staphylococcus aureus subsp. aureus Mu50
uucguagcaugacauuaag

SEQ ID NO: 2063765 - RNA, 17 nt, Staphylococcus aureus subsp. aureus Mu50
uucguuguucauaauca

SEQ ID NO: 2063766 - RNA, 20 nt, Staphylococcus aureus subsp. aureus Mu50
uuaucacgugcuucguuuuu

SEQ ID NO: 2063767 - RNA, 16 nt, Staphylococcus aureus subsp. aureus Mu50
uuaucagcuuuaauaa

SEQ ID NO: 2063768 - RNA, 22 nt, Staphylococcus aureus subsp. aureus Mu50
uuaucagcauuaaucguauuuu

SEQ ID NO: 2063769 - RNA, 15 nt, Staphylococcus aureus subsp. aureus Mu50
uucucccuuaaauac

SEQ ID NO: 2063770 - RNA, 14 nt, Staphylococcus aureus subsp. aureus Mu50
uucucucuuauuaa

SEQ ID NO: 2063771 - RNA, 20 nt, Staphylococcus aureus subsp. aureus Mu50
uucucuaucaguaugaaguu

SEQ ID NO: 2063772 - RNA, 16 nt, Staphylococcus aureus subsp. aureus Mu50
uucucaauuaauuuag

SEQ ID NO: 2063773 - RNA, 15 nt, Staphylococcus aureus subsp. aureus Mu50
uucucugcuucuaaa

SEQ ID NO: 2063774 - RNA, 19 nt, Staphylococcus aureus subsp. aureus Mu50
uucucuguagauaucaaag

SEQ ID NO: 2063775 - RNA, 19 nt, Staphylococcus aureus subsp. aureus Mu50
uucugcaugggcuucugcu

SEQ ID NO: 2063776 - RNA, 21 nt, Staphylococcus aureus subsp. aureus Mu50
uucugccauaaacauggucaa

SEQ ID NO: 2063777 - RNA, 21 nt, Staphylococcus aureus subsp. aureus Mu50
uucugucgcuucuucuucaga

SEQ ID NO: 2063778 - RNA, 13 nt, Staphylococcus aureus subsp. aureus Mu50
uucugucuguaaa

SEQ ID NO: 2063779 - RNA, 23 nt, Staphylococcus aureus subsp. aureus Mu50
uucuguguuggggcccacacccc

SEQ ID NO: 2063780 - RNA, 19 nt, Staphylococcus aureus subsp. aureus Mu50
uucuguugcaguuucaauc

SEQ ID NO: 2063781 - RNA, 16 nt, Staphylococcus aureus subsp. aureus Mu50
uucuuaaaucaacauc

SEQ ID NO: 2063782 - RNA, 20 nt, Staphylococcus aureus subsp. aureus Mu50
uucuuaaaauaugauuuaaa

SEQ ID NO: 2063783 - RNA, 16 nt, Staphylococcus aureus subsp. aureus Mu50
uucuucuaauucugaa

SEQ ID NO: 2063784 - RNA, 14 nt, Staphylococcus aureus subsp. aureus Mu50
uucuuauaaaauaa

SEQ ID NO: 2063785 - RNA, 14 nt, Staphylococcus aureus subsp. aureus Mu50
uucuuauaaaaauc

SEQ ID NO: 2063786 - RNA, 16 nt, Staphylococcus aureus subsp. aureus Mu50
uucuuauaaaaaucuu

SEQ ID NO: 2063787 - RNA, 18 nt, Staphylococcus aureus subsp. aureus Mu50
uucuuaguuugacaucua

SEQ ID NO: 2063788 - RNA, 16 nt, Staphylococcus aureus subsp. aureus Mu50
uucuuaacauaaaaug

SEQ ID NO: 2063789 - RNA, 18 nt, Staphylococcus aureus subsp. aureus Mu50
uucuuaacauccuuugau

SEQ ID NO: 2063790 - RNA, 13 nt, Staphylococcus aureus subsp. aureus Mu50
uucuuaucaguuu

SEQ ID NO: 2063791 - RNA, 17 nt, Staphylococcus aureus subsp. aureus Mu50
uucuuaucauuucaaau

SEQ ID NO: 2063792 - RNA, 21 nt, Staphylococcus aureus subsp. aureus Mu50
uugauaucgaaacgcuuugca

SEQ ID NO: 2063793 - RNA, 13 nt, Staphylococcus aureus subsp. aureus Mu50
uugauauauauuu

SEQ ID NO: 2063794 - RNA, 14 nt, Staphylococcus aureus subsp. aureus Mu50
uugaucauaauuca

SEQ ID NO: 2063795 - RNA, 15 nt, Staphylococcus aureus subsp. aureus Mu50
uugauguaauucugu

SEQ ID NO: 2063796 - RNA, 14 nt, Staphylococcus aureus subsp. aureus Mu50
uugauguuuucuau

SEQ ID NO: 2063797 - RNA, 12 nt, Staphylococcus aureus subsp. aureus Mu50
uugauuaaaauc

SEQ ID NO: 2063798 - RNA, 20 nt, Staphylococcus aureus subsp. aureus Mu50
uugauguguugcauuacuau

SEQ ID NO: 2063799 - RNA, 14 nt, Staphylococcus aureus subsp. aureus Mu50
uugauuaauuuuau

SEQ ID NO: 2063800 - RNA, 13 nt, Staphylococcus aureus subsp. aureus Mu50
uugauuaaauaaa

SEQ ID NO: 2063801 - RNA, 19 nt, Staphylococcus aureus subsp. aureus Mu50
uugauuaacacaauccuuu

SEQ ID NO: 2063802 - RNA, 23 nt, Staphylococcus aureus subsp. aureus Mu50
uugaugguuaaugacuaugcaaa

SEQ ID NO: 2063803 - RNA, 15 nt, Staphylococcus aureus subsp. aureus Mu50
uugaugucacauaug

SEQ ID NO: 2063804 - RNA, 16 nt, Staphylococcus aureus subsp. aureus Mu50
uugauuauauuucuca

SEQ ID NO: 2063805 - RNA, 22 nt, Staphylococcus aureus subsp. aureus Mu50
uugauuaucauuguucauacgc

SEQ ID NO: 2063806 - RNA, 18 nt, Staphylococcus aureus subsp. aureus Mu50
uugauuauucuuugauua

SEQ ID NO: 2063807 - RNA, 22 nt, Staphylococcus aureus subsp. aureus Mu50
uugcaaaacgcauuucaugugu

SEQ ID NO: 2063808 - RNA, 21 nt, Staphylococcus aureus subsp. aureus Mu50
uugcaaauauaucaucucuau

SEQ ID NO: 2063809 - RNA, 15 nt, Staphylococcus aureus subsp. aureus Mu50
uugcaaauuaucauu

SEQ ID NO: 2063810 - RNA, 15 nt, Staphylococcus aureus subsp. aureus Mu50
uugcaacauauuuuc

SEQ ID NO: 2063811 - RNA, 13 nt, Staphylococcus aureus subsp. aureus Mu50
uugauaagucuug

SEQ ID NO: 2063812 - RNA, 12 nt, Staphylococcus aureus subsp. aureus Mu50
uugauaauagcc

SEQ ID NO: 2063813 - RNA, 23 nt, Staphylococcus aureus subsp. aureus Mu50
uugauaaugcuacuauuaaauaa

SEQ ID NO: 2063814 - RNA, 15 nt, Staphylococcus aureus subsp. aureus Mu50
uugauagauagaaau

SEQ ID NO: 2063815 - RNA, 22 nt, Staphylococcus aureus subsp. aureus Mu50
uugauacguaaacacuuuagua

SEQ ID NO: 2063816 - RNA, 22 nt, Staphylococcus aureus subsp. aureus Mu50
uugauaguaaucucucgcuaaa

SEQ ID NO: 2063817 - RNA, 20 nt, Staphylococcus aureus subsp. aureus Mu50
uugauaguuguaucauuaau

SEQ ID NO: 2063818 - RNA, 12 nt, Staphylococcus aureus subsp. aureus Mu50
uugauauaaaaa

SEQ ID NO: 2063819 - RNA, 20 nt, Staphylococcus aureus subsp. aureus Mu50
uugacucaaagauauacuua

SEQ ID NO: 2063820 - RNA, 21 nt, Staphylococcus aureus subsp. aureus Mu50
uugaccgccuaugauauaugu

SEQ ID NO: 2063821 - RNA, 18 nt, Staphylococcus aureus subsp. aureus Mu50
uugagagauuauuuaaaa

SEQ ID NO: 2063822 - RNA, 13 nt, Staphylococcus aureus subsp. aureus Mu50
uugaaaaugacgu

SEQ ID NO: 2063823 - RNA, 20 nt, Staphylococcus aureus subsp. aureus Mu50
uugaaaacaauaaauuucaa

SEQ ID NO: 2063824 - RNA, 16 nt, Staphylococcus aureus subsp. aureus Mu50
uugaaaaucuaauccu

SEQ ID NO: 2063825 - RNA, 23 nt, Staphylococcus aureus subsp. aureus Mu50
uugaaaauaaucgaacagaaaau

SEQ ID NO: 2063826 - RNA, 13 nt, Staphylococcus aureus subsp. aureus Mu50
uucuuuuguaauu

SEQ ID NO: 2063827 - RNA, 14 nt, Staphylococcus aureus subsp. aureus Mu50
uucuuuuguuuuac

SEQ ID NO: 2063828 - RNA, 16 nt, Staphylococcus aureus subsp. aureus Mu50
uugaaaaauuaaaaaa

SEQ ID NO: 2063829 - RNA, 19 nt, Staphylococcus aureus subsp. aureus Mu50
uugaaaaauuaaaaaacaa

SEQ ID NO: 2063830 - RNA, 17 nt, Staphylococcus aureus subsp. aureus Mu50
uucuuuucaaaauaaua

SEQ ID NO: 2063831 - RNA, 17 nt, Staphylococcus aureus subsp. aureus Mu50
uucuuuuauaucgcuuu

SEQ ID NO: 2063832 - RNA, 23 nt, Staphylococcus aureus subsp. aureus Mu50
uucuucuuguuuagggaauccca

SEQ ID NO: 2063833 - RNA, 15 nt, Staphylococcus aureus subsp. aureus Mu50
uucuuuaaauacauc

SEQ ID NO: 2063834 - RNA, 13 nt, Staphylococcus aureus subsp. aureus Mu50
uucuuuaacaauu

SEQ ID NO: 2063835 - RNA, 14 nt, Staphylococcus aureus subsp. aureus Mu50
uucuugaaaaguuu

SEQ ID NO: 2063836 - RNA, 16 nt, Staphylococcus aureus subsp. aureus Mu50
uucuuguucuaaaaua

SEQ ID NO: 2063837 - RNA, 20 nt, Staphylococcus aureus subsp. aureus Mu50
uucuuuauagaaaccaaaaa

SEQ ID NO: 2063838 - RNA, 23 nt, Staphylococcus aureus subsp. aureus Mu50
uucuuuaugauaauaagaauauu

SEQ ID NO: 2063839 - RNA, 21 nt, Staphylococcus aureus subsp. aureus Mu50
uucuuuaauauaaauuuugaa

SEQ ID NO: 2063840 - RNA, 20 nt, Staphylococcus aureus subsp. aureus Mu50
uucuuuauuagaaugaaacc

SEQ ID NO: 2063841 - RNA, 24 nt, Staphylococcus aureus subsp. aureus Mu50
uucuuucaggcuuuguuuuucacu

SEQ ID NO: 2063842 - RNA, 14 nt, Staphylococcus aureus subsp. aureus Mu50
uugacauuugacca

SEQ ID NO: 2063843 - RNA, 17 nt, Staphylococcus aureus subsp. aureus Mu50
uugacauuugaccaagu

SEQ ID NO: 2063844 - RNA, 16 nt, Staphylococcus aureus subsp. aureus Mu50
uugaccacuuuuguua

SEQ ID NO: 2063845 - RNA, 15 nt, Staphylococcus aureus subsp. aureus Mu50
uugaauauaaaaaag

SEQ ID NO: 2063846 - RNA, 12 nt, Staphylococcus aureus subsp. aureus Mu50
uugaauauaaaa

SEQ ID NO: 2063847 - RNA, 13 nt, Staphylococcus aureus subsp. aureus Mu50
uugaauauaaaaa

SEQ ID NO: 2063848 - RNA, 16 nt, Staphylococcus aureus subsp. aureus Mu50
uugaauauuugcuuuu

SEQ ID NO: 2063849 - RNA, 23 nt, Staphylococcus aureus subsp. aureus Mu50
uugaauauggaaaauguauuauu

SEQ ID NO: 2063850 - RNA, 11 nt, Staphylococcus aureus subsp. aureus Mu50
uugaauauuuu

SEQ ID NO: 2063851 - RNA, 16 nt, Staphylococcus aureus subsp. aureus Mu50
uugaaucaacaguuuu

SEQ ID NO: 2063852 - RNA, 20 nt, Staphylococcus aureus subsp. aureus Mu50
uugaaucaacaguuuuauua

SEQ ID NO: 2063853 - RNA, 19 nt, Staphylococcus aureus subsp. aureus Mu50
uugaauauuguuguaaaug

SEQ ID NO: 2063854 - RNA, 22 nt, Staphylococcus aureus subsp. aureus Mu50
uugaaucggugucuuuauguuu

SEQ ID NO: 2063855 - RNA, 18 nt, Staphylococcus aureus subsp. aureus Mu50
uugacacauuauugaaau

SEQ ID NO: 2063856 - RNA, 17 nt, Staphylococcus aureus subsp. aureus Mu50
uugaauaaauuuuauuc

SEQ ID NO: 2063857 - RNA, 12 nt, Staphylococcus aureus subsp. aureus Mu50
uugaaguuguuu

SEQ ID NO: 2063858 - RNA, 21 nt, Staphylococcus aureus subsp. aureus Mu50
uugaaguuacuauauuuauua

SEQ ID NO: 2063859 - RNA, 19 nt, Staphylococcus aureus subsp. aureus Mu50
uugaauacuuuauuugaua

SEQ ID NO: 2063860 - RNA, 21 nt, Staphylococcus aureus subsp. aureus Mu50
uugaauagugagcguauuauu

SEQ ID NO: 2063861 - RNA, 15 nt, Staphylococcus aureus subsp. aureus Mu50
uugaauacuuuauuu

SEQ ID NO: 2063862 - RNA, 17 nt, Staphylococcus aureus subsp. aureus Mu50
uugaauaccuuuuauua

SEQ ID NO: 2063863 - RNA, 19 nt, Staphylococcus aureus subsp. aureus Mu50
uugaauaauauauuuagga

SEQ ID NO: 2063864 - RNA, 20 nt, Staphylococcus aureus subsp. aureus Mu50
uugaagggagcauuucauua

SEQ ID NO: 2063865 - RNA, 20 nt, Staphylococcus aureus subsp. aureus Mu50
uugaagaugcuuuaauuaaa

SEQ ID NO: 2063866 - RNA, 19 nt, Staphylococcus aureus subsp. aureus Mu50
uugaacaauucuucaucau

SEQ ID NO: 2063867 - RNA, 17 nt, Staphylococcus aureus subsp. aureus Mu50
uugaaauuuauuauaau

SEQ ID NO: 2063868 - RNA, 20 nt, Staphylococcus aureus subsp. aureus Mu50
uugaaauuauuauuuaaauu

SEQ ID NO: 2063869 - RNA, 17 nt, Staphylococcus aureus subsp. aureus Mu50
uugaacaacaucuuuug

SEQ ID NO: 2063870 - RNA, 16 nt, Staphylococcus aureus subsp. aureus Mu50
ugauguguuguuuuaa

SEQ ID NO: 2063871 - RNA, 13 nt, Staphylococcus aureus subsp. aureus Mu50
ugauguuaaaaaa

SEQ ID NO: 2063872 - RNA, 20 nt, Staphylococcus aureus subsp. aureus Mu50
ugauguuuucuauaauauuu

SEQ ID NO: 2063873 - RNA, 14 nt, Staphylococcus aureus subsp. aureus Mu50
ugaugugaauguuu

SEQ ID NO: 2063874 - RNA, 11 nt, Staphylococcus aureus subsp. aureus Mu50
ugauuauuaca

SEQ ID NO: 2063875 - RNA, 20 nt, Staphylococcus aureus subsp. aureus Mu50
ugauuaaaaaucaaagaggc

SEQ ID NO: 2063876 - RNA, 22 nt, Staphylococcus aureus subsp. aureus Mu50
ugauucaaauaaaucaaacuuu

SEQ ID NO: 2063877 - RNA, 12 nt, Staphylococcus aureus subsp. aureus Mu50
ugauucaaauaa

SEQ ID NO: 2063878 - RNA, 17 nt, Staphylococcus aureus subsp. aureus Mu50
ugauguaacguuucuuu

SEQ ID NO: 2063879 - RNA, 16 nt, Staphylococcus aureus subsp. aureus Mu50
ugaugguacuaaaguu

SEQ ID NO: 2063880 - RNA, 15 nt, Staphylococcus aureus subsp. aureus Mu50
ugauuuaauugaaau

SEQ ID NO: 2063881 - RNA, 17 nt, Staphylococcus aureus subsp. aureus Mu50
ugauuuaagauuuaaua

SEQ ID NO: 2063882 - RNA, 19 nt, Staphylococcus aureus subsp. aureus Mu50
ugauuuaagggucacaccc

SEQ ID NO: 2063883 - RNA, 16 nt, Staphylococcus aureus subsp. aureus Mu50
ugauuuaauuuuuaau

SEQ ID NO: 2063884 - RNA, 19 nt, Staphylococcus aureus subsp. aureus Mu50
ugauuuaaaauauaaauuu

SEQ ID NO: 2063885 - RNA, 14 nt, Staphylococcus aureus subsp. aureus Mu50
ugauucuaaauaau

SEQ ID NO: 2063886 - RNA, 16 nt, Staphylococcus aureus subsp. aureus Mu50
ugauucguauucaaag

SEQ ID NO: 2063887 - RNA, 23 nt, Staphylococcus aureus subsp. aureus Mu50
ugauucguuaucuaagauuaaug

SEQ ID NO: 2063888 - RNA, 16 nt, Staphylococcus aureus subsp. aureus Mu50
ugauucucuguagaua

SEQ ID NO: 2063889 - RNA, 21 nt, Staphylococcus aureus subsp. aureus Mu50
ugauucucuguagauaucaaa

SEQ ID NO: 2063890 - RNA, 21 nt, Staphylococcus aureus subsp. aureus Mu50
ugauuuuaucaaauucaucag

SEQ ID NO: 2063891 - RNA, 15 nt, Staphylococcus aureus subsp. aureus Mu50
ugauuuuauaaaguu

SEQ ID NO: 2063892 - RNA, 15 nt, Staphylococcus aureus subsp. aureus Mu50
ugauuuuauaauauu

SEQ ID NO: 2063893 - RNA, 17 nt, Staphylococcus aureus subsp. aureus Mu50
ugauuuuauaauauuau

SEQ ID NO: 2063894 - RNA, 14 nt, Staphylococcus aureus subsp. aureus Mu50
ugauuuuacuugaa

SEQ ID NO: 2063895 - RNA, 21 nt, Staphylococcus aureus subsp. aureus Mu50
ugauuugccaaaaguuauaua

SEQ ID NO: 2063896 - RNA, 19 nt, Staphylococcus aureus subsp. aureus Mu50
ugauuuguuacuucuaaua

SEQ ID NO: 2063897 - RNA, 18 nt, Staphylococcus aureus subsp. aureus Mu50
ugaugaauuguuguacau

SEQ ID NO: 2063898 - RNA, 20 nt, Staphylococcus aureus subsp. aureus Mu50
ugaugaauuguuguacaugu

SEQ ID NO: 2063899 - RNA, 12 nt, Staphylococcus aureus subsp. aureus Mu50
ugaugacaucaa

SEQ ID NO: 2063900 - RNA, 23 nt, Staphylococcus aureus subsp. aureus Mu50
ugaugcuagcuuucuuuuucauc

SEQ ID NO: 2063901 - RNA, 19 nt, Staphylococcus aureus subsp. aureus Mu50
ugaugcuucgaauuuaaca

SEQ ID NO: 2063902 - RNA, 15 nt, Staphylococcus aureus subsp. aureus Mu50
ugaugcuugaauguu

SEQ ID NO: 2063903 - RNA, 19 nt, Staphylococcus aureus subsp. aureus Mu50
ugaugcgcuucuaacucac

SEQ ID NO: 2063904 - RNA, 21 nt, Staphylococcus aureus subsp. aureus Mu50
ugaugauuuauaaaaacuuau

SEQ ID NO: 2063905 - RNA, 15 nt, Staphylococcus aureus subsp. aureus Mu50
ugaugagauaaaauc

SEQ ID NO: 2063906 - RNA, 20 nt, Staphylococcus aureus subsp. aureus Mu50
ugauauuuuucgaauuuaac

SEQ ID NO: 2063907 - RNA, 15 nt, Staphylococcus aureus subsp. aureus Mu50
ugauauaugaaauau

SEQ ID NO: 2063908 - RNA, 15 nt, Staphylococcus aureus subsp. aureus Mu50
ugauauauucaucuc

SEQ ID NO: 2063909 - RNA, 22 nt, Staphylococcus aureus subsp. aureus Mu50
ugauauccaaagcuugauuuaa

SEQ ID NO: 2063910 - RNA, 14 nt, Staphylococcus aureus subsp. aureus Mu50
ugauauugaaagug

SEQ ID NO: 2063911 - RNA, 17 nt, Staphylococcus aureus subsp. aureus Mu50
ugauauauaacaaguac

SEQ ID NO: 2063912 - RNA, 13 nt, Staphylococcus aureus subsp. aureus Mu50
ugauauauaacca

SEQ ID NO: 2063913 - RNA, 17 nt, Staphylococcus aureus subsp. aureus Mu50
ugauauauaaccauagu

SEQ ID NO: 2063914 - RNA, 19 nt, Staphylococcus aureus subsp. aureus Mu50
ugauauaccuugauucauu

SEQ ID NO: 2063915 - RNA, 16 nt, Staphylococcus aureus subsp. aureus Mu50
ugcacaucauaauaaa

SEQ ID NO: 2063916 - RNA, 17 nt, Staphylococcus aureus subsp. aureus Mu50
ugcacaguuucaucuuc

SEQ ID NO: 2063917 - RNA, 17 nt, Staphylococcus aureus subsp. aureus Mu50
ugcaccuuuacaacaua

SEQ ID NO: 2063918 - RNA, 14 nt, Staphylococcus aureus subsp. aureus Mu50
ugcacgagcaacau

SEQ ID NO: 2063919 - RNA, 15 nt, Staphylococcus aureus subsp. aureus Mu50
ugcacgagcaacauc

SEQ ID NO: 2063920 - RNA, 20 nt, Staphylococcus aureus subsp. aureus Mu50
ugcaccuggucguacuuuca

SEQ ID NO: 2063921 - RNA, 15 nt, Staphylococcus aureus subsp. aureus Mu50
ugcagaacguucuaa

SEQ ID NO: 2063922 - RNA, 21 nt, Staphylococcus aureus subsp. aureus Mu50
ugcacuuuuuucauuucuuug

SEQ ID NO: 2063923 - RNA, 17 nt, Staphylococcus aureus subsp. aureus Mu50
ugcacuuuaacauaacu

SEQ ID NO: 2063924 - RNA, 15 nt, Staphylococcus aureus subsp. aureus Mu50
ugcacaaauugcaau

SEQ ID NO: 2063925 - RNA, 18 nt, Staphylococcus aureus subsp. aureus Mu50
ugcaauuuguaauacaag

SEQ ID NO: 2063926 - RNA, 12 nt, Staphylococcus aureus subsp. aureus Mu50
ugcacaacaguc

SEQ ID NO: 2063927 - RNA, 22 nt, Staphylococcus aureus subsp. aureus Mu50
ugcacaccagccucuauaagua

SEQ ID NO: 2063928 - RNA, 15 nt, Staphylococcus aureus subsp. aureus Mu50
ugcaaucguugaaaa

SEQ ID NO: 2063929 - RNA, 17 nt, Staphylococcus aureus subsp. aureus Mu50
ugcaaugaauaacaaga

SEQ ID NO: 2063930 - RNA, 18 nt, Staphylococcus aureus subsp. aureus Mu50
ugcaauacaccuauuaca

SEQ ID NO: 2063931 - RNA, 15 nt, Staphylococcus aureus subsp. aureus Mu50
ugcaaucguauguaa

SEQ ID NO: 2063932 - RNA, 15 nt, Staphylococcus aureus subsp. aureus Mu50
ugcaauacauuaaua

SEQ ID NO: 2063933 - RNA, 15 nt, Staphylococcus aureus subsp. aureus Mu50
ugcaaugagcaucuu

SEQ ID NO: 2063934 - RNA, 16 nt, Staphylococcus aureus subsp. aureus Mu50
ugcaagccaucaauau

SEQ ID NO: 2063935 - RNA, 19 nt, Staphylococcus aureus subsp. aureus Mu50
ugcaaguaauuuaauuggu

SEQ ID NO: 2063936 - RNA, 18 nt, Staphylococcus aureus subsp. aureus Mu50
ugcaauaauuacuaaccu

SEQ ID NO: 2063937 - RNA, 22 nt, Staphylococcus aureus subsp. aureus Mu50
ugcaauaauaaauaggaugaaa

SEQ ID NO: 2063938 - RNA, 19 nt, Staphylococcus aureus subsp. aureus Mu50
ugcaauaacaccaauugaa

SEQ ID NO: 2063939 - RNA, 21 nt, Staphylococcus aureus subsp. aureus Mu50
ugcaauaacaccaauugaaua

SEQ ID NO: 2063940 - RNA, 23 nt, Staphylococcus aureus subsp. aureus Mu50
ugcagaagaaaacuauuuuaaaa

SEQ ID NO: 2063941 - RNA, 16 nt, Staphylococcus aureus subsp. aureus Mu50
ugcagcuguauaacca

SEQ ID NO: 2063942 - RNA, 19 nt, Staphylococcus aureus subsp. aureus Mu50
ugcaggcaucauaucauac

SEQ ID NO: 2063943 - RNA, 21 nt, Staphylococcus aureus subsp. aureus Mu50
ugcaggcaucauaucauacca

SEQ ID NO: 2063944 - RNA, 15 nt, Staphylococcus aureus subsp. aureus Mu50
ugagcguauuauuau

SEQ ID NO: 2063945 - RNA, 14 nt, Staphylococcus aureus subsp. aureus Mu50
ugagcuauucauag

SEQ ID NO: 2063946 - RNA, 20 nt, Staphylococcus aureus subsp. aureus Mu50
ugagcuguuacacuuuucuu

SEQ ID NO: 2063947 - RNA, 23 nt, Staphylococcus aureus subsp. aureus Mu50
ugagcuguuacacuuuucuuauc

SEQ ID NO: 2063948 - RNA, 17 nt, Staphylococcus aureus subsp. aureus Mu50
ugagcuuaauaaauugu

SEQ ID NO: 2063949 - RNA, 18 nt, Staphylococcus aureus subsp. aureus Mu50
ugaggauacauaaaucua

SEQ ID NO: 2063950 - RNA, 16 nt, Staphylococcus aureus subsp. aureus Mu50
ugaguaggcucuuaau

SEQ ID NO: 2063951 - RNA, 14 nt, Staphylococcus aureus subsp. aureus Mu50
ugaguacaacauag

SEQ ID NO: 2063952 - RNA, 11 nt, Staphylococcus aureus subsp. aureus Mu50
ugaguacaaca

SEQ ID NO: 2063953 - RNA, 13 nt, Staphylococcus aureus subsp. aureus Mu50
ugaguacaacaua

SEQ ID NO: 2063954 - RNA, 17 nt, Staphylococcus aureus subsp. aureus Mu50
ugaguaggcucuuaaug

SEQ ID NO: 2063955 - RNA, 20 nt, Staphylococcus aureus subsp. aureus Mu50
ugaguauacuuacugaaacu

SEQ ID NO: 2063956 - RNA, 18 nt, Staphylococcus aureus subsp. aureus Mu50
ugaguauauucaaaagga

SEQ ID NO: 2063957 - RNA, 14 nt, Staphylococcus aureus subsp. aureus Mu50
ugaguaucaugcuu

SEQ ID NO: 2063958 - RNA, 22 nt, Staphylococcus aureus subsp. aureus Mu50
ugaguauuugccuuuuuuauuu

SEQ ID NO: 2063959 - RNA, 20 nt, Staphylococcus aureus subsp. aureus Mu50
ugaguaucaugcuuuuaaua

SEQ ID NO: 2063960 - RNA, 14 nt, Staphylococcus aureus subsp. aureus Mu50
ugaguauuaaauuu

SEQ ID NO: 2063961 - RNA, 17 nt, Staphylococcus aureus subsp. aureus Mu50
ugaguauuacuugaaaa

SEQ ID NO: 2063962 - RNA, 14 nt, Staphylococcus aureus subsp. aureus Mu50
ugaguaaauuaaua

SEQ ID NO: 2063963 - RNA, 12 nt, Staphylococcus aureus subsp. aureus Mu50
ugagggccccaa

SEQ ID NO: 2063964 - RNA, 13 nt, Staphylococcus aureus subsp. aureus Mu50
ugagggccccaac

SEQ ID NO: 2063965 - RNA, 19 nt, Staphylococcus aureus subsp. aureus Mu50
ugagggccccaacacagaa

SEQ ID NO: 2063966 - RNA, 19 nt, Staphylococcus aureus subsp. aureus Mu50
ugagauauauuaauguuug

SEQ ID NO: 2063967 - RNA, 16 nt, Staphylococcus aureus subsp. aureus Mu50
ugagauuauuuuuuua

SEQ ID NO: 2063968 - RNA, 16 nt, Staphylococcus aureus subsp. aureus Mu50
ugagauuaucuuuaga

SEQ ID NO: 2063969 - RNA, 23 nt, Staphylococcus aureus subsp. aureus Mu50
ugagauuauuuuuuuaaaucuau

SEQ ID NO: 2063970 - RNA, 13 nt, Staphylococcus aureus subsp. aureus Mu50
ugagauggucuuu

SEQ ID NO: 2063971 - RNA, 19 nt, Staphylococcus aureus subsp. aureus Mu50
ugacuuuauuucuauaucu

SEQ ID NO: 2063972 - RNA, 16 nt, Staphylococcus aureus subsp. aureus Mu50
ugacuuuuaaaaaaca

SEQ ID NO: 2063973 - RNA, 16 nt, Staphylococcus aureus subsp. aureus Mu50
ugacuuuuauaauucu

SEQ ID NO: 2063974 - RNA, 18 nt, Staphylococcus aureus subsp. aureus Mu50
ugagaaaaauauuucuaa

SEQ ID NO: 2063975 - RNA, 18 nt, Staphylococcus aureus subsp. aureus Mu50
ugacucaaagauauacuu

SEQ ID NO: 2063976 - RNA, 17 nt, Staphylococcus aureus subsp. aureus Mu50
ugacucaguuauauuaa

SEQ ID NO: 2063977 - RNA, 20 nt, Staphylococcus aureus subsp. aureus Mu50
ugacucagaaucuuacauug

SEQ ID NO: 2063978 - RNA, 16 nt, Staphylococcus aureus subsp. aureus Mu50
ugacugcaaauacgag

SEQ ID NO: 2063979 - RNA, 17 nt, Staphylococcus aureus subsp. aureus Mu50
ugaccauugucaugccu

SEQ ID NO: 2063980 - RNA, 17 nt, Staphylococcus aureus subsp. aureus Mu50
ugaccauuaucaagaac

SEQ ID NO: 2063981 - RNA, 20 nt, Staphylococcus aureus subsp. aureus Mu50
ugacgcugguaauauuuuug

SEQ ID NO: 2063982 - RNA, 16 nt, Staphylococcus aureus subsp. aureus Mu50
ugacgcugguaauauu

SEQ ID NO: 2063983 - RNA, 17 nt, Staphylococcus aureus subsp. aureus Mu50
ugacgaucuucaugaac

SEQ ID NO: 2063984 - RNA, 17 nt, Staphylococcus aureus subsp. aureus Mu50
ugacgauaaugaaauac

SEQ ID NO: 2063985 - RNA, 14 nt, Staphylococcus aureus subsp. aureus Mu50
ugaccuacuuuuuc

SEQ ID NO: 2063986 - RNA, 19 nt, Staphylococcus aureus subsp. aureus Mu50
ugacaccuaauaccauugu

SEQ ID NO: 2063987 - RNA, 22 nt, Staphylococcus aureus subsp. aureus Mu50
ugaccaccuuuaucuguaacaa

SEQ ID NO: 2063988 - RNA, 23 nt, Staphylococcus aureus subsp. aureus Mu50
ugacauaggcgcuuuuuuuuaua

SEQ ID NO: 2063989 - RNA, 23 nt, Staphylococcus aureus subsp. aureus Mu50
ugacaguuuccauaaauaaaaug

SEQ ID NO: 2063990 - RNA, 19 nt, Staphylococcus aureus subsp. aureus Mu50
ugacauaaaaaauaacucc

SEQ ID NO: 2063991 - RNA, 13 nt, Staphylococcus aureus subsp. aureus Mu50
ugacauaaaacuu

SEQ ID NO: 2063992 - RNA, 14 nt, Staphylococcus aureus subsp. aureus Mu50
ugacaacauaacaa

SEQ ID NO: 2063993 - RNA, 15 nt, Staphylococcus aureus subsp. aureus Mu50
ugacacauuauugaa

SEQ ID NO: 2063994 - RNA, 22 nt, Staphylococcus aureus subsp. aureus Mu50
ugacaaguugcugaauaaaaua

SEQ ID NO: 2063995 - RNA, 19 nt, Staphylococcus aureus subsp. aureus Mu50
ugacaaguaugucaucuuc

SEQ ID NO: 2063996 - RNA, 17 nt, Staphylococcus aureus subsp. aureus Mu50
ugaauugcuuguuuuaa

SEQ ID NO: 2063997 - RNA, 14 nt, Staphylococcus aureus subsp. aureus Mu50
ugaauugauuauaa

SEQ ID NO: 2063998 - RNA, 15 nt, Staphylococcus aureus subsp. aureus Mu50
ugaauugauuauaau

SEQ ID NO: 2063999 - RNA, 19 nt, Staphylococcus aureus subsp. aureus Mu50
ugaauugaguauuaaauuu

SEQ ID NO: 2064000 - RNA, 20 nt, Staphylococcus aureus subsp. aureus Mu50
ugaauugaguauuaaauuug

SEQ ID NO: 2064001 - RNA, 23 nt, Staphylococcus aureus subsp. aureus Mu50
ugaauuuagcaucaaaaauaaaa

SEQ ID NO: 2064002 - RNA, 17 nt, Staphylococcus aureus subsp. aureus Mu50
ugaauuuagaugcauaa

SEQ ID NO: 2064003 - RNA, 21 nt, Staphylococcus aureus subsp. aureus Mu50
ugaauuuagcaucaaaaauaa

SEQ ID NO: 2064004 - RNA, 21 nt, Staphylococcus aureus subsp. aureus Mu50
ugaauuuauuuuguaguuccu

SEQ ID NO: 2064005 - RNA, 14 nt, Staphylococcus aureus subsp. aureus Mu50
ugaaugagugucau

SEQ ID NO: 2064006 - RNA, 15 nt, Staphylococcus aureus subsp. aureus Mu50
ugaauuauuuaaaau

SEQ ID NO: 2064007 - RNA, 18 nt, Staphylococcus aureus subsp. aureus Mu50
ugaauuauuuaaaaugcu

SEQ ID NO: 2064008 - RNA, 13 nt, Staphylococcus aureus subsp. aureus Mu50
ugaauugaaaaau

SEQ ID NO: 2064009 - RNA, 18 nt, Staphylococcus aureus subsp. aureus Mu50
ucuuuauauauaaaauca

SEQ ID NO: 2064010 - RNA, 23 nt, Staphylococcus aureus subsp. aureus Mu50
ucuuuauugggagcaaucaauac

SEQ ID NO: 2064011 - RNA, 14 nt, Staphylococcus aureus subsp. aureus Mu50
ucuuucaauuaauc

SEQ ID NO: 2064012 - RNA, 15 nt, Staphylococcus aureus subsp. aureus Mu50
ucuuucaauuaauuu

SEQ ID NO: 2064013 - RNA, 18 nt, Staphylococcus aureus subsp. aureus Mu50
ucuuucaaauacacagau

SEQ ID NO: 2064014 - RNA, 23 nt, Staphylococcus aureus subsp. aureus Mu50
ucuuucaagaccuucuucucuaa

SEQ ID NO: 2064015 - RNA, 18 nt, Staphylococcus aureus subsp. aureus Mu50
ucuuuauuuuuuaucauu

SEQ ID NO: 2064016 - RNA, 21 nt, Staphylococcus aureus subsp. aureus Mu50
ucuuuauuuuuuaucauuuuu

SEQ ID NO: 2064017 - RNA, 13 nt, Staphylococcus aureus subsp. aureus Mu50
ucuuuauuuacaa

SEQ ID NO: 2064018 - RNA, 18 nt, Staphylococcus aureus subsp. aureus Mu50
ucuuucaauuaauuuaaa

SEQ ID NO: 2064019 - RNA, 23 nt, Staphylococcus aureus subsp. aureus Mu50
ucuuucaauuaauuuaaaugcuu

SEQ ID NO: 2064020 - RNA, 14 nt, Staphylococcus aureus subsp. aureus Mu50
ugaauaauggaugu

SEQ ID NO: 2064021 - RNA, 13 nt, Staphylococcus aureus subsp. aureus Mu50
ugaauaauuaaaa

SEQ ID NO: 2064022 - RNA, 14 nt, Staphylococcus aureus subsp. aureus Mu50
ugaauaauuaaaaa

SEQ ID NO: 2064023 - RNA, 18 nt, Staphylococcus aureus subsp. aureus Mu50
ugaauaauguuuucauug

SEQ ID NO: 2064024 - RNA, 22 nt, Staphylococcus aureus subsp. aureus Mu50
ugaauaauugcuaaaauaucaa

SEQ ID NO: 2064025 - RNA, 19 nt, Staphylococcus aureus subsp. aureus Mu50
ugaauaauuucaguucuua

SEQ ID NO: 2064026 - RNA, 21 nt, Staphylococcus aureus subsp. aureus Mu50
ugaauaauuucaguucuuaga

SEQ ID NO: 2064027 - RNA, 20 nt, Staphylococcus aureus subsp. aureus Mu50
ugaauauagcugugauuuga

SEQ ID NO: 2064028 - RNA, 21 nt, Staphylococcus aureus subsp. aureus Mu50
ugaauacacgacgcuaaacaa

SEQ ID NO: 2064029 - RNA, 14 nt, Staphylococcus aureus subsp. aureus Mu50
ugaauaucuaaugc

SEQ ID NO: 2064030 - RNA, 16 nt, Staphylococcus aureus subsp. aureus Mu50
ugaauaugauauuaag

SEQ ID NO: 2064031 - RNA, 20 nt, Staphylococcus aureus subsp. aureus Mu50
ugaauauggaaaauguauua

SEQ ID NO: 2064032 - RNA, 21 nt, Staphylococcus aureus subsp. aureus Mu50
ugaauauggaaaauguauuau

SEQ ID NO: 2064033 - RNA, 18 nt, Staphylococcus aureus subsp. aureus Mu50
ugaaucgcauuuaaauau

SEQ ID NO: 2064034 - RNA, 13 nt, Staphylococcus aureus subsp. aureus Mu50
ugaaugaaaauaa

SEQ ID NO: 2064035 - RNA, 23 nt, Staphylococcus aureus subsp. aureus Mu50
ugaaucuuauuuuguuuuaaaaa

SEQ ID NO: 2064036 - RNA, 17 nt, Staphylococcus aureus subsp. aureus Mu50
ugaaucggugucuuuau

SEQ ID NO: 2064037 - RNA, 20 nt, Staphylococcus aureus subsp. aureus Mu50
ugaaucuagaauauaacaac

SEQ ID NO: 2064038 - RNA, 20 nt, Staphylococcus aureus subsp. aureus Mu50
ugccucaguuagaagaugau

SEQ ID NO: 2064039 - RNA, 16 nt, Staphylococcus aureus subsp. aureus Mu50
ugccuagcauuacgcc

SEQ ID NO: 2064040 - RNA, 17 nt, Staphylococcus aureus subsp. aureus Mu50
ugccuuaacuucauaau

SEQ ID NO: 2064041 - RNA, 15 nt, Staphylococcus aureus subsp. aureus Mu50
ugccuuaucagcauu

SEQ ID NO: 2064042 - RNA, 12 nt, Staphylococcus aureus subsp. aureus Mu50
ugccuuucuaau

SEQ ID NO: 2064043 - RNA, 17 nt, Staphylococcus aureus subsp. aureus Mu50
ugccuugucuauuguaa

SEQ ID NO: 2064044 - RNA, 16 nt, Staphylococcus aureus subsp. aureus Mu50
ugccguccauuuccau

SEQ ID NO: 2064045 - RNA, 21 nt, Staphylococcus aureus subsp. aureus Mu50
ugccguauuucaaauguaauu

SEQ ID NO: 2064046 - RNA, 17 nt, Staphylococcus aureus subsp. aureus Mu50
ugccguaucuauaaaaa

SEQ ID NO: 2064047 - RNA, 22 nt, Staphylococcus aureus subsp. aureus Mu50
ugccguaucuauaaaaagaaua

SEQ ID NO: 2064048 - RNA, 23 nt, Staphylococcus aureus subsp. aureus Mu50
ugccguaucuauaaaaagaauau

SEQ ID NO: 2064049 - RNA, 22 nt, Staphylococcus aureus subsp. aureus Mu50
ugcgacaucgccaauuugauua

SEQ ID NO: 2064050 - RNA, 22 nt, Staphylococcus aureus subsp. aureus Mu50
ugcgaaaccuuucgauaaacua

SEQ ID NO: 2064051 - RNA, 16 nt, Staphylococcus aureus subsp. aureus Mu50
ugccuuuugaauaauu

SEQ ID NO: 2064052 - RNA, 18 nt, Staphylococcus aureus subsp. aureus Mu50
ugccuuuuuguaauugua

SEQ ID NO: 2064053 - RNA, 20 nt, Staphylococcus aureus subsp. aureus Mu50
ugccuuuuuguaauuguaau

SEQ ID NO: 2064054 - RNA, 15 nt, Staphylococcus aureus subsp. aureus Mu50
ugcgaagucacuugu

SEQ ID NO: 2064055 - RNA, 16 nt, Staphylococcus aureus subsp. aureus Mu50
ugcgaagauuuuuaac

SEQ ID NO: 2064056 - RNA, 15 nt, Staphylococcus aureus subsp. aureus Mu50
ugcgaauuguuagau

SEQ ID NO: 2064057 - RNA, 16 nt, Staphylococcus aureus subsp. aureus Mu50
ugcgcaaaagcgcagg

SEQ ID NO: 2064058 - RNA, 12 nt, Staphylococcus aureus subsp. aureus Mu50
ugcccuuaaagc

SEQ ID NO: 2064059 - RNA, 13 nt, Staphylococcus aureus subsp. aureus Mu50
ugccauauguuuu

SEQ ID NO: 2064060 - RNA, 18 nt, Staphylococcus aureus subsp. aureus Mu50
ugccauacccauauuaaa

SEQ ID NO: 2064061 - RNA, 11 nt, Staphylococcus aureus subsp. aureus Mu50
ugccauaccug

SEQ ID NO: 2064062 - RNA, 20 nt, Staphylococcus aureus subsp. aureus Mu50
ugcguuuguguguuuuaaaa

SEQ ID NO: 2064063 - RNA, 12 nt, Staphylococcus aureus subsp. aureus Mu50
ugcgcuuccaau

SEQ ID NO: 2064064 - RNA, 14 nt, Staphylococcus aureus subsp. aureus Mu50
ugcuauuuuggaua

SEQ ID NO: 2064065 - RNA, 17 nt, Staphylococcus aureus subsp. aureus Mu50
ugcuauuuuggauaaua

SEQ ID NO: 2064066 - RNA, 19 nt, Staphylococcus aureus subsp. aureus Mu50
ugcuauuucaacaaacaua

SEQ ID NO: 2064067 - RNA, 13 nt, Staphylococcus aureus subsp. aureus Mu50
ugcuagugcucuu

SEQ ID NO: 2064068 - RNA, 12 nt, Staphylococcus aureus subsp. aureus Mu50
ugcuagugcuuc

SEQ ID NO: 2064069 - RNA, 16 nt, Staphylococcus aureus subsp. aureus Mu50
ugcuagucauaauuua

SEQ ID NO: 2064070 - RNA, 20 nt, Staphylococcus aureus subsp. aureus Mu50
ugcuaucucuaccauuucaa

SEQ ID NO: 2064071 - RNA, 21 nt, Staphylococcus aureus subsp. aureus Mu50
ugcuaucucuaccauuucaac

SEQ ID NO: 2064072 - RNA, 23 nt, Staphylococcus aureus subsp. aureus Mu50
ugcuauauuucgguauuuuaaau

SEQ ID NO: 2064073 - RNA, 22 nt, Staphylococcus aureus subsp. aureus Mu50
ugcuauauuucgguauuuuaaa

SEQ ID NO: 2064074 - RNA, 17 nt, Staphylococcus aureus subsp. aureus Mu50
ugcuacaauuuccuacc

SEQ ID NO: 2064075 - RNA, 15 nt, Staphylococcus aureus subsp. aureus Mu50
ugcuaauuuauaaac

SEQ ID NO: 2064076 - RNA, 13 nt, Staphylococcus aureus subsp. aureus Mu50
ugcguuuuuaaau

SEQ ID NO: 2064077 - RNA, 16 nt, Staphylococcus aureus subsp. aureus Mu50
ugcuaaaaaguuagca

SEQ ID NO: 2064078 - RNA, 23 nt, Staphylococcus aureus subsp. aureus Mu50
ugcuaaaaaaauuaaaauguuaa

SEQ ID NO: 2064079 - RNA, 16 nt, Staphylococcus aureus subsp. aureus Mu50
ugcuaaaaauauugaa

SEQ ID NO: 2064080 - RNA, 13 nt, Staphylococcus aureus subsp. aureus Mu50
ugcuaaaaauauu

SEQ ID NO: 2064081 - RNA, 14 nt, Staphylococcus aureus subsp. aureus Mu50
ugcuaaaaauauug

SEQ ID NO: 2064082 - RNA, 20 nt, Staphylococcus aureus subsp. aureus Mu50
ugcugaaucgaguuugaaau

SEQ ID NO: 2064083 - RNA, 17 nt, Staphylococcus aureus subsp. aureus Mu50
ugcucuuuauauauaaa

SEQ ID NO: 2064084 - RNA, 20 nt, Staphylococcus aureus subsp. aureus Mu50
ugcucuaauccaaaauaauc

SEQ ID NO: 2064085 - RNA, 14 nt, Staphylococcus aureus subsp. aureus Mu50
ugcucuacaaaguu

SEQ ID NO: 2064086 - RNA, 13 nt, Staphylococcus aureus subsp. aureus Mu50
ugcucuaagcauu

SEQ ID NO: 2064087 - RNA, 23 nt, Staphylococcus aureus subsp. aureus Mu50
uggacagcuacaauuuucucauu

SEQ ID NO: 2064088 - RNA, 15 nt, Staphylococcus aureus subsp. aureus Mu50
uggacagcuacaauu

SEQ ID NO: 2064089 - RNA, 20 nt, Staphylococcus aureus subsp. aureus Mu50
uggaccucuugaaaaaguuu

SEQ ID NO: 2064090 - RNA, 14 nt, Staphylococcus aureus subsp. aureus Mu50
uggaauuucauaua

SEQ ID NO: 2064091 - RNA, 21 nt, Staphylococcus aureus subsp. aureus Mu50
uggaauaccuaaccauaacaa

SEQ ID NO: 2064092 - RNA, 20 nt, Staphylococcus aureus subsp. aureus Mu50
uggaauaccuaauucaauac

SEQ ID NO: 2064093 - RNA, 16 nt, Staphylococcus aureus subsp. aureus Mu50
uggaauacucuucaau

SEQ ID NO: 2064094 - RNA, 23 nt, Staphylococcus aureus subsp. aureus Mu50
uggaauacucuucaaucuaccaa

SEQ ID NO: 2064095 - RNA, 16 nt, Staphylococcus aureus subsp. aureus Mu50
uggaaguuguugcuuu

SEQ ID NO: 2064096 - RNA, 18 nt, Staphylococcus aureus subsp. aureus Mu50
uggaaguucuuuuguaaa

SEQ ID NO: 2064097 - RNA, 17 nt, Staphylococcus aureus subsp. aureus Mu50
uggaaguguuuuaaguu

SEQ ID NO: 2064098 - RNA, 18 nt, Staphylococcus aureus subsp. aureus Mu50
uggaaauuuauuauaaaa

SEQ ID NO: 2064099 - RNA, 22 nt, Staphylococcus aureus subsp. aureus Mu50
uggaaaguaauaaguaauaauu

SEQ ID NO: 2064100 - RNA, 23 nt, Staphylococcus aureus subsp. aureus Mu50
uggaaagacguuuuuuuauaaau

SEQ ID NO: 2064101 - RNA, 23 nt, Staphylococcus aureus subsp. aureus Mu50
uggaaaggaggagauuguuauua

SEQ ID NO: 2064102 - RNA, 19 nt, Staphylococcus aureus subsp. aureus Mu50
ugcuuugcauacauaucuu

SEQ ID NO: 2064103 - RNA, 13 nt, Staphylococcus aureus subsp. aureus Mu50
ugcuuggugguuu

SEQ ID NO: 2064104 - RNA, 21 nt, Staphylococcus aureus subsp. aureus Mu50
ugcuucuucagguguuuuacc

SEQ ID NO: 2064105 - RNA, 12 nt, Staphylococcus aureus subsp. aureus Mu50
ugcuucuuauca

SEQ ID NO: 2064106 - RNA, 14 nt, Staphylococcus aureus subsp. aureus Mu50
ugcuguuuuuauua

SEQ ID NO: 2064107 - RNA, 13 nt, Staphylococcus aureus subsp. aureus Mu50
ugcuguuuuuauu

SEQ ID NO: 2064108 - RNA, 15 nt, Staphylococcus aureus subsp. aureus Mu50
ugcuguuuuauucaa

SEQ ID NO: 2064109 - RNA, 20 nt, Staphylococcus aureus subsp. aureus Mu50
ugcuucauuauauaauucuu

SEQ ID NO: 2064110 - RNA, 18 nt, Staphylococcus aureus subsp. aureus Mu50
ugcuuccacuucaucuaa

SEQ ID NO: 2064111 - RNA, 13 nt, Staphylococcus aureus subsp. aureus Mu50
ugcuucugcugua

SEQ ID NO: 2064112 - RNA, 17 nt, Staphylococcus aureus subsp. aureus Mu50
ugcuucugguucuucaa

SEQ ID NO: 2064113 - RNA, 18 nt, Staphylococcus aureus subsp. aureus Mu50
ugcuucugguucuucaau

SEQ ID NO: 2064114 - RNA, 21 nt, Staphylococcus aureus subsp. aureus Mu50
ugcuucguuuuuaguguuaau

SEQ ID NO: 2064115 - RNA, 15 nt, Staphylococcus aureus subsp. aureus Mu50
ugcuucgucauuagg

SEQ ID NO: 2064116 - RNA, 18 nt, Staphylococcus aureus subsp. aureus Mu50
ugcugcuaaaauaacaac

SEQ ID NO: 2064117 - RNA, 14 nt, Staphylococcus aureus subsp. aureus Mu50
ugcugcuaauugau

SEQ ID NO: 2064118 - RNA, 19 nt, Staphylococcus aureus subsp. aureus Mu50
ugcugucaaacaacaauca

SEQ ID NO: 2064119 - RNA, 13 nt, Staphylococcus aureus subsp. aureus Mu50
ugcugguugcuuc

SEQ ID NO: 2064120 - RNA, 17 nt, Staphylococcus aureus subsp. aureus Mu50
ugcuggguaauaaauug

SEQ ID NO: 2064121 - RNA, 14 nt, Staphylococcus aureus subsp. aureus Mu50
uuaguaucuauaca

SEQ ID NO: 2064122 - RNA, 19 nt, Staphylococcus aureus subsp. aureus Mu50
uuaguagauuuauuaaaua

SEQ ID NO: 2064123 - RNA, 18 nt, Staphylococcus aureus subsp. aureus Mu50
uuaguagccacaauuuug

SEQ ID NO: 2064124 - RNA, 18 nt, Staphylococcus aureus subsp. aureus Mu50
uuaguagucaaaauugug

SEQ ID NO: 2064125 - RNA, 18 nt, Staphylococcus aureus subsp. aureus Mu50
uuaguauaaauaaaaaua

SEQ ID NO: 2064126 - RNA, 21 nt, Staphylococcus aureus subsp. aureus Mu50
uuaguauaauuuaucuuaauc

SEQ ID NO: 2064127 - RNA, 19 nt, Staphylococcus aureus subsp. aureus Mu50
uuaguaaggaauauuuccc

SEQ ID NO: 2064128 - RNA, 19 nt, Staphylococcus aureus subsp. aureus Mu50
uuaguaauaacaucuaaau

SEQ ID NO: 2064129 - RNA, 22 nt, Staphylococcus aureus subsp. aureus Mu50
uuaguacuaaaccgauuaauau

SEQ ID NO: 2064130 - RNA, 21 nt, Staphylococcus aureus subsp. aureus Mu50
uuaguacggcugcuuuaacug

SEQ ID NO: 2064131 - RNA, 12 nt, Staphylococcus aureus subsp. aureus Mu50
uuaguaauaaca

SEQ ID NO: 2064132 - RNA, 18 nt, Staphylococcus aureus subsp. aureus Mu50
uuaguacacguguauugu

SEQ ID NO: 2064133 - RNA, 15 nt, Staphylococcus aureus subsp. aureus Mu50
uuagguccuuucaca

SEQ ID NO: 2064134 - RNA, 17 nt, Staphylococcus aureus subsp. aureus Mu50
uuagguugauuucugcu

SEQ ID NO: 2064135 - RNA, 16 nt, Staphylococcus aureus subsp. aureus Mu50
uuaggcuuauuaacuu

SEQ ID NO: 2064136 - RNA, 23 nt, Staphylococcus aureus subsp. aureus Mu50
uuagugaaacaauuuguaacuau

SEQ ID NO: 2064137 - RNA, 14 nt, Staphylococcus aureus subsp. aureus Mu50
uuagucauguuugg

SEQ ID NO: 2064138 - RNA, 13 nt, Staphylococcus aureus subsp. aureus Mu50
uuauaaaucaaag

SEQ ID NO: 2064139 - RNA, 15 nt, Staphylococcus aureus subsp. aureus Mu50
uuauaaaucaaagag

SEQ ID NO: 2064140 - RNA, 17 nt, Staphylococcus aureus subsp. aureus Mu50
uuauaaaucaaagagga

SEQ ID NO: 2064141 - RNA, 23 nt, Staphylococcus aureus subsp. aureus Mu50
uuauaaaaaaucaguuuuuaaau

SEQ ID NO: 2064142 - RNA, 12 nt, Staphylococcus aureus subsp. aureus Mu50
uuauaaaaaacg

SEQ ID NO: 2064143 - RNA, 14 nt, Staphylococcus aureus subsp. aureus Mu50
uuauaaauaucuuu

SEQ ID NO: 2064144 - RNA, 14 nt, Staphylococcus aureus subsp. aureus Mu50
uuaguuuuuuuaaa

SEQ ID NO: 2064145 - RNA, 14 nt, Staphylococcus aureus subsp. aureus Mu50
uuauauuuaaacuc

SEQ ID NO: 2064146 - RNA, 17 nt, Staphylococcus aureus subsp. aureus Mu50
uuauauuuaaaugucuu

SEQ ID NO: 2064147 - RNA, 14 nt, Staphylococcus aureus subsp. aureus Mu50
uuauauuguauuuu

SEQ ID NO: 2064148 - RNA, 22 nt, Staphylococcus aureus subsp. aureus Mu50
uuauauugcaaaaauaauauga

SEQ ID NO: 2064149 - RNA, 18 nt, Staphylococcus aureus subsp. aureus Mu50
uuauauugcgaaaaauaa

SEQ ID NO: 2064150 - RNA, 18 nt, Staphylococcus aureus subsp. aureus Mu50
uuauauugcaaaaauaau

SEQ ID NO: 2064151 - RNA, 15 nt, Staphylococcus aureus subsp. aureus Mu50
uuauauuuucucaua

SEQ ID NO: 2064152 - RNA, 14 nt, Staphylococcus aureus subsp. aureus Mu50
uuaucaauuucucu

SEQ ID NO: 2064153 - RNA, 15 nt, Staphylococcus aureus subsp. aureus Mu50
uuauauugcaaaaau

SEQ ID NO: 2064154 - RNA, 23 nt, Staphylococcus aureus subsp. aureus Mu50
uuauaugcuguuggcaaaacaau

SEQ ID NO: 2064155 - RNA, 12 nt, Staphylococcus aureus subsp. aureus Mu50
uuauauguuaua

SEQ ID NO: 2064156 - RNA, 15 nt, Staphylococcus aureus subsp. aureus Mu50
uuauauguuauauua

SEQ ID NO: 2064157 - RNA, 21 nt, Staphylococcus aureus subsp. aureus Mu50
uuauauguuuuaugauuuucu

SEQ ID NO: 2064158 - RNA, 22 nt, Staphylococcus aureus subsp. aureus Mu50
uuauauaacacgauaauuauac

SEQ ID NO: 2064159 - RNA, 19 nt, Staphylococcus aureus subsp. aureus Mu50
uuauauaaauuuguaccaa

SEQ ID NO: 2064160 - RNA, 20 nt, Staphylococcus aureus subsp. aureus Mu50
uuauaugaagcguuuuuauu

SEQ ID NO: 2064161 - RNA, 22 nt, Staphylococcus aureus subsp. aureus Mu50
uuauaucuuuuauacauguaca

SEQ ID NO: 2064162 - RNA, 16 nt, Staphylococcus aureus subsp. aureus Mu50
uuauaucuuaaguaca

SEQ ID NO: 2064163 - RNA, 23 nt, Staphylococcus aureus subsp. aureus Mu50
uuauaaauuucgauuaauugaau

SEQ ID NO: 2064164 - RNA, 17 nt, Staphylococcus aureus subsp. aureus Mu50
uuauaacauccccuucu

SEQ ID NO: 2064165 - RNA, 20 nt, Staphylococcus aureus subsp. aureus Mu50
uuauaaauuugguacauaau

SEQ ID NO: 2064166 - RNA, 14 nt, Staphylococcus aureus subsp. aureus Mu50
uuauaaaugauuaa

SEQ ID NO: 2064167 - RNA, 18 nt, Staphylococcus aureus subsp. aureus Mu50
uuauaaaugauuaaagug

SEQ ID NO: 2064168 - RNA, 12 nt, Staphylococcus aureus subsp. aureus Mu50
uuauaaauuucg

SEQ ID NO: 2064169 - RNA, 23 nt, Staphylococcus aureus subsp. aureus Mu50
uuauacgugcuuuaaaguuguug

SEQ ID NO: 2064170 - RNA, 23 nt, Staphylococcus aureus subsp. aureus Mu50
uuauaacucuauccaaagacaua

SEQ ID NO: 2064171 - RNA, 16 nt, Staphylococcus aureus subsp. aureus Mu50
uuauagguauaagaau

SEQ ID NO: 2064172 - RNA, 10 nt, Staphylococcus aureus subsp. aureus Mu50
uuauacugug

SEQ ID NO: 2064173 - RNA, 13 nt, Staphylococcus aureus subsp. aureus Mu50
uuauacuacuauu

SEQ ID NO: 2064174 - RNA, 12 nt, Staphylococcus aureus subsp. aureus Mu50
uuauaacauuua

SEQ ID NO: 2064175 - RNA, 19 nt, Staphylococcus aureus subsp. aureus Mu50
uuauacuaaauugagaagu

SEQ ID NO: 2064176 - RNA, 14 nt, Staphylococcus aureus subsp. aureus Mu50
uuauauaaaaagaa

SEQ ID NO: 2064177 - RNA, 22 nt, Staphylococcus aureus subsp. aureus Mu50
uuauagugguaaaaaguuuaaa

SEQ ID NO: 2064178 - RNA, 15 nt, Staphylococcus aureus subsp. aureus Mu50
uuauagugguaaaaa

SEQ ID NO: 2064179 - RNA, 17 nt, Staphylococcus aureus subsp. aureus Mu50
uuacuugcuuuuucaaa

SEQ ID NO: 2064180 - RNA, 17 nt, Staphylococcus aureus subsp. aureus Mu50
uuacuuccauugcuucu

SEQ ID NO: 2064181 - RNA, 11 nt, Staphylococcus aureus subsp. aureus Mu50
uuacuucaguu

SEQ ID NO: 2064182 - RNA, 23 nt, Staphylococcus aureus subsp. aureus Mu50
uuagaaccaucauucauauggaa

SEQ ID NO: 2064183 - RNA, 13 nt, Staphylococcus aureus subsp. aureus Mu50
uuaccuuuaauua

SEQ ID NO: 2064184 - RNA, 15 nt, Staphylococcus aureus subsp. aureus Mu50
uuaccuuuauguuca

SEQ ID NO: 2064185 - RNA, 17 nt, Staphylococcus aureus subsp. aureus Mu50
uuacuuauauauucaau

SEQ ID NO: 2064186 - RNA, 21 nt, Staphylococcus aureus subsp. aureus Mu50
uuagauaaauuaauaugaaca

SEQ ID NO: 2064187 - RNA, 15 nt, Staphylococcus aureus subsp. aureus Mu50
uuagauaauaaggaa

SEQ ID NO: 2064188 - RNA, 22 nt, Staphylococcus aureus subsp. aureus Mu50
uuagauacugaauuuuaacuaa

SEQ ID NO: 2064189 - RNA, 15 nt, Staphylococcus aureus subsp. aureus Mu50
uuagaugacuuuguc

SEQ ID NO: 2064190 - RNA, 23 nt, Staphylococcus aureus subsp. aureus Mu50
uuagaugauauuuaacaaaauua

SEQ ID NO: 2064191 - RNA, 18 nt, Staphylococcus aureus subsp. aureus Mu50
uuagauuuuauauaaaaa

SEQ ID NO: 2064192 - RNA, 21 nt, Staphylococcus aureus subsp. aureus Mu50
uuagauuuuauauaaaaagaa

SEQ ID NO: 2064193 - RNA, 19 nt, Staphylococcus aureus subsp. aureus Mu50
uuagauuuucacuaauauu

SEQ ID NO: 2064194 - RNA, 17 nt, Staphylococcus aureus subsp. aureus Mu50
uuagauuuuauauaaaa

SEQ ID NO: 2064195 - RNA, 14 nt, Staphylococcus aureus subsp. aureus Mu50
uuagauugacuaag

SEQ ID NO: 2064196 - RNA, 18 nt, Staphylococcus aureus subsp. aureus Mu50
uuagacgcuguuuuaaau

SEQ ID NO: 2064197 - RNA, 18 nt, Staphylococcus aureus subsp. aureus Mu50
uuagaagaugauuauucu

SEQ ID NO: 2064198 - RNA, 20 nt, Staphylococcus aureus subsp. aureus Mu50
uuagaagaugauuauucucu

SEQ ID NO: 2064199 - RNA, 18 nt, Staphylococcus aureus subsp. aureus Mu50
uuagacucacuucuuaaa

SEQ ID NO: 2064200 - RNA, 17 nt, Staphylococcus aureus subsp. aureus Mu50
uuagacucacuucuuaa

SEQ ID NO: 2064201 - RNA, 16 nt, Staphylococcus aureus subsp. aureus Mu50
uuagacuaaaaaacua

SEQ ID NO: 2064202 - RNA, 13 nt, Staphylococcus aureus subsp. aureus Mu50
uuagaagaaacuu

SEQ ID NO: 2064203 - RNA, 15 nt, Staphylococcus aureus subsp. aureus Mu50
uuagcaaauauuucu

SEQ ID NO: 2064204 - RNA, 14 nt, Staphylococcus aureus subsp. aureus Mu50
uuagcauacauuaa

SEQ ID NO: 2064205 - RNA, 19 nt, Staphylococcus aureus subsp. aureus Mu50
uuagcauaccuuuauuauu

SEQ ID NO: 2064206 - RNA, 13 nt, Staphylococcus aureus subsp. aureus Mu50
uuagcaucaaaaa

SEQ ID NO: 2064207 - RNA, 18 nt, Staphylococcus aureus subsp. aureus Mu50
uuagcaugacuguaagua

SEQ ID NO: 2064208 - RNA, 17 nt, Staphylococcus aureus subsp. aureus Mu50
uuagccaaaucuuuaau

SEQ ID NO: 2064209 - RNA, 18 nt, Staphylococcus aureus subsp. aureus Mu50
uuagccaauaaaauguca

SEQ ID NO: 2064210 - RNA, 23 nt, Staphylococcus aureus subsp. aureus Mu50
uuagccccagcaaauacuucaag

SEQ ID NO: 2064211 - RNA, 14 nt, Staphylococcus aureus subsp. aureus Mu50
uuagcccuccuaag

SEQ ID NO: 2064212 - RNA, 15 nt, Staphylococcus aureus subsp. aureus Mu50
uuaggaaugauagau

SEQ ID NO: 2064213 - RNA, 18 nt, Staphylococcus aureus subsp. aureus Mu50
uuaggaaugauagauuua

SEQ ID NO: 2064214 - RNA, 18 nt, Staphylococcus aureus subsp. aureus Mu50
uuaggauccaauuuaucu

SEQ ID NO: 2064215 - RNA, 15 nt, Staphylococcus aureus subsp. aureus Mu50
uuaggcgacuuaacu

SEQ ID NO: 2064216 - RNA, 12 nt, Staphylococcus aureus subsp. aureus Mu50
uuaagugaguuu

SEQ ID NO: 2064217 - RNA, 17 nt, Staphylococcus aureus subsp. aureus Mu50
uuaagugaguuuuauuu

SEQ ID NO: 2064218 - RNA, 22 nt, Staphylococcus aureus subsp. aureus Mu50
uuaagugcaauaacaccaauug

SEQ ID NO: 2064219 - RNA, 18 nt, Staphylococcus aureus subsp. aureus Mu50
uuaagugaguuuuauuua

SEQ ID NO: 2064220 - RNA, 23 nt, Staphylococcus aureus subsp. aureus Mu50
uuaagugaugaccaauauucugg

SEQ ID NO: 2064221 - RNA, 22 nt, Staphylococcus aureus subsp. aureus Mu50
uuaagucgccuaacuuuuauua

SEQ ID NO: 2064222 - RNA, 23 nt, Staphylococcus aureus subsp. aureus Mu50
uuaaguaaucugcaaaugccucu

SEQ ID NO: 2064223 - RNA, 18 nt, Staphylococcus aureus subsp. aureus Mu50
uuaaguacaacaguugca

SEQ ID NO: 2064224 - RNA, 15 nt, Staphylococcus aureus subsp. aureus Mu50
uuaaguauagcuuuu

SEQ ID NO: 2064225 - RNA, 19 nt, Staphylococcus aureus subsp. aureus Mu50
uuaaguaguuguuauauuc

SEQ ID NO: 2064226 - RNA, 14 nt, Staphylococcus aureus subsp. aureus Mu50
uuaaguauaucuuu

SEQ ID NO: 2064227 - RNA, 14 nt, Staphylococcus aureus subsp. aureus Mu50
uuaaguaguuguua

SEQ ID NO: 2064228 - RNA, 19 nt, Staphylococcus aureus subsp. aureus Mu50
uuaaguagaugauuagugu

SEQ ID NO: 2064229 - RNA, 23 nt, Staphylococcus aureus subsp. aureus Mu50
uuaagaauaaucgaacauaaaua

SEQ ID NO: 2064230 - RNA, 14 nt, Staphylococcus aureus subsp. aureus Mu50
uuaacugccauaua

SEQ ID NO: 2064231 - RNA, 20 nt, Staphylococcus aureus subsp. aureus Mu50
uuaacugccauauagauauu

SEQ ID NO: 2064232 - RNA, 15 nt, Staphylococcus aureus subsp. aureus Mu50
uuaacuuaaaauuua

SEQ ID NO: 2064233 - RNA, 21 nt, Staphylococcus aureus subsp. aureus Mu50
uuaacuguaugccgccuaaua

SEQ ID NO: 2064234 - RNA, 19 nt, Staphylococcus aureus subsp. aureus Mu50
uuaaaucugauucauuaaa

SEQ ID NO: 2064235 - RNA, 22 nt, Staphylococcus aureus subsp. aureus Mu50
uuaaaucugcuugugugucauu

SEQ ID NO: 2064236 - RNA, 15 nt, Staphylococcus aureus subsp. aureus Mu50
uuaaaucuacuuugu

SEQ ID NO: 2064237 - RNA, 20 nt, Staphylococcus aureus subsp. aureus Mu50
uuaaaucuucaagugccauu

SEQ ID NO: 2064238 - RNA, 21 nt, Staphylococcus aureus subsp. aureus Mu50
uuaaaucuucuaguaauucuu

SEQ ID NO: 2064239 - RNA, 23 nt, Staphylococcus aureus subsp. aureus Mu50
uuaaaucuuuuacuaaaugaauu

SEQ ID NO: 2064240 - RNA, 13 nt, Staphylococcus aureus subsp. aureus Mu50
uuaauaauguaca

SEQ ID NO: 2064241 - RNA, 17 nt, Staphylococcus aureus subsp. aureus Mu50
uuaauaaugaauucuau

SEQ ID NO: 2064242 - RNA, 14 nt, Staphylococcus aureus subsp. aureus Mu50
uuaaguuaaaauaa

SEQ ID NO: 2064243 - RNA, 15 nt, Staphylococcus aureus subsp. aureus Mu50
uuaauacaucaauau

SEQ ID NO: 2064244 - RNA, 19 nt, Staphylococcus aureus subsp. aureus Mu50
uuaauacaagucuuuacuc

SEQ ID NO: 2064245 - RNA, 21 nt, Staphylococcus aureus subsp. aureus Mu50
uuaauagugucaucaccuugu

SEQ ID NO: 2064246 - RNA, 17 nt, Staphylococcus aureus subsp. aureus Mu50
uuaauaguguuauauug

SEQ ID NO: 2064247 - RNA, 19 nt, Staphylococcus aureus subsp. aureus Mu50
uuaauaggauuauuaucaa

SEQ ID NO: 2064248 - RNA, 20 nt, Staphylococcus aureus subsp. aureus Mu50
uuaauagagacauuuuaucu

SEQ ID NO: 2064249 - RNA, 13 nt, Staphylococcus aureus subsp. aureus Mu50
uuaauagaucuuu

SEQ ID NO: 2064250 - RNA, 22 nt, Staphylococcus aureus subsp. aureus Mu50
uuaauagagacauuuuaucuga

SEQ ID NO: 2064251 - RNA, 19 nt, Staphylococcus aureus subsp. aureus Mu50
uuaauaguacuuaauuuaa

SEQ ID NO: 2064252 - RNA, 14 nt, Staphylococcus aureus subsp. aureus Mu50
uuaauauaaaauaa

SEQ ID NO: 2064253 - RNA, 18 nt, Staphylococcus aureus subsp. aureus Mu50
uuaauauaacgacacuuu

SEQ ID NO: 2064254 - RNA, 17 nt, Staphylococcus aureus subsp. aureus Mu50
uuaauauaaauaucaau

SEQ ID NO: 2064255 - RNA, 14 nt, Staphylococcus aureus subsp. aureus Mu50
uuaauauaauuaau

SEQ ID NO: 2064256 - RNA, 14 nt, Staphylococcus aureus subsp. aureus Mu50
uuaauauaauaccu

SEQ ID NO: 2064257 - RNA, 14 nt, Staphylococcus aureus subsp. aureus Mu50
uuaauauaauuauu

SEQ ID NO: 2064258 - RNA, 18 nt, Staphylococcus aureus subsp. aureus Mu50
uuaaucagcuauaaaagu

SEQ ID NO: 2064259 - RNA, 14 nt, Staphylococcus aureus subsp. aureus Mu50
uuaaucaauuuaau

SEQ ID NO: 2064260 - RNA, 16 nt, Staphylococcus aureus subsp. aureus Mu50
uuaaucauagcauuaa

SEQ ID NO: 2064261 - RNA, 22 nt, Staphylococcus aureus subsp. aureus Mu50
uuaauaugcaaugcaccuauaa

SEQ ID NO: 2064262 - RNA, 16 nt, Staphylococcus aureus subsp. aureus Mu50
uuaauaugaacaaaaa

SEQ ID NO: 2064263 - RNA, 20 nt, Staphylococcus aureus subsp. aureus Mu50
uuaauaugaacaaaaaauaa

SEQ ID NO: 2064264 - RNA, 12 nt, Staphylococcus aureus subsp. aureus Mu50
uuaauauccaaa

SEQ ID NO: 2064265 - RNA, 23 nt, Staphylococcus aureus subsp. aureus Mu50
uuaauaucacgaucuuuaaaguc

SEQ ID NO: 2064266 - RNA, 21 nt, Staphylococcus aureus subsp. aureus Mu50
uuaauaucauauucaaaauaa

SEQ ID NO: 2064267 - RNA, 13 nt, Staphylococcus aureus subsp. aureus Mu50
uuaauauauuuau

SEQ ID NO: 2064268 - RNA, 15 nt, Staphylococcus aureus subsp. aureus Mu50
uuaauauauuuauuu

SEQ ID NO: 2064269 - RNA, 17 nt, Staphylococcus aureus subsp. aureus Mu50
uuaauaucacgaucuuu

SEQ ID NO: 2064270 - RNA, 14 nt, Staphylococcus aureus subsp. aureus Mu50
uuaauauugauuaa

SEQ ID NO: 2064271 - RNA, 16 nt, Staphylococcus aureus subsp. aureus Mu50
uuaauauucuuucguu

SEQ ID NO: 2064272 - RNA, 18 nt, Staphylococcus aureus subsp. aureus Mu50
uuaauauuugauaacaaa

SEQ ID NO: 2064273 - RNA, 13 nt, Staphylococcus aureus subsp. aureus Mu50
uuaauuuuauuuu

SEQ ID NO: 2064274 - RNA, 18 nt, Staphylococcus aureus subsp. aureus Mu50
uuaauuuuaugucccaau

SEQ ID NO: 2064275 - RNA, 12 nt, Staphylococcus aureus subsp. aureus Mu50
uuaauuuuauua

SEQ ID NO: 2064276 - RNA, 16 nt, Staphylococcus aureus subsp. aureus Mu50
uuaauuuucuuuuuua

SEQ ID NO: 2064277 - RNA, 17 nt, Staphylococcus aureus subsp. aureus Mu50
uuaauuuucuaaauaua

SEQ ID NO: 2064278 - RNA, 12 nt, Staphylococcus aureus subsp. aureus Mu50
uuaauuuuucaa

SEQ ID NO: 2064279 - RNA, 19 nt, Staphylococcus aureus subsp. aureus Mu50
uuaauuuugcaacauuaaa

SEQ ID NO: 2064280 - RNA, 23 nt, Staphylococcus aureus subsp. aureus Mu50
uuacaauaagcgcaauuaaaagu

SEQ ID NO: 2064281 - RNA, 20 nt, Staphylococcus aureus subsp. aureus Mu50
uuaauuuuucauuaauacaa

SEQ ID NO: 2064282 - RNA, 15 nt, Staphylococcus aureus subsp. aureus Mu50
uuaauuuuucuaaau

SEQ ID NO: 2064283 - RNA, 17 nt, Staphylococcus aureus subsp. aureus Mu50
uuaauuuuucuaaauga

SEQ ID NO: 2064284 - RNA, 14 nt, Staphylococcus aureus subsp. aureus Mu50
uuaauuuuuuauua

SEQ ID NO: 2064285 - RNA, 16 nt, Staphylococcus aureus subsp. aureus Mu50
uuaauugaaguaugca

SEQ ID NO: 2064286 - RNA, 18 nt, Staphylococcus aureus subsp. aureus Mu50
uuaauugaaaaaccaagu

SEQ ID NO: 2064287 - RNA, 18 nt, Staphylococcus aureus subsp. aureus Mu50
uuaauugaaugaaaauaa

SEQ ID NO: 2064288 - RNA, 18 nt, Staphylococcus aureus subsp. aureus Mu50
uuaauugcuguaaauauu

SEQ ID NO: 2064289 - RNA, 19 nt, Staphylococcus aureus subsp. aureus Mu50
uuaauugcuguaaauauuc

SEQ ID NO: 2064290 - RNA, 21 nt, Staphylococcus aureus subsp. aureus Mu50
uuaauugcuuucacauuguuu

SEQ ID NO: 2064291 - RNA, 13 nt, Staphylococcus aureus subsp. aureus Mu50
uuaauuucuggua

SEQ ID NO: 2064292 - RNA, 23 nt, Staphylococcus aureus subsp. aureus Mu50
uuaauuucugguaaaaaaauaac

SEQ ID NO: 2064293 - RNA, 19 nt, Staphylococcus aureus subsp. aureus Mu50
uuaauuucugguaaaaaaa

SEQ ID NO: 2064294 - RNA, 23 nt, Staphylococcus aureus subsp. aureus Mu50
uuaauuucauguucauaauauaa

SEQ ID NO: 2064295 - RNA, 18 nt, Staphylococcus aureus subsp. aureus Mu50
uuaauuuguuuuaaauac

SEQ ID NO: 2064296 - RNA, 16 nt, Staphylococcus aureus subsp. aureus Mu50
uuaauuugauuaaaaa

SEQ ID NO: 2064297 - RNA, 12 nt, Staphylococcus aureus subsp. aureus Mu50
uuaauuugucau

SEQ ID NO: 2064298 - RNA, 14 nt, Staphylococcus aureus subsp. aureus Mu50
uuaauuuuaucuua

SEQ ID NO: 2064299 - RNA, 17 nt, Staphylococcus aureus subsp. aureus Mu50
uuaauuuuaucuuauua

SEQ ID NO: 2064300 - RNA, 19 nt, Staphylococcus aureus subsp. aureus Mu50
uuaauuuguuuuaaauacu

SEQ ID NO: 2064301 - RNA, 15 nt, Staphylococcus aureus subsp. aureus Mu50
uuaauuuuaaauauu

SEQ ID NO: 2064302 - RNA, 13 nt, Staphylococcus aureus subsp. aureus Mu50
uuaaugugcauuu

SEQ ID NO: 2064303 - RNA, 15 nt, Staphylococcus aureus subsp. aureus Mu50
uuaauguguaaauuu

SEQ ID NO: 2064304 - RNA, 13 nt, Staphylococcus aureus subsp. aureus Mu50
uuaauuaaaauac

SEQ ID NO: 2064305 - RNA, 12 nt, Staphylococcus aureus subsp. aureus Mu50
uuaauuaacaaa

SEQ ID NO: 2064306 - RNA, 13 nt, Staphylococcus aureus subsp. aureus Mu50
uuaauuaaagauu

SEQ ID NO: 2064307 - RNA, 17 nt, Staphylococcus aureus subsp. aureus Mu50
uuaauuacuguaaauau

SEQ ID NO: 2064308 - RNA, 15 nt, Staphylococcus aureus subsp. aureus Mu50
uuaauuccuucuaua

SEQ ID NO: 2064309 - RNA, 22 nt, Staphylococcus aureus subsp. aureus Mu50
uuaauucuauuuuugauuuaau

SEQ ID NO: 2064310 - RNA, 13 nt, Staphylococcus aureus subsp. aureus Mu50
uuaauucuuaauc

SEQ ID NO: 2064311 - RNA, 16 nt, Staphylococcus aureus subsp. aureus Mu50
uuaaugucuaaaaaug

SEQ ID NO: 2064312 - RNA, 19 nt, Staphylococcus aureus subsp. aureus Mu50
uuaaucggaucauuauuua

SEQ ID NO: 2064313 - RNA, 22 nt, Staphylococcus aureus subsp. aureus Mu50
uuaaucguauuagccaauaaaa

SEQ ID NO: 2064314 - RNA, 16 nt, Staphylococcus aureus subsp. aureus Mu50
uuaaucgcucuaaaua

SEQ ID NO: 2064315 - RNA, 18 nt, Staphylococcus aureus subsp. aureus Mu50
uuaaucgcucuaaauagu

SEQ ID NO: 2064316 - RNA, 19 nt, Staphylococcus aureus subsp. aureus Mu50
uuaauccgauuuugauaua

SEQ ID NO: 2064317 - RNA, 23 nt, Staphylococcus aureus subsp. aureus Mu50
uuaauccgauuuugauauaaaaa

SEQ ID NO: 2064318 - RNA, 14 nt, Staphylococcus aureus subsp. aureus Mu50
uuaccaaugaauaa

SEQ ID NO: 2064319 - RNA, 23 nt, Staphylococcus aureus subsp. aureus Mu50
uuaccaauaucaugcaaaauaau

SEQ ID NO: 2064320 - RNA, 15 nt, Staphylococcus aureus subsp. aureus Mu50
uuacagucaacugcu

SEQ ID NO: 2064321 - RNA, 16 nt, Staphylococcus aureus subsp. aureus Mu50
uuacagguugaauaaa

SEQ ID NO: 2064322 - RNA, 22 nt, Staphylococcus aureus subsp. aureus Mu50
uuacaggagcgagccauuauua

SEQ ID NO: 2064323 - RNA, 14 nt, Staphylococcus aureus subsp. aureus Mu50
uuacaauuguucuc

SEQ ID NO: 2064324 - RNA, 15 nt, Staphylococcus aureus subsp. aureus Mu50
uuacaauaugauuaa

SEQ ID NO: 2064325 - RNA, 14 nt, Staphylococcus aureus subsp. aureus Mu50
uuacccuuuaaacu

SEQ ID NO: 2064326 - RNA, 11 nt, Staphylococcus aureus subsp. aureus Mu50
ugugucaacuu

SEQ ID NO: 2064327 - RNA, 21 nt, Staphylococcus aureus subsp. aureus Mu50
uguguaucaguuauuuuaaua

SEQ ID NO: 2064328 - RNA, 21 nt, Staphylococcus aureus subsp. aureus Mu50
uguguaugguuuuguacauau

SEQ ID NO: 2064329 - RNA, 15 nt, Staphylococcus aureus subsp. aureus Mu50
uguguauuuuuauug

SEQ ID NO: 2064330 - RNA, 13 nt, Staphylococcus aureus subsp. aureus Mu50
uguguuucagcuu

SEQ ID NO: 2064331 - RNA, 13 nt, Staphylococcus aureus subsp. aureus Mu50
uguguuucuuuua

SEQ ID NO: 2064332 - RNA, 12 nt, Staphylococcus aureus subsp. aureus Mu50
uguguuugcuuu

SEQ ID NO: 2064333 - RNA, 17 nt, Staphylococcus aureus subsp. aureus Mu50
uguguuugcuuuuauuu

SEQ ID NO: 2064334 - RNA, 18 nt, Staphylococcus aureus subsp. aureus Mu50
uguguuuuaaaauuauuu

SEQ ID NO: 2064335 - RNA, 18 nt, Staphylococcus aureus subsp. aureus Mu50
uguguuuucaacaguuuu

SEQ ID NO: 2064336 - RNA, 15 nt, Staphylococcus aureus subsp. aureus Mu50
uguuaaaauuugaau

SEQ ID NO: 2064337 - RNA, 16 nt, Staphylococcus aureus subsp. aureus Mu50
uguuaaaauaaugucu

SEQ ID NO: 2064338 - RNA, 21 nt, Staphylococcus aureus subsp. aureus Mu50
uguuaaacccucauuuuuaua

SEQ ID NO: 2064339 - RNA, 22 nt, Staphylococcus aureus subsp. aureus Mu50
uguuaaacgcugauuuuauaaa

SEQ ID NO: 2064340 - RNA, 23 nt, Staphylococcus aureus subsp. aureus Mu50
uguuaaaggauggauacuuaaag

SEQ ID NO: 2064341 - RNA, 19 nt, Staphylococcus aureus subsp. aureus Mu50
ugugcucauuuuuuuaauu

SEQ ID NO: 2064342 - RNA, 14 nt, Staphylococcus aureus subsp. aureus Mu50
ugugacgauauuug

SEQ ID NO: 2064343 - RNA, 17 nt, Staphylococcus aureus subsp. aureus Mu50
ugugacuuguaucaucg

SEQ ID NO: 2064344 - RNA, 22 nt, Staphylococcus aureus subsp. aureus Mu50
ugucacuuggauucaaaugaca

SEQ ID NO: 2064345 - RNA, 15 nt, Staphylococcus aureus subsp. aureus Mu50
ugugcaauaccuguu

SEQ ID NO: 2064346 - RNA, 18 nt, Staphylococcus aureus subsp. aureus Mu50
ugugccggcuuuuucuuu

SEQ ID NO: 2064347 - RNA, 15 nt, Staphylococcus aureus subsp. aureus Mu50
ugugccuuucuaaua

SEQ ID NO: 2064348 - RNA, 20 nt, Staphylococcus aureus subsp. aureus Mu50
ugugccuuugcuuuuuauuu

SEQ ID NO: 2064349 - RNA, 13 nt, Staphylococcus aureus subsp. aureus Mu50
uguuguuuuugau

SEQ ID NO: 2064350 - RNA, 12 nt, Staphylococcus aureus subsp. aureus Mu50
uguuguuuuaau

SEQ ID NO: 2064351 - RNA, 13 nt, Staphylococcus aureus subsp. aureus Mu50
uguuguuuuaauu

SEQ ID NO: 2064352 - RNA, 21 nt, Staphylococcus aureus subsp. aureus Mu50
uguugucguuucuagcaacug

SEQ ID NO: 2064353 - RNA, 13 nt, Staphylococcus aureus subsp. aureus Mu50
uguucuauuugau

SEQ ID NO: 2064354 - RNA, 16 nt, Staphylococcus aureus subsp. aureus Mu50
uguucuaauuguugua

SEQ ID NO: 2064355 - RNA, 18 nt, Staphylococcus aureus subsp. aureus Mu50
uguucucauuauaaugau

SEQ ID NO: 2064356 - RNA, 23 nt, Staphylococcus aureus subsp. aureus Mu50
uguucucuauuuauaacacuucg

SEQ ID NO: 2064357 - RNA, 18 nt, Staphylococcus aureus subsp. aureus Mu50
uguuggaauaccuuuuuc

SEQ ID NO: 2064358 - RNA, 18 nt, Staphylococcus aureus subsp. aureus Mu50
uguuggauucaucucagc

SEQ ID NO: 2064359 - RNA, 20 nt, Staphylococcus aureus subsp. aureus Mu50
uguuggaauaccuuuuucua

SEQ ID NO: 2064360 - RNA, 16 nt, Staphylococcus aureus subsp. aureus Mu50
uguuggcaaacuauua

SEQ ID NO: 2064361 - RNA, 17 nt, Staphylococcus aureus subsp. aureus Mu50
uguucccauuuuuaaaa

SEQ ID NO: 2064362 - RNA, 14 nt, Staphylococcus aureus subsp. aureus Mu50
uguucuaaugcugc

SEQ ID NO: 2064363 - RNA, 22 nt, Staphylococcus aureus subsp. aureus Mu50
uguuccugcuacaacuucuucu

SEQ ID NO: 2064364 - RNA, 16 nt, Staphylococcus aureus subsp. aureus Mu50
uguucacauucuugaa

SEQ ID NO: 2064365 - RNA, 14 nt, Staphylococcus aureus subsp. aureus Mu50
uguuaugaaguauc

SEQ ID NO: 2064366 - RNA, 13 nt, Staphylococcus aureus subsp. aureus Mu50
uguuauuauaaac

SEQ ID NO: 2064367 - RNA, 16 nt, Staphylococcus aureus subsp. aureus Mu50
uguuaacugauaaaag

SEQ ID NO: 2064368 - RNA, 14 nt, Staphylococcus aureus subsp. aureus Mu50
uguuaacugaauuu

SEQ ID NO: 2064369 - RNA, 15 nt, Staphylococcus aureus subsp. aureus Mu50
uguuaacugauaaaa

SEQ ID NO: 2064370 - RNA, 21 nt, Staphylococcus aureus subsp. aureus Mu50
uguuuuuaacagcuuuuucua

SEQ ID NO: 2064371 - RNA, 12 nt, Staphylococcus aureus subsp. aureus Mu50
uguuuuuaaaau

SEQ ID NO: 2064372 - RNA, 21 nt, Staphylococcus aureus subsp. aureus Mu50
uguuuuucacuguuaaagucu

SEQ ID NO: 2064373 - RNA, 10 nt, Staphylococcus aureus subsp. aureus Mu50
uuaaaaaaau

SEQ ID NO: 2064374 - RNA, 11 nt, Staphylococcus aureus subsp. aureus Mu50
uuaaaaaaccu

SEQ ID NO: 2064375 - RNA, 15 nt, Staphylococcus aureus subsp. aureus Mu50
uuaaaaaaccugaaa

SEQ ID NO: 2064376 - RNA, 15 nt, Staphylococcus aureus subsp. aureus Mu50
uuaaaaaacagugua

SEQ ID NO: 2064377 - RNA, 18 nt, Staphylococcus aureus subsp. aureus Mu50
uuaaaaaagaacauaaaa

SEQ ID NO: 2064378 - RNA, 23 nt, Staphylococcus aureus subsp. aureus Mu50
uuaaaaagguacuaauguuaauc

SEQ ID NO: 2064379 - RNA, 12 nt, Staphylococcus aureus subsp. aureus Mu50
uuaaaaaauaug

SEQ ID NO: 2064380 - RNA, 19 nt, Staphylococcus aureus subsp. aureus Mu50
uuaaaaaauauguauguuu

SEQ ID NO: 2064381 - RNA, 16 nt, Staphylococcus aureus subsp. aureus Mu50
uuaaaaaauuuaaugu

SEQ ID NO: 2064382 - RNA, 16 nt, Staphylococcus aureus subsp. aureus Mu50
uuaaaaaauuuaaaua

SEQ ID NO: 2064383 - RNA, 19 nt, Staphylococcus aureus subsp. aureus Mu50
uuaaaacaaugauuaaaau

SEQ ID NO: 2064384 - RNA, 12 nt, Staphylococcus aureus subsp. aureus Mu50
uuaaaacaucau

SEQ ID NO: 2064385 - RNA, 15 nt, Staphylococcus aureus subsp. aureus Mu50
uuaaaacaucauuca

SEQ ID NO: 2064386 - RNA, 17 nt, Staphylococcus aureus subsp. aureus Mu50
uuaaaacuauaaccuau

SEQ ID NO: 2064387 - RNA, 20 nt, Staphylococcus aureus subsp. aureus Mu50
uuaaaacaauaauuuaauau

SEQ ID NO: 2064388 - RNA, 14 nt, Staphylococcus aureus subsp. aureus Mu50
uuaaaacuauaaua

SEQ ID NO: 2064389 - RNA, 15 nt, Staphylococcus aureus subsp. aureus Mu50
uuaaaaaugaaauga

SEQ ID NO: 2064390 - RNA, 19 nt, Staphylococcus aureus subsp. aureus Mu50
uuaaaaauugaaggaaaau

SEQ ID NO: 2064391 - RNA, 16 nt, Staphylococcus aureus subsp. aureus Mu50
uuaaaaauuucaauaa

SEQ ID NO: 2064392 - RNA, 14 nt, Staphylococcus aureus subsp. aureus Mu50
uuaaagucaguaua

SEQ ID NO: 2064393 - RNA, 14 nt, Staphylococcus aureus subsp. aureus Mu50
uuaaaguuuaaaua

SEQ ID NO: 2064394 - RNA, 23 nt, Staphylococcus aureus subsp. aureus Mu50
uuaaagucuguugguuuaucagc

SEQ ID NO: 2064395 - RNA, 14 nt, Staphylococcus aureus subsp. aureus Mu50
uuaaagucuucauc

SEQ ID NO: 2064396 - RNA, 22 nt, Staphylococcus aureus subsp. aureus Mu50
uuaaaguuuuguucaauaugau

SEQ ID NO: 2064397 - RNA, 17 nt, Staphylococcus aureus subsp. aureus Mu50
uuaaaguuuuguucaau

SEQ ID NO: 2064398 - RNA, 22 nt, Staphylococcus aureus subsp. aureus Mu50
uuaaacgugaauucgaugacuu

SEQ ID NO: 2064399 - RNA, 17 nt, Staphylococcus aureus subsp. aureus Mu50
uuaaacuacgaauucuc

SEQ ID NO: 2064400 - RNA, 23 nt, Staphylococcus aureus subsp. aureus Mu50
uuaaacucauaccaaaaacauua

SEQ ID NO: 2064401 - RNA, 12 nt, Staphylococcus aureus subsp. aureus Mu50
uuaaacuuauua

SEQ ID NO: 2064402 - RNA, 21 nt, Staphylococcus aureus subsp. aureus Mu50
uuaaagagcaauuaaagucaa

SEQ ID NO: 2064403 - RNA, 20 nt, Staphylococcus aureus subsp. aureus Mu50
uuaaagaugucgaaaaguau

SEQ ID NO: 2064404 - RNA, 14 nt, Staphylococcus aureus subsp. aureus Mu50
uuaaagauuaaaau

SEQ ID NO: 2064405 - RNA, 22 nt, Staphylococcus aureus subsp. aureus Mu50
uuaaaauuguauagaaugugua

SEQ ID NO: 2064406 - RNA, 14 nt, Staphylococcus aureus subsp. aureus Mu50
uuaaacguaucauu

SEQ ID NO: 2064407 - RNA, 14 nt, Staphylococcus aureus subsp. aureus Mu50
uuaaaauuuaaaua

SEQ ID NO: 2064408 - RNA, 22 nt, Staphylococcus aureus subsp. aureus Mu50
uuaaaaugauagcuaaacauuu

SEQ ID NO: 2064409 - RNA, 19 nt, Staphylococcus aureus subsp. aureus Mu50
uuaaaaugauaucugacau

SEQ ID NO: 2064410 - RNA, 21 nt, Staphylococcus aureus subsp. aureus Mu50
uuaaaaugauuguuuuaagug

SEQ ID NO: 2064411 - RNA, 11 nt, Staphylococcus aureus subsp. aureus Mu50
uuaaaaugcuu

SEQ ID NO: 2064412 - RNA, 23 nt, Staphylococcus aureus subsp. aureus Mu50
uuaaaaucggacaacugagaaau

SEQ ID NO: 2064413 - RNA, 18 nt, Staphylococcus aureus subsp. aureus Mu50
uuaaaauauuauuuuuaa

SEQ ID NO: 2064414 - RNA, 14 nt, Staphylococcus aureus subsp. aureus Mu50
uuaaaacuuguaaa

SEQ ID NO: 2064415 - RNA, 21 nt, Staphylococcus aureus subsp. aureus Mu50
uuaaaagugcaaguccaaaua

SEQ ID NO: 2064416 - RNA, 13 nt, Staphylococcus aureus subsp. aureus Mu50
uuaaaagugcaag

SEQ ID NO: 2064417 - RNA, 19 nt, Staphylococcus aureus subsp. aureus Mu50
uguuuaucuguaucaaaau

SEQ ID NO: 2064418 - RNA, 18 nt, Staphylococcus aureus subsp. aureus Mu50
uguuuaugacaaaguucu

SEQ ID NO: 2064419 - RNA, 16 nt, Staphylococcus aureus subsp. aureus Mu50
uguuuauuacauaauu

SEQ ID NO: 2064420 - RNA, 22 nt, Staphylococcus aureus subsp. aureus Mu50
uguuuaugagcuuaauaaauug

SEQ ID NO: 2064421 - RNA, 14 nt, Staphylococcus aureus subsp. aureus Mu50
uguuuauuuagaau

SEQ ID NO: 2064422 - RNA, 19 nt, Staphylococcus aureus subsp. aureus Mu50
uguuuauuuagaauaaacu

SEQ ID NO: 2064423 - RNA, 19 nt, Staphylococcus aureus subsp. aureus Mu50
uguuucaaaauaauuuuau

SEQ ID NO: 2064424 - RNA, 13 nt, Staphylococcus aureus subsp. aureus Mu50
uguuucaaacaaa

SEQ ID NO: 2064425 - RNA, 17 nt, Staphylococcus aureus subsp. aureus Mu50
uguuucgcaaguagucu

SEQ ID NO: 2064426 - RNA, 19 nt, Staphylococcus aureus subsp. aureus Mu50
uguuucauaugcaucaaca

SEQ ID NO: 2064427 - RNA, 12 nt, Staphylococcus aureus subsp. aureus Mu50
uguuucagcuug

SEQ ID NO: 2064428 - RNA, 22 nt, Staphylococcus aureus subsp. aureus Mu50
uguuuaagaauguacaauuuuu

SEQ ID NO: 2064429 - RNA, 15 nt, Staphylococcus aureus subsp. aureus Mu50
uguuuaaacauguac

SEQ ID NO: 2064430 - RNA, 16 nt, Staphylococcus aureus subsp. aureus Mu50
uguuuaaacauguaca

SEQ ID NO: 2064431 - RNA, 13 nt, Staphylococcus aureus subsp. aureus Mu50
uguuuacagaugc

SEQ ID NO: 2064432 - RNA, 14 nt, Staphylococcus aureus subsp. aureus Mu50
uguuuaauuuucua

SEQ ID NO: 2064433 - RNA, 16 nt, Staphylococcus aureus subsp. aureus Mu50
uguuuaauuaaaauac

SEQ ID NO: 2064434 - RNA, 22 nt, Staphylococcus aureus subsp. aureus Mu50
uguuuacgccauaagaaaauac

SEQ ID NO: 2064435 - RNA, 12 nt, Staphylococcus aureus subsp. aureus Mu50
uguuuaauuauc

SEQ ID NO: 2064436 - RNA, 18 nt, Staphylococcus aureus subsp. aureus Mu50
uguuuaucaauuucucuu

SEQ ID NO: 2064437 - RNA, 16 nt, Staphylococcus aureus subsp. aureus Mu50
uguuuauauugcaaaa

SEQ ID NO: 2064438 - RNA, 17 nt, Staphylococcus aureus subsp. aureus Mu50
uguuuauaucuuuuaua

SEQ ID NO: 2064439 - RNA, 17 nt, Staphylococcus aureus subsp. aureus Mu50
uguuuucuuuucaaaau

SEQ ID NO: 2064440 - RNA, 21 nt, Staphylococcus aureus subsp. aureus Mu50
uguuuugagagauuauuuaaa

SEQ ID NO: 2064441 - RNA, 16 nt, Staphylococcus aureus subsp. aureus Mu50
uguuuucuauaauauu

SEQ ID NO: 2064442 - RNA, 16 nt, Staphylococcus aureus subsp. aureus Mu50
uguuuucauuuaaaag

SEQ ID NO: 2064443 - RNA, 20 nt, Staphylococcus aureus subsp. aureus Mu50
uguuuucaacaguuuuaaag

SEQ ID NO: 2064444 - RNA, 13 nt, Staphylococcus aureus subsp. aureus Mu50
uguuuuauucaau

SEQ ID NO: 2064445 - RNA, 17 nt, Staphylococcus aureus subsp. aureus Mu50
uguuuuccaauaauaaa

SEQ ID NO: 2064446 - RNA, 15 nt, Staphylococcus aureus subsp. aureus Mu50
uguuuuaauaauauc

SEQ ID NO: 2064447 - RNA, 14 nt, Staphylococcus aureus subsp. aureus Mu50
uguuuuaucaauau

SEQ ID NO: 2064448 - RNA, 15 nt, Staphylococcus aureus subsp. aureus Mu50
uguuuuaucaauauu

SEQ ID NO: 2064449 - RNA, 16 nt, Staphylococcus aureus subsp. aureus Mu50
uguuuguaagucgcuc

SEQ ID NO: 2064450 - RNA, 22 nt, Staphylococcus aureus subsp. aureus Mu50
uguuugguaacacugugaagua

SEQ ID NO: 2064451 - RNA, 14 nt, Staphylococcus aureus subsp. aureus Mu50
uguuuguuuuuaua

SEQ ID NO: 2064452 - RNA, 14 nt, Staphylococcus aureus subsp. aureus Mu50
uguuuuaaauacuu

SEQ ID NO: 2064453 - RNA, 15 nt, Staphylococcus aureus subsp. aureus Mu50
uguuucuaaauucuu

SEQ ID NO: 2064454 - RNA, 14 nt, Staphylococcus aureus subsp. aureus Mu50
uguuucuaaugcuc

SEQ ID NO: 2064455 - RNA, 18 nt, Staphylococcus aureus subsp. aureus Mu50
uguuucuuuuauuuucau

SEQ ID NO: 2064456 - RNA, 17 nt, Staphylococcus aureus subsp. aureus Mu50
uguuugcaacauauuuu

SEQ ID NO: 2064457 - RNA, 22 nt, Staphylococcus aureus subsp. aureus Mu50
uguuugcccugcuguuuuauuc

SEQ ID NO: 2064458 - RNA, 18 nt, Staphylococcus aureus subsp. aureus Mu50
uguuugggauauagaaaa

SEQ ID NO: 2064459 - RNA, 18 nt, Staphylococcus aureus subsp. aureus Mu50
uguuugaauguuuuugau

SEQ ID NO: 2064460 - RNA, 23 nt, Staphylococcus aureus subsp. aureus Mu50
uggauucaaaugacauuuuaaau

SEQ ID NO: 2064461 - RNA, 17 nt, Staphylococcus aureus subsp. aureus Mu50
uggauucaaaugacauu

SEQ ID NO: 2064462 - RNA, 15 nt, Staphylococcus aureus subsp. aureus Mu50
uggauuuuaauuauu

SEQ ID NO: 2064463 - RNA, 13 nt, Staphylococcus aureus subsp. aureus Mu50
uggauuuuucuua

SEQ ID NO: 2064464 - RNA, 20 nt, Staphylococcus aureus subsp. aureus Mu50
uggauuuuucuuauaaaaau

SEQ ID NO: 2064465 - RNA, 14 nt, Staphylococcus aureus subsp. aureus Mu50
uggauuuuaacaag

SEQ ID NO: 2064466 - RNA, 14 nt, Staphylococcus aureus subsp. aureus Mu50
uggcaaauaugagu

SEQ ID NO: 2064467 - RNA, 19 nt, Staphylococcus aureus subsp. aureus Mu50
uggcaaagaauccuuaauu

SEQ ID NO: 2064468 - RNA, 14 nt, Staphylococcus aureus subsp. aureus Mu50
uggcaaaucaaaca

SEQ ID NO: 2064469 - RNA, 20 nt, Staphylococcus aureus subsp. aureus Mu50
uggcaauauacuuuuuaaau

SEQ ID NO: 2064470 - RNA, 11 nt, Staphylococcus aureus subsp. aureus Mu50
uggcaccagua

SEQ ID NO: 2064471 - RNA, 16 nt, Staphylococcus aureus subsp. aureus Mu50
uggcauaaccuguaau

SEQ ID NO: 2064472 - RNA, 23 nt, Staphylococcus aureus subsp. aureus Mu50
uggcauaucgauaaauguauuaa

SEQ ID NO: 2064473 - RNA, 18 nt, Staphylococcus aureus subsp. aureus Mu50
uggaugucaugucuagau

SEQ ID NO: 2064474 - RNA, 20 nt, Staphylococcus aureus subsp. aureus Mu50
uggauguguuuuaauaauau

SEQ ID NO: 2064475 - RNA, 13 nt, Staphylococcus aureus subsp. aureus Mu50
uggaucuguuaca

SEQ ID NO: 2064476 - RNA, 16 nt, Staphylococcus aureus subsp. aureus Mu50
uggauaauugcauuac

SEQ ID NO: 2064477 - RNA, 14 nt, Staphylococcus aureus subsp. aureus Mu50
uggauaaaaugaua

SEQ ID NO: 2064478 - RNA, 17 nt, Staphylococcus aureus subsp. aureus Mu50
uggauaaaaugauaucu

SEQ ID NO: 2064479 - RNA, 15 nt, Staphylococcus aureus subsp. aureus Mu50
uggauaugauaacca

SEQ ID NO: 2064480 - RNA, 14 nt, Staphylococcus aureus subsp. aureus Mu50
uggauacaaaccua

SEQ ID NO: 2064481 - RNA, 22 nt, Staphylococcus aureus subsp. aureus Mu50
uggacuaauaauuguccaugcc

SEQ ID NO: 2064482 - RNA, 17 nt, Staphylococcus aureus subsp. aureus Mu50
uggacuaacgucauuau

SEQ ID NO: 2064483 - RNA, 16 nt, Staphylococcus aureus subsp. aureus Mu50
uggacugaugcauuca

SEQ ID NO: 2064484 - RNA, 23 nt, Staphylococcus aureus subsp. aureus Mu50
uggacuuugcuguccaucgucau

SEQ ID NO: 2064485 - RNA, 16 nt, Staphylococcus aureus subsp. aureus Mu50
uggacuuuaaaguuaa

SEQ ID NO: 2064486 - RNA, 14 nt, Staphylococcus aureus subsp. aureus Mu50
uggacuucuaucuu

SEQ ID NO: 2064487 - RNA, 17 nt, Staphylococcus aureus subsp. aureus Mu50
uggacuucuaucuucac

SEQ ID NO: 2064488 - RNA, 19 nt, Staphylococcus aureus subsp. aureus Mu50
uggagccccuuguucuccg

SEQ ID NO: 2064489 - RNA, 22 nt, Staphylococcus aureus subsp. aureus Mu50
uggcgcaaugauaucuuuucca

SEQ ID NO: 2064490 - RNA, 18 nt, Staphylococcus aureus subsp. aureus Mu50
uggcgcaauuuuuaacaa

SEQ ID NO: 2064491 - RNA, 21 nt, Staphylococcus aureus subsp. aureus Mu50
uggcgaauagcgauuuuaaag

SEQ ID NO: 2064492 - RNA, 18 nt, Staphylococcus aureus subsp. aureus Mu50
uggccacuaaugcauaau

SEQ ID NO: 2064493 - RNA, 23 nt, Staphylococcus aureus subsp. aureus Mu50
uggccaaacaaccugugauaaaa

SEQ ID NO: 2064494 - RNA, 19 nt, Staphylococcus aureus subsp. aureus Mu50
uggcauuauugccuaaccu

SEQ ID NO: 2064495 - RNA, 23 nt, Staphylococcus aureus subsp. aureus Mu50
uguacgaccagucgcauauuuug

SEQ ID NO: 2064496 - RNA, 16 nt, Staphylococcus aureus subsp. aureus Mu50
uguaccgaauccuuca

SEQ ID NO: 2064497 - RNA, 22 nt, Staphylococcus aureus subsp. aureus Mu50
uguacuuccuuccauucggaua

SEQ ID NO: 2064498 - RNA, 15 nt, Staphylococcus aureus subsp. aureus Mu50
uguacuucuuugguc

SEQ ID NO: 2064499 - RNA, 13 nt, Staphylococcus aureus subsp. aureus Mu50
uguagaaaacaug

SEQ ID NO: 2064500 - RNA, 19 nt, Staphylococcus aureus subsp. aureus Mu50
uguaccaauugauuuugcu

SEQ ID NO: 2064501 - RNA, 19 nt, Staphylococcus aureus subsp. aureus Mu50
uguaccaucacuaaaguaa

SEQ ID NO: 2064502 - RNA, 16 nt, Staphylococcus aureus subsp. aureus Mu50
uguacauugguuuuua

SEQ ID NO: 2064503 - RNA, 17 nt, Staphylococcus aureus subsp. aureus Mu50
uguacauuguaaauaua

SEQ ID NO: 2064504 - RNA, 13 nt, Staphylococcus aureus subsp. aureus Mu50
uguaccaaauuug

SEQ ID NO: 2064505 - RNA, 12 nt, Staphylococcus aureus subsp. aureus Mu50
uguacaauaauu

SEQ ID NO: 2064506 - RNA, 17 nt, Staphylococcus aureus subsp. aureus Mu50
uguacaauaauuaguca

SEQ ID NO: 2064507 - RNA, 16 nt, Staphylococcus aureus subsp. aureus Mu50
uguacaauuuuuaaaa

SEQ ID NO: 2064508 - RNA, 17 nt, Staphylococcus aureus subsp. aureus Mu50
uguaauaccuuuacuuu

SEQ ID NO: 2064509 - RNA, 22 nt, Staphylococcus aureus subsp. aureus Mu50
uguaauaccuuuacuuucauua

SEQ ID NO: 2064510 - RNA, 15 nt, Staphylococcus aureus subsp. aureus Mu50
uguaauacaucuaau

SEQ ID NO: 2064511 - RNA, 19 nt, Staphylococcus aureus subsp. aureus Mu50
uguaauacaugacauucau

SEQ ID NO: 2064512 - RNA, 21 nt, Staphylococcus aureus subsp. aureus Mu50
uguaauaccaauuuuuagcau

SEQ ID NO: 2064513 - RNA, 14 nt, Staphylococcus aureus subsp. aureus Mu50
uguaauacaagcaa

SEQ ID NO: 2064514 - RNA, 16 nt, Staphylococcus aureus subsp. aureus Mu50
uguaauaauaaucuuu

SEQ ID NO: 2064515 - RNA, 22 nt, Staphylococcus aureus subsp. aureus Mu50
uguaauaauaucaccuuuuuua

SEQ ID NO: 2064516 - RNA, 19 nt, Staphylococcus aureus subsp. aureus Mu50
uguaauauaacaaguauaa

SEQ ID NO: 2064517 - RNA, 18 nt, Staphylococcus aureus subsp. aureus Mu50
uguaauuguuuuuucuua

SEQ ID NO: 2064518 - RNA, 20 nt, Staphylococcus aureus subsp. aureus Mu50
uguaauuguuuuuucuuauu

SEQ ID NO: 2064519 - RNA, 22 nt, Staphylococcus aureus subsp. aureus Mu50
uguaauuuaaaauaguucuuua

SEQ ID NO: 2064520 - RNA, 12 nt, Staphylococcus aureus subsp. aureus Mu50
uguaauuuaaaa

SEQ ID NO: 2064521 - RNA, 13 nt, Staphylococcus aureus subsp. aureus Mu50
uguaauuuaaaau

SEQ ID NO: 2064522 - RNA, 16 nt, Staphylococcus aureus subsp. aureus Mu50
uguaaccuaaaaacaa

SEQ ID NO: 2064523 - RNA, 21 nt, Staphylococcus aureus subsp. aureus Mu50
uguaacgugaggcccauaaau

SEQ ID NO: 2064524 - RNA, 21 nt, Staphylococcus aureus subsp. aureus Mu50
uguaacuuuagacauaaaaaa

SEQ ID NO: 2064525 - RNA, 18 nt, Staphylococcus aureus subsp. aureus Mu50
uguaacucaauaugaaac

SEQ ID NO: 2064526 - RNA, 15 nt, Staphylococcus aureus subsp. aureus Mu50
uguaagacaacaaau

SEQ ID NO: 2064527 - RNA, 22 nt, Staphylococcus aureus subsp. aureus Mu50
uguaagaacgaaacuuuaauua

SEQ ID NO: 2064528 - RNA, 18 nt, Staphylococcus aureus subsp. aureus Mu50
uguaauaaagaauaaaca

SEQ ID NO: 2064529 - RNA, 19 nt, Staphylococcus aureus subsp. aureus Mu50
uguaaauaacaguuaauua

SEQ ID NO: 2064530 - RNA, 14 nt, Staphylococcus aureus subsp. aureus Mu50
uguaaauaaaaauu

SEQ ID NO: 2064531 - RNA, 17 nt, Staphylococcus aureus subsp. aureus Mu50
uguaaaucacgauuuuc

SEQ ID NO: 2064532 - RNA, 15 nt, Staphylococcus aureus subsp. aureus Mu50
uguaaauauaaauau

SEQ ID NO: 2064533 - RNA, 16 nt, Staphylococcus aureus subsp. aureus Mu50
uguaaauauaaauaug

SEQ ID NO: 2064534 - RNA, 21 nt, Staphylococcus aureus subsp. aureus Mu50
uguaaagcuaauuuuuuauuu

SEQ ID NO: 2064535 - RNA, 15 nt, Staphylococcus aureus subsp. aureus Mu50
uguaaaguugauaau

SEQ ID NO: 2064536 - RNA, 23 nt, Staphylococcus aureus subsp. aureus Mu50
uguaaagcaugaauagcuuguug

SEQ ID NO: 2064537 - RNA, 17 nt, Staphylococcus aureus subsp. aureus Mu50
ugguucaucaaacaaca

SEQ ID NO: 2064538 - RNA, 16 nt, Staphylococcus aureus subsp. aureus Mu50
ugguucaucaaacaac

SEQ ID NO: 2064539 - RNA, 14 nt, Staphylococcus aureus subsp. aureus Mu50
ugguucauaaugau

SEQ ID NO: 2064540 - RNA, 20 nt, Staphylococcus aureus subsp. aureus Mu50
ugguucauaaugaucaagua

SEQ ID NO: 2064541 - RNA, 20 nt, Staphylococcus aureus subsp. aureus Mu50
ugguucagaaaugacaucau

SEQ ID NO: 2064542 - RNA, 21 nt, Staphylococcus aureus subsp. aureus Mu50
uguaaaaccuuacccaaaaaa

SEQ ID NO: 2064543 - RNA, 22 nt, Staphylococcus aureus subsp. aureus Mu50
uguaaaacauucccuuaauaau

SEQ ID NO: 2064544 - RNA, 17 nt, Staphylococcus aureus subsp. aureus Mu50
ugguuauuaaaauuaaa

SEQ ID NO: 2064545 - RNA, 14 nt, Staphylococcus aureus subsp. aureus Mu50
ugguucaaaaauca

SEQ ID NO: 2064546 - RNA, 19 nt, Staphylococcus aureus subsp. aureus Mu50
uguaaaacuaaguuauuua

SEQ ID NO: 2064547 - RNA, 18 nt, Staphylococcus aureus subsp. aureus Mu50
uguaaacaguauguagcu

SEQ ID NO: 2064548 - RNA, 20 nt, Staphylococcus aureus subsp. aureus Mu50
uguaaaaugcucccuucaaa

SEQ ID NO: 2064549 - RNA, 21 nt, Staphylococcus aureus subsp. aureus Mu50
uguaaaccagcuaaaccaucu

SEQ ID NO: 2064550 - RNA, 11 nt, Staphylococcus aureus subsp. aureus Mu50
uguaaagacac

SEQ ID NO: 2064551 - RNA, 18 nt, Staphylococcus aureus subsp. aureus Mu50
uguaaacuucuuuucuuu

SEQ ID NO: 2064552 - RNA, 16 nt, Staphylococcus aureus subsp. aureus Mu50
uguagugguucuuaua

SEQ ID NO: 2064553 - RNA, 21 nt, Staphylococcus aureus subsp. aureus Mu50
uguauaaaagauauaaacauu

SEQ ID NO: 2064554 - RNA, 16 nt, Staphylococcus aureus subsp. aureus Mu50
uguauaaaacagaauu

SEQ ID NO: 2064555 - RNA, 13 nt, Staphylococcus aureus subsp. aureus Mu50
uguauaaauguca

SEQ ID NO: 2064556 - RNA, 16 nt, Staphylococcus aureus subsp. aureus Mu50
uguaggcuuuuuauuu

SEQ ID NO: 2064557 - RNA, 18 nt, Staphylococcus aureus subsp. aureus Mu50
uguagcaggcaacuuuua

SEQ ID NO: 2064558 - RNA, 21 nt, Staphylococcus aureus subsp. aureus Mu50
uguagcacaagauucaacuug

SEQ ID NO: 2064559 - RNA, 12 nt, Staphylococcus aureus subsp. aureus Mu50
uguagagaugug

SEQ ID NO: 2064560 - RNA, 23 nt, Staphylococcus aureus subsp. aureus Mu50
uguagaaacacaaggaauauaca

SEQ ID NO: 2064561 - RNA, 22 nt, Staphylococcus aureus subsp. aureus Mu50
uguagacaauuguaguaaugaa

SEQ ID NO: 2064562 - RNA, 15 nt, Staphylococcus aureus subsp. aureus Mu50
uguauauauauguaa

SEQ ID NO: 2064563 - RNA, 20 nt, Staphylococcus aureus subsp. aureus Mu50
uguauaugaauuuuauaaau

SEQ ID NO: 2064564 - RNA, 17 nt, Staphylococcus aureus subsp. aureus Mu50
uguauaccuauuccuau

SEQ ID NO: 2064565 - RNA, 13 nt, Staphylococcus aureus subsp. aureus Mu50
uguauaacauuau

SEQ ID NO: 2064566 - RNA, 14 nt, Staphylococcus aureus subsp. aureus Mu50
uguauaacauuauu

SEQ ID NO: 2064567 - RNA, 19 nt, Staphylococcus aureus subsp. aureus Mu50
uguauaaggauguacuaua

SEQ ID NO: 2064568 - RNA, 18 nt, Staphylococcus aureus subsp. aureus Mu50
uguauauuuaacaucaau

SEQ ID NO: 2064569 - RNA, 24 nt, Staphylococcus aureus subsp. aureus Mu50
uguauauuuaacaucaauuacucu

SEQ ID NO: 2064570 - RNA, 17 nt, Staphylococcus aureus subsp. aureus Mu50
uguaucaucauaaucaa

SEQ ID NO: 2064571 - RNA, 22 nt, Staphylococcus aureus subsp. aureus Mu50
uguaucaaaaucgguuugauua

SEQ ID NO: 2064572 - RNA, 20 nt, Staphylococcus aureus subsp. aureus Mu50
uguauauggcgauaacaaga

SEQ ID NO: 2064573 - RNA, 15 nt, Staphylococcus aureus subsp. aureus Mu50
uguauauggcauuaa

SEQ ID NO: 2064574 - RNA, 15 nt, Staphylococcus aureus subsp. aureus Mu50
uguauauucuuuuua

SEQ ID NO: 2064575 - RNA, 23 nt, Staphylococcus aureus subsp. aureus Mu50
uguauuauucucucauuuguaua

SEQ ID NO: 2064576 - RNA, 21 nt, Staphylococcus aureus subsp. aureus Mu50
uguauuauugaaacuaauaau

SEQ ID NO: 2064577 - RNA, 12 nt, Staphylococcus aureus subsp. aureus Mu50
uguauuuauuac

SEQ ID NO: 2064578 - RNA, 15 nt, Staphylococcus aureus subsp. aureus Mu50
uguauguugaaagug

SEQ ID NO: 2064579 - RNA, 18 nt, Staphylococcus aureus subsp. aureus Mu50
uguaucucugaaaaacuu

SEQ ID NO: 2064580 - RNA, 18 nt, Staphylococcus aureus subsp. aureus Mu50
uguauuuuuacuuuuaua

SEQ ID NO: 2064581 - RNA, 14 nt, Staphylococcus aureus subsp. aureus Mu50
uguauuuuucaaau

SEQ ID NO: 2064582 - RNA, 16 nt, Staphylococcus aureus subsp. aureus Mu50
ugucacaaucuguuca

SEQ ID NO: 2064583 - RNA, 23 nt, Staphylococcus aureus subsp. aureus Mu50
ugucacauguaccacauuuuccu

SEQ ID NO: 2064584 - RNA, 18 nt, Staphylococcus aureus subsp. aureus Mu50
uguauuucuuaacauccu

SEQ ID NO: 2064585 - RNA, 18 nt, Staphylococcus aureus subsp. aureus Mu50
uguauuuauuuuuuuaaa

SEQ ID NO: 2064586 - RNA, 13 nt, Staphylococcus aureus subsp. aureus Mu50
uguauuucaucau

SEQ ID NO: 2064587 - RNA, 20 nt, Staphylococcus aureus subsp. aureus Mu50
uguauuuuaacgucauuuuu

SEQ ID NO: 2064588 - RNA, 21 nt, Staphylococcus aureus subsp. aureus Mu50
uguauuuuaacgucauuuuua

SEQ ID NO: 2064589 - RNA, 15 nt, Staphylococcus aureus subsp. aureus Mu50
ugguaaaaaguuuaa

SEQ ID NO: 2064590 - RNA, 18 nt, Staphylococcus aureus subsp. aureus Mu50
ugguaaaaaaauaacguu

SEQ ID NO: 2064591 - RNA, 17 nt, Staphylococcus aureus subsp. aureus Mu50
ugguaaaucaugacaua

SEQ ID NO: 2064592 - RNA, 18 nt, Staphylococcus aureus subsp. aureus Mu50
ugguaugacugcaaauac

SEQ ID NO: 2064593 - RNA, 20 nt, Staphylococcus aureus subsp. aureus Mu50
ugguaugacugcaaauacga

SEQ ID NO: 2064594 - RNA, 17 nt, Staphylococcus aureus subsp. aureus Mu50
ugguacuauuuuugacu

SEQ ID NO: 2064595 - RNA, 16 nt, Staphylococcus aureus subsp. aureus Mu50
uggugagaaauugaau

SEQ ID NO: 2064596 - RNA, 20 nt, Staphylococcus aureus subsp. aureus Mu50
uggucuaaagcuuauuaaau

SEQ ID NO: 2064597 - RNA, 18 nt, Staphylococcus aureus subsp. aureus Mu50
uggucuaaagcuuauuaa

SEQ ID NO: 2064598 - RNA, 14 nt, Staphylococcus aureus subsp. aureus Mu50
uggguaauguuuuu

SEQ ID NO: 2064599 - RNA, 12 nt, Staphylococcus aureus subsp. aureus Mu50
uggguaaucuuu

SEQ ID NO: 2064600 - RNA, 18 nt, Staphylococcus aureus subsp. aureus Mu50
uggggcccacaccccaac

SEQ ID NO: 2064601 - RNA, 18 nt, Staphylococcus aureus subsp. aureus Mu50
ugggcaguaauuuucauu

SEQ ID NO: 2064602 - RNA, 21 nt, Staphylococcus aureus subsp. aureus Mu50
uggcuuuuuauaccaauaauu

SEQ ID NO: 2064603 - RNA, 14 nt, Staphylococcus aureus subsp. aureus Mu50
uggcuuuuuuauuu

SEQ ID NO: 2064604 - RNA, 14 nt, Staphylococcus aureus subsp. aureus Mu50
uggcuuuuuuaauu

SEQ ID NO: 2064605 - RNA, 14 nt, Staphylococcus aureus subsp. aureus Mu50
ucugcuucuaaaac

SEQ ID NO: 2064606 - RNA, 14 nt, Staphylococcus aureus subsp. aureus Mu50
ucugcuuuucuauu

SEQ ID NO: 2064607 - RNA, 13 nt, Staphylococcus aureus subsp. aureus Mu50
ucugcuuucgcuu

SEQ ID NO: 2064608 - RNA, 15 nt, Staphylococcus aureus subsp. aureus Mu50
ucugcuuuauuuuau

SEQ ID NO: 2064609 - RNA, 14 nt, Staphylococcus aureus subsp. aureus Mu50
ucugcuucuuuuaa

SEQ ID NO: 2064610 - RNA, 22 nt, Staphylococcus aureus subsp. aureus Mu50
ucugguauuuuaugacguaauu

SEQ ID NO: 2064611 - RNA, 21 nt, Staphylococcus aureus subsp. aureus Mu50
ucuggugaaaacccugaagau

SEQ ID NO: 2064612 - RNA, 20 nt, Staphylococcus aureus subsp. aureus Mu50
ucuguacguuuuaaauaaau

SEQ ID NO: 2064613 - RNA, 20 nt, Staphylococcus aureus subsp. aureus Mu50
ucuguauauggcgauaacaa

SEQ ID NO: 2064614 - RNA, 15 nt, Staphylococcus aureus subsp. aureus Mu50
ucuuaaacauaacau

SEQ ID NO: 2064615 - RNA, 19 nt, Staphylococcus aureus subsp. aureus Mu50
ucuuaaagauuuuucagcu

SEQ ID NO: 2064616 - RNA, 22 nt, Staphylococcus aureus subsp. aureus Mu50
ucuuaaaucacuagcuaaugca

SEQ ID NO: 2064617 - RNA, 16 nt, Staphylococcus aureus subsp. aureus Mu50
ucuuaacaacaugauu

SEQ ID NO: 2064618 - RNA, 18 nt, Staphylococcus aureus subsp. aureus Mu50
ucuuaacaacuuuaauuu

SEQ ID NO: 2064619 - RNA, 20 nt, Staphylococcus aureus subsp. aureus Mu50
ucuguugaagucaauaauuu

SEQ ID NO: 2064620 - RNA, 15 nt, Staphylococcus aureus subsp. aureus Mu50
ucuguuucaaagcug

SEQ ID NO: 2064621 - RNA, 18 nt, Staphylococcus aureus subsp. aureus Mu50
ucugauuucacuucuaaa

SEQ ID NO: 2064622 - RNA, 13 nt, Staphylococcus aureus subsp. aureus Mu50
ucugauucucuaa

SEQ ID NO: 2064623 - RNA, 17 nt, Staphylococcus aureus subsp. aureus Mu50
ucugauucuucacuaaa

SEQ ID NO: 2064624 - RNA, 22 nt, Staphylococcus aureus subsp. aureus Mu50
ucugauucuucacuaaaaauau

SEQ ID NO: 2064625 - RNA, 23 nt, Staphylococcus aureus subsp. aureus Mu50
ucugauuucacuucuaaaacuaa

SEQ ID NO: 2064626 - RNA, 15 nt, Staphylococcus aureus subsp. aureus Mu50
ucugcccugcaaugc

SEQ ID NO: 2064627 - RNA, 19 nt, Staphylococcus aureus subsp. aureus Mu50
ucugaacauaaaaaauacu

SEQ ID NO: 2064628 - RNA, 20 nt, Staphylococcus aureus subsp. aureus Mu50
ucucgcuaaauuuauauagu

SEQ ID NO: 2064629 - RNA, 19 nt, Staphylococcus aureus subsp. aureus Mu50
ucugaaacuuuaauacuac

SEQ ID NO: 2064630 - RNA, 20 nt, Staphylococcus aureus subsp. aureus Mu50
ucuccuugcucaugagcaca

SEQ ID NO: 2064631 - RNA, 19 nt, Staphylococcus aureus subsp. aureus Mu50
ucucgcauacugucaucuu

SEQ ID NO: 2064632 - RNA, 22 nt, Staphylococcus aureus subsp. aureus Mu50
ucugauacuucaccaucuuuaa

SEQ ID NO: 2064633 - RNA, 14 nt, Staphylococcus aureus subsp. aureus Mu50
ucugauguguuaug

SEQ ID NO: 2064634 - RNA, 20 nt, Staphylococcus aureus subsp. aureus Mu50
ucugaugucgaaaauagcua

SEQ ID NO: 2064635 - RNA, 21 nt, Staphylococcus aureus subsp. aureus Mu50
ucugauacaucaucgccagca

SEQ ID NO: 2064636 - RNA, 22 nt, Staphylococcus aureus subsp. aureus Mu50
ucugacauuucaucaauaauuu

SEQ ID NO: 2064637 - RNA, 13 nt, Staphylococcus aureus subsp. aureus Mu50
ucugaauuuaaua

SEQ ID NO: 2064638 - RNA, 19 nt, Staphylococcus aureus subsp. aureus Mu50
ucuucucuaaucacuuggc

SEQ ID NO: 2064639 - RNA, 13 nt, Staphylococcus aureus subsp. aureus Mu50
ucuucuucagaaa

SEQ ID NO: 2064640 - RNA, 12 nt, Staphylococcus aureus subsp. aureus Mu50
ucuucuuuuaau

SEQ ID NO: 2064641 - RNA, 13 nt, Staphylococcus aureus subsp. aureus Mu50
ucuucuuuuaaua

SEQ ID NO: 2064642 - RNA, 19 nt, Staphylococcus aureus subsp. aureus Mu50
ucuugaaccccauucacua

SEQ ID NO: 2064643 - RNA, 22 nt, Staphylococcus aureus subsp. aureus Mu50
ucuugaaauccguuaaaauuuu

SEQ ID NO: 2064644 - RNA, 15 nt, Staphylococcus aureus subsp. aureus Mu50
ucuucuuuuuuuaac

SEQ ID NO: 2064645 - RNA, 15 nt, Staphylococcus aureus subsp. aureus Mu50
ucuucuuuuuuucuc

SEQ ID NO: 2064646 - RNA, 21 nt, Staphylococcus aureus subsp. aureus Mu50
ucuucuuuuuuucuccuuugu

SEQ ID NO: 2064647 - RNA, 14 nt, Staphylococcus aureus subsp. aureus Mu50
ucuugauaaaauaa

SEQ ID NO: 2064648 - RNA, 13 nt, Staphylococcus aureus subsp. aureus Mu50
ucuugauauucau

SEQ ID NO: 2064649 - RNA, 16 nt, Staphylococcus aureus subsp. aureus Mu50
ucuugauaaaauaaau

SEQ ID NO: 2064650 - RNA, 15 nt, Staphylococcus aureus subsp. aureus Mu50
ucuugauuauauuuu

SEQ ID NO: 2064651 - RNA, 20 nt, Staphylococcus aureus subsp. aureus Mu50
ucuuuacuuguaauuaauac

SEQ ID NO: 2064652 - RNA, 18 nt, Staphylococcus aureus subsp. aureus Mu50
ucuuuacuuguaauuaau

SEQ ID NO: 2064653 - RNA, 17 nt, Staphylococcus aureus subsp. aureus Mu50
ucuuuacgauaaacuaa

SEQ ID NO: 2064654 - RNA, 20 nt, Staphylococcus aureus subsp. aureus Mu50
ucuuuaaacucguaaauuuu

SEQ ID NO: 2064655 - RNA, 18 nt, Staphylococcus aureus subsp. aureus Mu50
ucuuuaaagcuaaauguu

SEQ ID NO: 2064656 - RNA, 17 nt, Staphylococcus aureus subsp. aureus Mu50
ucuuuaaagucuuuaau

SEQ ID NO: 2064657 - RNA, 19 nt, Staphylococcus aureus subsp. aureus Mu50
ucuuuaaagaaaauuucag

SEQ ID NO: 2064658 - RNA, 21 nt, Staphylococcus aureus subsp. aureus Mu50
ucuuuaaagaaaauuucagua

SEQ ID NO: 2064659 - RNA, 22 nt, Staphylococcus aureus subsp. aureus Mu50
ucuugucauuugaacaucauuu

SEQ ID NO: 2064660 - RNA, 14 nt, Staphylococcus aureus subsp. aureus Mu50
ucuuguauuuccuu

SEQ ID NO: 2064661 - RNA, 18 nt, Staphylococcus aureus subsp. aureus Mu50
ucuugugauaauucuuca

SEQ ID NO: 2064662 - RNA, 13 nt, Staphylococcus aureus subsp. aureus Mu50
ucuugugaaauua

SEQ ID NO: 2064663 - RNA, 22 nt, Staphylococcus aureus subsp. aureus Mu50
ucuugcauacgaauuaaaauaa

SEQ ID NO: 2064664 - RNA, 16 nt, Staphylococcus aureus subsp. aureus Mu50
ucuugcaauagcaaca

SEQ ID NO: 2064665 - RNA, 13 nt, Staphylococcus aureus subsp. aureus Mu50
ucuucuaauucug

SEQ ID NO: 2064666 - RNA, 14 nt, Staphylococcus aureus subsp. aureus Mu50
ucuucuaucuuuuc

SEQ ID NO: 2064667 - RNA, 13 nt, Staphylococcus aureus subsp. aureus Mu50
ucuucguuuuaau

SEQ ID NO: 2064668 - RNA, 13 nt, Staphylococcus aureus subsp. aureus Mu50
ucuucgucaaauu

SEQ ID NO: 2064669 - RNA, 16 nt, Staphylococcus aureus subsp. aureus Mu50
ucuucagguguaguag

SEQ ID NO: 2064670 - RNA, 17 nt, Staphylococcus aureus subsp. aureus Mu50
ucuucaggugauucauu

SEQ ID NO: 2064671 - RNA, 19 nt, Staphylococcus aureus subsp. aureus Mu50
ucuucagguguuuuaccuu

SEQ ID NO: 2064672 - RNA, 17 nt, Staphylococcus aureus subsp. aureus Mu50
ucuuaaucuaaaaauag

SEQ ID NO: 2064673 - RNA, 13 nt, Staphylococcus aureus subsp. aureus Mu50
ucuuaauuaucau

SEQ ID NO: 2064674 - RNA, 13 nt, Staphylococcus aureus subsp. aureus Mu50
ucuuaauucuucu

SEQ ID NO: 2064675 - RNA, 21 nt, Staphylococcus aureus subsp. aureus Mu50
ucuuaaucgagugauucagga

SEQ ID NO: 2064676 - RNA, 16 nt, Staphylococcus aureus subsp. aureus Mu50
ucuuaaguacauaaau

SEQ ID NO: 2064677 - RNA, 23 nt, Staphylococcus aureus subsp. aureus Mu50
ucuuccuccgccaucaauauuua

SEQ ID NO: 2064678 - RNA, 13 nt, Staphylococcus aureus subsp. aureus Mu50
ucgugaaaauaau

SEQ ID NO: 2064679 - RNA, 14 nt, Staphylococcus aureus subsp. aureus Mu50
ucgucgaaaugccu

SEQ ID NO: 2064680 - RNA, 13 nt, Staphylococcus aureus subsp. aureus Mu50
ucgucauuaugug

SEQ ID NO: 2064681 - RNA, 20 nt, Staphylococcus aureus subsp. aureus Mu50
ucgucacauauaaauauuuu

SEQ ID NO: 2064682 - RNA, 13 nt, Staphylococcus aureus subsp. aureus Mu50
ucguauuuuuaag

SEQ ID NO: 2064683 - RNA, 13 nt, Staphylococcus aureus subsp. aureus Mu50
ucgucaaauucaa

SEQ ID NO: 2064684 - RNA, 13 nt, Staphylococcus aureus subsp. aureus Mu50
ucgucaaaaacag

SEQ ID NO: 2064685 - RNA, 14 nt, Staphylococcus aureus subsp. aureus Mu50
ucguucuuugauua

SEQ ID NO: 2064686 - RNA, 18 nt, Staphylococcus aureus subsp. aureus Mu50
ucguugaaaaauauccug

SEQ ID NO: 2064687 - RNA, 18 nt, Staphylococcus aureus subsp. aureus Mu50
ucguuaaaacacccugcu

SEQ ID NO: 2064688 - RNA, 23 nt, Staphylococcus aureus subsp. aureus Mu50
ucguguuaauaaccgaaauauug

SEQ ID NO: 2064689 - RNA, 17 nt, Staphylococcus aureus subsp. aureus Mu50
ucguguuugaauguuuu

SEQ ID NO: 2064690 - RNA, 15 nt, Staphylococcus aureus subsp. aureus Mu50
ucguuucuuuuauau

SEQ ID NO: 2064691 - RNA, 17 nt, Staphylococcus aureus subsp. aureus Mu50
ucguuuucaucaacgau

SEQ ID NO: 2064692 - RNA, 16 nt, Staphylococcus aureus subsp. aureus Mu50
ucuaacaauauauaau

SEQ ID NO: 2064693 - RNA, 23 nt, Staphylococcus aureus subsp. aureus Mu50
ucuaacaccugauugacaaugua

SEQ ID NO: 2064694 - RNA, 13 nt, Staphylococcus aureus subsp. aureus Mu50
ucuaaauucuuuu

SEQ ID NO: 2064695 - RNA, 15 nt, Staphylococcus aureus subsp. aureus Mu50
ucuaaagcuauaaaa

SEQ ID NO: 2064696 - RNA, 16 nt, Staphylococcus aureus subsp. aureus Mu50
ucuaaagcuuauuaaa

SEQ ID NO: 2064697 - RNA, 17 nt, Staphylococcus aureus subsp. aureus Mu50
ucuaaagcuauaaaaaa

SEQ ID NO: 2064698 - RNA, 18 nt, Staphylococcus aureus subsp. aureus Mu50
ucuaaagcuauaaaaaau

SEQ ID NO: 2064699 - RNA, 17 nt, Staphylococcus aureus subsp. aureus Mu50
ucuaaacuucuauuaau

SEQ ID NO: 2064700 - RNA, 23 nt, Staphylococcus aureus subsp. aureus Mu50
ucuaaaauaaaacgugcaaauaa

SEQ ID NO: 2064701 - RNA, 13 nt, Staphylococcus aureus subsp. aureus Mu50
ucuaaacaauucc

SEQ ID NO: 2064702 - RNA, 19 nt, Staphylococcus aureus subsp. aureus Mu50
ucuaaaccuuuuuuaaguu

SEQ ID NO: 2064703 - RNA, 13 nt, Staphylococcus aureus subsp. aureus Mu50
ucuaaaacauguu

SEQ ID NO: 2064704 - RNA, 13 nt, Staphylococcus aureus subsp. aureus Mu50
ucuaaaaguugua

SEQ ID NO: 2064705 - RNA, 21 nt, Staphylococcus aureus subsp. aureus Mu50
ucuaaaaguuguaauuuaaaa

SEQ ID NO: 2064706 - RNA, 11 nt, Staphylococcus aureus subsp. aureus Mu50
ucuaaaaguug

SEQ ID NO: 2064707 - RNA, 16 nt, Staphylococcus aureus subsp. aureus Mu50
ucuacaauauuaaaau

SEQ ID NO: 2064708 - RNA, 22 nt, Staphylococcus aureus subsp. aureus Mu50
ucuacaauauuaaaauuaaaac

SEQ ID NO: 2064709 - RNA, 18 nt, Staphylococcus aureus subsp. aureus Mu50
ucuacaauauuaaaauua

SEQ ID NO: 2064710 - RNA, 20 nt, Staphylococcus aureus subsp. aureus Mu50
ucuaaugggucaaugacuga

SEQ ID NO: 2064711 - RNA, 19 nt, Staphylococcus aureus subsp. aureus Mu50
ucuaaugcucauuaauggu

SEQ ID NO: 2064712 - RNA, 22 nt, Staphylococcus aureus subsp. aureus Mu50
ucuaauucaaugauuuuuaaaa

SEQ ID NO: 2064713 - RNA, 17 nt, Staphylococcus aureus subsp. aureus Mu50
ucuaauuauucaugaau

SEQ ID NO: 2064714 - RNA, 14 nt, Staphylococcus aureus subsp. aureus Mu50
ucuaauucaaugau

SEQ ID NO: 2064715 - RNA, 17 nt, Staphylococcus aureus subsp. aureus Mu50
ucuaaucuucacgcuua

SEQ ID NO: 2064716 - RNA, 22 nt, Staphylococcus aureus subsp. aureus Mu50
ucuaaugauuaaaaaucaaaga

SEQ ID NO: 2064717 - RNA, 21 nt, Staphylococcus aureus subsp. aureus Mu50
ucuaauacauacugauuaaac

SEQ ID NO: 2064718 - RNA, 18 nt, Staphylococcus aureus subsp. aureus Mu50
ucuaauacuuucaaacaa

SEQ ID NO: 2064719 - RNA, 18 nt, Staphylococcus aureus subsp. aureus Mu50
ucuaauacuuucacuuuu

SEQ ID NO: 2064720 - RNA, 22 nt, Staphylococcus aureus subsp. aureus Mu50
ucuaauacuuucacuuuuuaua

SEQ ID NO: 2064721 - RNA, 13 nt, Staphylococcus aureus subsp. aureus Mu50
ucuaauauuuugg

SEQ ID NO: 2064722 - RNA, 16 nt, Staphylococcus aureus subsp. aureus Mu50
ucuaccaauacguuuc

SEQ ID NO: 2064723 - RNA, 22 nt, Staphylococcus aureus subsp. aureus Mu50
ucuacccauaauuuaaaugaua

SEQ ID NO: 2064724 - RNA, 15 nt, Staphylococcus aureus subsp. aureus Mu50
ucuacccuugcaaau

SEQ ID NO: 2064725 - RNA, 23 nt, Staphylococcus aureus subsp. aureus Mu50
ucuacacccauuugucuuaauuu

SEQ ID NO: 2064726 - RNA, 12 nt, Staphylococcus aureus subsp. aureus Mu50
ucuacagcacug

SEQ ID NO: 2064727 - RNA, 18 nt, Staphylococcus aureus subsp. aureus Mu50
ucuacuauuuaaucuuaa

SEQ ID NO: 2064728 - RNA, 16 nt, Staphylococcus aureus subsp. aureus Mu50
ucuacucaaauauaaa

SEQ ID NO: 2064729 - RNA, 18 nt, Staphylococcus aureus subsp. aureus Mu50
ucuacgaucaaaaucaug

SEQ ID NO: 2064730 - RNA, 15 nt, Staphylococcus aureus subsp. aureus Mu50
ucuauacaacaguaa

SEQ ID NO: 2064731 - RNA, 14 nt, Staphylococcus aureus subsp. aureus Mu50
ucuauacaacagua

SEQ ID NO: 2064732 - RNA, 23 nt, Staphylococcus aureus subsp. aureus Mu50
ucuauacauuccaaaguaccauc

SEQ ID NO: 2064733 - RNA, 14 nt, Staphylococcus aureus subsp. aureus Mu50
ucuauaauuuuaau

SEQ ID NO: 2064734 - RNA, 15 nt, Staphylococcus aureus subsp. aureus Mu50
ucuauaauuuuaauu

SEQ ID NO: 2064735 - RNA, 16 nt, Staphylococcus aureus subsp. aureus Mu50
ucuauaauuuuaauua

SEQ ID NO: 2064736 - RNA, 13 nt, Staphylococcus aureus subsp. aureus Mu50
ucuauaaaaagaa

SEQ ID NO: 2064737 - RNA, 20 nt, Staphylococcus aureus subsp. aureus Mu50
ucuauaaauaucaauaauuc

SEQ ID NO: 2064738 - RNA, 20 nt, Staphylococcus aureus subsp. aureus Mu50
ucuaguuuaucuucaguaau

SEQ ID NO: 2064739 - RNA, 19 nt, Staphylococcus aureus subsp. aureus Mu50
ucuagcuuuagucguuugu

SEQ ID NO: 2064740 - RNA, 13 nt, Staphylococcus aureus subsp. aureus Mu50
ucuacuuuguucu

SEQ ID NO: 2064741 - RNA, 13 nt, Staphylococcus aureus subsp. aureus Mu50
ucuacuucguuua

SEQ ID NO: 2064742 - RNA, 21 nt, Staphylococcus aureus subsp. aureus Mu50
ucuagauucauauuuauauuu

SEQ ID NO: 2064743 - RNA, 17 nt, Staphylococcus aureus subsp. aureus Mu50
ucuagagauaacuagaa

SEQ ID NO: 2064744 - RNA, 16 nt, Staphylococcus aureus subsp. aureus Mu50
ucuauauaauuuauuu

SEQ ID NO: 2064745 - RNA, 15 nt, Staphylococcus aureus subsp. aureus Mu50
ucuauaucuauuuau

SEQ ID NO: 2064746 - RNA, 13 nt, Staphylococcus aureus subsp. aureus Mu50
ucuauauuuaauu

SEQ ID NO: 2064747 - RNA, 12 nt, Staphylococcus aureus subsp. aureus Mu50
ucuauaugcaua

SEQ ID NO: 2064748 - RNA, 18 nt, Staphylococcus aureus subsp. aureus Mu50
ucuauagcaccauuauua

SEQ ID NO: 2064749 - RNA, 14 nt, Staphylococcus aureus subsp. aureus Mu50
ucuauagaauuuuu

SEQ ID NO: 2064750 - RNA, 17 nt, Staphylococcus aureus subsp. aureus Mu50
ucuauagaauuuuucau

SEQ ID NO: 2064751 - RNA, 21 nt, Staphylococcus aureus subsp. aureus Mu50
ucuauauaaaguugacaauac

SEQ ID NO: 2064752 - RNA, 12 nt, Staphylococcus aureus subsp. aureus Mu50
ucuauauaagaa

SEQ ID NO: 2064753 - RNA, 17 nt, Staphylococcus aureus subsp. aureus Mu50
ucuauagguuuauaaaa

SEQ ID NO: 2064754 - RNA, 18 nt, Staphylococcus aureus subsp. aureus Mu50
ucuauauuuaauuuugau

SEQ ID NO: 2064755 - RNA, 19 nt, Staphylococcus aureus subsp. aureus Mu50
ucuaucaguaugaaguugc

SEQ ID NO: 2064756 - RNA, 14 nt, Staphylococcus aureus subsp. aureus Mu50
ucuaucgccuaaaa

SEQ ID NO: 2064757 - RNA, 21 nt, Staphylococcus aureus subsp. aureus Mu50
ucuaucuccgcuacaauuaua

SEQ ID NO: 2064758 - RNA, 19 nt, Staphylococcus aureus subsp. aureus Mu50
ucuaucuacucaaauauaa

SEQ ID NO: 2064759 - RNA, 16 nt, Staphylococcus aureus subsp. aureus Mu50
ucuaugaaauuuuuua

SEQ ID NO: 2064760 - RNA, 14 nt, Staphylococcus aureus subsp. aureus Mu50
ucuaugaaauuuuu

SEQ ID NO: 2064761 - RNA, 13 nt, Staphylococcus aureus subsp. aureus Mu50
ucuaugauuguau

SEQ ID NO: 2064762 - RNA, 15 nt, Staphylococcus aureus subsp. aureus Mu50
ucuauucaaaaaggu

SEQ ID NO: 2064763 - RNA, 23 nt, Staphylococcus aureus subsp. aureus Mu50
ucuauuauauugaauugaaaaau

SEQ ID NO: 2064764 - RNA, 16 nt, Staphylococcus aureus subsp. aureus Mu50
ucuauggaaaauguua

SEQ ID NO: 2064765 - RNA, 14 nt, Staphylococcus aureus subsp. aureus Mu50
ucuaugucaaauug

SEQ ID NO: 2064766 - RNA, 16 nt, Staphylococcus aureus subsp. aureus Mu50
ucuaugucaaauugaa

SEQ ID NO: 2064767 - RNA, 14 nt, Staphylococcus aureus subsp. aureus Mu50
ucucaacgauaaga

SEQ ID NO: 2064768 - RNA, 21 nt, Staphylococcus aureus subsp. aureus Mu50
ucucaacaaaucuauaaauau

SEQ ID NO: 2064769 - RNA, 22 nt, Staphylococcus aureus subsp. aureus Mu50
ucucaaagguuuacuauuaaag

SEQ ID NO: 2064770 - RNA, 20 nt, Staphylococcus aureus subsp. aureus Mu50
ucuauuuuaugauuugauuu

SEQ ID NO: 2064771 - RNA, 16 nt, Staphylococcus aureus subsp. aureus Mu50
ucuauuuaauaaugua

SEQ ID NO: 2064772 - RNA, 22 nt, Staphylococcus aureus subsp. aureus Mu50
ucuauuucacucuacaauccua

SEQ ID NO: 2064773 - RNA, 22 nt, Staphylococcus aureus subsp. aureus Mu50
ucuauuuagcuugcuuacaaua

SEQ ID NO: 2064774 - RNA, 12 nt, Staphylococcus aureus subsp. aureus Mu50
ucuauuuuauga

SEQ ID NO: 2064775 - RNA, 19 nt, Staphylococcus aureus subsp. aureus Mu50
ucuauuuuauaauaaauuu

SEQ ID NO: 2064776 - RNA, 23 nt, Staphylococcus aureus subsp. aureus Mu50
ucucaccagcucguuuuuucauu

SEQ ID NO: 2064777 - RNA, 13 nt, Staphylococcus aureus subsp. aureus Mu50
ucuccuaauaauu

SEQ ID NO: 2064778 - RNA, 22 nt, Staphylococcus aureus subsp. aureus Mu50
ucuccuaaagguaacuuuuuaa

SEQ ID NO: 2064779 - RNA, 16 nt, Staphylococcus aureus subsp. aureus Mu50
ucuccguauuuaccuu

SEQ ID NO: 2064780 - RNA, 20 nt, Staphylococcus aureus subsp. aureus Mu50
ucuccuacaacuauucccac

SEQ ID NO: 2064781 - RNA, 19 nt, Staphylococcus aureus subsp. aureus Mu50
ucuccauuagaacuaagau

SEQ ID NO: 2064782 - RNA, 16 nt, Staphylococcus aureus subsp. aureus Mu50
ucucauacuauaagca

SEQ ID NO: 2064783 - RNA, 19 nt, Staphylococcus aureus subsp. aureus Mu50
ucucauaucuauuuuucga

SEQ ID NO: 2064784 - RNA, 16 nt, Staphylococcus aureus subsp. aureus Mu50
ucuccaccauuaauag

SEQ ID NO: 2064785 - RNA, 18 nt, Staphylococcus aureus subsp. aureus Mu50
ucuccacacuaaauguuc

SEQ ID NO: 2064786 - RNA, 17 nt, Staphylococcus aureus subsp. aureus Mu50
ucucauagucaucuuag

SEQ ID NO: 2064787 - RNA, 17 nt, Staphylococcus aureus subsp. aureus Mu50
ucucaucgaauucauuu

SEQ ID NO: 2064788 - RNA, 16 nt, Staphylococcus aureus subsp. aureus Mu50
uccgcuuguucaacua

SEQ ID NO: 2064789 - RNA, 13 nt, Staphylococcus aureus subsp. aureus Mu50
uccgcauaaauua

SEQ ID NO: 2064790 - RNA, 16 nt, Staphylococcus aureus subsp. aureus Mu50
uccguauuuaccuucu

SEQ ID NO: 2064791 - RNA, 14 nt, Staphylococcus aureus subsp. aureus Mu50
uccggggccccaac

SEQ ID NO: 2064792 - RNA, 14 nt, Staphylococcus aureus subsp. aureus Mu50
uccggcugaaggga

SEQ ID NO: 2064793 - RNA, 23 nt, Staphylococcus aureus subsp. aureus Mu50
uccgucgaauauaauuuuuugac

SEQ ID NO: 2064794 - RNA, 14 nt, Staphylococcus aureus subsp. aureus Mu50
uccguuaauuuaac

SEQ ID NO: 2064795 - RNA, 18 nt, Staphylococcus aureus subsp. aureus Mu50
uccguuaaaauuuuaauu

SEQ ID NO: 2064796 - RNA, 15 nt, Staphylococcus aureus subsp. aureus Mu50
uccguugaauucaac

SEQ ID NO: 2064797 - RNA, 18 nt, Staphylococcus aureus subsp. aureus Mu50
uccuaagcaucguaaaaa

SEQ ID NO: 2064798 - RNA, 17 nt, Staphylococcus aureus subsp. aureus Mu50
uccuaagucuuuuaaau

SEQ ID NO: 2064799 - RNA, 19 nt, Staphylococcus aureus subsp. aureus Mu50
uccuaagcaucguaaaaaa

SEQ ID NO: 2064800 - RNA, 13 nt, Staphylococcus aureus subsp. aureus Mu50
uccuaaaaacugu

SEQ ID NO: 2064801 - RNA, 18 nt, Staphylococcus aureus subsp. aureus Mu50
uccuaaagucgucucaau

SEQ ID NO: 2064802 - RNA, 16 nt, Staphylococcus aureus subsp. aureus Mu50
uccucauuaauaaauu

SEQ ID NO: 2064803 - RNA, 13 nt, Staphylococcus aureus subsp. aureus Mu50
uccuccaaagcua

SEQ ID NO: 2064804 - RNA, 21 nt, Staphylococcus aureus subsp. aureus Mu50
uccuaugccaaauaacguuaa

SEQ ID NO: 2064805 - RNA, 21 nt, Staphylococcus aureus subsp. aureus Mu50
uccuauggcgcaauuuuuaac

SEQ ID NO: 2064806 - RNA, 17 nt, Staphylococcus aureus subsp. aureus Mu50
uccuauuacuacauaau

SEQ ID NO: 2064807 - RNA, 19 nt, Staphylococcus aureus subsp. aureus Mu50
uccuauuacuacauaauuu

SEQ ID NO: 2064808 - RNA, 20 nt, Staphylococcus aureus subsp. aureus Mu50
uccuaucuguaccguauuuu

SEQ ID NO: 2064809 - RNA, 16 nt, Staphylococcus aureus subsp. aureus Mu50
uccucaacgggaacau

SEQ ID NO: 2064810 - RNA, 20 nt, Staphylococcus aureus subsp. aureus Mu50
uccucuauuuuaugauuuga

SEQ ID NO: 2064811 - RNA, 15 nt, Staphylococcus aureus subsp. aureus Mu50
uccucgguauuuaau

SEQ ID NO: 2064812 - RNA, 19 nt, Staphylococcus aureus subsp. aureus Mu50
uccucgguauuuaauguuu

SEQ ID NO: 2064813 - RNA, 21 nt, Staphylococcus aureus subsp. aureus Mu50
uccucgguauuuaauguuuua

SEQ ID NO: 2064814 - RNA, 16 nt, Staphylococcus aureus subsp. aureus Mu50
uccugaaauuaacguc

SEQ ID NO: 2064815 - RNA, 19 nt, Staphylococcus aureus subsp. aureus Mu50
uccucuguccgauuuuuaa

SEQ ID NO: 2064816 - RNA, 16 nt, Staphylococcus aureus subsp. aureus Mu50
uccucuuauaccaagg

SEQ ID NO: 2064817 - RNA, 16 nt, Staphylococcus aureus subsp. aureus Mu50
uccugguauaauggac

SEQ ID NO: 2064818 - RNA, 17 nt, Staphylococcus aureus subsp. aureus Mu50
uccugauacaaugauua

SEQ ID NO: 2064819 - RNA, 14 nt, Staphylococcus aureus subsp. aureus Mu50
uccugauuccacua

SEQ ID NO: 2064820 - RNA, 18 nt, Staphylococcus aureus subsp. aureus Mu50
uccugauuuaauguuaaa

SEQ ID NO: 2064821 - RNA, 17 nt, Staphylococcus aureus subsp. aureus Mu50
ucgauaccuaaaauacc

SEQ ID NO: 2064822 - RNA, 14 nt, Staphylococcus aureus subsp. aureus Mu50
ucgauaauauaacu

SEQ ID NO: 2064823 - RNA, 19 nt, Staphylococcus aureus subsp. aureus Mu50
ucgauaacuuacuauuugu

SEQ ID NO: 2064824 - RNA, 13 nt, Staphylococcus aureus subsp. aureus Mu50
ucgauaaguuuuu

SEQ ID NO: 2064825 - RNA, 23 nt, Staphylococcus aureus subsp. aureus Mu50
ucgauaaguuuuugaauaucuaa

SEQ ID NO: 2064826 - RNA, 13 nt, Staphylococcus aureus subsp. aureus Mu50
ucgauuuuuuaau

SEQ ID NO: 2064827 - RNA, 20 nt, Staphylococcus aureus subsp. aureus Mu50
ucgauuauucuuaauuuaag

SEQ ID NO: 2064828 - RNA, 15 nt, Staphylococcus aureus subsp. aureus Mu50
ucgauuaauuuaauu

SEQ ID NO: 2064829 - RNA, 15 nt, Staphylococcus aureus subsp. aureus Mu50
ucgcaaauacauaau

SEQ ID NO: 2064830 - RNA, 18 nt, Staphylococcus aureus subsp. aureus Mu50
ucgcaaauacauaaucau

SEQ ID NO: 2064831 - RNA, 15 nt, Staphylococcus aureus subsp. aureus Mu50
ucgcagcuucuuuaa

SEQ ID NO: 2064832 - RNA, 21 nt, Staphylococcus aureus subsp. aureus Mu50
ucgcaucguucccugcagcaa

SEQ ID NO: 2064833 - RNA, 17 nt, Staphylococcus aureus subsp. aureus Mu50
ucgcaucuccaaaggcc

SEQ ID NO: 2064834 - RNA, 22 nt, Staphylococcus aureus subsp. aureus Mu50
ucgcaucuguuaacugaauuuc

SEQ ID NO: 2064835 - RNA, 22 nt, Staphylococcus aureus subsp. aureus Mu50
ucgcauucuugguuuuuuagau

SEQ ID NO: 2064836 - RNA, 15 nt, Staphylococcus aureus subsp. aureus Mu50
ucgaauucauuugca

SEQ ID NO: 2064837 - RNA, 17 nt, Staphylococcus aureus subsp. aureus Mu50
ucgaauugauggaaaag

SEQ ID NO: 2064838 - RNA, 14 nt, Staphylococcus aureus subsp. aureus Mu50
ucgaauguuucuuc

SEQ ID NO: 2064839 - RNA, 15 nt, Staphylococcus aureus subsp. aureus Mu50
ucgaauuaagaaaag

SEQ ID NO: 2064840 - RNA, 22 nt, Staphylococcus aureus subsp. aureus Mu50
ucgaauguauugcuauaagaac

SEQ ID NO: 2064841 - RNA, 14 nt, Staphylococcus aureus subsp. aureus Mu50
ucgacuacaaguuu

SEQ ID NO: 2064842 - RNA, 15 nt, Staphylococcus aureus subsp. aureus Mu50
ucgagaggguacacu

SEQ ID NO: 2064843 - RNA, 16 nt, Staphylococcus aureus subsp. aureus Mu50
ucgcgcucuucuucag

SEQ ID NO: 2064844 - RNA, 17 nt, Staphylococcus aureus subsp. aureus Mu50
ucgccuacuauaaauac

SEQ ID NO: 2064845 - RNA, 14 nt, Staphylococcus aureus subsp. aureus Mu50
ucggaauaaaauaa

SEQ ID NO: 2064846 - RNA, 17 nt, Staphylococcus aureus subsp. aureus Mu50
ucggaaaaagaugaaaa

SEQ ID NO: 2064847 - RNA, 19 nt, Staphylococcus aureus subsp. aureus Mu50
ucggaaaaagaugaaaaag

SEQ ID NO: 2064848 - RNA, 15 nt, Staphylococcus aureus subsp. aureus Mu50
ucgcuucuucuucag

SEQ ID NO: 2064849 - RNA, 21 nt, Staphylococcus aureus subsp. aureus Mu50
ucgcuucuucuucagaaauac

SEQ ID NO: 2064850 - RNA, 21 nt, Staphylococcus aureus subsp. aureus Mu50
ucgcuugcaaagacucaauuu

SEQ ID NO: 2064851 - RNA, 21 nt, Staphylococcus aureus subsp. aureus Mu50
ucgcucacaugugaaauaauc

SEQ ID NO: 2064852 - RNA, 16 nt, Staphylococcus aureus subsp. aureus Mu50
ucgcucacaugugaaa

SEQ ID NO: 2064853 - RNA, 17 nt, Staphylococcus aureus subsp. aureus Mu50
ucgcucauccucauuaa

SEQ ID NO: 2064854 - RNA, 18 nt, Staphylococcus aureus subsp. aureus Mu50
ucgcgucugauucucuaa

SEQ ID NO: 2064855 - RNA, 19 nt, Staphylococcus aureus subsp. aureus Mu50
uccgauuuugauauaaaaa

SEQ ID NO: 2064856 - RNA, 19 nt, Staphylococcus aureus subsp. aureus Mu50
uccgauaucuuuuaauucu

SEQ ID NO: 2064857 - RNA, 14 nt, Staphylococcus aureus subsp. aureus Mu50
uccgacugcaccuc

SEQ ID NO: 2064858 - RNA, 20 nt, Staphylococcus aureus subsp. aureus Mu50
uccgaauucuccguuaauuu

SEQ ID NO: 2064859 - RNA, 21 nt, Staphylococcus aureus subsp. aureus Mu50
uccgaaaauugcuaaaaaaau

SEQ ID NO: 2064860 - RNA, 20 nt, Staphylococcus aureus subsp. aureus Mu50
ucccuuaaauacaauuucuu

SEQ ID NO: 2064861 - RNA, 12 nt, Staphylococcus aureus subsp. aureus Mu50
ucccuuaauaau

SEQ ID NO: 2064862 - RNA, 14 nt, Staphylococcus aureus subsp. aureus Mu50
ucccuuaauaauaa

SEQ ID NO: 2064863 - RNA, 17 nt, Staphylococcus aureus subsp. aureus Mu50
ucccuuaauaauaagua

SEQ ID NO: 2064864 - RNA, 14 nt, Staphylococcus aureus subsp. aureus Mu50
ucccuucaacauag

SEQ ID NO: 2064865 - RNA, 23 nt, Staphylococcus aureus subsp. aureus Mu50
ucccucuaucaaauuaccauuca

SEQ ID NO: 2064866 - RNA, 16 nt, Staphylococcus aureus subsp. aureus Mu50
ucccuacugcaccgau

SEQ ID NO: 2064867 - RNA, 12 nt, Staphylococcus aureus subsp. aureus Mu50
ucccuaugaaau

SEQ ID NO: 2064868 - RNA, 15 nt, Staphylococcus aureus subsp. aureus Mu50
ucccgcuuaaaauga

SEQ ID NO: 2064869 - RNA, 18 nt, Staphylococcus aureus subsp. aureus Mu50
ucccgcauuauuauuaaa

SEQ ID NO: 2064870 - RNA, 19 nt, Staphylococcus aureus subsp. aureus Mu50
ucccacgugccucauccuu

SEQ ID NO: 2064871 - RNA, 15 nt, Staphylococcus aureus subsp. aureus Mu50
ucccacgugccucau

SEQ ID NO: 2064872 - RNA, 17 nt, Staphylococcus aureus subsp. aureus Mu50
ucccaaugcuugaauuu

SEQ ID NO: 2064873 - RNA, 15 nt, Staphylococcus aureus subsp. aureus Mu50
ucccaacuuaauaac

SEQ ID NO: 2064874 - RNA, 14 nt, Staphylococcus aureus subsp. aureus Mu50
ucccaacuuaauaa

SEQ ID NO: 2064875 - RNA, 13 nt, Staphylococcus aureus subsp. aureus Mu50
uccauuuuaugca

SEQ ID NO: 2064876 - RNA, 22 nt, Staphylococcus aureus subsp. aureus Mu50
uccauuagaacuaagaugugca

SEQ ID NO: 2064877 - RNA, 13 nt, Staphylococcus aureus subsp. aureus Mu50
uccauuauauagu

SEQ ID NO: 2064878 - RNA, 11 nt, Staphylococcus aureus subsp. aureus Mu50
uccauuauugg

SEQ ID NO: 2064879 - RNA, 17 nt, Staphylococcus aureus subsp. aureus Mu50
uccauucguauaagaau

SEQ ID NO: 2064880 - RNA, 21 nt, Staphylococcus aureus subsp. aureus Mu50
uccauugaucuuuuauaauga

SEQ ID NO: 2064881 - RNA, 22 nt, Staphylococcus aureus subsp. aureus Mu50
uccaucgucaucacuuuuuaaa

SEQ ID NO: 2064882 - RNA, 19 nt, Staphylococcus aureus subsp. aureus Mu50
uccaucgucaucacuuuuu

SEQ ID NO: 2064883 - RNA, 21 nt, Staphylococcus aureus subsp. aureus Mu50
uccaugaguuuacuaaacuuu

SEQ ID NO: 2064884 - RNA, 20 nt, Staphylococcus aureus subsp. aureus Mu50
ucccagauucauaucuuuca

SEQ ID NO: 2064885 - RNA, 13 nt, Staphylococcus aureus subsp. aureus Mu50
ucccauaaugacu

SEQ ID NO: 2064886 - RNA, 19 nt, Staphylococcus aureus subsp. aureus Mu50
ucccauaaaagacagaaau

SEQ ID NO: 2064887 - RNA, 14 nt, Staphylococcus aureus subsp. aureus Mu50
ucccauuuuuaaaa

SEQ ID NO: 2064888 - RNA, 17 nt, Staphylococcus aureus subsp. aureus Mu50
ucccauucuuugaggug

SEQ ID NO: 2064889 - RNA, 22 nt, Staphylococcus aureus subsp. aureus Mu50
ucccaucuuuuagguaauaauu

SEQ ID NO: 2064890 - RNA, 22 nt, Staphylococcus aureus subsp. aureus Mu50
ucccauguauucuuagauauua

SEQ ID NO: 2064891 - RNA, 13 nt, Staphylococcus aureus subsp. aureus Mu50
ucccauacugauu

SEQ ID NO: 2064892 - RNA, 19 nt, Staphylococcus aureus subsp. aureus Mu50
uccccauuaauuaacaaag

SEQ ID NO: 2064893 - RNA, 15 nt, Staphylococcus aureus subsp. aureus Mu50
uccaauuuuauugag

SEQ ID NO: 2064894 - RNA, 12 nt, Staphylococcus aureus subsp. aureus Mu50
uccaauuuaaaa

SEQ ID NO: 2064895 - RNA, 20 nt, Staphylococcus aureus subsp. aureus Mu50
uccaaucaucauuaaaucug

SEQ ID NO: 2064896 - RNA, 22 nt, Staphylococcus aureus subsp. aureus Mu50
uccaaucaucauuaaaucugau

SEQ ID NO: 2064897 - RNA, 15 nt, Staphylococcus aureus subsp. aureus Mu50
uccaauuaaauauuu

SEQ ID NO: 2064898 - RNA, 22 nt, Staphylococcus aureus subsp. aureus Mu50
uccaaucuauuuuaaacucauc

SEQ ID NO: 2064899 - RNA, 17 nt, Staphylococcus aureus subsp. aureus Mu50
uccaaugcaauugguag

SEQ ID NO: 2064900 - RNA, 15 nt, Staphylococcus aureus subsp. aureus Mu50
uccaauuaccaauga

SEQ ID NO: 2064901 - RNA, 15 nt, Staphylococcus aureus subsp. aureus Mu50
uccaauuauguuuau

SEQ ID NO: 2064902 - RNA, 23 nt, Staphylococcus aureus subsp. aureus Mu50
uccaauucauuuuauaaaucaaa

SEQ ID NO: 2064903 - RNA, 18 nt, Staphylococcus aureus subsp. aureus Mu50
uccaaggauguuauaaaa

SEQ ID NO: 2064904 - RNA, 19 nt, Staphylococcus aureus subsp. aureus Mu50
uccaaggauguuauaaaau

SEQ ID NO: 2064905 - RNA, 19 nt, Staphylococcus aureus subsp. aureus Mu50
uccaagugacaacauuauu

SEQ ID NO: 2064906 - RNA, 17 nt, Staphylococcus aureus subsp. aureus Mu50
uccaauaauaaaccuaa

SEQ ID NO: 2064907 - RNA, 19 nt, Staphylococcus aureus subsp. aureus Mu50
uccaagauuaugacaacau

SEQ ID NO: 2064908 - RNA, 16 nt, Staphylococcus aureus subsp. aureus Mu50
uccaagauuaugacaa

SEQ ID NO: 2064909 - RNA, 13 nt, Staphylococcus aureus subsp. aureus Mu50
uccacacauuaag

SEQ ID NO: 2064910 - RNA, 13 nt, Staphylococcus aureus subsp. aureus Mu50
uccacagaauuag

SEQ ID NO: 2064911 - RNA, 22 nt, Staphylococcus aureus subsp. aureus Mu50
uccaccugauaacgagcuaaua

SEQ ID NO: 2064912 - RNA, 15 nt, Staphylococcus aureus subsp. aureus Mu50
uccacgcucacauua

SEQ ID NO: 2064913 - RNA, 13 nt, Staphylococcus aureus subsp. aureus Mu50
uccacuuuauaau

SEQ ID NO: 2064914 - RNA, 17 nt, Staphylococcus aureus subsp. aureus Mu50
uccacuucaucuaaaug

SEQ ID NO: 2064915 - RNA, 17 nt, Staphylococcus aureus subsp. aureus Mu50
uccagcagucauuugau

SEQ ID NO: 2064916 - RNA, 14 nt, Staphylococcus aureus subsp. aureus Mu50
uccaguauuaacug

SEQ ID NO: 2064917 - RNA, 19 nt, Staphylococcus aureus subsp. aureus Mu50
uccaguuuauaacugggau

SEQ ID NO: 2064918 - RNA, 22 nt, Staphylococcus aureus subsp. aureus Mu50
uccaguggaaaugauaauuuaa

SEQ ID NO: 2064919 - RNA, 23 nt, Staphylococcus aureus subsp. aureus Mu50
uccaguggaaaugauaauuuaau

SEQ ID NO: 2064920 - RNA, 23 nt, Staphylococcus aureus subsp. aureus Mu50
uccauauuuuuuaguaauaacau

SEQ ID NO: 2064921 - RNA, 17 nt, Staphylococcus aureus subsp. aureus Mu50
uccauauaaccuauuuc

SEQ ID NO: 2064922 - RNA, 21 nt, Staphylococcus aureus subsp. aureus Mu50
uccaucauuuguguaaaugaa

SEQ ID NO: 2064923 - RNA, 22 nt, Staphylococcus aureus subsp. aureus Mu50
uccauacaaaucguaaacauaa

SEQ ID NO: 2064924 - RNA, 21 nt, Staphylococcus aureus subsp. aureus Mu50
uccauaaucuuuauuaauaaa

SEQ ID NO: 2064925 - RNA, 20 nt, Staphylococcus aureus subsp. aureus Mu50
uccauaacuguaguuucuua

SEQ ID NO: 2064926 - RNA, 14 nt, Staphylococcus aureus subsp. aureus Mu50
uccauaaauauuua

SEQ ID NO: 2064927 - RNA, 18 nt, Staphylococcus aureus subsp. aureus Mu50
uccauaagucacauuuau

SEQ ID NO: 2064928 - RNA, 15 nt, Staphylococcus aureus subsp. aureus Mu50
uccaguuuucaauuu

SEQ ID NO: 2064929 - RNA, 16 nt, Staphylococcus aureus subsp. aureus Mu50
uccaguuuucaauuua

SEQ ID NO: 2064930 - RNA, 18 nt, Staphylococcus aureus subsp. aureus Mu50
uccauaaauaaaaugcua

SEQ ID NO: 2064931 - RNA, 13 nt, Staphylococcus aureus subsp. aureus Mu50
uccauaaauauua

SEQ ID NO: 2064932 - RNA, 17 nt, Staphylococcus aureus subsp. aureus Mu50
uccauaaauauuaaauu

SEQ ID NO: 2064933 - RNA, 21 nt, Staphylococcus aureus subsp. aureus Mu50
uccauaguaaucgauugguaa

SEQ ID NO: 2064934 - RNA, 15 nt, Staphylococcus aureus subsp. aureus Mu50
uccauaggauucuua

SEQ ID NO: 2064935 - RNA, 17 nt, Staphylococcus aureus subsp. aureus Mu50
uccauacguaucaaaau

SEQ ID NO: 2064936 - RNA, 13 nt, Staphylococcus aureus subsp. aureus Mu50
ucauuucuuuguu

SEQ ID NO: 2064937 - RNA, 14 nt, Staphylococcus aureus subsp. aureus Mu50
ucauuuguauagau

SEQ ID NO: 2064938 - RNA, 17 nt, Staphylococcus aureus subsp. aureus Mu50
ucauuuguguaaaugaa

SEQ ID NO: 2064939 - RNA, 17 nt, Staphylococcus aureus subsp. aureus Mu50
ucauuuguguuuuuaau

SEQ ID NO: 2064940 - RNA, 24 nt, Staphylococcus aureus subsp. aureus Mu50
ucauuuguguuuuuaauguuugcu

SEQ ID NO: 2064941 - RNA, 12 nt, Staphylococcus aureus subsp. aureus Mu50
ucauuucaauca

SEQ ID NO: 2064942 - RNA, 16 nt, Staphylococcus aureus subsp. aureus Mu50
ucauuucgauuaauuu

SEQ ID NO: 2064943 - RNA, 19 nt, Staphylococcus aureus subsp. aureus Mu50
ucauuuucugcuuucgcuu

SEQ ID NO: 2064944 - RNA, 11 nt, Staphylococcus aureus subsp. aureus Mu50
ucauuuuuaau

SEQ ID NO: 2064945 - RNA, 13 nt, Staphylococcus aureus subsp. aureus Mu50
ucauuuuuaauug

SEQ ID NO: 2064946 - RNA, 16 nt, Staphylococcus aureus subsp. aureus Mu50
ucauuuucauuguaug

SEQ ID NO: 2064947 - RNA, 12 nt, Staphylococcus aureus subsp. aureus Mu50
ucauuuucaaua

SEQ ID NO: 2064948 - RNA, 14 nt, Staphylococcus aureus subsp. aureus Mu50
ucauuuucaacaua

SEQ ID NO: 2064949 - RNA, 19 nt, Staphylococcus aureus subsp. aureus Mu50
ucauuuucaacauaauauu

SEQ ID NO: 2064950 - RNA, 15 nt, Staphylococcus aureus subsp. aureus Mu50
ucauuuuaaauucaa

SEQ ID NO: 2064951 - RNA, 23 nt, Staphylococcus aureus subsp. aureus Mu50
ucauuggcaauauacuuuuuaaa

SEQ ID NO: 2064952 - RNA, 14 nt, Staphylococcus aureus subsp. aureus Mu50
ucauuguauaaaaa

SEQ ID NO: 2064953 - RNA, 15 nt, Staphylococcus aureus subsp. aureus Mu50
ucauuguauaaaaag

SEQ ID NO: 2064954 - RNA, 19 nt, Staphylococcus aureus subsp. aureus Mu50
ucauugguuucaucauauc

SEQ ID NO: 2064955 - RNA, 19 nt, Staphylococcus aureus subsp. aureus Mu50
ucauuguguccauaaauau

SEQ ID NO: 2064956 - RNA, 13 nt, Staphylococcus aureus subsp. aureus Mu50
ucauuuauaacau

SEQ ID NO: 2064957 - RNA, 17 nt, Staphylococcus aureus subsp. aureus Mu50
ucauuucaauauuaaaa

SEQ ID NO: 2064958 - RNA, 18 nt, Staphylococcus aureus subsp. aureus Mu50
ucauuucaauauuaaaau

SEQ ID NO: 2064959 - RNA, 19 nt, Staphylococcus aureus subsp. aureus Mu50
ucauuucaauauuaaaaua

SEQ ID NO: 2064960 - RNA, 20 nt, Staphylococcus aureus subsp. aureus Mu50
ucauuucaaauaagaaugug

SEQ ID NO: 2064961 - RNA, 13 nt, Staphylococcus aureus subsp. aureus Mu50
ucauuuaaaauau

SEQ ID NO: 2064962 - RNA, 12 nt, Staphylococcus aureus subsp. aureus Mu50
ucauuuaaaaua

SEQ ID NO: 2064963 - RNA, 14 nt, Staphylococcus aureus subsp. aureus Mu50
uccaaaacauuuug

SEQ ID NO: 2064964 - RNA, 12 nt, Staphylococcus aureus subsp. aureus Mu50
ucauuuuuucaa

SEQ ID NO: 2064965 - RNA, 13 nt, Staphylococcus aureus subsp. aureus Mu50
ucauuuuuucaau

SEQ ID NO: 2064966 - RNA, 15 nt, Staphylococcus aureus subsp. aureus Mu50
uccaaagaaacggaa

SEQ ID NO: 2064967 - RNA, 21 nt, Staphylococcus aureus subsp. aureus Mu50
uccaaagcuugauuuaacaac

SEQ ID NO: 2064968 - RNA, 16 nt, Staphylococcus aureus subsp. aureus Mu50
uccaaauauuaaaaac

SEQ ID NO: 2064969 - RNA, 17 nt, Staphylococcus aureus subsp. aureus Mu50
uccaaaggccaugagcu

SEQ ID NO: 2064970 - RNA, 18 nt, Staphylococcus aureus subsp. aureus Mu50
uccaaaguacucaaguaa

SEQ ID NO: 2064971 - RNA, 22 nt, Staphylococcus aureus subsp. aureus Mu50
uccaaaguaacaugugcaagua

SEQ ID NO: 2064972 - RNA, 18 nt, Staphylococcus aureus subsp. aureus Mu50
uccaacacccauauaauu

SEQ ID NO: 2064973 - RNA, 21 nt, Staphylococcus aureus subsp. aureus Mu50
uccaacacccauauaauuugg

SEQ ID NO: 2064974 - RNA, 13 nt, Staphylococcus aureus subsp. aureus Mu50
ucauuaaauauuu

SEQ ID NO: 2064975 - RNA, 18 nt, Staphylococcus aureus subsp. aureus Mu50
ucauguucuuauaaaaaa

SEQ ID NO: 2064976 - RNA, 16 nt, Staphylococcus aureus subsp. aureus Mu50
ucauguucuuguaauc

SEQ ID NO: 2064977 - RNA, 16 nt, Staphylococcus aureus subsp. aureus Mu50
ucauuacaaagucugu

SEQ ID NO: 2064978 - RNA, 17 nt, Staphylococcus aureus subsp. aureus Mu50
ucauuacaaagucuguc

SEQ ID NO: 2064979 - RNA, 19 nt, Staphylococcus aureus subsp. aureus Mu50
ucauuacaaagucugucug

SEQ ID NO: 2064980 - RNA, 22 nt, Staphylococcus aureus subsp. aureus Mu50
ucauuacaaagucugucugaau

SEQ ID NO: 2064981 - RNA, 14 nt, Staphylococcus aureus subsp. aureus Mu50
ucauuaauuuuuca

SEQ ID NO: 2064982 - RNA, 15 nt, Staphylococcus aureus subsp. aureus Mu50
ucauuaauuuuucaa

SEQ ID NO: 2064983 - RNA, 14 nt, Staphylococcus aureus subsp. aureus Mu50
ucauuacauuuuau

SEQ ID NO: 2064984 - RNA, 18 nt, Staphylococcus aureus subsp. aureus Mu50
ucaugucuagauuuuaaa

SEQ ID NO: 2064985 - RNA, 12 nt, Staphylococcus aureus subsp. aureus Mu50
ucaugugcuuug

SEQ ID NO: 2064986 - RNA, 21 nt, Staphylococcus aureus subsp. aureus Mu50
ucaugugucacaaugaccauu

SEQ ID NO: 2064987 - RNA, 17 nt, Staphylococcus aureus subsp. aureus Mu50
ucauguucuaaugauau

SEQ ID NO: 2064988 - RNA, 17 nt, Staphylococcus aureus subsp. aureus Mu50
ucauguucauaauauaa

SEQ ID NO: 2064989 - RNA, 19 nt, Staphylococcus aureus subsp. aureus Mu50
ucauucuguguaaauauaa

SEQ ID NO: 2064990 - RNA, 20 nt, Staphylococcus aureus subsp. aureus Mu50
ucauucuuuaauauaaauuu

SEQ ID NO: 2064991 - RNA, 11 nt, Staphylococcus aureus subsp. aureus Mu50
ucauuaucauu

SEQ ID NO: 2064992 - RNA, 19 nt, Staphylococcus aureus subsp. aureus Mu50
ucauuauauaauucuucaa

SEQ ID NO: 2064993 - RNA, 16 nt, Staphylococcus aureus subsp. aureus Mu50
ucauuauaaugauuuu

SEQ ID NO: 2064994 - RNA, 19 nt, Staphylococcus aureus subsp. aureus Mu50
ucauuauagucuuaaacau

SEQ ID NO: 2064995 - RNA, 18 nt, Staphylococcus aureus subsp. aureus Mu50
ucauuagauaaaauaauu

SEQ ID NO: 2064996 - RNA, 16 nt, Staphylococcus aureus subsp. aureus Mu50
ucauuagcaauuucau

SEQ ID NO: 2064997 - RNA, 17 nt, Staphylococcus aureus subsp. aureus Mu50
ucauuagcauuauuauu

SEQ ID NO: 2064998 - RNA, 23 nt, Staphylococcus aureus subsp. aureus Mu50
ucauuaggucuacgaucaaaauc

SEQ ID NO: 2064999 - RNA, 18 nt, Staphylococcus aureus subsp. aureus Mu50
ucauuagcgcaagagaua

SEQ ID NO: 2065000 - RNA, 20 nt, Staphylococcus aureus subsp. aureus Mu50
ucauuagcgcaagagauaag

SEQ ID NO: 2065001 - RNA, 15 nt, Staphylococcus aureus subsp. aureus Mu50
ucauuaguguagaaa

SEQ ID NO: 2065002 - RNA, 18 nt, Staphylococcus aureus subsp. aureus Mu50
ucauuaguguagaaaaua

SEQ ID NO: 2065003 - RNA, 13 nt, Staphylococcus aureus subsp. aureus Mu50
ucauucacuguau

SEQ ID NO: 2065004 - RNA, 12 nt, Staphylococcus aureus subsp. aureus Mu50
ucauuauuuaaa

SEQ ID NO: 2065005 - RNA, 18 nt, Staphylococcus aureus subsp. aureus Mu50
ucauuauuugauaaauaa

SEQ ID NO: 2065006 - RNA, 21 nt, Staphylococcus aureus subsp. aureus Mu50
ucauuauuugauaaauaaaau

SEQ ID NO: 2065007 - RNA, 12 nt, Staphylococcus aureus subsp. aureus Mu50
ucaugagcacaa

SEQ ID NO: 2065008 - RNA, 17 nt, Staphylococcus aureus subsp. aureus Mu50
ucaugagcacaaacuaa

SEQ ID NO: 2065009 - RNA, 22 nt, Staphylococcus aureus subsp. aureus Mu50
ucaucuuucacaauuguauaau

SEQ ID NO: 2065010 - RNA, 15 nt, Staphylococcus aureus subsp. aureus Mu50
ucaugcuauuuaaau

SEQ ID NO: 2065011 - RNA, 21 nt, Staphylococcus aureus subsp. aureus Mu50
ucaugcuauuuaaaucuaagu

SEQ ID NO: 2065012 - RNA, 13 nt, Staphylococcus aureus subsp. aureus Mu50
ucaugccuucaug

SEQ ID NO: 2065013 - RNA, 15 nt, Staphylococcus aureus subsp. aureus Mu50
ucaugcaaaauaaua

SEQ ID NO: 2065014 - RNA, 13 nt, Staphylococcus aureus subsp. aureus Mu50
ucaugcauucuau

SEQ ID NO: 2065015 - RNA, 20 nt, Staphylococcus aureus subsp. aureus Mu50
ucaugccgucgauagauguu

SEQ ID NO: 2065016 - RNA, 12 nt, Staphylococcus aureus subsp. aureus Mu50
ucaugccuucau

SEQ ID NO: 2065017 - RNA, 20 nt, Staphylococcus aureus subsp. aureus Mu50
ucaucuuaugacugcuuuuu

SEQ ID NO: 2065018 - RNA, 19 nt, Staphylococcus aureus subsp. aureus Mu50
ucaucuucugaauuuaaua

SEQ ID NO: 2065019 - RNA, 21 nt, Staphylococcus aureus subsp. aureus Mu50
ucaucuuucaacgcauauucu

SEQ ID NO: 2065020 - RNA, 14 nt, Staphylococcus aureus subsp. aureus Mu50
ucaucuuuauuuac

SEQ ID NO: 2065021 - RNA, 17 nt, Staphylococcus aureus subsp. aureus Mu50
ucaucuuucaaaugcuu

SEQ ID NO: 2065022 - RNA, 18 nt, Staphylococcus aureus subsp. aureus Mu50
ucaucuuucaaaugcuua

SEQ ID NO: 2065023 - RNA, 23 nt, Staphylococcus aureus subsp. aureus Mu50
ucaucuugcgccuuguucaauuc

SEQ ID NO: 2065024 - RNA, 17 nt, Staphylococcus aureus subsp. aureus Mu50
ucaucuugagauuuuca

SEQ ID NO: 2065025 - RNA, 16 nt, Staphylococcus aureus subsp. aureus Mu50
ucaucugcuuguaaua

SEQ ID NO: 2065026 - RNA, 15 nt, Staphylococcus aureus subsp. aureus Mu50
ucaucugguauuuua

SEQ ID NO: 2065027 - RNA, 22 nt, Staphylococcus aureus subsp. aureus Mu50
ucaucugaugaggcaauauuaa

SEQ ID NO: 2065028 - RNA, 12 nt, Staphylococcus aureus subsp. aureus Mu50
ucaucguauuuc

SEQ ID NO: 2065029 - RNA, 18 nt, Staphylococcus aureus subsp. aureus Mu50
ucaucuauuuaauaaugu

SEQ ID NO: 2065030 - RNA, 19 nt, Staphylococcus aureus subsp. aureus Mu50
ucaucuauauuuaauuuug

SEQ ID NO: 2065031 - RNA, 23 nt, Staphylococcus aureus subsp. aureus Mu50
ucaucuaacgacccaaauuauau

SEQ ID NO: 2065032 - RNA, 16 nt, Staphylococcus aureus subsp. aureus Mu50
ucaucacuuuuuaaac

SEQ ID NO: 2065033 - RNA, 18 nt, Staphylococcus aureus subsp. aureus Mu50
ucaucacgugauaaugac

SEQ ID NO: 2065034 - RNA, 19 nt, Staphylococcus aureus subsp. aureus Mu50
ucaucaccuuguuaaaaua

SEQ ID NO: 2065035 - RNA, 19 nt, Staphylococcus aureus subsp. aureus Mu50
ucaucauaaucaagaauau

SEQ ID NO: 2065036 - RNA, 19 nt, Staphylococcus aureus subsp. aureus Mu50
ucaucauaaucugcugcug

SEQ ID NO: 2065037 - RNA, 21 nt, Staphylococcus aureus subsp. aureus Mu50
ucaucaugacuauuuuccauc

SEQ ID NO: 2065038 - RNA, 15 nt, Staphylococcus aureus subsp. aureus Mu50
ucaucauuaaaucug

SEQ ID NO: 2065039 - RNA, 23 nt, Staphylococcus aureus subsp. aureus Mu50
ucaucauuguaaaacaaauuaca

SEQ ID NO: 2065040 - RNA, 16 nt, Staphylococcus aureus subsp. aureus Mu50
ucaucauuuaaauauu

SEQ ID NO: 2065041 - RNA, 17 nt, Staphylococcus aureus subsp. aureus Mu50
ucaucaugugcuuuguu

SEQ ID NO: 2065042 - RNA, 13 nt, Staphylococcus aureus subsp. aureus Mu50
ucauccauaaaaa

SEQ ID NO: 2065043 - RNA, 14 nt, Staphylococcus aureus subsp. aureus Mu50
ucauaguuauuaaa

SEQ ID NO: 2065044 - RNA, 16 nt, Staphylococcus aureus subsp. aureus Mu50
ucauaguucaaauuga

SEQ ID NO: 2065045 - RNA, 15 nt, Staphylococcus aureus subsp. aureus Mu50
ucauaguuauuaaau

SEQ ID NO: 2065046 - RNA, 16 nt, Staphylococcus aureus subsp. aureus Mu50
ucauagccuauuuaaa

SEQ ID NO: 2065047 - RNA, 11 nt, Staphylococcus aureus subsp. aureus Mu50
ucauagccuau

SEQ ID NO: 2065048 - RNA, 23 nt, Staphylococcus aureus subsp. aureus Mu50
ucauagacuacgcgauugacgug

SEQ ID NO: 2065049 - RNA, 22 nt, Staphylococcus aureus subsp. aureus Mu50
ucauacgcaaugauuauaaaua

SEQ ID NO: 2065050 - RNA, 16 nt, Staphylococcus aureus subsp. aureus Mu50
ucauaccuuuuaauuu

SEQ ID NO: 2065051 - RNA, 17 nt, Staphylococcus aureus subsp. aureus Mu50
ucauaccgacaccuaua

SEQ ID NO: 2065052 - RNA, 21 nt, Staphylococcus aureus subsp. aureus Mu50
ucauacuauaagcaauuucua

SEQ ID NO: 2065053 - RNA, 21 nt, Staphylococcus aureus subsp. aureus Mu50
ucauaauauugaugaauaaau

SEQ ID NO: 2065054 - RNA, 13 nt, Staphylococcus aureus subsp. aureus Mu50
ucauaauaauuca

SEQ ID NO: 2065055 - RNA, 13 nt, Staphylococcus aureus subsp. aureus Mu50
ucauaaucaaguc

SEQ ID NO: 2065056 - RNA, 21 nt, Staphylococcus aureus subsp. aureus Mu50
ucauaauguaagcgaauacaa

SEQ ID NO: 2065057 - RNA, 18 nt, Staphylococcus aureus subsp. aureus Mu50
ucauaaugaauaauuaaa

SEQ ID NO: 2065058 - RNA, 14 nt, Staphylococcus aureus subsp. aureus Mu50
ucauaaugaauaau

SEQ ID NO: 2065059 - RNA, 22 nt, Staphylococcus aureus subsp. aureus Mu50
ucauaacgauuguugcaaugau

SEQ ID NO: 2065060 - RNA, 19 nt, Staphylococcus aureus subsp. aureus Mu50
ucauaccaaaaacauuaac

SEQ ID NO: 2065061 - RNA, 18 nt, Staphylococcus aureus subsp. aureus Mu50
ucauaccaaaaacauuaa

SEQ ID NO: 2065062 - RNA, 21 nt, Staphylococcus aureus subsp. aureus Mu50
ucauacacuaucauuaucaaa

SEQ ID NO: 2065063 - RNA, 21 nt, Staphylococcus aureus subsp. aureus Mu50
ucauaauuaacacauucaaau

SEQ ID NO: 2065064 - RNA, 14 nt, Staphylococcus aureus subsp. aureus Mu50
ucauaauuaauaac

SEQ ID NO: 2065065 - RNA, 12 nt, Staphylococcus aureus subsp. aureus Mu50
ucauaauuuaaa

SEQ ID NO: 2065066 - RNA, 15 nt, Staphylococcus aureus subsp. aureus Mu50
ucauaugcaucaaca

SEQ ID NO: 2065067 - RNA, 15 nt, Staphylococcus aureus subsp. aureus Mu50
ucauauggaauacua

SEQ ID NO: 2065068 - RNA, 14 nt, Staphylococcus aureus subsp. aureus Mu50
ucauaucuuucaau

SEQ ID NO: 2065069 - RNA, 17 nt, Staphylococcus aureus subsp. aureus Mu50
ucauaucuuuauuugau

SEQ ID NO: 2065070 - RNA, 22 nt, Staphylococcus aureus subsp. aureus Mu50
ucauaucuuuauuugauucuuc

SEQ ID NO: 2065071 - RNA, 16 nt, Staphylococcus aureus subsp. aureus Mu50
ucauauucacaucuuu

SEQ ID NO: 2065072 - RNA, 15 nt, Staphylococcus aureus subsp. aureus Mu50
ucauauucacaucuu

SEQ ID NO: 2065073 - RNA, 18 nt, Staphylococcus aureus subsp. aureus Mu50
ucauauguuuuauaauaa

SEQ ID NO: 2065074 - RNA, 20 nt, Staphylococcus aureus subsp. aureus Mu50
ucauauguuuuauaauaaau

SEQ ID NO: 2065075 - RNA, 23 nt, Staphylococcus aureus subsp. aureus Mu50
ucauauccuucauuagugacaag

SEQ ID NO: 2065076 - RNA, 17 nt, Staphylococcus aureus subsp. aureus Mu50
ucauauauuuuguuaau

SEQ ID NO: 2065077 - RNA, 22 nt, Staphylococcus aureus subsp. aureus Mu50
ucauauaaaucaaauauacuuu

SEQ ID NO: 2065078 - RNA, 13 nt, Staphylococcus aureus subsp. aureus Mu50
ucauauaaauagc

SEQ ID NO: 2065079 - RNA, 14 nt, Staphylococcus aureus subsp. aureus Mu50
ucauaguugucuuu

SEQ ID NO: 2065080 - RNA, 15 nt, Staphylococcus aureus subsp. aureus Mu50
ucauauaugauaaau

SEQ ID NO: 2065081 - RNA, 14 nt, Staphylococcus aureus subsp. aureus Mu50
ucauauaaugaaug

SEQ ID NO: 2065082 - RNA, 19 nt, Staphylococcus aureus subsp. aureus Mu50
ucauauaaugguugaauaa

SEQ ID NO: 2065083 - RNA, 21 nt, Staphylococcus aureus subsp. aureus Mu50
ucauauuuauauuuacacaga

SEQ ID NO: 2065084 - RNA, 18 nt, Staphylococcus aureus subsp. aureus Mu50
ucauauuuagguaauaca

SEQ ID NO: 2065085 - RNA, 17 nt, Staphylococcus aureus subsp. aureus Mu50
ucauauuugaauacuuu

SEQ ID NO: 2065086 - RNA, 11 nt, Staphylococcus aureus subsp. aureus Mu50
ucauauuuaua

SEQ ID NO: 2065087 - RNA, 12 nt, Staphylococcus aureus subsp. aureus Mu50
ucaucaauaauu

SEQ ID NO: 2065088 - RNA, 18 nt, Staphylococcus aureus subsp. aureus Mu50
ucaucaaacaacaucacu

SEQ ID NO: 2065089 - RNA, 14 nt, Staphylococcus aureus subsp. aureus Mu50
ucauaaaugacuga

SEQ ID NO: 2065090 - RNA, 19 nt, Staphylococcus aureus subsp. aureus Mu50
ucauaacgacaacuugaac

SEQ ID NO: 2065091 - RNA, 12 nt, Staphylococcus aureus subsp. aureus Mu50
ucauaaauauuu

SEQ ID NO: 2065092 - RNA, 16 nt, Staphylococcus aureus subsp. aureus Mu50
ucauaaauauaaaaua

SEQ ID NO: 2065093 - RNA, 15 nt, Staphylococcus aureus subsp. aureus Mu50
ucauaaauauaaaau

SEQ ID NO: 2065094 - RNA, 15 nt, Staphylococcus aureus subsp. aureus Mu50
ucauaaaguuuauuu

SEQ ID NO: 2065095 - RNA, 13 nt, Staphylococcus aureus subsp. aureus Mu50
ucauaaaauacca

SEQ ID NO: 2065096 - RNA, 15 nt, Staphylococcus aureus subsp. aureus Mu50
ucauaaaauuuaaaa

SEQ ID NO: 2065097 - RNA, 18 nt, Staphylococcus aureus subsp. aureus Mu50
ucauaaaauuuaaaacaa

SEQ ID NO: 2065098 - RNA, 19 nt, Staphylococcus aureus subsp. aureus Mu50
ucauaaaaaucauaaauaa

SEQ ID NO: 2065099 - RNA, 13 nt, Staphylococcus aureus subsp. aureus Mu50
ucaguuaauaauu

SEQ ID NO: 2065100 - RNA, 18 nt, Staphylococcus aureus subsp. aureus Mu50
ucaguucaaacagaaauu

SEQ ID NO: 2065101 - RNA, 13 nt, Staphylococcus aureus subsp. aureus Mu50
ucaguuaaaucuu

SEQ ID NO: 2065102 - RNA, 16 nt, Staphylococcus aureus subsp. aureus Mu50
ucaguugagucaauuu

SEQ ID NO: 2065103 - RNA, 14 nt, Staphylococcus aureus subsp. aureus Mu50
ucagucaauucaaa

SEQ ID NO: 2065104 - RNA, 18 nt, Staphylococcus aureus subsp. aureus Mu50
ucaguaucuaaauauuaa

SEQ ID NO: 2065105 - RNA, 23 nt, Staphylococcus aureus subsp. aureus Mu50
ucaguaucuaaauauuaaauuau

SEQ ID NO: 2065106 - RNA, 23 nt, Staphylococcus aureus subsp. aureus Mu50
ucaguacgguuauuuaauaaugc

SEQ ID NO: 2065107 - RNA, 16 nt, Staphylococcus aureus subsp. aureus Mu50
ucaguaaucuuguuuu

SEQ ID NO: 2065108 - RNA, 20 nt, Staphylococcus aureus subsp. aureus Mu50
ucaguaauuucuccaaguac

SEQ ID NO: 2065109 - RNA, 15 nt, Staphylococcus aureus subsp. aureus Mu50
ucaguaccauguuuu

SEQ ID NO: 2065110 - RNA, 17 nt, Staphylococcus aureus subsp. aureus Mu50
ucaguacgaacaacuaa

SEQ ID NO: 2065111 - RNA, 17 nt, Staphylococcus aureus subsp. aureus Mu50
ucaguaaaaacgaaauu

SEQ ID NO: 2065112 - RNA, 24 nt, Staphylococcus aureus subsp. aureus Mu50
ucaguaaaaacgaaauuguuaucu

SEQ ID NO: 2065113 - RNA, 13 nt, Staphylococcus aureus subsp. aureus Mu50
ucaguaauaauac

SEQ ID NO: 2065114 - RNA, 15 nt, Staphylococcus aureus subsp. aureus Mu50
ucaguaauaauguag

SEQ ID NO: 2065115 - RNA, 14 nt, Staphylococcus aureus subsp. aureus Mu50
ucagcugaugcuuc

SEQ ID NO: 2065116 - RNA, 15 nt, Staphylococcus aureus subsp. aureus Mu50
ucagcugaugcuucg

SEQ ID NO: 2065117 - RNA, 13 nt, Staphylococcus aureus subsp. aureus Mu50
ucagcuuauuaag

SEQ ID NO: 2065118 - RNA, 15 nt, Staphylococcus aureus subsp. aureus Mu50
ucagcuaauucgucu

SEQ ID NO: 2065119 - RNA, 14 nt, Staphylococcus aureus subsp. aureus Mu50
ucagcuaaauauuu

SEQ ID NO: 2065120 - RNA, 13 nt, Staphylococcus aureus subsp. aureus Mu50
ucagcuauaaaag

SEQ ID NO: 2065121 - RNA, 10 nt, Staphylococcus aureus subsp. aureus Mu50
ucagcuuguu

SEQ ID NO: 2065122 - RNA, 16 nt, Staphylococcus aureus subsp. aureus Mu50
ucagcuuuaauaauau

SEQ ID NO: 2065123 - RNA, 14 nt, Staphylococcus aureus subsp. aureus Mu50
ucagcuuuaauaau

SEQ ID NO: 2065124 - RNA, 13 nt, Staphylococcus aureus subsp. aureus Mu50
ucagcuuuuucac

SEQ ID NO: 2065125 - RNA, 14 nt, Staphylococcus aureus subsp. aureus Mu50
ucaggaauagaugu

SEQ ID NO: 2065126 - RNA, 16 nt, Staphylococcus aureus subsp. aureus Mu50
ucaggaauagauguca

SEQ ID NO: 2065127 - RNA, 22 nt, Staphylococcus aureus subsp. aureus Mu50
ucaggaccaaauagagaaauac

SEQ ID NO: 2065128 - RNA, 14 nt, Staphylococcus aureus subsp. aureus Mu50
uaucuucaguuauu

SEQ ID NO: 2065129 - RNA, 16 nt, Staphylococcus aureus subsp. aureus Mu50
uaucuuauuauuaauu

SEQ ID NO: 2065130 - RNA, 19 nt, Staphylococcus aureus subsp. aureus Mu50
uaucuucacacuuuuagaa

SEQ ID NO: 2065131 - RNA, 23 nt, Staphylococcus aureus subsp. aureus Mu50
ucaggaucacguuuuucuuuaaa

SEQ ID NO: 2065132 - RNA, 16 nt, Staphylococcus aureus subsp. aureus Mu50
ucagggaaaucaucug

SEQ ID NO: 2065133 - RNA, 21 nt, Staphylococcus aureus subsp. aureus Mu50
ucaggggccccaacacagaga

SEQ ID NO: 2065134 - RNA, 19 nt, Staphylococcus aureus subsp. aureus Mu50
ucaggggccccaacacaga

SEQ ID NO: 2065135 - RNA, 15 nt, Staphylococcus aureus subsp. aureus Mu50
ggauuaucuguaauu

SEQ ID NO: 2065136 - RNA, 17 nt, Staphylococcus aureus subsp. aureus Mu50
ggaugaguuuaaaaaua

SEQ ID NO: 2065137 - RNA, 19 nt, Staphylococcus aureus subsp. aureus Mu50
ggaugaguuuaaaaauaug

SEQ ID NO: 2065138 - RNA, 22 nt, Staphylococcus aureus subsp. aureus Mu50
ggauuuuuuuauguuugggaua

SEQ ID NO: 2065139 - RNA, 17 nt, Staphylococcus aureus subsp. aureus Mu50
ggauuuuuacaaaguga

SEQ ID NO: 2065140 - RNA, 20 nt, Staphylococcus aureus subsp. aureus Mu50
ggauuuccucgguuuuauuu

SEQ ID NO: 2065141 - RNA, 19 nt, Staphylococcus aureus subsp. aureus Mu50
ggauuucuuauuuguaauu

SEQ ID NO: 2065142 - RNA, 13 nt, Staphylococcus aureus subsp. aureus Mu50
ggcaaaucaaaca

SEQ ID NO: 2065143 - RNA, 23 nt, Staphylococcus aureus subsp. aureus Mu50
ggcaaaaaaggaugaugugaaug

SEQ ID NO: 2065144 - RNA, 17 nt, Staphylococcus aureus subsp. aureus Mu50
ggcaaucuauauaaaug

SEQ ID NO: 2065145 - RNA, 20 nt, Staphylococcus aureus subsp. aureus Mu50
ggcaaugaaauuaccaacac

SEQ ID NO: 2065146 - RNA, 15 nt, Staphylococcus aureus subsp. aureus Mu50
ggcaaugaaauuacc

SEQ ID NO: 2065147 - RNA, 21 nt, Staphylococcus aureus subsp. aureus Mu50
ggcaauauugaacaauucuuc

SEQ ID NO: 2065148 - RNA, 14 nt, Staphylococcus aureus subsp. aureus Mu50
ggcaauauacuuuu

SEQ ID NO: 2065149 - RNA, 23 nt, Staphylococcus aureus subsp. aureus Mu50
ggauauuuuuuaauaaucaaacc

SEQ ID NO: 2065150 - RNA, 23 nt, Staphylococcus aureus subsp. aureus Mu50
ggaguauuuuugcguuaauaauu

SEQ ID NO: 2065151 - RNA, 16 nt, Staphylococcus aureus subsp. aureus Mu50
ggagauuagagaagaa

SEQ ID NO: 2065152 - RNA, 12 nt, Staphylococcus aureus subsp. aureus Mu50
ggacugaaagaa

SEQ ID NO: 2065153 - RNA, 19 nt, Staphylococcus aureus subsp. aureus Mu50
ggacaacuaauaacaaaua

SEQ ID NO: 2065154 - RNA, 20 nt, Staphylococcus aureus subsp. aureus Mu50
ggaauacagaugaugcuucu

SEQ ID NO: 2065155 - RNA, 16 nt, Staphylococcus aureus subsp. aureus Mu50
ggaauaccuuuuucua

SEQ ID NO: 2065156 - RNA, 21 nt, Staphylococcus aureus subsp. aureus Mu50
ggaauagauguugaugaagua

SEQ ID NO: 2065157 - RNA, 20 nt, Staphylococcus aureus subsp. aureus Mu50
ggacagaaaagggcaaaaaa

SEQ ID NO: 2065158 - RNA, 10 nt, Staphylococcus aureus subsp. aureus Mu50
ggacaaguuu

SEQ ID NO: 2065159 - RNA, 18 nt, Staphylococcus aureus subsp. aureus Mu50
ggccaaauguugauaaua

SEQ ID NO: 2065160 - RNA, 13 nt, Staphylococcus aureus subsp. aureus Mu50
ggccaugagcucu

SEQ ID NO: 2065161 - RNA, 20 nt, Staphylococcus aureus subsp. aureus Mu50
ggccgugguaugauuuuuga

SEQ ID NO: 2065162 - RNA, 13 nt, Staphylococcus aureus subsp. aureus Mu50
ggcgacauuugua

SEQ ID NO: 2065163 - RNA, 23 nt, Staphylococcus aureus subsp. aureus Mu50
ggcguuucagaaguuguuuagaa

SEQ ID NO: 2065164 - RNA, 23 nt, Staphylococcus aureus subsp. aureus Mu50
ggcgcuguuccaaauucauuugu

SEQ ID NO: 2065165 - RNA, 14 nt, Staphylococcus aureus subsp. aureus Mu50
gucaguaaaaauac

SEQ ID NO: 2065166 - RNA, 20 nt, Staphylococcus aureus subsp. aureus Mu50
gucaggggccccaacacaga

SEQ ID NO: 2065167 - RNA, 23 nt, Staphylococcus aureus subsp. aureus Mu50
gucaggggccccaacacagagaa

SEQ ID NO: 2065168 - RNA, 18 nt, Staphylococcus aureus subsp. aureus Mu50
gucauaauagauaaugca

SEQ ID NO: 2065169 - RNA, 22 nt, Staphylococcus aureus subsp. aureus Mu50
gucauaauuuaaaagauuagau

SEQ ID NO: 2065170 - RNA, 14 nt, Staphylococcus aureus subsp. aureus Mu50
gucauaauuuaaaa

SEQ ID NO: 2065171 - RNA, 18 nt, Staphylococcus aureus subsp. aureus Mu50
gucauagaaauuuuaaaa

SEQ ID NO: 2065172 - RNA, 21 nt, Staphylococcus aureus subsp. aureus Mu50
gucauacgcaaugauuauaaa

SEQ ID NO: 2065173 - RNA, 15 nt, Staphylococcus aureus subsp. aureus Mu50
gucauacuaacuaua

SEQ ID NO: 2065174 - RNA, 16 nt, Staphylococcus aureus subsp. aureus Mu50
gucaugaaaauaagca

SEQ ID NO: 2065175 - RNA, 15 nt, Staphylococcus aureus subsp. aureus Mu50
gucagcuuacaauaa

SEQ ID NO: 2065176 - RNA, 16 nt, Staphylococcus aureus subsp. aureus Mu50
gucaauucaaacugau

SEQ ID NO: 2065177 - RNA, 22 nt, Staphylococcus aureus subsp. aureus Mu50
gucaauuuuaccauguuuuaca

SEQ ID NO: 2065178 - RNA, 20 nt, Staphylococcus aureus subsp. aureus Mu50
gucaauuuuuucaugauuua

SEQ ID NO: 2065179 - RNA, 14 nt, Staphylococcus aureus subsp. aureus Mu50
gucacuuuauuaaa

SEQ ID NO: 2065180 - RNA, 15 nt, Staphylococcus aureus subsp. aureus Mu50
gucacuuuauuaaau

SEQ ID NO: 2065181 - RNA, 12 nt, Staphylococcus aureus subsp. aureus Mu50
gucagauucaaa

SEQ ID NO: 2065182 - RNA, 21 nt, Staphylococcus aureus subsp. aureus Mu50
gucaaugacugagaaaaauau

SEQ ID NO: 2065183 - RNA, 15 nt, Staphylococcus aureus subsp. aureus Mu50
guauaccucuuagca

SEQ ID NO: 2065184 - RNA, 16 nt, Staphylococcus aureus subsp. aureus Mu50
guauauacaaugacag

SEQ ID NO: 2065185 - RNA, 22 nt, Staphylococcus aureus subsp. aureus Mu50
guauaugaauuuuauaaauuaa

SEQ ID NO: 2065186 - RNA, 13 nt, Staphylococcus aureus subsp. aureus Mu50
guauauguauaga

SEQ ID NO: 2065187 - RNA, 22 nt, Staphylococcus aureus subsp. aureus Mu50
guauacaguuuuacuauaauga

SEQ ID NO: 2065188 - RNA, 16 nt, Staphylococcus aureus subsp. aureus Mu50
guauacaacaugugua

SEQ ID NO: 2065189 - RNA, 23 nt, Staphylococcus aureus subsp. aureus Mu50
guauuuuucuuaauuaucauuac

SEQ ID NO: 2065190 - RNA, 15 nt, Staphylococcus aureus subsp. aureus Mu50
guauuuuuauuuaua

SEQ ID NO: 2065191 - RNA, 22 nt, Staphylococcus aureus subsp. aureus Mu50
guauuuuuauuguuuuggcuuu

SEQ ID NO: 2065192 - RNA, 19 nt, Staphylococcus aureus subsp. aureus Mu50
guauauuaaaaauuucaau

SEQ ID NO: 2065193 - RNA, 21 nt, Staphylococcus aureus subsp. aureus Mu50
guauauucaacagggguaaaa

SEQ ID NO: 2065194 - RNA, 18 nt, Staphylococcus aureus subsp. aureus Mu50
guauauugcuuauguaca

SEQ ID NO: 2065195 - RNA, 23 nt, Staphylococcus aureus subsp. aureus Mu50
guccuagacgaucuuuaaugaua

SEQ ID NO: 2065196 - RNA, 20 nt, Staphylococcus aureus subsp. aureus Mu50
guccuauuuguggaaauaaa

SEQ ID NO: 2065197 - RNA, 15 nt, Staphylococcus aureus subsp. aureus Mu50
guccucuugugaaau

SEQ ID NO: 2065198 - RNA, 14 nt, Staphylococcus aureus subsp. aureus Mu50
guccucuaaaacau

SEQ ID NO: 2065199 - RNA, 23 nt, Staphylococcus aureus subsp. aureus Mu50
gucccacucccauuggcauuuac

SEQ ID NO: 2065200 - RNA, 22 nt, Staphylococcus aureus subsp. aureus Mu50
gucccagauucauaucuuucaa

SEQ ID NO: 2065201 - RNA, 19 nt, Staphylococcus aureus subsp. aureus Mu50
gucccauaaggaaccuguc

SEQ ID NO: 2065202 - RNA, 18 nt, Staphylococcus aureus subsp. aureus Mu50
guccaucgucaucacuuu

SEQ ID NO: 2065203 - RNA, 20 nt, Staphylococcus aureus subsp. aureus Mu50
guccaucauuuguguuuuua

SEQ ID NO: 2065204 - RNA, 20 nt, Staphylococcus aureus subsp. aureus Mu50
guccauaaucuuuauuaaua

SEQ ID NO: 2065205 - RNA, 22 nt, Staphylococcus aureus subsp. aureus Mu50
gucgcacuauaaaauucaccaa

SEQ ID NO: 2065206 - RNA, 15 nt, Staphylococcus aureus subsp. aureus Mu50
guccuguacauccac

SEQ ID NO: 2065207 - RNA, 22 nt, Staphylococcus aureus subsp. aureus Mu50
guccuguacauccacuuuauaa

SEQ ID NO: 2065208 - RNA, 11 nt, Staphylococcus aureus subsp. aureus Mu50
guccuucccac

SEQ ID NO: 2065209 - RNA, 13 nt, Staphylococcus aureus subsp. aureus Mu50
guauaaaugcagc

SEQ ID NO: 2065210 - RNA, 15 nt, Staphylococcus aureus subsp. aureus Mu50
guauaaauaaaaaua

SEQ ID NO: 2065211 - RNA, 17 nt, Staphylococcus aureus subsp. aureus Mu50
guagugguucuuauaca

SEQ ID NO: 2065212 - RNA, 23 nt, Staphylococcus aureus subsp. aureus Mu50
guaguguauucauuuuaaauuca

SEQ ID NO: 2065213 - RNA, 22 nt, Staphylococcus aureus subsp. aureus Mu50
guaguuaagauaccuuuuucua

SEQ ID NO: 2065214 - RNA, 22 nt, Staphylococcus aureus subsp. aureus Mu50
guaguuggcugauagaugaaaa

SEQ ID NO: 2065215 - RNA, 18 nt, Staphylococcus aureus subsp. aureus Mu50
guaguucggaugagaaau

SEQ ID NO: 2065216 - RNA, 23 nt, Staphylococcus aureus subsp. aureus Mu50
guaguuggcugauagaugaaaau

SEQ ID NO: 2065217 - RNA, 21 nt, Staphylococcus aureus subsp. aureus Mu50
guagucgaagaagauuaugaa

SEQ ID NO: 2065218 - RNA, 15 nt, Staphylococcus aureus subsp. aureus Mu50
guaccuaaaauagaa

SEQ ID NO: 2065219 - RNA, 12 nt, Staphylococcus aureus subsp. aureus Mu50
guaccguauuuu

SEQ ID NO: 2065220 - RNA, 12 nt, Staphylococcus aureus subsp. aureus Mu50
guaccuaaaaua

SEQ ID NO: 2065221 - RNA, 13 nt, Staphylococcus aureus subsp. aureus Mu50
guaccuaaaauag

SEQ ID NO: 2065222 - RNA, 17 nt, Staphylococcus aureus subsp. aureus Mu50
guacgguagucucccau

SEQ ID NO: 2065223 - RNA, 20 nt, Staphylococcus aureus subsp. aureus Mu50
guacgguuauuuaauaaugc

SEQ ID NO: 2065224 - RNA, 17 nt, Staphylococcus aureus subsp. aureus Mu50
guacuaacguuuuaaag

SEQ ID NO: 2065225 - RNA, 15 nt, Staphylococcus aureus subsp. aureus Mu50
guacguuuuaaauaa

SEQ ID NO: 2065226 - RNA, 15 nt, Staphylococcus aureus subsp. aureus Mu50
guacuaagcuuucau

SEQ ID NO: 2065227 - RNA, 21 nt, Staphylococcus aureus subsp. aureus Mu50
guacuaggaccuacaauuuuc

SEQ ID NO: 2065228 - RNA, 21 nt, Staphylococcus aureus subsp. aureus Mu50
guagacguaaguguaaaugaa

SEQ ID NO: 2065229 - RNA, 13 nt, Staphylococcus aureus subsp. aureus Mu50
guaccaagcuuca

SEQ ID NO: 2065230 - RNA, 16 nt, Staphylococcus aureus subsp. aureus Mu50
guaaugucauagacua

SEQ ID NO: 2065231 - RNA, 11 nt, Staphylococcus aureus subsp. aureus Mu50
guaauguguua

SEQ ID NO: 2065232 - RNA, 11 nt, Staphylococcus aureus subsp. aureus Mu50
guacauguauu

SEQ ID NO: 2065233 - RNA, 13 nt, Staphylococcus aureus subsp. aureus Mu50
guaauuaaauacu

SEQ ID NO: 2065234 - RNA, 24 nt, Staphylococcus aureus subsp. aureus Mu50
guacauuuaauggucuaauaucaa

SEQ ID NO: 2065235 - RNA, 20 nt, Staphylococcus aureus subsp. aureus Mu50
guacauuuauuuucaauaaa

SEQ ID NO: 2065236 - RNA, 23 nt, Staphylococcus aureus subsp. aureus Mu50
guaaucgauugguaaaucuacua

SEQ ID NO: 2065237 - RNA, 14 nt, Staphylococcus aureus subsp. aureus Mu50
guaaucuauuuucu

SEQ ID NO: 2065238 - RNA, 16 nt, Staphylococcus aureus subsp. aureus Mu50
guaaugcuguacuaua

SEQ ID NO: 2065239 - RNA, 16 nt, Staphylococcus aureus subsp. aureus Mu50
guaaugcuuaaaaaca

SEQ ID NO: 2065240 - RNA, 23 nt, Staphylococcus aureus subsp. aureus Mu50
guaaugcuuaaaaacaauauuga

SEQ ID NO: 2065241 - RNA, 21 nt, Staphylococcus aureus subsp. aureus Mu50
guaaacaacaucgauuuauca

SEQ ID NO: 2065242 - RNA, 23 nt, Staphylococcus aureus subsp. aureus Mu50
guaaacaacaucgauuuaucauu

SEQ ID NO: 2065243 - RNA, 14 nt, Staphylococcus aureus subsp. aureus Mu50
guaaacacuauaaa

SEQ ID NO: 2065244 - RNA, 18 nt, Staphylococcus aureus subsp. aureus Mu50
gguguuuauaucuuugug

SEQ ID NO: 2065245 - RNA, 20 nt, Staphylococcus aureus subsp. aureus Mu50
guaaaaguuuugagccaagu

SEQ ID NO: 2065246 - RNA, 14 nt, Staphylococcus aureus subsp. aureus Mu50
guaaaauaaaucau

SEQ ID NO: 2065247 - RNA, 19 nt, Staphylococcus aureus subsp. aureus Mu50
guaaacggaauaacuuuuu

SEQ ID NO: 2065248 - RNA, 16 nt, Staphylococcus aureus subsp. aureus Mu50
guaaacuucuuuucuu

SEQ ID NO: 2065249 - RNA, 22 nt, Staphylococcus aureus subsp. aureus Mu50
guaaagaguacagcgguuugua

SEQ ID NO: 2065250 - RNA, 18 nt, Staphylococcus aureus subsp. aureus Mu50
guaaaccagcuaaaccau

SEQ ID NO: 2065251 - RNA, 17 nt, Staphylococcus aureus subsp. aureus Mu50
guaaacacuauaaaagc

SEQ ID NO: 2065252 - RNA, 18 nt, Staphylococcus aureus subsp. aureus Mu50
guaaaccuacuaauauau

SEQ ID NO: 2065253 - RNA, 14 nt, Staphylococcus aureus subsp. aureus Mu50
guaaauguuaaauu

SEQ ID NO: 2065254 - RNA, 13 nt, Staphylococcus aureus subsp. aureus Mu50
guaaauuacaaaa

SEQ ID NO: 2065255 - RNA, 15 nt, Staphylococcus aureus subsp. aureus Mu50
guaaaugaaauaggc

SEQ ID NO: 2065256 - RNA, 20 nt, Staphylococcus aureus subsp. aureus Mu50
guaaaucuuguuggauuuua

SEQ ID NO: 2065257 - RNA, 19 nt, Staphylococcus aureus subsp. aureus Mu50
guaaauuuuaucuaaacau

SEQ ID NO: 2065258 - RNA, 12 nt, Staphylococcus aureus subsp. aureus Mu50
guaaauuuaaau

SEQ ID NO: 2065259 - RNA, 17 nt, Staphylococcus aureus subsp. aureus Mu50
guaaauuuaucauuuua

SEQ ID NO: 2065260 - RNA, 17 nt, Staphylococcus aureus subsp. aureus Mu50
guaaauuuaaaauaaua

SEQ ID NO: 2065261 - RNA, 13 nt, Staphylococcus aureus subsp. aureus Mu50
guaacaauacgca

SEQ ID NO: 2065262 - RNA, 16 nt, Staphylococcus aureus subsp. aureus Mu50
guaacaauaacaccug

SEQ ID NO: 2065263 - RNA, 17 nt, Staphylococcus aureus subsp. aureus Mu50
guaacacgcucuuuuca

SEQ ID NO: 2065264 - RNA, 18 nt, Staphylococcus aureus subsp. aureus Mu50
guaacacgcucuuuucaa

SEQ ID NO: 2065265 - RNA, 23 nt, Staphylococcus aureus subsp. aureus Mu50
guaacacacuuauaaucuauaaa

SEQ ID NO: 2065266 - RNA, 15 nt, Staphylococcus aureus subsp. aureus Mu50
guaacagugacugau

SEQ ID NO: 2065267 - RNA, 23 nt, Staphylococcus aureus subsp. aureus Mu50
guaacauaaagcuguuuauuggu

SEQ ID NO: 2065268 - RNA, 21 nt, Staphylococcus aureus subsp. aureus Mu50
guaacauaucagcuuuuucau

SEQ ID NO: 2065269 - RNA, 13 nt, Staphylococcus aureus subsp. aureus Mu50
guaaaucaucaua

SEQ ID NO: 2065270 - RNA, 21 nt, Staphylococcus aureus subsp. aureus Mu50
guaaauauaguaauaaaaguc

SEQ ID NO: 2065271 - RNA, 13 nt, Staphylococcus aureus subsp. aureus Mu50
guaaauaauagua

SEQ ID NO: 2065272 - RNA, 20 nt, Staphylococcus aureus subsp. aureus Mu50
guaaauaaaaauuauauaaa

SEQ ID NO: 2065273 - RNA, 14 nt, Staphylococcus aureus subsp. aureus Mu50
guaaaggugauauu

SEQ ID NO: 2065274 - RNA, 21 nt, Staphylococcus aureus subsp. aureus Mu50
guaaaggugauauuugcuagu

SEQ ID NO: 2065275 - RNA, 18 nt, Staphylococcus aureus subsp. aureus Mu50
guaacauuuaaaaaaugc

SEQ ID NO: 2065276 - RNA, 19 nt, Staphylococcus aureus subsp. aureus Mu50
guaacauuuaaaaaaugcg

SEQ ID NO: 2065277 - RNA, 19 nt, Staphylococcus aureus subsp. aureus Mu50
guaacauuagcaugauaaa

SEQ ID NO: 2065278 - RNA, 16 nt, Staphylococcus aureus subsp. aureus Mu50
guaacauuaaaaauaa

SEQ ID NO: 2065279 - RNA, 15 nt, Staphylococcus aureus subsp. aureus Mu50
guaacgcgcaaugag

SEQ ID NO: 2065280 - RNA, 22 nt, Staphylococcus aureus subsp. aureus Mu50
guaacgcucaugaguuucucau

SEQ ID NO: 2065281 - RNA, 22 nt, Staphylococcus aureus subsp. aureus Mu50
guaacuauaugaaauguucccu

SEQ ID NO: 2065282 - RNA, 23 nt, Staphylococcus aureus subsp. aureus Mu50
guaacugauuuuguuucaaacgu

SEQ ID NO: 2065283 - RNA, 15 nt, Staphylococcus aureus subsp. aureus Mu50
guaagacuucccaau

SEQ ID NO: 2065284 - RNA, 16 nt, Staphylococcus aureus subsp. aureus Mu50
guaagacgauuucaau

SEQ ID NO: 2065285 - RNA, 18 nt, Staphylococcus aureus subsp. aureus Mu50
guaagaccccgaaaagag

SEQ ID NO: 2065286 - RNA, 15 nt, Staphylococcus aureus subsp. aureus Mu50
guaaguguaaaugaa

SEQ ID NO: 2065287 - RNA, 14 nt, Staphylococcus aureus subsp. aureus Mu50
guaauaaagaaggg

SEQ ID NO: 2065288 - RNA, 16 nt, Staphylococcus aureus subsp. aureus Mu50
guaaguuugguuucuu

SEQ ID NO: 2065289 - RNA, 18 nt, Staphylococcus aureus subsp. aureus Mu50
guaauaacaucuaaauuu

SEQ ID NO: 2065290 - RNA, 22 nt, Staphylococcus aureus subsp. aureus Mu50
guaauaaccaugccagcuucua

SEQ ID NO: 2065291 - RNA, 19 nt, Staphylococcus aureus subsp. aureus Mu50
guaauauguugcuuaucaa

SEQ ID NO: 2065292 - RNA, 20 nt, Staphylococcus aureus subsp. aureus Mu50
guaagguggacuucuaucuu

SEQ ID NO: 2065293 - RNA, 23 nt, Staphylococcus aureus subsp. aureus Mu50
guaaguaaaauaaaaaaugcacu

SEQ ID NO: 2065294 - RNA, 21 nt, Staphylococcus aureus subsp. aureus Mu50
guaaguaaaauaaaaaaugca

SEQ ID NO: 2065295 - RNA, 22 nt, Staphylococcus aureus subsp. aureus Mu50
guaagcaccuguuauugcaaua

SEQ ID NO: 2065296 - RNA, 18 nt, Staphylococcus aureus subsp. aureus Mu50
ggucuuuuaauuaaaagu

SEQ ID NO: 2065297 - RNA, 23 nt, Staphylococcus aureus subsp. aureus Mu50
ggugauauuugcuagucauaauu

SEQ ID NO: 2065298 - RNA, 21 nt, Staphylococcus aureus subsp. aureus Mu50
ggugcaauaauaaauaggaug

SEQ ID NO: 2065299 - RNA, 23 nt, Staphylococcus aureus subsp. aureus Mu50
gguggagaaccguuuuucaucaa

SEQ ID NO: 2065300 - RNA, 16 nt, Staphylococcus aureus subsp. aureus Mu50
ggugugauguacuacu

SEQ ID NO: 2065301 - RNA, 21 nt, Staphylococcus aureus subsp. aureus Mu50
gguaugauauuucuaaauugu

SEQ ID NO: 2065302 - RNA, 14 nt, Staphylococcus aureus subsp. aureus Mu50
gguauucaaauaaa

SEQ ID NO: 2065303 - RNA, 17 nt, Staphylococcus aureus subsp. aureus Mu50
gguaaugauuuugcuuu

SEQ ID NO: 2065304 - RNA, 21 nt, Staphylococcus aureus subsp. aureus Mu50
gguaauacuauaugaaaagag

SEQ ID NO: 2065305 - RNA, 17 nt, Staphylococcus aureus subsp. aureus Mu50
gguaaguauaauuaaac

SEQ ID NO: 2065306 - RNA, 14 nt, Staphylococcus aureus subsp. aureus Mu50
gguaauuuaacauu

SEQ ID NO: 2065307 - RNA, 23 nt, Staphylococcus aureus subsp. aureus Mu50
gguacacauguacguuuuuuuaa

SEQ ID NO: 2065308 - RNA, 17 nt, Staphylococcus aureus subsp. aureus Mu50
gguacaacuaaauaugc

SEQ ID NO: 2065309 - RNA, 17 nt, Staphylococcus aureus subsp. aureus Mu50
gguacauaaauaccugg

SEQ ID NO: 2065310 - RNA, 22 nt, Staphylococcus aureus subsp. aureus Mu50
gguaccuuuuuauuaucuuuaa

SEQ ID NO: 2065311 - RNA, 19 nt, Staphylococcus aureus subsp. aureus Mu50
gggcauugagauuggaagg

SEQ ID NO: 2065312 - RNA, 12 nt, Staphylococcus aureus subsp. aureus Mu50
gggccccaacac

SEQ ID NO: 2065313 - RNA, 13 nt, Staphylococcus aureus subsp. aureus Mu50
gggccccaacaca

SEQ ID NO: 2065314 - RNA, 15 nt, Staphylococcus aureus subsp. aureus Mu50
gggccccaacacaga

SEQ ID NO: 2065315 - RNA, 17 nt, Staphylococcus aureus subsp. aureus Mu50
gggauauagaaaaggga

SEQ ID NO: 2065316 - RNA, 22 nt, Staphylococcus aureus subsp. aureus Mu50
gggaugggccccaacaaagaga

SEQ ID NO: 2065317 - RNA, 24 nt, Staphylococcus aureus subsp. aureus Mu50
gggaugggccccaacacagagaau

SEQ ID NO: 2065318 - RNA, 15 nt, Staphylococcus aureus subsp. aureus Mu50
gggcuuuuaugcaug

SEQ ID NO: 2065319 - RNA, 11 nt, Staphylococcus aureus subsp. aureus Mu50
ggcuuuaaaau

SEQ ID NO: 2065320 - RNA, 18 nt, Staphylococcus aureus subsp. aureus Mu50
ggcuuuuuuauuuuauaa

SEQ ID NO: 2065321 - RNA, 19 nt, Staphylococcus aureus subsp. aureus Mu50
ggcuuaauuaauaaaaaaa

SEQ ID NO: 2065322 - RNA, 17 nt, Staphylococcus aureus subsp. aureus Mu50
uaauuaggauuuccgga

SEQ ID NO: 2065323 - RNA, 23 nt, Staphylococcus aureus subsp. aureus Mu50
uaauuaggauuuccggaacaaua

SEQ ID NO: 2065324 - RNA, 18 nt, Staphylococcus aureus subsp. aureus Mu50
uaauucauuuauuuucuu

SEQ ID NO: 2065325 - RNA, 19 nt, Staphylococcus aureus subsp. aureus Mu50
uaauucccuaggaaauaaa

SEQ ID NO: 2065326 - RNA, 19 nt, Staphylococcus aureus subsp. aureus Mu50
uaauuauacguuacuaaac

SEQ ID NO: 2065327 - RNA, 15 nt, Staphylococcus aureus subsp. aureus Mu50
uaauuccugauacaa

SEQ ID NO: 2065328 - RNA, 12 nt, Staphylococcus aureus subsp. aureus Mu50
uaauuccuggug

SEQ ID NO: 2065329 - RNA, 13 nt, Staphylococcus aureus subsp. aureus Mu50
uaauuccuggugc

SEQ ID NO: 2065330 - RNA, 12 nt, Staphylococcus aureus subsp. aureus Mu50
uaauucugaaau

SEQ ID NO: 2065331 - RNA, 22 nt, Staphylococcus aureus subsp. aureus Mu50
uaauucugaaaucaguuuuuga

SEQ ID NO: 2065332 - RNA, 13 nt, Staphylococcus aureus subsp. aureus Mu50
uaauucuucauca

SEQ ID NO: 2065333 - RNA, 14 nt, Staphylococcus aureus subsp. aureus Mu50
uaauucuucaucaa

SEQ ID NO: 2065334 - RNA, 23 nt, Staphylococcus aureus subsp. aureus Mu50
uaauucuuaaucgagugauucag

SEQ ID NO: 2065335 - RNA, 19 nt, Staphylococcus aureus subsp. aureus Mu50
uaauugauucucuguagau

SEQ ID NO: 2065336 - RNA, 20 nt, Staphylococcus aureus subsp. aureus Mu50
uaauugcauagcuaaauaaa

SEQ ID NO: 2065337 - RNA, 19 nt, Staphylococcus aureus subsp. aureus Mu50
uaauugcauagcuaaauaa

SEQ ID NO: 2065338 - RNA, 15 nt, Staphylococcus aureus subsp. aureus Mu50
uaauugaugucacau

SEQ ID NO: 2065339 - RNA, 19 nt, Staphylococcus aureus subsp. aureus Mu50
uaauugaugaugaugugcu

SEQ ID NO: 2065340 - RNA, 20 nt, Staphylococcus aureus subsp. aureus Mu50
uaauugauauggaucauaau

SEQ ID NO: 2065341 - RNA, 23 nt, Staphylococcus aureus subsp. aureus Mu50
uaauucuucaucaauaacuauaa

SEQ ID NO: 2065342 - RNA, 15 nt, Staphylococcus aureus subsp. aureus Mu50
uaauugaaaaaccaa

SEQ ID NO: 2065343 - RNA, 16 nt, Staphylococcus aureus subsp. aureus Mu50
uaauuggguuuaauaa

SEQ ID NO: 2065344 - RNA, 16 nt, Staphylococcus aureus subsp. aureus Mu50
uaauuguaaucuauuu

SEQ ID NO: 2065345 - RNA, 21 nt, Staphylococcus aureus subsp. aureus Mu50
uaauuaaacgcucaacuauau

SEQ ID NO: 2065346 - RNA, 17 nt, Staphylococcus aureus subsp. aureus Mu50
uaauuaaagauuaaaau

SEQ ID NO: 2065347 - RNA, 15 nt, Staphylococcus aureus subsp. aureus Mu50
uaauuaaagcaucuu

SEQ ID NO: 2065348 - RNA, 21 nt, Staphylococcus aureus subsp. aureus Mu50
uaauuaacacauucaaauaaa

SEQ ID NO: 2065349 - RNA, 15 nt, Staphylococcus aureus subsp. aureus Mu50
uaauuaauaagcauu

SEQ ID NO: 2065350 - RNA, 20 nt, Staphylococcus aureus subsp. aureus Mu50
uaauuacuuucauuguaaau

SEQ ID NO: 2065351 - RNA, 22 nt, Staphylococcus aureus subsp. aureus Mu50
uaauuacuuucauuguaaauuu

SEQ ID NO: 2065352 - RNA, 20 nt, Staphylococcus aureus subsp. aureus Mu50
uaauuaagaaaaucauucau

SEQ ID NO: 2065353 - RNA, 14 nt, Staphylococcus aureus subsp. aureus Mu50
uaaugugcauuuau

SEQ ID NO: 2065354 - RNA, 21 nt, Staphylococcus aureus subsp. aureus Mu50
uaauguucaaaaaaugaauau

SEQ ID NO: 2065355 - RNA, 18 nt, Staphylococcus aureus subsp. aureus Mu50
uaauguuggcaaacuauu

SEQ ID NO: 2065356 - RNA, 17 nt, Staphylococcus aureus subsp. aureus Mu50
uaauguguuaauacuuc

SEQ ID NO: 2065357 - RNA, 17 nt, Staphylococcus aureus subsp. aureus Mu50
uaaugugcgucacucac

SEQ ID NO: 2065358 - RNA, 19 nt, Staphylococcus aureus subsp. aureus Mu50
uaaugucucuuuucacgaa

SEQ ID NO: 2065359 - RNA, 13 nt, Staphylococcus aureus subsp. aureus Mu50
uaaugucuucaua

SEQ ID NO: 2065360 - RNA, 22 nt, Staphylococcus aureus subsp. aureus Mu50
uaaugucgcacuauaaaauuca

SEQ ID NO: 2065361 - RNA, 17 nt, Staphylococcus aureus subsp. aureus Mu50
uaaugcucuauauaucc

SEQ ID NO: 2065362 - RNA, 22 nt, Staphylococcus aureus subsp. aureus Mu50
uaaucuuguuuucauuuaaaag

SEQ ID NO: 2065363 - RNA, 16 nt, Staphylococcus aureus subsp. aureus Mu50
uaaucuuguuuucauu

SEQ ID NO: 2065364 - RNA, 22 nt, Staphylococcus aureus subsp. aureus Mu50
uaaucuuuaacauuuauucuuu

SEQ ID NO: 2065365 - RNA, 16 nt, Staphylococcus aureus subsp. aureus Mu50
uaaucuugauuauauu

SEQ ID NO: 2065366 - RNA, 15 nt, Staphylococcus aureus subsp. aureus Mu50
uaaucuucacgcuua

SEQ ID NO: 2065367 - RNA, 16 nt, Staphylococcus aureus subsp. aureus Mu50
uaaugucaugaaaaua

SEQ ID NO: 2065368 - RNA, 11 nt, Staphylococcus aureus subsp. aureus Mu50
uaauguauaaa

SEQ ID NO: 2065369 - RNA, 14 nt, Staphylococcus aureus subsp. aureus Mu50
uaauguauaaaaag

SEQ ID NO: 2065370 - RNA, 17 nt, Staphylococcus aureus subsp. aureus Mu50
uaauggcaccauacuuc

SEQ ID NO: 2065371 - RNA, 18 nt, Staphylococcus aureus subsp. aureus Mu50
uaauggcacuuaauauaa

SEQ ID NO: 2065372 - RNA, 18 nt, Staphylococcus aureus subsp. aureus Mu50
uaauggagcacuaucuuu

SEQ ID NO: 2065373 - RNA, 18 nt, Staphylococcus aureus subsp. aureus Mu50
uaaucugcugcuguugaa

SEQ ID NO: 2065374 - RNA, 18 nt, Staphylococcus aureus subsp. aureus Mu50
uaaucguguauuauugaa

SEQ ID NO: 2065375 - RNA, 16 nt, Staphylococcus aureus subsp. aureus Mu50
uaaucuauuuucugcc

SEQ ID NO: 2065376 - RNA, 15 nt, Staphylococcus aureus subsp. aureus Mu50
uaaucuauaaauggc

SEQ ID NO: 2065377 - RNA, 15 nt, Staphylococcus aureus subsp. aureus Mu50
uaaucguauuuuuaa

SEQ ID NO: 2065378 - RNA, 19 nt, Staphylococcus aureus subsp. aureus Mu50
uaaucccauuuuaaaguca

SEQ ID NO: 2065379 - RNA, 13 nt, Staphylococcus aureus subsp. aureus Mu50
uaauccauccauu

SEQ ID NO: 2065380 - RNA, 19 nt, Staphylococcus aureus subsp. aureus Mu50
uaauccaguaaucaaagau

SEQ ID NO: 2065381 - RNA, 20 nt, Staphylococcus aureus subsp. aureus Mu50
uaaucgauugguaaaucuac

SEQ ID NO: 2065382 - RNA, 15 nt, Staphylococcus aureus subsp. aureus Mu50
uaaucgcauucuugg

SEQ ID NO: 2065383 - RNA, 14 nt, Staphylococcus aureus subsp. aureus Mu50
uaaucgauugguaa

SEQ ID NO: 2065384 - RNA, 21 nt, Staphylococcus aureus subsp. aureus Mu50
uaauccccgaagcacagaaaa

SEQ ID NO: 2065385 - RNA, 12 nt, Staphylococcus aureus subsp. aureus Mu50
uaauauuauaaa

SEQ ID NO: 2065386 - RNA, 21 nt, Staphylococcus aureus subsp. aureus Mu50
uaauauuaaauugcguacuug

SEQ ID NO: 2065387 - RNA, 15 nt, Staphylococcus aureus subsp. aureus Mu50
uaauauuauaaccac

SEQ ID NO: 2065388 - RNA, 22 nt, Staphylococcus aureus subsp. aureus Mu50
uaauauuauaaccaccaguaua

SEQ ID NO: 2065389 - RNA, 12 nt, Staphylococcus aureus subsp. aureus Mu50
uaauauuauaag

SEQ ID NO: 2065390 - RNA, 23 nt, Staphylococcus aureus subsp. aureus Mu50
uaaucaaaaaagacucauacaca

SEQ ID NO: 2065391 - RNA, 15 nt, Staphylococcus aureus subsp. aureus Mu50
uaaucaaaccaccaa

SEQ ID NO: 2065392 - RNA, 13 nt, Staphylococcus aureus subsp. aureus Mu50
uaaucaaaauuau

SEQ ID NO: 2065393 - RNA, 12 nt, Staphylococcus aureus subsp. aureus Mu50
uaauauuuucuu

SEQ ID NO: 2065394 - RNA, 15 nt, Staphylococcus aureus subsp. aureus Mu50
uaauauuuuaaacgu

SEQ ID NO: 2065395 - RNA, 16 nt, Staphylococcus aureus subsp. aureus Mu50
uaauauuuucuuagaa

SEQ ID NO: 2065396 - RNA, 12 nt, Staphylococcus aureus subsp. aureus Mu50
uaauauuuuggc

SEQ ID NO: 2065397 - RNA, 15 nt, Staphylococcus aureus subsp. aureus Mu50
uaauagcgucaaguu

SEQ ID NO: 2065398 - RNA, 17 nt, Staphylococcus aureus subsp. aureus Mu50
uaauagcaaaauuaugu

SEQ ID NO: 2065399 - RNA, 24 nt, Staphylococcus aureus subsp. aureus Mu50
uaauagagacauuuuaucugaaaa

SEQ ID NO: 2065400 - RNA, 16 nt, Staphylococcus aureus subsp. aureus Mu50
uaaucagcuuuuucac

SEQ ID NO: 2065401 - RNA, 14 nt, Staphylococcus aureus subsp. aureus Mu50
uaaucauaaugaau

SEQ ID NO: 2065402 - RNA, 15 nt, Staphylococcus aureus subsp. aureus Mu50
uaaucaguuuccgca

SEQ ID NO: 2065403 - RNA, 22 nt, Staphylococcus aureus subsp. aureus Mu50
uaaucaacaaagugcaauuauu

SEQ ID NO: 2065404 - RNA, 15 nt, Staphylococcus aureus subsp. aureus Mu50
uaaucaaauuaguca

SEQ ID NO: 2065405 - RNA, 23 nt, Staphylococcus aureus subsp. aureus Mu50
uaagggguauauuaaaaauuuca

SEQ ID NO: 2065406 - RNA, 23 nt, Staphylococcus aureus subsp. aureus Mu50
uaaggcuaaugauaauccaccaa

SEQ ID NO: 2065407 - RNA, 20 nt, Staphylococcus aureus subsp. aureus Mu50
uaaguauaauuaaacuaaua

SEQ ID NO: 2065408 - RNA, 20 nt, Staphylococcus aureus subsp. aureus Mu50
uaaguaguuguuauauucua

SEQ ID NO: 2065409 - RNA, 17 nt, Staphylococcus aureus subsp. aureus Mu50
uaaguagcucaaaacaa

SEQ ID NO: 2065410 - RNA, 15 nt, Staphylococcus aureus subsp. aureus Mu50
uaaguacuuuuacaa

SEQ ID NO: 2065411 - RNA, 14 nt, Staphylococcus aureus subsp. aureus Mu50
uaaguaauaaaaua

SEQ ID NO: 2065412 - RNA, 13 nt, Staphylococcus aureus subsp. aureus Mu50
uaaguaauauaau

SEQ ID NO: 2065413 - RNA, 16 nt, Staphylococcus aureus subsp. aureus Mu50
uaaguaauaauauaaa

SEQ ID NO: 2065414 - RNA, 12 nt, Staphylococcus aureus subsp. aureus Mu50
uaaguaauucau

SEQ ID NO: 2065415 - RNA, 20 nt, Staphylococcus aureus subsp. aureus Mu50
uaaguaauaauauaaauaaa

SEQ ID NO: 2065416 - RNA, 15 nt, Staphylococcus aureus subsp. aureus Mu50
uaaguacaaauaaua

SEQ ID NO: 2065417 - RNA, 17 nt, Staphylococcus aureus subsp. aureus Mu50
uaaguacagcauauaau

SEQ ID NO: 2065418 - RNA, 18 nt, Staphylococcus aureus subsp. aureus Mu50
uaaggucauuuuuaauug

SEQ ID NO: 2065419 - RNA, 20 nt, Staphylococcus aureus subsp. aureus Mu50
uaaggugauugaacaauaau

SEQ ID NO: 2065420 - RNA, 23 nt, Staphylococcus aureus subsp. aureus Mu50
uaagguauuucauugauaagucu

SEQ ID NO: 2065421 - RNA, 15 nt, Staphylococcus aureus subsp. aureus Mu50
uaagguuugaacucu

SEQ ID NO: 2065422 - RNA, 20 nt, Staphylococcus aureus subsp. aureus Mu50
uaaguaaaauaaaaaaugca

SEQ ID NO: 2065423 - RNA, 21 nt, Staphylococcus aureus subsp. aureus Mu50
uaaguauuuaaauaacaagua

SEQ ID NO: 2065424 - RNA, 19 nt, Staphylococcus aureus subsp. aureus Mu50
uaaguaucgccaucauuca

SEQ ID NO: 2065425 - RNA, 18 nt, Staphylococcus aureus subsp. aureus Mu50
uaagucuagcauuagaau

SEQ ID NO: 2065426 - RNA, 23 nt, Staphylococcus aureus subsp. aureus Mu50
uaagugauuucuucauuaucaau

SEQ ID NO: 2065427 - RNA, 21 nt, Staphylococcus aureus subsp. aureus Mu50
uaagugccuugccaugauuua

SEQ ID NO: 2065428 - RNA, 22 nt, Staphylococcus aureus subsp. aureus Mu50
uaagugauauacgacaaucaca

SEQ ID NO: 2065429 - RNA, 15 nt, Staphylococcus aureus subsp. aureus Mu50
uaagugauaaauaau

SEQ ID NO: 2065430 - RNA, 19 nt, Staphylococcus aureus subsp. aureus Mu50
uaagucuuaacaaauuaaa

SEQ ID NO: 2065431 - RNA, 22 nt, Staphylococcus aureus subsp. aureus Mu50
uaagucugaugucgaaaauagc

SEQ ID NO: 2065432 - RNA, 20 nt, Staphylococcus aureus subsp. aureus Mu50
uaagucugaugucgaaaaua

SEQ ID NO: 2065433 - RNA, 16 nt, Staphylococcus aureus subsp. aureus Mu50
uaagucuuuuaaauga

SEQ ID NO: 2065434 - RNA, 22 nt, Staphylococcus aureus subsp. aureus Mu50
uaaguuaauuuuaugucccaau

SEQ ID NO: 2065435 - RNA, 22 nt, Staphylococcus aureus subsp. aureus Mu50
uaaguuaaaaauguaaauaaaa

SEQ ID NO: 2065436 - RNA, 22 nt, Staphylococcus aureus subsp. aureus Mu50
uaaguuaaaaccuuuucaaauu

SEQ ID NO: 2065437 - RNA, 23 nt, Staphylococcus aureus subsp. aureus Mu50
uaaguuaaaaccuuuucaaauua

SEQ ID NO: 2065438 - RNA, 13 nt, Staphylococcus aureus subsp. aureus Mu50
uaaguuaaaauaa

SEQ ID NO: 2065439 - RNA, 14 nt, Staphylococcus aureus subsp. aureus Mu50
uaaguuaugacuaa

SEQ ID NO: 2065440 - RNA, 21 nt, Staphylococcus aureus subsp. aureus Mu50
uaaguuaugacuaacgaaaaa

SEQ ID NO: 2065441 - RNA, 14 nt, Staphylococcus aureus subsp. aureus Mu50
uaaguuugaaucau

SEQ ID NO: 2065442 - RNA, 22 nt, Staphylococcus aureus subsp. aureus Mu50
uaaguuucgcugcuacaccacc

SEQ ID NO: 2065443 - RNA, 19 nt, Staphylococcus aureus subsp. aureus Mu50
uaaguuuuugaauaucuaa

SEQ ID NO: 2065444 - RNA, 23 nt, Staphylococcus aureus subsp. aureus Mu50
uaauaaaaaccaauauuucuggg

SEQ ID NO: 2065445 - RNA, 22 nt, Staphylococcus aureus subsp. aureus Mu50
uaauaaaucauuaguuguauca

SEQ ID NO: 2065446 - RNA, 23 nt, Staphylococcus aureus subsp. aureus Mu50
uaauaaaucgaauugauggaaaa

SEQ ID NO: 2065447 - RNA, 22 nt, Staphylococcus aureus subsp. aureus Mu50
uaauaaaucuaucuacucaaau

SEQ ID NO: 2065448 - RNA, 15 nt, Staphylococcus aureus subsp. aureus Mu50
uaauaaauuuaacgu

SEQ ID NO: 2065449 - RNA, 12 nt, Staphylococcus aureus subsp. aureus Mu50
uaauaaauugua

SEQ ID NO: 2065450 - RNA, 22 nt, Staphylococcus aureus subsp. aureus Mu50
uaauaaauuguuaucguucaau

SEQ ID NO: 2065451 - RNA, 12 nt, Staphylococcus aureus subsp. aureus Mu50
uaauaacaaaau

SEQ ID NO: 2065452 - RNA, 16 nt, Staphylococcus aureus subsp. aureus Mu50
uaauaaagaauaaaca

SEQ ID NO: 2065453 - RNA, 16 nt, Staphylococcus aureus subsp. aureus Mu50
uaauaaaccuacaaua

SEQ ID NO: 2065454 - RNA, 15 nt, Staphylococcus aureus subsp. aureus Mu50
uaauaaaucauuagu

SEQ ID NO: 2065455 - RNA, 22 nt, Staphylococcus aureus subsp. aureus Mu50
uaauaaaucacgccauaaucuu

SEQ ID NO: 2065456 - RNA, 16 nt, Staphylococcus aureus subsp. aureus Mu50
uaauaaaacuugugau

SEQ ID NO: 2065457 - RNA, 13 nt, Staphylococcus aureus subsp. aureus Mu50
uaauaaaccuaaa

SEQ ID NO: 2065458 - RNA, 21 nt, Staphylococcus aureus subsp. aureus Mu50
uaauaaacgacgcaagugacu

SEQ ID NO: 2065459 - RNA, 19 nt, Staphylococcus aureus subsp. aureus Mu50
uaauaacgcugcaccuaag

SEQ ID NO: 2065460 - RNA, 18 nt, Staphylococcus aureus subsp. aureus Mu50
uaauaaccauguaaaauu

SEQ ID NO: 2065461 - RNA, 20 nt, Staphylococcus aureus subsp. aureus Mu50
uaauaacauccccaaaaaua

SEQ ID NO: 2065462 - RNA, 14 nt, Staphylococcus aureus subsp. aureus Mu50
uaauaacaucuaaa

SEQ ID NO: 2065463 - RNA, 17 nt, Staphylococcus aureus subsp. aureus Mu50
uaauaacaucuaaauuu

SEQ ID NO: 2065464 - RNA, 20 nt, Staphylococcus aureus subsp. aureus Mu50
uaauaacccgaacacaaaaa

SEQ ID NO: 2065465 - RNA, 19 nt, Staphylococcus aureus subsp. aureus Mu50
uaauaaccauguaaaauua

SEQ ID NO: 2065466 - RNA, 15 nt, Staphylococcus aureus subsp. aureus Mu50
uaauaacgauaagca

SEQ ID NO: 2065467 - RNA, 17 nt, Staphylococcus aureus subsp. aureus Mu50
uaauaacgcauauaagc

SEQ ID NO: 2065468 - RNA, 18 nt, Staphylococcus aureus subsp. aureus Mu50
uaauaauauugaauggua

SEQ ID NO: 2065469 - RNA, 13 nt, Staphylococcus aureus subsp. aureus Mu50
uaauaauaucuuu

SEQ ID NO: 2065470 - RNA, 15 nt, Staphylococcus aureus subsp. aureus Mu50
uaauaauauaaauaa

SEQ ID NO: 2065471 - RNA, 15 nt, Staphylococcus aureus subsp. aureus Mu50
uaauaauacuucuaa

SEQ ID NO: 2065472 - RNA, 19 nt, Staphylococcus aureus subsp. aureus Mu50
uaauaauacuucuaaucgu

SEQ ID NO: 2065473 - RNA, 15 nt, Staphylococcus aureus subsp. aureus Mu50
uaauaaguugaauau

SEQ ID NO: 2065474 - RNA, 20 nt, Staphylococcus aureus subsp. aureus Mu50
uaauaaguugaauauaaaaa

SEQ ID NO: 2065475 - RNA, 21 nt, Staphylococcus aureus subsp. aureus Mu50
uaauaaguugaauauaaaaaa

SEQ ID NO: 2065476 - RNA, 18 nt, Staphylococcus aureus subsp. aureus Mu50
uaauaauuggaaucaucu

SEQ ID NO: 2065477 - RNA, 12 nt, Staphylococcus aureus subsp. aureus Mu50
uaauaauuuaac

SEQ ID NO: 2065478 - RNA, 19 nt, Staphylococcus aureus subsp. aureus Mu50
uaauaauuuaacuaaucaa

SEQ ID NO: 2065479 - RNA, 12 nt, Staphylococcus aureus subsp. aureus Mu50
uaauaauuuaca

SEQ ID NO: 2065480 - RNA, 20 nt, Staphylococcus aureus subsp. aureus Mu50
uaauaaugacgagaauuaaa

SEQ ID NO: 2065481 - RNA, 13 nt, Staphylococcus aureus subsp. aureus Mu50
uaauaauuaauaa

SEQ ID NO: 2065482 - RNA, 18 nt, Staphylococcus aureus subsp. aureus Mu50
uaauaaugggaauuguau

SEQ ID NO: 2065483 - RNA, 16 nt, Staphylococcus aureus subsp. aureus Mu50
uaauaauguaucauuu

SEQ ID NO: 2065484 - RNA, 16 nt, Staphylococcus aureus subsp. aureus Mu50
uaauaaugaauucuau

SEQ ID NO: 2065485 - RNA, 15 nt, Staphylococcus aureus subsp. aureus Mu50
uaauaaugacgagaa

SEQ ID NO: 2065486 - RNA, 17 nt, Staphylococcus aureus subsp. aureus Mu50
uaauaaucuuuaacauu

SEQ ID NO: 2065487 - RNA, 18 nt, Staphylococcus aureus subsp. aureus Mu50
uaauaaucuuuaacauuu

SEQ ID NO: 2065488 - RNA, 18 nt, Staphylococcus aureus subsp. aureus Mu50
uaauacaugacauucauu

SEQ ID NO: 2065489 - RNA, 13 nt, Staphylococcus aureus subsp. aureus Mu50
uaauaauuuuuuu

SEQ ID NO: 2065490 - RNA, 18 nt, Staphylococcus aureus subsp. aureus Mu50
uaauaauuuuuuuccuuu

SEQ ID NO: 2065491 - RNA, 15 nt, Staphylococcus aureus subsp. aureus Mu50
uaauacuuuucucga

SEQ ID NO: 2065492 - RNA, 14 nt, Staphylococcus aureus subsp. aureus Mu50
uaauagaaauaauc

SEQ ID NO: 2065493 - RNA, 15 nt, Staphylococcus aureus subsp. aureus Mu50
uaauagaaauaauca

SEQ ID NO: 2065494 - RNA, 17 nt, Staphylococcus aureus subsp. aureus Mu50
uaauacuuucaaacaaa

SEQ ID NO: 2065495 - RNA, 14 nt, Staphylococcus aureus subsp. aureus Mu50
uaauacuuucacuu

SEQ ID NO: 2065496 - RNA, 22 nt, Staphylococcus aureus subsp. aureus Mu50
uaauacuucauauccuucauua

SEQ ID NO: 2065497 - RNA, 16 nt, Staphylococcus aureus subsp. aureus Mu50
uaauacuguuuaaaua

SEQ ID NO: 2065498 - RNA, 17 nt, Staphylococcus aureus subsp. aureus Mu50
uaauacuguuuaaauaa

SEQ ID NO: 2065499 - RNA, 21 nt, Staphylococcus aureus subsp. aureus Mu50
uaauacguguguuuucuuuuc

SEQ ID NO: 2065500 - RNA, 17 nt, Staphylococcus aureus subsp. aureus Mu50
uaauacgucguaaugaa

SEQ ID NO: 2065501 - RNA, 17 nt, Staphylococcus aureus subsp. aureus Mu50
uaauacguuuaauaaug

SEQ ID NO: 2065502 - RNA, 16 nt, Staphylococcus aureus subsp. aureus Mu50
uaauacuauaugaaaa

SEQ ID NO: 2065503 - RNA, 22 nt, Staphylococcus aureus subsp. aureus Mu50
uaauaccuaauugcuuaauauc

SEQ ID NO: 2065504 - RNA, 17 nt, Staphylococcus aureus subsp. aureus Mu50
uaauaccagcauccauu

SEQ ID NO: 2065505 - RNA, 17 nt, Staphylococcus aureus subsp. aureus Mu50
uaauaccuuuacuuuca

SEQ ID NO: 2065506 - RNA, 19 nt, Staphylococcus aureus subsp. aureus Mu50
uaauaccuuuacuuucauu

SEQ ID NO: 2065507 - RNA, 20 nt, Staphylococcus aureus subsp. aureus Mu50
uaauaccuuuacuuucauua

SEQ ID NO: 2065508 - RNA, 13 nt, Staphylococcus aureus subsp. aureus Mu50
uaauacauuaugu

SEQ ID NO: 2065509 - RNA, 16 nt, Staphylococcus aureus subsp. aureus Mu50
uacuacgcauuauuaa

SEQ ID NO: 2065510 - RNA, 23 nt, Staphylococcus aureus subsp. aureus Mu50
uacuacuugauucuacuucaccu

SEQ ID NO: 2065511 - RNA, 22 nt, Staphylococcus aureus subsp. aureus Mu50
uacuaagcgcucauaaacgauu

SEQ ID NO: 2065512 - RNA, 18 nt, Staphylococcus aureus subsp. aureus Mu50
uacuaagcuuucauuaau

SEQ ID NO: 2065513 - RNA, 16 nt, Staphylococcus aureus subsp. aureus Mu50
uacuaacugaagacac

SEQ ID NO: 2065514 - RNA, 15 nt, Staphylococcus aureus subsp. aureus Mu50
uacuaauauauuaau

SEQ ID NO: 2065515 - RNA, 13 nt, Staphylococcus aureus subsp. aureus Mu50
uacuaauaucuuc

SEQ ID NO: 2065516 - RNA, 12 nt, Staphylococcus aureus subsp. aureus Mu50
uacuaauuucua

SEQ ID NO: 2065517 - RNA, 17 nt, Staphylococcus aureus subsp. aureus Mu50
uacuaaacgauaaauua

SEQ ID NO: 2065518 - RNA, 18 nt, Staphylococcus aureus subsp. aureus Mu50
uacguuauuucaauaaua

SEQ ID NO: 2065519 - RNA, 13 nt, Staphylococcus aureus subsp. aureus Mu50
uacuaaaucauuu

SEQ ID NO: 2065520 - RNA, 19 nt, Staphylococcus aureus subsp. aureus Mu50
uacuaaauaaguaguucag

SEQ ID NO: 2065521 - RNA, 14 nt, Staphylococcus aureus subsp. aureus Mu50
uacuaaacuuuuuu

SEQ ID NO: 2065522 - RNA, 18 nt, Staphylococcus aureus subsp. aureus Mu50
uacuaacaauuacgacaa

SEQ ID NO: 2065523 - RNA, 15 nt, Staphylococcus aureus subsp. aureus Mu50
uacuaaauugagaag

SEQ ID NO: 2065524 - RNA, 15 nt, Staphylococcus aureus subsp. aureus Mu50
uacgugcuuuaaagu

SEQ ID NO: 2065525 - RNA, 16 nt, Staphylococcus aureus subsp. aureus Mu50
uacguguguuuucuuu

SEQ ID NO: 2065526 - RNA, 16 nt, Staphylococcus aureus subsp. aureus Mu50
uacguuauuucaauaa

SEQ ID NO: 2065527 - RNA, 16 nt, Staphylococcus aureus subsp. aureus Mu50
uacgcuuuuuaaaaaa

SEQ ID NO: 2065528 - RNA, 11 nt, Staphylococcus aureus subsp. aureus Mu50
uacgacucucc

SEQ ID NO: 2065529 - RNA, 18 nt, Staphylococcus aureus subsp. aureus Mu50
uacgacgucgcaacagga

SEQ ID NO: 2065530 - RNA, 16 nt, Staphylococcus aureus subsp. aureus Mu50
uacgauucaauuuaac

SEQ ID NO: 2065531 - RNA, 19 nt, Staphylococcus aureus subsp. aureus Mu50
uacgauugaguugaaaaua

SEQ ID NO: 2065532 - RNA, 19 nt, Staphylococcus aureus subsp. aureus Mu50
uacgccuucuuuauaacuu

SEQ ID NO: 2065533 - RNA, 19 nt, Staphylococcus aureus subsp. aureus Mu50
uacgcgauugacguggucu

SEQ ID NO: 2065534 - RNA, 17 nt, Staphylococcus aureus subsp. aureus Mu50
uacgcaaugauuauaaa

SEQ ID NO: 2065535 - RNA, 23 nt, Staphylococcus aureus subsp. aureus Mu50
uaccauuucaaccuuuuaauagu

SEQ ID NO: 2065536 - RNA, 23 nt, Staphylococcus aureus subsp. aureus Mu50
uaccauugugaugauaauuaaug

SEQ ID NO: 2065537 - RNA, 17 nt, Staphylococcus aureus subsp. aureus Mu50
uaccauguuuuuuaagu

SEQ ID NO: 2065538 - RNA, 23 nt, Staphylococcus aureus subsp. aureus Mu50
uaccaugaugagauaaaaucaua

SEQ ID NO: 2065539 - RNA, 19 nt, Staphylococcus aureus subsp. aureus Mu50
uaccaugaugagauaaaau

SEQ ID NO: 2065540 - RNA, 22 nt, Staphylococcus aureus subsp. aureus Mu50
uaccaugaugagauaaaaucau

SEQ ID NO: 2065541 - RNA, 14 nt, Staphylococcus aureus subsp. aureus Mu50
uaccaucuuuaaua

SEQ ID NO: 2065542 - RNA, 15 nt, Staphylococcus aureus subsp. aureus Mu50
uaccauauaauucuu

SEQ ID NO: 2065543 - RNA, 15 nt, Staphylococcus aureus subsp. aureus Mu50
uaccaguugauuuaa

SEQ ID NO: 2065544 - RNA, 16 nt, Staphylococcus aureus subsp. aureus Mu50
uaccauagauuauauu

SEQ ID NO: 2065545 - RNA, 16 nt, Staphylococcus aureus subsp. aureus Mu50
uaccacauuuuccuug

SEQ ID NO: 2065546 - RNA, 12 nt, Staphylococcus aureus subsp. aureus Mu50
uaccaccccaac

SEQ ID NO: 2065547 - RNA, 18 nt, Staphylococcus aureus subsp. aureus Mu50
uaccacacuuuaaacaag

SEQ ID NO: 2065548 - RNA, 20 nt, Staphylococcus aureus subsp. aureus Mu50
uaccacacuuuaaacaagca

SEQ ID NO: 2065549 - RNA, 20 nt, Staphylococcus aureus subsp. aureus Mu50
uaccacaucgcauaauaucu

SEQ ID NO: 2065550 - RNA, 17 nt, Staphylococcus aureus subsp. aureus Mu50
uaccucgaaauuacugu

SEQ ID NO: 2065551 - RNA, 11 nt, Staphylococcus aureus subsp. aureus Mu50
uaccuaaaaua

SEQ ID NO: 2065552 - RNA, 16 nt, Staphylococcus aureus subsp. aureus Mu50
uaccucuacauuauau

SEQ ID NO: 2065553 - RNA, 16 nt, Staphylococcus aureus subsp. aureus Mu50
uaccucuugauaaaau

SEQ ID NO: 2065554 - RNA, 14 nt, Staphylococcus aureus subsp. aureus Mu50
uacauauguguaug

SEQ ID NO: 2065555 - RNA, 15 nt, Staphylococcus aureus subsp. aureus Mu50
uacaucaauuucuag

SEQ ID NO: 2065556 - RNA, 17 nt, Staphylococcus aureus subsp. aureus Mu50
uacauauaauaugugca

SEQ ID NO: 2065557 - RNA, 16 nt, Staphylococcus aureus subsp. aureus Mu50
uacauaggauaucuac

SEQ ID NO: 2065558 - RNA, 13 nt, Staphylococcus aureus subsp. aureus Mu50
uacauauaagaau

SEQ ID NO: 2065559 - RNA, 14 nt, Staphylococcus aureus subsp. aureus Mu50
uacauauaauaugu

SEQ ID NO: 2065560 - RNA, 15 nt, Staphylococcus aureus subsp. aureus Mu50
uacauaggauaucua

SEQ ID NO: 2065561 - RNA, 14 nt, Staphylococcus aureus subsp. aureus Mu50
uacaucuaauaaau

SEQ ID NO: 2065562 - RNA, 14 nt, Staphylococcus aureus subsp. aureus Mu50
uacauccauacuuc

SEQ ID NO: 2065563 - RNA, 17 nt, Staphylococcus aureus subsp. aureus Mu50
uacaucauuaaauauuu

SEQ ID NO: 2065564 - RNA, 14 nt, Staphylococcus aureus subsp. aureus Mu50
uacaucauuaaaua

SEQ ID NO: 2065565 - RNA, 17 nt, Staphylococcus aureus subsp. aureus Mu50
uacaugacauucauuua

SEQ ID NO: 2065566 - RNA, 16 nt, Staphylococcus aureus subsp. aureus Mu50
uacauguauaaaagau

SEQ ID NO: 2065567 - RNA, 14 nt, Staphylococcus aureus subsp. aureus Mu50
uacauguauaaaag

SEQ ID NO: 2065568 - RNA, 19 nt, Staphylococcus aureus subsp. aureus Mu50
uacaugcaccuuuacaaca

SEQ ID NO: 2065569 - RNA, 18 nt, Staphylococcus aureus subsp. aureus Mu50
uacauuaaagaaaauauc

SEQ ID NO: 2065570 - RNA, 17 nt, Staphylococcus aureus subsp. aureus Mu50
uacauuacgcucaucac

SEQ ID NO: 2065571 - RNA, 17 nt, Staphylococcus aureus subsp. aureus Mu50
uacauuaauauaaauau

SEQ ID NO: 2065572 - RNA, 14 nt, Staphylococcus aureus subsp. aureus Mu50
uacauuaauuuguc

SEQ ID NO: 2065573 - RNA, 18 nt, Staphylococcus aureus subsp. aureus Mu50
uacauuacgcucaucacc

SEQ ID NO: 2065574 - RNA, 15 nt, Staphylococcus aureus subsp. aureus Mu50
uacauugauaaaaua

SEQ ID NO: 2065575 - RNA, 14 nt, Staphylococcus aureus subsp. aureus Mu50
uacauugauaaauu

SEQ ID NO: 2065576 - RNA, 16 nt, Staphylococcus aureus subsp. aureus Mu50
uacauuguaaauauag

SEQ ID NO: 2065577 - RNA, 20 nt, Staphylococcus aureus subsp. aureus Mu50
uacauuuauuuucaauaaau

SEQ ID NO: 2065578 - RNA, 23 nt, Staphylococcus aureus subsp. aureus Mu50
uacauuucucguuucgucagauu

SEQ ID NO: 2065579 - RNA, 17 nt, Staphylococcus aureus subsp. aureus Mu50
uacauuuugcucuaaac

SEQ ID NO: 2065580 - RNA, 21 nt, Staphylococcus aureus subsp. aureus Mu50
uacauuuugaaacaucuaaau

SEQ ID NO: 2065581 - RNA, 14 nt, Staphylococcus aureus subsp. aureus Mu50
uacauuuguagaga

SEQ ID NO: 2065582 - RNA, 17 nt, Staphylococcus aureus subsp. aureus Mu50
uaccaaaaaguauugcc

SEQ ID NO: 2065583 - RNA, 22 nt, Staphylococcus aureus subsp. aureus Mu50
uaccaauaucaugcaaaauaau

SEQ ID NO: 2065584 - RNA, 15 nt, Staphylococcus aureus subsp. aureus Mu50
uaccaaugaauaaau

SEQ ID NO: 2065585 - RNA, 19 nt, Staphylococcus aureus subsp. aureus Mu50
uaccaaugaauaaauugau

SEQ ID NO: 2065586 - RNA, 18 nt, Staphylococcus aureus subsp. aureus Mu50
uaccaauacguuuccaau

SEQ ID NO: 2065587 - RNA, 18 nt, Staphylococcus aureus subsp. aureus Mu50
uaccaaggguuucuggcu

SEQ ID NO: 2065588 - RNA, 19 nt, Staphylococcus aureus subsp. aureus Mu50
uaccaagugcuuuuuuacc

SEQ ID NO: 2065589 - RNA, 22 nt, Staphylococcus aureus subsp. aureus Mu50
uaccaagugcuuuuuuaccagc

SEQ ID NO: 2065590 - RNA, 14 nt, Staphylococcus aureus subsp. aureus Mu50
uaccaaacaauaca

SEQ ID NO: 2065591 - RNA, 16 nt, Staphylococcus aureus subsp. aureus Mu50
uaccaaauaaauaagu

SEQ ID NO: 2065592 - RNA, 13 nt, Staphylococcus aureus subsp. aureus Mu50
uaccaaacugccu

SEQ ID NO: 2065593 - RNA, 14 nt, Staphylococcus aureus subsp. aureus Mu50
uacaaugaaaaaac

SEQ ID NO: 2065594 - RNA, 22 nt, Staphylococcus aureus subsp. aureus Mu50
uacaaugaauuguuaguuuucu

SEQ ID NO: 2065595 - RNA, 20 nt, Staphylococcus aureus subsp. aureus Mu50
uacaauauucaauaauucau

SEQ ID NO: 2065596 - RNA, 14 nt, Staphylococcus aureus subsp. aureus Mu50
uacaauaugauuaa

SEQ ID NO: 2065597 - RNA, 19 nt, Staphylococcus aureus subsp. aureus Mu50
uacaauauucaauaauuca

SEQ ID NO: 2065598 - RNA, 17 nt, Staphylococcus aureus subsp. aureus Mu50
uacaauauagaaaauga

SEQ ID NO: 2065599 - RNA, 13 nt, Staphylococcus aureus subsp. aureus Mu50
uacaauaguacua

SEQ ID NO: 2065600 - RNA, 17 nt, Staphylococcus aureus subsp. aureus Mu50
uacaauaguauaaauau

SEQ ID NO: 2065601 - RNA, 14 nt, Staphylococcus aureus subsp. aureus Mu50
uacaauaaccauuu

SEQ ID NO: 2065602 - RNA, 13 nt, Staphylococcus aureus subsp. aureus Mu50
uacaauaaucacu

SEQ ID NO: 2065603 - RNA, 14 nt, Staphylococcus aureus subsp. aureus Mu50
uacaauaaugugca

SEQ ID NO: 2065604 - RNA, 14 nt, Staphylococcus aureus subsp. aureus Mu50
uacaaauauaucua

SEQ ID NO: 2065605 - RNA, 19 nt, Staphylococcus aureus subsp. aureus Mu50
uacaaauguauaaauaaua

SEQ ID NO: 2065606 - RNA, 13 nt, Staphylococcus aureus subsp. aureus Mu50
uacaaauuauaaa

SEQ ID NO: 2065607 - RNA, 18 nt, Staphylococcus aureus subsp. aureus Mu50
uacaaauuacaauaagcg

SEQ ID NO: 2065608 - RNA, 18 nt, Staphylococcus aureus subsp. aureus Mu50
uacaacaccaauugaaau

SEQ ID NO: 2065609 - RNA, 15 nt, Staphylococcus aureus subsp. aureus Mu50
uacaacaguaaucau

SEQ ID NO: 2065610 - RNA, 21 nt, Staphylococcus aureus subsp. aureus Mu50
uacaacaccaauugaaauuaa

SEQ ID NO: 2065611 - RNA, 15 nt, Staphylococcus aureus subsp. aureus Mu50
uacaacaguugcacc

SEQ ID NO: 2065612 - RNA, 18 nt, Staphylococcus aureus subsp. aureus Mu50
uacaaaguuauaauggca

SEQ ID NO: 2065613 - RNA, 14 nt, Staphylococcus aureus subsp. aureus Mu50
uacaaauaacaaac

SEQ ID NO: 2065614 - RNA, 23 nt, Staphylococcus aureus subsp. aureus Mu50
uacaaauaacaaacauuaaucua

SEQ ID NO: 2065615 - RNA, 13 nt, Staphylococcus aureus subsp. aureus Mu50
uaauuguucuuca

SEQ ID NO: 2065616 - RNA, 14 nt, Staphylococcus aureus subsp. aureus Mu50
uacaaagucugucu

SEQ ID NO: 2065617 - RNA, 15 nt, Staphylococcus aureus subsp. aureus Mu50
uacaaagugauuuaa

SEQ ID NO: 2065618 - RNA, 23 nt, Staphylococcus aureus subsp. aureus Mu50
uaauuguuauaaguaaauaauag

SEQ ID NO: 2065619 - RNA, 18 nt, Staphylococcus aureus subsp. aureus Mu50
uaauuguuaaaucaccaa

SEQ ID NO: 2065620 - RNA, 22 nt, Staphylococcus aureus subsp. aureus Mu50
uacaaagccuuaauaucaugca

SEQ ID NO: 2065621 - RNA, 14 nt, Staphylococcus aureus subsp. aureus Mu50
uaauuguuuaauaa

SEQ ID NO: 2065622 - RNA, 21 nt, Staphylococcus aureus subsp. aureus Mu50
uaauuggauugagaucuguau

SEQ ID NO: 2065623 - RNA, 15 nt, Staphylococcus aureus subsp. aureus Mu50
uaauugucuuuauaa

SEQ ID NO: 2065624 - RNA, 17 nt, Staphylococcus aureus subsp. aureus Mu50
uacagagaaucaauuau

SEQ ID NO: 2065625 - RNA, 19 nt, Staphylococcus aureus subsp. aureus Mu50
uacagauaggaaacuuaaa

SEQ ID NO: 2065626 - RNA, 22 nt, Staphylococcus aureus subsp. aureus Mu50
uacagauaggaaacuuaaauau

SEQ ID NO: 2065627 - RNA, 17 nt, Staphylococcus aureus subsp. aureus Mu50
uacagauaagaauauuu

SEQ ID NO: 2065628 - RNA, 14 nt, Staphylococcus aureus subsp. aureus Mu50
uacagauaauuauu

SEQ ID NO: 2065629 - RNA, 15 nt, Staphylococcus aureus subsp. aureus Mu50
uacagauaauuauuu

SEQ ID NO: 2065630 - RNA, 17 nt, Staphylococcus aureus subsp. aureus Mu50
uacagauuuuaaaaauu

SEQ ID NO: 2065631 - RNA, 19 nt, Staphylococcus aureus subsp. aureus Mu50
uacagauuuuaaaaauuca

SEQ ID NO: 2065632 - RNA, 22 nt, Staphylococcus aureus subsp. aureus Mu50
uacacaaauuuuuuguaaacau

SEQ ID NO: 2065633 - RNA, 18 nt, Staphylococcus aureus subsp. aureus Mu50
uacacacuaaggaaaauu

SEQ ID NO: 2065634 - RNA, 22 nt, Staphylococcus aureus subsp. aureus Mu50
uacacuuggcuuaggaugaaaa

SEQ ID NO: 2065635 - RNA, 21 nt, Staphylococcus aureus subsp. aureus Mu50
uacaauuucuucauuuucauu

SEQ ID NO: 2065636 - RNA, 23 nt, Staphylococcus aureus subsp. aureus Mu50
uacaauuuuccuuccaauaauaa

SEQ ID NO: 2065637 - RNA, 15 nt, Staphylococcus aureus subsp. aureus Mu50
uacacaaauuaaaac

SEQ ID NO: 2065638 - RNA, 17 nt, Staphylococcus aureus subsp. aureus Mu50
uacaauuuucucauuaa

SEQ ID NO: 2065639 - RNA, 14 nt, Staphylococcus aureus subsp. aureus Mu50
uacaauuuuuaaaa

SEQ ID NO: 2065640 - RNA, 16 nt, Staphylococcus aureus subsp. aureus Mu50
uacagacaaacauuac

SEQ ID NO: 2065641 - RNA, 21 nt, Staphylococcus aureus subsp. aureus Mu50
uacagaauggauaccuaaagc

SEQ ID NO: 2065642 - RNA, 16 nt, Staphylococcus aureus subsp. aureus Mu50
uacacuuuugauuguu

SEQ ID NO: 2065643 - RNA, 15 nt, Staphylococcus aureus subsp. aureus Mu50
uacacuuuucuuauc

SEQ ID NO: 2065644 - RNA, 14 nt, Staphylococcus aureus subsp. aureus Mu50
uagaauauuaacgu

SEQ ID NO: 2065645 - RNA, 17 nt, Staphylococcus aureus subsp. aureus Mu50
uagaauagucaauuaau

SEQ ID NO: 2065646 - RNA, 19 nt, Staphylococcus aureus subsp. aureus Mu50
uagaauaguuaccaaaauu

SEQ ID NO: 2065647 - RNA, 19 nt, Staphylococcus aureus subsp. aureus Mu50
uagaauagucaauuaauga

SEQ ID NO: 2065648 - RNA, 19 nt, Staphylococcus aureus subsp. aureus Mu50
uagaaucuacgauuuucaa

SEQ ID NO: 2065649 - RNA, 16 nt, Staphylococcus aureus subsp. aureus Mu50
uagaauucuaaaagaa

SEQ ID NO: 2065650 - RNA, 21 nt, Staphylococcus aureus subsp. aureus Mu50
uagaacgaaauaguucaaaau

SEQ ID NO: 2065651 - RNA, 22 nt, Staphylococcus aureus subsp. aureus Mu50
uagaagaacaauaauugaugaa

SEQ ID NO: 2065652 - RNA, 21 nt, Staphylococcus aureus subsp. aureus Mu50
uagaagaugauuauucucuuu

SEQ ID NO: 2065653 - RNA, 18 nt, Staphylococcus aureus subsp. aureus Mu50
uagaauacuaaaaguguu

SEQ ID NO: 2065654 - RNA, 15 nt, Staphylococcus aureus subsp. aureus Mu50
uacuauggcauuauu

SEQ ID NO: 2065655 - RNA, 23 nt, Staphylococcus aureus subsp. aureus Mu50
uagaaacuuccaacauauaaaaa

SEQ ID NO: 2065656 - RNA, 15 nt, Staphylococcus aureus subsp. aureus Mu50
uagaaacacuuuuag

SEQ ID NO: 2065657 - RNA, 18 nt, Staphylococcus aureus subsp. aureus Mu50
uagaaaaugaguacaaca

SEQ ID NO: 2065658 - RNA, 18 nt, Staphylococcus aureus subsp. aureus Mu50
uacuaggaauauaaaacu

SEQ ID NO: 2065659 - RNA, 23 nt, Staphylococcus aureus subsp. aureus Mu50
uacuaguuuguaauaauuaacuu

SEQ ID NO: 2065660 - RNA, 23 nt, Staphylococcus aureus subsp. aureus Mu50
uacuagaaagcacaccuaauuca

SEQ ID NO: 2065661 - RNA, 17 nt, Staphylococcus aureus subsp. aureus Mu50
uacuauaaauccuaagu

SEQ ID NO: 2065662 - RNA, 20 nt, Staphylococcus aureus subsp. aureus Mu50
uacuauaaaaucaucguauu

SEQ ID NO: 2065663 - RNA, 13 nt, Staphylococcus aureus subsp. aureus Mu50
uacuauaugaaaa

SEQ ID NO: 2065664 - RNA, 15 nt, Staphylococcus aureus subsp. aureus Mu50
uacuauauucaauga

SEQ ID NO: 2065665 - RNA, 16 nt, Staphylococcus aureus subsp. aureus Mu50
uacuauauuuaaauug

SEQ ID NO: 2065666 - RNA, 16 nt, Staphylococcus aureus subsp. aureus Mu50
uagaaauccucuuaua

SEQ ID NO: 2065667 - RNA, 22 nt, Staphylococcus aureus subsp. aureus Mu50
uagaaagcacaccuaauucaua

SEQ ID NO: 2065668 - RNA, 15 nt, Staphylococcus aureus subsp. aureus Mu50
uagaaaggcaggcau

SEQ ID NO: 2065669 - RNA, 13 nt, Staphylococcus aureus subsp. aureus Mu50
uagaaauagauuu

SEQ ID NO: 2065670 - RNA, 12 nt, Staphylococcus aureus subsp. aureus Mu50
uagauaauauau

SEQ ID NO: 2065671 - RNA, 19 nt, Staphylococcus aureus subsp. aureus Mu50
uagauaaaucgauaaaaug

SEQ ID NO: 2065672 - RNA, 16 nt, Staphylococcus aureus subsp. aureus Mu50
uagauaaaaauuacua

SEQ ID NO: 2065673 - RNA, 13 nt, Staphylococcus aureus subsp. aureus Mu50
uagauagcggauu

SEQ ID NO: 2065674 - RNA, 15 nt, Staphylococcus aureus subsp. aureus Mu50
uagauaccaaacugc

SEQ ID NO: 2065675 - RNA, 18 nt, Staphylococcus aureus subsp. aureus Mu50
uagauacauauaagaauu

SEQ ID NO: 2065676 - RNA, 14 nt, Staphylococcus aureus subsp. aureus Mu50
uagaguuuuuauua

SEQ ID NO: 2065677 - RNA, 14 nt, Staphylococcus aureus subsp. aureus Mu50
uagagcguuuugcu

SEQ ID NO: 2065678 - RNA, 23 nt, Staphylococcus aureus subsp. aureus Mu50
uagagcccgagacauaaauuaau

SEQ ID NO: 2065679 - RNA, 18 nt, Staphylococcus aureus subsp. aureus Mu50
uagacuuggauaaaaauu

SEQ ID NO: 2065680 - RNA, 13 nt, Staphylococcus aureus subsp. aureus Mu50
uagagaaagaaua

SEQ ID NO: 2065681 - RNA, 16 nt, Staphylococcus aureus subsp. aureus Mu50
uagagacuuauuuuau

SEQ ID NO: 2065682 - RNA, 17 nt, Staphylococcus aureus subsp. aureus Mu50
uagacugccaauaaaau

SEQ ID NO: 2065683 - RNA, 22 nt, Staphylococcus aureus subsp. aureus Mu50
uagacugccaauaaaaugcaau

SEQ ID NO: 2065684 - RNA, 21 nt, Staphylococcus aureus subsp. aureus Mu50
uagacuuauuugaaugcaaau

SEQ ID NO: 2065685 - RNA, 20 nt, Staphylococcus aureus subsp. aureus Mu50
uagacguaaguguaaaugaa

SEQ ID NO: 2065686 - RNA, 19 nt, Staphylococcus aureus subsp. aureus Mu50
uagacauugaauaaaugaa

SEQ ID NO: 2065687 - RNA, 16 nt, Staphylococcus aureus subsp. aureus Mu50
uagacaucauuguuuu

SEQ ID NO: 2065688 - RNA, 17 nt, Staphylococcus aureus subsp. aureus Mu50
uagacaucauuguuuua

SEQ ID NO: 2065689 - RNA, 18 nt, Staphylococcus aureus subsp. aureus Mu50
uagacaucauuguuuuag

SEQ ID NO: 2065690 - RNA, 23 nt, Staphylococcus aureus subsp. aureus Mu50
uagacauaaauauggauuuugaa

SEQ ID NO: 2065691 - RNA, 14 nt, Staphylococcus aureus subsp. aureus Mu50
uagacauaaaaaaa

SEQ ID NO: 2065692 - RNA, 21 nt, Staphylococcus aureus subsp. aureus Mu50
uagacaauauuuuuacauauu

SEQ ID NO: 2065693 - RNA, 20 nt, Staphylococcus aureus subsp. aureus Mu50
uagacaauauuuuuacauau

SEQ ID NO: 2065694 - RNA, 13 nt, Staphylococcus aureus subsp. aureus Mu50
uagacaccaaaaa

SEQ ID NO: 2065695 - RNA, 18 nt, Staphylococcus aureus subsp. aureus Mu50
uagacauuguaaaaugcu

SEQ ID NO: 2065696 - RNA, 14 nt, Staphylococcus aureus subsp. aureus Mu50
uagacauuaaaaaa

SEQ ID NO: 2065697 - RNA, 19 nt, Staphylococcus aureus subsp. aureus Mu50
uaggggcuuuuaugcaugc

SEQ ID NO: 2065698 - RNA, 13 nt, Staphylococcus aureus subsp. aureus Mu50
uagcuugaauaau

SEQ ID NO: 2065699 - RNA, 15 nt, Staphylococcus aureus subsp. aureus Mu50
uagcuuuaguuacua

SEQ ID NO: 2065700 - RNA, 16 nt, Staphylococcus aureus subsp. aureus Mu50
uagcuuucguuucuuu

SEQ ID NO: 2065701 - RNA, 20 nt, Staphylococcus aureus subsp. aureus Mu50
uagcucuccuacaacuauuc

SEQ ID NO: 2065702 - RNA, 21 nt, Staphylococcus aureus subsp. aureus Mu50
uagcugcaaucguugaaaaau

SEQ ID NO: 2065703 - RNA, 21 nt, Staphylococcus aureus subsp. aureus Mu50
uagcucuuuuuugauuuggaa

SEQ ID NO: 2065704 - RNA, 15 nt, Staphylococcus aureus subsp. aureus Mu50
uagcgauuuuaaaga

SEQ ID NO: 2065705 - RNA, 16 nt, Staphylococcus aureus subsp. aureus Mu50
uagcgugauuuuucau

SEQ ID NO: 2065706 - RNA, 15 nt, Staphylococcus aureus subsp. aureus Mu50
uagcucauuacaaag

SEQ ID NO: 2065707 - RNA, 12 nt, Staphylococcus aureus subsp. aureus Mu50
uagcuaaugcaa

SEQ ID NO: 2065708 - RNA, 16 nt, Staphylococcus aureus subsp. aureus Mu50
uagcaauaucaucauu

SEQ ID NO: 2065709 - RNA, 14 nt, Staphylococcus aureus subsp. aureus Mu50
uagcaauaucauca

SEQ ID NO: 2065710 - RNA, 13 nt, Staphylococcus aureus subsp. aureus Mu50
uagauauuauaaa

SEQ ID NO: 2065711 - RNA, 18 nt, Staphylococcus aureus subsp. aureus Mu50
uagauaucuuaaucuaaa

SEQ ID NO: 2065712 - RNA, 13 nt, Staphylococcus aureus subsp. aureus Mu50
uagccaaauaaau

SEQ ID NO: 2065713 - RNA, 21 nt, Staphylococcus aureus subsp. aureus Mu50
uagccaaauaaauuuugacgc

SEQ ID NO: 2065714 - RNA, 16 nt, Staphylococcus aureus subsp. aureus Mu50
uagccaauaucauauu

SEQ ID NO: 2065715 - RNA, 19 nt, Staphylococcus aureus subsp. aureus Mu50
uagcaucaaaaauaaaaau

SEQ ID NO: 2065716 - RNA, 18 nt, Staphylococcus aureus subsp. aureus Mu50
uagcauaucuuuaucauu

SEQ ID NO: 2065717 - RNA, 19 nt, Staphylococcus aureus subsp. aureus Mu50
uagcauauucgcuuaaaaa

SEQ ID NO: 2065718 - RNA, 13 nt, Staphylococcus aureus subsp. aureus Mu50
uagcaccauuauu

SEQ ID NO: 2065719 - RNA, 22 nt, Staphylococcus aureus subsp. aureus Mu50
uagcacuuggauuuuaauuauu

SEQ ID NO: 2065720 - RNA, 18 nt, Staphylococcus aureus subsp. aureus Mu50
uagcaguaauauguugcu

SEQ ID NO: 2065721 - RNA, 19 nt, Staphylococcus aureus subsp. aureus Mu50
uagcaguuucugagaagaa

SEQ ID NO: 2065722 - RNA, 18 nt, Staphylococcus aureus subsp. aureus Mu50
uagcagucaaacauagau

SEQ ID NO: 2065723 - RNA, 16 nt, Staphylococcus aureus subsp. aureus Mu50
uagccauauucauauu

SEQ ID NO: 2065724 - RNA, 23 nt, Staphylococcus aureus subsp. aureus Mu50
uagccaaugcuuccaucacauca

SEQ ID NO: 2065725 - RNA, 14 nt, Staphylococcus aureus subsp. aureus Mu50
uagcgaaaacuaaa

SEQ ID NO: 2065726 - RNA, 17 nt, Staphylococcus aureus subsp. aureus Mu50
uagccuucaauauuucu

SEQ ID NO: 2065727 - RNA, 20 nt, Staphylococcus aureus subsp. aureus Mu50
uagccuucaauauuucuugc

SEQ ID NO: 2065728 - RNA, 15 nt, Staphylococcus aureus subsp. aureus Mu50
uagccugaaauagaa

SEQ ID NO: 2065729 - RNA, 16 nt, Staphylococcus aureus subsp. aureus Mu50
uagccuagauaccaaa

SEQ ID NO: 2065730 - RNA, 22 nt, Staphylococcus aureus subsp. aureus Mu50
uaucuaaagcuauaaaaaaucu

SEQ ID NO: 2065731 - RNA, 20 nt, Staphylococcus aureus subsp. aureus Mu50
uaucuaacaaucguuuuaau

SEQ ID NO: 2065732 - RNA, 14 nt, Staphylococcus aureus subsp. aureus Mu50
uaucgauaguucua

SEQ ID NO: 2065733 - RNA, 21 nt, Staphylococcus aureus subsp. aureus Mu50
uaucgauaguucuauauaauu

SEQ ID NO: 2065734 - RNA, 14 nt, Staphylococcus aureus subsp. aureus Mu50
uaucgauuaucuga

SEQ ID NO: 2065735 - RNA, 17 nt, Staphylococcus aureus subsp. aureus Mu50
uaucgauucgauuauuu

SEQ ID NO: 2065736 - RNA, 12 nt, Staphylococcus aureus subsp. aureus Mu50
uaucuacagaga

SEQ ID NO: 2065737 - RNA, 11 nt, Staphylococcus aureus subsp. aureus Mu50
uaucuaagucg

SEQ ID NO: 2065738 - RNA, 16 nt, Staphylococcus aureus subsp. aureus Mu50
uaucuacauuaaagaa

SEQ ID NO: 2065739 - RNA, 16 nt, Staphylococcus aureus subsp. aureus Mu50
uaucuaguguucucau

SEQ ID NO: 2065740 - RNA, 16 nt, Staphylococcus aureus subsp. aureus Mu50
uaucuagccugaaaua

SEQ ID NO: 2065741 - RNA, 13 nt, Staphylococcus aureus subsp. aureus Mu50
uaucuguugucau

SEQ ID NO: 2065742 - RNA, 15 nt, Staphylococcus aureus subsp. aureus Mu50
uaucuguaucaaaau

SEQ ID NO: 2065743 - RNA, 19 nt, Staphylococcus aureus subsp. aureus Mu50
uaucuuacuacuuaauuaa

SEQ ID NO: 2065744 - RNA, 17 nt, Staphylococcus aureus subsp. aureus Mu50
uaucuuauaacaaaaau

SEQ ID NO: 2065745 - RNA, 18 nt, Staphylococcus aureus subsp. aureus Mu50
uaucuuauaacaaaaauu

SEQ ID NO: 2065746 - RNA, 24 nt, Staphylococcus aureus subsp. aureus Mu50
uaucuauacaauuauggauaaaau

SEQ ID NO: 2065747 - RNA, 19 nt, Staphylococcus aureus subsp. aureus Mu50
uaucucugaaaaacuucuu

SEQ ID NO: 2065748 - RNA, 19 nt, Staphylococcus aureus subsp. aureus Mu50
uaucauuaaauugcuugaa

SEQ ID NO: 2065749 - RNA, 21 nt, Staphylococcus aureus subsp. aureus Mu50
uaucaugggcaguaauuuuca

SEQ ID NO: 2065750 - RNA, 20 nt, Staphylococcus aureus subsp. aureus Mu50
uaucauguucuuauaaaaaa

SEQ ID NO: 2065751 - RNA, 19 nt, Staphylococcus aureus subsp. aureus Mu50
uaucauguucuuauaaaaa

SEQ ID NO: 2065752 - RNA, 17 nt, Staphylococcus aureus subsp. aureus Mu50
uaucauguucuuauaaa

SEQ ID NO: 2065753 - RNA, 17 nt, Staphylococcus aureus subsp. aureus Mu50
uaucaugaugauaaauu

SEQ ID NO: 2065754 - RNA, 12 nt, Staphylococcus aureus subsp. aureus Mu50
uaucaucuauuc

SEQ ID NO: 2065755 - RNA, 16 nt, Staphylococcus aureus subsp. aureus Mu50
uaucaucauuuaaaua

SEQ ID NO: 2065756 - RNA, 23 nt, Staphylococcus aureus subsp. aureus Mu50
uaucaucaaucguuaauuuccaa

SEQ ID NO: 2065757 - RNA, 21 nt, Staphylococcus aureus subsp. aureus Mu50
uaucaucaugacuauuucgcu

SEQ ID NO: 2065758 - RNA, 19 nt, Staphylococcus aureus subsp. aureus Mu50
uaucaucauacuucaauaa

SEQ ID NO: 2065759 - RNA, 21 nt, Staphylococcus aureus subsp. aureus Mu50
uaucaucaacaaucuuuuuca

SEQ ID NO: 2065760 - RNA, 12 nt, Staphylococcus aureus subsp. aureus Mu50
uaucauauuuga

SEQ ID NO: 2065761 - RNA, 22 nt, Staphylococcus aureus subsp. aureus Mu50
uaucgaaagguauaucuucauu

SEQ ID NO: 2065762 - RNA, 13 nt, Staphylococcus aureus subsp. aureus Mu50
uauauacuaaucu

SEQ ID NO: 2065763 - RNA, 24 nt, Staphylococcus aureus subsp. aureus Mu50
uauaucuaauucguaauuuaugau

SEQ ID NO: 2065764 - RNA, 15 nt, Staphylococcus aureus subsp. aureus Mu50
uauaucgcuuuugaa

SEQ ID NO: 2065765 - RNA, 21 nt, Staphylococcus aureus subsp. aureus Mu50
uauauaucacaacacauaaau

SEQ ID NO: 2065766 - RNA, 16 nt, Staphylococcus aureus subsp. aureus Mu50
uauauaucaaauacau

SEQ ID NO: 2065767 - RNA, 18 nt, Staphylococcus aureus subsp. aureus Mu50
uauauaucaaauacauuu

SEQ ID NO: 2065768 - RNA, 18 nt, Staphylococcus aureus subsp. aureus Mu50
uauauaucacaacacaua

SEQ ID NO: 2065769 - RNA, 21 nt, Staphylococcus aureus subsp. aureus Mu50
uauauagcgcgcuuauugaaa

SEQ ID NO: 2065770 - RNA, 18 nt, Staphylococcus aureus subsp. aureus Mu50
uauauuacaucuauauuu

SEQ ID NO: 2065771 - RNA, 22 nt, Staphylococcus aureus subsp. aureus Mu50
uauauuacaucuauauuuguuu

SEQ ID NO: 2065772 - RNA, 20 nt, Staphylococcus aureus subsp. aureus Mu50
uauauuaagacguuguaaug

SEQ ID NO: 2065773 - RNA, 14 nt, Staphylococcus aureus subsp. aureus Mu50
uauauuaaauacua

SEQ ID NO: 2065774 - RNA, 17 nt, Staphylococcus aureus subsp. aureus Mu50
uauauuaaauacuauau

SEQ ID NO: 2065775 - RNA, 15 nt, Staphylococcus aureus subsp. aureus Mu50
uauauuaauguuuga

SEQ ID NO: 2065776 - RNA, 18 nt, Staphylococcus aureus subsp. aureus Mu50
uauauuaaggucauuuuu

SEQ ID NO: 2065777 - RNA, 16 nt, Staphylococcus aureus subsp. aureus Mu50
uauauuaauguuugau

SEQ ID NO: 2065778 - RNA, 13 nt, Staphylococcus aureus subsp. aureus Mu50
uauaucuuuuaua

SEQ ID NO: 2065779 - RNA, 14 nt, Staphylococcus aureus subsp. aureus Mu50
uauaugaaaagaga

SEQ ID NO: 2065780 - RNA, 20 nt, Staphylococcus aureus subsp. aureus Mu50
uauauuaaaaauuucaauaa

SEQ ID NO: 2065781 - RNA, 18 nt, Staphylococcus aureus subsp. aureus Mu50
uauauuccacgcucacau

SEQ ID NO: 2065782 - RNA, 17 nt, Staphylococcus aureus subsp. aureus Mu50
uauauuaucauugauau

SEQ ID NO: 2065783 - RNA, 16 nt, Staphylococcus aureus subsp. aureus Mu50
uauauucaucucuuau

SEQ ID NO: 2065784 - RNA, 17 nt, Staphylococcus aureus subsp. aureus Mu50
uauauuagugauauuuu

SEQ ID NO: 2065785 - RNA, 14 nt, Staphylococcus aureus subsp. aureus Mu50
uaucaaugacaucc

SEQ ID NO: 2065786 - RNA, 22 nt, Staphylococcus aureus subsp. aureus Mu50
uaucaauagaugaaaauuuaau

SEQ ID NO: 2065787 - RNA, 20 nt, Staphylococcus aureus subsp. aureus Mu50
uaucacaacacauaaauuaa

SEQ ID NO: 2065788 - RNA, 21 nt, Staphylococcus aureus subsp. aureus Mu50
uaucaauuguugcaaaauacg

SEQ ID NO: 2065789 - RNA, 18 nt, Staphylococcus aureus subsp. aureus Mu50
uaucaauugaaugaagua

SEQ ID NO: 2065790 - RNA, 19 nt, Staphylococcus aureus subsp. aureus Mu50
uaucaauugaaugaaguaa

SEQ ID NO: 2065791 - RNA, 21 nt, Staphylococcus aureus subsp. aureus Mu50
uauauuguauuuuauuuauuu

SEQ ID NO: 2065792 - RNA, 16 nt, Staphylococcus aureus subsp. aureus Mu50
uauauugauagcaccg

SEQ ID NO: 2065793 - RNA, 23 nt, Staphylococcus aureus subsp. aureus Mu50
uauauugcacauaaaaaauguga

SEQ ID NO: 2065794 - RNA, 14 nt, Staphylococcus aureus subsp. aureus Mu50
uauauuuacacaga

SEQ ID NO: 2065795 - RNA, 23 nt, Staphylococcus aureus subsp. aureus Mu50
uauauuuaguuagcccuauucaa

SEQ ID NO: 2065796 - RNA, 14 nt, Staphylococcus aureus subsp. aureus Mu50
uaucaauuucuauu

SEQ ID NO: 2065797 - RNA, 13 nt, Staphylococcus aureus subsp. aureus Mu50
uaucagcuuuaau

SEQ ID NO: 2065798 - RNA, 16 nt, Staphylococcus aureus subsp. aureus Mu50
uaucagcuuuuucauu

SEQ ID NO: 2065799 - RNA, 18 nt, Staphylococcus aureus subsp. aureus Mu50
uaucagugugauuuugga

SEQ ID NO: 2065800 - RNA, 18 nt, Staphylococcus aureus subsp. aureus Mu50
uaucaguuauuuuaauaa

SEQ ID NO: 2065801 - RNA, 13 nt, Staphylococcus aureus subsp. aureus Mu50
uaucauaauauug

SEQ ID NO: 2065802 - RNA, 17 nt, Staphylococcus aureus subsp. aureus Mu50
uaucauaaagauaagau

SEQ ID NO: 2065803 - RNA, 12 nt, Staphylococcus aureus subsp. aureus Mu50
uaucauaaucuu

SEQ ID NO: 2065804 - RNA, 22 nt, Staphylococcus aureus subsp. aureus Mu50
uaucauauaaugguugaauaac

SEQ ID NO: 2065805 - RNA, 14 nt, Staphylococcus aureus subsp. aureus Mu50
uaucauaauuuugu

SEQ ID NO: 2065806 - RNA, 19 nt, Staphylococcus aureus subsp. aureus Mu50
uaguucaaauugaacuucu

SEQ ID NO: 2065807 - RNA, 21 nt, Staphylococcus aureus subsp. aureus Mu50
uaguucacaugaauuuuaaua

SEQ ID NO: 2065808 - RNA, 15 nt, Staphylococcus aureus subsp. aureus Mu50
uaguuugaauuggga

SEQ ID NO: 2065809 - RNA, 23 nt, Staphylococcus aureus subsp. aureus Mu50
uaguuugauaugcucucuucaaa

SEQ ID NO: 2065810 - RNA, 16 nt, Staphylococcus aureus subsp. aureus Mu50
uaguuuucuuaaaaga

SEQ ID NO: 2065811 - RNA, 23 nt, Staphylococcus aureus subsp. aureus Mu50
uauaaaaaaauuaacuauacuuu

SEQ ID NO: 2065812 - RNA, 22 nt, Staphylococcus aureus subsp. aureus Mu50
uauaaaaaaccguaauuuuaau

SEQ ID NO: 2065813 - RNA, 21 nt, Staphylococcus aureus subsp. aureus Mu50
uauaaaaaagaucacugccaa

SEQ ID NO: 2065814 - RNA, 18 nt, Staphylococcus aureus subsp. aureus Mu50
uaguuuuuacguuuucua

SEQ ID NO: 2065815 - RNA, 19 nt, Staphylococcus aureus subsp. aureus Mu50
uauaaauguuuauaucuuu

SEQ ID NO: 2065816 - RNA, 22 nt, Staphylococcus aureus subsp. aureus Mu50
uauaaauguuuauaucuuuuau

SEQ ID NO: 2065817 - RNA, 19 nt, Staphylococcus aureus subsp. aureus Mu50
uauaaaugcagcuguauaa

SEQ ID NO: 2065818 - RNA, 22 nt, Staphylococcus aureus subsp. aureus Mu50
uauaaauccuaagucuuuuaaa

SEQ ID NO: 2065819 - RNA, 21 nt, Staphylococcus aureus subsp. aureus Mu50
uauaaaugaaucgcuuugauu

SEQ ID NO: 2065820 - RNA, 13 nt, Staphylococcus aureus subsp. aureus Mu50
uauaaauacaaau

SEQ ID NO: 2065821 - RNA, 13 nt, Staphylococcus aureus subsp. aureus Mu50
uauaaauaucaau

SEQ ID NO: 2065822 - RNA, 18 nt, Staphylococcus aureus subsp. aureus Mu50
uauaaauauuuuuaauua

SEQ ID NO: 2065823 - RNA, 17 nt, Staphylococcus aureus subsp. aureus Mu50
uauaaauauuuuuaauu

SEQ ID NO: 2065824 - RNA, 21 nt, Staphylococcus aureus subsp. aureus Mu50
uauaaauaugguuucuuauua

SEQ ID NO: 2065825 - RNA, 23 nt, Staphylococcus aureus subsp. aureus Mu50
uauaaauaugguuucuuauuaaa

SEQ ID NO: 2065826 - RNA, 13 nt, Staphylococcus aureus subsp. aureus Mu50
uauaaaaacaaaa

SEQ ID NO: 2065827 - RNA, 23 nt, Staphylococcus aureus subsp. aureus Mu50
uauaaaauggugcgaauaauaau

SEQ ID NO: 2065828 - RNA, 14 nt, Staphylococcus aureus subsp. aureus Mu50
uaguuuuuuuuaua

SEQ ID NO: 2065829 - RNA, 16 nt, Staphylococcus aureus subsp. aureus Mu50
uauaaaauucaccaac

SEQ ID NO: 2065830 - RNA, 12 nt, Staphylococcus aureus subsp. aureus Mu50
uauaaaauucac

SEQ ID NO: 2065831 - RNA, 22 nt, Staphylococcus aureus subsp. aureus Mu50
uauaaaccuaaugcuuuaauaa

SEQ ID NO: 2065832 - RNA, 14 nt, Staphylococcus aureus subsp. aureus Mu50
uauaaauaaaaaua

SEQ ID NO: 2065833 - RNA, 18 nt, Staphylococcus aureus subsp. aureus Mu50
uauaaauaaaaauacaua

SEQ ID NO: 2065834 - RNA, 17 nt, Staphylococcus aureus subsp. aureus Mu50
uaguuagggaaauguag

SEQ ID NO: 2065835 - RNA, 17 nt, Staphylococcus aureus subsp. aureus Mu50
uaguuagcccuauucaa

SEQ ID NO: 2065836 - RNA, 15 nt, Staphylococcus aureus subsp. aureus Mu50
uaguuaauucuccua

SEQ ID NO: 2065837 - RNA, 23 nt, Staphylococcus aureus subsp. aureus Mu50
uaguggaagacaaugauuugugg

SEQ ID NO: 2065838 - RNA, 16 nt, Staphylococcus aureus subsp. aureus Mu50
uagugacucaguuaua

SEQ ID NO: 2065839 - RNA, 18 nt, Staphylococcus aureus subsp. aureus Mu50
uagugucacaaagaaauu

SEQ ID NO: 2065840 - RNA, 16 nt, Staphylococcus aureus subsp. aureus Mu50
uagucucguaauaaug

SEQ ID NO: 2065841 - RNA, 22 nt, Staphylococcus aureus subsp. aureus Mu50
uagucucccauaacaccuacug

SEQ ID NO: 2065842 - RNA, 18 nt, Staphylococcus aureus subsp. aureus Mu50
uagugaaaaaguuucgga

SEQ ID NO: 2065843 - RNA, 12 nt, Staphylococcus aureus subsp. aureus Mu50
uagugaauaaug

SEQ ID NO: 2065844 - RNA, 15 nt, Staphylococcus aureus subsp. aureus Mu50
uagucuuuuuaagua

SEQ ID NO: 2065845 - RNA, 17 nt, Staphylococcus aureus subsp. aureus Mu50
uagucgucgaaaugccu

SEQ ID NO: 2065846 - RNA, 12 nt, Staphylococcus aureus subsp. aureus Mu50
uagguaauaauu

SEQ ID NO: 2065847 - RNA, 14 nt, Staphylococcus aureus subsp. aureus Mu50
uauaauauacacaa

SEQ ID NO: 2065848 - RNA, 15 nt, Staphylococcus aureus subsp. aureus Mu50
uauaauauacacaaa

SEQ ID NO: 2065849 - RNA, 13 nt, Staphylococcus aureus subsp. aureus Mu50
uauaauaccccaa

SEQ ID NO: 2065850 - RNA, 14 nt, Staphylococcus aureus subsp. aureus Mu50
uauaauacgugugu

SEQ ID NO: 2065851 - RNA, 13 nt, Staphylococcus aureus subsp. aureus Mu50
uauaauagaaaua

SEQ ID NO: 2065852 - RNA, 21 nt, Staphylococcus aureus subsp. aureus Mu50
uauaauaaccuaaguuaauuu

SEQ ID NO: 2065853 - RNA, 17 nt, Staphylococcus aureus subsp. aureus Mu50
uauaaauuaaaugcaau

SEQ ID NO: 2065854 - RNA, 11 nt, Staphylococcus aureus subsp. aureus Mu50
uauaauucuuc

SEQ ID NO: 2065855 - RNA, 22 nt, Staphylococcus aureus subsp. aureus Mu50
uauaauucgucuguuucauaua

SEQ ID NO: 2065856 - RNA, 17 nt, Staphylococcus aureus subsp. aureus Mu50
uauaauucuaagucucu

SEQ ID NO: 2065857 - RNA, 13 nt, Staphylococcus aureus subsp. aureus Mu50
uauaauucacuuu

SEQ ID NO: 2065858 - RNA, 14 nt, Staphylococcus aureus subsp. aureus Mu50
uauaauguauaaaa

SEQ ID NO: 2065859 - RNA, 16 nt, Staphylococcus aureus subsp. aureus Mu50
uauaaugguugaauaa

SEQ ID NO: 2065860 - RNA, 15 nt, Staphylococcus aureus subsp. aureus Mu50
uauaauuaaacauuu

SEQ ID NO: 2065861 - RNA, 14 nt, Staphylococcus aureus subsp. aureus Mu50
uauaauuaaacuaa

SEQ ID NO: 2065862 - RNA, 18 nt, Staphylococcus aureus subsp. aureus Mu50
uauacacuuuuugacaua

SEQ ID NO: 2065863 - RNA, 21 nt, Staphylococcus aureus subsp. aureus Mu50
uauacacacuaaggaaaauua

SEQ ID NO: 2065864 - RNA, 17 nt, Staphylococcus aureus subsp. aureus Mu50
uauacacacuaaggaaa

SEQ ID NO: 2065865 - RNA, 15 nt, Staphylococcus aureus subsp. aureus Mu50
uauacaaugacagca

SEQ ID NO: 2065866 - RNA, 20 nt, Staphylococcus aureus subsp. aureus Mu50
uauaauuggcagauagaaug

SEQ ID NO: 2065867 - RNA, 13 nt, Staphylococcus aureus subsp. aureus Mu50
uauaauuuaaaga

SEQ ID NO: 2065868 - RNA, 19 nt, Staphylococcus aureus subsp. aureus Mu50
uauaauucuuguuugauuu

SEQ ID NO: 2065869 - RNA, 23 nt, Staphylococcus aureus subsp. aureus Mu50
uauaauugauugucauauaaaac

SEQ ID NO: 2065870 - RNA, 15 nt, Staphylococcus aureus subsp. aureus Mu50
uauaauuuauaaaaa

SEQ ID NO: 2065871 - RNA, 16 nt, Staphylococcus aureus subsp. aureus Mu50
uauaauuuaucuuaau

SEQ ID NO: 2065872 - RNA, 22 nt, Staphylococcus aureus subsp. aureus Mu50
uauaauuuauuuagcaucuuua

SEQ ID NO: 2065873 - RNA, 23 nt, Staphylococcus aureus subsp. aureus Mu50
uauaauuucaguaggacauauaa

SEQ ID NO: 2065874 - RNA, 13 nt, Staphylococcus aureus subsp. aureus Mu50
uauaauuuccuaa

SEQ ID NO: 2065875 - RNA, 15 nt, Staphylococcus aureus subsp. aureus Mu50
uauaauuuuguuuca

SEQ ID NO: 2065876 - RNA, 20 nt, Staphylococcus aureus subsp. aureus Mu50
uauaauuuccuaaaaacugu

SEQ ID NO: 2065877 - RNA, 20 nt, Staphylococcus aureus subsp. aureus Mu50
uauaauuuucuguccaaaaa

SEQ ID NO: 2065878 - RNA, 15 nt, Staphylococcus aureus subsp. aureus Mu50
uauacugaugaaaac

SEQ ID NO: 2065879 - RNA, 22 nt, Staphylococcus aureus subsp. aureus Mu50
uauacuuacugaaacuaaauua

SEQ ID NO: 2065880 - RNA, 21 nt, Staphylococcus aureus subsp. aureus Mu50
uauacuauaaauacaaauaua

SEQ ID NO: 2065881 - RNA, 17 nt, Staphylococcus aureus subsp. aureus Mu50
uauacuacuauugauau

SEQ ID NO: 2065882 - RNA, 13 nt, Staphylococcus aureus subsp. aureus Mu50
uauacuaaauuga

SEQ ID NO: 2065883 - RNA, 12 nt, Staphylococcus aureus subsp. aureus Mu50
uauacuaaucuu

SEQ ID NO: 2065884 - RNA, 12 nt, Staphylococcus aureus subsp. aureus Mu50
uauacuaaauug

SEQ ID NO: 2065885 - RNA, 15 nt, Staphylococcus aureus subsp. aureus Mu50
uauacuaaacuuuuu

SEQ ID NO: 2065886 - RNA, 16 nt, Staphylococcus aureus subsp. aureus Mu50
uauagaaaauuaacuc

SEQ ID NO: 2065887 - RNA, 21 nt, Staphylococcus aureus subsp. aureus Mu50
uauagaaaaugaguacaacau

SEQ ID NO: 2065888 - RNA, 18 nt, Staphylococcus aureus subsp. aureus Mu50
uauacuuuuuaaaugauu

SEQ ID NO: 2065889 - RNA, 15 nt, Staphylococcus aureus subsp. aureus Mu50
uauacuuuuaccauu

SEQ ID NO: 2065890 - RNA, 15 nt, Staphylococcus aureus subsp. aureus Mu50
uauacuugaagaauc

SEQ ID NO: 2065891 - RNA, 14 nt, Staphylococcus aureus subsp. aureus Mu50
uauacuuuuuaaau

SEQ ID NO: 2065892 - RNA, 19 nt, Staphylococcus aureus subsp. aureus Mu50
uauagaccguugaaauguu

SEQ ID NO: 2065893 - RNA, 22 nt, Staphylococcus aureus subsp. aureus Mu50
uauagaccguugaaauguucaa

SEQ ID NO: 2065894 - RNA, 21 nt, Staphylococcus aureus subsp. aureus Mu50
uauagaugacuguagaaaaca

SEQ ID NO: 2065895 - RNA, 20 nt, Staphylococcus aureus subsp. aureus Mu50
uauagauucauguaaauagu

SEQ ID NO: 2065896 - RNA, 18 nt, Staphylococcus aureus subsp. aureus Mu50
uauagaugacuguagaaa

SEQ ID NO: 2065897 - RNA, 19 nt, Staphylococcus aureus subsp. aureus Mu50
uauagauggcguaagcagu

SEQ ID NO: 2065898 - RNA, 16 nt, Staphylococcus aureus subsp. aureus Mu50
uauagaggauauuuau

SEQ ID NO: 2065899 - RNA, 22 nt, Staphylococcus aureus subsp. aureus Mu50
uauagagccaugaaaaggaaaa

SEQ ID NO: 2065900 - RNA, 18 nt, Staphylococcus aureus subsp. aureus Mu50
uaagauagauaaaucaag

SEQ ID NO: 2065901 - RNA, 12 nt, Staphylococcus aureus subsp. aureus Mu50
uaagauauauug

SEQ ID NO: 2065902 - RNA, 13 nt, Staphylococcus aureus subsp. aureus Mu50
uaagaauuaacaa

SEQ ID NO: 2065903 - RNA, 22 nt, Staphylococcus aureus subsp. aureus Mu50
uaagaaugugagauacguuauu

SEQ ID NO: 2065904 - RNA, 14 nt, Staphylococcus aureus subsp. aureus Mu50
uaagaauuuaaaag

SEQ ID NO: 2065905 - RNA, 22 nt, Staphylococcus aureus subsp. aureus Mu50
uaagaauauuuaaguuuccuau

SEQ ID NO: 2065906 - RNA, 20 nt, Staphylococcus aureus subsp. aureus Mu50
uaagaaugcaccaacaauag

SEQ ID NO: 2065907 - RNA, 14 nt, Staphylococcus aureus subsp. aureus Mu50
uaagacuucccaau

SEQ ID NO: 2065908 - RNA, 24 nt, Staphylococcus aureus subsp. aureus Mu50
uaagacugccauucuuuuucucaa

SEQ ID NO: 2065909 - RNA, 16 nt, Staphylococcus aureus subsp. aureus Mu50
uaagacugauuaauua

SEQ ID NO: 2065910 - RNA, 17 nt, Staphylococcus aureus subsp. aureus Mu50
uaagagaacuuuucaaa

SEQ ID NO: 2065911 - RNA, 22 nt, Staphylococcus aureus subsp. aureus Mu50
uaagagaacuuuucaaacaaua

SEQ ID NO: 2065912 - RNA, 17 nt, Staphylococcus aureus subsp. aureus Mu50
uaagacagcuucucauu

SEQ ID NO: 2065913 - RNA, 23 nt, Staphylococcus aureus subsp. aureus Mu50
uaagaccacaucgauaucuaagu

SEQ ID NO: 2065914 - RNA, 15 nt, Staphylococcus aureus subsp. aureus Mu50
uaacuuccuaaaauu

SEQ ID NO: 2065915 - RNA, 21 nt, Staphylococcus aureus subsp. aureus Mu50
uaacuuccuaaaauuuacaaa

SEQ ID NO: 2065916 - RNA, 21 nt, Staphylococcus aureus subsp. aureus Mu50
uaacuucuauuaagaaauacu

SEQ ID NO: 2065917 - RNA, 17 nt, Staphylococcus aureus subsp. aureus Mu50
uaacuucugauucuuca

SEQ ID NO: 2065918 - RNA, 18 nt, Staphylococcus aureus subsp. aureus Mu50
uaacuucugauucuucac

SEQ ID NO: 2065919 - RNA, 14 nt, Staphylococcus aureus subsp. aureus Mu50
uaacuugauaucau

SEQ ID NO: 2065920 - RNA, 13 nt, Staphylococcus aureus subsp. aureus Mu50
uaacuuuaaaaau

SEQ ID NO: 2065921 - RNA, 13 nt, Staphylococcus aureus subsp. aureus Mu50
uaacuguucuuuc

SEQ ID NO: 2065922 - RNA, 16 nt, Staphylococcus aureus subsp. aureus Mu50
uaacuguucuuucguc

SEQ ID NO: 2065923 - RNA, 13 nt, Staphylococcus aureus subsp. aureus Mu50
uaacuuaaaauuu

SEQ ID NO: 2065924 - RNA, 19 nt, Staphylococcus aureus subsp. aureus Mu50
uaacuuaagcucauuucaa

SEQ ID NO: 2065925 - RNA, 13 nt, Staphylococcus aureus subsp. aureus Mu50
uaacuuaccauga

SEQ ID NO: 2065926 - RNA, 19 nt, Staphylococcus aureus subsp. aureus Mu50
uaacuucauaauauauccu

SEQ ID NO: 2065927 - RNA, 20 nt, Staphylococcus aureus subsp. aureus Mu50
uaacuucauaauauauccug

SEQ ID NO: 2065928 - RNA, 15 nt, Staphylococcus aureus subsp. aureus Mu50
uaagaagaaauacuu

SEQ ID NO: 2065929 - RNA, 22 nt, Staphylococcus aureus subsp. aureus Mu50
uaacuuucuaauuguuucauug

SEQ ID NO: 2065930 - RNA, 18 nt, Staphylococcus aureus subsp. aureus Mu50
uaacuuucagcaccagaa

SEQ ID NO: 2065931 - RNA, 20 nt, Staphylococcus aureus subsp. aureus Mu50
uaacuuucuuuuguuuuuau

SEQ ID NO: 2065932 - RNA, 13 nt, Staphylococcus aureus subsp. aureus Mu50
uaacuuuuuaaua

SEQ ID NO: 2065933 - RNA, 12 nt, Staphylococcus aureus subsp. aureus Mu50
uaagcaaaaauu

SEQ ID NO: 2065934 - RNA, 15 nt, Staphylococcus aureus subsp. aureus Mu50
uaagauuuaaacauc

SEQ ID NO: 2065935 - RNA, 19 nt, Staphylococcus aureus subsp. aureus Mu50
uaagauuuugaauuuuaua

SEQ ID NO: 2065936 - RNA, 22 nt, Staphylococcus aureus subsp. aureus Mu50
uaagauuuuuuauguuuaauuu

SEQ ID NO: 2065937 - RNA, 22 nt, Staphylococcus aureus subsp. aureus Mu50
uaagauguauaugaauuuuaua

SEQ ID NO: 2065938 - RNA, 19 nt, Staphylococcus aureus subsp. aureus Mu50
uaagaugacugaaccaauc

SEQ ID NO: 2065939 - RNA, 20 nt, Staphylococcus aureus subsp. aureus Mu50
uaagcauaauucaacuuaaa

SEQ ID NO: 2065940 - RNA, 19 nt, Staphylococcus aureus subsp. aureus Mu50
uaagcaguuaauaagaaac

SEQ ID NO: 2065941 - RNA, 20 nt, Staphylococcus aureus subsp. aureus Mu50
uaagcaguuaauaagaaacu

SEQ ID NO: 2065942 - RNA, 14 nt, Staphylococcus aureus subsp. aureus Mu50
uaagcaaucauaau

SEQ ID NO: 2065943 - RNA, 23 nt, Staphylococcus aureus subsp. aureus Mu50
uaagcauuaauguucaauuuaua

SEQ ID NO: 2065944 - RNA, 23 nt, Staphylococcus aureus subsp. aureus Mu50
uaagcuaguguuuuuauuuuuau

SEQ ID NO: 2065945 - RNA, 18 nt, Staphylococcus aureus subsp. aureus Mu50
uaagccuuuucaaacaua

SEQ ID NO: 2065946 - RNA, 23 nt, Staphylococcus aureus subsp. aureus Mu50
uaagcgcaauggccauuugauuu

SEQ ID NO: 2065947 - RNA, 21 nt, Staphylococcus aureus subsp. aureus Mu50
uaagcugcucgauauaugucu

SEQ ID NO: 2065948 - RNA, 23 nt, Staphylococcus aureus subsp. aureus Mu50
uaagcucguuaauuuuauuuuag

SEQ ID NO: 2065949 - RNA, 12 nt, Staphylococcus aureus subsp. aureus Mu50
uaagcugaaaua

SEQ ID NO: 2065950 - RNA, 19 nt, Staphylococcus aureus subsp. aureus Mu50
uaagcugaaaaucaucauu

SEQ ID NO: 2065951 - RNA, 21 nt, Staphylococcus aureus subsp. aureus Mu50
uaagcugaaaaucaucauuau

SEQ ID NO: 2065952 - RNA, 21 nt, Staphylococcus aureus subsp. aureus Mu50
uaagcucauuucaauauuaaa

SEQ ID NO: 2065953 - RNA, 23 nt, Staphylococcus aureus subsp. aureus Mu50
uaagcucauuucaauauuaaaau

SEQ ID NO: 2065954 - RNA, 13 nt, Staphylococcus aureus subsp. aureus Mu50
uaagcuuaucaac

SEQ ID NO: 2065955 - RNA, 21 nt, Staphylococcus aureus subsp. aureus Mu50
uaagcuuaucaacgauuuugu

SEQ ID NO: 2065956 - RNA, 17 nt, Staphylococcus aureus subsp. aureus Mu50
uaagcuuguaacaagca

SEQ ID NO: 2065957 - RNA, 12 nt, Staphylococcus aureus subsp. aureus Mu50
uaagcuuucauu

SEQ ID NO: 2065958 - RNA, 17 nt, Staphylococcus aureus subsp. aureus Mu50
uaagcuuucauuaauuu

SEQ ID NO: 2065959 - RNA, 15 nt, Staphylococcus aureus subsp. aureus Mu50
uaagcuuuguuugac

SEQ ID NO: 2065960 - RNA, 15 nt, Staphylococcus aureus subsp. aureus Mu50
uaaccccuccuggug

SEQ ID NO: 2065961 - RNA, 14 nt, Staphylococcus aureus subsp. aureus Mu50
uaaccauuuaaaaa

SEQ ID NO: 2065962 - RNA, 15 nt, Staphylococcus aureus subsp. aureus Mu50
uaaccauuuaaaaau

SEQ ID NO: 2065963 - RNA, 14 nt, Staphylococcus aureus subsp. aureus Mu50
uaacccacauuaaa

SEQ ID NO: 2065964 - RNA, 18 nt, Staphylococcus aureus subsp. aureus Mu50
uaacccaacgaugaaacu

SEQ ID NO: 2065965 - RNA, 15 nt, Staphylococcus aureus subsp. aureus Mu50
uaaccuuguucuuua

SEQ ID NO: 2065966 - RNA, 15 nt, Staphylococcus aureus subsp. aureus Mu50
uaaccuuuaaaacau

SEQ ID NO: 2065967 - RNA, 14 nt, Staphylococcus aureus subsp. aureus Mu50
uaaccuugauuuaa

SEQ ID NO: 2065968 - RNA, 12 nt, Staphylococcus aureus subsp. aureus Mu50
uaacggcucgcg

SEQ ID NO: 2065969 - RNA, 13 nt, Staphylococcus aureus subsp. aureus Mu50
uaacuaaaauguc

SEQ ID NO: 2065970 - RNA, 14 nt, Staphylococcus aureus subsp. aureus Mu50
uaacuaaaaugucu

SEQ ID NO: 2065971 - RNA, 21 nt, Staphylococcus aureus subsp. aureus Mu50
uaacguuucuuuguauaccua

SEQ ID NO: 2065972 - RNA, 14 nt, Staphylococcus aureus subsp. aureus Mu50
uaacucaagugauu

SEQ ID NO: 2065973 - RNA, 20 nt, Staphylococcus aureus subsp. aureus Mu50
uaacucuaaauauaauagaa

SEQ ID NO: 2065974 - RNA, 16 nt, Staphylococcus aureus subsp. aureus Mu50
uaacucguaaucauag

SEQ ID NO: 2065975 - RNA, 23 nt, Staphylococcus aureus subsp. aureus Mu50
uaacuauauugugcuaaguuagg

SEQ ID NO: 2065976 - RNA, 16 nt, Staphylococcus aureus subsp. aureus Mu50
uaacuauugaaaauag

SEQ ID NO: 2065977 - RNA, 17 nt, Staphylococcus aureus subsp. aureus Mu50
uaacuaugaaugcugug

SEQ ID NO: 2065978 - RNA, 17 nt, Staphylococcus aureus subsp. aureus Mu50
uaacucaaagaaacuau

SEQ ID NO: 2065979 - RNA, 22 nt, Staphylococcus aureus subsp. aureus Mu50
uaacuagauguucacauucuug

SEQ ID NO: 2065980 - RNA, 17 nt, Staphylococcus aureus subsp. aureus Mu50
uaacuagcaaaugcacu

SEQ ID NO: 2065981 - RNA, 17 nt, Staphylococcus aureus subsp. aureus Mu50
uaacuagugccucuuuu

SEQ ID NO: 2065982 - RNA, 19 nt, Staphylococcus aureus subsp. aureus Mu50
uaacugcaaacuugauuca

SEQ ID NO: 2065983 - RNA, 15 nt, Staphylococcus aureus subsp. aureus Mu50
uaacugaccuaacaa

SEQ ID NO: 2065984 - RNA, 15 nt, Staphylococcus aureus subsp. aureus Mu50
uaacucuuuaauuuu

SEQ ID NO: 2065985 - RNA, 22 nt, Staphylococcus aureus subsp. aureus Mu50
uaacugugauauuaauugaaaa

SEQ ID NO: 2065986 - RNA, 22 nt, Staphylococcus aureus subsp. aureus Mu50
uaaccaaucaucgcaaauacau

SEQ ID NO: 2065987 - RNA, 18 nt, Staphylococcus aureus subsp. aureus Mu50
uaaccacuccuuaaacaa

SEQ ID NO: 2065988 - RNA, 20 nt, Staphylococcus aureus subsp. aureus Mu50
uaacauccugcuuauuaauu

SEQ ID NO: 2065989 - RNA, 22 nt, Staphylococcus aureus subsp. aureus Mu50
uaacauccuuugauguuuucua

SEQ ID NO: 2065990 - RNA, 14 nt, Staphylococcus aureus subsp. aureus Mu50
uaacaucuaaauuu

SEQ ID NO: 2065991 - RNA, 14 nt, Staphylococcus aureus subsp. aureus Mu50
uaaccaaaagaaau

SEQ ID NO: 2065992 - RNA, 16 nt, Staphylococcus aureus subsp. aureus Mu50
uaaccaaaagaaauuc

SEQ ID NO: 2065993 - RNA, 21 nt, Staphylococcus aureus subsp. aureus Mu50
uaacagucccaaccccuuuau

SEQ ID NO: 2065994 - RNA, 20 nt, Staphylococcus aureus subsp. aureus Mu50
uaacagcuuaauuuuauuau

SEQ ID NO: 2065995 - RNA, 15 nt, Staphylococcus aureus subsp. aureus Mu50
uaacagcuaaaaauu

SEQ ID NO: 2065996 - RNA, 16 nt, Staphylococcus aureus subsp. aureus Mu50
uaacagcuacaaauaa

SEQ ID NO: 2065997 - RNA, 22 nt, Staphylococcus aureus subsp. aureus Mu50
uaacauaucgcgcaucaaaaau

SEQ ID NO: 2065998 - RNA, 16 nt, Staphylococcus aureus subsp. aureus Mu50
uaacaucaaauagaca

SEQ ID NO: 2065999 - RNA, 22 nt, Staphylococcus aureus subsp. aureus Mu50
uaacaucaaauagacaccaaaa

SEQ ID NO: 2066000 - RNA, 14 nt, Staphylococcus aureus subsp. aureus Mu50
uaacaucaauuacu

SEQ ID NO: 2066001 - RNA, 17 nt, Staphylococcus aureus subsp. aureus Mu50
uaacaucaauuacucuu

SEQ ID NO: 2066002 - RNA, 21 nt, Staphylococcus aureus subsp. aureus Mu50
uaacauacuauaaaaauuuau

SEQ ID NO: 2066003 - RNA, 18 nt, Staphylococcus aureus subsp. aureus Mu50
uaacauacuauaaaaauu

SEQ ID NO: 2066004 - RNA, 16 nt, Staphylococcus aureus subsp. aureus Mu50
uaacauacuauaaaaa

SEQ ID NO: 2066005 - RNA, 17 nt, Staphylococcus aureus subsp. aureus Mu50
uaacauacuauaaaaau

SEQ ID NO: 2066006 - RNA, 14 nt, Staphylococcus aureus subsp. aureus Mu50
uaacauaccuaaua

SEQ ID NO: 2066007 - RNA, 23 nt, Staphylococcus aureus subsp. aureus Mu50
uaacauaaaaaggucuauguaca

SEQ ID NO: 2066008 - RNA, 13 nt, Staphylococcus aureus subsp. aureus Mu50
uaacauaaaaaug

SEQ ID NO: 2066009 - RNA, 15 nt, Staphylococcus aureus subsp. aureus Mu50
uaacauaaaaaugcu

SEQ ID NO: 2066010 - RNA, 15 nt, Staphylococcus aureus subsp. aureus Mu50
uaacauaaaaugagu

SEQ ID NO: 2066011 - RNA, 16 nt, Staphylococcus aureus subsp. aureus Mu50
uaaauguacauuguaa

SEQ ID NO: 2066012 - RNA, 13 nt, Staphylococcus aureus subsp. aureus Mu50
uaaaugugacuuu

SEQ ID NO: 2066013 - RNA, 20 nt, Staphylococcus aureus subsp. aureus Mu50
uaaaugucuuucaaauacac

SEQ ID NO: 2066014 - RNA, 15 nt, Staphylococcus aureus subsp. aureus Mu50
uaaauguucuggaau

SEQ ID NO: 2066015 - RNA, 16 nt, Staphylococcus aureus subsp. aureus Mu50
uaaauguuauugcuua

SEQ ID NO: 2066016 - RNA, 17 nt, Staphylococcus aureus subsp. aureus Mu50
uaaauguuauuaaccau

SEQ ID NO: 2066017 - RNA, 17 nt, Staphylococcus aureus subsp. aureus Mu50
uaaaugugcaauuagaa

SEQ ID NO: 2066018 - RNA, 16 nt, Staphylococcus aureus subsp. aureus Mu50
uaaaugugacuuuaaa

SEQ ID NO: 2066019 - RNA, 15 nt, Staphylococcus aureus subsp. aureus Mu50
uaaauguuaaagauu

SEQ ID NO: 2066020 - RNA, 13 nt, Staphylococcus aureus subsp. aureus Mu50
uaaauguuauuaa

SEQ ID NO: 2066021 - RNA, 18 nt, Staphylococcus aureus subsp. aureus Mu50
uaaauguuauuaaccauc

SEQ ID NO: 2066022 - RNA, 17 nt, Staphylococcus aureus subsp. aureus Mu50
uaacaacacuacccaca

SEQ ID NO: 2066023 - RNA, 16 nt, Staphylococcus aureus subsp. aureus Mu50
uaacacgauaauuaua

SEQ ID NO: 2066024 - RNA, 14 nt, Staphylococcus aureus subsp. aureus Mu50
uaacaccuacugau

SEQ ID NO: 2066025 - RNA, 12 nt, Staphylococcus aureus subsp. aureus Mu50
uaacaaucaaag

SEQ ID NO: 2066026 - RNA, 20 nt, Staphylococcus aureus subsp. aureus Mu50
uaacaauauucguaaauccu

SEQ ID NO: 2066027 - RNA, 20 nt, Staphylococcus aureus subsp. aureus Mu50
uaacaagcuuuuuucaauuc

SEQ ID NO: 2066028 - RNA, 13 nt, Staphylococcus aureus subsp. aureus Mu50
uaacaagaaaaac

SEQ ID NO: 2066029 - RNA, 20 nt, Staphylococcus aureus subsp. aureus Mu50
uaacaagaaguaauguuaaa

SEQ ID NO: 2066030 - RNA, 12 nt, Staphylococcus aureus subsp. aureus Mu50
uaacaagcauuu

SEQ ID NO: 2066031 - RNA, 20 nt, Staphylococcus aureus subsp. aureus Mu50
uaacaagcauuuuucaauua

SEQ ID NO: 2066032 - RNA, 17 nt, Staphylococcus aureus subsp. aureus Mu50
uaaagaacuauuuuaaa

SEQ ID NO: 2066033 - RNA, 21 nt, Staphylococcus aureus subsp. aureus Mu50
uaaagaguuauguuugucguu

SEQ ID NO: 2066034 - RNA, 19 nt, Staphylococcus aureus subsp. aureus Mu50
uaaagaucauuuucaacau

SEQ ID NO: 2066035 - RNA, 20 nt, Staphylococcus aureus subsp. aureus Mu50
uaaagcuugcuguucaacau

SEQ ID NO: 2066036 - RNA, 16 nt, Staphylococcus aureus subsp. aureus Mu50
uaaagcuuuaguuaaa

SEQ ID NO: 2066037 - RNA, 16 nt, Staphylococcus aureus subsp. aureus Mu50
uaaagcuuauuaaauc

SEQ ID NO: 2066038 - RNA, 21 nt, Staphylococcus aureus subsp. aureus Mu50
uaaagcuucgucaaugacuaa

SEQ ID NO: 2066039 - RNA, 16 nt, Staphylococcus aureus subsp. aureus Mu50
uaaagcaauguugcau

SEQ ID NO: 2066040 - RNA, 17 nt, Staphylococcus aureus subsp. aureus Mu50
uaaagcugauuuuucau

SEQ ID NO: 2066041 - RNA, 15 nt, Staphylococcus aureus subsp. aureus Mu50
uaaagcuauaaaaaa

SEQ ID NO: 2066042 - RNA, 17 nt, Staphylococcus aureus subsp. aureus Mu50
uaaagauuuacccauua

SEQ ID NO: 2066043 - RNA, 16 nt, Staphylococcus aureus subsp. aureus Mu50
uaaagauuaaaauaug

SEQ ID NO: 2066044 - RNA, 22 nt, Staphylococcus aureus subsp. aureus Mu50
uaaagauuauuauuacaaugaa

SEQ ID NO: 2066045 - RNA, 24 nt, Staphylococcus aureus subsp. aureus Mu50
uaaacucaaaaagccaacacauuc

SEQ ID NO: 2066046 - RNA, 16 nt, Staphylococcus aureus subsp. aureus Mu50
uaaacucauaccaaaa

SEQ ID NO: 2066047 - RNA, 14 nt, Staphylococcus aureus subsp. aureus Mu50
uaaacucauaccaa

SEQ ID NO: 2066048 - RNA, 19 nt, Staphylococcus aureus subsp. aureus Mu50
uaaacgcugauuuuauaaa

SEQ ID NO: 2066049 - RNA, 23 nt, Staphylococcus aureus subsp. aureus Mu50
uaaacuagaaaacauaaauacaa

SEQ ID NO: 2066050 - RNA, 14 nt, Staphylococcus aureus subsp. aureus Mu50
uaaacaugaacaau

SEQ ID NO: 2066051 - RNA, 18 nt, Staphylococcus aureus subsp. aureus Mu50
uaaaccgauuaauauaau

SEQ ID NO: 2066052 - RNA, 21 nt, Staphylococcus aureus subsp. aureus Mu50
uaaaccgauuguuucaccagc

SEQ ID NO: 2066053 - RNA, 20 nt, Staphylococcus aureus subsp. aureus Mu50
uaaaccaucugugucagcau

SEQ ID NO: 2066054 - RNA, 14 nt, Staphylococcus aureus subsp. aureus Mu50
uaaacccaaagcuc

SEQ ID NO: 2066055 - RNA, 15 nt, Staphylococcus aureus subsp. aureus Mu50
uaaacauguacaauu

SEQ ID NO: 2066056 - RNA, 18 nt, Staphylococcus aureus subsp. aureus Mu50
uaaaguacuuacaaauau

SEQ ID NO: 2066057 - RNA, 21 nt, Staphylococcus aureus subsp. aureus Mu50
uaaagucguaucauauauuga

SEQ ID NO: 2066058 - RNA, 17 nt, Staphylococcus aureus subsp. aureus Mu50
uaaaguauguugucaua

SEQ ID NO: 2066059 - RNA, 21 nt, Staphylococcus aureus subsp. aureus Mu50
uaaagucaacaucguauucuu

SEQ ID NO: 2066060 - RNA, 18 nt, Staphylococcus aureus subsp. aureus Mu50
uaaagucaauuuaaauaa

SEQ ID NO: 2066061 - RNA, 13 nt, Staphylococcus aureus subsp. aureus Mu50
uaaaguuauaaau

SEQ ID NO: 2066062 - RNA, 15 nt, Staphylococcus aureus subsp. aureus Mu50
uaaaguuauaaauua

SEQ ID NO: 2066063 - RNA, 14 nt, Staphylococcus aureus subsp. aureus Mu50
uaaaguuaaagacu

SEQ ID NO: 2066064 - RNA, 19 nt, Staphylococcus aureus subsp. aureus Mu50
uaaaguuccaaguuaaugc

SEQ ID NO: 2066065 - RNA, 19 nt, Staphylococcus aureus subsp. aureus Mu50
uaaauaacaguuaauuaua

SEQ ID NO: 2066066 - RNA, 15 nt, Staphylococcus aureus subsp. aureus Mu50
uaaagugaaauaaag

SEQ ID NO: 2066067 - RNA, 19 nt, Staphylococcus aureus subsp. aureus Mu50
uaaauacgccaaauaucag

SEQ ID NO: 2066068 - RNA, 19 nt, Staphylococcus aureus subsp. aureus Mu50
uaaauaacuuuuuaaagga

SEQ ID NO: 2066069 - RNA, 15 nt, Staphylococcus aureus subsp. aureus Mu50
uaaauaacuuuacca

SEQ ID NO: 2066070 - RNA, 17 nt, Staphylococcus aureus subsp. aureus Mu50
uaaauaacuuuaccacc

SEQ ID NO: 2066071 - RNA, 18 nt, Staphylococcus aureus subsp. aureus Mu50
uaaauaacuuuaccacca

SEQ ID NO: 2066072 - RNA, 19 nt, Staphylococcus aureus subsp. aureus Mu50
uaaauaagcaaucauaaua

SEQ ID NO: 2066073 - RNA, 13 nt, Staphylococcus aureus subsp. aureus Mu50
uaaauaacuucgu

SEQ ID NO: 2066074 - RNA, 21 nt, Staphylococcus aureus subsp. aureus Mu50
uaaauaaccgcacuuucuauu

SEQ ID NO: 2066075 - RNA, 19 nt, Staphylococcus aureus subsp. aureus Mu50
uaaauaagugauaaauaau

SEQ ID NO: 2066076 - RNA, 12 nt, Staphylococcus aureus subsp. aureus Mu50
uaaaucaucauu

SEQ ID NO: 2066077 - RNA, 14 nt, Staphylococcus aureus subsp. aureus Mu50
uaaaucauucuuua

SEQ ID NO: 2066078 - RNA, 14 nt, Staphylococcus aureus subsp. aureus Mu50
uaaauauuuagauu

SEQ ID NO: 2066079 - RNA, 19 nt, Staphylococcus aureus subsp. aureus Mu50
uaaauauugauauaaaaaa

SEQ ID NO: 2066080 - RNA, 15 nt, Staphylococcus aureus subsp. aureus Mu50
uaaaucaguaguuuu

SEQ ID NO: 2066081 - RNA, 20 nt, Staphylococcus aureus subsp. aureus Mu50
uaaauauaaaccagcugauu

SEQ ID NO: 2066082 - RNA, 15 nt, Staphylococcus aureus subsp. aureus Mu50
uaaauauaaauauga

SEQ ID NO: 2066083 - RNA, 16 nt, Staphylococcus aureus subsp. aureus Mu50
uaaauaguuuuucaua

SEQ ID NO: 2066084 - RNA, 18 nt, Staphylococcus aureus subsp. aureus Mu50
uaaauaguuuuucauauu

SEQ ID NO: 2066085 - RNA, 22 nt, Staphylococcus aureus subsp. aureus Mu50
uaaauauuauuuugcaauugca

SEQ ID NO: 2066086 - RNA, 13 nt, Staphylococcus aureus subsp. aureus Mu50
uaaauauugaaga

SEQ ID NO: 2066087 - RNA, 14 nt, Staphylococcus aureus subsp. aureus Mu50
uaaauauugauaua

SEQ ID NO: 2066088 - RNA, 18 nt, Staphylococcus aureus subsp. aureus Mu50
uaaauauuggaauacucu

SEQ ID NO: 2066089 - RNA, 19 nt, Staphylococcus aureus subsp. aureus Mu50
uaaauauuggaauacucuu

SEQ ID NO: 2066090 - RNA, 13 nt, Staphylococcus aureus subsp. aureus Mu50
uaaauauuuaauu

SEQ ID NO: 2066091 - RNA, 18 nt, Staphylococcus aureus subsp. aureus Mu50
uaaauauuuaauuggauu

SEQ ID NO: 2066092 - RNA, 21 nt, Staphylococcus aureus subsp. aureus Mu50
uaaauauuuaaaauauuauuu

SEQ ID NO: 2066093 - RNA, 14 nt, Staphylococcus aureus subsp. aureus Mu50
uaaauccuuuauau

SEQ ID NO: 2066094 - RNA, 17 nt, Staphylococcus aureus subsp. aureus Mu50
uaaaucgauaaaaugua

SEQ ID NO: 2066095 - RNA, 21 nt, Staphylococcus aureus subsp. aureus Mu50
uaaaugcacgagcaacaucuu

SEQ ID NO: 2066096 - RNA, 22 nt, Staphylococcus aureus subsp. aureus Mu50
uaaaugcaauacauuaauauaa

SEQ ID NO: 2066097 - RNA, 15 nt, Staphylococcus aureus subsp. aureus Mu50
uaaaugauuucacuu

SEQ ID NO: 2066098 - RNA, 12 nt, Staphylococcus aureus subsp. aureus Mu50
uaaaugauuuau

SEQ ID NO: 2066099 - RNA, 12 nt, Staphylococcus aureus subsp. aureus Mu50
uaaaugauuuaa

SEQ ID NO: 2066100 - RNA, 14 nt, Staphylococcus aureus subsp. aureus Mu50
uaaaugauuuaaua

SEQ ID NO: 2066101 - RNA, 14 nt, Staphylococcus aureus subsp. aureus Mu50
uaaaugauuaauaa

SEQ ID NO: 2066102 - RNA, 23 nt, Staphylococcus aureus subsp. aureus Mu50
uaaaugauggguaguuaauauaa

SEQ ID NO: 2066103 - RNA, 20 nt, Staphylococcus aureus subsp. aureus Mu50
uaaaucgugcuguuaucaug

SEQ ID NO: 2066104 - RNA, 16 nt, Staphylococcus aureus subsp. aureus Mu50
uaaaucgggcaaccuc

SEQ ID NO: 2066105 - RNA, 15 nt, Staphylococcus aureus subsp. aureus Mu50
uaaaauaucaaaaua

SEQ ID NO: 2066106 - RNA, 15 nt, Staphylococcus aureus subsp. aureus Mu50
uaaaauauuuaacuu

SEQ ID NO: 2066107 - RNA, 16 nt, Staphylococcus aureus subsp. aureus Mu50
uaaaauauuuaacuuu

SEQ ID NO: 2066108 - RNA, 14 nt, Staphylococcus aureus subsp. aureus Mu50
uaaaauauaucuua

SEQ ID NO: 2066109 - RNA, 19 nt, Staphylococcus aureus subsp. aureus Mu50
uaaaauauaugaauaaguc

SEQ ID NO: 2066110 - RNA, 13 nt, Staphylococcus aureus subsp. aureus Mu50
uaaaauaauuaaa

SEQ ID NO: 2066111 - RNA, 16 nt, Staphylococcus aureus subsp. aureus Mu50
uaaaauaauuaaauaa

SEQ ID NO: 2066112 - RNA, 20 nt, Staphylococcus aureus subsp. aureus Mu50
uaaaauaauuaaauaaaaau

SEQ ID NO: 2066113 - RNA, 20 nt, Staphylococcus aureus subsp. aureus Mu50
uaaaauaaucgguaauuacu

SEQ ID NO: 2066114 - RNA, 18 nt, Staphylococcus aureus subsp. aureus Mu50
uaaaauaauagauaauag

SEQ ID NO: 2066115 - RNA, 17 nt, Staphylococcus aureus subsp. aureus Mu50
uaaaaggcgaaacauua

SEQ ID NO: 2066116 - RNA, 20 nt, Staphylococcus aureus subsp. aureus Mu50
uaaaaggcgaaacauuaaaa

SEQ ID NO: 2066117 - RNA, 17 nt, Staphylococcus aureus subsp. aureus Mu50
uaaaaggcuuuguuaaa

SEQ ID NO: 2066118 - RNA, 22 nt, Staphylococcus aureus subsp. aureus Mu50
uaaaaggcgaaacauuaaaaua

SEQ ID NO: 2066119 - RNA, 18 nt, Staphylococcus aureus subsp. aureus Mu50
uaaaauaagauauauaau

SEQ ID NO: 2066120 - RNA, 13 nt, Staphylococcus aureus subsp. aureus Mu50
uaaaauaaucggu

SEQ ID NO: 2066121 - RNA, 11 nt, Staphylococcus aureus subsp. aureus Mu50
uaaaauaauga

SEQ ID NO: 2066122 - RNA, 14 nt, Staphylococcus aureus subsp. aureus Mu50
uaaaaugcauagcu

SEQ ID NO: 2066123 - RNA, 18 nt, Staphylococcus aureus subsp. aureus Mu50
uaaaaugcuacaauuucc

SEQ ID NO: 2066124 - RNA, 22 nt, Staphylococcus aureus subsp. aureus Mu50
uaaaaucuauaccauuccaaaa

SEQ ID NO: 2066125 - RNA, 16 nt, Staphylococcus aureus subsp. aureus Mu50
uaaaauaugacacaua

SEQ ID NO: 2066126 - RNA, 15 nt, Staphylococcus aureus subsp. aureus Mu50
uaaaauaugauuuaa

SEQ ID NO: 2066127 - RNA, 15 nt, Staphylococcus aureus subsp. aureus Mu50
uaaaaucgcagcaau

SEQ ID NO: 2066128 - RNA, 16 nt, Staphylococcus aureus subsp. aureus Mu50
uaaaaucgcgucugau

SEQ ID NO: 2066129 - RNA, 23 nt, Staphylococcus aureus subsp. aureus Mu50
uaaaaucgcgucugauucucuaa

SEQ ID NO: 2066130 - RNA, 14 nt, Staphylococcus aureus subsp. aureus Mu50
uaaaauuaaaacuu

SEQ ID NO: 2066131 - RNA, 17 nt, Staphylococcus aureus subsp. aureus Mu50
uaaaauguuaauaauga

SEQ ID NO: 2066132 - RNA, 21 nt, Staphylococcus aureus subsp. aureus Mu50
uaaaauuaaaccuacaacgaa

SEQ ID NO: 2066133 - RNA, 21 nt, Staphylococcus aureus subsp. aureus Mu50
uaaaauuaacuuaaaauuuaa

SEQ ID NO: 2066134 - RNA, 22 nt, Staphylococcus aureus subsp. aureus Mu50
uaaaauuaacuuaaaauuuaaa

SEQ ID NO: 2066135 - RNA, 16 nt, Staphylococcus aureus subsp. aureus Mu50
uaaaauuguauagaau

SEQ ID NO: 2066136 - RNA, 20 nt, Staphylococcus aureus subsp. aureus Mu50
uaaaauugccaguaucucuu

SEQ ID NO: 2066137 - RNA, 14 nt, Staphylococcus aureus subsp. aureus Mu50
uaaaauucuuucag

SEQ ID NO: 2066138 - RNA, 18 nt, Staphylococcus aureus subsp. aureus Mu50
uaaaauuacuugaauauu

SEQ ID NO: 2066139 - RNA, 18 nt, Staphylococcus aureus subsp. aureus Mu50
uaaaauuuaaauauugaa

SEQ ID NO: 2066140 - RNA, 15 nt, Staphylococcus aureus subsp. aureus Mu50
uaaaauuuaaaacaa

SEQ ID NO: 2066141 - RNA, 23 nt, Staphylococcus aureus subsp. aureus Mu50
uaaaauuguugagucuuagacau

SEQ ID NO: 2066142 - RNA, 23 nt, Staphylococcus aureus subsp. aureus Mu50
uaaaauuuuuuucauaauuaaua

SEQ ID NO: 2066143 - RNA, 23 nt, Staphylococcus aureus subsp. aureus Mu50
uaaaauuuuuugggcuuuuucac

SEQ ID NO: 2066144 - RNA, 18 nt, Staphylococcus aureus subsp. aureus Mu50
uaaaauuuuuaaaaaaau

SEQ ID NO: 2066145 - RNA, 21 nt, Staphylococcus aureus subsp. aureus Mu50
uaaaauuuucguguuaauaac

SEQ ID NO: 2066146 - RNA, 18 nt, Staphylococcus aureus subsp. aureus Mu50
uaaaauuuguuaauuuaa

SEQ ID NO: 2066147 - RNA, 15 nt, Staphylococcus aureus subsp. aureus Mu50
uaaacacaucuaugu

SEQ ID NO: 2066148 - RNA, 18 nt, Staphylococcus aureus subsp. aureus Mu50
uaaacacuauaaaagcca

SEQ ID NO: 2066149 - RNA, 14 nt, Staphylococcus aureus subsp. aureus Mu50
uaaacaacauacag

SEQ ID NO: 2066150 - RNA, 20 nt, Staphylococcus aureus subsp. aureus Mu50
uaaacaagcaucaugaaauu

SEQ ID NO: 2066151 - RNA, 14 nt, Staphylococcus aureus subsp. aureus Mu50
uaaacaagcaucau

SEQ ID NO: 2066152 - RNA, 20 nt, Staphylococcus aureus subsp. aureus Mu50
uaaaacaaauucauauuaac

SEQ ID NO: 2066153 - RNA, 21 nt, Staphylococcus aureus subsp. aureus Mu50
uaaaacaaauucauauuaacu

SEQ ID NO: 2066154 - RNA, 14 nt, Staphylococcus aureus subsp. aureus Mu50
uaaaaauuucaaua

SEQ ID NO: 2066155 - RNA, 21 nt, Staphylococcus aureus subsp. aureus Mu50
uaaaaauuucgccucaucuaa

SEQ ID NO: 2066156 - RNA, 24 nt, Staphylococcus aureus subsp. aureus Mu50
uaaaaauuuauucaaaauucaaua

SEQ ID NO: 2066157 - RNA, 22 nt, Staphylococcus aureus subsp. aureus Mu50
uaaaaauugcaaugcuaucaug

SEQ ID NO: 2066158 - RNA, 19 nt, Staphylococcus aureus subsp. aureus Mu50
uaaaaauugauauugcaaa

SEQ ID NO: 2066159 - RNA, 20 nt, Staphylococcus aureus subsp. aureus Mu50
uaaaaaugcugguaaauguu

SEQ ID NO: 2066160 - RNA, 16 nt, Staphylococcus aureus subsp. aureus Mu50
uaaaaauuaaguaaua

SEQ ID NO: 2066161 - RNA, 13 nt, Staphylococcus aureus subsp. aureus Mu50
uaaaaauguaaau

SEQ ID NO: 2066162 - RNA, 17 nt, Staphylococcus aureus subsp. aureus Mu50
uaaaaauuaaguaauag

SEQ ID NO: 2066163 - RNA, 19 nt, Staphylococcus aureus subsp. aureus Mu50
uaaaaccgguacuuucauu

SEQ ID NO: 2066164 - RNA, 15 nt, Staphylococcus aureus subsp. aureus Mu50
uaaaacgcuucauau

SEQ ID NO: 2066165 - RNA, 20 nt, Staphylococcus aureus subsp. aureus Mu50
uaaaacgugcaaauaaaaaa

SEQ ID NO: 2066166 - RNA, 15 nt, Staphylococcus aureus subsp. aureus Mu50
uaaaacugcaauaau

SEQ ID NO: 2066167 - RNA, 15 nt, Staphylococcus aureus subsp. aureus Mu50
uaaaacuaaugauag

SEQ ID NO: 2066168 - RNA, 20 nt, Staphylococcus aureus subsp. aureus Mu50
uaaaacuacugauuuauuga

SEQ ID NO: 2066169 - RNA, 19 nt, Staphylococcus aureus subsp. aureus Mu50
uaaaagacauccacagaau

SEQ ID NO: 2066170 - RNA, 19 nt, Staphylococcus aureus subsp. aureus Mu50
uaaaagacagaaauuacua

SEQ ID NO: 2066171 - RNA, 19 nt, Staphylococcus aureus subsp. aureus Mu50
uaaaagagaauuuuaauua

SEQ ID NO: 2066172 - RNA, 22 nt, Staphylococcus aureus subsp. aureus Mu50
uaaaaggaaggauuuuagauuu

SEQ ID NO: 2066173 - RNA, 19 nt, Staphylococcus aureus subsp. aureus Mu50
uaaaaggaagucgcaauca

SEQ ID NO: 2066174 - RNA, 15 nt, Staphylococcus aureus subsp. aureus Mu50
uaaaagcugauguga

SEQ ID NO: 2066175 - RNA, 14 nt, Staphylococcus aureus subsp. aureus Mu50
uaaaagauuagaug

SEQ ID NO: 2066176 - RNA, 21 nt, Staphylococcus aureus subsp. aureus Mu50
uaaaaagguacuaauguuaau

SEQ ID NO: 2066177 - RNA, 17 nt, Staphylococcus aureus subsp. aureus Mu50
uaaaaagaucauuaaaa

SEQ ID NO: 2066178 - RNA, 14 nt, Staphylococcus aureus subsp. aureus Mu50
uaaaaaucuuggug

SEQ ID NO: 2066179 - RNA, 17 nt, Staphylococcus aureus subsp. aureus Mu50
uaaaaauaggaauacau

SEQ ID NO: 2066180 - RNA, 21 nt, Staphylococcus aureus subsp. aureus Mu50
uaaaaauacauuuugcucuaa

SEQ ID NO: 2066181 - RNA, 14 nt, Staphylococcus aureus subsp. aureus Mu50
uaaaaauaaaaccg

SEQ ID NO: 2066182 - RNA, 14 nt, Staphylococcus aureus subsp. aureus Mu50
uaaaaauaaucccg

SEQ ID NO: 2066183 - RNA, 14 nt, Staphylococcus aureus subsp. aureus Mu50
guuugauuaaaauc

SEQ ID NO: 2066184 - RNA, 15 nt, Staphylococcus aureus subsp. aureus Mu50
guuugauuaaaaucu

SEQ ID NO: 2066185 - RNA, 15 nt, Staphylococcus aureus subsp. aureus Mu50
guuugcaacauauuu

SEQ ID NO: 2066186 - RNA, 13 nt, Staphylococcus aureus subsp. aureus Mu50
uaaaaacuguuca

SEQ ID NO: 2066187 - RNA, 15 nt, Staphylococcus aureus subsp. aureus Mu50
uaaaaacguucaauc

SEQ ID NO: 2066188 - RNA, 23 nt, Staphylococcus aureus subsp. aureus Mu50
uaaaaacggacaaguugcacauu

SEQ ID NO: 2066189 - RNA, 14 nt, Staphylococcus aureus subsp. aureus Mu50
guuuaaaaaugcug

SEQ ID NO: 2066190 - RNA, 13 nt, Staphylococcus aureus subsp. aureus Mu50
guuuaaacauuuu

SEQ ID NO: 2066191 - RNA, 18 nt, Staphylococcus aureus subsp. aureus Mu50
guuguuuuuuguuuucaa

SEQ ID NO: 2066192 - RNA, 16 nt, Staphylococcus aureus subsp. aureus Mu50
guuguugaaauuaaau

SEQ ID NO: 2066193 - RNA, 13 nt, Staphylococcus aureus subsp. aureus Mu50
guuguuucuccag

SEQ ID NO: 2066194 - RNA, 15 nt, Staphylococcus aureus subsp. aureus Mu50
guuguaauuuaaaau

SEQ ID NO: 2066195 - RNA, 22 nt, Staphylococcus aureus subsp. aureus Mu50
guugucacuuggauucaaauga

SEQ ID NO: 2066196 - RNA, 21 nt, Staphylococcus aureus subsp. aureus Mu50
guuguauucugaaacuuuaau

SEQ ID NO: 2066197 - RNA, 15 nt, Staphylococcus aureus subsp. aureus Mu50
guuguucuuuuuguu

SEQ ID NO: 2066198 - RNA, 14 nt, Staphylococcus aureus subsp. aureus Mu50
guuuaauuuuaaau

SEQ ID NO: 2066199 - RNA, 23 nt, Staphylococcus aureus subsp. aureus Mu50
guuuaauuugauuaaauucaucu

SEQ ID NO: 2066200 - RNA, 20 nt, Staphylococcus aureus subsp. aureus Mu50
guuuaauuugauuaaauuca

SEQ ID NO: 2066201 - RNA, 18 nt, Staphylococcus aureus subsp. aureus Mu50
guuuaacaacacuaccca

SEQ ID NO: 2066202 - RNA, 14 nt, Staphylococcus aureus subsp. aureus Mu50
guuuaucaauuucu

SEQ ID NO: 2066203 - RNA, 17 nt, Staphylococcus aureus subsp. aureus Mu50
guuuauauugcaaaaau

SEQ ID NO: 2066204 - RNA, 19 nt, Staphylococcus aureus subsp. aureus Mu50
guuuauauugcaaaaauaa

SEQ ID NO: 2066205 - RNA, 13 nt, Staphylococcus aureus subsp. aureus Mu50
guuuaucagcuuu

SEQ ID NO: 2066206 - RNA, 16 nt, Staphylococcus aureus subsp. aureus Mu50
guuuaucagcuuuaau

SEQ ID NO: 2066207 - RNA, 20 nt, Staphylococcus aureus subsp. aureus Mu50
guuuauaaaaaaucaguuuu

SEQ ID NO: 2066208 - RNA, 23 nt, Staphylococcus aureus subsp. aureus Mu50
guuuauaaucuuuuuuacuaaaa

SEQ ID NO: 2066209 - RNA, 16 nt, Staphylococcus aureus subsp. aureus Mu50
guuuauauugcaaaaa

SEQ ID NO: 2066210 - RNA, 19 nt, Staphylococcus aureus subsp. aureus Mu50
guuuacgaucauaaauauu

SEQ ID NO: 2066211 - RNA, 20 nt, Staphylococcus aureus subsp. aureus Mu50
guuucuauaaagaaugauuu

SEQ ID NO: 2066212 - RNA, 20 nt, Staphylococcus aureus subsp. aureus Mu50
guuucggaaaaagaugaaaa

SEQ ID NO: 2066213 - RNA, 23 nt, Staphylococcus aureus subsp. aureus Mu50
guuugacaaagcuaaagugaagu

SEQ ID NO: 2066214 - RNA, 15 nt, Staphylococcus aureus subsp. aureus Mu50
guuugaauggcaaau

SEQ ID NO: 2066215 - RNA, 21 nt, Staphylococcus aureus subsp. aureus Mu50
guuugaauguuuuugauagua

SEQ ID NO: 2066216 - RNA, 17 nt, Staphylococcus aureus subsp. aureus Mu50
guuucuuuuauuuucau

SEQ ID NO: 2066217 - RNA, 14 nt, Staphylococcus aureus subsp. aureus Mu50
guuuccauaaauaa

SEQ ID NO: 2066218 - RNA, 20 nt, Staphylococcus aureus subsp. aureus Mu50
guuuauuacauaauuuaucu

SEQ ID NO: 2066219 - RNA, 17 nt, Staphylococcus aureus subsp. aureus Mu50
guuuauuacauaauuua

SEQ ID NO: 2066220 - RNA, 22 nt, Staphylococcus aureus subsp. aureus Mu50
guuuaucgaucgguauuuucau

SEQ ID NO: 2066221 - RNA, 20 nt, Staphylococcus aureus subsp. aureus Mu50
guuuaucuguugucaucaug

SEQ ID NO: 2066222 - RNA, 16 nt, Staphylococcus aureus subsp. aureus Mu50
guuuauccauauauga

SEQ ID NO: 2066223 - RNA, 22 nt, Staphylococcus aureus subsp. aureus Mu50
guuuauccauauaugaugauuu

SEQ ID NO: 2066224 - RNA, 19 nt, Staphylococcus aureus subsp. aureus Mu50
guuucgaacgcuugaaaaa

SEQ ID NO: 2066225 - RNA, 18 nt, Staphylococcus aureus subsp. aureus Mu50
guuggcggggccccaaca

SEQ ID NO: 2066226 - RNA, 12 nt, Staphylococcus aureus subsp. aureus Mu50
guuggggcccac

SEQ ID NO: 2066227 - RNA, 18 nt, Staphylococcus aureus subsp. aureus Mu50
guuggggcccacacccca

SEQ ID NO: 2066228 - RNA, 21 nt, Staphylococcus aureus subsp. aureus Mu50
guuguaaucauugguuucauc

SEQ ID NO: 2066229 - RNA, 16 nt, Staphylococcus aureus subsp. aureus Mu50
guugguucaucaaaca

SEQ ID NO: 2066230 - RNA, 15 nt, Staphylococcus aureus subsp. aureus Mu50
guugguugugauuug

SEQ ID NO: 2066231 - RNA, 15 nt, Staphylococcus aureus subsp. aureus Mu50
guugcacucuuuucu

SEQ ID NO: 2066232 - RNA, 19 nt, Staphylococcus aureus subsp. aureus Mu50
guugcauaaucaauuucac

SEQ ID NO: 2066233 - RNA, 21 nt, Staphylococcus aureus subsp. aureus Mu50
guugaucuuugacauguguua

SEQ ID NO: 2066234 - RNA, 22 nt, Staphylococcus aureus subsp. aureus Mu50
guugcaaauuggauaauuucuu

SEQ ID NO: 2066235 - RNA, 16 nt, Staphylococcus aureus subsp. aureus Mu50
guugauguguugcauu

SEQ ID NO: 2066236 - RNA, 19 nt, Staphylococcus aureus subsp. aureus Mu50
guugaauguggaacaugau

SEQ ID NO: 2066237 - RNA, 22 nt, Staphylococcus aureus subsp. aureus Mu50
guugaauaauuaauguuucuuc

SEQ ID NO: 2066238 - RNA, 13 nt, Staphylococcus aureus subsp. aureus Mu50
guucuuuuuguug

SEQ ID NO: 2066239 - RNA, 12 nt, Staphylococcus aureus subsp. aureus Mu50
guucuuugucug

SEQ ID NO: 2066240 - RNA, 13 nt, Staphylococcus aureus subsp. aureus Mu50
guugaacgguugu

SEQ ID NO: 2066241 - RNA, 12 nt, Staphylococcus aureus subsp. aureus Mu50
guucuaaaucuu

SEQ ID NO: 2066242 - RNA, 14 nt, Staphylococcus aureus subsp. aureus Mu50
guucuuucuuucuu

SEQ ID NO: 2066243 - RNA, 18 nt, Staphylococcus aureus subsp. aureus Mu50
guucuugguauuuuuuaa

SEQ ID NO: 2066244 - RNA, 13 nt, Staphylococcus aureus subsp. aureus Mu50
guucaucaaacaa

SEQ ID NO: 2066245 - RNA, 22 nt, Staphylococcus aureus subsp. aureus Mu50
guucauuggcaauauacuuuuu

SEQ ID NO: 2066246 - RNA, 12 nt, Staphylococcus aureus subsp. aureus Mu50
guucaguuguuu

SEQ ID NO: 2066247 - RNA, 14 nt, Staphylococcus aureus subsp. aureus Mu50
guucaguaggaauu

SEQ ID NO: 2066248 - RNA, 20 nt, Staphylococcus aureus subsp. aureus Mu50
guuagacucacuucuuaaaa

SEQ ID NO: 2066249 - RNA, 16 nt, Staphylococcus aureus subsp. aureus Mu50
guuacuucuaauagua

SEQ ID NO: 2066250 - RNA, 16 nt, Staphylococcus aureus subsp. aureus Mu50
guucacuugguacacc

SEQ ID NO: 2066251 - RNA, 14 nt, Staphylococcus aureus subsp. aureus Mu50
guuccaaucuuuuu

SEQ ID NO: 2066252 - RNA, 18 nt, Staphylococcus aureus subsp. aureus Mu50
guuccaacaacuaagaua

SEQ ID NO: 2066253 - RNA, 18 nt, Staphylococcus aureus subsp. aureus Mu50
guuccaccgaauccuguu

SEQ ID NO: 2066254 - RNA, 14 nt, Staphylococcus aureus subsp. aureus Mu50
guucccauucuuug

SEQ ID NO: 2066255 - RNA, 15 nt, Staphylococcus aureus subsp. aureus Mu50
guuccguugaauuaa

SEQ ID NO: 2066256 - RNA, 19 nt, Staphylococcus aureus subsp. aureus Mu50
guuaauaacccauuuucaa

SEQ ID NO: 2066257 - RNA, 20 nt, Staphylococcus aureus subsp. aureus Mu50
guuaauaacccauuuucaaa

SEQ ID NO: 2066258 - RNA, 18 nt, Staphylococcus aureus subsp. aureus Mu50
guuaaacuagaaaacaua

SEQ ID NO: 2066259 - RNA, 19 nt, Staphylococcus aureus subsp. aureus Mu50
guuaaacuagaaaacauaa

SEQ ID NO: 2066260 - RNA, 23 nt, Staphylococcus aureus subsp. aureus Mu50
guuaauuuuauuuuagcagcagu

SEQ ID NO: 2066261 - RNA, 12 nt, Staphylococcus aureus subsp. aureus Mu50
guuaauuuaucg

SEQ ID NO: 2066262 - RNA, 16 nt, Staphylococcus aureus subsp. aureus Mu50
guuaauucuccuaaua

SEQ ID NO: 2066263 - RNA, 19 nt, Staphylococcus aureus subsp. aureus Mu50
guuaauucuccuaauaauu

SEQ ID NO: 2066264 - RNA, 23 nt, Staphylococcus aureus subsp. aureus Mu50
guuaauuuaauaauuaaauauaa

SEQ ID NO: 2066265 - RNA, 16 nt, Staphylococcus aureus subsp. aureus Mu50
guuacuuauauauuca

SEQ ID NO: 2066266 - RNA, 20 nt, Staphylococcus aureus subsp. aureus Mu50
guuacucugcgauuucuaaa

SEQ ID NO: 2066267 - RNA, 16 nt, Staphylococcus aureus subsp. aureus Mu50
gugugccggcuuuuuc

SEQ ID NO: 2066268 - RNA, 23 nt, Staphylococcus aureus subsp. aureus Mu50
guguugaaaaguaauuaaauacu

SEQ ID NO: 2066269 - RNA, 21 nt, Staphylococcus aureus subsp. aureus Mu50
guguuaaaccaacuuucucaa

SEQ ID NO: 2066270 - RNA, 20 nt, Staphylococcus aureus subsp. aureus Mu50
guguuaaucaacguauauaa

SEQ ID NO: 2066271 - RNA, 19 nt, Staphylococcus aureus subsp. aureus Mu50
guguuggggcccacacccc

SEQ ID NO: 2066272 - RNA, 21 nt, Staphylococcus aureus subsp. aureus Mu50
guguuuuaauaauaucuuuug

SEQ ID NO: 2066273 - RNA, 15 nt, Staphylococcus aureus subsp. aureus Mu50
guguuuuuauuuuua

SEQ ID NO: 2066274 - RNA, 23 nt, Staphylococcus aureus subsp. aureus Mu50
gugguuuucuuuauuuuaaacau

SEQ ID NO: 2066275 - RNA, 18 nt, Staphylococcus aureus subsp. aureus Mu50
gugcuuauuuguuuauua

SEQ ID NO: 2066276 - RNA, 20 nt, Staphylococcus aureus subsp. aureus Mu50
guggauuacagaugaugcuu

SEQ ID NO: 2066277 - RNA, 13 nt, Staphylococcus aureus subsp. aureus Mu50
gugauucaucuau

SEQ ID NO: 2066278 - RNA, 14 nt, Staphylococcus aureus subsp. aureus Mu50
gugauuaauuucau

SEQ ID NO: 2066279 - RNA, 16 nt, Staphylococcus aureus subsp. aureus Mu50
gugcaaguauaaucca

SEQ ID NO: 2066280 - RNA, 17 nt, Staphylococcus aureus subsp. aureus Mu50
gugauuuaaaaaauuua

SEQ ID NO: 2066281 - RNA, 23 nt, Staphylococcus aureus subsp. aureus Mu50
gugcaauauuauauuuugaauca

SEQ ID NO: 2066282 - RNA, 18 nt, Staphylococcus aureus subsp. aureus Mu50
gugaugcuugaauguuug

SEQ ID NO: 2066283 - RNA, 14 nt, Staphylococcus aureus subsp. aureus Mu50
gugaugguaaauca

SEQ ID NO: 2066284 - RNA, 18 nt, Staphylococcus aureus subsp. aureus Mu50
gucgcuucuucuucagaa

SEQ ID NO: 2066285 - RNA, 15 nt, Staphylococcus aureus subsp. aureus Mu50
gugcuaaguuagggc

SEQ ID NO: 2066286 - RNA, 21 nt, Staphylococcus aureus subsp. aureus Mu50
gugcgugaagagaugaaagau

SEQ ID NO: 2066287 - RNA, 15 nt, Staphylococcus aureus subsp. aureus Mu50
gugcgguuauuuaua

SEQ ID NO: 2066288 - RNA, 15 nt, Staphylococcus aureus subsp. aureus Mu50
gugccuuugcuuuuu

SEQ ID NO: 2066289 - RNA, 16 nt, Staphylococcus aureus subsp. aureus Mu50
gccuucaauauuucuu

SEQ ID NO: 2066290 - RNA, 14 nt, Staphylococcus aureus subsp. aureus Mu50
gccuuguucaauuc

SEQ ID NO: 2066291 - RNA, 17 nt, Staphylococcus aureus subsp. aureus Mu50
gccuucuaucucuuuag

SEQ ID NO: 2066292 - RNA, 21 nt, Staphylococcus aureus subsp. aureus Mu50
gccuucuauauaguaaaauaa

SEQ ID NO: 2066293 - RNA, 19 nt, Staphylococcus aureus subsp. aureus Mu50
gccuugauuuuuugaaaug

SEQ ID NO: 2066294 - RNA, 15 nt, Staphylococcus aureus subsp. aureus Mu50
gcgaaaguaucuaug

SEQ ID NO: 2066295 - RNA, 23 nt, Staphylococcus aureus subsp. aureus Mu50
gcgaaaacguugaguauuacuug

SEQ ID NO: 2066296 - RNA, 19 nt, Staphylococcus aureus subsp. aureus Mu50
gcgcaaaagcgcaggcgaa

SEQ ID NO: 2066297 - RNA, 15 nt, Staphylococcus aureus subsp. aureus Mu50
gcgcagcaaaugcuu

SEQ ID NO: 2066298 - RNA, 15 nt, Staphylococcus aureus subsp. aureus Mu50
gcgauacguuuauau

SEQ ID NO: 2066299 - RNA, 18 nt, Staphylococcus aureus subsp. aureus Mu50
gcgauacguuuauaucuu

SEQ ID NO: 2066300 - RNA, 23 nt, Staphylococcus aureus subsp. aureus Mu50
gcgcucuggauuuuucuuauaaa

SEQ ID NO: 2066301 - RNA, 21 nt, Staphylococcus aureus subsp. aureus Mu50
gcguucgugauagaaguuuuu

SEQ ID NO: 2066302 - RNA, 11 nt, Staphylococcus aureus subsp. aureus Mu50
gcuaaaaaaau

SEQ ID NO: 2066303 - RNA, 17 nt, Staphylococcus aureus subsp. aureus Mu50
gcgucugauucucuaac

SEQ ID NO: 2066304 - RNA, 19 nt, Staphylococcus aureus subsp. aureus Mu50
gcgugcuuaauuacaauau

SEQ ID NO: 2066305 - RNA, 15 nt, Staphylococcus aureus subsp. aureus Mu50
gcuacuauuaaauaa

SEQ ID NO: 2066306 - RNA, 17 nt, Staphylococcus aureus subsp. aureus Mu50
gcuaauuucuaauacau

SEQ ID NO: 2066307 - RNA, 20 nt, Staphylococcus aureus subsp. aureus Mu50
gcuaauuuuaauuuucagaa

SEQ ID NO: 2066308 - RNA, 14 nt, Staphylococcus aureus subsp. aureus Mu50
gcuacaauuauaaa

SEQ ID NO: 2066309 - RNA, 18 nt, Staphylococcus aureus subsp. aureus Mu50
gcuaauguguacuuaaaa

SEQ ID NO: 2066310 - RNA, 19 nt, Staphylococcus aureus subsp. aureus Mu50
gcuaaauuuacgaaaguag

SEQ ID NO: 2066311 - RNA, 18 nt, Staphylococcus aureus subsp. aureus Mu50
gcuaacauucagugcaau

SEQ ID NO: 2066312 - RNA, 16 nt, Staphylococcus aureus subsp. aureus Mu50
gcuaaaauaaaauuaa

SEQ ID NO: 2066313 - RNA, 18 nt, Staphylococcus aureus subsp. aureus Mu50
gcuaaacaaugaugggaa

SEQ ID NO: 2066314 - RNA, 11 nt, Staphylococcus aureus subsp. aureus Mu50
gcuaaaaauau

SEQ ID NO: 2066315 - RNA, 14 nt, Staphylococcus aureus subsp. aureus Mu50
gcuaaaaguauaaa

SEQ ID NO: 2066316 - RNA, 20 nt, Staphylococcus aureus subsp. aureus Mu50
gcuaaugcaacuaaaacuau

SEQ ID NO: 2066317 - RNA, 15 nt, Staphylococcus aureus subsp. aureus Mu50
gcuaaugauaaucca

SEQ ID NO: 2066318 - RNA, 16 nt, Staphylococcus aureus subsp. aureus Mu50
gcuaaucuauuuagcu

SEQ ID NO: 2066319 - RNA, 16 nt, Staphylococcus aureus subsp. aureus Mu50
gcucauaugucuguuc

SEQ ID NO: 2066320 - RNA, 16 nt, Staphylococcus aureus subsp. aureus Mu50
gcucauuacaaagucu

SEQ ID NO: 2066321 - RNA, 19 nt, Staphylococcus aureus subsp. aureus Mu50
gcucauccucauuaauaaa

SEQ ID NO: 2066322 - RNA, 15 nt, Staphylococcus aureus subsp. aureus Mu50
gcucauugugcuuga

SEQ ID NO: 2066323 - RNA, 18 nt, Staphylococcus aureus subsp. aureus Mu50
gcucauuucaauauuaaa

SEQ ID NO: 2066324 - RNA, 19 nt, Staphylococcus aureus subsp. aureus Mu50
gcuacuugaauaccuuuua

SEQ ID NO: 2066325 - RNA, 19 nt, Staphylococcus aureus subsp. aureus Mu50
gcuagucauaauuuaaaag

SEQ ID NO: 2066326 - RNA, 13 nt, Staphylococcus aureus subsp. aureus Mu50
gcguacauauaau

SEQ ID NO: 2066327 - RNA, 23 nt, Staphylococcus aureus subsp. aureus Mu50
gcguacuuggcucaaaacuuuua

SEQ ID NO: 2066328 - RNA, 23 nt, Staphylococcus aureus subsp. aureus Mu50
gcggucaauuuuaccauguuuua

SEQ ID NO: 2066329 - RNA, 17 nt, Staphylococcus aureus subsp. aureus Mu50
gccugcaagucguucuc

SEQ ID NO: 2066330 - RNA, 23 nt, Staphylococcus aureus subsp. aureus Mu50
gccuaauacacuugauaaaacua

SEQ ID NO: 2066331 - RNA, 16 nt, Staphylococcus aureus subsp. aureus Mu50
gccuauccauucaaau

SEQ ID NO: 2066332 - RNA, 13 nt, Staphylococcus aureus subsp. aureus Mu50
gccuauuuaaaag

SEQ ID NO: 2066333 - RNA, 12 nt, Staphylococcus aureus subsp. aureus Mu50
gccucguccauu

SEQ ID NO: 2066334 - RNA, 22 nt, Staphylococcus aureus subsp. aureus Mu50
gccgauaauuugagaaaugaaa

SEQ ID NO: 2066335 - RNA, 14 nt, Staphylococcus aureus subsp. aureus Mu50
gccaccaguuucaa

SEQ ID NO: 2066336 - RNA, 17 nt, Staphylococcus aureus subsp. aureus Mu50
gcauacgaauuaaaaua

SEQ ID NO: 2066337 - RNA, 18 nt, Staphylococcus aureus subsp. aureus Mu50
gcauacgaauuaaaauaa

SEQ ID NO: 2066338 - RNA, 18 nt, Staphylococcus aureus subsp. aureus Mu50
gcauacaggaaauugaag

SEQ ID NO: 2066339 - RNA, 13 nt, Staphylococcus aureus subsp. aureus Mu50
gccaugauuuaag

SEQ ID NO: 2066340 - RNA, 18 nt, Staphylococcus aureus subsp. aureus Mu50
gccauacccauauuaaau

SEQ ID NO: 2066341 - RNA, 22 nt, Staphylococcus aureus subsp. aureus Mu50
gccauagaaaugugcugugucu

SEQ ID NO: 2066342 - RNA, 16 nt, Staphylococcus aureus subsp. aureus Mu50
gccauaguaauaaugg

SEQ ID NO: 2066343 - RNA, 14 nt, Staphylococcus aureus subsp. aureus Mu50
gccauaaucuucau

SEQ ID NO: 2066344 - RNA, 17 nt, Staphylococcus aureus subsp. aureus Mu50
gccccaucuauuagaaa

SEQ ID NO: 2066345 - RNA, 13 nt, Staphylococcus aureus subsp. aureus Mu50
gccccaacaaaga

SEQ ID NO: 2066346 - RNA, 15 nt, Staphylococcus aureus subsp. aureus Mu50
gccccaacaaagaag

SEQ ID NO: 2066347 - RNA, 11 nt, Staphylococcus aureus subsp. aureus Mu50
gccccaacaca

SEQ ID NO: 2066348 - RNA, 15 nt, Staphylococcus aureus subsp. aureus Mu50
gccccaacacagaag

SEQ ID NO: 2066349 - RNA, 14 nt, Staphylococcus aureus subsp. aureus Mu50
gccccaacacagaa

SEQ ID NO: 2066350 - RNA, 14 nt, Staphylococcus aureus subsp. aureus Mu50
gccccaacacagag

SEQ ID NO: 2066351 - RNA, 15 nt, Staphylococcus aureus subsp. aureus Mu50
gccccaacacagaga

SEQ ID NO: 2066352 - RNA, 15 nt, Staphylococcus aureus subsp. aureus Mu50
gcccaucaucacugu

SEQ ID NO: 2066353 - RNA, 13 nt, Staphylococcus aureus subsp. aureus Mu50
gcccauaccacca

SEQ ID NO: 2066354 - RNA, 13 nt, Staphylococcus aureus subsp. aureus Mu50
gcaacauuaaauu

SEQ ID NO: 2066355 - RNA, 22 nt, Staphylococcus aureus subsp. aureus Mu50
gcaaaacgcauuucauguguca

SEQ ID NO: 2066356 - RNA, 15 nt, Staphylococcus aureus subsp. aureus Mu50
gcaauacuaacugaa

SEQ ID NO: 2066357 - RNA, 14 nt, Staphylococcus aureus subsp. aureus Mu50
gcaaucauaauacu

SEQ ID NO: 2066358 - RNA, 13 nt, Staphylococcus aureus subsp. aureus Mu50
gcaaguuggggau

SEQ ID NO: 2066359 - RNA, 12 nt, Staphylococcus aureus subsp. aureus Mu50
gcaaguugggga

SEQ ID NO: 2066360 - RNA, 18 nt, Staphylococcus aureus subsp. aureus Mu50
gcaacuaagaugacugaa

SEQ ID NO: 2066361 - RNA, 21 nt, Staphylococcus aureus subsp. aureus Mu50
gcaagaauagauugauuguau

SEQ ID NO: 2066362 - RNA, 13 nt, Staphylococcus aureus subsp. aureus Mu50
gcacaaaugaaug

SEQ ID NO: 2066363 - RNA, 17 nt, Staphylococcus aureus subsp. aureus Mu50
gcaaugcgaguuggggu

SEQ ID NO: 2066364 - RNA, 14 nt, Staphylococcus aureus subsp. aureus Mu50
gcaaugcauauugu

SEQ ID NO: 2066365 - RNA, 15 nt, Staphylococcus aureus subsp. aureus Mu50
gcaaugcaugcuucu

SEQ ID NO: 2066366 - RNA, 19 nt, Staphylococcus aureus subsp. aureus Mu50
gcacagcgauuaaaugaug

SEQ ID NO: 2066367 - RNA, 23 nt, Staphylococcus aureus subsp. aureus Mu50
gcaccgacaauuauaauaaaacu

SEQ ID NO: 2066368 - RNA, 16 nt, Staphylococcus aureus subsp. aureus Mu50
gcaccgacaauuauaa

SEQ ID NO: 2066369 - RNA, 15 nt, Staphylococcus aureus subsp. aureus Mu50
gcaccuccaaccgcu

SEQ ID NO: 2066370 - RNA, 18 nt, Staphylococcus aureus subsp. aureus Mu50
gcagggugcuaaauuuac

SEQ ID NO: 2066371 - RNA, 14 nt, Staphylococcus aureus subsp. aureus Mu50
gcauaagaaauacu

SEQ ID NO: 2066372 - RNA, 14 nt, Staphylococcus aureus subsp. aureus Mu50
gcaguugaaaaaga

SEQ ID NO: 2066373 - RNA, 15 nt, Staphylococcus aureus subsp. aureus Mu50
gcagcuaaaaaguau

SEQ ID NO: 2066374 - RNA, 15 nt, Staphylococcus aureus subsp. aureus Mu50
gcagcaaugacacua

SEQ ID NO: 2066375 - RNA, 22 nt, Staphylococcus aureus subsp. aureus Mu50
gcacgcgugccaacaucuucaa

SEQ ID NO: 2066376 - RNA, 14 nt, Staphylococcus aureus subsp. aureus Mu50
gcacuuuauuaaaa

SEQ ID NO: 2066377 - RNA, 15 nt, Staphylococcus aureus subsp. aureus Mu50
gcacuuuaacauaac

SEQ ID NO: 2066378 - RNA, 23 nt, Staphylococcus aureus subsp. aureus Mu50
gcagaagaaaacuauuuuaaaaa

SEQ ID NO: 2066379 - RNA, 15 nt, Staphylococcus aureus subsp. aureus Mu50
gcagagaauauagau

SEQ ID NO: 2066380 - RNA, 20 nt, Staphylococcus aureus subsp. aureus Mu50
gaguuguacuacuugauucu

SEQ ID NO: 2066381 - RNA, 19 nt, Staphylococcus aureus subsp. aureus Mu50
gaguguguccaucauuugu

SEQ ID NO: 2066382 - RNA, 21 nt, Staphylococcus aureus subsp. aureus Mu50
gaguggauacuauacuuaaaa

SEQ ID NO: 2066383 - RNA, 21 nt, Staphylococcus aureus subsp. aureus Mu50
gaguaguucggaugagaaaug

SEQ ID NO: 2066384 - RNA, 16 nt, Staphylococcus aureus subsp. aureus Mu50
gauaaauuaauaugaa

SEQ ID NO: 2066385 - RNA, 14 nt, Staphylococcus aureus subsp. aureus Mu50
gauaaaucaucauu

SEQ ID NO: 2066386 - RNA, 22 nt, Staphylococcus aureus subsp. aureus Mu50
gauaaauaugauguuaaaaaau

SEQ ID NO: 2066387 - RNA, 21 nt, Staphylococcus aureus subsp. aureus Mu50
gauaacagcuacaaauaauga

SEQ ID NO: 2066388 - RNA, 22 nt, Staphylococcus aureus subsp. aureus Mu50
gauaacaauuuuaaaucuuuua

SEQ ID NO: 2066389 - RNA, 21 nt, Staphylococcus aureus subsp. aureus Mu50
gauaacuguaacgugaggccc

SEQ ID NO: 2066390 - RNA, 13 nt, Staphylococcus aureus subsp. aureus Mu50
gauaagaaaauac

SEQ ID NO: 2066391 - RNA, 21 nt, Staphylococcus aureus subsp. aureus Mu50
gauaagaaucaucuaaaugca

SEQ ID NO: 2066392 - RNA, 21 nt, Staphylococcus aureus subsp. aureus Mu50
gaguaaugaccggcauauaau

SEQ ID NO: 2066393 - RNA, 15 nt, Staphylococcus aureus subsp. aureus Mu50
gauagaaguuuuuug

SEQ ID NO: 2066394 - RNA, 21 nt, Staphylococcus aureus subsp. aureus Mu50
gauagaaugucgauauuucua

SEQ ID NO: 2066395 - RNA, 20 nt, Staphylococcus aureus subsp. aureus Mu50
gauagaauacuaaaaguguu

SEQ ID NO: 2066396 - RNA, 21 nt, Staphylococcus aureus subsp. aureus Mu50
gauagaauacuaaaaguguua

SEQ ID NO: 2066397 - RNA, 14 nt, Staphylococcus aureus subsp. aureus Mu50
gauagaaaggcagg

SEQ ID NO: 2066398 - RNA, 20 nt, Staphylococcus aureus subsp. aureus Mu50
gauacuaaacgauaaauuaa

SEQ ID NO: 2066399 - RNA, 16 nt, Staphylococcus aureus subsp. aureus Mu50
gauacuaauaucuucu

SEQ ID NO: 2066400 - RNA, 17 nt, Staphylococcus aureus subsp. aureus Mu50
gauacuaauaucuucuu

SEQ ID NO: 2066401 - RNA, 20 nt, Staphylococcus aureus subsp. aureus Mu50
gauaccuaagcugauuaaaa

SEQ ID NO: 2066402 - RNA, 14 nt, Staphylococcus aureus subsp. aureus Mu50
gauaccuaaaauac

SEQ ID NO: 2066403 - RNA, 14 nt, Staphylococcus aureus subsp. aureus Mu50
gauauaaacauuua

SEQ ID NO: 2066404 - RNA, 16 nt, Staphylococcus aureus subsp. aureus Mu50
gauauaaugaaguuau

SEQ ID NO: 2066405 - RNA, 19 nt, Staphylococcus aureus subsp. aureus Mu50
gauauaagauucauauuua

SEQ ID NO: 2066406 - RNA, 18 nt, Staphylococcus aureus subsp. aureus Mu50
gauauagaauucacgcaa

SEQ ID NO: 2066407 - RNA, 20 nt, Staphylococcus aureus subsp. aureus Mu50
gauauagaccguugaaaugu

SEQ ID NO: 2066408 - RNA, 17 nt, Staphylococcus aureus subsp. aureus Mu50
gauauaaugaaguuaug

SEQ ID NO: 2066409 - RNA, 15 nt, Staphylococcus aureus subsp. aureus Mu50
gauauagaaaaggga

SEQ ID NO: 2066410 - RNA, 14 nt, Staphylococcus aureus subsp. aureus Mu50
gauagcuaaacauu

SEQ ID NO: 2066411 - RNA, 14 nt, Staphylococcus aureus subsp. aureus Mu50
gauagccuuuucua

SEQ ID NO: 2066412 - RNA, 22 nt, Staphylococcus aureus subsp. aureus Mu50
gauaggauuuacaccuauaccu

SEQ ID NO: 2066413 - RNA, 21 nt, Staphylococcus aureus subsp. aureus Mu50
gaucacuuacugugaaaauac

SEQ ID NO: 2066414 - RNA, 14 nt, Staphylococcus aureus subsp. aureus Mu50
gaucaucguauaga

SEQ ID NO: 2066415 - RNA, 13 nt, Staphylococcus aureus subsp. aureus Mu50
gaucaugccuuca

SEQ ID NO: 2066416 - RNA, 17 nt, Staphylococcus aureus subsp. aureus Mu50
gaucaugccuucaugaa

SEQ ID NO: 2066417 - RNA, 20 nt, Staphylococcus aureus subsp. aureus Mu50
gauauugaccaccuguaucu

SEQ ID NO: 2066418 - RNA, 18 nt, Staphylococcus aureus subsp. aureus Mu50
gauauuucuaaauugucg

SEQ ID NO: 2066419 - RNA, 15 nt, Staphylococcus aureus subsp. aureus Mu50
gauauuuccaaauug

SEQ ID NO: 2066420 - RNA, 13 nt, Staphylococcus aureus subsp. aureus Mu50
gauauuugaucgu

SEQ ID NO: 2066421 - RNA, 21 nt, Staphylococcus aureus subsp. aureus Mu50
gauauuauaaaaacagcagug

SEQ ID NO: 2066422 - RNA, 23 nt, Staphylococcus aureus subsp. aureus Mu50
gauauauaacuauggucaucaau

SEQ ID NO: 2066423 - RNA, 22 nt, Staphylococcus aureus subsp. aureus Mu50
gauauagugcuuguuuauuaca

SEQ ID NO: 2066424 - RNA, 20 nt, Staphylococcus aureus subsp. aureus Mu50
gauauagauggcuuuuuuug

SEQ ID NO: 2066425 - RNA, 18 nt, Staphylococcus aureus subsp. aureus Mu50
gaucuucccaucuuuuag

SEQ ID NO: 2066426 - RNA, 18 nt, Staphylococcus aureus subsp. aureus Mu50
gaucuucaugaacagcau

SEQ ID NO: 2066427 - RNA, 12 nt, Staphylococcus aureus subsp. aureus Mu50
gaugaaaaagau

SEQ ID NO: 2066428 - RNA, 21 nt, Staphylococcus aureus subsp. aureus Mu50
gaugaaauuguguugaaucaa

SEQ ID NO: 2066429 - RNA, 23 nt, Staphylococcus aureus subsp. aureus Mu50
gaugaacaaaauaacauguuugu

SEQ ID NO: 2066430 - RNA, 19 nt, Staphylococcus aureus subsp. aureus Mu50
gaugaacauaccugcauau

SEQ ID NO: 2066431 - RNA, 14 nt, Staphylococcus aureus subsp. aureus Mu50
gaugaaaauauagu

SEQ ID NO: 2066432 - RNA, 18 nt, Staphylococcus aureus subsp. aureus Mu50
gaugaaauauucuuuaau

SEQ ID NO: 2066433 - RNA, 21 nt, Staphylococcus aureus subsp. aureus Mu50
gaugaaagacugacuaauaaa

SEQ ID NO: 2066434 - RNA, 21 nt, Staphylococcus aureus subsp. aureus Mu50
gaugaacuuaaugcuucaaau

SEQ ID NO: 2066435 - RNA, 18 nt, Staphylococcus aureus subsp. aureus Mu50
gaugaacuuaaugcuuca

SEQ ID NO: 2066436 - RNA, 13 nt, Staphylococcus aureus subsp. aureus Mu50
gaugauucuuauc

SEQ ID NO: 2066437 - RNA, 14 nt, Staphylococcus aureus subsp. aureus Mu50
gaugauucuuauca

SEQ ID NO: 2066438 - RNA, 16 nt, Staphylococcus aureus subsp. aureus Mu50
gaugcucguauagaaa

SEQ ID NO: 2066439 - RNA, 14 nt, Staphylococcus aureus subsp. aureus Mu50
gaugcgcuucuaac

SEQ ID NO: 2066440 - RNA, 22 nt, Staphylococcus aureus subsp. aureus Mu50
gauucuaacggcguuuguuucu

SEQ ID NO: 2066441 - RNA, 16 nt, Staphylococcus aureus subsp. aureus Mu50
gauucuacagcacuga

SEQ ID NO: 2066442 - RNA, 13 nt, Staphylococcus aureus subsp. aureus Mu50
gauucuacagcau

SEQ ID NO: 2066443 - RNA, 21 nt, Staphylococcus aureus subsp. aureus Mu50
gauugcaaauuaucauuaaau

SEQ ID NO: 2066444 - RNA, 20 nt, Staphylococcus aureus subsp. aureus Mu50
gauucgauuauuuagauaaa

SEQ ID NO: 2066445 - RNA, 16 nt, Staphylococcus aureus subsp. aureus Mu50
gauuuagcauacauua

SEQ ID NO: 2066446 - RNA, 21 nt, Staphylococcus aureus subsp. aureus Mu50
gauuuaauugaaauagaaacu

SEQ ID NO: 2066447 - RNA, 13 nt, Staphylococcus aureus subsp. aureus Mu50
gauuguaccagua

SEQ ID NO: 2066448 - RNA, 14 nt, Staphylococcus aureus subsp. aureus Mu50
gauugguaaaucua

SEQ ID NO: 2066449 - RNA, 19 nt, Staphylococcus aureus subsp. aureus Mu50
gauuggcugugcuauaauc

SEQ ID NO: 2066450 - RNA, 21 nt, Staphylococcus aureus subsp. aureus Mu50
gauuggcuugaaguuguuucu

SEQ ID NO: 2066451 - RNA, 17 nt, Staphylococcus aureus subsp. aureus Mu50
gauuucuaucaaauaau

SEQ ID NO: 2066452 - RNA, 20 nt, Staphylococcus aureus subsp. aureus Mu50
gauuucuaguuuaucuucag

SEQ ID NO: 2066453 - RNA, 15 nt, Staphylococcus aureus subsp. aureus Mu50
gauuuccucgguuuu

SEQ ID NO: 2066454 - RNA, 15 nt, Staphylococcus aureus subsp. aureus Mu50
gauuuuuugguuucu

SEQ ID NO: 2066455 - RNA, 12 nt, Staphylococcus aureus subsp. aureus Mu50
gcaaaacaauau

SEQ ID NO: 2066456 - RNA, 20 nt, Staphylococcus aureus subsp. aureus Mu50
gauuuucuuuaauaacuaaa

SEQ ID NO: 2066457 - RNA, 22 nt, Staphylococcus aureus subsp. aureus Mu50
gauuuugcugccaaaaaguauu

SEQ ID NO: 2066458 - RNA, 10 nt, Staphylococcus aureus subsp. aureus Mu50
gauuuugcuu

SEQ ID NO: 2066459 - RNA, 22 nt, Staphylococcus aureus subsp. aureus Mu50
gauuuucgagugugucaacuua

SEQ ID NO: 2066460 - RNA, 17 nt, Staphylococcus aureus subsp. aureus Mu50
gauuuuaaagaaaaguu

SEQ ID NO: 2066461 - RNA, 19 nt, Staphylococcus aureus subsp. aureus Mu50
gauucauuuaaaaaucaaa

SEQ ID NO: 2066462 - RNA, 16 nt, Staphylococcus aureus subsp. aureus Mu50
gauuauagguauaaga

SEQ ID NO: 2066463 - RNA, 22 nt, Staphylococcus aureus subsp. aureus Mu50
gauuaguaauuuuuaaaucuac

SEQ ID NO: 2066464 - RNA, 16 nt, Staphylococcus aureus subsp. aureus Mu50
gauucauaaaauuuaa

SEQ ID NO: 2066465 - RNA, 14 nt, Staphylococcus aureus subsp. aureus Mu50
gauucaaaugacau

SEQ ID NO: 2066466 - RNA, 15 nt, Staphylococcus aureus subsp. aureus Mu50
gauucaccagguuuu

SEQ ID NO: 2066467 - RNA, 16 nt, Staphylococcus aureus subsp. aureus Mu50
gaugggagaaauuuuu

SEQ ID NO: 2066468 - RNA, 16 nt, Staphylococcus aureus subsp. aureus Mu50
gaugucuguacuuuua

SEQ ID NO: 2066469 - RNA, 23 nt, Staphylococcus aureus subsp. aureus Mu50
gauuaauuuuaucuuauuauuaa

SEQ ID NO: 2066470 - RNA, 22 nt, Staphylococcus aureus subsp. aureus Mu50
gauuaauccuacacggacugca

SEQ ID NO: 2066471 - RNA, 17 nt, Staphylococcus aureus subsp. aureus Mu50
gauuacagcguaacuaa

SEQ ID NO: 2066472 - RNA, 18 nt, Staphylococcus aureus subsp. aureus Mu50
gauuacagaugaugcuuc

SEQ ID NO: 2066473 - RNA, 14 nt, Staphylococcus aureus subsp. aureus Mu50
gauuagaugauauu

SEQ ID NO: 2066474 - RNA, 15 nt, Staphylococcus aureus subsp. aureus Mu50
gauguucaucaacau

SEQ ID NO: 2066475 - RNA, 13 nt, Staphylococcus aureus subsp. aureus Mu50
gauguguugaaac

SEQ ID NO: 2066476 - RNA, 22 nt, Staphylococcus aureus subsp. aureus Mu50
gagccauuauuauuuuuuucuu

SEQ ID NO: 2066477 - RNA, 21 nt, Staphylococcus aureus subsp. aureus Mu50
gagcauuuuuauauccaucuc

SEQ ID NO: 2066478 - RNA, 16 nt, Staphylococcus aureus subsp. aureus Mu50
gagaugaaagauacug

SEQ ID NO: 2066479 - RNA, 14 nt, Staphylococcus aureus subsp. aureus Mu50
gagauugagaauuc

SEQ ID NO: 2066480 - RNA, 18 nt, Staphylococcus aureus subsp. aureus Mu50
gagauucucgguuuuuuc

SEQ ID NO: 2066481 - RNA, 21 nt, Staphylococcus aureus subsp. aureus Mu50
gagauuauuuuuuuaaaucua

SEQ ID NO: 2066482 - RNA, 16 nt, Staphylococcus aureus subsp. aureus Mu50
gagcaacgauaccaaa

SEQ ID NO: 2066483 - RNA, 19 nt, Staphylococcus aureus subsp. aureus Mu50
gagcaagucuucuaaaaaa

SEQ ID NO: 2066484 - RNA, 15 nt, Staphylococcus aureus subsp. aureus Mu50
gagcaauucuucaau

SEQ ID NO: 2066485 - RNA, 19 nt, Staphylococcus aureus subsp. aureus Mu50
gagcaauucuucaauuuca

SEQ ID NO: 2066486 - RNA, 19 nt, Staphylococcus aureus subsp. aureus Mu50
gagcacuaucuuuugcuuc

SEQ ID NO: 2066487 - RNA, 17 nt, Staphylococcus aureus subsp. aureus Mu50
gagcuuuucuaaugcua

SEQ ID NO: 2066488 - RNA, 14 nt, Staphylococcus aureus subsp. aureus Mu50
gagcuuuaauuuuu

SEQ ID NO: 2066489 - RNA, 15 nt, Staphylococcus aureus subsp. aureus Mu50
gaggauauuuauucu

SEQ ID NO: 2066490 - RNA, 21 nt, Staphylococcus aureus subsp. aureus Mu50
gaggauaauuauuaggggaga

SEQ ID NO: 2066491 - RNA, 19 nt, Staphylococcus aureus subsp. aureus Mu50
gaggauacauaaaucuaau

SEQ ID NO: 2066492 - RNA, 17 nt, Staphylococcus aureus subsp. aureus Mu50
gaggcgccacaacaugu

SEQ ID NO: 2066493 - RNA, 15 nt, Staphylococcus aureus subsp. aureus Mu50
gagcggaaauaugau

SEQ ID NO: 2066494 - RNA, 20 nt, Staphylococcus aureus subsp. aureus Mu50
gagcgaccgugguucaaaaa

SEQ ID NO: 2066495 - RNA, 14 nt, Staphylococcus aureus subsp. aureus Mu50
gagcggaagauagg

SEQ ID NO: 2066496 - RNA, 15 nt, Staphylococcus aureus subsp. aureus Mu50
gagcggaagauagga

SEQ ID NO: 2066497 - RNA, 20 nt, Staphylococcus aureus subsp. aureus Mu50
gacgguauaaaaaaauuaac

SEQ ID NO: 2066498 - RNA, 17 nt, Staphylococcus aureus subsp. aureus Mu50
gacgugucauuggugga

SEQ ID NO: 2066499 - RNA, 15 nt, Staphylococcus aureus subsp. aureus Mu50
gacguucauggauuc

SEQ ID NO: 2066500 - RNA, 17 nt, Staphylococcus aureus subsp. aureus Mu50
gacguugugucaugcug

SEQ ID NO: 2066501 - RNA, 13 nt, Staphylococcus aureus subsp. aureus Mu50
gacuaaccacauu

SEQ ID NO: 2066502 - RNA, 16 nt, Staphylococcus aureus subsp. aureus Mu50
gacguuuuuuuauaaa

SEQ ID NO: 2066503 - RNA, 19 nt, Staphylococcus aureus subsp. aureus Mu50
gacuaaaaugaaugaagac

SEQ ID NO: 2066504 - RNA, 14 nt, Staphylococcus aureus subsp. aureus Mu50
gacucaagugaauc

SEQ ID NO: 2066505 - RNA, 20 nt, Staphylococcus aureus subsp. aureus Mu50
gacuauuuuugaaaagagcg

SEQ ID NO: 2066506 - RNA, 20 nt, Staphylococcus aureus subsp. aureus Mu50
gacuaguguaccuuguuuca

SEQ ID NO: 2066507 - RNA, 20 nt, Staphylococcus aureus subsp. aureus Mu50
gacuauaacaccaauuaaau

SEQ ID NO: 2066508 - RNA, 11 nt, Staphylococcus aureus subsp. aureus Mu50
gacuacucaau

SEQ ID NO: 2066509 - RNA, 11 nt, Staphylococcus aureus subsp. aureus Mu50
gacuaauuuau

SEQ ID NO: 2066510 - RNA, 14 nt, Staphylococcus aureus subsp. aureus Mu50
gacucacuucuuaa

SEQ ID NO: 2066511 - RNA, 18 nt, Staphylococcus aureus subsp. aureus Mu50
gacugccaauaaaaugca

SEQ ID NO: 2066512 - RNA, 11 nt, Staphylococcus aureus subsp. aureus Mu50
gacugaaagaa

SEQ ID NO: 2066513 - RNA, 21 nt, Staphylococcus aureus subsp. aureus Mu50
gacugaaugagaaugugcuug

SEQ ID NO: 2066514 - RNA, 15 nt, Staphylococcus aureus subsp. aureus Mu50
gagacaauaaugcac

SEQ ID NO: 2066515 - RNA, 15 nt, Staphylococcus aureus subsp. aureus Mu50
gagacaaguauacuu

SEQ ID NO: 2066516 - RNA, 14 nt, Staphylococcus aureus subsp. aureus Mu50
gagaauuuuaauua

SEQ ID NO: 2066517 - RNA, 12 nt, Staphylococcus aureus subsp. aureus Mu50
gagaaucuccau

SEQ ID NO: 2066518 - RNA, 14 nt, Staphylococcus aureus subsp. aureus Mu50
gagaaucuccauuu

SEQ ID NO: 2066519 - RNA, 19 nt, Staphylococcus aureus subsp. aureus Mu50
gagaauuucgaaaagaaau

SEQ ID NO: 2066520 - RNA, 22 nt, Staphylococcus aureus subsp. aureus Mu50
gagagauuauuuaaaacuugua

SEQ ID NO: 2066521 - RNA, 16 nt, Staphylococcus aureus subsp. aureus Mu50
gagaguaauguuccau

SEQ ID NO: 2066522 - RNA, 15 nt, Staphylococcus aureus subsp. aureus Mu50
gagacuguuuuuuug

SEQ ID NO: 2066523 - RNA, 23 nt, Staphylococcus aureus subsp. aureus Mu50
gagaaauuuuucacuucaaacaa

SEQ ID NO: 2066524 - RNA, 13 nt, Staphylococcus aureus subsp. aureus Mu50
gagaaauuagaac

SEQ ID NO: 2066525 - RNA, 16 nt, Staphylococcus aureus subsp. aureus Mu50
gacuuucuugaugaau

SEQ ID NO: 2066526 - RNA, 17 nt, Staphylococcus aureus subsp. aureus Mu50
gacuuuuagauuaucuu

SEQ ID NO: 2066527 - RNA, 21 nt, Staphylococcus aureus subsp. aureus Mu50
gacuuuuagauuaucuuucaa

SEQ ID NO: 2066528 - RNA, 18 nt, Staphylococcus aureus subsp. aureus Mu50
gacuuuaaaucuuguucu

SEQ ID NO: 2066529 - RNA, 15 nt, Staphylococcus aureus subsp. aureus Mu50
gacuuggugcccaag

SEQ ID NO: 2066530 - RNA, 16 nt, Staphylococcus aureus subsp. aureus Mu50
gacuuggugcccaagu

SEQ ID NO: 2066531 - RNA, 22 nt, Staphylococcus aureus subsp. aureus Mu50
gacuugugcgcgacguuuaaau

SEQ ID NO: 2066532 - RNA, 14 nt, Staphylococcus aureus subsp. aureus Mu50
gacuguagaaaaca

SEQ ID NO: 2066533 - RNA, 23 nt, Staphylococcus aureus subsp. aureus Mu50
gacuguuuuuuuguuugguguga

SEQ ID NO: 2066534 - RNA, 16 nt, Staphylococcus aureus subsp. aureus Mu50
gacuucgauaucaaug

SEQ ID NO: 2066535 - RNA, 18 nt, Staphylococcus aureus subsp. aureus Mu50
gacuuauuugaaugcaaa

SEQ ID NO: 2066536 - RNA, 14 nt, Staphylococcus aureus subsp. aureus Mu50
gacuuauuuuucau

SEQ ID NO: 2066537 - RNA, 20 nt, Staphylococcus aureus subsp. aureus Mu50
gacuuauuuuucaucauuua

SEQ ID NO: 2066538 - RNA, 16 nt, Staphylococcus aureus subsp. aureus Mu50
gacuuaucguaagcuu

SEQ ID NO: 2066539 - RNA, 14 nt, Staphylococcus aureus subsp. aureus Mu50
gacuucuuuauauu

SEQ ID NO: 2066540 - RNA, 19 nt, Staphylococcus aureus subsp. aureus Mu50
gacuucuuucaauuaaucg

SEQ ID NO: 2066541 - RNA, 18 nt, Staphylococcus aureus subsp. aureus Mu50
gacuucuaucuucacacu

SEQ ID NO: 2066542 - RNA, 23 nt, Staphylococcus aureus subsp. aureus Mu50
gacauaaaauuaacuuaaaauuu

SEQ ID NO: 2066543 - RNA, 16 nt, Staphylococcus aureus subsp. aureus Mu50
gacauaaaacuuacau

SEQ ID NO: 2066544 - RNA, 11 nt, Staphylococcus aureus subsp. aureus Mu50
gacaguuuuua

SEQ ID NO: 2066545 - RNA, 22 nt, Staphylococcus aureus subsp. aureus Mu50
gacauacuugucguauucuuca

SEQ ID NO: 2066546 - RNA, 22 nt, Staphylococcus aureus subsp. aureus Mu50
gacaucgucuucuuuuuguccc

SEQ ID NO: 2066547 - RNA, 12 nt, Staphylococcus aureus subsp. aureus Mu50
gacaucuagaug

SEQ ID NO: 2066548 - RNA, 19 nt, Staphylococcus aureus subsp. aureus Mu50
gacauuuaauacuuuucuc

SEQ ID NO: 2066549 - RNA, 16 nt, Staphylococcus aureus subsp. aureus Mu50
gacauuuguaaauauu

SEQ ID NO: 2066550 - RNA, 15 nt, Staphylococcus aureus subsp. aureus Mu50
gacauuuguaaauau

SEQ ID NO: 2066551 - RNA, 15 nt, Staphylococcus aureus subsp. aureus Mu50
gacauuucaucaaua

SEQ ID NO: 2066552 - RNA, 14 nt, Staphylococcus aureus subsp. aureus Mu50
gaccaauagcaauu

SEQ ID NO: 2066553 - RNA, 15 nt, Staphylococcus aureus subsp. aureus Mu50
gacauuuuuggcuua

SEQ ID NO: 2066554 - RNA, 21 nt, Staphylococcus aureus subsp. aureus Mu50
gaccacucaauucucuaacuu

SEQ ID NO: 2066555 - RNA, 17 nt, Staphylococcus aureus subsp. aureus Mu50
gaccaccuuuaucugua

SEQ ID NO: 2066556 - RNA, 12 nt, Staphylococcus aureus subsp. aureus Mu50
gaauuuuauaaa

SEQ ID NO: 2066557 - RNA, 13 nt, Staphylococcus aureus subsp. aureus Mu50
gaauuuuaauaua

SEQ ID NO: 2066558 - RNA, 20 nt, Staphylococcus aureus subsp. aureus Mu50
cuuuguaaccuaaaaacaaa

SEQ ID NO: 2066559 - RNA, 15 nt, Staphylococcus aureus subsp. aureus Mu50
gacaaaacuuguaau

SEQ ID NO: 2066560 - RNA, 18 nt, Staphylococcus aureus subsp. aureus Mu50
gaauuuuucaaagcgauc

SEQ ID NO: 2066561 - RNA, 18 nt, Staphylococcus aureus subsp. aureus Mu50
gacaaauguucuauagaa

SEQ ID NO: 2066562 - RNA, 12 nt, Staphylococcus aureus subsp. aureus Mu50
gacaauuauaau

SEQ ID NO: 2066563 - RNA, 14 nt, Staphylococcus aureus subsp. aureus Mu50
gacaauuauaauaa

SEQ ID NO: 2066564 - RNA, 20 nt, Staphylococcus aureus subsp. aureus Mu50
gacaaucgcuugcuucuuuc

SEQ ID NO: 2066565 - RNA, 22 nt, Staphylococcus aureus subsp. aureus Mu50
gacagcaguaggauaauuucaa

SEQ ID NO: 2066566 - RNA, 23 nt, Staphylococcus aureus subsp. aureus Mu50
gacacgcccgacaucauaaauga

SEQ ID NO: 2066567 - RNA, 18 nt, Staphylococcus aureus subsp. aureus Mu50
gacaccaacauauuuuaa

SEQ ID NO: 2066568 - RNA, 19 nt, Staphylococcus aureus subsp. aureus Mu50
gacacauuuacuuaagaac

SEQ ID NO: 2066569 - RNA, 18 nt, Staphylococcus aureus subsp. aureus Mu50
gacgaucuuuaaugauaa

SEQ ID NO: 2066570 - RNA, 21 nt, Staphylococcus aureus subsp. aureus Mu50
gacgaucuucaugaacagcau

SEQ ID NO: 2066571 - RNA, 21 nt, Staphylococcus aureus subsp. aureus Mu50
gacgauaccuuuaauaauauu

SEQ ID NO: 2066572 - RNA, 20 nt, Staphylococcus aureus subsp. aureus Mu50
gacgauuuauuaguuuuuac

SEQ ID NO: 2066573 - RNA, 19 nt, Staphylococcus aureus subsp. aureus Mu50
gacgaaacacacuaaaagc

SEQ ID NO: 2066574 - RNA, 23 nt, Staphylococcus aureus subsp. aureus Mu50
gaccuuaucugaccaguauacga

SEQ ID NO: 2066575 - RNA, 20 nt, Staphylococcus aureus subsp. aureus Mu50
gaccuucaauaucuucagcu

SEQ ID NO: 2066576 - RNA, 19 nt, Staphylococcus aureus subsp. aureus Mu50
gaccauugucaugccuuca

SEQ ID NO: 2066577 - RNA, 23 nt, Staphylococcus aureus subsp. aureus Mu50
gacccuugucaguuuuuuuauaa

SEQ ID NO: 2066578 - RNA, 15 nt, Staphylococcus aureus subsp. aureus Mu50
gaccuacuuuuucaa

SEQ ID NO: 2066579 - RNA, 20 nt, Staphylococcus aureus subsp. aureus Mu50
cguuaucuuuaaguaauuca

SEQ ID NO: 2066580 - RNA, 13 nt, Staphylococcus aureus subsp. aureus Mu50
cguucauauauuu

SEQ ID NO: 2066581 - RNA, 14 nt, Staphylococcus aureus subsp. aureus Mu50
cguucauauauuuu

SEQ ID NO: 2066582 - RNA, 21 nt, Staphylococcus aureus subsp. aureus Mu50
cguugaauuaacaauauuaaa

SEQ ID NO: 2066583 - RNA, 15 nt, Staphylococcus aureus subsp. aureus Mu50
cguugaccuuguucu

SEQ ID NO: 2066584 - RNA, 16 nt, Staphylococcus aureus subsp. aureus Mu50
cguugaccuuguucuu

SEQ ID NO: 2066585 - RNA, 15 nt, Staphylococcus aureus subsp. aureus Mu50
cuaaaauaucaaaau

SEQ ID NO: 2066586 - RNA, 18 nt, Staphylococcus aureus subsp. aureus Mu50
cuaaaauaucaaaauaua

SEQ ID NO: 2066587 - RNA, 15 nt, Staphylococcus aureus subsp. aureus Mu50
cuaaaaugucuuuga

SEQ ID NO: 2066588 - RNA, 18 nt, Staphylococcus aureus subsp. aureus Mu50
cuaaaaguuguaauuuaa

SEQ ID NO: 2066589 - RNA, 17 nt, Staphylococcus aureus subsp. aureus Mu50
cuaaaaguuucccaagc

SEQ ID NO: 2066590 - RNA, 18 nt, Staphylococcus aureus subsp. aureus Mu50
cuaaaauacccauuuuuu

SEQ ID NO: 2066591 - RNA, 13 nt, Staphylococcus aureus subsp. aureus Mu50
cuaaaauaaaauu

SEQ ID NO: 2066592 - RNA, 19 nt, Staphylococcus aureus subsp. aureus Mu50
cuaaacauugcuuaacuuc

SEQ ID NO: 2066593 - RNA, 16 nt, Staphylococcus aureus subsp. aureus Mu50
cuaaaauucuuucagc

SEQ ID NO: 2066594 - RNA, 18 nt, Staphylococcus aureus subsp. aureus Mu50
cuaaacaaugaugggaaa

SEQ ID NO: 2066595 - RNA, 13 nt, Staphylococcus aureus subsp. aureus Mu50
cuaaagguaacuu

SEQ ID NO: 2066596 - RNA, 18 nt, Staphylococcus aureus subsp. aureus Mu50
cuaaagguauucuauuuu

SEQ ID NO: 2066597 - RNA, 19 nt, Staphylococcus aureus subsp. aureus Mu50
cuaaagguauucuauuuuu

SEQ ID NO: 2066598 - RNA, 13 nt, Staphylococcus aureus subsp. aureus Mu50
cuaaaguaaauaa

SEQ ID NO: 2066599 - RNA, 15 nt, Staphylococcus aureus subsp. aureus Mu50
cuaaaguaaauaaca

SEQ ID NO: 2066600 - RNA, 17 nt, Staphylococcus aureus subsp. aureus Mu50
cuaaagucgucucaaua

SEQ ID NO: 2066601 - RNA, 16 nt, Staphylococcus aureus subsp. aureus Mu50
cuaaauaaaauuaaaa

SEQ ID NO: 2066602 - RNA, 14 nt, Staphylococcus aureus subsp. aureus Mu50
cuaaauaaaauuaa

SEQ ID NO: 2066603 - RNA, 22 nt, Staphylococcus aureus subsp. aureus Mu50
cuaaauaaaauuaaaacagcaa

SEQ ID NO: 2066604 - RNA, 23 nt, Staphylococcus aureus subsp. aureus Mu50
cuaaagcuugcuguucaacaucu

SEQ ID NO: 2066605 - RNA, 14 nt, Staphylococcus aureus subsp. aureus Mu50
cuaaagcuaaugca

SEQ ID NO: 2066606 - RNA, 20 nt, Staphylococcus aureus subsp. aureus Mu50
cuaaacucguugcacucuuu

SEQ ID NO: 2066607 - RNA, 14 nt, Staphylococcus aureus subsp. aureus Mu50
cguuuuuaaauaau

SEQ ID NO: 2066608 - RNA, 16 nt, Staphylococcus aureus subsp. aureus Mu50
cguuuuccaugaguuu

SEQ ID NO: 2066609 - RNA, 12 nt, Staphylococcus aureus subsp. aureus Mu50
cguuuuccauga

SEQ ID NO: 2066610 - RNA, 19 nt, Staphylococcus aureus subsp. aureus Mu50
cguuucuuuguauaccuau

SEQ ID NO: 2066611 - RNA, 13 nt, Staphylococcus aureus subsp. aureus Mu50
cguuugauuucac

SEQ ID NO: 2066612 - RNA, 14 nt, Staphylococcus aureus subsp. aureus Mu50
cguuuuauauuuau

SEQ ID NO: 2066613 - RNA, 21 nt, Staphylococcus aureus subsp. aureus Mu50
cguuucagaaguuguuuagaa

SEQ ID NO: 2066614 - RNA, 23 nt, Staphylococcus aureus subsp. aureus Mu50
cguuguucauaaucauaauaaga

SEQ ID NO: 2066615 - RNA, 15 nt, Staphylococcus aureus subsp. aureus Mu50
cuaaggacuuuaugc

SEQ ID NO: 2066616 - RNA, 14 nt, Staphylococcus aureus subsp. aureus Mu50
cuaaggcuaaugau

SEQ ID NO: 2066617 - RNA, 15 nt, Staphylococcus aureus subsp. aureus Mu50
cuaaggcuaaugaua

SEQ ID NO: 2066618 - RNA, 22 nt, Staphylococcus aureus subsp. aureus Mu50
cuaagguaagaccccgaaaaga

SEQ ID NO: 2066619 - RNA, 14 nt, Staphylococcus aureus subsp. aureus Mu50
cuaauaauaaaaua

SEQ ID NO: 2066620 - RNA, 13 nt, Staphylococcus aureus subsp. aureus Mu50
cuaacguuuuaaa

SEQ ID NO: 2066621 - RNA, 15 nt, Staphylococcus aureus subsp. aureus Mu50
cuaaauauuaaauua

SEQ ID NO: 2066622 - RNA, 23 nt, Staphylococcus aureus subsp. aureus Mu50
cuaaauaguuuuucauauucaca

SEQ ID NO: 2066623 - RNA, 17 nt, Staphylococcus aureus subsp. aureus Mu50
cuaagaguugaaauacu

SEQ ID NO: 2066624 - RNA, 17 nt, Staphylococcus aureus subsp. aureus Mu50
cuaagauacuuuuaaau

SEQ ID NO: 2066625 - RNA, 12 nt, Staphylococcus aureus subsp. aureus Mu50
cuaacuauauug

SEQ ID NO: 2066626 - RNA, 14 nt, Staphylococcus aureus subsp. aureus Mu50
cuaacucaccugca

SEQ ID NO: 2066627 - RNA, 18 nt, Staphylococcus aureus subsp. aureus Mu50
cuaacuaaguauaguguu

SEQ ID NO: 2066628 - RNA, 15 nt, Staphylococcus aureus subsp. aureus Mu50
cuaauauuuuaaacg

SEQ ID NO: 2066629 - RNA, 16 nt, Staphylococcus aureus subsp. aureus Mu50
cuaauauuuuaaacgu

SEQ ID NO: 2066630 - RNA, 15 nt, Staphylococcus aureus subsp. aureus Mu50
cuaauaucaauuuuu

SEQ ID NO: 2066631 - RNA, 19 nt, Staphylococcus aureus subsp. aureus Mu50
cuaauaauuuguaauuccu

SEQ ID NO: 2066632 - RNA, 22 nt, Staphylococcus aureus subsp. aureus Mu50
cuaauaucaucuuguuguucug

SEQ ID NO: 2066633 - RNA, 17 nt, Staphylococcus aureus subsp. aureus Mu50
cuaaucuuuuuuuaauu

SEQ ID NO: 2066634 - RNA, 18 nt, Staphylococcus aureus subsp. aureus Mu50
cuaaucuuuuuuuaauua

SEQ ID NO: 2066635 - RNA, 18 nt, Staphylococcus aureus subsp. aureus Mu50
cuaaucuuaguuaaaauu

SEQ ID NO: 2066636 - RNA, 22 nt, Staphylococcus aureus subsp. aureus Mu50
cuaaucguguauuauugaaacu

SEQ ID NO: 2066637 - RNA, 11 nt, Staphylococcus aureus subsp. aureus Mu50
cuaaucuauuu

SEQ ID NO: 2066638 - RNA, 13 nt, Staphylococcus aureus subsp. aureus Mu50
cuaaucuaaauuc

SEQ ID NO: 2066639 - RNA, 16 nt, Staphylococcus aureus subsp. aureus Mu50
cuaaucuauuuagcuu

SEQ ID NO: 2066640 - RNA, 14 nt, Staphylococcus aureus subsp. aureus Mu50
cuaauucgccaucu

SEQ ID NO: 2066641 - RNA, 15 nt, Staphylococcus aureus subsp. aureus Mu50
cuaauucaauaccua

SEQ ID NO: 2066642 - RNA, 22 nt, Staphylococcus aureus subsp. aureus Mu50
cuaauuagguauaguguuugac

SEQ ID NO: 2066643 - RNA, 14 nt, Staphylococcus aureus subsp. aureus Mu50
cuaauucugaaauc

SEQ ID NO: 2066644 - RNA, 18 nt, Staphylococcus aureus subsp. aureus Mu50
cuaaugauuaaaaaucaa

SEQ ID NO: 2066645 - RNA, 22 nt, Staphylococcus aureus subsp. aureus Mu50
cuaaugauuaaaaaucaaagag

SEQ ID NO: 2066646 - RNA, 14 nt, Staphylococcus aureus subsp. aureus Mu50
cuaaugauuuauua

SEQ ID NO: 2066647 - RNA, 19 nt, Staphylococcus aureus subsp. aureus Mu50
cuaaugcacgugagaaacu

SEQ ID NO: 2066648 - RNA, 18 nt, Staphylococcus aureus subsp. aureus Mu50
cuaaugcuaauuuaacug

SEQ ID NO: 2066649 - RNA, 18 nt, Staphylococcus aureus subsp. aureus Mu50
cuaaugucgcacuauaaa

SEQ ID NO: 2066650 - RNA, 20 nt, Staphylococcus aureus subsp. aureus Mu50
cuaauguguacuuaaaaaua

SEQ ID NO: 2066651 - RNA, 21 nt, Staphylococcus aureus subsp. aureus Mu50
cuaauguguacuuaaaaauag

SEQ ID NO: 2066652 - RNA, 15 nt, Staphylococcus aureus subsp. aureus Mu50
cuacacggucccaag

SEQ ID NO: 2066653 - RNA, 19 nt, Staphylococcus aureus subsp. aureus Mu50
cuacacgaguauuaucaca

SEQ ID NO: 2066654 - RNA, 12 nt, Staphylococcus aureus subsp. aureus Mu50
cuacacccauuu

SEQ ID NO: 2066655 - RNA, 23 nt, Staphylococcus aureus subsp. aureus Mu50
cuacaacuucuucuccguauuua

SEQ ID NO: 2066656 - RNA, 23 nt, Staphylococcus aureus subsp. aureus Mu50
cuacaacgaagaauccuaugcca

SEQ ID NO: 2066657 - RNA, 22 nt, Staphylococcus aureus subsp. aureus Mu50
cuacaaucauaccggcaaauaa

SEQ ID NO: 2066658 - RNA, 19 nt, Staphylococcus aureus subsp. aureus Mu50
cuacaauauuaaaauuaaa

SEQ ID NO: 2066659 - RNA, 23 nt, Staphylococcus aureus subsp. aureus Mu50
cuaauuuugugaauuuauuuugu

SEQ ID NO: 2066660 - RNA, 13 nt, Staphylococcus aureus subsp. aureus Mu50
cuaauuuuuucau

SEQ ID NO: 2066661 - RNA, 18 nt, Staphylococcus aureus subsp. aureus Mu50
cuaauuucuauagaaaaa

SEQ ID NO: 2066662 - RNA, 18 nt, Staphylococcus aureus subsp. aureus Mu50
cuaauuuuaauuuucaga

SEQ ID NO: 2066663 - RNA, 18 nt, Staphylococcus aureus subsp. aureus Mu50
cuaauuuacguacuucau

SEQ ID NO: 2066664 - RNA, 19 nt, Staphylococcus aureus subsp. aureus Mu50
cuaauucgccaucuuuuuu

SEQ ID NO: 2066665 - RNA, 16 nt, Staphylococcus aureus subsp. aureus Mu50
cuaauugagagaaguu

SEQ ID NO: 2066666 - RNA, 14 nt, Staphylococcus aureus subsp. aureus Mu50
cuaccaauaauucc

SEQ ID NO: 2066667 - RNA, 14 nt, Staphylococcus aureus subsp. aureus Mu50
cuacacuguuuuau

SEQ ID NO: 2066668 - RNA, 19 nt, Staphylococcus aureus subsp. aureus Mu50
cuacacuguuuuauaaaug

SEQ ID NO: 2066669 - RNA, 22 nt, Staphylococcus aureus subsp. aureus Mu50
cuacacuuggcuuaggaugaaa

SEQ ID NO: 2066670 - RNA, 23 nt, Staphylococcus aureus subsp. aureus Mu50
cuacagaauggauaccuaaagcu

SEQ ID NO: 2066671 - RNA, 17 nt, Staphylococcus aureus subsp. aureus Mu50
cuacagauaaagcuucg

SEQ ID NO: 2066672 - RNA, 18 nt, Staphylococcus aureus subsp. aureus Mu50
cuacagauuuuaaaaauu

SEQ ID NO: 2066673 - RNA, 20 nt, Staphylococcus aureus subsp. aureus Mu50
cuacagauuuuaaaaauuca

SEQ ID NO: 2066674 - RNA, 17 nt, Staphylococcus aureus subsp. aureus Mu50
cuacagguaaugcaagu

SEQ ID NO: 2066675 - RNA, 19 nt, Staphylococcus aureus subsp. aureus Mu50
cuacauaauuuaucaauuu

SEQ ID NO: 2066676 - RNA, 15 nt, Staphylococcus aureus subsp. aureus Mu50
cuacauauuggcuug

SEQ ID NO: 2066677 - RNA, 15 nt, Staphylococcus aureus subsp. aureus Mu50
cucauacaaauuuuu

SEQ ID NO: 2066678 - RNA, 14 nt, Staphylococcus aureus subsp. aureus Mu50
cucauaauuaucau

SEQ ID NO: 2066679 - RNA, 19 nt, Staphylococcus aureus subsp. aureus Mu50
cucauaauuaucauauaaa

SEQ ID NO: 2066680 - RNA, 10 nt, Staphylococcus aureus subsp. aureus Mu50
cucauaauaa

SEQ ID NO: 2066681 - RNA, 13 nt, Staphylococcus aureus subsp. aureus Mu50
cucagugcauuuu

SEQ ID NO: 2066682 - RNA, 15 nt, Staphylococcus aureus subsp. aureus Mu50
cucagugcauuuuuu

SEQ ID NO: 2066683 - RNA, 18 nt, Staphylococcus aureus subsp. aureus Mu50
cucauaaccgcuucuuuu

SEQ ID NO: 2066684 - RNA, 18 nt, Staphylococcus aureus subsp. aureus Mu50
cucaugagcacaaacuaa

SEQ ID NO: 2066685 - RNA, 12 nt, Staphylococcus aureus subsp. aureus Mu50
cucaucuucuaa

SEQ ID NO: 2066686 - RNA, 16 nt, Staphylococcus aureus subsp. aureus Mu50
cucauaucuauuuuuc

SEQ ID NO: 2066687 - RNA, 18 nt, Staphylococcus aureus subsp. aureus Mu50
cucauaccaaaaacauua

SEQ ID NO: 2066688 - RNA, 17 nt, Staphylococcus aureus subsp. aureus Mu50
cucauuuagcucuacua

SEQ ID NO: 2066689 - RNA, 20 nt, Staphylococcus aureus subsp. aureus Mu50
cuccaagauuaugacaacau

SEQ ID NO: 2066690 - RNA, 22 nt, Staphylococcus aureus subsp. aureus Mu50
cuccaagauuaugacaacauaa

SEQ ID NO: 2066691 - RNA, 15 nt, Staphylococcus aureus subsp. aureus Mu50
cuccaaucaucauua

SEQ ID NO: 2066692 - RNA, 20 nt, Staphylococcus aureus subsp. aureus Mu50
cucaacgggaacaucauaau

SEQ ID NO: 2066693 - RNA, 18 nt, Staphylococcus aureus subsp. aureus Mu50
cucaacgggaacaucaua

SEQ ID NO: 2066694 - RNA, 17 nt, Staphylococcus aureus subsp. aureus Mu50
cucaacuugccuggcaa

SEQ ID NO: 2066695 - RNA, 15 nt, Staphylococcus aureus subsp. aureus Mu50
cucaacuuaaauauc

SEQ ID NO: 2066696 - RNA, 23 nt, Staphylococcus aureus subsp. aureus Mu50
cuauugauauucuaaaaaauuaa

SEQ ID NO: 2066697 - RNA, 16 nt, Staphylococcus aureus subsp. aureus Mu50
cucaaaaagccaacac

SEQ ID NO: 2066698 - RNA, 19 nt, Staphylococcus aureus subsp. aureus Mu50
cuauugugauauaugaaau

SEQ ID NO: 2066699 - RNA, 15 nt, Staphylococcus aureus subsp. aureus Mu50
cucaaaacaauuuaa

SEQ ID NO: 2066700 - RNA, 17 nt, Staphylococcus aureus subsp. aureus Mu50
cuauagguuuauaaaaa

SEQ ID NO: 2066701 - RNA, 14 nt, Staphylococcus aureus subsp. aureus Mu50
cuauaguaagaaaa

SEQ ID NO: 2066702 - RNA, 17 nt, Staphylococcus aureus subsp. aureus Mu50
cuauauugugcuaaguu

SEQ ID NO: 2066703 - RNA, 16 nt, Staphylococcus aureus subsp. aureus Mu50
cuauagucauucauaa

SEQ ID NO: 2066704 - RNA, 19 nt, Staphylococcus aureus subsp. aureus Mu50
cuauagauaggauauuuuu

SEQ ID NO: 2066705 - RNA, 21 nt, Staphylococcus aureus subsp. aureus Mu50
cuauagauaggauauuuuuua

SEQ ID NO: 2066706 - RNA, 14 nt, Staphylococcus aureus subsp. aureus Mu50
cuaguuuaucuuca

SEQ ID NO: 2066707 - RNA, 12 nt, Staphylococcus aureus subsp. aureus Mu50
cuaguuguuuua

SEQ ID NO: 2066708 - RNA, 21 nt, Staphylococcus aureus subsp. aureus Mu50
cuaguuuaacaauacuacuua

SEQ ID NO: 2066709 - RNA, 16 nt, Staphylococcus aureus subsp. aureus Mu50
cuaguuuguaauaauu

SEQ ID NO: 2066710 - RNA, 12 nt, Staphylococcus aureus subsp. aureus Mu50
cuaguucaacuc

SEQ ID NO: 2066711 - RNA, 14 nt, Staphylococcus aureus subsp. aureus Mu50
cuaguucagcuucu

SEQ ID NO: 2066712 - RNA, 12 nt, Staphylococcus aureus subsp. aureus Mu50
cuaucaaauaau

SEQ ID NO: 2066713 - RNA, 17 nt, Staphylococcus aureus subsp. aureus Mu50
cuauauuuuuuuacuuu

SEQ ID NO: 2066714 - RNA, 18 nt, Staphylococcus aureus subsp. aureus Mu50
cuaucaauauaauuuggu

SEQ ID NO: 2066715 - RNA, 13 nt, Staphylococcus aureus subsp. aureus Mu50
cuaucaauauaau

SEQ ID NO: 2066716 - RNA, 17 nt, Staphylococcus aureus subsp. aureus Mu50
cuaucccuguaaaacca

SEQ ID NO: 2066717 - RNA, 11 nt, Staphylococcus aureus subsp. aureus Mu50
cuauucaacug

SEQ ID NO: 2066718 - RNA, 22 nt, Staphylococcus aureus subsp. aureus Mu50
cuauuauuauguuauaaauucu

SEQ ID NO: 2066719 - RNA, 12 nt, Staphylococcus aureus subsp. aureus Mu50
cuauuaaauaau

SEQ ID NO: 2066720 - RNA, 12 nt, Staphylococcus aureus subsp. aureus Mu50
cuauguggcuac

SEQ ID NO: 2066721 - RNA, 20 nt, Staphylococcus aureus subsp. aureus Mu50
cuauuccuauuacuacauaa

SEQ ID NO: 2066722 - RNA, 22 nt, Staphylococcus aureus subsp. aureus Mu50
cuauucccaaaaugauugccac

SEQ ID NO: 2066723 - RNA, 16 nt, Staphylococcus aureus subsp. aureus Mu50
cuaugcauaauaccaa

SEQ ID NO: 2066724 - RNA, 21 nt, Staphylococcus aureus subsp. aureus Mu50
cuaucguuuauugauagucac

SEQ ID NO: 2066725 - RNA, 16 nt, Staphylococcus aureus subsp. aureus Mu50
cuaucuauaaacguca

SEQ ID NO: 2066726 - RNA, 17 nt, Staphylococcus aureus subsp. aureus Mu50
cuaggaaauaaaaaaua

SEQ ID NO: 2066727 - RNA, 12 nt, Staphylococcus aureus subsp. aureus Mu50
cuagcaaaugca

SEQ ID NO: 2066728 - RNA, 17 nt, Staphylococcus aureus subsp. aureus Mu50
cuagcaaaaauacuuuu

SEQ ID NO: 2066729 - RNA, 11 nt, Staphylococcus aureus subsp. aureus Mu50
cuagcaaaaau

SEQ ID NO: 2066730 - RNA, 16 nt, Staphylococcus aureus subsp. aureus Mu50
cuagauuuuaaaucaa

SEQ ID NO: 2066731 - RNA, 18 nt, Staphylococcus aureus subsp. aureus Mu50
cuaguagcuagaacagau

SEQ ID NO: 2066732 - RNA, 18 nt, Staphylococcus aureus subsp. aureus Mu50
cuagucaggggccccaac

SEQ ID NO: 2066733 - RNA, 23 nt, Staphylococcus aureus subsp. aureus Mu50
cuagucaggggccccaacacaga

SEQ ID NO: 2066734 - RNA, 18 nt, Staphylococcus aureus subsp. aureus Mu50
cuagugcgcgauaaauaa

SEQ ID NO: 2066735 - RNA, 18 nt, Staphylococcus aureus subsp. aureus Mu50
cuaguguucucauuauaa

SEQ ID NO: 2066736 - RNA, 16 nt, Staphylococcus aureus subsp. aureus Mu50
cuaguaauucuucauc

SEQ ID NO: 2066737 - RNA, 15 nt, Staphylococcus aureus subsp. aureus Mu50
cuacuuuuucaucuu

SEQ ID NO: 2066738 - RNA, 17 nt, Staphylococcus aureus subsp. aureus Mu50
cuagaauauaacaacua

SEQ ID NO: 2066739 - RNA, 19 nt, Staphylococcus aureus subsp. aureus Mu50
cuagaaaacauaaauacaa

SEQ ID NO: 2066740 - RNA, 22 nt, Staphylococcus aureus subsp. aureus Mu50
cuagaaaacauaaauacaaaaa

SEQ ID NO: 2066741 - RNA, 15 nt, Staphylococcus aureus subsp. aureus Mu50
cuacuuugucugcaa

SEQ ID NO: 2066742 - RNA, 21 nt, Staphylococcus aureus subsp. aureus Mu50
cuacuuugauauguuuccucu

SEQ ID NO: 2066743 - RNA, 23 nt, Staphylococcus aureus subsp. aureus Mu50
cuacugcaccgauaucauauaau

SEQ ID NO: 2066744 - RNA, 14 nt, Staphylococcus aureus subsp. aureus Mu50
cuacugucucaucu

SEQ ID NO: 2066745 - RNA, 20 nt, Staphylococcus aureus subsp. aureus Mu50
cuacuuaauuaauaauuuaa

SEQ ID NO: 2066746 - RNA, 14 nt, Staphylococcus aureus subsp. aureus Mu50
cuacccuauuuuac

SEQ ID NO: 2066747 - RNA, 22 nt, Staphylococcus aureus subsp. aureus Mu50
cuaccgauuguuaauuuaaagu

SEQ ID NO: 2066748 - RNA, 18 nt, Staphylococcus aureus subsp. aureus Mu50
cuacccuugcaaauauau

SEQ ID NO: 2066749 - RNA, 13 nt, Staphylococcus aureus subsp. aureus Mu50
cuacccuauuuua

SEQ ID NO: 2066750 - RNA, 18 nt, Staphylococcus aureus subsp. aureus Mu50
cucuuuuuguuuaucuga

SEQ ID NO: 2066751 - RNA, 18 nt, Staphylococcus aureus subsp. aureus Mu50
cugaaaagaauaaguugu

SEQ ID NO: 2066752 - RNA, 15 nt, Staphylococcus aureus subsp. aureus Mu50
cugaaaaacuucuua

SEQ ID NO: 2066753 - RNA, 13 nt, Staphylococcus aureus subsp. aureus Mu50
cugaaaaacuucu

SEQ ID NO: 2066754 - RNA, 21 nt, Staphylococcus aureus subsp. aureus Mu50
cucuuuguuggggcccacacc

SEQ ID NO: 2066755 - RNA, 15 nt, Staphylococcus aureus subsp. aureus Mu50
cugaaacaaauuagu

SEQ ID NO: 2066756 - RNA, 16 nt, Staphylococcus aureus subsp. aureus Mu50
cugaaaaucaucauua

SEQ ID NO: 2066757 - RNA, 20 nt, Staphylococcus aureus subsp. aureus Mu50
cugaaacgccucaacacuuu

SEQ ID NO: 2066758 - RNA, 15 nt, Staphylococcus aureus subsp. aureus Mu50
cugaaacuaaauuaa

SEQ ID NO: 2066759 - RNA, 21 nt, Staphylococcus aureus subsp. aureus Mu50
cugaaacuaaauuaaaagugu

SEQ ID NO: 2066760 - RNA, 19 nt, Staphylococcus aureus subsp. aureus Mu50
cugaaauuucauaaaguuu

SEQ ID NO: 2066761 - RNA, 20 nt, Staphylococcus aureus subsp. aureus Mu50
cugaaauuuuuuagugaaaa

SEQ ID NO: 2066762 - RNA, 14 nt, Staphylococcus aureus subsp. aureus Mu50
cugaaauuuuuccg

SEQ ID NO: 2066763 - RNA, 19 nt, Staphylococcus aureus subsp. aureus Mu50
cucuucuuaucuuuuuacu

SEQ ID NO: 2066764 - RNA, 15 nt, Staphylococcus aureus subsp. aureus Mu50
cucuugauaaaauaa

SEQ ID NO: 2066765 - RNA, 20 nt, Staphylococcus aureus subsp. aureus Mu50
cucuuuaaagcuaaauguua

SEQ ID NO: 2066766 - RNA, 17 nt, Staphylococcus aureus subsp. aureus Mu50
cucuuuacaccauugca

SEQ ID NO: 2066767 - RNA, 16 nt, Staphylococcus aureus subsp. aureus Mu50
cucuucaaucuaccaa

SEQ ID NO: 2066768 - RNA, 21 nt, Staphylococcus aureus subsp. aureus Mu50
cucuucaaaguagauauugaa

SEQ ID NO: 2066769 - RNA, 12 nt, Staphylococcus aureus subsp. aureus Mu50
cucuuauuaaaa

SEQ ID NO: 2066770 - RNA, 14 nt, Staphylococcus aureus subsp. aureus Mu50
cucuuauuaaaaaa

SEQ ID NO: 2066771 - RNA, 21 nt, Staphylococcus aureus subsp. aureus Mu50
cucuuauaaagacaccuucaa

SEQ ID NO: 2066772 - RNA, 14 nt, Staphylococcus aureus subsp. aureus Mu50
cucuuaaauaugaa

SEQ ID NO: 2066773 - RNA, 23 nt, Staphylococcus aureus subsp. aureus Mu50
cucuuaaaucacuagcuaaugca

SEQ ID NO: 2066774 - RNA, 18 nt, Staphylococcus aureus subsp. aureus Mu50
cugagauugagaauucag

SEQ ID NO: 2066775 - RNA, 13 nt, Staphylococcus aureus subsp. aureus Mu50
cugagauugagaa

SEQ ID NO: 2066776 - RNA, 12 nt, Staphylococcus aureus subsp. aureus Mu50
cugacuuuccac

SEQ ID NO: 2066777 - RNA, 18 nt, Staphylococcus aureus subsp. aureus Mu50
cugacuuuccaccagccu

SEQ ID NO: 2066778 - RNA, 18 nt, Staphylococcus aureus subsp. aureus Mu50
cugaccuaacaauuugag

SEQ ID NO: 2066779 - RNA, 12 nt, Staphylococcus aureus subsp. aureus Mu50
cugacuaauaaa

SEQ ID NO: 2066780 - RNA, 23 nt, Staphylococcus aureus subsp. aureus Mu50
cugaaguuaucggcuaaaguuau

SEQ ID NO: 2066781 - RNA, 14 nt, Staphylococcus aureus subsp. aureus Mu50
cugaauaaaauaua

SEQ ID NO: 2066782 - RNA, 17 nt, Staphylococcus aureus subsp. aureus Mu50
cugaaugcuaauacuaa

SEQ ID NO: 2066783 - RNA, 23 nt, Staphylococcus aureus subsp. aureus Mu50
cugaauguucgaagauuuuuuuc

SEQ ID NO: 2066784 - RNA, 18 nt, Staphylococcus aureus subsp. aureus Mu50
cugaauuaauauccaaaa

SEQ ID NO: 2066785 - RNA, 17 nt, Staphylococcus aureus subsp. aureus Mu50
cugaauuagauuuuguu

SEQ ID NO: 2066786 - RNA, 21 nt, Staphylococcus aureus subsp. aureus Mu50
cugacauuguugcuaaucuca

SEQ ID NO: 2066787 - RNA, 17 nt, Staphylococcus aureus subsp. aureus Mu50
cugacauuuuuggcuua

SEQ ID NO: 2066788 - RNA, 18 nt, Staphylococcus aureus subsp. aureus Mu50
cugacauuucaucaauaa

SEQ ID NO: 2066789 - RNA, 14 nt, Staphylococcus aureus subsp. aureus Mu50
cucucuuauuaaaa

SEQ ID NO: 2066790 - RNA, 17 nt, Staphylococcus aureus subsp. aureus Mu50
cucugauauugaucuga

SEQ ID NO: 2066791 - RNA, 14 nt, Staphylococcus aureus subsp. aureus Mu50
cucugauauugauc

SEQ ID NO: 2066792 - RNA, 19 nt, Staphylococcus aureus subsp. aureus Mu50
cucugaaaagccuacuuug

SEQ ID NO: 2066793 - RNA, 15 nt, Staphylococcus aureus subsp. aureus Mu50
cucugaaaaacuucu

SEQ ID NO: 2066794 - RNA, 19 nt, Staphylococcus aureus subsp. aureus Mu50
cucugauacuucaccaucu

SEQ ID NO: 2066795 - RNA, 15 nt, Staphylococcus aureus subsp. aureus Mu50
cucuggaacuuuaau

SEQ ID NO: 2066796 - RNA, 15 nt, Staphylococcus aureus subsp. aureus Mu50
cucuggauuuuucuu

SEQ ID NO: 2066797 - RNA, 20 nt, Staphylococcus aureus subsp. aureus Mu50
cucuaaugauuaaaaaucaa

SEQ ID NO: 2066798 - RNA, 18 nt, Staphylococcus aureus subsp. aureus Mu50
cucuaacguuaacaauau

SEQ ID NO: 2066799 - RNA, 18 nt, Staphylococcus aureus subsp. aureus Mu50
cucuaacuuuaccaauau

SEQ ID NO: 2066800 - RNA, 14 nt, Staphylococcus aureus subsp. aureus Mu50
cucgaccuuuauau

SEQ ID NO: 2066801 - RNA, 15 nt, Staphylococcus aureus subsp. aureus Mu50
cucgaagucagcgau

SEQ ID NO: 2066802 - RNA, 20 nt, Staphylococcus aureus subsp. aureus Mu50
cuccucuuuuauuuaugagu

SEQ ID NO: 2066803 - RNA, 23 nt, Staphylococcus aureus subsp. aureus Mu50
cuccucuauuuuaugauuugauu

SEQ ID NO: 2066804 - RNA, 15 nt, Staphylococcus aureus subsp. aureus Mu50
cuccguugaauucaa

SEQ ID NO: 2066805 - RNA, 15 nt, Staphylococcus aureus subsp. aureus Mu50
cuccgaucaugccuu

SEQ ID NO: 2066806 - RNA, 14 nt, Staphylococcus aureus subsp. aureus Mu50
cuccgaucaugccu

SEQ ID NO: 2066807 - RNA, 21 nt, Staphylococcus aureus subsp. aureus Mu50
cuguguaaauauaaauaugaa

SEQ ID NO: 2066808 - RNA, 14 nt, Staphylococcus aureus subsp. aureus Mu50
cugugugcuguucu

SEQ ID NO: 2066809 - RNA, 15 nt, Staphylococcus aureus subsp. aureus Mu50
cugugucagcauuca

SEQ ID NO: 2066810 - RNA, 15 nt, Staphylococcus aureus subsp. aureus Mu50
cuguuccaaauucau

SEQ ID NO: 2066811 - RNA, 16 nt, Staphylococcus aureus subsp. aureus Mu50
cuguuauugcaauaaa

SEQ ID NO: 2066812 - RNA, 22 nt, Staphylococcus aureus subsp. aureus Mu50
cuguuaaacgcugauuuuauaa

SEQ ID NO: 2066813 - RNA, 14 nt, Staphylococcus aureus subsp. aureus Mu50
cuguuaaacucaua

SEQ ID NO: 2066814 - RNA, 22 nt, Staphylococcus aureus subsp. aureus Mu50
cuguguuggggcccacacccca

SEQ ID NO: 2066815 - RNA, 16 nt, Staphylococcus aureus subsp. aureus Mu50
cuguuaauaaaucauu

SEQ ID NO: 2066816 - RNA, 22 nt, Staphylococcus aureus subsp. aureus Mu50
cuguuaaacucauacaaauuuu

SEQ ID NO: 2066817 - RNA, 15 nt, Staphylococcus aureus subsp. aureus Mu50
cuguuaauguuccaa

SEQ ID NO: 2066818 - RNA, 16 nt, Staphylococcus aureus subsp. aureus Mu50
cuguuacacuuuucuu

SEQ ID NO: 2066819 - RNA, 16 nt, Staphylococcus aureus subsp. aureus Mu50
cugugauauuaauuga
